United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 11

SEQ ID NO: 423243 - DNA, 17 bp, Homo sapiens
agcacatttcctctcta

SEQ ID NO: 423244 - DNA, 16 bp, Homo sapiens
agcaccagcctgagcc

SEQ ID NO: 423245 - DNA, 21 bp, Homo sapiens
agcaccagcctgagccacagt

SEQ ID NO: 423246 - DNA, 21 bp, Homo sapiens
agcaccaggtgttaaaaacca

SEQ ID NO: 423247 - DNA, 13 bp, Homo sapiens
agcacccccaccc

SEQ ID NO: 423248 - DNA, 11 bp, Homo sapiens
agcacccccag

SEQ ID NO: 423249 - DNA, 12 bp, Homo sapiens
agcacccccagc

SEQ ID NO: 423250 - DNA, 15 bp, Homo sapiens
agcacccccagcctc

SEQ ID NO: 423251 - DNA, 16 bp, Homo sapiens
agcacccccagcctcc

SEQ ID NO: 423252 - DNA, 12 bp, Homo sapiens
agcaccctctcc

SEQ ID NO: 423253 - DNA, 17 bp, Homo sapiens
agcaccgtggtgtgagg

SEQ ID NO: 423254 - DNA, 20 bp, Homo sapiens
agcaccgtggtgtgaggccc

SEQ ID NO: 423255 - DNA, 15 bp, Homo sapiens
agcacctgaacccca

SEQ ID NO: 423256 - DNA, 18 bp, Homo sapiens
agcacctgccctctgttt

SEQ ID NO: 423257 - DNA, 14 bp, Homo sapiens
agcacctgggctga

SEQ ID NO: 423258 - DNA, 19 bp, Homo sapiens
agcacctgggctgaggagg

SEQ ID NO: 423259 - DNA, 14 bp, Homo sapiens
agcaccttgaatgg

SEQ ID NO: 423260 - DNA, 16 bp, Homo sapiens
agcaccttgaatggaa

SEQ ID NO: 423261 - DNA, 22 bp, Homo sapiens
agcaccttgttcttagagcaga

SEQ ID NO: 423262 - DNA, 16 bp, Homo sapiens
agcactacataaactg

SEQ ID NO: 423263 - DNA, 22 bp, Homo sapiens
agcactacttacttagagatgc

SEQ ID NO: 423264 - DNA, 13 bp, Homo sapiens
agcactattgttt

SEQ ID NO: 423265 - DNA, 13 bp, Homo sapiens
agcactcacatgc

SEQ ID NO: 423266 - DNA, 16 bp, Homo sapiens
agcactcccagggccc

SEQ ID NO: 423267 - DNA, 13 bp, Homo sapiens
agcactctgctgg

SEQ ID NO: 423268 - DNA, 18 bp, Homo sapiens
agcactgatttcacaaca

SEQ ID NO: 423269 - DNA, 16 bp, Homo sapiens
agcactggagtgcagg

SEQ ID NO: 423270 - DNA, 23 bp, Homo sapiens
agcactggccagagagggcccag

SEQ ID NO: 423271 - DNA, 19 bp, Homo sapiens
agcactggctctctccagg

SEQ ID NO: 423272 - DNA, 15 bp, Homo sapiens
agcactgggaagctg

SEQ ID NO: 423273 - DNA, 19 bp, Homo sapiens
agcactgggaagctggagt

SEQ ID NO: 423274 - DNA, 12 bp, Homo sapiens
agcactgtccct

SEQ ID NO: 423275 - DNA, 13 bp, Homo sapiens
agcactgtccctt

SEQ ID NO: 423276 - DNA, 15 bp, Homo sapiens
agcactgtcccttgc

SEQ ID NO: 423277 - DNA, 22 bp, Homo sapiens
agcactgtcccttgcctcaatg

SEQ ID NO: 423278 - DNA, 14 bp, Homo sapiens
agcactgtctcagt

SEQ ID NO: 423279 - DNA, 23 bp, Homo sapiens
agcactgtgtaaccagcagtcac

SEQ ID NO: 423280 - DNA, 12 bp, Homo sapiens
agcacttccaaa

SEQ ID NO: 423281 - DNA, 19 bp, Homo sapiens
agcacttccaaaattctta

SEQ ID NO: 423282 - DNA, 15 bp, Homo sapiens
agcacttcttttcca

SEQ ID NO: 423283 - DNA, 21 bp, Homo sapiens
agcacttcttttccaaaaata

SEQ ID NO: 423284 - DNA, 17 bp, Homo sapiens
agcacttgcgtcctgca

SEQ ID NO: 423285 - DNA, 17 bp, Homo sapiens
agcactttataagccaa

SEQ ID NO: 423286 - DNA, 21 bp, Homo sapiens
agcactttgaaaatatttcta

SEQ ID NO: 423287 - DNA, 12 bp, Homo sapiens
agcactttggga

SEQ ID NO: 423288 - DNA, 18 bp, Homo sapiens
agcactttgggaggccaa

SEQ ID NO: 423289 - DNA, 20 bp, Homo sapiens
agcagaaacccccaggagga

SEQ ID NO: 423290 - DNA, 22 bp, Homo sapiens
agcagaacaagtgcctcctgga

SEQ ID NO: 423291 - DNA, 16 bp, Homo sapiens
agcagacgcagcagct

SEQ ID NO: 423292 - DNA, 19 bp, Homo sapiens
agcagactggtgagcagac

SEQ ID NO: 423293 - DNA, 16 bp, Homo sapiens
agcagagaaggccagg

SEQ ID NO: 423294 - DNA, 17 bp, Homo sapiens
agcagagacggcagccc

SEQ ID NO: 423295 - DNA, 17 bp, Homo sapiens
agcagagcaaatgaggg

SEQ ID NO: 423296 - DNA, 18 bp, Homo sapiens
agcagagcaaatgaggga

SEQ ID NO: 423297 - DNA, 22 bp, Homo sapiens
agcagagccgccccgtgtcccc

SEQ ID NO: 423298 - DNA, 16 bp, Homo sapiens
agcagagttctttgca

SEQ ID NO: 423299 - DNA, 18 bp, Homo sapiens
agcagattctagcacatc

SEQ ID NO: 423300 - DNA, 16 bp, Homo sapiens
agcagcaacacaatgt

SEQ ID NO: 423301 - DNA, 20 bp, Homo sapiens
agcagcacaattctgtccct

SEQ ID NO: 423302 - DNA, 21 bp, Homo sapiens
agcagcacaattctgtccctg

SEQ ID NO: 423303 - DNA, 22 bp, Homo sapiens
agcagcacgtcgccatccgtca

SEQ ID NO: 423304 - DNA, 18 bp, Homo sapiens
agcagcacttataaatca

SEQ ID NO: 423305 - DNA, 18 bp, Homo sapiens
agcagcatctgctaataa

SEQ ID NO: 423306 - DNA, 11 bp, Homo sapiens
agcagccagcc

SEQ ID NO: 423307 - DNA, 21 bp, Homo sapiens
agcagccagccagtcttgcct

SEQ ID NO: 423308 - DNA, 13 bp, Homo sapiens
agcagcccaagct

SEQ ID NO: 423309 - DNA, 18 bp, Homo sapiens
agcagccgtttctccttg

SEQ ID NO: 423310 - DNA, 15 bp, Homo sapiens
agcagcctccaagaa

SEQ ID NO: 423311 - DNA, 24 bp, Homo sapiens
agcagcctccctgtcactcagctg

SEQ ID NO: 423312 - DNA, 12 bp, Homo sapiens
agcagcctctga

SEQ ID NO: 423313 - DNA, 14 bp, Homo sapiens
agcagcctctgtcc

SEQ ID NO: 423314 - DNA, 13 bp, Homo sapiens
agcagcctgatgg

SEQ ID NO: 423315 - DNA, 14 bp, Homo sapiens
agcagcctgatggc

SEQ ID NO: 423316 - DNA, 20 bp, Homo sapiens
agcagcctgtgagggagtgc

SEQ ID NO: 423317 - DNA, 15 bp, Homo sapiens
agcagcctttctgtg

SEQ ID NO: 423318 - DNA, 15 bp, Homo sapiens
agcagcggcccagat

SEQ ID NO: 423319 - DNA, 17 bp, Homo sapiens
agcagcggcccagattg

SEQ ID NO: 423320 - DNA, 14 bp, Homo sapiens
agcagctaggactg

SEQ ID NO: 423321 - DNA, 22 bp, Homo sapiens
agcagctaggactgaggagtgg

SEQ ID NO: 423322 - DNA, 12 bp, Homo sapiens
agcagctcaggc

SEQ ID NO: 423323 - DNA, 15 bp, Homo sapiens
agcagctcaggcgca

SEQ ID NO: 423324 - DNA, 21 bp, Homo sapiens
agcagctcaggcgcagcccta

SEQ ID NO: 423325 - DNA, 16 bp, Homo sapiens
agcagctccgcctggc

SEQ ID NO: 423326 - DNA, 19 bp, Homo sapiens
agcagctccgcctggcacc

SEQ ID NO: 423327 - DNA, 15 bp, Homo sapiens
agcagctgggcactg

SEQ ID NO: 423328 - DNA, 15 bp, Homo sapiens
agcagcttggctgag

SEQ ID NO: 423329 - DNA, 17 bp, Homo sapiens
agcagcttggctgagcc

SEQ ID NO: 423330 - DNA, 18 bp, Homo sapiens
agcagcttggctgagccc

SEQ ID NO: 423331 - DNA, 21 bp, Homo sapiens
agcagcttggctgagccccct

SEQ ID NO: 423332 - DNA, 22 bp, Homo sapiens
agcagcttggctgagccccctc

SEQ ID NO: 423333 - DNA, 21 bp, Homo sapiens
agcaggaagcaaggccagccc

SEQ ID NO: 423334 - DNA, 21 bp, Homo sapiens
agcaggacctactaggagagg

SEQ ID NO: 423335 - DNA, 21 bp, Homo sapiens
agcaggagactggcaagagct

SEQ ID NO: 423336 - DNA, 16 bp, Homo sapiens
agcaggaggcccctgg

SEQ ID NO: 423337 - DNA, 20 bp, Homo sapiens
agcaggaggcccctggccca

SEQ ID NO: 423338 - DNA, 23 bp, Homo sapiens
agcaggaggcccctggcccagcg

SEQ ID NO: 423339 - DNA, 21 bp, Homo sapiens
agcaggatagttgctccgcct

SEQ ID NO: 423340 - DNA, 15 bp, Homo sapiens
agcaggatgtgcctg

SEQ ID NO: 423341 - DNA, 17 bp, Homo sapiens
agcaggcaaaaaaggga

SEQ ID NO: 423342 - DNA, 20 bp, Homo sapiens
agcaggcaaaaaagggacag

SEQ ID NO: 423343 - DNA, 13 bp, Homo sapiens
agcaggcagagga

SEQ ID NO: 423344 - DNA, 13 bp, Homo sapiens
agcaggcccagct

SEQ ID NO: 423345 - DNA, 21 bp, Homo sapiens
agcaggccttttgatattaaa

SEQ ID NO: 423346 - DNA, 20 bp, Homo sapiens
agcaggctggcagctctcca

SEQ ID NO: 423347 - DNA, 16 bp, Homo sapiens
agcagggaaagctcca

SEQ ID NO: 423348 - DNA, 19 bp, Homo sapiens
agcagggattaacctctgc

SEQ ID NO: 423349 - DNA, 20 bp, Homo sapiens
agcagggattaacctctgca

SEQ ID NO: 423350 - DNA, 16 bp, Homo sapiens
agcaggggcagaagga

SEQ ID NO: 423351 - DNA, 12 bp, Homo sapiens
agcaggtctgca

SEQ ID NO: 423352 - DNA, 16 bp, Homo sapiens
agcaggtctgcaggcc

SEQ ID NO: 423353 - DNA, 19 bp, Homo sapiens
agcaggtctgcaggccacc

SEQ ID NO: 423354 - DNA, 18 bp, Homo sapiens
agcaggtgtggtggctca

SEQ ID NO: 423355 - DNA, 19 bp, Homo sapiens
agcaggttctctcctgtga

SEQ ID NO: 423356 - DNA, 22 bp, Homo sapiens
agcaggtttcactattcctatg

SEQ ID NO: 423357 - DNA, 17 bp, Homo sapiens
agcagtaccagcgctct

SEQ ID NO: 423358 - DNA, 15 bp, Homo sapiens
agcagtaccatccca

SEQ ID NO: 423359 - DNA, 16 bp, Homo sapiens
agcagtaccatcccac

SEQ ID NO: 423360 - DNA, 19 bp, Homo sapiens
agcagtacttgctcaataa

SEQ ID NO: 423361 - DNA, 15 bp, Homo sapiens
agcagtatgaatgat

SEQ ID NO: 423362 - DNA, 14 bp, Homo sapiens
agcagtcatcatct

SEQ ID NO: 423363 - DNA, 21 bp, Homo sapiens
agcagtcccagtattctcaga

SEQ ID NO: 423364 - DNA, 20 bp, Homo sapiens
agcagtgaaacttgtgctat

SEQ ID NO: 423365 - DNA, 15 bp, Homo sapiens
agcagtgattctctc

SEQ ID NO: 423366 - DNA, 13 bp, Homo sapiens
agcagtgcatgct

SEQ ID NO: 423367 - DNA, 17 bp, Homo sapiens
agcagtgcatgctgtcc

SEQ ID NO: 423368 - DNA, 16 bp, Homo sapiens
agcagtgcctcgaggc

SEQ ID NO: 423369 - DNA, 12 bp, Homo sapiens
agcagtgctggg

SEQ ID NO: 423370 - DNA, 15 bp, Homo sapiens
agcagtgctgggccc

SEQ ID NO: 423371 - DNA, 16 bp, Homo sapiens
agcagtgctgggccca

SEQ ID NO: 423372 - DNA, 17 bp, Homo sapiens
agcagtgctgggcccag

SEQ ID NO: 423373 - DNA, 18 bp, Homo sapiens
agcagtgctgggcccagc

SEQ ID NO: 423374 - DNA, 16 bp, Homo sapiens
agcagtgcttgtaaac

SEQ ID NO: 423375 - DNA, 12 bp, Homo sapiens
agcagtggctgg

SEQ ID NO: 423376 - DNA, 13 bp, Homo sapiens
agcagtggctggt

SEQ ID NO: 423377 - DNA, 21 bp, Homo sapiens
agcagtggctggtccagggct

SEQ ID NO: 423378 - DNA, 23 bp, Homo sapiens
agcagtgtcgccgtccctctgcc

SEQ ID NO: 423379 - DNA, 21 bp, Homo sapiens
agcagtgtgtctcctgcatgc

SEQ ID NO: 423380 - DNA, 12 bp, Homo sapiens
agcagtgttttc

SEQ ID NO: 423381 - DNA, 19 bp, Homo sapiens
agcagttaccgaggagcta

SEQ ID NO: 423382 - DNA, 17 bp, Homo sapiens
agcagttcacttcctag

SEQ ID NO: 423383 - DNA, 22 bp, Homo sapiens
agcagttgctagcaacaactta

SEQ ID NO: 423384 - DNA, 23 bp, Homo sapiens
agcagttgctagcaacaacttac

SEQ ID NO: 423385 - DNA, 22 bp, Homo sapiens
agcagttgttatattcattctt

SEQ ID NO: 423386 - DNA, 14 bp, Homo sapiens
agcagtttgctttg

SEQ ID NO: 423387 - DNA, 16 bp, Homo sapiens
agcagttttccaggag

SEQ ID NO: 423388 - DNA, 18 bp, Homo sapiens
agcataagtatacagttc

SEQ ID NO: 423389 - DNA, 17 bp, Homo sapiens
agcataagtttctggga

SEQ ID NO: 423390 - DNA, 15 bp, Homo sapiens
agcatacaaaaatat

SEQ ID NO: 423391 - DNA, 21 bp, Homo sapiens
agcatacaaaaatatattaaa

SEQ ID NO: 423392 - DNA, 12 bp, Homo sapiens
agcatactgatg

SEQ ID NO: 423393 - DNA, 22 bp, Homo sapiens
agcatactgatgagacaacaca

SEQ ID NO: 423394 - DNA, 12 bp, Homo sapiens
agcatatataaa

SEQ ID NO: 423395 - DNA, 16 bp, Homo sapiens
agcatatataaaacaa

SEQ ID NO: 423396 - DNA, 19 bp, Homo sapiens
agcatatattcatacctgt

SEQ ID NO: 423397 - DNA, 14 bp, Homo sapiens
agcatcaaaataca

SEQ ID NO: 423398 - DNA, 14 bp, Homo sapiens
agcatcaaacatga

SEQ ID NO: 423399 - DNA, 14 bp, Homo sapiens
agcatcaaataata

SEQ ID NO: 423400 - DNA, 15 bp, Homo sapiens
agcatcaaataatac

SEQ ID NO: 423401 - DNA, 23 bp, Homo sapiens
agcatcagagagtgtacatcatg

SEQ ID NO: 423402 - DNA, 13 bp, Homo sapiens
agcatcccaagat

SEQ ID NO: 423403 - DNA, 19 bp, Homo sapiens
agcatcccatctcagaaga

SEQ ID NO: 423404 - DNA, 14 bp, Homo sapiens
agcatcccctgtga

SEQ ID NO: 423405 - DNA, 20 bp, Homo sapiens
agcatccttaagtatcagaa

SEQ ID NO: 423406 - DNA, 16 bp, Homo sapiens
agcatctatgtgagac

SEQ ID NO: 423407 - DNA, 20 bp, Homo sapiens
agcatctgagaaggccctgt

SEQ ID NO: 423408 - DNA, 18 bp, Homo sapiens
agcatctgctcttctctt

SEQ ID NO: 423409 - DNA, 13 bp, Homo sapiens
agcatctgtccca

SEQ ID NO: 423410 - DNA, 16 bp, Homo sapiens
agcatctgtcccactg

SEQ ID NO: 423411 - DNA, 20 bp, Homo sapiens
agcatcttcacttctaaatg

SEQ ID NO: 423412 - DNA, 14 bp, Homo sapiens
agcatgaaaaagca

SEQ ID NO: 423413 - DNA, 18 bp, Homo sapiens
agcatgacctgtgaccag

SEQ ID NO: 423414 - DNA, 22 bp, Homo sapiens
agcatgacctgtgaccagcact

SEQ ID NO: 423415 - DNA, 14 bp, Homo sapiens
agcatgaccttttg

SEQ ID NO: 423416 - DNA, 22 bp, Homo sapiens
agcatgaccttttggcctttgt

SEQ ID NO: 423417 - DNA, 15 bp, Homo sapiens
agcatgagtggcctt

SEQ ID NO: 423418 - DNA, 19 bp, Homo sapiens
agcatgattctttaataga

SEQ ID NO: 423419 - DNA, 13 bp, Homo sapiens
agcatgcacaaag

SEQ ID NO: 423420 - DNA, 14 bp, Homo sapiens
agcatgcacaaagt

SEQ ID NO: 423421 - DNA, 23 bp, Homo sapiens
agcatgccccacccacccctcct

SEQ ID NO: 423422 - DNA, 22 bp, Homo sapiens
agcatggagagcctcttagtga

SEQ ID NO: 423423 - DNA, 18 bp, Homo sapiens
agcatggctcaaagtgca

SEQ ID NO: 423424 - DNA, 19 bp, Homo sapiens
agcatgggcctggccacct

SEQ ID NO: 423425 - DNA, 17 bp, Homo sapiens
agcatggtgcatgccgc

SEQ ID NO: 423426 - DNA, 19 bp, Homo sapiens
agcatgtaagaaataagtt

SEQ ID NO: 423427 - DNA, 15 bp, Homo sapiens
agcatgtctactgct

SEQ ID NO: 423428 - DNA, 23 bp, Homo sapiens
agcatgtctctgcttccatggct

SEQ ID NO: 423429 - DNA, 17 bp, Homo sapiens
agcatgtggggaagcaa

SEQ ID NO: 423430 - DNA, 22 bp, Homo sapiens
agcatgtgggggaaggccttgc

SEQ ID NO: 423431 - DNA, 12 bp, Homo sapiens
agcatgtgtgtg

SEQ ID NO: 423432 - DNA, 18 bp, Homo sapiens
agcatgtgtgtgtctcta

SEQ ID NO: 423433 - DNA, 12 bp, Homo sapiens
agcatgttactg

SEQ ID NO: 423434 - DNA, 15 bp, Homo sapiens
agcatgttgaatgta

SEQ ID NO: 423435 - DNA, 15 bp, Homo sapiens
agcatgttgtagata

SEQ ID NO: 423436 - DNA, 21 bp, Homo sapiens
agcatgtttcatgttttgtga

SEQ ID NO: 423437 - DNA, 15 bp, Homo sapiens
agcattaaaaataaa

SEQ ID NO: 423438 - DNA, 18 bp, Homo sapiens
agcattaaaaataaaagt

SEQ ID NO: 423439 - DNA, 14 bp, Homo sapiens
agcattaggctttt

SEQ ID NO: 423440 - DNA, 18 bp, Homo sapiens
agcattatccttttatct

SEQ ID NO: 423441 - DNA, 17 bp, Homo sapiens
agcattattcttcagaa

SEQ ID NO: 423442 - DNA, 21 bp, Homo sapiens
agcattcaaaatagttctatt

SEQ ID NO: 423443 - DNA, 18 bp, Homo sapiens
agcattccagctctgccc

SEQ ID NO: 423444 - DNA, 20 bp, Homo sapiens
agcattccttagcagctcag

SEQ ID NO: 423445 - DNA, 20 bp, Homo sapiens
agcattctcactcctacctg

SEQ ID NO: 423446 - DNA, 13 bp, Homo sapiens
agcattctgcctg

SEQ ID NO: 423447 - DNA, 14 bp, Homo sapiens
agcattctgcctgc

SEQ ID NO: 423448 - DNA, 16 bp, Homo sapiens
agcattctggggtggg

SEQ ID NO: 423449 - DNA, 16 bp, Homo sapiens
agcattgaaataataa

SEQ ID NO: 423450 - DNA, 16 bp, Homo sapiens
agcattgaaattatag

SEQ ID NO: 423451 - DNA, 14 bp, Homo sapiens
agcattgttccaca

SEQ ID NO: 423452 - DNA, 15 bp, Homo sapiens
agcattgttccacac

SEQ ID NO: 423453 - DNA, 23 bp, Homo sapiens
agcattgttccacacatttaaaa

SEQ ID NO: 423454 - DNA, 15 bp, Homo sapiens
agcattgtttgctta

SEQ ID NO: 423455 - DNA, 14 bp, Homo sapiens
agcatttccaacac

SEQ ID NO: 423456 - DNA, 18 bp, Homo sapiens
agcatttccaacaccaca

SEQ ID NO: 423457 - DNA, 22 bp, Homo sapiens
agcatttccaacaccacagaca

SEQ ID NO: 423458 - DNA, 23 bp, Homo sapiens
agcatttccaacaccacagacac

SEQ ID NO: 423459 - DNA, 16 bp, Homo sapiens
agcatttcggtgcttc

SEQ ID NO: 423460 - DNA, 18 bp, Homo sapiens
agcatttggaaggaaagg

SEQ ID NO: 423461 - DNA, 16 bp, Homo sapiens
agcatttgtccaccca

SEQ ID NO: 423462 - DNA, 18 bp, Homo sapiens
agcattttactgtctgta

SEQ ID NO: 423463 - DNA, 14 bp, Homo sapiens
agcattttcacatt

SEQ ID NO: 423464 - DNA, 21 bp, Homo sapiens
agcattttcagcatcaaacat

SEQ ID NO: 423465 - DNA, 15 bp, Homo sapiens
agcattttgtgtctt

SEQ ID NO: 423466 - DNA, 23 bp, Homo sapiens
agcattttgtgtcttaagaaaaa

SEQ ID NO: 423467 - DNA, 14 bp, Homo sapiens
agccaaaccctgtc

SEQ ID NO: 423468 - DNA, 16 bp, Homo sapiens
agccaaaccctgtctg

SEQ ID NO: 423469 - DNA, 18 bp, Homo sapiens
agccaaacctttcctgta

SEQ ID NO: 423470 - DNA, 13 bp, Homo sapiens
agccaaagagaaa

SEQ ID NO: 423471 - DNA, 15 bp, Homo sapiens
agccaaagagaatgc

SEQ ID NO: 423472 - DNA, 22 bp, Homo sapiens
agccaaatgacttcatttctga

SEQ ID NO: 423473 - DNA, 23 bp, Homo sapiens
agccaaatgcagggaggggaggc

SEQ ID NO: 423474 - DNA, 20 bp, Homo sapiens
agccaaatgtaattgaataa

SEQ ID NO: 423475 - DNA, 18 bp, Homo sapiens
agccaacagaagcttcca

SEQ ID NO: 423476 - DNA, 15 bp, Homo sapiens
agccaacattgcctt

SEQ ID NO: 423477 - DNA, 16 bp, Homo sapiens
agccaacccctgtgga

SEQ ID NO: 423478 - DNA, 20 bp, Homo sapiens
agccaacctcggcttgtggg

SEQ ID NO: 423479 - DNA, 15 bp, Homo sapiens
agccaacttttgcat

SEQ ID NO: 423480 - DNA, 21 bp, Homo sapiens
agccaagaagtgaggcctggg

SEQ ID NO: 423481 - DNA, 21 bp, Homo sapiens
agccaagacccaacaggtgct

SEQ ID NO: 423482 - DNA, 16 bp, Homo sapiens
agccaaggaagttggt

SEQ ID NO: 423483 - DNA, 13 bp, Homo sapiens
agccaataaataa

SEQ ID NO: 423484 - DNA, 17 bp, Homo sapiens
agccaatactgagtgcc

SEQ ID NO: 423485 - DNA, 19 bp, Homo sapiens
agccaatatttactcatca

SEQ ID NO: 423486 - DNA, 18 bp, Homo sapiens
agccaatgaagcaaacac

SEQ ID NO: 423487 - DNA, 19 bp, Homo sapiens
agccacaagaaatttgatt

SEQ ID NO: 423488 - DNA, 17 bp, Homo sapiens
agccacaaggctggcca

SEQ ID NO: 423489 - DNA, 14 bp, Homo sapiens
agccacagtggggc

SEQ ID NO: 423490 - DNA, 16 bp, Homo sapiens
agccacagtggggccc

SEQ ID NO: 423491 - DNA, 14 bp, Homo sapiens
agccacataaccag

SEQ ID NO: 423492 - DNA, 16 bp, Homo sapiens
agccaccacctggatg

SEQ ID NO: 423493 - DNA, 23 bp, Homo sapiens
agccaccacctggatggatctgc

SEQ ID NO: 423494 - DNA, 16 bp, Homo sapiens
agccaccacgccctgc

SEQ ID NO: 423495 - DNA, 17 bp, Homo sapiens
agccaccacgtccagct

SEQ ID NO: 423496 - DNA, 23 bp, Homo sapiens
agccaccatgcccagctcagagg

SEQ ID NO: 423497 - DNA, 13 bp, Homo sapiens
agccacccagcca

SEQ ID NO: 423498 - DNA, 21 bp, Homo sapiens
agccacccaggccactgacct

SEQ ID NO: 423499 - DNA, 22 bp, Homo sapiens
agccacccggatctccaggccc

SEQ ID NO: 423500 - DNA, 21 bp, Homo sapiens
agccaccctaactgagctgcc

SEQ ID NO: 423501 - DNA, 17 bp, Homo sapiens
agccaccgcgagggcct

SEQ ID NO: 423502 - DNA, 16 bp, Homo sapiens
agccaccgctgccagc

SEQ ID NO: 423503 - DNA, 20 bp, Homo sapiens
agccacctccacccccaaga

SEQ ID NO: 423504 - DNA, 15 bp, Homo sapiens
agccacctctccctc

SEQ ID NO: 423505 - DNA, 13 bp, Homo sapiens
agccacctgggct

SEQ ID NO: 423506 - DNA, 21 bp, Homo sapiens
agccacctgggctgggagaag

SEQ ID NO: 423507 - DNA, 15 bp, Homo sapiens
agccacctgtcccac

SEQ ID NO: 423508 - DNA, 17 bp, Homo sapiens
agccaccttcctgactg

SEQ ID NO: 423509 - DNA, 22 bp, Homo sapiens
agccaccttcctgactgggaag

SEQ ID NO: 423510 - DNA, 17 bp, Homo sapiens
agccacgtgctggagag

SEQ ID NO: 423511 - DNA, 15 bp, Homo sapiens
agccacgttggtggt

SEQ ID NO: 423512 - DNA, 17 bp, Homo sapiens
agccactaccttctgac

SEQ ID NO: 423513 - DNA, 14 bp, Homo sapiens
agccactagactct

SEQ ID NO: 423514 - DNA, 12 bp, Homo sapiens
agccactcctca

SEQ ID NO: 423515 - DNA, 16 bp, Homo sapiens
agccactcctgtcccg

SEQ ID NO: 423516 - DNA, 22 bp, Homo sapiens
agccactcctgtcccgccttcc

SEQ ID NO: 423517 - DNA, 15 bp, Homo sapiens
agccactctctgccc

SEQ ID NO: 423518 - DNA, 16 bp, Homo sapiens
agccactctctgccca

SEQ ID NO: 423519 - DNA, 17 bp, Homo sapiens
agccactctctgcccac

SEQ ID NO: 423520 - DNA, 15 bp, Homo sapiens
agccactctgttcct

SEQ ID NO: 423521 - DNA, 20 bp, Homo sapiens
agccagagaggagcacctga

SEQ ID NO: 423522 - DNA, 20 bp, Homo sapiens
agccagagctgggtggggac

SEQ ID NO: 423523 - DNA, 16 bp, Homo sapiens
agccagcagctgaagt

SEQ ID NO: 423524 - DNA, 21 bp, Homo sapiens
agccagcagggcgggccagga

SEQ ID NO: 423525 - DNA, 23 bp, Homo sapiens
agccagcagggcgggccaggaga

SEQ ID NO: 423526 - DNA, 16 bp, Homo sapiens
agccagcagggctgtg

SEQ ID NO: 423527 - DNA, 11 bp, Homo sapiens
agccagcaggt

SEQ ID NO: 423528 - DNA, 20 bp, Homo sapiens
agccagcaggttctctcctg

SEQ ID NO: 423529 - DNA, 15 bp, Homo sapiens
agccagcccagctcc

SEQ ID NO: 423530 - DNA, 14 bp, Homo sapiens
agccagcccttccc

SEQ ID NO: 423531 - DNA, 19 bp, Homo sapiens
agccagcccttcccaggcc

SEQ ID NO: 423532 - DNA, 22 bp, Homo sapiens
agccagcccttcccaggccagc

SEQ ID NO: 423533 - DNA, 23 bp, Homo sapiens
agccagcccttcccaggccagcg

SEQ ID NO: 423534 - DNA, 17 bp, Homo sapiens
agccagcccttccctgg

SEQ ID NO: 423535 - DNA, 13 bp, Homo sapiens
agccagcctggga

SEQ ID NO: 423536 - DNA, 20 bp, Homo sapiens
agccagcctgggactcccag

SEQ ID NO: 423537 - DNA, 20 bp, Homo sapiens
agccagctgcagctgggctg

SEQ ID NO: 423538 - DNA, 22 bp, Homo sapiens
agccagctgtgttcacactgta

SEQ ID NO: 423539 - DNA, 14 bp, Homo sapiens
agccagcttggtgg

SEQ ID NO: 423540 - DNA, 17 bp, Homo sapiens
agccagcttggtggtta

SEQ ID NO: 423541 - DNA, 16 bp, Homo sapiens
agccaggaagccccgc

SEQ ID NO: 423542 - DNA, 12 bp, Homo sapiens
agccaggagacc

SEQ ID NO: 423543 - DNA, 15 bp, Homo sapiens
agccaggagaccctg

SEQ ID NO: 423544 - DNA, 19 bp, Homo sapiens
agccaggagaccctgtctt

SEQ ID NO: 423545 - DNA, 24 bp, Homo sapiens
agccaggaggctttaagctccagc

SEQ ID NO: 423546 - DNA, 18 bp, Homo sapiens
agccaggagtctgtgctc

SEQ ID NO: 423547 - DNA, 21 bp, Homo sapiens
agccaggagtctgtgctcttt

SEQ ID NO: 423548 - DNA, 21 bp, Homo sapiens
agccaggcctcccgcatgctg

SEQ ID NO: 423549 - DNA, 15 bp, Homo sapiens
agccaggctcaggcc

SEQ ID NO: 423550 - DNA, 18 bp, Homo sapiens
agccaggctcaggccatg

SEQ ID NO: 423551 - DNA, 20 bp, Homo sapiens
agccagggatggggccacag

SEQ ID NO: 423552 - DNA, 22 bp, Homo sapiens
agccagggatggggccacagcc

SEQ ID NO: 423553 - DNA, 20 bp, Homo sapiens
agccagggcttacctgtaca

SEQ ID NO: 423554 - DNA, 14 bp, Homo sapiens
agccagggttccag

SEQ ID NO: 423555 - DNA, 16 bp, Homo sapiens
agccagggttccagac

SEQ ID NO: 423556 - DNA, 19 bp, Homo sapiens
agccagggttccagacagg

SEQ ID NO: 423557 - DNA, 20 bp, Homo sapiens
agccagggttccagacaggg

SEQ ID NO: 423558 - DNA, 17 bp, Homo sapiens
agccaggtgtcctgact

SEQ ID NO: 423559 - DNA, 18 bp, Homo sapiens
agccaggtgtcctgactg

SEQ ID NO: 423560 - DNA, 14 bp, Homo sapiens
agccagtcccaggg

SEQ ID NO: 423561 - DNA, 18 bp, Homo sapiens
agccagtgactccaggag

SEQ ID NO: 423562 - DNA, 12 bp, Homo sapiens
agccagtgactt

SEQ ID NO: 423563 - DNA, 14 bp, Homo sapiens
agccagtgactttt

SEQ ID NO: 423564 - DNA, 23 bp, Homo sapiens
agccagtggggtcccccctgagt

SEQ ID NO: 423565 - DNA, 17 bp, Homo sapiens
agccataggcccaggat

SEQ ID NO: 423566 - DNA, 20 bp, Homo sapiens
agccatatgacaatttcaaa

SEQ ID NO: 423567 - DNA, 17 bp, Homo sapiens
agccatattcacacctc

SEQ ID NO: 423568 - DNA, 17 bp, Homo sapiens
agccatcaattttaaca

SEQ ID NO: 423569 - DNA, 18 bp, Homo sapiens
agccatcaattttaacat

SEQ ID NO: 423570 - DNA, 16 bp, Homo sapiens
agccatcacttctccc

SEQ ID NO: 423571 - DNA, 17 bp, Homo sapiens
agccatcacttctcccc

SEQ ID NO: 423572 - DNA, 20 bp, Homo sapiens
agccatcacttctccccgca

SEQ ID NO: 423573 - DNA, 20 bp, Homo sapiens
agccatcccactccctttcc

SEQ ID NO: 423574 - DNA, 19 bp, Homo sapiens
agccatctaatgcttgttt

SEQ ID NO: 423575 - DNA, 15 bp, Homo sapiens
agccatctactggat

SEQ ID NO: 423576 - DNA, 22 bp, Homo sapiens
agccatcttcccgcctcagcct

SEQ ID NO: 423577 - DNA, 12 bp, Homo sapiens
agccatggctca

SEQ ID NO: 423578 - DNA, 15 bp, Homo sapiens
agccatggctcaggc

SEQ ID NO: 423579 - DNA, 16 bp, Homo sapiens
agccatggctcaggca

SEQ ID NO: 423580 - DNA, 18 bp, Homo sapiens
agccatggctcaggcaag

SEQ ID NO: 423581 - DNA, 13 bp, Homo sapiens
agccatgggcctg

SEQ ID NO: 423582 - DNA, 18 bp, Homo sapiens
agccatgggcctgggcct

SEQ ID NO: 423583 - DNA, 20 bp, Homo sapiens
agccatgggcctgggcctgc

SEQ ID NO: 423584 - DNA, 19 bp, Homo sapiens
agccatgtaccagtgtact

SEQ ID NO: 423585 - DNA, 21 bp, Homo sapiens
agccatgtccaagttcttcac

SEQ ID NO: 423586 - DNA, 23 bp, Homo sapiens
agccatgtctacaaaagcaaagt

SEQ ID NO: 423587 - DNA, 14 bp, Homo sapiens
agccattcctgttc

SEQ ID NO: 423588 - DNA, 19 bp, Homo sapiens
agccattttttgaggagag

SEQ ID NO: 423589 - DNA, 16 bp, Homo sapiens
agcccaaagctggagc

SEQ ID NO: 423590 - DNA, 16 bp, Homo sapiens
agcccaaccaggaggg

SEQ ID NO: 423591 - DNA, 13 bp, Homo sapiens
agcccaaccggga

SEQ ID NO: 423592 - DNA, 21 bp, Homo sapiens
agcccaacgggaagcaacctc

SEQ ID NO: 423593 - DNA, 19 bp, Homo sapiens
agcccaagcttaatagccc

SEQ ID NO: 423594 - DNA, 9 bp, Homo sapiens
agcccaata

SEQ ID NO: 423595 - DNA, 23 bp, Homo sapiens
agcccacacttgagaggatgaat

SEQ ID NO: 423596 - DNA, 13 bp, Homo sapiens
agcccacagagga

SEQ ID NO: 423597 - DNA, 15 bp, Homo sapiens
agcccacagaggaca

SEQ ID NO: 423598 - DNA, 21 bp, Homo sapiens
agcccacagaggacagtgctg

SEQ ID NO: 423599 - DNA, 19 bp, Homo sapiens
agcccacaggtgtccccag

SEQ ID NO: 423600 - DNA, 16 bp, Homo sapiens
agcccacatccagtgg

SEQ ID NO: 423601 - DNA, 21 bp, Homo sapiens
agcccacatggccgggccctc

SEQ ID NO: 423602 - DNA, 13 bp, Homo sapiens
agcccacccccct

SEQ ID NO: 423603 - DNA, 16 bp, Homo sapiens
agcccaccctgctgcc

SEQ ID NO: 423604 - DNA, 12 bp, Homo sapiens
agcccaccctgg

SEQ ID NO: 423605 - DNA, 14 bp, Homo sapiens
agcccactgcctgg

SEQ ID NO: 423606 - DNA, 20 bp, Homo sapiens
agcccactggatcagaaaga

SEQ ID NO: 423607 - DNA, 18 bp, Homo sapiens
agcccagagagaccctgc

SEQ ID NO: 423608 - DNA, 16 bp, Homo sapiens
agcccagcccagctgc

SEQ ID NO: 423609 - DNA, 14 bp, Homo sapiens
agcccagcccggct

SEQ ID NO: 423610 - DNA, 16 bp, Homo sapiens
agcccagccctgttct

SEQ ID NO: 423611 - DNA, 17 bp, Homo sapiens
agcccagctacattcct

SEQ ID NO: 423612 - DNA, 18 bp, Homo sapiens
agcccagctacattcctc

SEQ ID NO: 423613 - DNA, 22 bp, Homo sapiens
agcccagctccactcagggctg

SEQ ID NO: 423614 - DNA, 23 bp, Homo sapiens
agcccagctccactcagggctgg

SEQ ID NO: 423615 - DNA, 23 bp, Homo sapiens
agcccagctgctctgcccagagc

SEQ ID NO: 423616 - DNA, 12 bp, Homo sapiens
agcccaggagct

SEQ ID NO: 423617 - DNA, 23 bp, Homo sapiens
agcccaggagctgagtcacctcc

SEQ ID NO: 423618 - DNA, 16 bp, Homo sapiens
agcccaggaggacctg

SEQ ID NO: 423619 - DNA, 13 bp, Homo sapiens
agcccaggcctgg

SEQ ID NO: 423620 - DNA, 23 bp, Homo sapiens
agcccagggttcccccagccctg

SEQ ID NO: 423621 - DNA, 16 bp, Homo sapiens
agcccaggtcccagtg

SEQ ID NO: 423622 - DNA, 18 bp, Homo sapiens
agcccagtccctggagct

SEQ ID NO: 423623 - DNA, 19 bp, Homo sapiens
agcccataggccaccccct

SEQ ID NO: 423624 - DNA, 19 bp, Homo sapiens
agcccatcttgcctccatg

SEQ ID NO: 423625 - DNA, 20 bp, Homo sapiens
agcccatgcccacctgccca

SEQ ID NO: 423626 - DNA, 14 bp, Homo sapiens
agcccattcccacc

SEQ ID NO: 423627 - DNA, 19 bp, Homo sapiens
agccccaactccaggggca

SEQ ID NO: 423628 - DNA, 22 bp, Homo sapiens
agccccaactccaggggcacct

SEQ ID NO: 423629 - DNA, 21 bp, Homo sapiens
agccccaatatggtggccctg

SEQ ID NO: 423630 - DNA, 20 bp, Homo sapiens
agccccacccaggagggagg

SEQ ID NO: 423631 - DNA, 19 bp, Homo sapiens
agccccacctctccaagtc

SEQ ID NO: 423632 - DNA, 23 bp, Homo sapiens
agccccacctctccaagtctctc

SEQ ID NO: 423633 - DNA, 13 bp, Homo sapiens
agccccactcccg

SEQ ID NO: 423634 - DNA, 12 bp, Homo sapiens
agccccagcaag

SEQ ID NO: 423635 - DNA, 14 bp, Homo sapiens
agccccagcccagc

SEQ ID NO: 423636 - DNA, 23 bp, Homo sapiens
agccccagcccagcccagctgct

SEQ ID NO: 423637 - DNA, 15 bp, Homo sapiens
agccccagcgagtct

SEQ ID NO: 423638 - DNA, 13 bp, Homo sapiens
agccccaggcagg

SEQ ID NO: 423639 - DNA, 20 bp, Homo sapiens
agccccaggcaggctgtgcg

SEQ ID NO: 423640 - DNA, 12 bp, Homo sapiens
agccccagggcc

SEQ ID NO: 423641 - DNA, 17 bp, Homo sapiens
agccccagggccctgct

SEQ ID NO: 423642 - DNA, 18 bp, Homo sapiens
agccccagggccctgctc

SEQ ID NO: 423643 - DNA, 19 bp, Homo sapiens
agccccagggccctgctca

SEQ ID NO: 423644 - DNA, 15 bp, Homo sapiens
agccccagggcctgg

SEQ ID NO: 423645 - DNA, 20 bp, Homo sapiens
agccccatccttcccgcagc

SEQ ID NO: 423646 - DNA, 21 bp, Homo sapiens
agccccatccttcccgcagca

SEQ ID NO: 423647 - DNA, 21 bp, Homo sapiens
agcccccaaccccgcggtgct

SEQ ID NO: 423648 - DNA, 16 bp, Homo sapiens
agcccccaccagcagc

SEQ ID NO: 423649 - DNA, 22 bp, Homo sapiens
agcccccaccagcagcacaatt

SEQ ID NO: 423650 - DNA, 17 bp, Homo sapiens
agcccccacctgcctga

SEQ ID NO: 423651 - DNA, 19 bp, Homo sapiens
agcccccagatagagctgg

SEQ ID NO: 423652 - DNA, 22 bp, Homo sapiens
agcccccagatagagctgggtg

SEQ ID NO: 423653 - DNA, 22 bp, Homo sapiens
agccccccagagagagctctgc

SEQ ID NO: 423654 - DNA, 19 bp, Homo sapiens
agccccccagtgtccccag

SEQ ID NO: 423655 - DNA, 22 bp, Homo sapiens
agccccctccacaccagtggcc

SEQ ID NO: 423656 - DNA, 13 bp, Homo sapiens
agccccctgcacc

SEQ ID NO: 423657 - DNA, 15 bp, Homo sapiens
agccccctgcaccca

SEQ ID NO: 423658 - DNA, 19 bp, Homo sapiens
agccccctggatgtcccct

SEQ ID NO: 423659 - DNA, 14 bp, Homo sapiens
agccccctgtcctt

SEQ ID NO: 423660 - DNA, 22 bp, Homo sapiens
agccccctgtccttcccacggc

SEQ ID NO: 423661 - DNA, 21 bp, Homo sapiens
agccccctgtgcccacccagg

SEQ ID NO: 423662 - DNA, 20 bp, Homo sapiens
agccccgctcctcccctctt

SEQ ID NO: 423663 - DNA, 14 bp, Homo sapiens
agccccggccactc

SEQ ID NO: 423664 - DNA, 19 bp, Homo sapiens
agcccctacaactccagcc

SEQ ID NO: 423665 - DNA, 21 bp, Homo sapiens
agcccctatcctgcaccctct

SEQ ID NO: 423666 - DNA, 16 bp, Homo sapiens
agcccctcacctcagg

SEQ ID NO: 423667 - DNA, 13 bp, Homo sapiens
agcccctcagccc

SEQ ID NO: 423668 - DNA, 14 bp, Homo sapiens
agcccctcccacca

SEQ ID NO: 423669 - DNA, 16 bp, Homo sapiens
agcccctcccaccaca

SEQ ID NO: 423670 - DNA, 13 bp, Homo sapiens
agcccctccccag

SEQ ID NO: 423671 - DNA, 21 bp, Homo sapiens
agcccctccccatggtgcagt

SEQ ID NO: 423672 - DNA, 12 bp, Homo sapiens
agcccctcctct

SEQ ID NO: 423673 - DNA, 17 bp, Homo sapiens
agcccctcctctgagca

SEQ ID NO: 423674 - DNA, 16 bp, Homo sapiens
agcccctcggctctgc

SEQ ID NO: 423675 - DNA, 10 bp, Homo sapiens
agcccctctt

SEQ ID NO: 423676 - DNA, 13 bp, Homo sapiens
agcccctgctgct

SEQ ID NO: 423677 - DNA, 16 bp, Homo sapiens
agcccctgctgctcct

SEQ ID NO: 423678 - DNA, 12 bp, Homo sapiens
agcccctgctgg

SEQ ID NO: 423679 - DNA, 16 bp, Homo sapiens
agcccctgctggacca

SEQ ID NO: 423680 - DNA, 21 bp, Homo sapiens
agcccctgctggaccaaggtg

SEQ ID NO: 423681 - DNA, 12 bp, Homo sapiens
agcccctggagc

SEQ ID NO: 423682 - DNA, 13 bp, Homo sapiens
agcccctggggcc

SEQ ID NO: 423683 - DNA, 18 bp, Homo sapiens
agcccctgtatggcactg

SEQ ID NO: 423684 - DNA, 11 bp, Homo sapiens
agcccctgtgt

SEQ ID NO: 423685 - DNA, 18 bp, Homo sapiens
agcccctgtgtgggaggg

SEQ ID NO: 423686 - DNA, 19 bp, Homo sapiens
agcccctgtgtgggagggc

SEQ ID NO: 423687 - DNA, 23 bp, Homo sapiens
agccccttctcccagcacacggc

SEQ ID NO: 423688 - DNA, 17 bp, Homo sapiens
agccccttgagaaacct

SEQ ID NO: 423689 - DNA, 18 bp, Homo sapiens
agcccgatattctccctg

SEQ ID NO: 423690 - DNA, 19 bp, Homo sapiens
agcccgatattctccctga

SEQ ID NO: 423691 - DNA, 17 bp, Homo sapiens
agcccgcacccccaccc

SEQ ID NO: 423692 - DNA, 18 bp, Homo sapiens
agcccgcacccccaccct

SEQ ID NO: 423693 - DNA, 18 bp, Homo sapiens
agcccgcatgcagcagct

SEQ ID NO: 423694 - DNA, 21 bp, Homo sapiens
agcccgcatgcagcagcttgc

SEQ ID NO: 423695 - DNA, 16 bp, Homo sapiens
agcccgcccacctggg

SEQ ID NO: 423696 - DNA, 14 bp, Homo sapiens
agcccgcttttgtt

SEQ ID NO: 423697 - DNA, 14 bp, Homo sapiens
agcccggatgccca

SEQ ID NO: 423698 - DNA, 10 bp, Homo sapiens
agcccggcca

SEQ ID NO: 423699 - DNA, 11 bp, Homo sapiens
agcccggcctg

SEQ ID NO: 423700 - DNA, 20 bp, Homo sapiens
agcccggcctgctcccagca

SEQ ID NO: 423701 - DNA, 22 bp, Homo sapiens
agcccggcgcccctgccacctc

SEQ ID NO: 423702 - DNA, 24 bp, Homo sapiens
agcccgggagatccgccctgggct

SEQ ID NO: 423703 - DNA, 19 bp, Homo sapiens
agcccggggcagagctcag

SEQ ID NO: 423704 - DNA, 20 bp, Homo sapiens
agcccggggcagagctcaga

SEQ ID NO: 423705 - DNA, 22 bp, Homo sapiens
agcccggggcagagctcagagg

SEQ ID NO: 423706 - DNA, 23 bp, Homo sapiens
agcccgtcatcttccctttcctc

SEQ ID NO: 423707 - DNA, 19 bp, Homo sapiens
agcccgtgtggccccttca

SEQ ID NO: 423708 - DNA, 21 bp, Homo sapiens
agccctaaggatctctcagga

SEQ ID NO: 423709 - DNA, 22 bp, Homo sapiens
agccctaagtaaatctaaatta

SEQ ID NO: 423710 - DNA, 13 bp, Homo sapiens
agccctagtggga

SEQ ID NO: 423711 - DNA, 17 bp, Homo sapiens
agccctcagtcagttcc

SEQ ID NO: 423712 - DNA, 12 bp, Homo sapiens
agccctcccagc

SEQ ID NO: 423713 - DNA, 19 bp, Homo sapiens
agccctccccctcaacctc

SEQ ID NO: 423714 - DNA, 16 bp, Homo sapiens
agccctccctcttccc

SEQ ID NO: 423715 - DNA, 20 bp, Homo sapiens
agccctccctcttcccagca

SEQ ID NO: 423716 - DNA, 14 bp, Homo sapiens
agccctccctggct

SEQ ID NO: 423717 - DNA, 23 bp, Homo sapiens
agccctccctggctgtgagcagc

SEQ ID NO: 423718 - DNA, 19 bp, Homo sapiens
agccctccttcttgccctg

SEQ ID NO: 423719 - DNA, 21 bp, Homo sapiens
agccctccttcttgccctgag

SEQ ID NO: 423720 - DNA, 23 bp, Homo sapiens
agccctccttcttgccctgagct

SEQ ID NO: 423721 - DNA, 14 bp, Homo sapiens
agccctccttgcca

SEQ ID NO: 423722 - DNA, 20 bp, Homo sapiens
agccctcgaaccaaggcagc

SEQ ID NO: 423723 - DNA, 22 bp, Homo sapiens
agccctcgaaccaaggcagcct

SEQ ID NO: 423724 - DNA, 13 bp, Homo sapiens
agccctcggcctc

SEQ ID NO: 423725 - DNA, 14 bp, Homo sapiens
agccctcggcctcc

SEQ ID NO: 423726 - DNA, 17 bp, Homo sapiens
agccctctcactgtgtc

SEQ ID NO: 423727 - DNA, 22 bp, Homo sapiens
agccctcttcaggggtcacctc

SEQ ID NO: 423728 - DNA, 23 bp, Homo sapiens
agccctcttcaggggtcacctcc

SEQ ID NO: 423729 - DNA, 13 bp, Homo sapiens
agccctctttctc

SEQ ID NO: 423730 - DNA, 14 bp, Homo sapiens
agccctctttctct

SEQ ID NO: 423731 - DNA, 17 bp, Homo sapiens
agccctctttctctctg

SEQ ID NO: 423732 - DNA, 22 bp, Homo sapiens
agccctctttctctctgtgtgg

SEQ ID NO: 423733 - DNA, 18 bp, Homo sapiens
agccctgaacctttgtcc

SEQ ID NO: 423734 - DNA, 16 bp, Homo sapiens
agccctgaccttggct

SEQ ID NO: 423735 - DNA, 11 bp, Homo sapiens
agccctgcccc

SEQ ID NO: 423736 - DNA, 23 bp, Homo sapiens
agccctgccctcactccactccc

SEQ ID NO: 423737 - DNA, 13 bp, Homo sapiens
agccctgccctgc

SEQ ID NO: 423738 - DNA, 15 bp, Homo sapiens
agccctgccctgcac

SEQ ID NO: 423739 - DNA, 12 bp, Homo sapiens
agccctgctgct

SEQ ID NO: 423740 - DNA, 18 bp, Homo sapiens
agccctgctgcttcctaa

SEQ ID NO: 423741 - DNA, 21 bp, Homo sapiens
agccctgctgcttcctaactt

SEQ ID NO: 423742 - DNA, 20 bp, Homo sapiens
agccctgctttgggctgccc

SEQ ID NO: 423743 - DNA, 15 bp, Homo sapiens
agccctggccagagg

SEQ ID NO: 423744 - DNA, 16 bp, Homo sapiens
agccctggccagaggc

SEQ ID NO: 423745 - DNA, 17 bp, Homo sapiens
agccctggccagaggct

SEQ ID NO: 423746 - DNA, 15 bp, Homo sapiens
agccctggggctggg

SEQ ID NO: 423747 - DNA, 21 bp, Homo sapiens
agccctggttctccatcccca

SEQ ID NO: 423748 - DNA, 14 bp, Homo sapiens
agccctgtcagtgc

SEQ ID NO: 423749 - DNA, 18 bp, Homo sapiens
agccctgtcgagacactt

SEQ ID NO: 423750 - DNA, 10 bp, Homo sapiens
agcccttagc

SEQ ID NO: 423751 - DNA, 12 bp, Homo sapiens
agcccttagcct

SEQ ID NO: 423752 - DNA, 22 bp, Homo sapiens
agcccttagccttgctgtagag

SEQ ID NO: 423753 - DNA, 14 bp, Homo sapiens
agcccttcatttgg

SEQ ID NO: 423754 - DNA, 19 bp, Homo sapiens
agcccttccatgtcgcctc

SEQ ID NO: 423755 - DNA, 14 bp, Homo sapiens
agcccttcccaggc

SEQ ID NO: 423756 - DNA, 16 bp, Homo sapiens
agcccttcccaggcca

SEQ ID NO: 423757 - DNA, 17 bp, Homo sapiens
agcccttcccaggccag

SEQ ID NO: 423758 - DNA, 18 bp, Homo sapiens
agcccttcccaggccagc

SEQ ID NO: 423759 - DNA, 14 bp, Homo sapiens
agcccttccctgct

SEQ ID NO: 423760 - DNA, 22 bp, Homo sapiens
agcccttcctcctgaagcctct

SEQ ID NO: 423761 - DNA, 17 bp, Homo sapiens
agcccttctgcctttct

SEQ ID NO: 423762 - DNA, 14 bp, Homo sapiens
agcccttgccccca

SEQ ID NO: 423763 - DNA, 18 bp, Homo sapiens
agcccttgcccccatccc

SEQ ID NO: 423764 - DNA, 19 bp, Homo sapiens
agcccttgcccccatccct

SEQ ID NO: 423765 - DNA, 13 bp, Homo sapiens
agcccttgggcag

SEQ ID NO: 423766 - DNA, 22 bp, Homo sapiens
agcccttgggcagttctcactc

SEQ ID NO: 423767 - DNA, 11 bp, Homo sapiens
agccctttcca

SEQ ID NO: 423768 - DNA, 20 bp, Homo sapiens
agccctttgcaggcccagca

SEQ ID NO: 423769 - DNA, 21 bp, Homo sapiens
agccctttgcaggcccagcag

SEQ ID NO: 423770 - DNA, 12 bp, Homo sapiens
agccctttgcct

SEQ ID NO: 423771 - DNA, 22 bp, Homo sapiens
agcccttttacagctcttggca

SEQ ID NO: 423772 - DNA, 22 bp, Homo sapiens
agccgagatcggggtggcagaa

SEQ ID NO: 423773 - DNA, 18 bp, Homo sapiens
agccgagccgggcctggg

SEQ ID NO: 423774 - DNA, 20 bp, Homo sapiens
agccgagctctcctgggcca

SEQ ID NO: 423775 - DNA, 13 bp, Homo sapiens
agccgccacatcc

SEQ ID NO: 423776 - DNA, 22 bp, Homo sapiens
agccgccactcctatccccagg

SEQ ID NO: 423777 - DNA, 21 bp, Homo sapiens
agccgccaggaccgccaaaga

SEQ ID NO: 423778 - DNA, 17 bp, Homo sapiens
agccgccatcagcccaa

SEQ ID NO: 423779 - DNA, 22 bp, Homo sapiens
agccgccattgccaccaggaga

SEQ ID NO: 423780 - DNA, 20 bp, Homo sapiens
agccgccgttttcatgacca

SEQ ID NO: 423781 - DNA, 16 bp, Homo sapiens
agccgcctgcctgcga

SEQ ID NO: 423782 - DNA, 23 bp, Homo sapiens
agccgcctgcctgcgaaacccag

SEQ ID NO: 423783 - DNA, 16 bp, Homo sapiens
agccgccttccttgac

SEQ ID NO: 423784 - DNA, 17 bp, Homo sapiens
agccgccttccttgacc

SEQ ID NO: 423785 - DNA, 18 bp, Homo sapiens
agccgcgctctgcccctc

SEQ ID NO: 423786 - DNA, 18 bp, Homo sapiens
agccgctaggagagactg

SEQ ID NO: 423787 - DNA, 18 bp, Homo sapiens
agccggcggcccaagccc

SEQ ID NO: 423788 - DNA, 14 bp, Homo sapiens
agccgggccgcaga

SEQ ID NO: 423789 - DNA, 13 bp, Homo sapiens
agccgggcctggg

SEQ ID NO: 423790 - DNA, 19 bp, Homo sapiens
agccgggcctggggctcct

SEQ ID NO: 423791 - DNA, 20 bp, Homo sapiens
agccggggtggggtgcctga

SEQ ID NO: 423792 - DNA, 23 bp, Homo sapiens
agccggggtggggtgcctgagcc

SEQ ID NO: 423793 - DNA, 14 bp, Homo sapiens
agccggtgcccacc

SEQ ID NO: 423794 - DNA, 16 bp, Homo sapiens
agccgtcagccaaatg

SEQ ID NO: 423795 - DNA, 19 bp, Homo sapiens
agccgtcagccaaatgtaa

SEQ ID NO: 423796 - DNA, 19 bp, Homo sapiens
agccgtccatggcaccagc

SEQ ID NO: 423797 - DNA, 22 bp, Homo sapiens
agccgtccatggcaccagcccc

SEQ ID NO: 423798 - DNA, 19 bp, Homo sapiens
agccgtctgactccagagt

SEQ ID NO: 423799 - DNA, 22 bp, Homo sapiens
agccgtctgactccagagtctg

SEQ ID NO: 423800 - DNA, 14 bp, Homo sapiens
agccgtgagtgcag

SEQ ID NO: 423801 - DNA, 17 bp, Homo sapiens
agccgtgatgctcaggc

SEQ ID NO: 423802 - DNA, 19 bp, Homo sapiens
agccgtgatgctcaggctt

SEQ ID NO: 423803 - DNA, 15 bp, Homo sapiens
agccgtgccttcagc

SEQ ID NO: 423804 - DNA, 17 bp, Homo sapiens
agccgtgccttcagctc

SEQ ID NO: 423805 - DNA, 14 bp, Homo sapiens
agccgtggcttccc

SEQ ID NO: 423806 - DNA, 22 bp, Homo sapiens
agccgtggcttcccgctcagcc

SEQ ID NO: 423807 - DNA, 16 bp, Homo sapiens
agccgttcctgggact

SEQ ID NO: 423808 - DNA, 22 bp, Homo sapiens
agccgttcctgggactgtcaga

SEQ ID NO: 423809 - DNA, 20 bp, Homo sapiens
agccgtttgaatatatttta

SEQ ID NO: 423810 - DNA, 13 bp, Homo sapiens
agcctaagaaaaa

SEQ ID NO: 423811 - DNA, 18 bp, Homo sapiens
agcctaagatgaagagga

SEQ ID NO: 423812 - DNA, 14 bp, Homo sapiens
agcctaatgaaagg

SEQ ID NO: 423813 - DNA, 16 bp, Homo sapiens
agcctacagatgaact

SEQ ID NO: 423814 - DNA, 22 bp, Homo sapiens
agcctaccggcaatttccggcc

SEQ ID NO: 423815 - DNA, 23 bp, Homo sapiens
agcctactgtctccttcccactg

SEQ ID NO: 423816 - DNA, 14 bp, Homo sapiens
agcctaggggtcag

SEQ ID NO: 423817 - DNA, 16 bp, Homo sapiens
agcctagtaggagctg

SEQ ID NO: 423818 - DNA, 17 bp, Homo sapiens
agcctagttcatccaat

SEQ ID NO: 423819 - DNA, 19 bp, Homo sapiens
agcctatatttcctcttct

SEQ ID NO: 423820 - DNA, 21 bp, Homo sapiens
agcctatatttcctcttctgt

SEQ ID NO: 423821 - DNA, 15 bp, Homo sapiens
agcctattgtaaata

SEQ ID NO: 423822 - DNA, 14 bp, Homo sapiens
agcctcaaatgcag

SEQ ID NO: 423823 - DNA, 11 bp, Homo sapiens
agcctcacctt

SEQ ID NO: 423824 - DNA, 12 bp, Homo sapiens
agcctcagccat

SEQ ID NO: 423825 - DNA, 12 bp, Homo sapiens
agcctcagggct

SEQ ID NO: 423826 - DNA, 18 bp, Homo sapiens
agcctcagggcttcctta

SEQ ID NO: 423827 - DNA, 24 bp, Homo sapiens
agcctcagtccctccctcctggct

SEQ ID NO: 423828 - DNA, 18 bp, Homo sapiens
agcctcagtgccacttga

SEQ ID NO: 423829 - DNA, 12 bp, Homo sapiens
agcctcatctct

SEQ ID NO: 423830 - DNA, 15 bp, Homo sapiens
agcctccaagaaact

SEQ ID NO: 423831 - DNA, 18 bp, Homo sapiens
agcctccaagcctgcctc

SEQ ID NO: 423832 - DNA, 23 bp, Homo sapiens
agcctccactttggatcaggaaa

SEQ ID NO: 423833 - DNA, 14 bp, Homo sapiens
agcctccagagcca

SEQ ID NO: 423834 - DNA, 19 bp, Homo sapiens
agcctccagagccagcctg

SEQ ID NO: 423835 - DNA, 14 bp, Homo sapiens
agcctccagggccc

SEQ ID NO: 423836 - DNA, 18 bp, Homo sapiens
agcctccatgctgcctcc

SEQ ID NO: 423837 - DNA, 20 bp, Homo sapiens
agcctccatgctgcctccag

SEQ ID NO: 423838 - DNA, 20 bp, Homo sapiens
agcctccatttagttctttg

SEQ ID NO: 423839 - DNA, 16 bp, Homo sapiens
agcctcccaaagtgtt

SEQ ID NO: 423840 - DNA, 12 bp, Homo sapiens
agcctcccccaa

SEQ ID NO: 423841 - DNA, 16 bp, Homo sapiens
agcctcccccaggctg

SEQ ID NO: 423842 - DNA, 16 bp, Homo sapiens
agcctcccctcccctg

SEQ ID NO: 423843 - DNA, 17 bp, Homo sapiens
agcctcccctcccctgg

SEQ ID NO: 423844 - DNA, 13 bp, Homo sapiens
agcctccctcctc

SEQ ID NO: 423845 - DNA, 11 bp, Homo sapiens
agcctccctga

SEQ ID NO: 423846 - DNA, 14 bp, Homo sapiens
agcctccctgtcac

SEQ ID NO: 423847 - DNA, 13 bp, Homo sapiens
agcctccggaagc

SEQ ID NO: 423848 - DNA, 23 bp, Homo sapiens
agcctccgttcccacctctgagg

SEQ ID NO: 423849 - DNA, 20 bp, Homo sapiens
agcctccgtttatgggcctt

SEQ ID NO: 423850 - DNA, 23 bp, Homo sapiens
agcctccgtttatgggccttgct

SEQ ID NO: 423851 - DNA, 12 bp, Homo sapiens
agcctcctcctg

SEQ ID NO: 423852 - DNA, 15 bp, Homo sapiens
agcctcctgaccctg

SEQ ID NO: 423853 - DNA, 13 bp, Homo sapiens
agcctcctgagcc

SEQ ID NO: 423854 - DNA, 14 bp, Homo sapiens
agcctcctgagcct

SEQ ID NO: 423855 - DNA, 17 bp, Homo sapiens
agcctcctgccccctgc

SEQ ID NO: 423856 - DNA, 18 bp, Homo sapiens
agcctcctgccccctgcc

SEQ ID NO: 423857 - DNA, 21 bp, Homo sapiens
agcctcctgctgagtggtcca

SEQ ID NO: 423858 - DNA, 18 bp, Homo sapiens
agcctcctgtttgcaggc

SEQ ID NO: 423859 - DNA, 19 bp, Homo sapiens
agcctcgaactcctgggct

SEQ ID NO: 423860 - DNA, 14 bp, Homo sapiens
agcctcgcccctcc

SEQ ID NO: 423861 - DNA, 15 bp, Homo sapiens
agcctcgcccctcca

SEQ ID NO: 423862 - DNA, 16 bp, Homo sapiens
agcctcgcccctccag

SEQ ID NO: 423863 - DNA, 23 bp, Homo sapiens
agcctctacagccgtcccgcgtt

SEQ ID NO: 423864 - DNA, 10 bp, Homo sapiens
agcctctccc

SEQ ID NO: 423865 - DNA, 15 bp, Homo sapiens
agcctctcccacccg

SEQ ID NO: 423866 - DNA, 22 bp, Homo sapiens
agcctctcccacccggccacag

SEQ ID NO: 423867 - DNA, 15 bp, Homo sapiens
agcctctcccggctg

SEQ ID NO: 423868 - DNA, 17 bp, Homo sapiens
agcctctcccggctgcc

SEQ ID NO: 423869 - DNA, 20 bp, Homo sapiens
agcctctcccggctgcctgc

SEQ ID NO: 423870 - DNA, 22 bp, Homo sapiens
agcctctcccggctgcctgccg

SEQ ID NO: 423871 - DNA, 22 bp, Homo sapiens
agcctctccttgccccagtcct

SEQ ID NO: 423872 - DNA, 15 bp, Homo sapiens
agcctctctgctata

SEQ ID NO: 423873 - DNA, 15 bp, Homo sapiens
agcctctgccaggcc

SEQ ID NO: 423874 - DNA, 17 bp, Homo sapiens
agcctctgccaggcctg

SEQ ID NO: 423875 - DNA, 19 bp, Homo sapiens
agcctctgccctgcctccc

SEQ ID NO: 423876 - DNA, 15 bp, Homo sapiens
agcctctgcctccca

SEQ ID NO: 423877 - DNA, 14 bp, Homo sapiens
agcctctggctaga

SEQ ID NO: 423878 - DNA, 21 bp, Homo sapiens
agcctctgtcctggctgtgca

SEQ ID NO: 423879 - DNA, 22 bp, Homo sapiens
agcctctgtcctggctgtgcac

SEQ ID NO: 423880 - DNA, 13 bp, Homo sapiens
agcctcttctgaa

SEQ ID NO: 423881 - DNA, 17 bp, Homo sapiens
agcctgaccaaaagtga

SEQ ID NO: 423882 - DNA, 15 bp, Homo sapiens
agcctgacctgagac

SEQ ID NO: 423883 - DNA, 11 bp, Homo sapiens
agcctgagcca

SEQ ID NO: 423884 - DNA, 13 bp, Homo sapiens
agcctgagccaca

SEQ ID NO: 423885 - DNA, 18 bp, Homo sapiens
agcctgagtcagggccca

SEQ ID NO: 423886 - DNA, 19 bp, Homo sapiens
agcctgagtcagggcccag

SEQ ID NO: 423887 - DNA, 20 bp, Homo sapiens
agcctgagtcagggcccaga

SEQ ID NO: 423888 - DNA, 16 bp, Homo sapiens
agcctgagtctcctgt

SEQ ID NO: 423889 - DNA, 17 bp, Homo sapiens
agcctgagtctcctgtg

SEQ ID NO: 423890 - DNA, 14 bp, Homo sapiens
agcctgagtggtga

SEQ ID NO: 423891 - DNA, 20 bp, Homo sapiens
agcctgagtggtgaggggcc

SEQ ID NO: 423892 - DNA, 17 bp, Homo sapiens
agcctgatgatggaagg

SEQ ID NO: 423893 - DNA, 23 bp, Homo sapiens
agcctgatggccaagggggtgga

SEQ ID NO: 423894 - DNA, 21 bp, Homo sapiens
agcctgcaatttcatatgctg

SEQ ID NO: 423895 - DNA, 19 bp, Homo sapiens
agcctgcacacacctgcct

SEQ ID NO: 423896 - DNA, 12 bp, Homo sapiens
agcctgcagggt

SEQ ID NO: 423897 - DNA, 18 bp, Homo sapiens
agcctgcagggtggtgct

SEQ ID NO: 423898 - DNA, 19 bp, Homo sapiens
agcctgccccagctgggct

SEQ ID NO: 423899 - DNA, 20 bp, Homo sapiens
agcctgccccagctgggctg

SEQ ID NO: 423900 - DNA, 18 bp, Homo sapiens
agcctgcccgctgcaatg

SEQ ID NO: 423901 - DNA, 21 bp, Homo sapiens
agcctgcccgctgcaatgcct

SEQ ID NO: 423902 - DNA, 19 bp, Homo sapiens
agcctgccgccgtctctgt

SEQ ID NO: 423903 - DNA, 18 bp, Homo sapiens
agcctgcggctgctggca

SEQ ID NO: 423904 - DNA, 20 bp, Homo sapiens
agcctgcggctgctggcaca

SEQ ID NO: 423905 - DNA, 15 bp, Homo sapiens
agcctgcgtggcctg

SEQ ID NO: 423906 - DNA, 16 bp, Homo sapiens
agcctgctgagagccc

SEQ ID NO: 423907 - DNA, 22 bp, Homo sapiens
agcctgcttcccacctccctgc

SEQ ID NO: 423908 - DNA, 10 bp, Homo sapiens
agcctggagc

SEQ ID NO: 423909 - DNA, 13 bp, Homo sapiens
agcctggagccgt

SEQ ID NO: 423910 - DNA, 20 bp, Homo sapiens
agcctggcacagggcagtgg

SEQ ID NO: 423911 - DNA, 22 bp, Homo sapiens
agcctggccacgcagccaggac

SEQ ID NO: 423912 - DNA, 12 bp, Homo sapiens
agcctggcccca

SEQ ID NO: 423913 - DNA, 12 bp, Homo sapiens
agcctggcctcc

SEQ ID NO: 423914 - DNA, 17 bp, Homo sapiens
agcctggcctcccctgc

SEQ ID NO: 423915 - DNA, 21 bp, Homo sapiens
agcctggcctcccctgcggag

SEQ ID NO: 423916 - DNA, 11 bp, Homo sapiens
agcctggctcc

SEQ ID NO: 423917 - DNA, 18 bp, Homo sapiens
agcctggctcccaggaca

SEQ ID NO: 423918 - DNA, 16 bp, Homo sapiens
agcctggcttttctgg

SEQ ID NO: 423919 - DNA, 20 bp, Homo sapiens
agcctggcttttctggctgg

SEQ ID NO: 423920 - DNA, 18 bp, Homo sapiens
agcctgggactcccagtg

SEQ ID NO: 423921 - DNA, 19 bp, Homo sapiens
agcctgggactcccagtga

SEQ ID NO: 423922 - DNA, 21 bp, Homo sapiens
agcctgggcagccaggctgcc

SEQ ID NO: 423923 - DNA, 13 bp, Homo sapiens
agcctgggccact

SEQ ID NO: 423924 - DNA, 14 bp, Homo sapiens
agcctgggccactg

SEQ ID NO: 423925 - DNA, 15 bp, Homo sapiens
agcctgggccactgg

SEQ ID NO: 423926 - DNA, 16 bp, Homo sapiens
agcctgggccactggc

SEQ ID NO: 423927 - DNA, 18 bp, Homo sapiens
agcctgggccactggcat

SEQ ID NO: 423928 - DNA, 22 bp, Homo sapiens
agcctgggccactggcatctct

SEQ ID NO: 423929 - DNA, 15 bp, Homo sapiens
agcctgggccagaga

SEQ ID NO: 423930 - DNA, 14 bp, Homo sapiens
agcctggggcctgg

SEQ ID NO: 423931 - DNA, 18 bp, Homo sapiens
agcctggggcctggcagg

SEQ ID NO: 423932 - DNA, 19 bp, Homo sapiens
agcctggggcctggcaggg

SEQ ID NO: 423933 - DNA, 20 bp, Homo sapiens
agcctgggtgacagagcgag

SEQ ID NO: 423934 - DNA, 21 bp, Homo sapiens
agcctgggtgacagagcgaga

SEQ ID NO: 423935 - DNA, 22 bp, Homo sapiens
agcctgggtgagaatcctgcct

SEQ ID NO: 423936 - DNA, 16 bp, Homo sapiens
agcctggtgacaggca

SEQ ID NO: 423937 - DNA, 18 bp, Homo sapiens
agcctggtgacaggcaga

SEQ ID NO: 423938 - DNA, 14 bp, Homo sapiens
agcctggtgctgct

SEQ ID NO: 423939 - DNA, 15 bp, Homo sapiens
agcctggttccctct

SEQ ID NO: 423940 - DNA, 22 bp, Homo sapiens
agcctggttccctctttcctgt

SEQ ID NO: 423941 - DNA, 15 bp, Homo sapiens
agcctgtccccgcct

SEQ ID NO: 423942 - DNA, 19 bp, Homo sapiens
agcctgtccccgccttccc

SEQ ID NO: 423943 - DNA, 23 bp, Homo sapiens
agcctgtccccgccttccctcac

SEQ ID NO: 423944 - DNA, 14 bp, Homo sapiens
agcctgtcctcacc

SEQ ID NO: 423945 - DNA, 15 bp, Homo sapiens
agcctgtcctcaccg

SEQ ID NO: 423946 - DNA, 13 bp, Homo sapiens
agcctgtcctggt

SEQ ID NO: 423947 - DNA, 23 bp, Homo sapiens
agcctgtcctggtacagcagggt

SEQ ID NO: 423948 - DNA, 14 bp, Homo sapiens
agcctgtcttcaga

SEQ ID NO: 423949 - DNA, 13 bp, Homo sapiens
agcctgtgaggga

SEQ ID NO: 423950 - DNA, 20 bp, Homo sapiens
agcctgtgagggagtgcaga

SEQ ID NO: 423951 - DNA, 21 bp, Homo sapiens
agcctgtgagggagtgcagaa

SEQ ID NO: 423952 - DNA, 14 bp, Homo sapiens
agcctgtggcatct

SEQ ID NO: 423953 - DNA, 21 bp, Homo sapiens
agcctgtggcatctttgcctt

SEQ ID NO: 423954 - DNA, 22 bp, Homo sapiens
agcctgtggcatctttgccttg

SEQ ID NO: 423955 - DNA, 19 bp, Homo sapiens
agcctgtgttagtgtctgt

SEQ ID NO: 423956 - DNA, 22 bp, Homo sapiens
agcctgtgttagtgtctgtcca

SEQ ID NO: 423957 - DNA, 18 bp, Homo sapiens
agcctgttcccctcactg

SEQ ID NO: 423958 - DNA, 18 bp, Homo sapiens
agccttaagaaagctata

SEQ ID NO: 423959 - DNA, 21 bp, Homo sapiens
agccttaagtcttactgtttt

SEQ ID NO: 423960 - DNA, 14 bp, Homo sapiens
agccttacatttgt

SEQ ID NO: 423961 - DNA, 24 bp, Homo sapiens
agccttacggtcatgatgtctgca

SEQ ID NO: 423962 - DNA, 15 bp, Homo sapiens
agccttatcaagtgt

SEQ ID NO: 423963 - DNA, 15 bp, Homo sapiens
agccttcactggaga

SEQ ID NO: 423964 - DNA, 13 bp, Homo sapiens
agccttcccctcc

SEQ ID NO: 423965 - DNA, 14 bp, Homo sapiens
agccttcccctccc

SEQ ID NO: 423966 - DNA, 19 bp, Homo sapiens
agccttcctccatggccca

SEQ ID NO: 423967 - DNA, 19 bp, Homo sapiens
agccttcctctgcagctga

SEQ ID NO: 423968 - DNA, 18 bp, Homo sapiens
agccttgcatcaagggct

SEQ ID NO: 423969 - DNA, 14 bp, Homo sapiens
agccttgcccagca

SEQ ID NO: 423970 - DNA, 19 bp, Homo sapiens
agccttgcgcaaaacccag

SEQ ID NO: 423971 - DNA, 13 bp, Homo sapiens
agccttgctgcca

SEQ ID NO: 423972 - DNA, 15 bp, Homo sapiens
agccttgctgccaag

SEQ ID NO: 423973 - DNA, 14 bp, Homo sapiens
agccttgctgtaga

SEQ ID NO: 423974 - DNA, 13 bp, Homo sapiens
agccttggagtgt

SEQ ID NO: 423975 - DNA, 23 bp, Homo sapiens
agccttgggttccaaccaggcag

SEQ ID NO: 423976 - DNA, 22 bp, Homo sapiens
agccttggttggacctattgcc

SEQ ID NO: 423977 - DNA, 23 bp, Homo sapiens
agccttggttggacctattgcca

SEQ ID NO: 423978 - DNA, 18 bp, Homo sapiens
agccttgtaattctaaat

SEQ ID NO: 423979 - DNA, 21 bp, Homo sapiens
agccttgtgagatccttcaca

SEQ ID NO: 423980 - DNA, 23 bp, Homo sapiens
agccttgtgatcactttctgaaa

SEQ ID NO: 423981 - DNA, 14 bp, Homo sapiens
agccttgtgccctg

SEQ ID NO: 423982 - DNA, 18 bp, Homo sapiens
agccttgtgccctgcccc

SEQ ID NO: 423983 - DNA, 19 bp, Homo sapiens
agccttgtgccctgccccc

SEQ ID NO: 423984 - DNA, 12 bp, Homo sapiens
agcctttaaatt

SEQ ID NO: 423985 - DNA, 23 bp, Homo sapiens
agcctttctgtatcaagcccctg

SEQ ID NO: 423986 - DNA, 13 bp, Homo sapiens
agcctttcttcct

SEQ ID NO: 423987 - DNA, 21 bp, Homo sapiens
agcctttgaataaaaatgcac

SEQ ID NO: 423988 - DNA, 15 bp, Homo sapiens
agcctttgcctcccc

SEQ ID NO: 423989 - DNA, 16 bp, Homo sapiens
agccttttccataaag

SEQ ID NO: 423990 - DNA, 16 bp, Homo sapiens
agcgaacatcttcata

SEQ ID NO: 423991 - DNA, 17 bp, Homo sapiens
agcgacgctcccctgag

SEQ ID NO: 423992 - DNA, 17 bp, Homo sapiens
agcgacggctcctcccc

SEQ ID NO: 423993 - DNA, 23 bp, Homo sapiens
agcgagacccttgcattagaaac

SEQ ID NO: 423994 - DNA, 14 bp, Homo sapiens
agcgagcacagtat

SEQ ID NO: 423995 - DNA, 19 bp, Homo sapiens
agcgagcatcccccaaagt

SEQ ID NO: 423996 - DNA, 14 bp, Homo sapiens
agcgagctgctctg

SEQ ID NO: 423997 - DNA, 15 bp, Homo sapiens
agcgagctgctctgc

SEQ ID NO: 423998 - DNA, 16 bp, Homo sapiens
agcgagctgctctgct

SEQ ID NO: 423999 - DNA, 15 bp, Homo sapiens
agcgaggcgaggctg

SEQ ID NO: 424000 - DNA, 22 bp, Homo sapiens
agcgaggcgaggctgcctctgg

SEQ ID NO: 424001 - DNA, 19 bp, Homo sapiens
agcgagtaccccagccact

SEQ ID NO: 424002 - DNA, 15 bp, Homo sapiens
agcgagtctggagac

SEQ ID NO: 424003 - DNA, 17 bp, Homo sapiens
agcgagtctggagacca

SEQ ID NO: 424004 - DNA, 15 bp, Homo sapiens
agcgatatacagatg

SEQ ID NO: 424005 - DNA, 17 bp, Homo sapiens
agcgatatacagatgaa

SEQ ID NO: 424006 - DNA, 20 bp, Homo sapiens
agcgatatacagatgaaaat

SEQ ID NO: 424007 - DNA, 18 bp, Homo sapiens
agcgatggtctcagaaac

SEQ ID NO: 424008 - DNA, 23 bp, Homo sapiens
agcgattattatctaaagtgtgt

SEQ ID NO: 424009 - DNA, 13 bp, Homo sapiens
agcgcacttccca

SEQ ID NO: 424010 - DNA, 19 bp, Homo sapiens
agcgcaggtttagtttact

SEQ ID NO: 424011 - DNA, 20 bp, Homo sapiens
agcgccccgcccccacccct

SEQ ID NO: 424012 - DNA, 16 bp, Homo sapiens
agcgcccgctgggctg

SEQ ID NO: 424013 - DNA, 13 bp, Homo sapiens
agcgcctcctgga

SEQ ID NO: 424014 - DNA, 15 bp, Homo sapiens
agcgcctcctggaca

SEQ ID NO: 424015 - DNA, 24 bp, Homo sapiens
agcgcctgtgctgaggactccctc

SEQ ID NO: 424016 - DNA, 11 bp, Homo sapiens
agcgctgccca

SEQ ID NO: 424017 - DNA, 14 bp, Homo sapiens
agcgctgcccacac

SEQ ID NO: 424018 - DNA, 12 bp, Homo sapiens
agcgctggcctc

SEQ ID NO: 424019 - DNA, 13 bp, Homo sapiens
agcgctggcctct

SEQ ID NO: 424020 - DNA, 16 bp, Homo sapiens
agcgctggcctcttcc

SEQ ID NO: 424021 - DNA, 15 bp, Homo sapiens
agcggaaaagttgtc

SEQ ID NO: 424022 - DNA, 12 bp, Homo sapiens
agcggcccctcc

SEQ ID NO: 424023 - DNA, 13 bp, Homo sapiens
agcggcccctccc

SEQ ID NO: 424024 - DNA, 14 bp, Homo sapiens
agcggcccctccca

SEQ ID NO: 424025 - DNA, 15 bp, Homo sapiens
agcggcccggcccac

SEQ ID NO: 424026 - DNA, 17 bp, Homo sapiens
agcggcccggcccacgc

SEQ ID NO: 424027 - DNA, 19 bp, Homo sapiens
agcggcccggcccacgcag

SEQ ID NO: 424028 - DNA, 21 bp, Homo sapiens
agcggcccggcccacgcagag

SEQ ID NO: 424029 - DNA, 23 bp, Homo sapiens
agcggcccggcccacgcagagcc

SEQ ID NO: 424030 - DNA, 23 bp, Homo sapiens
agcggccgatgggagtctccctc

SEQ ID NO: 424031 - DNA, 14 bp, Homo sapiens
agcggccgcctgtc

SEQ ID NO: 424032 - DNA, 16 bp, Homo sapiens
agcggccgcctgtcct

SEQ ID NO: 424033 - DNA, 15 bp, Homo sapiens
agcggctgaggacgg

SEQ ID NO: 424034 - DNA, 23 bp, Homo sapiens
agcggctgaggacggggcagagc

SEQ ID NO: 424035 - DNA, 14 bp, Homo sapiens
agcgggacctgtgg

SEQ ID NO: 424036 - DNA, 15 bp, Homo sapiens
agcgggacctgtggc

SEQ ID NO: 424037 - DNA, 14 bp, Homo sapiens
agcgggcagggccg

SEQ ID NO: 424038 - DNA, 13 bp, Homo sapiens
agcgggccctctg

SEQ ID NO: 424039 - DNA, 16 bp, Homo sapiens
agcgggccctctgccg

SEQ ID NO: 424040 - DNA, 17 bp, Homo sapiens
agcgggccctctgccga

SEQ ID NO: 424041 - DNA, 19 bp, Homo sapiens
agcgggggctaactggccc

SEQ ID NO: 424042 - DNA, 20 bp, Homo sapiens
agcgggggctaactggcccc

SEQ ID NO: 424043 - DNA, 21 bp, Homo sapiens
agcgggggctaactggcccca

SEQ ID NO: 424044 - DNA, 22 bp, Homo sapiens
agcgggggctaactggccccag

SEQ ID NO: 424045 - DNA, 16 bp, Homo sapiens
agcgggtaaaaagaga

SEQ ID NO: 424046 - DNA, 12 bp, Homo sapiens
agcgggtggggt

SEQ ID NO: 424047 - DNA, 19 bp, Homo sapiens
agcggtggaaggagcctgc

SEQ ID NO: 424048 - DNA, 23 bp, Homo sapiens
agcggtggaaggagcctgcggct

SEQ ID NO: 424049 - DNA, 14 bp, Homo sapiens
agcggtttggggag

SEQ ID NO: 424050 - DNA, 19 bp, Homo sapiens
agcgtctcccttggccacg

SEQ ID NO: 424051 - DNA, 22 bp, Homo sapiens
agcgtctcccttggccacggcc

SEQ ID NO: 424052 - DNA, 15 bp, Homo sapiens
agcgtgcataagtta

SEQ ID NO: 424053 - DNA, 21 bp, Homo sapiens
agcgtggcgcagtggccctga

SEQ ID NO: 424054 - DNA, 15 bp, Homo sapiens
agcgtggtcccgagg

SEQ ID NO: 424055 - DNA, 20 bp, Homo sapiens
agcgtgtagcgtcctgagga

SEQ ID NO: 424056 - DNA, 16 bp, Homo sapiens
agcgttctggactctg

SEQ ID NO: 424057 - DNA, 18 bp, Homo sapiens
agcgttctggactctgcc

SEQ ID NO: 424058 - DNA, 21 bp, Homo sapiens
agcgttctggactctgcccca

SEQ ID NO: 424059 - DNA, 13 bp, Homo sapiens
agcgttcttcagg

SEQ ID NO: 424060 - DNA, 20 bp, Homo sapiens
agcgttcttcaggagatgat

SEQ ID NO: 424061 - DNA, 16 bp, Homo sapiens
agcgtttgctgtgcca

SEQ ID NO: 424062 - DNA, 21 bp, Homo sapiens
agctaaaataaaccagactca

SEQ ID NO: 424063 - DNA, 16 bp, Homo sapiens
agctaaaatgatttta

SEQ ID NO: 424064 - DNA, 14 bp, Homo sapiens
agctaaaattttta

SEQ ID NO: 424065 - DNA, 22 bp, Homo sapiens
agctaacattttaaataaaaga

SEQ ID NO: 424066 - DNA, 17 bp, Homo sapiens
agctaataaaatatcat

SEQ ID NO: 424067 - DNA, 23 bp, Homo sapiens
agctaataaaatatcattcagca

SEQ ID NO: 424068 - DNA, 12 bp, Homo sapiens
agctaataaatc

SEQ ID NO: 424069 - DNA, 17 bp, Homo sapiens
agctaatctgtagggct

SEQ ID NO: 424070 - DNA, 19 bp, Homo sapiens
agctaatctgtagggctgg

SEQ ID NO: 424071 - DNA, 20 bp, Homo sapiens
agctaatctgtagggctgga

SEQ ID NO: 424072 - DNA, 18 bp, Homo sapiens
agctacaatcctaccttt

SEQ ID NO: 424073 - DNA, 17 bp, Homo sapiens
agctacaggggaggctg

SEQ ID NO: 424074 - DNA, 13 bp, Homo sapiens
agctacattcctc

SEQ ID NO: 424075 - DNA, 16 bp, Homo sapiens
agctacattcctcagc

SEQ ID NO: 424076 - DNA, 21 bp, Homo sapiens
agctacctgagacgggcatcg

SEQ ID NO: 424077 - DNA, 16 bp, Homo sapiens
agctactaacctggag

SEQ ID NO: 424078 - DNA, 18 bp, Homo sapiens
agctactaacctggagac

SEQ ID NO: 424079 - DNA, 22 bp, Homo sapiens
agctactaacctggagacagta

SEQ ID NO: 424080 - DNA, 22 bp, Homo sapiens
agctactatatgcataaacaac

SEQ ID NO: 424081 - DNA, 16 bp, Homo sapiens
agctactctgtccagg

SEQ ID NO: 424082 - DNA, 19 bp, Homo sapiens
agctactctgtccaggcca

SEQ ID NO: 424083 - DNA, 22 bp, Homo sapiens
agctactctgtccaggccactg

SEQ ID NO: 424084 - DNA, 18 bp, Homo sapiens
agctactgcggaaaagga

SEQ ID NO: 424085 - DNA, 14 bp, Homo sapiens
agctacttgggagg

SEQ ID NO: 424086 - DNA, 17 bp, Homo sapiens
agctacttgggaggctg

SEQ ID NO: 424087 - DNA, 15 bp, Homo sapiens
agctagaaagtggca

SEQ ID NO: 424088 - DNA, 22 bp, Homo sapiens
agctagaaagtggcagagccag

SEQ ID NO: 424089 - DNA, 16 bp, Homo sapiens
agctagaatatcctat

SEQ ID NO: 424090 - DNA, 18 bp, Homo sapiens
agctagacaaaggcccag

SEQ ID NO: 424091 - DNA, 20 bp, Homo sapiens
agctagacaaaggcccagaa

SEQ ID NO: 424092 - DNA, 15 bp, Homo sapiens
agctagactaggaga

SEQ ID NO: 424093 - DNA, 17 bp, Homo sapiens
agctagactaggagacc

SEQ ID NO: 424094 - DNA, 21 bp, Homo sapiens
agctagactggagtgaggctt

SEQ ID NO: 424095 - DNA, 23 bp, Homo sapiens
agctagagaggggcctctggctg

SEQ ID NO: 424096 - DNA, 23 bp, Homo sapiens
agctagctatttctatgtatgtg

SEQ ID NO: 424097 - DNA, 15 bp, Homo sapiens
agctaggaaaggcag

SEQ ID NO: 424098 - DNA, 19 bp, Homo sapiens
agctaggaaaggcagaaac

SEQ ID NO: 424099 - DNA, 13 bp, Homo sapiens
agctaggactgag

SEQ ID NO: 424100 - DNA, 20 bp, Homo sapiens
agctaggttaataggaggac

SEQ ID NO: 424101 - DNA, 13 bp, Homo sapiens
agctagtatcttc

SEQ ID NO: 424102 - DNA, 16 bp, Homo sapiens
agctagtatcttcaaa

SEQ ID NO: 424103 - DNA, 16 bp, Homo sapiens
agctagttatgtgaga

SEQ ID NO: 424104 - DNA, 21 bp, Homo sapiens
agctagtttaaaattattaaa

SEQ ID NO: 424105 - DNA, 12 bp, Homo sapiens
agctataacatt

SEQ ID NO: 424106 - DNA, 13 bp, Homo sapiens
agctataacattt

SEQ ID NO: 424107 - DNA, 16 bp, Homo sapiens
agctataatgtttccc

SEQ ID NO: 424108 - DNA, 15 bp, Homo sapiens
agctatatccatgta

SEQ ID NO: 424109 - DNA, 22 bp, Homo sapiens
agctatatccatgtactgtagt

SEQ ID NO: 424110 - DNA, 22 bp, Homo sapiens
agctatcaagtgtgctttagct

SEQ ID NO: 424111 - DNA, 18 bp, Homo sapiens
agctatcagtgttcttct

SEQ ID NO: 424112 - DNA, 17 bp, Homo sapiens
agctatctagatagctg

SEQ ID NO: 424113 - DNA, 18 bp, Homo sapiens
agctatgagagatgtgtc

SEQ ID NO: 424114 - DNA, 22 bp, Homo sapiens
agctatgcacaccaaattgctg

SEQ ID NO: 424115 - DNA, 18 bp, Homo sapiens
agctatgggagccccagg

SEQ ID NO: 424116 - DNA, 22 bp, Homo sapiens
agctatgggagccccagggtct

SEQ ID NO: 424117 - DNA, 15 bp, Homo sapiens
agctattactgtctg

SEQ ID NO: 424118 - DNA, 16 bp, Homo sapiens
agctattcacacacac

SEQ ID NO: 424119 - DNA, 12 bp, Homo sapiens
agctattctttg

SEQ ID NO: 424120 - DNA, 22 bp, Homo sapiens
agctattctttgaccaaactgt

SEQ ID NO: 424121 - DNA, 15 bp, Homo sapiens
agctatttctatgta

SEQ ID NO: 424122 - DNA, 16 bp, Homo sapiens
agctatttctatgtat

SEQ ID NO: 424123 - DNA, 23 bp, Homo sapiens
agctcaaatgtatatttaacttc

SEQ ID NO: 424124 - DNA, 14 bp, Homo sapiens
agctcacccaaggt

SEQ ID NO: 424125 - DNA, 15 bp, Homo sapiens
agctcacccaaggtc

SEQ ID NO: 424126 - DNA, 18 bp, Homo sapiens
agctcacccaaggtcacc

SEQ ID NO: 424127 - DNA, 15 bp, Homo sapiens
agctcacccctgggc

SEQ ID NO: 424128 - DNA, 18 bp, Homo sapiens
agctcacccctgggcagg

SEQ ID NO: 424129 - DNA, 21 bp, Homo sapiens
agctcagaatagatctgatgg

SEQ ID NO: 424130 - DNA, 17 bp, Homo sapiens
agctcagagcagcctct

SEQ ID NO: 424131 - DNA, 15 bp, Homo sapiens
agctcagcagttcac

SEQ ID NO: 424132 - DNA, 17 bp, Homo sapiens
agctcagcagttcactt

SEQ ID NO: 424133 - DNA, 16 bp, Homo sapiens
agctcagcccaccccc

SEQ ID NO: 424134 - DNA, 16 bp, Homo sapiens
agctcagccccggcca

SEQ ID NO: 424135 - DNA, 14 bp, Homo sapiens
agctcaggagaagg

SEQ ID NO: 424136 - DNA, 15 bp, Homo sapiens
agctcaggagaaggc

SEQ ID NO: 424137 - DNA, 19 bp, Homo sapiens
agctcaggagaaggcctgc

SEQ ID NO: 424138 - DNA, 13 bp, Homo sapiens
agctcaggagaga

SEQ ID NO: 424139 - DNA, 17 bp, Homo sapiens
agctcaggcgcagccct

SEQ ID NO: 424140 - DNA, 14 bp, Homo sapiens
agctcaggggcagc

SEQ ID NO: 424141 - DNA, 19 bp, Homo sapiens
agctcagtttatccaaggt

SEQ ID NO: 424142 - DNA, 16 bp, Homo sapiens
agctcagtttggctgt

SEQ ID NO: 424143 - DNA, 15 bp, Homo sapiens
agctcatattttgta

SEQ ID NO: 424144 - DNA, 18 bp, Homo sapiens
agctcatattttgtatat

SEQ ID NO: 424145 - DNA, 20 bp, Homo sapiens
agctccacagggtgggatga

SEQ ID NO: 424146 - DNA, 16 bp, Homo sapiens
agctccaccctcccct

SEQ ID NO: 424147 - DNA, 22 bp, Homo sapiens
agctccacggtgcgtggctgtg

SEQ ID NO: 424148 - DNA, 14 bp, Homo sapiens
agctccactcaggg

SEQ ID NO: 424149 - DNA, 22 bp, Homo sapiens
agctccactcagggctggcccg

SEQ ID NO: 424150 - DNA, 16 bp, Homo sapiens
agctccactctgaagt

SEQ ID NO: 424151 - DNA, 15 bp, Homo sapiens
agctccactggcctg

SEQ ID NO: 424152 - DNA, 18 bp, Homo sapiens
agctccagacccccagca

SEQ ID NO: 424153 - DNA, 19 bp, Homo sapiens
agctccagacccccagcaa

SEQ ID NO: 424154 - DNA, 22 bp, Homo sapiens
agctccagcccgagtggtctcc

SEQ ID NO: 424155 - DNA, 14 bp, Homo sapiens
agctccagtcctgc

SEQ ID NO: 424156 - DNA, 15 bp, Homo sapiens
agctccagttttcgt

SEQ ID NO: 424157 - DNA, 10 bp, Homo sapiens
agctccatgt

SEQ ID NO: 424158 - DNA, 17 bp, Homo sapiens
agctccatgtttagaaa

SEQ ID NO: 424159 - DNA, 15 bp, Homo sapiens
agctccccaggagct

SEQ ID NO: 424160 - DNA, 23 bp, Homo sapiens
agctcccctggagccagcagggc

SEQ ID NO: 424161 - DNA, 14 bp, Homo sapiens
agctccctcccgca

SEQ ID NO: 424162 - DNA, 13 bp, Homo sapiens
agctccctcgctg

SEQ ID NO: 424163 - DNA, 23 bp, Homo sapiens
agctcccttctctgtagggaact

SEQ ID NO: 424164 - DNA, 22 bp, Homo sapiens
agctcctcctcttggagctgag

SEQ ID NO: 424165 - DNA, 24 bp, Homo sapiens
agctcctctccttgggctcctggc

SEQ ID NO: 424166 - DNA, 15 bp, Homo sapiens
agctcctctgggcag

SEQ ID NO: 424167 - DNA, 20 bp, Homo sapiens
agctcctctgggcaggacct

SEQ ID NO: 424168 - DNA, 20 bp, Homo sapiens
agctcctcttaccgtagcct

SEQ ID NO: 424169 - DNA, 12 bp, Homo sapiens
agctccttcagt

SEQ ID NO: 424170 - DNA, 16 bp, Homo sapiens
agctccttcatgcttt

SEQ ID NO: 424171 - DNA, 21 bp, Homo sapiens
agctccttcatgcttttctca

SEQ ID NO: 424172 - DNA, 22 bp, Homo sapiens
agctccttcatgcttttctcat

SEQ ID NO: 424173 - DNA, 15 bp, Homo sapiens
agctccttggagcag

SEQ ID NO: 424174 - DNA, 15 bp, Homo sapiens
agctccttttctgtg

SEQ ID NO: 424175 - DNA, 18 bp, Homo sapiens
agctcggaacttactgtg

SEQ ID NO: 424176 - DNA, 18 bp, Homo sapiens
agctcgtgtatcctgggg

SEQ ID NO: 424177 - DNA, 19 bp, Homo sapiens
agctcgtttttcagcaccc

SEQ ID NO: 424178 - DNA, 17 bp, Homo sapiens
agctctacacaacatgt

SEQ ID NO: 424179 - DNA, 17 bp, Homo sapiens
agctctagacaaccctg

SEQ ID NO: 424180 - DNA, 13 bp, Homo sapiens
agctctatctgca

SEQ ID NO: 424181 - DNA, 17 bp, Homo sapiens
agctctatctgcaatgt

SEQ ID NO: 424182 - DNA, 18 bp, Homo sapiens
agctctatctgcaatgtt

SEQ ID NO: 424183 - DNA, 17 bp, Homo sapiens
agctctcagttgcagcc

SEQ ID NO: 424184 - DNA, 19 bp, Homo sapiens
agctctcccacatcccact

SEQ ID NO: 424185 - DNA, 13 bp, Homo sapiens
agctctcccctgc

SEQ ID NO: 424186 - DNA, 23 bp, Homo sapiens
agctctcccctgcgcaggccctc

SEQ ID NO: 424187 - DNA, 15 bp, Homo sapiens
agctctcctgggcca

SEQ ID NO: 424188 - DNA, 22 bp, Homo sapiens
agctctcctgggccagggtctc

SEQ ID NO: 424189 - DNA, 22 bp, Homo sapiens
agctctcggaactgcatgctgc

SEQ ID NO: 424190 - DNA, 12 bp, Homo sapiens
agctctctcaga

SEQ ID NO: 424191 - DNA, 16 bp, Homo sapiens
agctctcttgccgagg

SEQ ID NO: 424192 - DNA, 21 bp, Homo sapiens
agctctgcagcaatattctga

SEQ ID NO: 424193 - DNA, 16 bp, Homo sapiens
agctctgcatgtgtgt

SEQ ID NO: 424194 - DNA, 13 bp, Homo sapiens
agctctgcccccg

SEQ ID NO: 424195 - DNA, 19 bp, Homo sapiens
agctctgcccccgcgggtt

SEQ ID NO: 424196 - DNA, 12 bp, Homo sapiens
agctctgcttgc

SEQ ID NO: 424197 - DNA, 20 bp, Homo sapiens
agctctggctcacagactgg

SEQ ID NO: 424198 - DNA, 13 bp, Homo sapiens
agctctggtggga

SEQ ID NO: 424199 - DNA, 15 bp, Homo sapiens
agctctgtcctctgt

SEQ ID NO: 424200 - DNA, 16 bp, Homo sapiens
agctctgtcctctgtc

SEQ ID NO: 424201 - DNA, 15 bp, Homo sapiens
agctctgtggcctgt

SEQ ID NO: 424202 - DNA, 15 bp, Homo sapiens
agctctgtgttgcca

SEQ ID NO: 424203 - DNA, 18 bp, Homo sapiens
agctctgtgttgccatgt

SEQ ID NO: 424204 - DNA, 13 bp, Homo sapiens
agctcttcaggcc

SEQ ID NO: 424205 - DNA, 16 bp, Homo sapiens
agctcttcaggcctcc

SEQ ID NO: 424206 - DNA, 18 bp, Homo sapiens
agctcttcaggcctccct

SEQ ID NO: 424207 - DNA, 17 bp, Homo sapiens
agctcttctccccaggt

SEQ ID NO: 424208 - DNA, 12 bp, Homo sapiens
agctcttctggg

SEQ ID NO: 424209 - DNA, 16 bp, Homo sapiens
agctcttctgggcaga

SEQ ID NO: 424210 - DNA, 17 bp, Homo sapiens
agctcttctgggcagag

SEQ ID NO: 424211 - DNA, 16 bp, Homo sapiens
agctcttcttgtgaaa

SEQ ID NO: 424212 - DNA, 14 bp, Homo sapiens
agctcttctttttt

SEQ ID NO: 424213 - DNA, 18 bp, Homo sapiens
agctcttggcaggagtgg

SEQ ID NO: 424214 - DNA, 13 bp, Homo sapiens
agctctttcctcc

SEQ ID NO: 424215 - DNA, 15 bp, Homo sapiens
agctctttcctcctt

SEQ ID NO: 424216 - DNA, 22 bp, Homo sapiens
agctctttcctccttccatgga

SEQ ID NO: 424217 - DNA, 23 bp, Homo sapiens
agctctttcctccttccatggaa

SEQ ID NO: 424218 - DNA, 16 bp, Homo sapiens
agctctttggtgccag

SEQ ID NO: 424219 - DNA, 15 bp, Homo sapiens
agctctttgtctcac

SEQ ID NO: 424220 - DNA, 21 bp, Homo sapiens
agctgaaacattccgaagagg

SEQ ID NO: 424221 - DNA, 22 bp, Homo sapiens
agctgaaacattccgaagaggg

SEQ ID NO: 424222 - DNA, 14 bp, Homo sapiens
agctgaaccccctc

SEQ ID NO: 424223 - DNA, 12 bp, Homo sapiens
agctgaagaaaa

SEQ ID NO: 424224 - DNA, 14 bp, Homo sapiens
agctgaagccgcca

SEQ ID NO: 424225 - DNA, 22 bp, Homo sapiens
agctgaatattttttatttcta

SEQ ID NO: 424226 - DNA, 20 bp, Homo sapiens
agctgacacataatttgaat

SEQ ID NO: 424227 - DNA, 16 bp, Homo sapiens
agctgacccagcccct

SEQ ID NO: 424228 - DNA, 17 bp, Homo sapiens
agctgacctctgttgtc

SEQ ID NO: 424229 - DNA, 22 bp, Homo sapiens
agctgacctctgttgtcctccc

SEQ ID NO: 424230 - DNA, 16 bp, Homo sapiens
agctgacgaggctggg

SEQ ID NO: 424231 - DNA, 17 bp, Homo sapiens
agctgacgaggctgggc

SEQ ID NO: 424232 - DNA, 18 bp, Homo sapiens
agctgacgaggctgggcc

SEQ ID NO: 424233 - DNA, 17 bp, Homo sapiens
agctgactggccccagg

SEQ ID NO: 424234 - DNA, 18 bp, Homo sapiens
agctgactgtggccccct

SEQ ID NO: 424235 - DNA, 14 bp, Homo sapiens
agctgagagacttt

SEQ ID NO: 424236 - DNA, 15 bp, Homo sapiens
agctgagagactttt

SEQ ID NO: 424237 - DNA, 16 bp, Homo sapiens
agctgagatgagcccc

SEQ ID NO: 424238 - DNA, 14 bp, Homo sapiens
agctgagatgtgga

SEQ ID NO: 424239 - DNA, 13 bp, Homo sapiens
agctgagcttgag

SEQ ID NO: 424240 - DNA, 22 bp, Homo sapiens
agctgagcttgagctcccctgg

SEQ ID NO: 424241 - DNA, 13 bp, Homo sapiens
agctgagtcacct

SEQ ID NO: 424242 - DNA, 17 bp, Homo sapiens
agctgagtcacctcctc

SEQ ID NO: 424243 - DNA, 20 bp, Homo sapiens
agctgagtcggctgggcagg

SEQ ID NO: 424244 - DNA, 15 bp, Homo sapiens
agctgatccagagca

SEQ ID NO: 424245 - DNA, 11 bp, Homo sapiens
agctgatgaaa

SEQ ID NO: 424246 - DNA, 22 bp, Homo sapiens
agctgatgaaactcacaaatga

SEQ ID NO: 424247 - DNA, 23 bp, Homo sapiens
agctgatgttttgtattttgtgt

SEQ ID NO: 424248 - DNA, 20 bp, Homo sapiens
agctgattactgtcaataaa

SEQ ID NO: 424249 - DNA, 22 bp, Homo sapiens
agctgattactgtcaataaaca

SEQ ID NO: 424250 - DNA, 16 bp, Homo sapiens
agctgatttccaggcc

SEQ ID NO: 424251 - DNA, 19 bp, Homo sapiens
agctgattttaacaataac

SEQ ID NO: 424252 - DNA, 20 bp, Homo sapiens
agctgattttaacaataact

SEQ ID NO: 424253 - DNA, 14 bp, Homo sapiens
agctgcacattcct

SEQ ID NO: 424254 - DNA, 15 bp, Homo sapiens
agctgcacattcctg

SEQ ID NO: 424255 - DNA, 19 bp, Homo sapiens
agctgcacattcctggccc

SEQ ID NO: 424256 - DNA, 22 bp, Homo sapiens
agctgcacattcctggccccgg

SEQ ID NO: 424257 - DNA, 19 bp, Homo sapiens
agctgcagcgcctcctgga

SEQ ID NO: 424258 - DNA, 13 bp, Homo sapiens
agctgcagctggg

SEQ ID NO: 424259 - DNA, 15 bp, Homo sapiens
agctgcagctgggcc

SEQ ID NO: 424260 - DNA, 17 bp, Homo sapiens
agctgcagctgggcccc

SEQ ID NO: 424261 - DNA, 19 bp, Homo sapiens
agctgcagctgggccccat

SEQ ID NO: 424262 - DNA, 22 bp, Homo sapiens
agctgcagctgggccccatgct

SEQ ID NO: 424263 - DNA, 11 bp, Homo sapiens
agctgcagctt

SEQ ID NO: 424264 - DNA, 15 bp, Homo sapiens
agctgcaggtgccca

SEQ ID NO: 424265 - DNA, 19 bp, Homo sapiens
agctgcatggacgcctggc

SEQ ID NO: 424266 - DNA, 24 bp, Homo sapiens
agctgcatggacgcctggctccag

SEQ ID NO: 424267 - DNA, 15 bp, Homo sapiens
agctgccaaaaagaa

SEQ ID NO: 424268 - DNA, 15 bp, Homo sapiens
agctgccagtgctgg

SEQ ID NO: 424269 - DNA, 17 bp, Homo sapiens
agctgcccacaagccat

SEQ ID NO: 424270 - DNA, 18 bp, Homo sapiens
agctgcccccgctcatgg

SEQ ID NO: 424271 - DNA, 19 bp, Homo sapiens
agctgcccccgctcatggg

SEQ ID NO: 424272 - DNA, 20 bp, Homo sapiens
agctgcctctcggtggccag

SEQ ID NO: 424273 - DNA, 16 bp, Homo sapiens
agctgcctctgacagc

SEQ ID NO: 424274 - DNA, 19 bp, Homo sapiens
agctgcctctgacagcagc

SEQ ID NO: 424275 - DNA, 18 bp, Homo sapiens
agctgcctgaaacagcca

SEQ ID NO: 424276 - DNA, 19 bp, Homo sapiens
agctgcctgaaacagccat

SEQ ID NO: 424277 - DNA, 17 bp, Homo sapiens
agctgcctgctctgcag

SEQ ID NO: 424278 - DNA, 19 bp, Homo sapiens
agctgcctgctctgcagcc

SEQ ID NO: 424279 - DNA, 23 bp, Homo sapiens
agctgcctgctctgcagcccaca

SEQ ID NO: 424280 - DNA, 18 bp, Homo sapiens
agctgcctgtagttagga

SEQ ID NO: 424281 - DNA, 19 bp, Homo sapiens
agctgcctgtagttaggaa

SEQ ID NO: 424282 - DNA, 18 bp, Homo sapiens
agctgccttcctcatccc

SEQ ID NO: 424283 - DNA, 12 bp, Homo sapiens
agctgctcccct

SEQ ID NO: 424284 - DNA, 14 bp, Homo sapiens
agctgctctccttc

SEQ ID NO: 424285 - DNA, 11 bp, Homo sapiens
agctgctctgc

SEQ ID NO: 424286 - DNA, 13 bp, Homo sapiens
agctgctctgccc

SEQ ID NO: 424287 - DNA, 15 bp, Homo sapiens
agctgctctgcccag

SEQ ID NO: 424288 - DNA, 14 bp, Homo sapiens
agctgctctgcccc

SEQ ID NO: 424289 - DNA, 17 bp, Homo sapiens
agctgctctgccccttg

SEQ ID NO: 424290 - DNA, 21 bp, Homo sapiens
agctgctctgccccttgggca

SEQ ID NO: 424291 - DNA, 21 bp, Homo sapiens
agctgctcttgcatctgggcc

SEQ ID NO: 424292 - DNA, 15 bp, Homo sapiens
agctgctggccaggg

SEQ ID NO: 424293 - DNA, 14 bp, Homo sapiens
agctgctggcttgc

SEQ ID NO: 424294 - DNA, 10 bp, Homo sapiens
agctgctgtg

SEQ ID NO: 424295 - DNA, 16 bp, Homo sapiens
agctgctgtgccagga

SEQ ID NO: 424296 - DNA, 22 bp, Homo sapiens
agctgctgtgccaggactgtga

SEQ ID NO: 424297 - DNA, 19 bp, Homo sapiens
agctgcttccagttggact

SEQ ID NO: 424298 - DNA, 22 bp, Homo sapiens
agctgcttggacctcgtgcttt

SEQ ID NO: 424299 - DNA, 23 bp, Homo sapiens
agctgcttggacctcgtgcttta

SEQ ID NO: 424300 - DNA, 20 bp, Homo sapiens
agctgctttgttaccttaaa

SEQ ID NO: 424301 - DNA, 21 bp, Homo sapiens
agctgctttgttaccttaaaa

SEQ ID NO: 424302 - DNA, 22 bp, Homo sapiens
agctgctttgttaccttaaaac

SEQ ID NO: 424303 - DNA, 16 bp, Homo sapiens
agctggacaagaagct

SEQ ID NO: 424304 - DNA, 17 bp, Homo sapiens
agctggacaagaagctg

SEQ ID NO: 424305 - DNA, 16 bp, Homo sapiens
agctggacatgctttg

SEQ ID NO: 424306 - DNA, 19 bp, Homo sapiens
agctggacatgctttggca

SEQ ID NO: 424307 - DNA, 15 bp, Homo sapiens
agctggaccagtggt

SEQ ID NO: 424308 - DNA, 14 bp, Homo sapiens
agctggagtgctgc

SEQ ID NO: 424309 - DNA, 12 bp, Homo sapiens
agctggcagcgc

SEQ ID NO: 424310 - DNA, 13 bp, Homo sapiens
agctggcagcgcc

SEQ ID NO: 424311 - DNA, 15 bp, Homo sapiens
agctggcagcgcctc

SEQ ID NO: 424312 - DNA, 15 bp, Homo sapiens
agctggcaggacaca

SEQ ID NO: 424313 - DNA, 19 bp, Homo sapiens
agctggcaggacacatccc

SEQ ID NO: 424314 - DNA, 19 bp, Homo sapiens
agctggcaggagacactgg

SEQ ID NO: 424315 - DNA, 21 bp, Homo sapiens
agctggcaggagggtggcact

SEQ ID NO: 424316 - DNA, 21 bp, Homo sapiens
agctggccgagggtcctggct

SEQ ID NO: 424317 - DNA, 23 bp, Homo sapiens
agctggccgagggtcctggctcc

SEQ ID NO: 424318 - DNA, 15 bp, Homo sapiens
agctggcggaacctg

SEQ ID NO: 424319 - DNA, 18 bp, Homo sapiens
agctggcgtctgtcttca

SEQ ID NO: 424320 - DNA, 20 bp, Homo sapiens
agctggctcctctataggag

SEQ ID NO: 424321 - DNA, 13 bp, Homo sapiens
agctggctgggtc

SEQ ID NO: 424322 - DNA, 19 bp, Homo sapiens
agctggctgggtcgcccct

SEQ ID NO: 424323 - DNA, 21 bp, Homo sapiens
agctggctgggtcgcccctcc

SEQ ID NO: 424324 - DNA, 22 bp, Homo sapiens
agctggctgggtcgcccctcct

SEQ ID NO: 424325 - DNA, 17 bp, Homo sapiens
agctgggactacaggtg

SEQ ID NO: 424326 - DNA, 10 bp, Homo sapiens
agctgggcaa

SEQ ID NO: 424327 - DNA, 17 bp, Homo sapiens
agctgggcatggtacca

SEQ ID NO: 424328 - DNA, 22 bp, Homo sapiens
agctgggcatggtaccagccct

SEQ ID NO: 424329 - DNA, 16 bp, Homo sapiens
agctgggccccaccta

SEQ ID NO: 424330 - DNA, 19 bp, Homo sapiens
agctgggccccatgctctg

SEQ ID NO: 424331 - DNA, 21 bp, Homo sapiens
agctgggccccatgctctgcc

SEQ ID NO: 424332 - DNA, 20 bp, Homo sapiens
agctggggaatcccctcgct

SEQ ID NO: 424333 - DNA, 23 bp, Homo sapiens
agctggggcccctcggctacccc

SEQ ID NO: 424334 - DNA, 14 bp, Homo sapiens
agctggggccggag

SEQ ID NO: 424335 - DNA, 22 bp, Homo sapiens
agctggggcttcaccagtctgt

SEQ ID NO: 424336 - DNA, 18 bp, Homo sapiens
agctgggggccatgagct

SEQ ID NO: 424337 - DNA, 17 bp, Homo sapiens
agctggggggctgtcct

SEQ ID NO: 424338 - DNA, 18 bp, Homo sapiens
agctggggggctgtcctg

SEQ ID NO: 424339 - DNA, 15 bp, Homo sapiens
agctgggtaccaggc

SEQ ID NO: 424340 - DNA, 22 bp, Homo sapiens
agctggtagttagtagcatgtt

SEQ ID NO: 424341 - DNA, 18 bp, Homo sapiens
agctggtgacagccttgg

SEQ ID NO: 424342 - DNA, 17 bp, Homo sapiens
agctggtggatggtgac

SEQ ID NO: 424343 - DNA, 22 bp, Homo sapiens
agctggtggtgcagccttcccc

SEQ ID NO: 424344 - DNA, 18 bp, Homo sapiens
agctggtgtcactctgcc

SEQ ID NO: 424345 - DNA, 22 bp, Homo sapiens
agctggtgtcactctgcctcta

SEQ ID NO: 424346 - DNA, 15 bp, Homo sapiens
agctggtttcctcat

SEQ ID NO: 424347 - DNA, 17 bp, Homo sapiens
agctgtaagaagagact

SEQ ID NO: 424348 - DNA, 13 bp, Homo sapiens
agctgtactcaga

SEQ ID NO: 424349 - DNA, 19 bp, Homo sapiens
agctgtactcagagcagag

SEQ ID NO: 424350 - DNA, 20 bp, Homo sapiens
agctgtactcagagcagagc

SEQ ID NO: 424351 - DNA, 15 bp, Homo sapiens
agctgtagaaatgta

SEQ ID NO: 424352 - DNA, 16 bp, Homo sapiens
agctgtagccatggct

SEQ ID NO: 424353 - DNA, 19 bp, Homo sapiens
agctgtagccatggctcag

SEQ ID NO: 424354 - DNA, 19 bp, Homo sapiens
agctgtatatttgaaactg

SEQ ID NO: 424355 - DNA, 11 bp, Homo sapiens
agctgtatcaa

SEQ ID NO: 424356 - DNA, 21 bp, Homo sapiens
agctgtcacttcgcgtgccct

SEQ ID NO: 424357 - DNA, 13 bp, Homo sapiens
agctgtcaggcag

SEQ ID NO: 424358 - DNA, 17 bp, Homo sapiens
agctgtcccctctccct

SEQ ID NO: 424359 - DNA, 19 bp, Homo sapiens
agctgtcccctctccctgg

SEQ ID NO: 424360 - DNA, 21 bp, Homo sapiens
agctgtcctctcagaactcct

SEQ ID NO: 424361 - DNA, 19 bp, Homo sapiens
agctgtctcaaacctccaa

SEQ ID NO: 424362 - DNA, 17 bp, Homo sapiens
agctgtgaaatgtgcaa

SEQ ID NO: 424363 - DNA, 13 bp, Homo sapiens
agctgtgaaattg

SEQ ID NO: 424364 - DNA, 17 bp, Homo sapiens
agctgtgaaattgaagt

SEQ ID NO: 424365 - DNA, 15 bp, Homo sapiens
agctgtggggagctg

SEQ ID NO: 424366 - DNA, 15 bp, Homo sapiens
agctgtggttttctt

SEQ ID NO: 424367 - DNA, 22 bp, Homo sapiens
agctgtggttttcttttgccat

SEQ ID NO: 424368 - DNA, 13 bp, Homo sapiens
agctgtgtctctg

SEQ ID NO: 424369 - DNA, 13 bp, Homo sapiens
agctgtgtgtttt

SEQ ID NO: 424370 - DNA, 21 bp, Homo sapiens
agctgtgtgttttcaatcctt

SEQ ID NO: 424371 - DNA, 18 bp, Homo sapiens
agctgttatcttgtgtat

SEQ ID NO: 424372 - DNA, 14 bp, Homo sapiens
agctgttcctgtgt

SEQ ID NO: 424373 - DNA, 21 bp, Homo sapiens
agctgtttatggcctcagctg

SEQ ID NO: 424374 - DNA, 18 bp, Homo sapiens
agctgttttggatgaatg

SEQ ID NO: 424375 - DNA, 17 bp, Homo sapiens
agcttaaaaaaaggaaa

SEQ ID NO: 424376 - DNA, 19 bp, Homo sapiens
agcttaaaaaaaggaaaac

SEQ ID NO: 424377 - DNA, 12 bp, Homo sapiens
agcttaaaataa

SEQ ID NO: 424378 - DNA, 13 bp, Homo sapiens
agcttaaaataag

SEQ ID NO: 424379 - DNA, 15 bp, Homo sapiens
agcttaaaataagtg

SEQ ID NO: 424380 - DNA, 16 bp, Homo sapiens
agcttaaaataagtga

SEQ ID NO: 424381 - DNA, 16 bp, Homo sapiens
agcttaactaatttga

SEQ ID NO: 424382 - DNA, 14 bp, Homo sapiens
agcttaaggagagg

SEQ ID NO: 424383 - DNA, 17 bp, Homo sapiens
agcttaaggagaggaga

SEQ ID NO: 424384 - DNA, 17 bp, Homo sapiens
agcttacaagccagctg

SEQ ID NO: 424385 - DNA, 19 bp, Homo sapiens
agcttacaagccagctgga

SEQ ID NO: 424386 - DNA, 18 bp, Homo sapiens
agcttacaggaagctttt

SEQ ID NO: 424387 - DNA, 17 bp, Homo sapiens
agcttacctcccacctt

SEQ ID NO: 424388 - DNA, 20 bp, Homo sapiens
agcttagccttgtgccctgc

SEQ ID NO: 424389 - DNA, 21 bp, Homo sapiens
agcttagccttgtgccctgcc

SEQ ID NO: 424390 - DNA, 14 bp, Homo sapiens
agcttatctccctg

SEQ ID NO: 424391 - DNA, 14 bp, Homo sapiens
agcttattaatgct

SEQ ID NO: 424392 - DNA, 15 bp, Homo sapiens
agcttattaatgcta

SEQ ID NO: 424393 - DNA, 16 bp, Homo sapiens
agcttattaatgctaa

SEQ ID NO: 424394 - DNA, 18 bp, Homo sapiens
agcttattaatgctaagg

SEQ ID NO: 424395 - DNA, 22 bp, Homo sapiens
agcttattaatgctaagggcag

SEQ ID NO: 424396 - DNA, 12 bp, Homo sapiens
agcttatttcta

SEQ ID NO: 424397 - DNA, 16 bp, Homo sapiens
agcttatttctaacta

SEQ ID NO: 424398 - DNA, 13 bp, Homo sapiens
agcttcaaaacag

SEQ ID NO: 424399 - DNA, 14 bp, Homo sapiens
agcttcaaaacaga

SEQ ID NO: 424400 - DNA, 21 bp, Homo sapiens
agcttcaagtctgtgcctgga

SEQ ID NO: 424401 - DNA, 24 bp, Homo sapiens
agcttcaagtctgtgcctggagct

SEQ ID NO: 424402 - DNA, 16 bp, Homo sapiens
agcttcaccctgtcaa

SEQ ID NO: 424403 - DNA, 21 bp, Homo sapiens
agcttcagaagtttggcaata

SEQ ID NO: 424404 - DNA, 19 bp, Homo sapiens
agcttcagttgttttcccg

SEQ ID NO: 424405 - DNA, 15 bp, Homo sapiens
agcttcatgcctttg

SEQ ID NO: 424406 - DNA, 20 bp, Homo sapiens
agcttcatgcctttgtaagt

SEQ ID NO: 424407 - DNA, 20 bp, Homo sapiens
agcttcatttgtgtcaatgg

SEQ ID NO: 424408 - DNA, 15 bp, Homo sapiens
agcttccatgtttaa

SEQ ID NO: 424409 - DNA, 23 bp, Homo sapiens
agcttccattccaagcctgacca

SEQ ID NO: 424410 - DNA, 13 bp, Homo sapiens
agcttcctgaggg

SEQ ID NO: 424411 - DNA, 15 bp, Homo sapiens
agcttcctgagggct

SEQ ID NO: 424412 - DNA, 15 bp, Homo sapiens
agcttcctgtttcta

SEQ ID NO: 424413 - DNA, 18 bp, Homo sapiens
agcttcggttctccagaa

SEQ ID NO: 424414 - DNA, 22 bp, Homo sapiens
agcttcggttctccagaatgta

SEQ ID NO: 424415 - DNA, 16 bp, Homo sapiens
agcttcgtgctggagg

SEQ ID NO: 424416 - DNA, 20 bp, Homo sapiens
agcttctaattttgtgctct

SEQ ID NO: 424417 - DNA, 23 bp, Homo sapiens
agcttctagtgatttctggggcc

SEQ ID NO: 424418 - DNA, 12 bp, Homo sapiens
agcttctctgcc

SEQ ID NO: 424419 - DNA, 13 bp, Homo sapiens
agcttctctgtga

SEQ ID NO: 424420 - DNA, 17 bp, Homo sapiens
agcttctggtactctcc

SEQ ID NO: 424421 - DNA, 19 bp, Homo sapiens
agcttctggtactctccta

SEQ ID NO: 424422 - DNA, 23 bp, Homo sapiens
agcttctggtactctcctagaga

SEQ ID NO: 424423 - DNA, 22 bp, Homo sapiens
agcttcttaatataactgcctt

SEQ ID NO: 424424 - DNA, 16 bp, Homo sapiens
agcttcttgctcctgt

SEQ ID NO: 424425 - DNA, 18 bp, Homo sapiens
agcttcttgcttgtaaaa

SEQ ID NO: 424426 - DNA, 22 bp, Homo sapiens
agcttcttgcttgtaaaaatat

SEQ ID NO: 424427 - DNA, 16 bp, Homo sapiens
agcttgaaagttttca

SEQ ID NO: 424428 - DNA, 17 bp, Homo sapiens
agcttgaaagttttcag

SEQ ID NO: 424429 - DNA, 22 bp, Homo sapiens
agcttgaaagttttcagaacct

SEQ ID NO: 424430 - DNA, 22 bp, Homo sapiens
agcttgaagatcgttagtatct

SEQ ID NO: 424431 - DNA, 15 bp, Homo sapiens
agcttgagcctcccc

SEQ ID NO: 424432 - DNA, 17 bp, Homo sapiens
agcttgagcctccccca

SEQ ID NO: 424433 - DNA, 21 bp, Homo sapiens
agcttgagcctcccccaaagc

SEQ ID NO: 424434 - DNA, 20 bp, Homo sapiens
agcttgctgcaccccaagtc

SEQ ID NO: 424435 - DNA, 14 bp, Homo sapiens
agcttggcagccga

SEQ ID NO: 424436 - DNA, 17 bp, Homo sapiens
agcttggcatggtggca

SEQ ID NO: 424437 - DNA, 14 bp, Homo sapiens
agcttggccagaag

SEQ ID NO: 424438 - DNA, 12 bp, Homo sapiens
agcttgggccca

SEQ ID NO: 424439 - DNA, 20 bp, Homo sapiens
agcttggggaacccatgagt

SEQ ID NO: 424440 - DNA, 18 bp, Homo sapiens
agcttgggtttttgttac

SEQ ID NO: 424441 - DNA, 13 bp, Homo sapiens
agcttggtggtta

SEQ ID NO: 424442 - DNA, 17 bp, Homo sapiens
agcttggtggttatgtc

SEQ ID NO: 424443 - DNA, 18 bp, Homo sapiens
agcttgtatagtgtaaaa

SEQ ID NO: 424444 - DNA, 22 bp, Homo sapiens
agcttgtctatggtacaaaaat

SEQ ID NO: 424445 - DNA, 16 bp, Homo sapiens
agcttgttatttataa

SEQ ID NO: 424446 - DNA, 17 bp, Homo sapiens
agcttgtttccctgctg

SEQ ID NO: 424447 - DNA, 14 bp, Homo sapiens
agcttgtttctata

SEQ ID NO: 424448 - DNA, 19 bp, Homo sapiens
agcttgtttctatactgtt

SEQ ID NO: 424449 - DNA, 13 bp, Homo sapiens
agcttgttttgga

SEQ ID NO: 424450 - DNA, 21 bp, Homo sapiens
agcttgttttggactttgtta

SEQ ID NO: 424451 - DNA, 17 bp, Homo sapiens
agctttaaaaaataaag

SEQ ID NO: 424452 - DNA, 19 bp, Homo sapiens
agctttacatgcaatttat

SEQ ID NO: 424453 - DNA, 13 bp, Homo sapiens
agctttaccctca

SEQ ID NO: 424454 - DNA, 18 bp, Homo sapiens
agctttaccctcaggcat

SEQ ID NO: 424455 - DNA, 16 bp, Homo sapiens
agctttcaagtgcctt

SEQ ID NO: 424456 - DNA, 16 bp, Homo sapiens
agctttcagagccagt

SEQ ID NO: 424457 - DNA, 12 bp, Homo sapiens
agctttccctgg

SEQ ID NO: 424458 - DNA, 13 bp, Homo sapiens
agctttccctggc

SEQ ID NO: 424459 - DNA, 14 bp, Homo sapiens
agctttccctggct

SEQ ID NO: 424460 - DNA, 14 bp, Homo sapiens
agctttcctgcccc

SEQ ID NO: 424461 - DNA, 15 bp, Homo sapiens
agctttcctgcccca

SEQ ID NO: 424462 - DNA, 22 bp, Homo sapiens
agctttcctgccccaggcctga

SEQ ID NO: 424463 - DNA, 12 bp, Homo sapiens
agctttctcctt

SEQ ID NO: 424464 - DNA, 14 bp, Homo sapiens
agctttctcctttg

SEQ ID NO: 424465 - DNA, 22 bp, Homo sapiens
agctttcttctacaaccagagc

SEQ ID NO: 424466 - DNA, 19 bp, Homo sapiens
agctttggacacacacagc

SEQ ID NO: 424467 - DNA, 14 bp, Homo sapiens
agctttggacgcac

SEQ ID NO: 424468 - DNA, 20 bp, Homo sapiens
agctttggacgcacacagct

SEQ ID NO: 424469 - DNA, 14 bp, Homo sapiens
agcttttactgttt

SEQ ID NO: 424470 - DNA, 16 bp, Homo sapiens
agcttttcccttcttt

SEQ ID NO: 424471 - DNA, 19 bp, Homo sapiens
agcttttgaaatccagaag

SEQ ID NO: 424472 - DNA, 15 bp, Homo sapiens
agcttttgttctaga

SEQ ID NO: 424473 - DNA, 15 bp, Homo sapiens
agctttttaaaacat

SEQ ID NO: 424474 - DNA, 22 bp, Homo sapiens
agctttttaccgttcacttccc

SEQ ID NO: 424475 - DNA, 14 bp, Homo sapiens
agcttttttcttta

SEQ ID NO: 424476 - DNA, 20 bp, Homo sapiens
aggaaaaacaaaacaaagaa

SEQ ID NO: 424477 - DNA, 23 bp, Homo sapiens
aggaaaaacagaggatgctgaag

SEQ ID NO: 424478 - DNA, 19 bp, Homo sapiens
aggaaaactcaccatttca

SEQ ID NO: 424479 - DNA, 20 bp, Homo sapiens
aggaaaactcaccatttcat

SEQ ID NO: 424480 - DNA, 12 bp, Homo sapiens
aggaaaactgtt

SEQ ID NO: 424481 - DNA, 13 bp, Homo sapiens
aggaaaaggctgg

SEQ ID NO: 424482 - DNA, 22 bp, Homo sapiens
aggaaaagtacatttaatacag

SEQ ID NO: 424483 - DNA, 16 bp, Homo sapiens
aggaaaatagtttagg

SEQ ID NO: 424484 - DNA, 19 bp, Homo sapiens
aggaaaatagtttaggaga

SEQ ID NO: 424485 - DNA, 14 bp, Homo sapiens
aggaaacagaaaag

SEQ ID NO: 424486 - DNA, 20 bp, Homo sapiens
aggaaacagaaaagagaaga

SEQ ID NO: 424487 - DNA, 16 bp, Homo sapiens
aggaaactcacctgct

SEQ ID NO: 424488 - DNA, 23 bp, Homo sapiens
aggaaactcacctgctggcccct

SEQ ID NO: 424489 - DNA, 17 bp, Homo sapiens
aggaaagatcccaagtc

SEQ ID NO: 424490 - DNA, 18 bp, Homo sapiens
aggaaagcaataaatgaa

SEQ ID NO: 424491 - DNA, 22 bp, Homo sapiens
aggaaagcaataaatgaatggg

SEQ ID NO: 424492 - DNA, 22 bp, Homo sapiens
aggaaagcatgtctctgcttcc

SEQ ID NO: 424493 - DNA, 13 bp, Homo sapiens
aggaaagggaagg

SEQ ID NO: 424494 - DNA, 14 bp, Homo sapiens
aggaaataaaacct

SEQ ID NO: 424495 - DNA, 16 bp, Homo sapiens
aggaaataaaaccttt

SEQ ID NO: 424496 - DNA, 19 bp, Homo sapiens
aggaaataaaacctttcaa

SEQ ID NO: 424497 - DNA, 20 bp, Homo sapiens
aggaaataaaacctttcaaa

SEQ ID NO: 424498 - DNA, 17 bp, Homo sapiens
aggaaataatgggaaag

SEQ ID NO: 424499 - DNA, 21 bp, Homo sapiens
aggaaatagtaccttcaatac

SEQ ID NO: 424500 - DNA, 14 bp, Homo sapiens
aggaaatctcaccc

SEQ ID NO: 424501 - DNA, 12 bp, Homo sapiens
aggaaattaaat

SEQ ID NO: 424502 - DNA, 16 bp, Homo sapiens
aggaacaaggcaaggc

SEQ ID NO: 424503 - DNA, 23 bp, Homo sapiens
aggaacaaggcaaggctgtcaat

SEQ ID NO: 424504 - DNA, 13 bp, Homo sapiens
aggaacacccagc

SEQ ID NO: 424505 - DNA, 14 bp, Homo sapiens
aggaacacccagcc

SEQ ID NO: 424506 - DNA, 17 bp, Homo sapiens
aggaacacccagcccca

SEQ ID NO: 424507 - DNA, 18 bp, Homo sapiens
aggaacacccggaaagac

SEQ ID NO: 424508 - DNA, 19 bp, Homo sapiens
aggaacagagtatatatgt

SEQ ID NO: 424509 - DNA, 19 bp, Homo sapiens
aggaacctggaccaaagct

SEQ ID NO: 424510 - DNA, 18 bp, Homo sapiens
aggaacgagcactggcca

SEQ ID NO: 424511 - DNA, 21 bp, Homo sapiens
aggaacgagcactggccagag

SEQ ID NO: 424512 - DNA, 18 bp, Homo sapiens
aggaacgtggttcagaga

SEQ ID NO: 424513 - DNA, 20 bp, Homo sapiens
aggaacgtggttcagagact

SEQ ID NO: 424514 - DNA, 22 bp, Homo sapiens
aggaacgtggttcagagactgg

SEQ ID NO: 424515 - DNA, 23 bp, Homo sapiens
aggaacgtggttcagagactggc

SEQ ID NO: 424516 - DNA, 14 bp, Homo sapiens
aggaactccttggc

SEQ ID NO: 424517 - DNA, 15 bp, Homo sapiens
aggaactgaaaacca

SEQ ID NO: 424518 - DNA, 14 bp, Homo sapiens
aggaacttgctgct

SEQ ID NO: 424519 - DNA, 19 bp, Homo sapiens
aggaacttgctgctgtgcc

SEQ ID NO: 424520 - DNA, 22 bp, Homo sapiens
aggaacttgctgctgtgcctgc

SEQ ID NO: 424521 - DNA, 14 bp, Homo sapiens
aggaagaaaaatca

SEQ ID NO: 424522 - DNA, 16 bp, Homo sapiens
aggaagaaaaatcagt

SEQ ID NO: 424523 - DNA, 18 bp, Homo sapiens
aggaagaaggcccgggag

SEQ ID NO: 424524 - DNA, 23 bp, Homo sapiens
aggaagaatggtgtgtttcccta

SEQ ID NO: 424525 - DNA, 14 bp, Homo sapiens
aggaagactggaga

SEQ ID NO: 424526 - DNA, 18 bp, Homo sapiens
aggaagacttggcccagg

SEQ ID NO: 424527 - DNA, 14 bp, Homo sapiens
aggaagagggacag

SEQ ID NO: 424528 - DNA, 20 bp, Homo sapiens
aggaagatcactttgctctg

SEQ ID NO: 424529 - DNA, 18 bp, Homo sapiens
aggaagatcttaaatttt

SEQ ID NO: 424530 - DNA, 19 bp, Homo sapiens
aggaagatcttgagagctg

SEQ ID NO: 424531 - DNA, 20 bp, Homo sapiens
aggaagatcttgagagctgc

SEQ ID NO: 424532 - DNA, 17 bp, Homo sapiens
aggaagcaaggccagcc

SEQ ID NO: 424533 - DNA, 12 bp, Homo sapiens
aggaagcacagg

SEQ ID NO: 424534 - DNA, 20 bp, Homo sapiens
aggaagcacaggccagggga

SEQ ID NO: 424535 - DNA, 18 bp, Homo sapiens
aggaagcaccccatgcca

SEQ ID NO: 424536 - DNA, 21 bp, Homo sapiens
aggaagcagagcactgtgtaa

SEQ ID NO: 424537 - DNA, 11 bp, Homo sapiens
aggaagcaggg

SEQ ID NO: 424538 - DNA, 20 bp, Homo sapiens
aggaagccgcctagtgcaga

SEQ ID NO: 424539 - DNA, 16 bp, Homo sapiens
aggaagcctaaataaa

SEQ ID NO: 424540 - DNA, 19 bp, Homo sapiens
aggaagctccagtcctgct

SEQ ID NO: 424541 - DNA, 21 bp, Homo sapiens
aggaagctccagtcctgctct

SEQ ID NO: 424542 - DNA, 22 bp, Homo sapiens
aggaagctttctctgcttcagc

SEQ ID NO: 424543 - DNA, 14 bp, Homo sapiens
aggaaggcagctgc

SEQ ID NO: 424544 - DNA, 13 bp, Homo sapiens
aggaaggcctggg

SEQ ID NO: 424545 - DNA, 14 bp, Homo sapiens
aggaaggcctgggt

SEQ ID NO: 424546 - DNA, 21 bp, Homo sapiens
aggaaggcgtgtccaggagac

SEQ ID NO: 424547 - DNA, 15 bp, Homo sapiens
aggaagggagaggag

SEQ ID NO: 424548 - DNA, 20 bp, Homo sapiens
aggaagggcatccttctgcc

SEQ ID NO: 424549 - DNA, 12 bp, Homo sapiens
aggaaggggctg

SEQ ID NO: 424550 - DNA, 17 bp, Homo sapiens
aggaaggggctggactg

SEQ ID NO: 424551 - DNA, 21 bp, Homo sapiens
aggaagggggtctaaggtcta

SEQ ID NO: 424552 - DNA, 15 bp, Homo sapiens
aggaaggtgctgagc

SEQ ID NO: 424553 - DNA, 15 bp, Homo sapiens
aggaagtagcaggcc

SEQ ID NO: 424554 - DNA, 19 bp, Homo sapiens
aggaagtcaggagccagca

SEQ ID NO: 424555 - DNA, 20 bp, Homo sapiens
aggaagtccctgagaagcct

SEQ ID NO: 424556 - DNA, 18 bp, Homo sapiens
aggaagtgacttgaatgt

SEQ ID NO: 424557 - DNA, 19 bp, Homo sapiens
aggaagtgacttgaatgta

SEQ ID NO: 424558 - DNA, 23 bp, Homo sapiens
aggaagtgacttgaatgtacaaa

SEQ ID NO: 424559 - DNA, 15 bp, Homo sapiens
aggaagtgataacac

SEQ ID NO: 424560 - DNA, 18 bp, Homo sapiens
aggaagtgataacactgg

SEQ ID NO: 424561 - DNA, 17 bp, Homo sapiens
aggaagtgggagaagtg

SEQ ID NO: 424562 - DNA, 18 bp, Homo sapiens
aggaagtgggagaagtgg

SEQ ID NO: 424563 - DNA, 21 bp, Homo sapiens
aggaagtgggagaagtggccc

SEQ ID NO: 424564 - DNA, 18 bp, Homo sapiens
aggaagtgtaacagctga

SEQ ID NO: 424565 - DNA, 13 bp, Homo sapiens
aggaataaataaa

SEQ ID NO: 424566 - DNA, 20 bp, Homo sapiens
aggaataaattgctccttga

SEQ ID NO: 424567 - DNA, 16 bp, Homo sapiens
aggaataattatttat

SEQ ID NO: 424568 - DNA, 18 bp, Homo sapiens
aggaatagcatgtcacta

SEQ ID NO: 424569 - DNA, 17 bp, Homo sapiens
aggaatagccagagagg

SEQ ID NO: 424570 - DNA, 18 bp, Homo sapiens
aggaataggtaggagacc

SEQ ID NO: 424571 - DNA, 22 bp, Homo sapiens
aggaatatacatagtctttgtt

SEQ ID NO: 424572 - DNA, 21 bp, Homo sapiens
aggaatatccagtcaaagacg

SEQ ID NO: 424573 - DNA, 14 bp, Homo sapiens
aggaatctgccttc

SEQ ID NO: 424574 - DNA, 15 bp, Homo sapiens
aggaatctgccttcc

SEQ ID NO: 424575 - DNA, 17 bp, Homo sapiens
aggaatctgccttccag

SEQ ID NO: 424576 - DNA, 18 bp, Homo sapiens
aggaatctgccttccagc

SEQ ID NO: 424577 - DNA, 20 bp, Homo sapiens
aggaatctgccttccagccc

SEQ ID NO: 424578 - DNA, 23 bp, Homo sapiens
aggaatctgccttccagcccaga

SEQ ID NO: 424579 - DNA, 12 bp, Homo sapiens
aggaatgcaaga

SEQ ID NO: 424580 - DNA, 17 bp, Homo sapiens
aggaatgcctgtgccaa

SEQ ID NO: 424581 - DNA, 21 bp, Homo sapiens
aggaatgcctgtgccaataaa

SEQ ID NO: 424582 - DNA, 19 bp, Homo sapiens
aggaatgcggttcagggct

SEQ ID NO: 424583 - DNA, 12 bp, Homo sapiens
aggaatgctcaa

SEQ ID NO: 424584 - DNA, 15 bp, Homo sapiens
aggaatgctcaatgt

SEQ ID NO: 424585 - DNA, 16 bp, Homo sapiens
aggaatgctcaatgtg

SEQ ID NO: 424586 - DNA, 20 bp, Homo sapiens
aggaatgctcccccatcctc

SEQ ID NO: 424587 - DNA, 12 bp, Homo sapiens
aggaatgtttca

SEQ ID NO: 424588 - DNA, 21 bp, Homo sapiens
aggaattaaactaaaatacaa

SEQ ID NO: 424589 - DNA, 17 bp, Homo sapiens
aggaattgacttcagca

SEQ ID NO: 424590 - DNA, 16 bp, Homo sapiens
aggacaaacagtgaat

SEQ ID NO: 424591 - DNA, 18 bp, Homo sapiens
aggacaaagagaataaag

SEQ ID NO: 424592 - DNA, 19 bp, Homo sapiens
aggacacatcccggcctct

SEQ ID NO: 424593 - DNA, 11 bp, Homo sapiens
aggacacatgt

SEQ ID NO: 424594 - DNA, 17 bp, Homo sapiens
aggacagacagaaggca

SEQ ID NO: 424595 - DNA, 15 bp, Homo sapiens
aggacagacttagga

SEQ ID NO: 424596 - DNA, 19 bp, Homo sapiens
aggacagctgcaggtgccc

SEQ ID NO: 424597 - DNA, 11 bp, Homo sapiens
aggacaggaaa

SEQ ID NO: 424598 - DNA, 21 bp, Homo sapiens
aggacaggaggaggagatggc

SEQ ID NO: 424599 - DNA, 20 bp, Homo sapiens
aggacaggggcatctctggg

SEQ ID NO: 424600 - DNA, 21 bp, Homo sapiens
aggacagtgctgaccccagga

SEQ ID NO: 424601 - DNA, 20 bp, Homo sapiens
aggacataaattagaggtct

SEQ ID NO: 424602 - DNA, 18 bp, Homo sapiens
aggacattgccccaagat

SEQ ID NO: 424603 - DNA, 19 bp, Homo sapiens
aggacattgccccaagata

SEQ ID NO: 424604 - DNA, 20 bp, Homo sapiens
aggaccaagcttaaggagag

SEQ ID NO: 424605 - DNA, 23 bp, Homo sapiens
aggaccaagcttaaggagaggag

SEQ ID NO: 424606 - DNA, 16 bp, Homo sapiens
aggaccacagtgggtg

SEQ ID NO: 424607 - DNA, 19 bp, Homo sapiens
aggaccacagtgggtggca

SEQ ID NO: 424608 - DNA, 12 bp, Homo sapiens
aggaccactcct

SEQ ID NO: 424609 - DNA, 12 bp, Homo sapiens
aggaccaggact

SEQ ID NO: 424610 - DNA, 16 bp, Homo sapiens
aggaccaggactccct

SEQ ID NO: 424611 - DNA, 18 bp, Homo sapiens
aggaccaggactccctcc

SEQ ID NO: 424612 - DNA, 19 bp, Homo sapiens
aggaccaggactccctcct

SEQ ID NO: 424613 - DNA, 21 bp, Homo sapiens
aggaccaggactccctcctca

SEQ ID NO: 424614 - DNA, 19 bp, Homo sapiens
aggacccacactgctacac

SEQ ID NO: 424615 - DNA, 12 bp, Homo sapiens
aggacccaggcc

SEQ ID NO: 424616 - DNA, 23 bp, Homo sapiens
aggacccctcaccttgcaacaca

SEQ ID NO: 424617 - DNA, 20 bp, Homo sapiens
aggacccggaggggcctggc

SEQ ID NO: 424618 - DNA, 22 bp, Homo sapiens
aggacccggaggggcctggcag

SEQ ID NO: 424619 - DNA, 19 bp, Homo sapiens
aggaccctgagggtttcca

SEQ ID NO: 424620 - DNA, 16 bp, Homo sapiens
aggaccctgggtcacc

SEQ ID NO: 424621 - DNA, 23 bp, Homo sapiens
aggaccctgggtcaccttcctgg

SEQ ID NO: 424622 - DNA, 19 bp, Homo sapiens
aggacctccacctgggaga

SEQ ID NO: 424623 - DNA, 13 bp, Homo sapiens
aggacctctgggc

SEQ ID NO: 424624 - DNA, 14 bp, Homo sapiens
aggacggggcagag

SEQ ID NO: 424625 - DNA, 17 bp, Homo sapiens
aggacggggcagagctg

SEQ ID NO: 424626 - DNA, 18 bp, Homo sapiens
aggacgtggactggggta

SEQ ID NO: 424627 - DNA, 20 bp, Homo sapiens
aggacgtggactggggtagg

SEQ ID NO: 424628 - DNA, 20 bp, Homo sapiens
aggactaacataaaatctgt

SEQ ID NO: 424629 - DNA, 21 bp, Homo sapiens
aggactagaaaaacttgggtc

SEQ ID NO: 424630 - DNA, 14 bp, Homo sapiens
aggactcaggcctg

SEQ ID NO: 424631 - DNA, 16 bp, Homo sapiens
aggactccctcctcac

SEQ ID NO: 424632 - DNA, 23 bp, Homo sapiens
aggactccctcctcacctctgga

SEQ ID NO: 424633 - DNA, 18 bp, Homo sapiens
aggactccgggaccattg

SEQ ID NO: 424634 - DNA, 14 bp, Homo sapiens
aggactctgcctcc

SEQ ID NO: 424635 - DNA, 13 bp, Homo sapiens
aggactctgcctt

SEQ ID NO: 424636 - DNA, 22 bp, Homo sapiens
aggactgacctgcccctgccgc

SEQ ID NO: 424637 - DNA, 14 bp, Homo sapiens
aggactgaggagtg

SEQ ID NO: 424638 - DNA, 21 bp, Homo sapiens
aggactgccccgtgcagactg

SEQ ID NO: 424639 - DNA, 17 bp, Homo sapiens
aggactgccgaccgagg

SEQ ID NO: 424640 - DNA, 21 bp, Homo sapiens
aggactgccgaccgaggctgg

SEQ ID NO: 424641 - DNA, 22 bp, Homo sapiens
aggactgccgaccgaggctgga

SEQ ID NO: 424642 - DNA, 18 bp, Homo sapiens
aggactgtataggtagat

SEQ ID NO: 424643 - DNA, 22 bp, Homo sapiens
aggactgttttttcctgagctt

SEQ ID NO: 424644 - DNA, 21 bp, Homo sapiens
aggacttaacggctccaggat

SEQ ID NO: 424645 - DNA, 22 bp, Homo sapiens
aggacttcaaaaggtgattaaa

SEQ ID NO: 424646 - DNA, 14 bp, Homo sapiens
aggacttcctgcta

SEQ ID NO: 424647 - DNA, 22 bp, Homo sapiens
aggacttcctgctacagtagct

SEQ ID NO: 424648 - DNA, 21 bp, Homo sapiens
aggacttgaaagcatccatgt

SEQ ID NO: 424649 - DNA, 13 bp, Homo sapiens
aggacttgccctc

SEQ ID NO: 424650 - DNA, 16 bp, Homo sapiens
aggacttggggtcagg

SEQ ID NO: 424651 - DNA, 16 bp, Homo sapiens
aggacttgtgcctctt

SEQ ID NO: 424652 - DNA, 14 bp, Homo sapiens
aggagaaacacatc

SEQ ID NO: 424653 - DNA, 14 bp, Homo sapiens
aggagaaggagagg

SEQ ID NO: 424654 - DNA, 13 bp, Homo sapiens
aggagaagttggt

SEQ ID NO: 424655 - DNA, 16 bp, Homo sapiens
aggagacaaagcagga

SEQ ID NO: 424656 - DNA, 17 bp, Homo sapiens
aggagacaaagcaggag

SEQ ID NO: 424657 - DNA, 18 bp, Homo sapiens
aggagacaaagcaggagt

SEQ ID NO: 424658 - DNA, 21 bp, Homo sapiens
aggagacaaagcaggagtgga

SEQ ID NO: 424659 - DNA, 13 bp, Homo sapiens
aggagacactggt

SEQ ID NO: 424660 - DNA, 21 bp, Homo sapiens
aggagacactggtctcagagg

SEQ ID NO: 424661 - DNA, 19 bp, Homo sapiens
aggagacagtcaggaagcc

SEQ ID NO: 424662 - DNA, 15 bp, Homo sapiens
aggagaccagaagtg

SEQ ID NO: 424663 - DNA, 18 bp, Homo sapiens
aggagaccagaagtgaat

SEQ ID NO: 424664 - DNA, 14 bp, Homo sapiens
aggagaccctgtct

SEQ ID NO: 424665 - DNA, 17 bp, Homo sapiens
aggagaccctgtctttg

SEQ ID NO: 424666 - DNA, 13 bp, Homo sapiens
aggagacctcttc

SEQ ID NO: 424667 - DNA, 23 bp, Homo sapiens
aggagacgtccaccctgcagcca

SEQ ID NO: 424668 - DNA, 18 bp, Homo sapiens
aggagactggcaagagct

SEQ ID NO: 424669 - DNA, 14 bp, Homo sapiens
aggagacttgtaca

SEQ ID NO: 424670 - DNA, 15 bp, Homo sapiens
aggagacttgtacag

SEQ ID NO: 424671 - DNA, 22 bp, Homo sapiens
aggagagaatgagagagtgtgg

SEQ ID NO: 424672 - DNA, 16 bp, Homo sapiens
aggagagactggccag

SEQ ID NO: 424673 - DNA, 23 bp, Homo sapiens
aggagagactggccagaggcagc

SEQ ID NO: 424674 - DNA, 21 bp, Homo sapiens
aggagagagagagagaaagaa

SEQ ID NO: 424675 - DNA, 22 bp, Homo sapiens
aggagagagagagagaaagaat

SEQ ID NO: 424676 - DNA, 18 bp, Homo sapiens
aggagagcatcaccacca

SEQ ID NO: 424677 - DNA, 18 bp, Homo sapiens
aggagagccaacctcggc

SEQ ID NO: 424678 - DNA, 18 bp, Homo sapiens
aggagagcccaggcctgc

SEQ ID NO: 424679 - DNA, 21 bp, Homo sapiens
aggagagccctctgctgcttt

SEQ ID NO: 424680 - DNA, 14 bp, Homo sapiens
aggagagcctgctg

SEQ ID NO: 424681 - DNA, 18 bp, Homo sapiens
aggagagcctgctgcatg

SEQ ID NO: 424682 - DNA, 20 bp, Homo sapiens
aggagagcctgctgcatggg

SEQ ID NO: 424683 - DNA, 15 bp, Homo sapiens
aggagaggaaaagta

SEQ ID NO: 424684 - DNA, 20 bp, Homo sapiens
aggagaggaaaagtaaggtg

SEQ ID NO: 424685 - DNA, 15 bp, Homo sapiens
aggagaggagagcat

SEQ ID NO: 424686 - DNA, 18 bp, Homo sapiens
aggagaggagagcatctg

SEQ ID NO: 424687 - DNA, 13 bp, Homo sapiens
aggagaggagtgc

SEQ ID NO: 424688 - DNA, 18 bp, Homo sapiens
aggagaggggaagggcca

SEQ ID NO: 424689 - DNA, 19 bp, Homo sapiens
aggagaggggaagggccag

SEQ ID NO: 424690 - DNA, 17 bp, Homo sapiens
aggagagtagaacagat

SEQ ID NO: 424691 - DNA, 17 bp, Homo sapiens
aggagagtgcagatctg

SEQ ID NO: 424692 - DNA, 20 bp, Homo sapiens
aggagagtggttgttgccaa

SEQ ID NO: 424693 - DNA, 20 bp, Homo sapiens
aggagatataaaatctagat

SEQ ID NO: 424694 - DNA, 23 bp, Homo sapiens
aggagatgatgtgatggaacaca

SEQ ID NO: 424695 - DNA, 14 bp, Homo sapiens
aggagatggccata

SEQ ID NO: 424696 - DNA, 22 bp, Homo sapiens
aggagatggccataggagagga

SEQ ID NO: 424697 - DNA, 14 bp, Homo sapiens
aggagatgggcctt

SEQ ID NO: 424698 - DNA, 18 bp, Homo sapiens
aggagattttccttccta

SEQ ID NO: 424699 - DNA, 15 bp, Homo sapiens
aggagcaaacactga

SEQ ID NO: 424700 - DNA, 14 bp, Homo sapiens
aggagcaatgggac

SEQ ID NO: 424701 - DNA, 10 bp, Homo sapiens
aggagcaccc

SEQ ID NO: 424702 - DNA, 11 bp, Homo sapiens
aggagcacccc

SEQ ID NO: 424703 - DNA, 19 bp, Homo sapiens
aggagcacccccagcctcc

SEQ ID NO: 424704 - DNA, 21 bp, Homo sapiens
aggagcacccccagcctcccc

SEQ ID NO: 424705 - DNA, 22 bp, Homo sapiens
aggagcacccccagcctccccc

SEQ ID NO: 424706 - DNA, 16 bp, Homo sapiens
aggagcacctgaaccc

SEQ ID NO: 424707 - DNA, 17 bp, Homo sapiens
aggagcaggaagcaagg

SEQ ID NO: 424708 - DNA, 21 bp, Homo sapiens
aggagcaggaagcaaggccag

SEQ ID NO: 424709 - DNA, 18 bp, Homo sapiens
aggagcattttgtgtctt

SEQ ID NO: 424710 - DNA, 13 bp, Homo sapiens
aggagccttggag

SEQ ID NO: 424711 - DNA, 22 bp, Homo sapiens
aggagcgcgcgtgatagaagaa

SEQ ID NO: 424712 - DNA, 19 bp, Homo sapiens
aggagctagcccagtccct

SEQ ID NO: 424713 - DNA, 24 bp, Homo sapiens
aggagctagcccagtccctggagc

SEQ ID NO: 424714 - DNA, 19 bp, Homo sapiens
aggagctcttcttgtgaaa

SEQ ID NO: 424715 - DNA, 20 bp, Homo sapiens
aggagctcttcttgtgaaat

SEQ ID NO: 424716 - DNA, 22 bp, Homo sapiens
aggagctcttcttgtgaaatgt

SEQ ID NO: 424717 - DNA, 16 bp, Homo sapiens
aggagctgagtcacct

SEQ ID NO: 424718 - DNA, 18 bp, Homo sapiens
aggagctgatttccaggc

SEQ ID NO: 424719 - DNA, 19 bp, Homo sapiens
aggagctgatttccaggcc

SEQ ID NO: 424720 - DNA, 20 bp, Homo sapiens
aggagctgatttccaggccc

SEQ ID NO: 424721 - DNA, 23 bp, Homo sapiens
aggagctgatttccaggcccctg

SEQ ID NO: 424722 - DNA, 16 bp, Homo sapiens
aggagctggctggcag

SEQ ID NO: 424723 - DNA, 19 bp, Homo sapiens
aggagctggctggcaggtg

SEQ ID NO: 424724 - DNA, 15 bp, Homo sapiens
aggagctgggagccg

SEQ ID NO: 424725 - DNA, 17 bp, Homo sapiens
aggagctgggagccggg

SEQ ID NO: 424726 - DNA, 13 bp, Homo sapiens
aggagcttccaga

SEQ ID NO: 424727 - DNA, 17 bp, Homo sapiens
aggagcttttttacaca

SEQ ID NO: 424728 - DNA, 15 bp, Homo sapiens
aggaggaactggtcc

SEQ ID NO: 424729 - DNA, 19 bp, Homo sapiens
aggaggaactggtccaggc

SEQ ID NO: 424730 - DNA, 14 bp, Homo sapiens
aggaggaagcagaa

SEQ ID NO: 424731 - DNA, 15 bp, Homo sapiens
aggaggaagggactg

SEQ ID NO: 424732 - DNA, 16 bp, Homo sapiens
aggaggaagggactgg

SEQ ID NO: 424733 - DNA, 16 bp, Homo sapiens
aggaggacctgggggg

SEQ ID NO: 424734 - DNA, 11 bp, Homo sapiens
aggaggagaaa

SEQ ID NO: 424735 - DNA, 12 bp, Homo sapiens
aggaggatgctg

SEQ ID NO: 424736 - DNA, 22 bp, Homo sapiens
aggaggcagaaagcagaggctg

SEQ ID NO: 424737 - DNA, 21 bp, Homo sapiens
aggaggcagagggttgcagtg

SEQ ID NO: 424738 - DNA, 18 bp, Homo sapiens
aggaggcagccccctcca

SEQ ID NO: 424739 - DNA, 19 bp, Homo sapiens
aggaggcagccccctccac

SEQ ID NO: 424740 - DNA, 15 bp, Homo sapiens
aggaggcctgggagg

SEQ ID NO: 424741 - DNA, 16 bp, Homo sapiens
aggaggcctgggaggg

SEQ ID NO: 424742 - DNA, 14 bp, Homo sapiens
aggaggctggcagt

SEQ ID NO: 424743 - DNA, 19 bp, Homo sapiens
aggaggctttaagctccag

SEQ ID NO: 424744 - DNA, 16 bp, Homo sapiens
aggagggagccttgtg

SEQ ID NO: 424745 - DNA, 14 bp, Homo sapiens
aggagggagctgct

SEQ ID NO: 424746 - DNA, 14 bp, Homo sapiens
aggagggcagagcc

SEQ ID NO: 424747 - DNA, 15 bp, Homo sapiens
aggagggcctcagag

SEQ ID NO: 424748 - DNA, 16 bp, Homo sapiens
aggagggcctcagaga

SEQ ID NO: 424749 - DNA, 19 bp, Homo sapiens
aggagggcctcagagacag

SEQ ID NO: 424750 - DNA, 16 bp, Homo sapiens
aggaggggaagctgca

SEQ ID NO: 424751 - DNA, 19 bp, Homo sapiens
aggaggggaagctgcagct

SEQ ID NO: 424752 - DNA, 16 bp, Homo sapiens
aggaggggtaaatata

SEQ ID NO: 424753 - DNA, 19 bp, Homo sapiens
aggaggggtaaatatatgt

SEQ ID NO: 424754 - DNA, 14 bp, Homo sapiens
aggagggtggagga

SEQ ID NO: 424755 - DNA, 15 bp, Homo sapiens
aggagggtggaggaa

SEQ ID NO: 424756 - DNA, 18 bp, Homo sapiens
aggagggtggaggaaggt

SEQ ID NO: 424757 - DNA, 14 bp, Homo sapiens
aggagggtggcact

SEQ ID NO: 424758 - DNA, 16 bp, Homo sapiens
aggaggtcccaggaag

SEQ ID NO: 424759 - DNA, 13 bp, Homo sapiens
aggaggtgggcca

SEQ ID NO: 424760 - DNA, 15 bp, Homo sapiens
aggaggtgggccaca

SEQ ID NO: 424761 - DNA, 15 bp, Homo sapiens
aggaggtgtggagtg

SEQ ID NO: 424762 - DNA, 16 bp, Homo sapiens
aggaggtgtggagtgg

SEQ ID NO: 424763 - DNA, 17 bp, Homo sapiens
aggaggtgtggagtgga

SEQ ID NO: 424764 - DNA, 18 bp, Homo sapiens
aggaggtgtggagtggag

SEQ ID NO: 424765 - DNA, 21 bp, Homo sapiens
aggaggtgtggagtggagggg

SEQ ID NO: 424766 - DNA, 16 bp, Homo sapiens
aggaggttggtgactg

SEQ ID NO: 424767 - DNA, 19 bp, Homo sapiens
aggaggttggtgactgaaa

SEQ ID NO: 424768 - DNA, 22 bp, Homo sapiens
aggagtaaagataaaaggatag

SEQ ID NO: 424769 - DNA, 15 bp, Homo sapiens
aggagtcctttcttt

SEQ ID NO: 424770 - DNA, 15 bp, Homo sapiens
aggagtctctgccac

SEQ ID NO: 424771 - DNA, 19 bp, Homo sapiens
aggagtctctgccacccac

SEQ ID NO: 424772 - DNA, 16 bp, Homo sapiens
aggagtctgattgcag

SEQ ID NO: 424773 - DNA, 21 bp, Homo sapiens
aggagtgcatggccacagcca

SEQ ID NO: 424774 - DNA, 19 bp, Homo sapiens
aggagtgggtgggacacag

SEQ ID NO: 424775 - DNA, 21 bp, Homo sapiens
aggagtgggtgggacacagag

SEQ ID NO: 424776 - DNA, 19 bp, Homo sapiens
aggagtggtttttcttttc

SEQ ID NO: 424777 - DNA, 22 bp, Homo sapiens
aggagttaaagagcagcctggc

SEQ ID NO: 424778 - DNA, 13 bp, Homo sapiens
aggagttcaatga

SEQ ID NO: 424779 - DNA, 15 bp, Homo sapiens
aggagttcaatgatc

SEQ ID NO: 424780 - DNA, 16 bp, Homo sapiens
aggagttcgagaccaa

SEQ ID NO: 424781 - DNA, 23 bp, Homo sapiens
aggagtttgagacaagccctggc

SEQ ID NO: 424782 - DNA, 20 bp, Homo sapiens
aggataaattaatgagtttt

SEQ ID NO: 424783 - DNA, 19 bp, Homo sapiens
aggataatttttaaaagag

SEQ ID NO: 424784 - DNA, 16 bp, Homo sapiens
aggatagcctttgtag

SEQ ID NO: 424785 - DNA, 15 bp, Homo sapiens
aggataggaaaagat

SEQ ID NO: 424786 - DNA, 16 bp, Homo sapiens
aggatatttaagaaaa

SEQ ID NO: 424787 - DNA, 18 bp, Homo sapiens
aggatatttaagaaaata

SEQ ID NO: 424788 - DNA, 14 bp, Homo sapiens
aggatcacttaagc

SEQ ID NO: 424789 - DNA, 13 bp, Homo sapiens
aggatcccctgct

SEQ ID NO: 424790 - DNA, 12 bp, Homo sapiens
aggatccgctgc

SEQ ID NO: 424791 - DNA, 14 bp, Homo sapiens
aggatccgctgcca

SEQ ID NO: 424792 - DNA, 13 bp, Homo sapiens
aggatcctcctgg

SEQ ID NO: 424793 - DNA, 18 bp, Homo sapiens
aggatcctcctggagcag

SEQ ID NO: 424794 - DNA, 14 bp, Homo sapiens
aggatcctctccac

SEQ ID NO: 424795 - DNA, 18 bp, Homo sapiens
aggatcctctccactcca

SEQ ID NO: 424796 - DNA, 13 bp, Homo sapiens
aggatctctcagg

SEQ ID NO: 424797 - DNA, 21 bp, Homo sapiens
aggatctctcaggagcacagg

SEQ ID NO: 424798 - DNA, 22 bp, Homo sapiens
aggatctctcaggagcacaggc

SEQ ID NO: 424799 - DNA, 14 bp, Homo sapiens
aggatgaaagacaa

SEQ ID NO: 424800 - DNA, 22 bp, Homo sapiens
aggatgaaagacaaagaaggaa

SEQ ID NO: 424801 - DNA, 22 bp, Homo sapiens
aggatgaacatcttttaactgc

SEQ ID NO: 424802 - DNA, 20 bp, Homo sapiens
aggatgaagaacacagcatg

SEQ ID NO: 424803 - DNA, 18 bp, Homo sapiens
aggatgaatgtatgtgca

SEQ ID NO: 424804 - DNA, 20 bp, Homo sapiens
aggatgaatgtatgtgcact

SEQ ID NO: 424805 - DNA, 16 bp, Homo sapiens
aggatgaccaggacta

SEQ ID NO: 424806 - DNA, 13 bp, Homo sapiens
aggatgagcagca

SEQ ID NO: 424807 - DNA, 23 bp, Homo sapiens
aggatgaggccgctagaggcctg

SEQ ID NO: 424808 - DNA, 13 bp, Homo sapiens
aggatgatgtaat

SEQ ID NO: 424809 - DNA, 17 bp, Homo sapiens
aggatgcactggcctgt

SEQ ID NO: 424810 - DNA, 18 bp, Homo sapiens
aggatgctgtgcctccca

SEQ ID NO: 424811 - DNA, 23 bp, Homo sapiens
aggatgggcagctggggggctgt

SEQ ID NO: 424812 - DNA, 22 bp, Homo sapiens
aggatgtggatggaggtgatga

SEQ ID NO: 424813 - DNA, 17 bp, Homo sapiens
aggattaatctctaaaa

SEQ ID NO: 424814 - DNA, 19 bp, Homo sapiens
aggattaggtttagaatca

SEQ ID NO: 424815 - DNA, 14 bp, Homo sapiens
aggattattggaaa

SEQ ID NO: 424816 - DNA, 19 bp, Homo sapiens
aggattccagttgcgtgtc

SEQ ID NO: 424817 - DNA, 16 bp, Homo sapiens
aggattctttccccag

SEQ ID NO: 424818 - DNA, 17 bp, Homo sapiens
aggattctttccccaga

SEQ ID NO: 424819 - DNA, 18 bp, Homo sapiens
aggattctttccccagag

SEQ ID NO: 424820 - DNA, 24 bp, Homo sapiens
aggattctttccccagaggctccc

SEQ ID NO: 424821 - DNA, 16 bp, Homo sapiens
aggattgtacgtggga

SEQ ID NO: 424822 - DNA, 15 bp, Homo sapiens
aggatttaaaaactg

SEQ ID NO: 424823 - DNA, 20 bp, Homo sapiens
aggatttaacagtcatttaa

SEQ ID NO: 424824 - DNA, 18 bp, Homo sapiens
aggatttctaatcaaaag

SEQ ID NO: 424825 - DNA, 16 bp, Homo sapiens
aggatttggttgttta

SEQ ID NO: 424826 - DNA, 17 bp, Homo sapiens
aggatttggtttttctc

SEQ ID NO: 424827 - DNA, 23 bp, Homo sapiens
aggattttaacaaaagcaagact

SEQ ID NO: 424828 - DNA, 18 bp, Homo sapiens
aggattttgtattgccat

SEQ ID NO: 424829 - DNA, 20 bp, Homo sapiens
aggcaaaaaagggacagcat

SEQ ID NO: 424830 - DNA, 21 bp, Homo sapiens
aggcaaaacacgcaagggcat

SEQ ID NO: 424831 - DNA, 23 bp, Homo sapiens
aggcaaaaggcagtggggctggg

SEQ ID NO: 424832 - DNA, 14 bp, Homo sapiens
aggcaaagaggtgc

SEQ ID NO: 424833 - DNA, 16 bp, Homo sapiens
aggcaaagttttccat

SEQ ID NO: 424834 - DNA, 20 bp, Homo sapiens
aggcaaagttttccattttt

SEQ ID NO: 424835 - DNA, 14 bp, Homo sapiens
aggcaaatgtccaa

SEQ ID NO: 424836 - DNA, 23 bp, Homo sapiens
aggcaacacctgtggataaaaca

SEQ ID NO: 424837 - DNA, 17 bp, Homo sapiens
aggcaactgaacaaaaa

SEQ ID NO: 424838 - DNA, 17 bp, Homo sapiens
aggcaacttcagtcctg

SEQ ID NO: 424839 - DNA, 13 bp, Homo sapiens
aggcaagaagtgg

SEQ ID NO: 424840 - DNA, 15 bp, Homo sapiens
aggcaagagaaatga

SEQ ID NO: 424841 - DNA, 21 bp, Homo sapiens
aggcaagattggaaagacagg

SEQ ID NO: 424842 - DNA, 18 bp, Homo sapiens
aggcaagcaagctctctt

SEQ ID NO: 424843 - DNA, 14 bp, Homo sapiens
aggcaagcatgttg

SEQ ID NO: 424844 - DNA, 20 bp, Homo sapiens
aggcaagcccctcagccctt

SEQ ID NO: 424845 - DNA, 14 bp, Homo sapiens
aggcaagctggcag

SEQ ID NO: 424846 - DNA, 17 bp, Homo sapiens
aggcaagctggcaggag

SEQ ID NO: 424847 - DNA, 18 bp, Homo sapiens
aggcaagctggcaggagg

SEQ ID NO: 424848 - DNA, 22 bp, Homo sapiens
aggcaagctggcaggagggtgg

SEQ ID NO: 424849 - DNA, 14 bp, Homo sapiens
aggcaaggctgccg

SEQ ID NO: 424850 - DNA, 19 bp, Homo sapiens
aggcaaggggtgcctggga

SEQ ID NO: 424851 - DNA, 19 bp, Homo sapiens
aggcaatggcctaaacttc

SEQ ID NO: 424852 - DNA, 14 bp, Homo sapiens
aggcacacagctgc

SEQ ID NO: 424853 - DNA, 23 bp, Homo sapiens
aggcacacagctgcagagacaga

SEQ ID NO: 424854 - DNA, 13 bp, Homo sapiens
aggcaccagaaga

SEQ ID NO: 424855 - DNA, 16 bp, Homo sapiens
aggcaccatagaagaa

SEQ ID NO: 424856 - DNA, 23 bp, Homo sapiens
aggcaccatagaagaacagcaga

SEQ ID NO: 424857 - DNA, 20 bp, Homo sapiens
aggcacccctccgtgtggag

SEQ ID NO: 424858 - DNA, 15 bp, Homo sapiens
aggcaccgagaatgt

SEQ ID NO: 424859 - DNA, 15 bp, Homo sapiens
aggcaccgcagcctg

SEQ ID NO: 424860 - DNA, 16 bp, Homo sapiens
aggcaccgcagcctgt

SEQ ID NO: 424861 - DNA, 15 bp, Homo sapiens
aggcaccggcgctgc

SEQ ID NO: 424862 - DNA, 14 bp, Homo sapiens
aggcacctgctgga

SEQ ID NO: 424863 - DNA, 13 bp, Homo sapiens
aggcacctggcct

SEQ ID NO: 424864 - DNA, 17 bp, Homo sapiens
aggcacctggcctgctg

SEQ ID NO: 424865 - DNA, 18 bp, Homo sapiens
aggcacctggcctgctgg

SEQ ID NO: 424866 - DNA, 18 bp, Homo sapiens
aggcactgcgccacctgc

SEQ ID NO: 424867 - DNA, 16 bp, Homo sapiens
aggcactggtggcatc

SEQ ID NO: 424868 - DNA, 20 bp, Homo sapiens
aggcacttatcgaagctgat

SEQ ID NO: 424869 - DNA, 16 bp, Homo sapiens
aggcagaaaactggca

SEQ ID NO: 424870 - DNA, 18 bp, Homo sapiens
aggcagaaaactggcagt

SEQ ID NO: 424871 - DNA, 19 bp, Homo sapiens
aggcagaaagcagaggctg

SEQ ID NO: 424872 - DNA, 15 bp, Homo sapiens
aggcagaaaggagat

SEQ ID NO: 424873 - DNA, 17 bp, Homo sapiens
aggcagaaagggtaggt

SEQ ID NO: 424874 - DNA, 13 bp, Homo sapiens
aggcagaaccagc

SEQ ID NO: 424875 - DNA, 14 bp, Homo sapiens
aggcagaaccctgg

SEQ ID NO: 424876 - DNA, 20 bp, Homo sapiens
aggcagaatcctggccctct

SEQ ID NO: 424877 - DNA, 15 bp, Homo sapiens
aggcagaatggtggg

SEQ ID NO: 424878 - DNA, 20 bp, Homo sapiens
aggcagaatggtgggctcca

SEQ ID NO: 424879 - DNA, 14 bp, Homo sapiens
aggcagactcgagg

SEQ ID NO: 424880 - DNA, 17 bp, Homo sapiens
aggcagactcgagggcc

SEQ ID NO: 424881 - DNA, 23 bp, Homo sapiens
aggcagagaaaacacacgctcct

SEQ ID NO: 424882 - DNA, 23 bp, Homo sapiens
aggcagagattgggggggcttgg

SEQ ID NO: 424883 - DNA, 20 bp, Homo sapiens
aggcagagtgccccacctgc

SEQ ID NO: 424884 - DNA, 16 bp, Homo sapiens
aggcagattgaaaagg

SEQ ID NO: 424885 - DNA, 22 bp, Homo sapiens
aggcagcaacaggaccaggagc

SEQ ID NO: 424886 - DNA, 16 bp, Homo sapiens
aggcagcacctggagc

SEQ ID NO: 424887 - DNA, 15 bp, Homo sapiens
aggcagcaggagcca

SEQ ID NO: 424888 - DNA, 13 bp, Homo sapiens
aggcagccccctc

SEQ ID NO: 424889 - DNA, 16 bp, Homo sapiens
aggcagccccctccac

SEQ ID NO: 424890 - DNA, 15 bp, Homo sapiens
aggcagcctccagag

SEQ ID NO: 424891 - DNA, 17 bp, Homo sapiens
aggcagcctccagagcc

SEQ ID NO: 424892 - DNA, 22 bp, Homo sapiens
aggcagcctccagagccagcct

SEQ ID NO: 424893 - DNA, 17 bp, Homo sapiens
aggcagctaaggggcag

SEQ ID NO: 424894 - DNA, 12 bp, Homo sapiens
aggcagctcacc

SEQ ID NO: 424895 - DNA, 13 bp, Homo sapiens
aggcagctcaccc

SEQ ID NO: 424896 - DNA, 16 bp, Homo sapiens
aggcagctctgtcgtg

SEQ ID NO: 424897 - DNA, 19 bp, Homo sapiens
aggcagctgaaaagtaaat

SEQ ID NO: 424898 - DNA, 14 bp, Homo sapiens
aggcagctgctctt

SEQ ID NO: 424899 - DNA, 16 bp, Homo sapiens
aggcaggaagggcagg

SEQ ID NO: 424900 - DNA, 20 bp, Homo sapiens
aggcaggaagggcaggaagg

SEQ ID NO: 424901 - DNA, 11 bp, Homo sapiens
aggcaggaagt

SEQ ID NO: 424902 - DNA, 22 bp, Homo sapiens
aggcaggcacctgggctttctg

SEQ ID NO: 424903 - DNA, 16 bp, Homo sapiens
aggcagggatttgagg

SEQ ID NO: 424904 - DNA, 13 bp, Homo sapiens
aggcagggcagag

SEQ ID NO: 424905 - DNA, 13 bp, Homo sapiens
aggcagggccctg

SEQ ID NO: 424906 - DNA, 17 bp, Homo sapiens
aggcaggggagtctgct

SEQ ID NO: 424907 - DNA, 17 bp, Homo sapiens
aggcaggggctgggcag

SEQ ID NO: 424908 - DNA, 18 bp, Homo sapiens
aggcaggggctgggcaga

SEQ ID NO: 424909 - DNA, 19 bp, Homo sapiens
aggcaggggctgggcagag

SEQ ID NO: 424910 - DNA, 22 bp, Homo sapiens
aggcagggttttatctctgtct

SEQ ID NO: 424911 - DNA, 15 bp, Homo sapiens
aggcagtccagagct

SEQ ID NO: 424912 - DNA, 14 bp, Homo sapiens
aggcagtctgaacc

SEQ ID NO: 424913 - DNA, 17 bp, Homo sapiens
aggcagtcttctaccaa

SEQ ID NO: 424914 - DNA, 15 bp, Homo sapiens
aggcagtgcatgtga

SEQ ID NO: 424915 - DNA, 22 bp, Homo sapiens
aggcagtgcatgtgaagcatgc

SEQ ID NO: 424916 - DNA, 14 bp, Homo sapiens
aggcagtggcagca

SEQ ID NO: 424917 - DNA, 15 bp, Homo sapiens
aggcagtggcagcaa

SEQ ID NO: 424918 - DNA, 18 bp, Homo sapiens
aggcagttagagatgcct

SEQ ID NO: 424919 - DNA, 15 bp, Homo sapiens
aggcatactctccag

SEQ ID NO: 424920 - DNA, 19 bp, Homo sapiens
aggcatactctccaggatt

SEQ ID NO: 424921 - DNA, 17 bp, Homo sapiens
aggcataggcctgggtg

SEQ ID NO: 424922 - DNA, 15 bp, Homo sapiens
aggcatcattttcac

SEQ ID NO: 424923 - DNA, 20 bp, Homo sapiens
aggcatgaccctggagcccg

SEQ ID NO: 424924 - DNA, 16 bp, Homo sapiens
aggcatgctggcctcc

SEQ ID NO: 424925 - DNA, 19 bp, Homo sapiens
aggcatggcccagcctgga

SEQ ID NO: 424926 - DNA, 22 bp, Homo sapiens
aggcatggcccagcctggagcc

SEQ ID NO: 424927 - DNA, 12 bp, Homo sapiens
aggcattcaagt

SEQ ID NO: 424928 - DNA, 21 bp, Homo sapiens
aggcattgcactaaaagtgat

SEQ ID NO: 424929 - DNA, 22 bp, Homo sapiens
aggcattgcactaaaagtgatg

SEQ ID NO: 424930 - DNA, 21 bp, Homo sapiens
aggcatttgcctaattcctgg

SEQ ID NO: 424931 - DNA, 23 bp, Homo sapiens
aggcatttgcctaattcctggca

SEQ ID NO: 424932 - DNA, 19 bp, Homo sapiens
aggcatttgtaaatattaa

SEQ ID NO: 424933 - DNA, 20 bp, Homo sapiens
aggcatttgtcttagagaga

SEQ ID NO: 424934 - DNA, 21 bp, Homo sapiens
aggcatttgtcttagagagag

SEQ ID NO: 424935 - DNA, 22 bp, Homo sapiens
aggcatttgtcttagagagaga

SEQ ID NO: 424936 - DNA, 22 bp, Homo sapiens
aggccaaatgcacaagctcaga

SEQ ID NO: 424937 - DNA, 15 bp, Homo sapiens
aggccaagcctgcag

SEQ ID NO: 424938 - DNA, 14 bp, Homo sapiens
aggccaaggcaggt

SEQ ID NO: 424939 - DNA, 12 bp, Homo sapiens
aggccaaggcct

SEQ ID NO: 424940 - DNA, 17 bp, Homo sapiens
aggccaaggcctcagga

SEQ ID NO: 424941 - DNA, 14 bp, Homo sapiens
aggccaagtgcagg

SEQ ID NO: 424942 - DNA, 18 bp, Homo sapiens
aggccacacgctgcccag

SEQ ID NO: 424943 - DNA, 21 bp, Homo sapiens
aggccacacgctgcccaggct

SEQ ID NO: 424944 - DNA, 14 bp, Homo sapiens
aggccacaggccac

SEQ ID NO: 424945 - DNA, 14 bp, Homo sapiens
aggccaccagctgc

SEQ ID NO: 424946 - DNA, 18 bp, Homo sapiens
aggccaccagctgctgga

SEQ ID NO: 424947 - DNA, 18 bp, Homo sapiens
aggccacccactgtgggg

SEQ ID NO: 424948 - DNA, 21 bp, Homo sapiens
aggccaccccaaaccccagcc

SEQ ID NO: 424949 - DNA, 21 bp, Homo sapiens
aggccaccccctatcctctga

SEQ ID NO: 424950 - DNA, 11 bp, Homo sapiens
aggccacctgc

SEQ ID NO: 424951 - DNA, 12 bp, Homo sapiens
aggccacctgca

SEQ ID NO: 424952 - DNA, 15 bp, Homo sapiens
aggccacctgccccc

SEQ ID NO: 424953 - DNA, 16 bp, Homo sapiens
aggccacctgccccct

SEQ ID NO: 424954 - DNA, 13 bp, Homo sapiens
aggccacttgctc

SEQ ID NO: 424955 - DNA, 22 bp, Homo sapiens
aggccagagtggcctggccagg

SEQ ID NO: 424956 - DNA, 15 bp, Homo sapiens
aggccagccacacca

SEQ ID NO: 424957 - DNA, 19 bp, Homo sapiens
aggccagccacaccacagg

SEQ ID NO: 424958 - DNA, 16 bp, Homo sapiens
aggccagccccaccca

SEQ ID NO: 424959 - DNA, 18 bp, Homo sapiens
aggccagccccacccagg

SEQ ID NO: 424960 - DNA, 19 bp, Homo sapiens
aggccagcttcgtgctgga

SEQ ID NO: 424961 - DNA, 22 bp, Homo sapiens
aggccaggccctcctgctggct

SEQ ID NO: 424962 - DNA, 11 bp, Homo sapiens
aggccaggtcc

SEQ ID NO: 424963 - DNA, 21 bp, Homo sapiens
aggccaggtccctggaccagc

SEQ ID NO: 424964 - DNA, 24 bp, Homo sapiens
aggccaggtccctggaccagcctc

SEQ ID NO: 424965 - DNA, 18 bp, Homo sapiens
aggccataccaggtgcta

SEQ ID NO: 424966 - DNA, 13 bp, Homo sapiens
aggccatctgtaa

SEQ ID NO: 424967 - DNA, 15 bp, Homo sapiens
aggccatctgtaaat

SEQ ID NO: 424968 - DNA, 22 bp, Homo sapiens
aggccatctgtaaatatcccag

SEQ ID NO: 424969 - DNA, 20 bp, Homo sapiens
aggccatggccaaggggcca

SEQ ID NO: 424970 - DNA, 12 bp, Homo sapiens
aggccatggctc

SEQ ID NO: 424971 - DNA, 17 bp, Homo sapiens
aggccatgggggcccct

SEQ ID NO: 424972 - DNA, 19 bp, Homo sapiens
aggccatgtgagccaccgc

SEQ ID NO: 424973 - DNA, 22 bp, Homo sapiens
aggccatgtgagccaccgctgc

SEQ ID NO: 424974 - DNA, 15 bp, Homo sapiens
aggccattccctgta

SEQ ID NO: 424975 - DNA, 17 bp, Homo sapiens
aggccattccctgtagg

SEQ ID NO: 424976 - DNA, 21 bp, Homo sapiens
aggcccaaattatcaagctaa

SEQ ID NO: 424977 - DNA, 20 bp, Homo sapiens
aggcccaaggtcccctccac

SEQ ID NO: 424978 - DNA, 13 bp, Homo sapiens
aggcccacaggag

SEQ ID NO: 424979 - DNA, 19 bp, Homo sapiens
aggcccacaggaggcaagc

SEQ ID NO: 424980 - DNA, 19 bp, Homo sapiens
aggcccacattgcccacac

SEQ ID NO: 424981 - DNA, 16 bp, Homo sapiens
aggcccagcagagccg

SEQ ID NO: 424982 - DNA, 23 bp, Homo sapiens
aggcccagcagagccgttcctgg

SEQ ID NO: 424983 - DNA, 18 bp, Homo sapiens
aggcccatctcaggtgcc

SEQ ID NO: 424984 - DNA, 16 bp, Homo sapiens
aggcccatgggcagaa

SEQ ID NO: 424985 - DNA, 18 bp, Homo sapiens
aggcccatggttgagaaa

SEQ ID NO: 424986 - DNA, 18 bp, Homo sapiens
aggccccaaaaccacagc

SEQ ID NO: 424987 - DNA, 22 bp, Homo sapiens
aggccccagagactcagaggga

SEQ ID NO: 424988 - DNA, 14 bp, Homo sapiens
aggccccagccaag

SEQ ID NO: 424989 - DNA, 17 bp, Homo sapiens
aggccccagggctgtgg

SEQ ID NO: 424990 - DNA, 21 bp, Homo sapiens
aggcccccaaacatagcccct

SEQ ID NO: 424991 - DNA, 21 bp, Homo sapiens
aggcccccaaattgccttcag

SEQ ID NO: 424992 - DNA, 22 bp, Homo sapiens
aggcccccaaattgccttcagc

SEQ ID NO: 424993 - DNA, 16 bp, Homo sapiens
aggccccctgcatcta

SEQ ID NO: 424994 - DNA, 15 bp, Homo sapiens
aggcccctgaggact

SEQ ID NO: 424995 - DNA, 21 bp, Homo sapiens
aggcccctgaggactggagac

SEQ ID NO: 424996 - DNA, 14 bp, Homo sapiens
aggcccctggccca

SEQ ID NO: 424997 - DNA, 13 bp, Homo sapiens
aggcccctggtgg

SEQ ID NO: 424998 - DNA, 14 bp, Homo sapiens
aggcccctggtggc

SEQ ID NO: 424999 - DNA, 19 bp, Homo sapiens
aggcccggcccagcctagg

SEQ ID NO: 425000 - DNA, 13 bp, Homo sapiens
aggcccgggagga

SEQ ID NO: 425001 - DNA, 15 bp, Homo sapiens
aggcccgggaggagg

SEQ ID NO: 425002 - DNA, 16 bp, Homo sapiens
aggcccgggaggagga

SEQ ID NO: 425003 - DNA, 15 bp, Homo sapiens
aggcccgggcccctg

SEQ ID NO: 425004 - DNA, 18 bp, Homo sapiens
aggcccgggcccctggca

SEQ ID NO: 425005 - DNA, 17 bp, Homo sapiens
aggccctaggattcctc

SEQ ID NO: 425006 - DNA, 16 bp, Homo sapiens
aggccctcctgctggc

SEQ ID NO: 425007 - DNA, 19 bp, Homo sapiens
aggccctcctgctggctga

SEQ ID NO: 425008 - DNA, 15 bp, Homo sapiens
aggcccttcctctcc

SEQ ID NO: 425009 - DNA, 17 bp, Homo sapiens
aggcccttcctctccac

SEQ ID NO: 425010 - DNA, 15 bp, Homo sapiens
aggcccttgtcctgc

SEQ ID NO: 425011 - DNA, 17 bp, Homo sapiens
aggcccttgtcctgcca

SEQ ID NO: 425012 - DNA, 19 bp, Homo sapiens
aggcccttgtcctgccagc

SEQ ID NO: 425013 - DNA, 19 bp, Homo sapiens
aggcccttttctggctcct

SEQ ID NO: 425014 - DNA, 20 bp, Homo sapiens
aggcccttttctggctcctg

SEQ ID NO: 425015 - DNA, 21 bp, Homo sapiens
aggcccttttctggctcctgt

SEQ ID NO: 425016 - DNA, 13 bp, Homo sapiens
aggccgaggcagg

SEQ ID NO: 425017 - DNA, 24 bp, Homo sapiens
aggccgaggcaggggctgggcaga

SEQ ID NO: 425018 - DNA, 12 bp, Homo sapiens
aggccgcccacc

SEQ ID NO: 425019 - DNA, 14 bp, Homo sapiens
aggccgcccacctg

SEQ ID NO: 425020 - DNA, 15 bp, Homo sapiens
aggccgcccacctgc

SEQ ID NO: 425021 - DNA, 16 bp, Homo sapiens
aggccggccagctccc

SEQ ID NO: 425022 - DNA, 19 bp, Homo sapiens
aggccggccagctccccct

SEQ ID NO: 425023 - DNA, 17 bp, Homo sapiens
aggccggggggagcagg

SEQ ID NO: 425024 - DNA, 14 bp, Homo sapiens
aggccggtgggaag

SEQ ID NO: 425025 - DNA, 22 bp, Homo sapiens
aggccgtcctcccgggccctcc

SEQ ID NO: 425026 - DNA, 13 bp, Homo sapiens
aggccgttcccct

SEQ ID NO: 425027 - DNA, 18 bp, Homo sapiens
aggccgttccccttggct

SEQ ID NO: 425028 - DNA, 22 bp, Homo sapiens
aggccgttccccttggcttcct

SEQ ID NO: 425029 - DNA, 18 bp, Homo sapiens
aggcctcaccctgcttgg

SEQ ID NO: 425030 - DNA, 23 bp, Homo sapiens
aggcctcaccctgcttggggcct

SEQ ID NO: 425031 - DNA, 13 bp, Homo sapiens
aggcctcacctgg

SEQ ID NO: 425032 - DNA, 17 bp, Homo sapiens
aggcctcacctggcttc

SEQ ID NO: 425033 - DNA, 21 bp, Homo sapiens
aggcctcacctggcttcccag

SEQ ID NO: 425034 - DNA, 23 bp, Homo sapiens
aggcctcacctggcttcccagga

SEQ ID NO: 425035 - DNA, 12 bp, Homo sapiens
aggcctcaggag

SEQ ID NO: 425036 - DNA, 15 bp, Homo sapiens
aggcctcaggcctcc

SEQ ID NO: 425037 - DNA, 12 bp, Homo sapiens
aggcctcagtgt

SEQ ID NO: 425038 - DNA, 15 bp, Homo sapiens
aggcctcatccctcg

SEQ ID NO: 425039 - DNA, 16 bp, Homo sapiens
aggcctccagcctctc

SEQ ID NO: 425040 - DNA, 21 bp, Homo sapiens
aggcctccagcctctcccggc

SEQ ID NO: 425041 - DNA, 22 bp, Homo sapiens
aggcctccagcctctcccggct

SEQ ID NO: 425042 - DNA, 22 bp, Homo sapiens
aggcctcccgcatgctgcctgc

SEQ ID NO: 425043 - DNA, 24 bp, Homo sapiens
aggcctcggcagaactctctgtct

SEQ ID NO: 425044 - DNA, 15 bp, Homo sapiens
aggcctcttgctggt

SEQ ID NO: 425045 - DNA, 18 bp, Homo sapiens
aggcctcttgctggtgca

SEQ ID NO: 425046 - DNA, 15 bp, Homo sapiens
aggcctcttgtgctc

SEQ ID NO: 425047 - DNA, 18 bp, Homo sapiens
aggcctgaaatgtttcca

SEQ ID NO: 425048 - DNA, 21 bp, Homo sapiens
aggcctgaaatgtttccaggc

SEQ ID NO: 425049 - DNA, 14 bp, Homo sapiens
aggcctgaggatga

SEQ ID NO: 425050 - DNA, 16 bp, Homo sapiens
aggcctgaggatgagc

SEQ ID NO: 425051 - DNA, 17 bp, Homo sapiens
aggcctgaggatgagct

SEQ ID NO: 425052 - DNA, 19 bp, Homo sapiens
aggcctgaggatgagctgg

SEQ ID NO: 425053 - DNA, 20 bp, Homo sapiens
aggcctgagggaagcccacc

SEQ ID NO: 425054 - DNA, 21 bp, Homo sapiens
aggcctgagggaagcccaccc

SEQ ID NO: 425055 - DNA, 22 bp, Homo sapiens
aggcctgagggaagcccacccg

SEQ ID NO: 425056 - DNA, 16 bp, Homo sapiens
aggcctgccagcccct

SEQ ID NO: 425057 - DNA, 12 bp, Homo sapiens
aggcctgccctc

SEQ ID NO: 425058 - DNA, 14 bp, Homo sapiens
aggcctggaaccag

SEQ ID NO: 425059 - DNA, 15 bp, Homo sapiens
aggcctggaaccagg

SEQ ID NO: 425060 - DNA, 17 bp, Homo sapiens
aggcctggaaccaggga

SEQ ID NO: 425061 - DNA, 18 bp, Homo sapiens
aggcctggaaccagggag

SEQ ID NO: 425062 - DNA, 19 bp, Homo sapiens
aggcctggaaccagggagg

SEQ ID NO: 425063 - DNA, 17 bp, Homo sapiens
aggcctggactttcctg

SEQ ID NO: 425064 - DNA, 18 bp, Homo sapiens
aggcctggactttcctgc

SEQ ID NO: 425065 - DNA, 22 bp, Homo sapiens
aggcctggactttcctgcaact

SEQ ID NO: 425066 - DNA, 10 bp, Homo sapiens
aggcctggcc

SEQ ID NO: 425067 - DNA, 13 bp, Homo sapiens
aggcctggcccag

SEQ ID NO: 425068 - DNA, 17 bp, Homo sapiens
aggcctggcctcggggc

SEQ ID NO: 425069 - DNA, 15 bp, Homo sapiens
aggcctgggacccag

SEQ ID NO: 425070 - DNA, 15 bp, Homo sapiens
aggcctgggagggca

SEQ ID NO: 425071 - DNA, 12 bp, Homo sapiens
aggcctgggtgg

SEQ ID NO: 425072 - DNA, 22 bp, Homo sapiens
aggcctggtcagcagagccgcc

SEQ ID NO: 425073 - DNA, 16 bp, Homo sapiens
aggcctggtctggagc

SEQ ID NO: 425074 - DNA, 23 bp, Homo sapiens
aggcctggtctggagcccctatc

SEQ ID NO: 425075 - DNA, 24 bp, Homo sapiens
aggcctggtctggagcccctatcc

SEQ ID NO: 425076 - DNA, 15 bp, Homo sapiens
aggcctgtccctggc

SEQ ID NO: 425077 - DNA, 16 bp, Homo sapiens
aggcctgtccctggcc

SEQ ID NO: 425078 - DNA, 19 bp, Homo sapiens
aggccttcagaaaagacac

SEQ ID NO: 425079 - DNA, 12 bp, Homo sapiens
aggccttgctgt

SEQ ID NO: 425080 - DNA, 15 bp, Homo sapiens
aggcctttcaggaag

SEQ ID NO: 425081 - DNA, 23 bp, Homo sapiens
aggcctttcaggaagggagagga

SEQ ID NO: 425082 - DNA, 10 bp, Homo sapiens
aggcctttgg

SEQ ID NO: 425083 - DNA, 12 bp, Homo sapiens
aggcctttggga

SEQ ID NO: 425084 - DNA, 12 bp, Homo sapiens
aggcgaagctga

SEQ ID NO: 425085 - DNA, 16 bp, Homo sapiens
aggcgaggctgcctct

SEQ ID NO: 425086 - DNA, 18 bp, Homo sapiens
aggcgaggctgcctctgg

SEQ ID NO: 425087 - DNA, 23 bp, Homo sapiens
aggcgatccacctgtctcagcct

SEQ ID NO: 425088 - DNA, 18 bp, Homo sapiens
aggcgatgtggtgacccc

SEQ ID NO: 425089 - DNA, 22 bp, Homo sapiens
aggcgatgtggtgaccccaccc

SEQ ID NO: 425090 - DNA, 17 bp, Homo sapiens
aggcgcagccctagtgg

SEQ ID NO: 425091 - DNA, 12 bp, Homo sapiens
aggcgcccacct

SEQ ID NO: 425092 - DNA, 13 bp, Homo sapiens
aggcgcccacctg

SEQ ID NO: 425093 - DNA, 17 bp, Homo sapiens
aggcgcccacctgccca

SEQ ID NO: 425094 - DNA, 18 bp, Homo sapiens
aggcgcccacctgcccag

SEQ ID NO: 425095 - DNA, 15 bp, Homo sapiens
aggcgcccctggggt

SEQ ID NO: 425096 - DNA, 18 bp, Homo sapiens
aggcgcccctggggtggg

SEQ ID NO: 425097 - DNA, 14 bp, Homo sapiens
aggcgccccttccc

SEQ ID NO: 425098 - DNA, 12 bp, Homo sapiens
aggcgcgcaccg

SEQ ID NO: 425099 - DNA, 23 bp, Homo sapiens
aggcgcggttcaggtcagggcta

SEQ ID NO: 425100 - DNA, 22 bp, Homo sapiens
aggcggcagctcttctgggcag

SEQ ID NO: 425101 - DNA, 13 bp, Homo sapiens
aggcggcagctgg

SEQ ID NO: 425102 - DNA, 15 bp, Homo sapiens
aggcggcagctgggg

SEQ ID NO: 425103 - DNA, 15 bp, Homo sapiens
aggcgggagatggac

SEQ ID NO: 425104 - DNA, 18 bp, Homo sapiens
aggcgggggagcctggag

SEQ ID NO: 425105 - DNA, 22 bp, Homo sapiens
aggcgggggagcctggagcccc

SEQ ID NO: 425106 - DNA, 18 bp, Homo sapiens
aggcgggggatcctggag

SEQ ID NO: 425107 - DNA, 23 bp, Homo sapiens
aggcgggggatcctggagcccct

SEQ ID NO: 425108 - DNA, 14 bp, Homo sapiens
aggcgtagggccag

SEQ ID NO: 425109 - DNA, 15 bp, Homo sapiens
aggcgtagggccagg

SEQ ID NO: 425110 - DNA, 21 bp, Homo sapiens
aggcgtagggccagggctctg

SEQ ID NO: 425111 - DNA, 15 bp, Homo sapiens
aggcgtcctggtgag

SEQ ID NO: 425112 - DNA, 12 bp, Homo sapiens
aggcgtgccccc

SEQ ID NO: 425113 - DNA, 13 bp, Homo sapiens
aggcgtgggatcc

SEQ ID NO: 425114 - DNA, 18 bp, Homo sapiens
aggcgtgggatccagaga

SEQ ID NO: 425115 - DNA, 17 bp, Homo sapiens
aggcgtggtggctggcg

SEQ ID NO: 425116 - DNA, 18 bp, Homo sapiens
aggcgttagtgggcaggt

SEQ ID NO: 425117 - DNA, 20 bp, Homo sapiens
aggcgttagtgggcaggtgg

SEQ ID NO: 425118 - DNA, 14 bp, Homo sapiens
aggcgttctcctgc

SEQ ID NO: 425119 - DNA, 15 bp, Homo sapiens
aggcgttggtgccac

SEQ ID NO: 425120 - DNA, 17 bp, Homo sapiens
aggctaaaaacatttta

SEQ ID NO: 425121 - DNA, 21 bp, Homo sapiens
aggctaaaacaaatctcagaa

SEQ ID NO: 425122 - DNA, 22 bp, Homo sapiens
aggctaagatgagatttgccag

SEQ ID NO: 425123 - DNA, 23 bp, Homo sapiens
aggctaagatgagatttgccagc

SEQ ID NO: 425124 - DNA, 18 bp, Homo sapiens
aggctaatcaataccctt

SEQ ID NO: 425125 - DNA, 13 bp, Homo sapiens
aggctacagaatg

SEQ ID NO: 425126 - DNA, 15 bp, Homo sapiens
aggctagccccaggg

SEQ ID NO: 425127 - DNA, 18 bp, Homo sapiens
aggctagccccagggtga

SEQ ID NO: 425128 - DNA, 14 bp, Homo sapiens
aggctagttccttt

SEQ ID NO: 425129 - DNA, 15 bp, Homo sapiens
aggctataagaagta

SEQ ID NO: 425130 - DNA, 21 bp, Homo sapiens
aggctatggagggtcctcctc

SEQ ID NO: 425131 - DNA, 22 bp, Homo sapiens
aggctccaggctgactgggggc

SEQ ID NO: 425132 - DNA, 14 bp, Homo sapiens
aggctcccagaccc

SEQ ID NO: 425133 - DNA, 21 bp, Homo sapiens
aggctcccagacccagggcag

SEQ ID NO: 425134 - DNA, 14 bp, Homo sapiens
aggctcctccttgc

SEQ ID NO: 425135 - DNA, 12 bp, Homo sapiens
aggctctccctc

SEQ ID NO: 425136 - DNA, 19 bp, Homo sapiens
aggctctccctctctgcac

SEQ ID NO: 425137 - DNA, 15 bp, Homo sapiens
aggctctgcacagat

SEQ ID NO: 425138 - DNA, 17 bp, Homo sapiens
aggctctgcacagatgg

SEQ ID NO: 425139 - DNA, 11 bp, Homo sapiens
aggctctgctg

SEQ ID NO: 425140 - DNA, 12 bp, Homo sapiens
aggctctgctga

SEQ ID NO: 425141 - DNA, 14 bp, Homo sapiens
aggctctgggctca

SEQ ID NO: 425142 - DNA, 20 bp, Homo sapiens
aggctctgggctcagggctg

SEQ ID NO: 425143 - DNA, 14 bp, Homo sapiens
aggctcttctcctt

SEQ ID NO: 425144 - DNA, 14 bp, Homo sapiens
aggctgaaaagtgc

SEQ ID NO: 425145 - DNA, 17 bp, Homo sapiens
aggctgaaagaggccaa

SEQ ID NO: 425146 - DNA, 22 bp, Homo sapiens
aggctgaccttgaactcctggg

SEQ ID NO: 425147 - DNA, 21 bp, Homo sapiens
aggctgactgggggcctctgc

SEQ ID NO: 425148 - DNA, 13 bp, Homo sapiens
aggctgaggcctg

SEQ ID NO: 425149 - DNA, 17 bp, Homo sapiens
aggctgcactgcagtga

SEQ ID NO: 425150 - DNA, 20 bp, Homo sapiens
aggctgcagcaggcagagga

SEQ ID NO: 425151 - DNA, 21 bp, Homo sapiens
aggctgcagcaggcagaggag

SEQ ID NO: 425152 - DNA, 22 bp, Homo sapiens
aggctgcagcaggcagaggaga

SEQ ID NO: 425153 - DNA, 17 bp, Homo sapiens
aggctgcagtgagccaa

SEQ ID NO: 425154 - DNA, 20 bp, Homo sapiens
aggctgccccacccctccat

SEQ ID NO: 425155 - DNA, 15 bp, Homo sapiens
aggctgcctctgggt

SEQ ID NO: 425156 - DNA, 17 bp, Homo sapiens
aggctgcctctgggtga

SEQ ID NO: 425157 - DNA, 21 bp, Homo sapiens
aggctgcctctgggtgagtgg

SEQ ID NO: 425158 - DNA, 22 bp, Homo sapiens
aggctgcctctgggtgagtggc

SEQ ID NO: 425159 - DNA, 14 bp, Homo sapiens
aggctgcctggaga

SEQ ID NO: 425160 - DNA, 13 bp, Homo sapiens
aggctgctggagg

SEQ ID NO: 425161 - DNA, 14 bp, Homo sapiens
aggctgctggagga

SEQ ID NO: 425162 - DNA, 17 bp, Homo sapiens
aggctggagctggcgtc

SEQ ID NO: 425163 - DNA, 18 bp, Homo sapiens
aggctggagctggcgtct

SEQ ID NO: 425164 - DNA, 15 bp, Homo sapiens
aggctggaggaaggg

SEQ ID NO: 425165 - DNA, 20 bp, Homo sapiens
aggctggagggcagtggcac

SEQ ID NO: 425166 - DNA, 20 bp, Homo sapiens
aggctggagtggagtggcgt

SEQ ID NO: 425167 - DNA, 17 bp, Homo sapiens
aggctggcagctctcca

SEQ ID NO: 425168 - DNA, 19 bp, Homo sapiens
aggctggcagctctccagt

SEQ ID NO: 425169 - DNA, 21 bp, Homo sapiens
aggctggcagctctccagtca

SEQ ID NO: 425170 - DNA, 13 bp, Homo sapiens
aggctggccagca

SEQ ID NO: 425171 - DNA, 13 bp, Homo sapiens
aggctggcctcag

SEQ ID NO: 425172 - DNA, 15 bp, Homo sapiens
aggctggctgagtgg

SEQ ID NO: 425173 - DNA, 18 bp, Homo sapiens
aggctggctgagtggaat

SEQ ID NO: 425174 - DNA, 12 bp, Homo sapiens
aggctggctgtt

SEQ ID NO: 425175 - DNA, 23 bp, Homo sapiens
aggctgggcacggctccgagggc

SEQ ID NO: 425176 - DNA, 12 bp, Homo sapiens
aggctgggccaa

SEQ ID NO: 425177 - DNA, 14 bp, Homo sapiens
aggctgggcccaga

SEQ ID NO: 425178 - DNA, 16 bp, Homo sapiens
aggctgggcccagagg

SEQ ID NO: 425179 - DNA, 21 bp, Homo sapiens
aggctgggcccagaggcacag

SEQ ID NO: 425180 - DNA, 10 bp, Homo sapiens
aggctggggc

SEQ ID NO: 425181 - DNA, 11 bp, Homo sapiens
aggctggggcc

SEQ ID NO: 425182 - DNA, 11 bp, Homo sapiens
aggctgggtgc

SEQ ID NO: 425183 - DNA, 17 bp, Homo sapiens
aggctgggtgcccacag

SEQ ID NO: 425184 - DNA, 18 bp, Homo sapiens
aggctgggtgcccacagc

SEQ ID NO: 425185 - DNA, 14 bp, Homo sapiens
aggctgtattttct

SEQ ID NO: 425186 - DNA, 20 bp, Homo sapiens
aggctgtattttcttttata

SEQ ID NO: 425187 - DNA, 22 bp, Homo sapiens
aggctgtattttcttttatatc

SEQ ID NO: 425188 - DNA, 15 bp, Homo sapiens
aggctgtcagcgcct

SEQ ID NO: 425189 - DNA, 17 bp, Homo sapiens
aggctgtcagcgcctca

SEQ ID NO: 425190 - DNA, 19 bp, Homo sapiens
aggctgtcgtccccctcca

SEQ ID NO: 425191 - DNA, 14 bp, Homo sapiens
aggctgtctggggc

SEQ ID NO: 425192 - DNA, 14 bp, Homo sapiens
aggcttaagagaga

SEQ ID NO: 425193 - DNA, 13 bp, Homo sapiens
aggcttaggactt

SEQ ID NO: 425194 - DNA, 20 bp, Homo sapiens
aggcttccctgacttgcttt

SEQ ID NO: 425195 - DNA, 21 bp, Homo sapiens
aggcttccctgacttgcttta

SEQ ID NO: 425196 - DNA, 13 bp, Homo sapiens
aggcttctccttc

SEQ ID NO: 425197 - DNA, 16 bp, Homo sapiens
aggcttctccttctcc

SEQ ID NO: 425198 - DNA, 17 bp, Homo sapiens
aggcttgggcccagtag

SEQ ID NO: 425199 - DNA, 16 bp, Homo sapiens
aggcttgtcagagctg

SEQ ID NO: 425200 - DNA, 17 bp, Homo sapiens
aggcttgtcagagctgg

SEQ ID NO: 425201 - DNA, 18 bp, Homo sapiens
aggctttaagctccagct

SEQ ID NO: 425202 - DNA, 19 bp, Homo sapiens
aggctttgccatgggcctg

SEQ ID NO: 425203 - DNA, 23 bp, Homo sapiens
aggctttgccatgggcctgctgc

SEQ ID NO: 425204 - DNA, 20 bp, Homo sapiens
agggaaaacataatatcttg

SEQ ID NO: 425205 - DNA, 22 bp, Homo sapiens
agggaaacaaaatatttatttg

SEQ ID NO: 425206 - DNA, 18 bp, Homo sapiens
agggaaactcagatgtcc

SEQ ID NO: 425207 - DNA, 19 bp, Homo sapiens
agggaaagatgtagaaaga

SEQ ID NO: 425208 - DNA, 21 bp, Homo sapiens
agggaaagcgggcagccccgt

SEQ ID NO: 425209 - DNA, 15 bp, Homo sapiens
agggaaaggctgaac

SEQ ID NO: 425210 - DNA, 18 bp, Homo sapiens
agggaaaggctgaacata

SEQ ID NO: 425211 - DNA, 22 bp, Homo sapiens
agggaaccagccctccagagca

SEQ ID NO: 425212 - DNA, 14 bp, Homo sapiens
agggaactctgggg

SEQ ID NO: 425213 - DNA, 19 bp, Homo sapiens
agggaactgcttgcccagg

SEQ ID NO: 425214 - DNA, 22 bp, Homo sapiens
agggaactgcttgcccagggtg

SEQ ID NO: 425215 - DNA, 19 bp, Homo sapiens
agggaactgggaagatgct

SEQ ID NO: 425216 - DNA, 12 bp, Homo sapiens
agggaagagggc

SEQ ID NO: 425217 - DNA, 13 bp, Homo sapiens
agggaagagggca

SEQ ID NO: 425218 - DNA, 14 bp, Homo sapiens
agggaagcccaccc

SEQ ID NO: 425219 - DNA, 17 bp, Homo sapiens
agggaagcccacccgcc

SEQ ID NO: 425220 - DNA, 18 bp, Homo sapiens
agggaagcccacccgccc

SEQ ID NO: 425221 - DNA, 20 bp, Homo sapiens
agggaagcccacccgcccca

SEQ ID NO: 425222 - DNA, 12 bp, Homo sapiens
agggaataatta

SEQ ID NO: 425223 - DNA, 14 bp, Homo sapiens
agggaatgaatcca

SEQ ID NO: 425224 - DNA, 13 bp, Homo sapiens
agggaatgtgaaa

SEQ ID NO: 425225 - DNA, 15 bp, Homo sapiens
agggaattctcttgg

SEQ ID NO: 425226 - DNA, 19 bp, Homo sapiens
agggaattgattcaagatt

SEQ ID NO: 425227 - DNA, 16 bp, Homo sapiens
agggaatttctatcta

SEQ ID NO: 425228 - DNA, 21 bp, Homo sapiens
agggaattttcattggatgca

SEQ ID NO: 425229 - DNA, 19 bp, Homo sapiens
agggacaaatttaaaacaa

SEQ ID NO: 425230 - DNA, 18 bp, Homo sapiens
agggacaagggattctgg

SEQ ID NO: 425231 - DNA, 17 bp, Homo sapiens
agggacaagggggagga

SEQ ID NO: 425232 - DNA, 20 bp, Homo sapiens
agggacacgggcagcctggc

SEQ ID NO: 425233 - DNA, 23 bp, Homo sapiens
agggacacgggcagcctggctcc

SEQ ID NO: 425234 - DNA, 17 bp, Homo sapiens
agggacactacaaacat

SEQ ID NO: 425235 - DNA, 22 bp, Homo sapiens
agggacagatgaatgccgtgga

SEQ ID NO: 425236 - DNA, 16 bp, Homo sapiens
agggacagcagcctcc

SEQ ID NO: 425237 - DNA, 14 bp, Homo sapiens
agggacagcatgcc

SEQ ID NO: 425238 - DNA, 20 bp, Homo sapiens
agggacagccaaaagtaagt

SEQ ID NO: 425239 - DNA, 18 bp, Homo sapiens
agggacatgctcacctct

SEQ ID NO: 425240 - DNA, 17 bp, Homo sapiens
agggaccaactgggccc

SEQ ID NO: 425241 - DNA, 19 bp, Homo sapiens
agggaccaactgggcccaa

SEQ ID NO: 425242 - DNA, 21 bp, Homo sapiens
agggaccaaggacccctcacc

SEQ ID NO: 425243 - DNA, 23 bp, Homo sapiens
agggaccaatattaccatcttaa

SEQ ID NO: 425244 - DNA, 13 bp, Homo sapiens
agggaccttggag

SEQ ID NO: 425245 - DNA, 15 bp, Homo sapiens
agggacgaagaaagg

SEQ ID NO: 425246 - DNA, 22 bp, Homo sapiens
agggacgcggctcccggggcag

SEQ ID NO: 425247 - DNA, 17 bp, Homo sapiens
agggactaggagcactg

SEQ ID NO: 425248 - DNA, 17 bp, Homo sapiens
agggactgcctctgcca

SEQ ID NO: 425249 - DNA, 14 bp, Homo sapiens
agggactgggggtg

SEQ ID NO: 425250 - DNA, 14 bp, Homo sapiens
agggactggtccag

SEQ ID NO: 425251 - DNA, 17 bp, Homo sapiens
agggactggtccaggca

SEQ ID NO: 425252 - DNA, 18 bp, Homo sapiens
agggactgtataaacaag

SEQ ID NO: 425253 - DNA, 18 bp, Homo sapiens
agggactgtatttctgtg

SEQ ID NO: 425254 - DNA, 16 bp, Homo sapiens
agggacttaacttgtt

SEQ ID NO: 425255 - DNA, 20 bp, Homo sapiens
agggacttccctagaagtct

SEQ ID NO: 425256 - DNA, 17 bp, Homo sapiens
agggagacccaataaag

SEQ ID NO: 425257 - DNA, 20 bp, Homo sapiens
agggagacccaataaagaat

SEQ ID NO: 425258 - DNA, 14 bp, Homo sapiens
agggagaccctggg

SEQ ID NO: 425259 - DNA, 23 bp, Homo sapiens
agggagagacctcatcaggatga

SEQ ID NO: 425260 - DNA, 17 bp, Homo sapiens
agggagaggaggggctg

SEQ ID NO: 425261 - DNA, 17 bp, Homo sapiens
agggagcaagacagaga

SEQ ID NO: 425262 - DNA, 23 bp, Homo sapiens
agggagcagagaaggccaggggc

SEQ ID NO: 425263 - DNA, 17 bp, Homo sapiens
agggagcccctcctctg

SEQ ID NO: 425264 - DNA, 23 bp, Homo sapiens
agggagctgaggccattccctgt

SEQ ID NO: 425265 - DNA, 17 bp, Homo sapiens
agggagggaaacccggg

SEQ ID NO: 425266 - DNA, 17 bp, Homo sapiens
agggagggctgacccag

SEQ ID NO: 425267 - DNA, 11 bp, Homo sapiens
agggaggggag

SEQ ID NO: 425268 - DNA, 14 bp, Homo sapiens
agggaggggaggtg

SEQ ID NO: 425269 - DNA, 23 bp, Homo sapiens
agggaggggctgagtctggctag

SEQ ID NO: 425270 - DNA, 20 bp, Homo sapiens
agggagggggcgctcaggac

SEQ ID NO: 425271 - DNA, 16 bp, Homo sapiens
agggagggtcagtgcc

SEQ ID NO: 425272 - DNA, 17 bp, Homo sapiens
agggaggtcaggccctg

SEQ ID NO: 425273 - DNA, 18 bp, Homo sapiens
agggaggtcaggccctgg

SEQ ID NO: 425274 - DNA, 22 bp, Homo sapiens
agggaggtcaggccctggaact

SEQ ID NO: 425275 - DNA, 22 bp, Homo sapiens
agggaggtgtttaaagagaggt

SEQ ID NO: 425276 - DNA, 13 bp, Homo sapiens
agggaggtttgtg

SEQ ID NO: 425277 - DNA, 16 bp, Homo sapiens
agggagtacaaagaca

SEQ ID NO: 425278 - DNA, 16 bp, Homo sapiens
agggagtacctgctgc

SEQ ID NO: 425279 - DNA, 19 bp, Homo sapiens
agggagtgcagaacacctg

SEQ ID NO: 425280 - DNA, 16 bp, Homo sapiens
agggatagagacgcag

SEQ ID NO: 425281 - DNA, 13 bp, Homo sapiens
agggatagagggg

SEQ ID NO: 425282 - DNA, 22 bp, Homo sapiens
agggatctggggaaggaccaac

SEQ ID NO: 425283 - DNA, 21 bp, Homo sapiens
agggatctgtttgaacactta

SEQ ID NO: 425284 - DNA, 16 bp, Homo sapiens
agggatcttctccctc

SEQ ID NO: 425285 - DNA, 16 bp, Homo sapiens
agggatgaattgtaaa

SEQ ID NO: 425286 - DNA, 19 bp, Homo sapiens
agggatgaggtgctgggag

SEQ ID NO: 425287 - DNA, 18 bp, Homo sapiens
agggatgccatctgtggg

SEQ ID NO: 425288 - DNA, 22 bp, Homo sapiens
agggatgctatctcgctagcca

SEQ ID NO: 425289 - DNA, 22 bp, Homo sapiens
agggatggaaaaggaagactag

SEQ ID NO: 425290 - DNA, 18 bp, Homo sapiens
agggatggggagcagctg

SEQ ID NO: 425291 - DNA, 20 bp, Homo sapiens
agggatggggagcagctggg

SEQ ID NO: 425292 - DNA, 18 bp, Homo sapiens
agggattaacctctgcac

SEQ ID NO: 425293 - DNA, 18 bp, Homo sapiens
agggattcaggctgcttg

SEQ ID NO: 425294 - DNA, 20 bp, Homo sapiens
agggattggaccgagctgga

SEQ ID NO: 425295 - DNA, 15 bp, Homo sapiens
agggcaatctttgcc

SEQ ID NO: 425296 - DNA, 14 bp, Homo sapiens
agggcactctctgc

SEQ ID NO: 425297 - DNA, 15 bp, Homo sapiens
agggcactctctgcc

SEQ ID NO: 425298 - DNA, 16 bp, Homo sapiens
agggcactctctgcca

SEQ ID NO: 425299 - DNA, 16 bp, Homo sapiens
agggcactgctgctgc

SEQ ID NO: 425300 - DNA, 12 bp, Homo sapiens
agggcagagcca

SEQ ID NO: 425301 - DNA, 13 bp, Homo sapiens
agggcagagccat

SEQ ID NO: 425302 - DNA, 21 bp, Homo sapiens
agggcagagccatgggcctgg

SEQ ID NO: 425303 - DNA, 23 bp, Homo sapiens
agggcagagccatgggcctgggc

SEQ ID NO: 425304 - DNA, 20 bp, Homo sapiens
agggcagaggtcccctgagg

SEQ ID NO: 425305 - DNA, 12 bp, Homo sapiens
agggcagcactg

SEQ ID NO: 425306 - DNA, 18 bp, Homo sapiens
agggcagcactgggaagc

SEQ ID NO: 425307 - DNA, 14 bp, Homo sapiens
agggcagcccctcc

SEQ ID NO: 425308 - DNA, 16 bp, Homo sapiens
agggcagcctgtggga

SEQ ID NO: 425309 - DNA, 21 bp, Homo sapiens
agggcagcttcagtctctgca

SEQ ID NO: 425310 - DNA, 18 bp, Homo sapiens
agggcaggaaggagagcc

SEQ ID NO: 425311 - DNA, 21 bp, Homo sapiens
agggcaggaaggagagcctgc

SEQ ID NO: 425312 - DNA, 11 bp, Homo sapiens
agggcaggcag

SEQ ID NO: 425313 - DNA, 13 bp, Homo sapiens
agggcagggcatc

SEQ ID NO: 425314 - DNA, 22 bp, Homo sapiens
agggcagggcggctaggccggc

SEQ ID NO: 425315 - DNA, 21 bp, Homo sapiens
agggcagtgctagtgagctgg

SEQ ID NO: 425316 - DNA, 24 bp, Homo sapiens
agggcatcagctttccctggctca

SEQ ID NO: 425317 - DNA, 17 bp, Homo sapiens
agggcatcaggcactgg

SEQ ID NO: 425318 - DNA, 22 bp, Homo sapiens
agggcatcaggcactggtggca

SEQ ID NO: 425319 - DNA, 13 bp, Homo sapiens
agggcatctccag

SEQ ID NO: 425320 - DNA, 14 bp, Homo sapiens
agggcatctccagg

SEQ ID NO: 425321 - DNA, 22 bp, Homo sapiens
agggcatctccaggaaggcggg

SEQ ID NO: 425322 - DNA, 16 bp, Homo sapiens
agggccaagtcccacc

SEQ ID NO: 425323 - DNA, 24 bp, Homo sapiens
agggccacactattaccatgagaa

SEQ ID NO: 425324 - DNA, 12 bp, Homo sapiens
agggccagaagg

SEQ ID NO: 425325 - DNA, 20 bp, Homo sapiens
agggccagaaggagggcaga

SEQ ID NO: 425326 - DNA, 14 bp, Homo sapiens
agggccagagcctg

SEQ ID NO: 425327 - DNA, 16 bp, Homo sapiens
agggccagatctgtta

SEQ ID NO: 425328 - DNA, 17 bp, Homo sapiens
agggccagtagagagtg

SEQ ID NO: 425329 - DNA, 22 bp, Homo sapiens
agggccagtagagagtgccctt

SEQ ID NO: 425330 - DNA, 23 bp, Homo sapiens
agggccagtcctgcctggccagg

SEQ ID NO: 425331 - DNA, 15 bp, Homo sapiens
agggccatgaacttt

SEQ ID NO: 425332 - DNA, 17 bp, Homo sapiens
agggccatgcctgcccc

SEQ ID NO: 425333 - DNA, 15 bp, Homo sapiens
agggcccagaggctg

SEQ ID NO: 425334 - DNA, 21 bp, Homo sapiens
agggcccagaggggcggggcc

SEQ ID NO: 425335 - DNA, 23 bp, Homo sapiens
agggcccagaggggcggggccag

SEQ ID NO: 425336 - DNA, 14 bp, Homo sapiens
agggcccagctgta

SEQ ID NO: 425337 - DNA, 19 bp, Homo sapiens
agggcccagctgtagccat

SEQ ID NO: 425338 - DNA, 18 bp, Homo sapiens
agggcccaggcctggagc

SEQ ID NO: 425339 - DNA, 13 bp, Homo sapiens
agggcccccaccg

SEQ ID NO: 425340 - DNA, 23 bp, Homo sapiens
agggcccccaccgaggttcccag

SEQ ID NO: 425341 - DNA, 19 bp, Homo sapiens
agggcccctcaccctgcct

SEQ ID NO: 425342 - DNA, 13 bp, Homo sapiens
agggcccctccct

SEQ ID NO: 425343 - DNA, 18 bp, Homo sapiens
agggcccctccctctgcc

SEQ ID NO: 425344 - DNA, 13 bp, Homo sapiens
agggcccctctgc

SEQ ID NO: 425345 - DNA, 15 bp, Homo sapiens
agggcccctctgccc

SEQ ID NO: 425346 - DNA, 19 bp, Homo sapiens
agggcccgagcgcgtgcct

SEQ ID NO: 425347 - DNA, 15 bp, Homo sapiens
agggccctcagagga

SEQ ID NO: 425348 - DNA, 19 bp, Homo sapiens
agggccctcagaggaaagg

SEQ ID NO: 425349 - DNA, 11 bp, Homo sapiens
agggccctgct

SEQ ID NO: 425350 - DNA, 15 bp, Homo sapiens
agggccctgctcagg

SEQ ID NO: 425351 - DNA, 17 bp, Homo sapiens
agggccctgctcaggcc

SEQ ID NO: 425352 - DNA, 18 bp, Homo sapiens
agggccctgctcaggcct

SEQ ID NO: 425353 - DNA, 22 bp, Homo sapiens
agggccctgctcaggcctcacc

SEQ ID NO: 425354 - DNA, 15 bp, Homo sapiens
agggcctgggggcag

SEQ ID NO: 425355 - DNA, 17 bp, Homo sapiens
agggcctgggggcagtg

SEQ ID NO: 425356 - DNA, 23 bp, Homo sapiens
agggcctgggggcagtgactggc

SEQ ID NO: 425357 - DNA, 22 bp, Homo sapiens
agggcgaggcgggggagcctgg

SEQ ID NO: 425358 - DNA, 13 bp, Homo sapiens
agggcgaggggag

SEQ ID NO: 425359 - DNA, 23 bp, Homo sapiens
agggcgaggggagggtggcaggt

SEQ ID NO: 425360 - DNA, 23 bp, Homo sapiens
agggcgcccattcgtctgtccca

SEQ ID NO: 425361 - DNA, 15 bp, Homo sapiens
agggcgctccggcag

SEQ ID NO: 425362 - DNA, 16 bp, Homo sapiens
agggcgctccggcaga

SEQ ID NO: 425363 - DNA, 13 bp, Homo sapiens
agggcggccaggg

SEQ ID NO: 425364 - DNA, 14 bp, Homo sapiens
agggcggccaggga

SEQ ID NO: 425365 - DNA, 15 bp, Homo sapiens
agggcggccagggac

SEQ ID NO: 425366 - DNA, 20 bp, Homo sapiens
agggctaaggcctcttgctg

SEQ ID NO: 425367 - DNA, 21 bp, Homo sapiens
agggctaaggcctcttgctgg

SEQ ID NO: 425368 - DNA, 16 bp, Homo sapiens
agggctacattgtaat

SEQ ID NO: 425369 - DNA, 21 bp, Homo sapiens
agggctactgcagctttacat

SEQ ID NO: 425370 - DNA, 20 bp, Homo sapiens
agggctccagcatccagcct

SEQ ID NO: 425371 - DNA, 22 bp, Homo sapiens
agggctccagcatccagcctgt

SEQ ID NO: 425372 - DNA, 18 bp, Homo sapiens
agggctccagggccaggg

SEQ ID NO: 425373 - DNA, 19 bp, Homo sapiens
agggctccctcctggagca

SEQ ID NO: 425374 - DNA, 15 bp, Homo sapiens
agggctctgatattc

SEQ ID NO: 425375 - DNA, 17 bp, Homo sapiens
agggctctgatattcca

SEQ ID NO: 425376 - DNA, 21 bp, Homo sapiens
agggctctgatattccatgaa

SEQ ID NO: 425377 - DNA, 21 bp, Homo sapiens
agggctgacacgtccacccca

SEQ ID NO: 425378 - DNA, 12 bp, Homo sapiens
agggctgagccc

SEQ ID NO: 425379 - DNA, 15 bp, Homo sapiens
agggctgagcccctc

SEQ ID NO: 425380 - DNA, 17 bp, Homo sapiens
agggctgagcccctcct

SEQ ID NO: 425381 - DNA, 20 bp, Homo sapiens
agggctgagcccctcctctc

SEQ ID NO: 425382 - DNA, 14 bp, Homo sapiens
agggctgcccctgt

SEQ ID NO: 425383 - DNA, 13 bp, Homo sapiens
agggctggaccta

SEQ ID NO: 425384 - DNA, 19 bp, Homo sapiens
agggctggagtgcgctctt

SEQ ID NO: 425385 - DNA, 23 bp, Homo sapiens
agggctggcccggggagtccccg

SEQ ID NO: 425386 - DNA, 20 bp, Homo sapiens
agggctgggcaggtcctggg

SEQ ID NO: 425387 - DNA, 11 bp, Homo sapiens
agggctgggtg

SEQ ID NO: 425388 - DNA, 21 bp, Homo sapiens
agggctggtgtggctgctccc

SEQ ID NO: 425389 - DNA, 13 bp, Homo sapiens
agggctgtggctg

SEQ ID NO: 425390 - DNA, 14 bp, Homo sapiens
agggctgtgggtgg

SEQ ID NO: 425391 - DNA, 19 bp, Homo sapiens
agggcttatctagccaaag

SEQ ID NO: 425392 - DNA, 13 bp, Homo sapiens
agggcttggggct

SEQ ID NO: 425393 - DNA, 18 bp, Homo sapiens
agggcttttattttttaa

SEQ ID NO: 425394 - DNA, 21 bp, Homo sapiens
agggcttttctctttcctcta

SEQ ID NO: 425395 - DNA, 13 bp, Homo sapiens
aggggaaaatgaa

SEQ ID NO: 425396 - DNA, 20 bp, Homo sapiens
aggggaaaatgtgaagctga

SEQ ID NO: 425397 - DNA, 21 bp, Homo sapiens
aggggaaagaaagggaaaagg

SEQ ID NO: 425398 - DNA, 15 bp, Homo sapiens
aggggaagctgcagc

SEQ ID NO: 425399 - DNA, 20 bp, Homo sapiens
aggggaagctgcagcttggg

SEQ ID NO: 425400 - DNA, 14 bp, Homo sapiens
aggggaagggccag

SEQ ID NO: 425401 - DNA, 12 bp, Homo sapiens
aggggactgggg

SEQ ID NO: 425402 - DNA, 15 bp, Homo sapiens
aggggagaaactgaa

SEQ ID NO: 425403 - DNA, 16 bp, Homo sapiens
aggggagaagagccct

SEQ ID NO: 425404 - DNA, 14 bp, Homo sapiens
aggggaggcagatg

SEQ ID NO: 425405 - DNA, 21 bp, Homo sapiens
aggggaggggcctagggagcc

SEQ ID NO: 425406 - DNA, 13 bp, Homo sapiens
aggggagtctgct

SEQ ID NO: 425407 - DNA, 18 bp, Homo sapiens
aggggagtctgcttgtct

SEQ ID NO: 425408 - DNA, 19 bp, Homo sapiens
aggggatactgaaaaatac

SEQ ID NO: 425409 - DNA, 19 bp, Homo sapiens
aggggatgtatccatgggg

SEQ ID NO: 425410 - DNA, 17 bp, Homo sapiens
aggggattgaagccctc

SEQ ID NO: 425411 - DNA, 18 bp, Homo sapiens
aggggcaaagaactgccc

SEQ ID NO: 425412 - DNA, 19 bp, Homo sapiens
aggggcaaagaactgcccc

SEQ ID NO: 425413 - DNA, 19 bp, Homo sapiens
aggggcacactacagagca

SEQ ID NO: 425414 - DNA, 17 bp, Homo sapiens
aggggcacacttcccct

SEQ ID NO: 425415 - DNA, 20 bp, Homo sapiens
aggggcagaaggaggaaggg

SEQ ID NO: 425416 - DNA, 13 bp, Homo sapiens
aggggcagccgct

SEQ ID NO: 425417 - DNA, 22 bp, Homo sapiens
aggggcaggaatcaaggagcct

SEQ ID NO: 425418 - DNA, 20 bp, Homo sapiens
aggggcaggagctcagatga

SEQ ID NO: 425419 - DNA, 12 bp, Homo sapiens
aggggcaggcct

SEQ ID NO: 425420 - DNA, 13 bp, Homo sapiens
aggggcaggcctg

SEQ ID NO: 425421 - DNA, 16 bp, Homo sapiens
aggggcaggcctggga

SEQ ID NO: 425422 - DNA, 23 bp, Homo sapiens
aggggcaggcctgggacccagct

SEQ ID NO: 425423 - DNA, 20 bp, Homo sapiens
aggggcagtctggaggggca

SEQ ID NO: 425424 - DNA, 16 bp, Homo sapiens
aggggcatctctgggc

SEQ ID NO: 425425 - DNA, 14 bp, Homo sapiens
aggggcatctgccc

SEQ ID NO: 425426 - DNA, 15 bp, Homo sapiens
aggggcatctgcccc

SEQ ID NO: 425427 - DNA, 17 bp, Homo sapiens
aggggcatctgcccctc

SEQ ID NO: 425428 - DNA, 20 bp, Homo sapiens
aggggcatctgcccctcccc

SEQ ID NO: 425429 - DNA, 20 bp, Homo sapiens
aggggcatgtattggcctgg

SEQ ID NO: 425430 - DNA, 22 bp, Homo sapiens
aggggcatgtattggcctggag

SEQ ID NO: 425431 - DNA, 23 bp, Homo sapiens
aggggcatgtattggcctggagg

SEQ ID NO: 425432 - DNA, 11 bp, Homo sapiens
aggggccactg

SEQ ID NO: 425433 - DNA, 14 bp, Homo sapiens
aggggccagctgcc

SEQ ID NO: 425434 - DNA, 14 bp, Homo sapiens
aggggccaggccat

SEQ ID NO: 425435 - DNA, 15 bp, Homo sapiens
aggggcccaggctcc

SEQ ID NO: 425436 - DNA, 22 bp, Homo sapiens
aggggcccaggctcccctgccc

SEQ ID NO: 425437 - DNA, 21 bp, Homo sapiens
aggggccccagatctgcctgg

SEQ ID NO: 425438 - DNA, 22 bp, Homo sapiens
aggggccccagatctgcctggg

SEQ ID NO: 425439 - DNA, 17 bp, Homo sapiens
aggggccccggggctgg

SEQ ID NO: 425440 - DNA, 19 bp, Homo sapiens
aggggccccggggctggca

SEQ ID NO: 425441 - DNA, 20 bp, Homo sapiens
aggggccccggggctggcaa

SEQ ID NO: 425442 - DNA, 20 bp, Homo sapiens
aggggcccctcctctgtgct

SEQ ID NO: 425443 - DNA, 16 bp, Homo sapiens
aggggccgagtccagg

SEQ ID NO: 425444 - DNA, 18 bp, Homo sapiens
aggggccgagtccaggag

SEQ ID NO: 425445 - DNA, 19 bp, Homo sapiens
aggggccgagtccaggagc

SEQ ID NO: 425446 - DNA, 12 bp, Homo sapiens
aggggcctaggg

SEQ ID NO: 425447 - DNA, 15 bp, Homo sapiens
aggggcctagggagc

SEQ ID NO: 425448 - DNA, 13 bp, Homo sapiens
aggggcctctgaa

SEQ ID NO: 425449 - DNA, 12 bp, Homo sapiens
aggggcctggca

SEQ ID NO: 425450 - DNA, 13 bp, Homo sapiens
aggggcctggcag

SEQ ID NO: 425451 - DNA, 15 bp, Homo sapiens
aggggcctggcctgg

SEQ ID NO: 425452 - DNA, 17 bp, Homo sapiens
aggggcctggcctgggt

SEQ ID NO: 425453 - DNA, 13 bp, Homo sapiens
aggggcgagcacc

SEQ ID NO: 425454 - DNA, 14 bp, Homo sapiens
aggggcggcaggag

SEQ ID NO: 425455 - DNA, 16 bp, Homo sapiens
aggggcggggcaggaa

SEQ ID NO: 425456 - DNA, 14 bp, Homo sapiens
aggggcgtgtccct

SEQ ID NO: 425457 - DNA, 21 bp, Homo sapiens
aggggcgtgtccctcctcttc

SEQ ID NO: 425458 - DNA, 14 bp, Homo sapiens
aggggcgtgtggct

SEQ ID NO: 425459 - DNA, 17 bp, Homo sapiens
aggggcgtgtggctcac

SEQ ID NO: 425460 - DNA, 20 bp, Homo sapiens
aggggctcgagtgcccctgc

SEQ ID NO: 425461 - DNA, 11 bp, Homo sapiens
aggggctctgc

SEQ ID NO: 425462 - DNA, 22 bp, Homo sapiens
aggggctgcatcctcagcccca

SEQ ID NO: 425463 - DNA, 11 bp, Homo sapiens
aggggctgctg

SEQ ID NO: 425464 - DNA, 16 bp, Homo sapiens
aggggctgctggggca

SEQ ID NO: 425465 - DNA, 18 bp, Homo sapiens
aggggctgctggggcatg

SEQ ID NO: 425466 - DNA, 14 bp, Homo sapiens
aggggctgggcaga

SEQ ID NO: 425467 - DNA, 18 bp, Homo sapiens
aggggctgggggtgaggg

SEQ ID NO: 425468 - DNA, 19 bp, Homo sapiens
aggggctgtggccgtctcc

SEQ ID NO: 425469 - DNA, 16 bp, Homo sapiens
aggggcttccctctgc

SEQ ID NO: 425470 - DNA, 17 bp, Homo sapiens
aggggcttggagcagag

SEQ ID NO: 425471 - DNA, 19 bp, Homo sapiens
aggggcttggagcagagac

SEQ ID NO: 425472 - DNA, 20 bp, Homo sapiens
aggggctttggaagctctgt

SEQ ID NO: 425473 - DNA, 22 bp, Homo sapiens
agggggagggggttacaaactg

SEQ ID NO: 425474 - DNA, 10 bp, Homo sapiens
agggggccac

SEQ ID NO: 425475 - DNA, 15 bp, Homo sapiens
agggggccacctccc

SEQ ID NO: 425476 - DNA, 17 bp, Homo sapiens
agggggcctgcaggccc

SEQ ID NO: 425477 - DNA, 14 bp, Homo sapiens
agggggccttggaa

SEQ ID NO: 425478 - DNA, 19 bp, Homo sapiens
agggggcgctcaggaccca

SEQ ID NO: 425479 - DNA, 23 bp, Homo sapiens
agggggcgctcaggacccaggcc

SEQ ID NO: 425480 - DNA, 17 bp, Homo sapiens
aggggggaacatgcatt

SEQ ID NO: 425481 - DNA, 13 bp, Homo sapiens
aggggggagctgg

SEQ ID NO: 425482 - DNA, 17 bp, Homo sapiens
aggggggagggggaggg

SEQ ID NO: 425483 - DNA, 20 bp, Homo sapiens
aggggggttgcagtggagag

SEQ ID NO: 425484 - DNA, 23 bp, Homo sapiens
agggggtaatggaggccaagcct

SEQ ID NO: 425485 - DNA, 16 bp, Homo sapiens
agggggtttgggggct

SEQ ID NO: 425486 - DNA, 22 bp, Homo sapiens
agggggtttgggggcttgcaag

SEQ ID NO: 425487 - DNA, 15 bp, Homo sapiens
aggggtaaatatatg

SEQ ID NO: 425488 - DNA, 22 bp, Homo sapiens
aggggtaaatatatgttttgag

SEQ ID NO: 425489 - DNA, 16 bp, Homo sapiens
aggggtcaccttgaga

SEQ ID NO: 425490 - DNA, 15 bp, Homo sapiens
aggggtcagcagggg

SEQ ID NO: 425491 - DNA, 22 bp, Homo sapiens
aggggtcagcaggggggttggg

SEQ ID NO: 425492 - DNA, 14 bp, Homo sapiens
aggggtcagctctg

SEQ ID NO: 425493 - DNA, 20 bp, Homo sapiens
aggggtcagctctggccaca

SEQ ID NO: 425494 - DNA, 16 bp, Homo sapiens
aggggtcaggctccat

SEQ ID NO: 425495 - DNA, 15 bp, Homo sapiens
aggggtcccagccac

SEQ ID NO: 425496 - DNA, 19 bp, Homo sapiens
aggggtcccagccaccccg

SEQ ID NO: 425497 - DNA, 13 bp, Homo sapiens
aggggtctccctg

SEQ ID NO: 425498 - DNA, 16 bp, Homo sapiens
aggggtctccctgagc

SEQ ID NO: 425499 - DNA, 17 bp, Homo sapiens
aggggtctgcctcccac

SEQ ID NO: 425500 - DNA, 15 bp, Homo sapiens
aggggtgagacagtg

SEQ ID NO: 425501 - DNA, 22 bp, Homo sapiens
aggggtgcacccactcaccagg

SEQ ID NO: 425502 - DNA, 12 bp, Homo sapiens
aggggtgggagc

SEQ ID NO: 425503 - DNA, 13 bp, Homo sapiens
aggggtggtcctg

SEQ ID NO: 425504 - DNA, 15 bp, Homo sapiens
aggggtggtcctgac

SEQ ID NO: 425505 - DNA, 15 bp, Homo sapiens
aggggtttctaacac

SEQ ID NO: 425506 - DNA, 14 bp, Homo sapiens
agggtaaattattc

SEQ ID NO: 425507 - DNA, 15 bp, Homo sapiens
agggtaaggctgtgg

SEQ ID NO: 425508 - DNA, 15 bp, Homo sapiens
agggtaatagaaatg

SEQ ID NO: 425509 - DNA, 22 bp, Homo sapiens
agggtagaattgtttggcaatg

SEQ ID NO: 425510 - DNA, 15 bp, Homo sapiens
agggtagcctggctt

SEQ ID NO: 425511 - DNA, 15 bp, Homo sapiens
agggtagggggcctg

SEQ ID NO: 425512 - DNA, 23 bp, Homo sapiens
agggtatctgctgcctctgaaaa

SEQ ID NO: 425513 - DNA, 12 bp, Homo sapiens
agggtcatttct

SEQ ID NO: 425514 - DNA, 23 bp, Homo sapiens
agggtcattttcctttctgtatt

SEQ ID NO: 425515 - DNA, 15 bp, Homo sapiens
agggtccgcaccagc

SEQ ID NO: 425516 - DNA, 18 bp, Homo sapiens
agggtccgcaccagctgc

SEQ ID NO: 425517 - DNA, 17 bp, Homo sapiens
agggtcctgattctccc

SEQ ID NO: 425518 - DNA, 22 bp, Homo sapiens
agggtccttccctctccccaag

SEQ ID NO: 425519 - DNA, 15 bp, Homo sapiens
agggtctatggggag

SEQ ID NO: 425520 - DNA, 21 bp, Homo sapiens
agggtctgctctttctctgcc

SEQ ID NO: 425521 - DNA, 22 bp, Homo sapiens
agggtctgctctttctctgcca

SEQ ID NO: 425522 - DNA, 18 bp, Homo sapiens
agggtcttgactctaaat

SEQ ID NO: 425523 - DNA, 21 bp, Homo sapiens
agggtcttgactctaaatgca

SEQ ID NO: 425524 - DNA, 19 bp, Homo sapiens
agggtctttactgggaagc

SEQ ID NO: 425525 - DNA, 18 bp, Homo sapiens
agggtctttgtgtgctgt

SEQ ID NO: 425526 - DNA, 24 bp, Homo sapiens
agggtgagcagggccctcagagga

SEQ ID NO: 425527 - DNA, 22 bp, Homo sapiens
agggtgaggcgtgggatccaga

SEQ ID NO: 425528 - DNA, 20 bp, Homo sapiens
agggtgcagttttccaggaa

SEQ ID NO: 425529 - DNA, 21 bp, Homo sapiens
agggtgccctttggggtcccg

SEQ ID NO: 425530 - DNA, 12 bp, Homo sapiens
agggtgcctgct

SEQ ID NO: 425531 - DNA, 14 bp, Homo sapiens
agggtgcctgctct

SEQ ID NO: 425532 - DNA, 17 bp, Homo sapiens
agggtgcctgctctcct

SEQ ID NO: 425533 - DNA, 18 bp, Homo sapiens
agggtgctccctcctcag

SEQ ID NO: 425534 - DNA, 21 bp, Homo sapiens
agggtgctgcttccctctgcc

SEQ ID NO: 425535 - DNA, 21 bp, Homo sapiens
agggtggaggaaggtgctgag

SEQ ID NO: 425536 - DNA, 18 bp, Homo sapiens
agggtgggccccagccgt

SEQ ID NO: 425537 - DNA, 21 bp, Homo sapiens
agggtgggccccagccgtggc

SEQ ID NO: 425538 - DNA, 17 bp, Homo sapiens
agggtggtgctgggact

SEQ ID NO: 425539 - DNA, 23 bp, Homo sapiens
agggtggttcctgttctcagcat

SEQ ID NO: 425540 - DNA, 14 bp, Homo sapiens
agggtgtttatgta

SEQ ID NO: 425541 - DNA, 16 bp, Homo sapiens
agggttaaagaaaggc

SEQ ID NO: 425542 - DNA, 22 bp, Homo sapiens
agggttcaaattcctgcaaaat

SEQ ID NO: 425543 - DNA, 15 bp, Homo sapiens
agggttcccccagcc

SEQ ID NO: 425544 - DNA, 19 bp, Homo sapiens
agggttcccccagccctgt

SEQ ID NO: 425545 - DNA, 19 bp, Homo sapiens
agggttctaacctttctaa

SEQ ID NO: 425546 - DNA, 14 bp, Homo sapiens
agggttctggctgc

SEQ ID NO: 425547 - DNA, 18 bp, Homo sapiens
agggttgatatattcttt

SEQ ID NO: 425548 - DNA, 21 bp, Homo sapiens
agggttgcttctgagtggtgt

SEQ ID NO: 425549 - DNA, 16 bp, Homo sapiens
aggtaagggccgccgg

SEQ ID NO: 425550 - DNA, 16 bp, Homo sapiens
aggtaatgtgaataaa

SEQ ID NO: 425551 - DNA, 16 bp, Homo sapiens
aggtaatttcttgtgc

SEQ ID NO: 425552 - DNA, 20 bp, Homo sapiens
aggtaccacccttcagaccc

SEQ ID NO: 425553 - DNA, 22 bp, Homo sapiens
aggtacgaaaagaggggaagag

SEQ ID NO: 425554 - DNA, 19 bp, Homo sapiens
aggtacttcctcctgatgg

SEQ ID NO: 425555 - DNA, 15 bp, Homo sapiens
aggtagatccagatc

SEQ ID NO: 425556 - DNA, 20 bp, Homo sapiens
aggtagatcgcttgagccca

SEQ ID NO: 425557 - DNA, 20 bp, Homo sapiens
aggtagcgagctgctctgct

SEQ ID NO: 425558 - DNA, 21 bp, Homo sapiens
aggtagcgagctgctctgcta

SEQ ID NO: 425559 - DNA, 13 bp, Homo sapiens
aggtaggcccttg

SEQ ID NO: 425560 - DNA, 19 bp, Homo sapiens
aggtaggcccttgtcctgc

SEQ ID NO: 425561 - DNA, 19 bp, Homo sapiens
aggtagtagaatctcagca

SEQ ID NO: 425562 - DNA, 23 bp, Homo sapiens
aggtattgattgaaaaaagagaa

SEQ ID NO: 425563 - DNA, 17 bp, Homo sapiens
aggtcaagtaagaagac

SEQ ID NO: 425564 - DNA, 19 bp, Homo sapiens
aggtcaagtaagaagacat

SEQ ID NO: 425565 - DNA, 15 bp, Homo sapiens
aggtcactcctgggg

SEQ ID NO: 425566 - DNA, 19 bp, Homo sapiens
aggtcactcctggggcctc

SEQ ID NO: 425567 - DNA, 13 bp, Homo sapiens
aggtcagatggag

SEQ ID NO: 425568 - DNA, 21 bp, Homo sapiens
aggtcagctgttactttcttt

SEQ ID NO: 425569 - DNA, 18 bp, Homo sapiens
aggtcagcttgctgccct

SEQ ID NO: 425570 - DNA, 12 bp, Homo sapiens
aggtcaggccct

SEQ ID NO: 425571 - DNA, 13 bp, Homo sapiens
aggtcaggccctg

SEQ ID NO: 425572 - DNA, 15 bp, Homo sapiens
aggtcaggccctgga

SEQ ID NO: 425573 - DNA, 21 bp, Homo sapiens
aggtcagtgttataaaatctg

SEQ ID NO: 425574 - DNA, 17 bp, Homo sapiens
aggtcatagctgagatt

SEQ ID NO: 425575 - DNA, 15 bp, Homo sapiens
aggtcccagaatgga

SEQ ID NO: 425576 - DNA, 13 bp, Homo sapiens
aggtcccaggaag

SEQ ID NO: 425577 - DNA, 12 bp, Homo sapiens
aggtcccagtgc

SEQ ID NO: 425578 - DNA, 14 bp, Homo sapiens
aggtcccctccaca

SEQ ID NO: 425579 - DNA, 21 bp, Homo sapiens
aggtcccctccacatcccagc

SEQ ID NO: 425580 - DNA, 13 bp, Homo sapiens
aggtcccctgagg

SEQ ID NO: 425581 - DNA, 21 bp, Homo sapiens
aggtcccgagccccctgtcct

SEQ ID NO: 425582 - DNA, 14 bp, Homo sapiens
aggtcccgggagga

SEQ ID NO: 425583 - DNA, 15 bp, Homo sapiens
aggtccgagctctgt

SEQ ID NO: 425584 - DNA, 12 bp, Homo sapiens
aggtcctgccct

SEQ ID NO: 425585 - DNA, 22 bp, Homo sapiens
aggtcctggggaggctgagact

SEQ ID NO: 425586 - DNA, 13 bp, Homo sapiens
aggtcctgtgagc

SEQ ID NO: 425587 - DNA, 16 bp, Homo sapiens
aggtcctgtgagcaaa

SEQ ID NO: 425588 - DNA, 20 bp, Homo sapiens
aggtcctgtgagcaaagtgc

SEQ ID NO: 425589 - DNA, 16 bp, Homo sapiens
aggtccttctgctgga

SEQ ID NO: 425590 - DNA, 13 bp, Homo sapiens
aggtcctttcctt

SEQ ID NO: 425591 - DNA, 18 bp, Homo sapiens
aggtcgggctcagctctg

SEQ ID NO: 425592 - DNA, 15 bp, Homo sapiens
aggtcgggtgttaaa

SEQ ID NO: 425593 - DNA, 22 bp, Homo sapiens
aggtctacctgaaaattcaaca

SEQ ID NO: 425594 - DNA, 15 bp, Homo sapiens
aggtctccatgaaga

SEQ ID NO: 425595 - DNA, 15 bp, Homo sapiens
aggtctccttactct

SEQ ID NO: 425596 - DNA, 16 bp, Homo sapiens
aggtctctgccggctc

SEQ ID NO: 425597 - DNA, 13 bp, Homo sapiens
aggtctgaaatgg

SEQ ID NO: 425598 - DNA, 15 bp, Homo sapiens
aggtctgaaatggag

SEQ ID NO: 425599 - DNA, 12 bp, Homo sapiens
aggtctgcaggc

SEQ ID NO: 425600 - DNA, 16 bp, Homo sapiens
aggtctgcaggccacc

SEQ ID NO: 425601 - DNA, 17 bp, Homo sapiens
aggtctgcaggccacca

SEQ ID NO: 425602 - DNA, 20 bp, Homo sapiens
aggtctgcaggccaccagct

SEQ ID NO: 425603 - DNA, 15 bp, Homo sapiens
aggtctgcattttct

SEQ ID NO: 425604 - DNA, 19 bp, Homo sapiens
aggtctgcattttctcagg

SEQ ID NO: 425605 - DNA, 19 bp, Homo sapiens
aggtctgggagaggcagag

SEQ ID NO: 425606 - DNA, 21 bp, Homo sapiens
aggtctgggagaggcagagtg

SEQ ID NO: 425607 - DNA, 22 bp, Homo sapiens
aggtctgggagaggcagagtgc

SEQ ID NO: 425608 - DNA, 21 bp, Homo sapiens
aggtcttcttgtgtcctgatg

SEQ ID NO: 425609 - DNA, 14 bp, Homo sapiens
aggtcttttgacat

SEQ ID NO: 425610 - DNA, 15 bp, Homo sapiens
aggtgaaacacacac

SEQ ID NO: 425611 - DNA, 22 bp, Homo sapiens
aggtgaaatgggagatggtcag

SEQ ID NO: 425612 - DNA, 22 bp, Homo sapiens
aggtgaaggctctcacccccat

SEQ ID NO: 425613 - DNA, 19 bp, Homo sapiens
aggtgacactatagtttaa

SEQ ID NO: 425614 - DNA, 15 bp, Homo sapiens
aggtgacagcagtcg

SEQ ID NO: 425615 - DNA, 20 bp, Homo sapiens
aggtgaccccatctctgctg

SEQ ID NO: 425616 - DNA, 21 bp, Homo sapiens
aggtgaccgcccagctctccc

SEQ ID NO: 425617 - DNA, 16 bp, Homo sapiens
aggtgaccttctggga

SEQ ID NO: 425618 - DNA, 20 bp, Homo sapiens
aggtgaccttgcaacttcat

SEQ ID NO: 425619 - DNA, 14 bp, Homo sapiens
aggtgagaccacct

SEQ ID NO: 425620 - DNA, 20 bp, Homo sapiens
aggtgagatcacagcctcca

SEQ ID NO: 425621 - DNA, 15 bp, Homo sapiens
aggtgagggaggcct

SEQ ID NO: 425622 - DNA, 17 bp, Homo sapiens
aggtgagggaggcctga

SEQ ID NO: 425623 - DNA, 19 bp, Homo sapiens
aggtgagttttaaagaagt

SEQ ID NO: 425624 - DNA, 18 bp, Homo sapiens
aggtgataggaaaactga

SEQ ID NO: 425625 - DNA, 16 bp, Homo sapiens
aggtgattaaatattt

SEQ ID NO: 425626 - DNA, 18 bp, Homo sapiens
aggtgattaaatatttaa

SEQ ID NO: 425627 - DNA, 22 bp, Homo sapiens
aggtgattaaatatttaatgat

SEQ ID NO: 425628 - DNA, 20 bp, Homo sapiens
aggtgattttcctgtgtcca

SEQ ID NO: 425629 - DNA, 22 bp, Homo sapiens
aggtgcacagacgtccctccac

SEQ ID NO: 425630 - DNA, 23 bp, Homo sapiens
aggtgcacagacgtccctccacg

SEQ ID NO: 425631 - DNA, 16 bp, Homo sapiens
aggtgcagttccccca

SEQ ID NO: 425632 - DNA, 17 bp, Homo sapiens
aggtgccaccaataaaa

SEQ ID NO: 425633 - DNA, 18 bp, Homo sapiens
aggtgccactccctgagc

SEQ ID NO: 425634 - DNA, 13 bp, Homo sapiens
aggtgccaggctg

SEQ ID NO: 425635 - DNA, 16 bp, Homo sapiens
aggtgcccagtcttga

SEQ ID NO: 425636 - DNA, 20 bp, Homo sapiens
aggtgcccagtcttgagtgg

SEQ ID NO: 425637 - DNA, 22 bp, Homo sapiens
aggtgcccagtcttgagtgggc

SEQ ID NO: 425638 - DNA, 14 bp, Homo sapiens
aggtgccccgtggt

SEQ ID NO: 425639 - DNA, 18 bp, Homo sapiens
aggtgccctgtgggagag

SEQ ID NO: 425640 - DNA, 18 bp, Homo sapiens
aggtgcctcaagagaagg

SEQ ID NO: 425641 - DNA, 17 bp, Homo sapiens
aggtgcctgagagcaga

SEQ ID NO: 425642 - DNA, 21 bp, Homo sapiens
aggtgcggaccggagcggctg

SEQ ID NO: 425643 - DNA, 22 bp, Homo sapiens
aggtgcggaccggagcggctga

SEQ ID NO: 425644 - DNA, 18 bp, Homo sapiens
aggtgctcaaagatgtac

SEQ ID NO: 425645 - DNA, 20 bp, Homo sapiens
aggtgctcaaagatgtactg

SEQ ID NO: 425646 - DNA, 21 bp, Homo sapiens
aggtgctcaaagatgtactga

SEQ ID NO: 425647 - DNA, 17 bp, Homo sapiens
aggtgctgctttgcttc

SEQ ID NO: 425648 - DNA, 15 bp, Homo sapiens
aggtgctggaggcag

SEQ ID NO: 425649 - DNA, 19 bp, Homo sapiens
aggtgcttaagcagaagca

SEQ ID NO: 425650 - DNA, 21 bp, Homo sapiens
aggtggaaaatggactggctt

SEQ ID NO: 425651 - DNA, 19 bp, Homo sapiens
aggtggaacaggaggaact

SEQ ID NO: 425652 - DNA, 15 bp, Homo sapiens
aggtggattcatgtc

SEQ ID NO: 425653 - DNA, 19 bp, Homo sapiens
aggtggccaggcctgccag

SEQ ID NO: 425654 - DNA, 20 bp, Homo sapiens
aggtggccagggctccacgg

SEQ ID NO: 425655 - DNA, 17 bp, Homo sapiens
aggtggctatggccacc

SEQ ID NO: 425656 - DNA, 23 bp, Homo sapiens
aggtggctcagtgccacctatgc

SEQ ID NO: 425657 - DNA, 13 bp, Homo sapiens
aggtgggagcttg

SEQ ID NO: 425658 - DNA, 21 bp, Homo sapiens
aggtgggaggcccctggtggc

SEQ ID NO: 425659 - DNA, 22 bp, Homo sapiens
aggtgggaggcccctggtggca

SEQ ID NO: 425660 - DNA, 16 bp, Homo sapiens
aggtgggatcctccct

SEQ ID NO: 425661 - DNA, 14 bp, Homo sapiens
aggtgggcagctgg

SEQ ID NO: 425662 - DNA, 16 bp, Homo sapiens
aggtgggcagctgggc

SEQ ID NO: 425663 - DNA, 17 bp, Homo sapiens
aggtgggcagctgggcc

SEQ ID NO: 425664 - DNA, 19 bp, Homo sapiens
aggtgggcagctgggcccc

SEQ ID NO: 425665 - DNA, 18 bp, Homo sapiens
aggtgggcatgccaccct

SEQ ID NO: 425666 - DNA, 16 bp, Homo sapiens
aggtgggccacaccca

SEQ ID NO: 425667 - DNA, 14 bp, Homo sapiens
aggtgggccagccc

SEQ ID NO: 425668 - DNA, 19 bp, Homo sapiens
aggtgggccagcccctccc

SEQ ID NO: 425669 - DNA, 21 bp, Homo sapiens
aggtgggccttgctacctcaa

SEQ ID NO: 425670 - DNA, 19 bp, Homo sapiens
aggtggggaagagagcctg

SEQ ID NO: 425671 - DNA, 22 bp, Homo sapiens
aggtggggagggggtttggggg

SEQ ID NO: 425672 - DNA, 17 bp, Homo sapiens
aggtggggcgggaaagc

SEQ ID NO: 425673 - DNA, 14 bp, Homo sapiens
aggtgggggagcct

SEQ ID NO: 425674 - DNA, 18 bp, Homo sapiens
aggtgggggagcctggag

SEQ ID NO: 425675 - DNA, 14 bp, Homo sapiens
aggtgggggttggc

SEQ ID NO: 425676 - DNA, 22 bp, Homo sapiens
aggtggggttgggattgggggc

SEQ ID NO: 425677 - DNA, 14 bp, Homo sapiens
aggtgggtccagga

SEQ ID NO: 425678 - DNA, 21 bp, Homo sapiens
aggtgggtccaggaaggcagc

SEQ ID NO: 425679 - DNA, 22 bp, Homo sapiens
aggtgggtccaggaaggcagct

SEQ ID NO: 425680 - DNA, 15 bp, Homo sapiens
aggtgggtcttggat

SEQ ID NO: 425681 - DNA, 15 bp, Homo sapiens
aggtggtagctctga

SEQ ID NO: 425682 - DNA, 21 bp, Homo sapiens
aggtggtagctctgagccctc

SEQ ID NO: 425683 - DNA, 15 bp, Homo sapiens
aggtggtctgaatgt

SEQ ID NO: 425684 - DNA, 17 bp, Homo sapiens
aggtggtctgaatgttc

SEQ ID NO: 425685 - DNA, 22 bp, Homo sapiens
aggtggtctgaatgttctgaca

SEQ ID NO: 425686 - DNA, 13 bp, Homo sapiens
aggtggtcttgga

SEQ ID NO: 425687 - DNA, 14 bp, Homo sapiens
aggtggtcttggag

SEQ ID NO: 425688 - DNA, 17 bp, Homo sapiens
aggtggtcttggagagg

SEQ ID NO: 425689 - DNA, 18 bp, Homo sapiens
aggtggtcttggagagga

SEQ ID NO: 425690 - DNA, 19 bp, Homo sapiens
aggtggtcttggagaggag

SEQ ID NO: 425691 - DNA, 23 bp, Homo sapiens
aggtgtattcccgttttacagat

SEQ ID NO: 425692 - DNA, 21 bp, Homo sapiens
aggtgtcaccctgcagagcta

SEQ ID NO: 425693 - DNA, 15 bp, Homo sapiens
aggtgtcatttccat

SEQ ID NO: 425694 - DNA, 11 bp, Homo sapiens
aggtgtcccca

SEQ ID NO: 425695 - DNA, 13 bp, Homo sapiens
aggtgtggagtgg

SEQ ID NO: 425696 - DNA, 18 bp, Homo sapiens
aggtgttaaaaaccatta

SEQ ID NO: 425697 - DNA, 20 bp, Homo sapiens
aggtgttctacactcatctt

SEQ ID NO: 425698 - DNA, 14 bp, Homo sapiens
aggtgttgaaaatg

SEQ ID NO: 425699 - DNA, 20 bp, Homo sapiens
aggtgttgggacctgctgct

SEQ ID NO: 425700 - DNA, 15 bp, Homo sapiens
aggttaaaatataaa

SEQ ID NO: 425701 - DNA, 19 bp, Homo sapiens
aggttaaaatataaattaa

SEQ ID NO: 425702 - DNA, 23 bp, Homo sapiens
aggttaaaatataaattaagact

SEQ ID NO: 425703 - DNA, 13 bp, Homo sapiens
aggttaacagtaa

SEQ ID NO: 425704 - DNA, 21 bp, Homo sapiens
aggttaacagtaaaaatttct

SEQ ID NO: 425705 - DNA, 14 bp, Homo sapiens
aggttaagccatat

SEQ ID NO: 425706 - DNA, 15 bp, Homo sapiens
aggttaattccaatt

SEQ ID NO: 425707 - DNA, 18 bp, Homo sapiens
aggttactcataaggcat

SEQ ID NO: 425708 - DNA, 18 bp, Homo sapiens
aggttaggatttaacagt

SEQ ID NO: 425709 - DNA, 14 bp, Homo sapiens
aggttatctgcctg

SEQ ID NO: 425710 - DNA, 18 bp, Homo sapiens
aggttatctgcctggcct

SEQ ID NO: 425711 - DNA, 22 bp, Homo sapiens
aggttatctgcctggcctggct

SEQ ID NO: 425712 - DNA, 23 bp, Homo sapiens
aggttatctgcctggcctggctc

SEQ ID NO: 425713 - DNA, 15 bp, Homo sapiens
aggttatgagaaaaa

SEQ ID NO: 425714 - DNA, 17 bp, Homo sapiens
aggttatgagaaaaaaa

SEQ ID NO: 425715 - DNA, 16 bp, Homo sapiens
aggttcactaaagcag

SEQ ID NO: 425716 - DNA, 22 bp, Homo sapiens
aggttcagcaaggtgagagagg

SEQ ID NO: 425717 - DNA, 21 bp, Homo sapiens
aggttcatgccaccatggcca

SEQ ID NO: 425718 - DNA, 11 bp, Homo sapiens
aggttccagaa

SEQ ID NO: 425719 - DNA, 17 bp, Homo sapiens
aggttccatccaccacc

SEQ ID NO: 425720 - DNA, 21 bp, Homo sapiens
aggttccatccaccaccttgc

SEQ ID NO: 425721 - DNA, 16 bp, Homo sapiens
aggttcgtatagaaaa

SEQ ID NO: 425722 - DNA, 18 bp, Homo sapiens
aggttcgtatagaaaaag

SEQ ID NO: 425723 - DNA, 11 bp, Homo sapiens
aggttctaaaa

SEQ ID NO: 425724 - DNA, 15 bp, Homo sapiens
aggttctcagcaagt

SEQ ID NO: 425725 - DNA, 18 bp, Homo sapiens
aggttctggtaacctgtg

SEQ ID NO: 425726 - DNA, 19 bp, Homo sapiens
aggttctggttagctcagc

SEQ ID NO: 425727 - DNA, 13 bp, Homo sapiens
aggttctgtctgt

SEQ ID NO: 425728 - DNA, 16 bp, Homo sapiens
aggttcttactgcttg

SEQ ID NO: 425729 - DNA, 17 bp, Homo sapiens
aggttcttagtgtcact

SEQ ID NO: 425730 - DNA, 15 bp, Homo sapiens
aggttgaggacagga

SEQ ID NO: 425731 - DNA, 21 bp, Homo sapiens
aggttgaggatgcactggcct

SEQ ID NO: 425732 - DNA, 18 bp, Homo sapiens
aggttgagtgagccggga

SEQ ID NO: 425733 - DNA, 14 bp, Homo sapiens
aggttgcagtgagc

SEQ ID NO: 425734 - DNA, 13 bp, Homo sapiens
aggttgccgtgag

SEQ ID NO: 425735 - DNA, 17 bp, Homo sapiens
aggttgccgtgagccaa

SEQ ID NO: 425736 - DNA, 17 bp, Homo sapiens
aggttgcctgaaaaatg

SEQ ID NO: 425737 - DNA, 12 bp, Homo sapiens
aggttgctgttg

SEQ ID NO: 425738 - DNA, 15 bp, Homo sapiens
aggttggaaaagaaa

SEQ ID NO: 425739 - DNA, 22 bp, Homo sapiens
aggttggagatgacagaaatat

SEQ ID NO: 425740 - DNA, 20 bp, Homo sapiens
aggttggtgactgaaacatt

SEQ ID NO: 425741 - DNA, 20 bp, Homo sapiens
aggttgtctgaagtcactgc

SEQ ID NO: 425742 - DNA, 22 bp, Homo sapiens
aggttgtgaaaacagcagcaat

SEQ ID NO: 425743 - DNA, 18 bp, Homo sapiens
aggtttaactcagatcac

SEQ ID NO: 425744 - DNA, 20 bp, Homo sapiens
aggtttagaatcaagtctgt

SEQ ID NO: 425745 - DNA, 15 bp, Homo sapiens
aggtttagagattaa

SEQ ID NO: 425746 - DNA, 16 bp, Homo sapiens
aggtttcgttgcatgg

SEQ ID NO: 425747 - DNA, 14 bp, Homo sapiens
aggtttcttgcttc

SEQ ID NO: 425748 - DNA, 11 bp, Homo sapiens
aggttttcctg

SEQ ID NO: 425749 - DNA, 12 bp, Homo sapiens
aggttttgttgt

SEQ ID NO: 425750 - DNA, 17 bp, Homo sapiens
aggttttgttgttttat

SEQ ID NO: 425751 - DNA, 20 bp, Homo sapiens
agtaaaaattcatataaagt

SEQ ID NO: 425752 - DNA, 12 bp, Homo sapiens
agtaaaacacaa

SEQ ID NO: 425753 - DNA, 20 bp, Homo sapiens
agtaaactattctataaaca

SEQ ID NO: 425754 - DNA, 14 bp, Homo sapiens
agtaaactgccctg

SEQ ID NO: 425755 - DNA, 13 bp, Homo sapiens
agtaaagacatag

SEQ ID NO: 425756 - DNA, 17 bp, Homo sapiens
agtaaagctaaaatgat

SEQ ID NO: 425757 - DNA, 24 bp, Homo sapiens
agtaaagttccacttagagaacaa

SEQ ID NO: 425758 - DNA, 18 bp, Homo sapiens
agtaaataaactcttcaa

SEQ ID NO: 425759 - DNA, 23 bp, Homo sapiens
agtaaataaactcttcaaggcca

SEQ ID NO: 425760 - DNA, 18 bp, Homo sapiens
agtaaataaattgtttga

SEQ ID NO: 425761 - DNA, 23 bp, Homo sapiens
agtaaatgctaggttaattccaa

SEQ ID NO: 425762 - DNA, 13 bp, Homo sapiens
agtaaattgcctt

SEQ ID NO: 425763 - DNA, 17 bp, Homo sapiens
agtaaccatttaatgtc

SEQ ID NO: 425764 - DNA, 17 bp, Homo sapiens
agtaacgcgtcttcctg

SEQ ID NO: 425765 - DNA, 19 bp, Homo sapiens
agtaacgcgtcttcctgag

SEQ ID NO: 425766 - DNA, 14 bp, Homo sapiens
agtaacttttacaa

SEQ ID NO: 425767 - DNA, 16 bp, Homo sapiens
agtaagaagacatgaa

SEQ ID NO: 425768 - DNA, 16 bp, Homo sapiens
agtaagaccggaagct

SEQ ID NO: 425769 - DNA, 14 bp, Homo sapiens
agtaagagctggtg

SEQ ID NO: 425770 - DNA, 20 bp, Homo sapiens
agtaagctgctctattgtag

SEQ ID NO: 425771 - DNA, 15 bp, Homo sapiens
agtaaggcagctctg

SEQ ID NO: 425772 - DNA, 14 bp, Homo sapiens
agtaaggtgcagtt

SEQ ID NO: 425773 - DNA, 23 bp, Homo sapiens
agtaagtatcttcgttcttgtta

SEQ ID NO: 425774 - DNA, 19 bp, Homo sapiens
agtaagttctgaaaactgt

SEQ ID NO: 425775 - DNA, 20 bp, Homo sapiens
agtaagttctgaaaactgtt

SEQ ID NO: 425776 - DNA, 15 bp, Homo sapiens
agtaataaaacatct

SEQ ID NO: 425777 - DNA, 16 bp, Homo sapiens
agtaataaaacatctt

SEQ ID NO: 425778 - DNA, 13 bp, Homo sapiens
agtaatagagcaa

SEQ ID NO: 425779 - DNA, 14 bp, Homo sapiens
agtaatagagcaaa

SEQ ID NO: 425780 - DNA, 22 bp, Homo sapiens
agtaatcccgccacctatctcg

SEQ ID NO: 425781 - DNA, 12 bp, Homo sapiens
agtaatgaattt

SEQ ID NO: 425782 - DNA, 19 bp, Homo sapiens
agtaatgcagacatttaca

SEQ ID NO: 425783 - DNA, 20 bp, Homo sapiens
agtaatgcagacatttacat

SEQ ID NO: 425784 - DNA, 21 bp, Homo sapiens
agtaatgcagacatttacatg

SEQ ID NO: 425785 - DNA, 15 bp, Homo sapiens
agtaattgtgaaaaa

SEQ ID NO: 425786 - DNA, 15 bp, Homo sapiens
agtaattgttacaat

SEQ ID NO: 425787 - DNA, 13 bp, Homo sapiens
agtaatttaaatg

SEQ ID NO: 425788 - DNA, 18 bp, Homo sapiens
agtaatttaaatgctttg

SEQ ID NO: 425789 - DNA, 15 bp, Homo sapiens
agtaattttctgatg

SEQ ID NO: 425790 - DNA, 14 bp, Homo sapiens
agtacaaagacagg

SEQ ID NO: 425791 - DNA, 14 bp, Homo sapiens
agtacaatgtttca

SEQ ID NO: 425792 - DNA, 16 bp, Homo sapiens
agtacaatgtttcaga

SEQ ID NO: 425793 - DNA, 19 bp, Homo sapiens
agtacaattctttgttgct

SEQ ID NO: 425794 - DNA, 21 bp, Homo sapiens
agtacagagaaattctgtggt

SEQ ID NO: 425795 - DNA, 22 bp, Homo sapiens
agtacatggaagaagtatattt

SEQ ID NO: 425796 - DNA, 12 bp, Homo sapiens
agtacatttaat

SEQ ID NO: 425797 - DNA, 16 bp, Homo sapiens
agtacatttggagaca

SEQ ID NO: 425798 - DNA, 20 bp, Homo sapiens
agtaccaaatccacaagcca

SEQ ID NO: 425799 - DNA, 19 bp, Homo sapiens
agtaccaatgctgttgtaa

SEQ ID NO: 425800 - DNA, 15 bp, Homo sapiens
agtaccactcttggt

SEQ ID NO: 425801 - DNA, 12 bp, Homo sapiens
agtacccacctg

SEQ ID NO: 425802 - DNA, 15 bp, Homo sapiens
agtacccacctgagc

SEQ ID NO: 425803 - DNA, 22 bp, Homo sapiens
agtacccacctgagctttggac

SEQ ID NO: 425804 - DNA, 18 bp, Homo sapiens
agtaccccagccactcct

SEQ ID NO: 425805 - DNA, 15 bp, Homo sapiens
agtacctccaagcaa

SEQ ID NO: 425806 - DNA, 13 bp, Homo sapiens
agtacctgctgcc

SEQ ID NO: 425807 - DNA, 19 bp, Homo sapiens
agtacctgctgccccagct

SEQ ID NO: 425808 - DNA, 14 bp, Homo sapiens
agtacctttgtcac

SEQ ID NO: 425809 - DNA, 19 bp, Homo sapiens
agtactaaaactagataac

SEQ ID NO: 425810 - DNA, 12 bp, Homo sapiens
agtactactgta

SEQ ID NO: 425811 - DNA, 13 bp, Homo sapiens
agtactactgtag

SEQ ID NO: 425812 - DNA, 14 bp, Homo sapiens
agtactataattta

SEQ ID NO: 425813 - DNA, 22 bp, Homo sapiens
agtactcacttttcacttgtct

SEQ ID NO: 425814 - DNA, 18 bp, Homo sapiens
agtactcctgcaaaattt

SEQ ID NO: 425815 - DNA, 19 bp, Homo sapiens
agtactcctgcaaaatttt

SEQ ID NO: 425816 - DNA, 17 bp, Homo sapiens
agtactccttaagaaca

SEQ ID NO: 425817 - DNA, 15 bp, Homo sapiens
agtactctctgctct

SEQ ID NO: 425818 - DNA, 19 bp, Homo sapiens
agtactctctgctctagcc

SEQ ID NO: 425819 - DNA, 22 bp, Homo sapiens
agtactgcacccagcatcacca

SEQ ID NO: 425820 - DNA, 15 bp, Homo sapiens
agtacttaatatact

SEQ ID NO: 425821 - DNA, 20 bp, Homo sapiens
agtacttgagggaccaatat

SEQ ID NO: 425822 - DNA, 23 bp, Homo sapiens
agtacttgagggaccaatattac

SEQ ID NO: 425823 - DNA, 14 bp, Homo sapiens
agtagaaattgttc

SEQ ID NO: 425824 - DNA, 14 bp, Homo sapiens
agtagaaattttac

SEQ ID NO: 425825 - DNA, 19 bp, Homo sapiens
agtagaacagataatcagt

SEQ ID NO: 425826 - DNA, 21 bp, Homo sapiens
agtagaaggtcggaggcttgg

SEQ ID NO: 425827 - DNA, 23 bp, Homo sapiens
agtagacagcaataactcggtgt

SEQ ID NO: 425828 - DNA, 16 bp, Homo sapiens
agtagagaagtatcca

SEQ ID NO: 425829 - DNA, 16 bp, Homo sapiens
agtagatctgtggcga

SEQ ID NO: 425830 - DNA, 22 bp, Homo sapiens
agtagattgatctaaggcatgc

SEQ ID NO: 425831 - DNA, 20 bp, Homo sapiens
agtagcacccccagccatct

SEQ ID NO: 425832 - DNA, 14 bp, Homo sapiens
agtagcagctgtgt

SEQ ID NO: 425833 - DNA, 19 bp, Homo sapiens
agtagcatgttgagccagg

SEQ ID NO: 425834 - DNA, 18 bp, Homo sapiens
agtagccattttgtaact

SEQ ID NO: 425835 - DNA, 23 bp, Homo sapiens
agtagcccacaataatgaataat

SEQ ID NO: 425836 - DNA, 16 bp, Homo sapiens
agtagctgataaagaa

SEQ ID NO: 425837 - DNA, 16 bp, Homo sapiens
agtagctgccaaaaag

SEQ ID NO: 425838 - DNA, 19 bp, Homo sapiens
agtagctgtggggagctgg

SEQ ID NO: 425839 - DNA, 20 bp, Homo sapiens
agtagctttccacatttgtc

SEQ ID NO: 425840 - DNA, 13 bp, Homo sapiens
agtaggagacaca

SEQ ID NO: 425841 - DNA, 23 bp, Homo sapiens
agtaggagacacagatggcacct

SEQ ID NO: 425842 - DNA, 12 bp, Homo sapiens
agtaggagagga

SEQ ID NO: 425843 - DNA, 15 bp, Homo sapiens
agtaggctaaaaaca

SEQ ID NO: 425844 - DNA, 14 bp, Homo sapiens
agtaggctgtattt

SEQ ID NO: 425845 - DNA, 22 bp, Homo sapiens
agtagggaaaatagggtccttg

SEQ ID NO: 425846 - DNA, 13 bp, Homo sapiens
agtagggtcaggc

SEQ ID NO: 425847 - DNA, 22 bp, Homo sapiens
agtaggtgggattacaggtgcc

SEQ ID NO: 425848 - DNA, 16 bp, Homo sapiens
agtaggtgggtcttgg

SEQ ID NO: 425849 - DNA, 20 bp, Homo sapiens
agtaggttgaggacaggaga

SEQ ID NO: 425850 - DNA, 21 bp, Homo sapiens
agtagtaaaattagaaaaaaa

SEQ ID NO: 425851 - DNA, 16 bp, Homo sapiens
agtagtccaggctgtc

SEQ ID NO: 425852 - DNA, 19 bp, Homo sapiens
agtagtgcctgtgatcgtg

SEQ ID NO: 425853 - DNA, 14 bp, Homo sapiens
agtataaaagacaa

SEQ ID NO: 425854 - DNA, 14 bp, Homo sapiens
agtataaatttgtg

SEQ ID NO: 425855 - DNA, 17 bp, Homo sapiens
agtataaatttgtgtaa

SEQ ID NO: 425856 - DNA, 21 bp, Homo sapiens
agtatacagttcaataaactt

SEQ ID NO: 425857 - DNA, 14 bp, Homo sapiens
agtatacccactgc

SEQ ID NO: 425858 - DNA, 16 bp, Homo sapiens
agtatactgtgtggga

SEQ ID NO: 425859 - DNA, 23 bp, Homo sapiens
agtatactttgtacccatcatgt

SEQ ID NO: 425860 - DNA, 14 bp, Homo sapiens
agtatataagctgt

SEQ ID NO: 425861 - DNA, 15 bp, Homo sapiens
agtatataagctttt

SEQ ID NO: 425862 - DNA, 14 bp, Homo sapiens
agtatatatgtaca

SEQ ID NO: 425863 - DNA, 15 bp, Homo sapiens
agtatatatgtacag

SEQ ID NO: 425864 - DNA, 16 bp, Homo sapiens
agtatatctggacaag

SEQ ID NO: 425865 - DNA, 11 bp, Homo sapiens
agtatatttat

SEQ ID NO: 425866 - DNA, 17 bp, Homo sapiens
agtatatttatataatt

SEQ ID NO: 425867 - DNA, 20 bp, Homo sapiens
agtatatttatataattatg

SEQ ID NO: 425868 - DNA, 12 bp, Homo sapiens
agtatatttttg

SEQ ID NO: 425869 - DNA, 16 bp, Homo sapiens
agtatcaaaggcagaa

SEQ ID NO: 425870 - DNA, 13 bp, Homo sapiens
agtatcaaggctg

SEQ ID NO: 425871 - DNA, 17 bp, Homo sapiens
agtatcactgtctttcc

SEQ ID NO: 425872 - DNA, 22 bp, Homo sapiens
agtatcactgtctttcctagat

SEQ ID NO: 425873 - DNA, 12 bp, Homo sapiens
agtatcatgcat

SEQ ID NO: 425874 - DNA, 18 bp, Homo sapiens
agtatccaattatgtgac

SEQ ID NO: 425875 - DNA, 19 bp, Homo sapiens
agtatccaattatgtgaca

SEQ ID NO: 425876 - DNA, 16 bp, Homo sapiens
agtatctaacatgtat

SEQ ID NO: 425877 - DNA, 22 bp, Homo sapiens
agtatctcggacctttcagctg

SEQ ID NO: 425878 - DNA, 23 bp, Homo sapiens
agtatctcggacctttcagctgt

SEQ ID NO: 425879 - DNA, 15 bp, Homo sapiens
agtatctggctgggt

SEQ ID NO: 425880 - DNA, 16 bp, Homo sapiens
agtatctggctgggtt

SEQ ID NO: 425881 - DNA, 15 bp, Homo sapiens
agtatctgtaaccct

SEQ ID NO: 425882 - DNA, 18 bp, Homo sapiens
agtatctgtatctctctc

SEQ ID NO: 425883 - DNA, 17 bp, Homo sapiens
agtatcttttttcaaaa

SEQ ID NO: 425884 - DNA, 23 bp, Homo sapiens
agtatgaagacactgtcaatgag

SEQ ID NO: 425885 - DNA, 15 bp, Homo sapiens
agtatgaatgatgtt

SEQ ID NO: 425886 - DNA, 21 bp, Homo sapiens
agtatgagaaatacagtgctt

SEQ ID NO: 425887 - DNA, 15 bp, Homo sapiens
agtatgtaaagtatg

SEQ ID NO: 425888 - DNA, 21 bp, Homo sapiens
agtatgtcagtccaataaatt

SEQ ID NO: 425889 - DNA, 12 bp, Homo sapiens
agtatgtgtcta

SEQ ID NO: 425890 - DNA, 16 bp, Homo sapiens
agtatgttaagctctt

SEQ ID NO: 425891 - DNA, 19 bp, Homo sapiens
agtatgttaagctctttat

SEQ ID NO: 425892 - DNA, 20 bp, Homo sapiens
agtattaaactctcctttga

SEQ ID NO: 425893 - DNA, 17 bp, Homo sapiens
agtattaacatcaaaga

SEQ ID NO: 425894 - DNA, 15 bp, Homo sapiens
agtattaactattag

SEQ ID NO: 425895 - DNA, 21 bp, Homo sapiens
agtattccaccttaaattaaa

SEQ ID NO: 425896 - DNA, 22 bp, Homo sapiens
agtattccaccttaaattaaac

SEQ ID NO: 425897 - DNA, 22 bp, Homo sapiens
agtattccattgtgtgagtgta

SEQ ID NO: 425898 - DNA, 20 bp, Homo sapiens
agtattccatttttactaaa

SEQ ID NO: 425899 - DNA, 14 bp, Homo sapiens
agtattccttggcc

SEQ ID NO: 425900 - DNA, 17 bp, Homo sapiens
agtattccttggcccag

SEQ ID NO: 425901 - DNA, 20 bp, Homo sapiens
agtattccttggcccagcag

SEQ ID NO: 425902 - DNA, 21 bp, Homo sapiens
agtattccttggcccagcagc

SEQ ID NO: 425903 - DNA, 13 bp, Homo sapiens
agtattctcagag

SEQ ID NO: 425904 - DNA, 22 bp, Homo sapiens
agtattctcagagcatgtgtca

SEQ ID NO: 425905 - DNA, 23 bp, Homo sapiens
agtattctcagagcatgtgtcag

SEQ ID NO: 425906 - DNA, 15 bp, Homo sapiens
agtattcttgtcaaa

SEQ ID NO: 425907 - DNA, 14 bp, Homo sapiens
agtattgaaaactt

SEQ ID NO: 425908 - DNA, 15 bp, Homo sapiens
agtattgaaaacttc

SEQ ID NO: 425909 - DNA, 14 bp, Homo sapiens
agtattgagacact

SEQ ID NO: 425910 - DNA, 17 bp, Homo sapiens
agtattgagacactgtc

SEQ ID NO: 425911 - DNA, 21 bp, Homo sapiens
agtattgagacactgtcaaga

SEQ ID NO: 425912 - DNA, 16 bp, Homo sapiens
agtattgccacctctg

SEQ ID NO: 425913 - DNA, 21 bp, Homo sapiens
agtattgccacctctggccaa

SEQ ID NO: 425914 - DNA, 17 bp, Homo sapiens
agtattgtgtaaaggaa

SEQ ID NO: 425915 - DNA, 15 bp, Homo sapiens
agtatttaaatgttc

SEQ ID NO: 425916 - DNA, 20 bp, Homo sapiens
agtatttattgttcccacaa

SEQ ID NO: 425917 - DNA, 17 bp, Homo sapiens
agtatttcagatgcttt

SEQ ID NO: 425918 - DNA, 12 bp, Homo sapiens
agtatttgctgt

SEQ ID NO: 425919 - DNA, 14 bp, Homo sapiens
agtatttgctgttt

SEQ ID NO: 425920 - DNA, 17 bp, Homo sapiens
agtattttggttcttag

SEQ ID NO: 425921 - DNA, 18 bp, Homo sapiens
agtattttggttcttagt

SEQ ID NO: 425922 - DNA, 19 bp, Homo sapiens
agtatttttatatttaaat

SEQ ID NO: 425923 - DNA, 21 bp, Homo sapiens
agtatttttatatttaaatgt

SEQ ID NO: 425924 - DNA, 21 bp, Homo sapiens
agtcaacactcttcttgagca

SEQ ID NO: 425925 - DNA, 13 bp, Homo sapiens
agtcaactgctgt

SEQ ID NO: 425926 - DNA, 21 bp, Homo sapiens
agtcaactgctgttttatgtc

SEQ ID NO: 425927 - DNA, 16 bp, Homo sapiens
agtcaaggagtggctt

SEQ ID NO: 425928 - DNA, 18 bp, Homo sapiens
agtcaagtgtgcctgcta

SEQ ID NO: 425929 - DNA, 15 bp, Homo sapiens
agtcaatcaaacagg

SEQ ID NO: 425930 - DNA, 22 bp, Homo sapiens
agtcaatcatttctcactgtgt

SEQ ID NO: 425931 - DNA, 16 bp, Homo sapiens
agtcaatccaagacta

SEQ ID NO: 425932 - DNA, 14 bp, Homo sapiens
agtcaatgtgcagt

SEQ ID NO: 425933 - DNA, 20 bp, Homo sapiens
agtcacacattatagaaatt

SEQ ID NO: 425934 - DNA, 19 bp, Homo sapiens
agtcacactgctagcaaat

SEQ ID NO: 425935 - DNA, 17 bp, Homo sapiens
agtcacagctgcagctg

SEQ ID NO: 425936 - DNA, 18 bp, Homo sapiens
agtcacagctttcccagg

SEQ ID NO: 425937 - DNA, 20 bp, Homo sapiens
agtcacagctttcccaggta

SEQ ID NO: 425938 - DNA, 14 bp, Homo sapiens
agtcacccctgtct

SEQ ID NO: 425939 - DNA, 16 bp, Homo sapiens
agtcaccctgtggcaa

SEQ ID NO: 425940 - DNA, 16 bp, Homo sapiens
agtcacccttctgggc

SEQ ID NO: 425941 - DNA, 12 bp, Homo sapiens
agtcacctcctc

SEQ ID NO: 425942 - DNA, 20 bp, Homo sapiens
agtcacctgcaagccccagg

SEQ ID NO: 425943 - DNA, 22 bp, Homo sapiens
agtcacctgcaagccccagggc

SEQ ID NO: 425944 - DNA, 23 bp, Homo sapiens
agtcacctgcaagccccagggcc

SEQ ID NO: 425945 - DNA, 14 bp, Homo sapiens
agtcaccttccagg

SEQ ID NO: 425946 - DNA, 19 bp, Homo sapiens
agtcactaaatttctcagt

SEQ ID NO: 425947 - DNA, 16 bp, Homo sapiens
agtcacttatttcata

SEQ ID NO: 425948 - DNA, 12 bp, Homo sapiens
agtcagagccct

SEQ ID NO: 425949 - DNA, 14 bp, Homo sapiens
agtcagatggatgt

SEQ ID NO: 425950 - DNA, 15 bp, Homo sapiens
agtcagatggatgta

SEQ ID NO: 425951 - DNA, 18 bp, Homo sapiens
agtcagatggatgtagat

SEQ ID NO: 425952 - DNA, 15 bp, Homo sapiens
agtcagccagcttgg

SEQ ID NO: 425953 - DNA, 19 bp, Homo sapiens
agtcaggaagcctcctgct

SEQ ID NO: 425954 - DNA, 16 bp, Homo sapiens
agtcaggctgcagagg

SEQ ID NO: 425955 - DNA, 15 bp, Homo sapiens
agtcagggagccctg

SEQ ID NO: 425956 - DNA, 20 bp, Homo sapiens
agtcagggcccagaggctga

SEQ ID NO: 425957 - DNA, 18 bp, Homo sapiens
agtcagtaggagaggatg

SEQ ID NO: 425958 - DNA, 19 bp, Homo sapiens
agtcagtaggtccaagggc

SEQ ID NO: 425959 - DNA, 17 bp, Homo sapiens
agtcagtattcccagcc

SEQ ID NO: 425960 - DNA, 15 bp, Homo sapiens
agtcagttcccggag

SEQ ID NO: 425961 - DNA, 21 bp, Homo sapiens
agtcagttcccggagcacagc

SEQ ID NO: 425962 - DNA, 14 bp, Homo sapiens
agtcagttggagaa

SEQ ID NO: 425963 - DNA, 15 bp, Homo sapiens
agtcatatgtgaaga

SEQ ID NO: 425964 - DNA, 15 bp, Homo sapiens
agtcatcaaaaagag

SEQ ID NO: 425965 - DNA, 18 bp, Homo sapiens
agtcatctccatcagctg

SEQ ID NO: 425966 - DNA, 20 bp, Homo sapiens
agtcatctccatcagctgta

SEQ ID NO: 425967 - DNA, 20 bp, Homo sapiens
agtcatgacatttctcaaag

SEQ ID NO: 425968 - DNA, 21 bp, Homo sapiens
agtcatgcgtccactttccct

SEQ ID NO: 425969 - DNA, 16 bp, Homo sapiens
agtcatgggaacgcag

SEQ ID NO: 425970 - DNA, 23 bp, Homo sapiens
agtcatgtactggagagtggcaa

SEQ ID NO: 425971 - DNA, 13 bp, Homo sapiens
agtcatgtgcatt

SEQ ID NO: 425972 - DNA, 22 bp, Homo sapiens
agtcatgtgtcagctgtagaaa

SEQ ID NO: 425973 - DNA, 22 bp, Homo sapiens
agtcattatgagaggcaatgat

SEQ ID NO: 425974 - DNA, 19 bp, Homo sapiens
agtcattgggttttatcag

SEQ ID NO: 425975 - DNA, 22 bp, Homo sapiens
agtcatttgcgcacaacttaaa

SEQ ID NO: 425976 - DNA, 16 bp, Homo sapiens
agtccaaatgtcctcc

SEQ ID NO: 425977 - DNA, 23 bp, Homo sapiens
agtccaaatgtcctccagaagcc

SEQ ID NO: 425978 - DNA, 20 bp, Homo sapiens
agtccaaatgtgatcaactg

SEQ ID NO: 425979 - DNA, 12 bp, Homo sapiens
agtccaacctgc

SEQ ID NO: 425980 - DNA, 15 bp, Homo sapiens
agtccaacctgcctg

SEQ ID NO: 425981 - DNA, 19 bp, Homo sapiens
agtccaacgtggggcagca

SEQ ID NO: 425982 - DNA, 14 bp, Homo sapiens
agtccaatttaagg

SEQ ID NO: 425983 - DNA, 20 bp, Homo sapiens
agtccaccccaattaactga

SEQ ID NO: 425984 - DNA, 21 bp, Homo sapiens
agtccaccccaattaactgaa

SEQ ID NO: 425985 - DNA, 17 bp, Homo sapiens
agtccacctgagctgcc

SEQ ID NO: 425986 - DNA, 21 bp, Homo sapiens
agtccacgattctcaggtatt

SEQ ID NO: 425987 - DNA, 14 bp, Homo sapiens
agtccactgctcca

SEQ ID NO: 425988 - DNA, 12 bp, Homo sapiens
agtccactttcc

SEQ ID NO: 425989 - DNA, 14 bp, Homo sapiens
agtccactttcctc

SEQ ID NO: 425990 - DNA, 17 bp, Homo sapiens
agtccactttcctctct

SEQ ID NO: 425991 - DNA, 20 bp, Homo sapiens
agtccactttcctctctctc

SEQ ID NO: 425992 - DNA, 15 bp, Homo sapiens
agtccagacctgggc

SEQ ID NO: 425993 - DNA, 21 bp, Homo sapiens
agtccagacctgggccctggt

SEQ ID NO: 425994 - DNA, 12 bp, Homo sapiens
agtccagagctt

SEQ ID NO: 425995 - DNA, 19 bp, Homo sapiens
agtccagctccccccaaga

SEQ ID NO: 425996 - DNA, 14 bp, Homo sapiens
agtccagctctccc

SEQ ID NO: 425997 - DNA, 15 bp, Homo sapiens
agtccagctctcccc

SEQ ID NO: 425998 - DNA, 23 bp, Homo sapiens
agtccagctctcccctgcgcagg

SEQ ID NO: 425999 - DNA, 16 bp, Homo sapiens
agtccaggagccccag

SEQ ID NO: 426000 - DNA, 21 bp, Homo sapiens
agtccaggagccccagccagc

SEQ ID NO: 426001 - DNA, 22 bp, Homo sapiens
agtccaggagccccagccagcc

SEQ ID NO: 426002 - DNA, 23 bp, Homo sapiens
agtccaggagccccagccagccc

SEQ ID NO: 426003 - DNA, 23 bp, Homo sapiens
agtccaggccccaaaaccacagc

SEQ ID NO: 426004 - DNA, 12 bp, Homo sapiens
agtccaggctgt

SEQ ID NO: 426005 - DNA, 17 bp, Homo sapiens
agtccaggtcgggctca

SEQ ID NO: 426006 - DNA, 15 bp, Homo sapiens
agtccagtgtttcca

SEQ ID NO: 426007 - DNA, 18 bp, Homo sapiens
agtccatagctgagctgg

SEQ ID NO: 426008 - DNA, 19 bp, Homo sapiens
agtccatagctgagctgga

SEQ ID NO: 426009 - DNA, 16 bp, Homo sapiens
agtccatgagttgagt

SEQ ID NO: 426010 - DNA, 22 bp, Homo sapiens
agtcccaatttaagagtcctga

SEQ ID NO: 426011 - DNA, 20 bp, Homo sapiens
agtcccaccggttgcttctg

SEQ ID NO: 426012 - DNA, 23 bp, Homo sapiens
agtcccaccggttgcttctggga

SEQ ID NO: 426013 - DNA, 12 bp, Homo sapiens
agtcccagagca

SEQ ID NO: 426014 - DNA, 20 bp, Homo sapiens
agtcccagtattctcagagc

SEQ ID NO: 426015 - DNA, 22 bp, Homo sapiens
agtcccagtattctcagagcat

SEQ ID NO: 426016 - DNA, 13 bp, Homo sapiens
agtcccagtggga

SEQ ID NO: 426017 - DNA, 15 bp, Homo sapiens
agtcccagtgggagg

SEQ ID NO: 426018 - DNA, 13 bp, Homo sapiens
agtcccatctcac

SEQ ID NO: 426019 - DNA, 14 bp, Homo sapiens
agtccccagccctt

SEQ ID NO: 426020 - DNA, 18 bp, Homo sapiens
agtcccccaccacactga

SEQ ID NO: 426021 - DNA, 20 bp, Homo sapiens
agtccccgtgccccgcctcc

SEQ ID NO: 426022 - DNA, 20 bp, Homo sapiens
agtccccgtgtgccccaaga

SEQ ID NO: 426023 - DNA, 19 bp, Homo sapiens
agtcccctccccggcccta

SEQ ID NO: 426024 - DNA, 16 bp, Homo sapiens
agtccctccctcctgg

SEQ ID NO: 426025 - DNA, 21 bp, Homo sapiens
agtccctccctcctggctcac

SEQ ID NO: 426026 - DNA, 13 bp, Homo sapiens
agtccctggagct

SEQ ID NO: 426027 - DNA, 16 bp, Homo sapiens
agtccctgtgttctgc

SEQ ID NO: 426028 - DNA, 13 bp, Homo sapiens
agtcccttcccct

SEQ ID NO: 426029 - DNA, 14 bp, Homo sapiens
agtcccttcccctc

SEQ ID NO: 426030 - DNA, 17 bp, Homo sapiens
agtcccttcccctccct

SEQ ID NO: 426031 - DNA, 21 bp, Homo sapiens
agtcccttcccctccctggct

SEQ ID NO: 426032 - DNA, 17 bp, Homo sapiens
agtcccttcctgtcctg

SEQ ID NO: 426033 - DNA, 20 bp, Homo sapiens
agtcccttcctgtcctgctc

SEQ ID NO: 426034 - DNA, 20 bp, Homo sapiens
agtcctacaagctaaaatta

SEQ ID NO: 426035 - DNA, 17 bp, Homo sapiens
agtcctcaaagcttttt

SEQ ID NO: 426036 - DNA, 14 bp, Homo sapiens
agtcctcacagcct

SEQ ID NO: 426037 - DNA, 16 bp, Homo sapiens
agtcctcacagcctct

SEQ ID NO: 426038 - DNA, 18 bp, Homo sapiens
agtcctcacagcctctcc

SEQ ID NO: 426039 - DNA, 16 bp, Homo sapiens
agtcctcacatgcccg

SEQ ID NO: 426040 - DNA, 16 bp, Homo sapiens
agtcctcactcccagt

SEQ ID NO: 426041 - DNA, 16 bp, Homo sapiens
agtcctccctgctcag

SEQ ID NO: 426042 - DNA, 21 bp, Homo sapiens
agtcctccctgctcagctggc

SEQ ID NO: 426043 - DNA, 20 bp, Homo sapiens
agtcctctcccaagtccaca

SEQ ID NO: 426044 - DNA, 17 bp, Homo sapiens
agtcctgcctggccagg

SEQ ID NO: 426045 - DNA, 20 bp, Homo sapiens
agtcctgcctggccaggcag

SEQ ID NO: 426046 - DNA, 21 bp, Homo sapiens
agtcctgcctggccaggcaga

SEQ ID NO: 426047 - DNA, 20 bp, Homo sapiens
agtcctgctctctacccagc

SEQ ID NO: 426048 - DNA, 21 bp, Homo sapiens
agtcctggcatgggaatgaat

SEQ ID NO: 426049 - DNA, 18 bp, Homo sapiens
agtcctggctacatccca

SEQ ID NO: 426050 - DNA, 16 bp, Homo sapiens
agtcctgggagaccca

SEQ ID NO: 426051 - DNA, 10 bp, Homo sapiens
agtcctgtat

SEQ ID NO: 426052 - DNA, 13 bp, Homo sapiens
agtcctgtgaatt

SEQ ID NO: 426053 - DNA, 16 bp, Homo sapiens
agtcctgtgaatttct

SEQ ID NO: 426054 - DNA, 23 bp, Homo sapiens
agtcctgtgaatttcttcactgt

SEQ ID NO: 426055 - DNA, 15 bp, Homo sapiens
agtcctgttctcaga

SEQ ID NO: 426056 - DNA, 21 bp, Homo sapiens
agtcctgttctcagagctcca

SEQ ID NO: 426057 - DNA, 17 bp, Homo sapiens
agtccttacctcttccg

SEQ ID NO: 426058 - DNA, 17 bp, Homo sapiens
agtccttagaatgaggg

SEQ ID NO: 426059 - DNA, 18 bp, Homo sapiens
agtccttagaatgaggga

SEQ ID NO: 426060 - DNA, 22 bp, Homo sapiens
agtccttcagtgagcccctccc

SEQ ID NO: 426061 - DNA, 18 bp, Homo sapiens
agtcgattaacctgcatg

SEQ ID NO: 426062 - DNA, 22 bp, Homo sapiens
agtcgcagaccagagctgtctg

SEQ ID NO: 426063 - DNA, 23 bp, Homo sapiens
agtcgcaggatccgctgccacca

SEQ ID NO: 426064 - DNA, 19 bp, Homo sapiens
agtcgcatctcagtgcagg

SEQ ID NO: 426065 - DNA, 17 bp, Homo sapiens
agtcgccaggcaggagg

SEQ ID NO: 426066 - DNA, 13 bp, Homo sapiens
agtcgccctctgt

SEQ ID NO: 426067 - DNA, 17 bp, Homo sapiens
agtcgccctctgtgcct

SEQ ID NO: 426068 - DNA, 16 bp, Homo sapiens
agtcgctgaggaaaaa

SEQ ID NO: 426069 - DNA, 20 bp, Homo sapiens
agtcggatctagccatggct

SEQ ID NO: 426070 - DNA, 17 bp, Homo sapiens
agtcggctgggcagggc

SEQ ID NO: 426071 - DNA, 18 bp, Homo sapiens
agtcggctgggcagggcc

SEQ ID NO: 426072 - DNA, 20 bp, Homo sapiens
agtcggctgggcagggccgc

SEQ ID NO: 426073 - DNA, 19 bp, Homo sapiens
agtcgggaaattctgctgc

SEQ ID NO: 426074 - DNA, 21 bp, Homo sapiens
agtcgggaaattctgctgctt

SEQ ID NO: 426075 - DNA, 22 bp, Homo sapiens
agtcgtcatcacttttcagtga

SEQ ID NO: 426076 - DNA, 14 bp, Homo sapiens
agtctaaagtttac

SEQ ID NO: 426077 - DNA, 18 bp, Homo sapiens
agtctaaagtttacagta

SEQ ID NO: 426078 - DNA, 23 bp, Homo sapiens
agtctaaagtttacagtaaataa

SEQ ID NO: 426079 - DNA, 15 bp, Homo sapiens
agtctaaagttttat

SEQ ID NO: 426080 - DNA, 16 bp, Homo sapiens
agtctaaatatttcct

SEQ ID NO: 426081 - DNA, 21 bp, Homo sapiens
agtctacaggcctttcaggaa

SEQ ID NO: 426082 - DNA, 22 bp, Homo sapiens
agtctacaggcctttcaggaag

SEQ ID NO: 426083 - DNA, 15 bp, Homo sapiens
agtctacttctgtgt

SEQ ID NO: 426084 - DNA, 19 bp, Homo sapiens
agtctacttctgtgtctgt

SEQ ID NO: 426085 - DNA, 11 bp, Homo sapiens
agtctattttt

SEQ ID NO: 426086 - DNA, 20 bp, Homo sapiens
agtctatttttttaactgaa

SEQ ID NO: 426087 - DNA, 20 bp, Homo sapiens
agtctcaaaaatacaaaata

SEQ ID NO: 426088 - DNA, 21 bp, Homo sapiens
agtctcaaaaatacaaaataa

SEQ ID NO: 426089 - DNA, 14 bp, Homo sapiens
agtctcaattttgt

SEQ ID NO: 426090 - DNA, 19 bp, Homo sapiens
agtctcaattttgtattta

SEQ ID NO: 426091 - DNA, 21 bp, Homo sapiens
agtctcaattttgtatttaat

SEQ ID NO: 426092 - DNA, 14 bp, Homo sapiens
agtctcactcccct

SEQ ID NO: 426093 - DNA, 23 bp, Homo sapiens
agtctcaggaggagggcgcatgt

SEQ ID NO: 426094 - DNA, 21 bp, Homo sapiens
agtctcagtgctagcttattt

SEQ ID NO: 426095 - DNA, 18 bp, Homo sapiens
agtctcattacttttgaa

SEQ ID NO: 426096 - DNA, 19 bp, Homo sapiens
agtctcattctgttgccca

SEQ ID NO: 426097 - DNA, 14 bp, Homo sapiens
agtctccaccagga

SEQ ID NO: 426098 - DNA, 12 bp, Homo sapiens
agtctccctccg

SEQ ID NO: 426099 - DNA, 16 bp, Homo sapiens
agtctccctccgactc

SEQ ID NO: 426100 - DNA, 14 bp, Homo sapiens
agtctcctgtatca

SEQ ID NO: 426101 - DNA, 23 bp, Homo sapiens
agtctcctttgcactgagggcca

SEQ ID NO: 426102 - DNA, 13 bp, Homo sapiens
agtctcgctctgt

SEQ ID NO: 426103 - DNA, 15 bp, Homo sapiens
agtctctccctgggg

SEQ ID NO: 426104 - DNA, 23 bp, Homo sapiens
agtctctctgtgaatacaattaa

SEQ ID NO: 426105 - DNA, 15 bp, Homo sapiens
agtctctcttaccct

SEQ ID NO: 426106 - DNA, 16 bp, Homo sapiens
agtctctgccacccac

SEQ ID NO: 426107 - DNA, 17 bp, Homo sapiens
agtctctgccacccact

SEQ ID NO: 426108 - DNA, 22 bp, Homo sapiens
agtctctgccacccactcagga

SEQ ID NO: 426109 - DNA, 16 bp, Homo sapiens
agtctcttctccactg

SEQ ID NO: 426110 - DNA, 21 bp, Homo sapiens
agtctcttctccactggatgg

SEQ ID NO: 426111 - DNA, 15 bp, Homo sapiens
agtctctttaatctt

SEQ ID NO: 426112 - DNA, 23 bp, Homo sapiens
agtctctttaatcttcagtttta

SEQ ID NO: 426113 - DNA, 15 bp, Homo sapiens
agtctgaacagctgt

SEQ ID NO: 426114 - DNA, 19 bp, Homo sapiens
agtctgaacccttgtgctt

SEQ ID NO: 426115 - DNA, 19 bp, Homo sapiens
agtctgaaggagaggagtg

SEQ ID NO: 426116 - DNA, 20 bp, Homo sapiens
agtctgaaggagaggagtgc

SEQ ID NO: 426117 - DNA, 17 bp, Homo sapiens
agtctgaagtttcattt

SEQ ID NO: 426118 - DNA, 21 bp, Homo sapiens
agtctgaattgttgaaactaa

SEQ ID NO: 426119 - DNA, 22 bp, Homo sapiens
agtctgaattgttgaaactaaa

SEQ ID NO: 426120 - DNA, 20 bp, Homo sapiens
agtctgacaggaagactgga

SEQ ID NO: 426121 - DNA, 21 bp, Homo sapiens
agtctgacaggaagactggag

SEQ ID NO: 426122 - DNA, 12 bp, Homo sapiens
agtctgagcccc

SEQ ID NO: 426123 - DNA, 20 bp, Homo sapiens
agtctgcttaccaaaacata

SEQ ID NO: 426124 - DNA, 14 bp, Homo sapiens
agtctggagaccag

SEQ ID NO: 426125 - DNA, 20 bp, Homo sapiens
agtctggcaaacatgtgcaa

SEQ ID NO: 426126 - DNA, 14 bp, Homo sapiens
agtctggcctgcca

SEQ ID NO: 426127 - DNA, 19 bp, Homo sapiens
agtctggcctgccaggctc

SEQ ID NO: 426128 - DNA, 13 bp, Homo sapiens
agtctgggcctct

SEQ ID NO: 426129 - DNA, 15 bp, Homo sapiens
agtctggtttctaga

SEQ ID NO: 426130 - DNA, 23 bp, Homo sapiens
agtctgtcatgaacatgttcctg

SEQ ID NO: 426131 - DNA, 14 bp, Homo sapiens
agtctgtctactgt

SEQ ID NO: 426132 - DNA, 15 bp, Homo sapiens
agtctgtctactgtg

SEQ ID NO: 426133 - DNA, 17 bp, Homo sapiens
agtctgtctactgtggt

SEQ ID NO: 426134 - DNA, 16 bp, Homo sapiens
agtctgtctgcactgc

SEQ ID NO: 426135 - DNA, 21 bp, Homo sapiens
agtctgtgcctggagctcctg

SEQ ID NO: 426136 - DNA, 20 bp, Homo sapiens
agtctgtggacactgtggaa

SEQ ID NO: 426137 - DNA, 15 bp, Homo sapiens
agtctgtgtgaaggt

SEQ ID NO: 426138 - DNA, 15 bp, Homo sapiens
agtcttacaggaagc

SEQ ID NO: 426139 - DNA, 16 bp, Homo sapiens
agtcttacaggaagcc

SEQ ID NO: 426140 - DNA, 20 bp, Homo sapiens
agtcttcaagggctgcttca

SEQ ID NO: 426141 - DNA, 17 bp, Homo sapiens
agtcttcactctctgaa

SEQ ID NO: 426142 - DNA, 20 bp, Homo sapiens
agtcttcatggtctcttcca

SEQ ID NO: 426143 - DNA, 20 bp, Homo sapiens
agtcttccatcagcagtgat

SEQ ID NO: 426144 - DNA, 19 bp, Homo sapiens
agtcttccctagggctggg

SEQ ID NO: 426145 - DNA, 13 bp, Homo sapiens
agtcttctcatag

SEQ ID NO: 426146 - DNA, 20 bp, Homo sapiens
agtcttctcatagcattaac

SEQ ID NO: 426147 - DNA, 12 bp, Homo sapiens
agtcttgcattg

SEQ ID NO: 426148 - DNA, 15 bp, Homo sapiens
agtcttgcattgaat

SEQ ID NO: 426149 - DNA, 21 bp, Homo sapiens
agtcttgctgtggtctctttg

SEQ ID NO: 426150 - DNA, 23 bp, Homo sapiens
agtcttgctgtggtctctttgtg

SEQ ID NO: 426151 - DNA, 15 bp, Homo sapiens
agtcttggctcactg

SEQ ID NO: 426152 - DNA, 20 bp, Homo sapiens
agtcttgtgcttttcctatt

SEQ ID NO: 426153 - DNA, 18 bp, Homo sapiens
agtctttagctatctgtt

SEQ ID NO: 426154 - DNA, 20 bp, Homo sapiens
agtctttcacagtaccatct

SEQ ID NO: 426155 - DNA, 14 bp, Homo sapiens
agtctttgccttct

SEQ ID NO: 426156 - DNA, 18 bp, Homo sapiens
agtctttgctcagtggat

SEQ ID NO: 426157 - DNA, 19 bp, Homo sapiens
agtctttgggggattcaaa

SEQ ID NO: 426158 - DNA, 23 bp, Homo sapiens
agtctttttagtgttttgcaagg

SEQ ID NO: 426159 - DNA, 20 bp, Homo sapiens
agtctttttttttaagtgtt

SEQ ID NO: 426160 - DNA, 23 bp, Homo sapiens
agtgaaaaagacttcaaatgtta

SEQ ID NO: 426161 - DNA, 21 bp, Homo sapiens
agtgaaagacatttcaaatct

SEQ ID NO: 426162 - DNA, 18 bp, Homo sapiens
agtgaaagggctatggca

SEQ ID NO: 426163 - DNA, 21 bp, Homo sapiens
agtgaaattttggtgaatgtg

SEQ ID NO: 426164 - DNA, 15 bp, Homo sapiens
agtgaacaactattt

SEQ ID NO: 426165 - DNA, 20 bp, Homo sapiens
agtgaacacactcagcagcc

SEQ ID NO: 426166 - DNA, 18 bp, Homo sapiens
agtgaacacattgtgtca

SEQ ID NO: 426167 - DNA, 13 bp, Homo sapiens
agtgaacatttct

SEQ ID NO: 426168 - DNA, 14 bp, Homo sapiens
agtgaacatttcta

SEQ ID NO: 426169 - DNA, 13 bp, Homo sapiens
agtgaaccatcat

SEQ ID NO: 426170 - DNA, 17 bp, Homo sapiens
agtgaacctaccttcat

SEQ ID NO: 426171 - DNA, 13 bp, Homo sapiens
agtgaagaaaatg

SEQ ID NO: 426172 - DNA, 16 bp, Homo sapiens
agtgaagcccaggagg

SEQ ID NO: 426173 - DNA, 17 bp, Homo sapiens
agtgaagcccaggagga

SEQ ID NO: 426174 - DNA, 17 bp, Homo sapiens
agtgaaggagccacgtg

SEQ ID NO: 426175 - DNA, 20 bp, Homo sapiens
agtgaaggagccacgtgaat

SEQ ID NO: 426176 - DNA, 12 bp, Homo sapiens
agtgaagtaatt

SEQ ID NO: 426177 - DNA, 15 bp, Homo sapiens
agtgaagtccttcag

SEQ ID NO: 426178 - DNA, 16 bp, Homo sapiens
agtgaatacatggtag

SEQ ID NO: 426179 - DNA, 14 bp, Homo sapiens
agtgaatataaatg

SEQ ID NO: 426180 - DNA, 19 bp, Homo sapiens
agtgaatcttatggtggaa

SEQ ID NO: 426181 - DNA, 21 bp, Homo sapiens
agtgaatcttatggtggaaga

SEQ ID NO: 426182 - DNA, 21 bp, Homo sapiens
agtgaattgtgaccaagttat

SEQ ID NO: 426183 - DNA, 14 bp, Homo sapiens
agtgaatttgaatg

SEQ ID NO: 426184 - DNA, 20 bp, Homo sapiens
agtgaatttgaatgaaaaat

SEQ ID NO: 426185 - DNA, 15 bp, Homo sapiens
agtgacaaggcccca

SEQ ID NO: 426186 - DNA, 20 bp, Homo sapiens
agtgacaaggccccagagac

SEQ ID NO: 426187 - DNA, 15 bp, Homo sapiens
agtgacacttcagag

SEQ ID NO: 426188 - DNA, 21 bp, Homo sapiens
agtgacacttcagagagctgg

SEQ ID NO: 426189 - DNA, 22 bp, Homo sapiens
agtgacacttcagagagctggt

SEQ ID NO: 426190 - DNA, 21 bp, Homo sapiens
agtgacagagcccagcatccc

SEQ ID NO: 426191 - DNA, 14 bp, Homo sapiens
agtgacatgcggct

SEQ ID NO: 426192 - DNA, 19 bp, Homo sapiens
agtgacccggaggccacat

SEQ ID NO: 426193 - DNA, 22 bp, Homo sapiens
agtgacctggcatcttggaaat

SEQ ID NO: 426194 - DNA, 21 bp, Homo sapiens
agtgactaccacttatttcta

SEQ ID NO: 426195 - DNA, 16 bp, Homo sapiens
agtgactagtacaaat

SEQ ID NO: 426196 - DNA, 18 bp, Homo sapiens
agtgactcatcctcttga

SEQ ID NO: 426197 - DNA, 23 bp, Homo sapiens
agtgactcatcctcttgaagatg

SEQ ID NO: 426198 - DNA, 15 bp, Homo sapiens
agtgactggcaggtg

SEQ ID NO: 426199 - DNA, 17 bp, Homo sapiens
agtgactgtttggctta

SEQ ID NO: 426200 - DNA, 18 bp, Homo sapiens
agtgacttcctggtgagg

SEQ ID NO: 426201 - DNA, 19 bp, Homo sapiens
agtgacttgaatgtacaaa

SEQ ID NO: 426202 - DNA, 22 bp, Homo sapiens
agtgacttgaatgtacaaagat

SEQ ID NO: 426203 - DNA, 19 bp, Homo sapiens
agtgactttttctgagctt

SEQ ID NO: 426204 - DNA, 21 bp, Homo sapiens
agtgagaaatttttttccaga

SEQ ID NO: 426205 - DNA, 18 bp, Homo sapiens
agtgagaataattgtgta

SEQ ID NO: 426206 - DNA, 19 bp, Homo sapiens
agtgagaataattgtgtac

SEQ ID NO: 426207 - DNA, 20 bp, Homo sapiens
agtgagaataattgtgtaca

SEQ ID NO: 426208 - DNA, 21 bp, Homo sapiens
agtgagaataattgtgtacaa

SEQ ID NO: 426209 - DNA, 13 bp, Homo sapiens
agtgagacagaag

SEQ ID NO: 426210 - DNA, 18 bp, Homo sapiens
agtgagagcacaaagata

SEQ ID NO: 426211 - DNA, 16 bp, Homo sapiens
agtgagatttgtattt

SEQ ID NO: 426212 - DNA, 20 bp, Homo sapiens
agtgagatttgtatttatat

SEQ ID NO: 426213 - DNA, 22 bp, Homo sapiens
agtgagcaaaatatgccccttc

SEQ ID NO: 426214 - DNA, 21 bp, Homo sapiens
agtgagcatgctttctgaact

SEQ ID NO: 426215 - DNA, 13 bp, Homo sapiens
agtgagctgggca

SEQ ID NO: 426216 - DNA, 21 bp, Homo sapiens
agtgagctgggcatggtacca

SEQ ID NO: 426217 - DNA, 22 bp, Homo sapiens
agtgagcttttatattctaaat

SEQ ID NO: 426218 - DNA, 12 bp, Homo sapiens
agtgaggagggt

SEQ ID NO: 426219 - DNA, 13 bp, Homo sapiens
agtgaggcccagg

SEQ ID NO: 426220 - DNA, 15 bp, Homo sapiens
agtgaggcccaggga

SEQ ID NO: 426221 - DNA, 14 bp, Homo sapiens
agtgaggcttccag

SEQ ID NO: 426222 - DNA, 16 bp, Homo sapiens
agtgaggcttccaggc

SEQ ID NO: 426223 - DNA, 17 bp, Homo sapiens
agtgaggtcatcccggg

SEQ ID NO: 426224 - DNA, 20 bp, Homo sapiens
agtgaggttagttctgtgtg

SEQ ID NO: 426225 - DNA, 16 bp, Homo sapiens
agtgagtctcttcaga

SEQ ID NO: 426226 - DNA, 14 bp, Homo sapiens
agtgagtctgtcag

SEQ ID NO: 426227 - DNA, 18 bp, Homo sapiens
agtgagtgtggctcccct

SEQ ID NO: 426228 - DNA, 19 bp, Homo sapiens
agtgagtgtggctcccctc

SEQ ID NO: 426229 - DNA, 20 bp, Homo sapiens
agtgataacactggagtggt

SEQ ID NO: 426230 - DNA, 21 bp, Homo sapiens
agtgatacactgtatctaaaa

SEQ ID NO: 426231 - DNA, 14 bp, Homo sapiens
agtgataggcccaa

SEQ ID NO: 426232 - DNA, 20 bp, Homo sapiens
agtgatcaataaaatgtgat

SEQ ID NO: 426233 - DNA, 14 bp, Homo sapiens
agtgatgaaattat

SEQ ID NO: 426234 - DNA, 17 bp, Homo sapiens
agtgatgatttggggga

SEQ ID NO: 426235 - DNA, 17 bp, Homo sapiens
agtgatgcaataaacaa

SEQ ID NO: 426236 - DNA, 11 bp, Homo sapiens
agtgatggcat

SEQ ID NO: 426237 - DNA, 12 bp, Homo sapiens
agtgatggcatt

SEQ ID NO: 426238 - DNA, 20 bp, Homo sapiens
agtgatggcattactctgca

SEQ ID NO: 426239 - DNA, 22 bp, Homo sapiens
agtgatggcattactctgcact

SEQ ID NO: 426240 - DNA, 19 bp, Homo sapiens
agtgatggtctcacagagc

SEQ ID NO: 426241 - DNA, 19 bp, Homo sapiens
agtgattctcctgcctcag

SEQ ID NO: 426242 - DNA, 13 bp, Homo sapiens
agtgattctctct

SEQ ID NO: 426243 - DNA, 18 bp, Homo sapiens
agtgattgaaccagctca

SEQ ID NO: 426244 - DNA, 14 bp, Homo sapiens
agtgattgacattt

SEQ ID NO: 426245 - DNA, 13 bp, Homo sapiens
agtgattgctttt

SEQ ID NO: 426246 - DNA, 15 bp, Homo sapiens
agtgatttctagaaa

SEQ ID NO: 426247 - DNA, 21 bp, Homo sapiens
agtgatttctggggccccacc

SEQ ID NO: 426248 - DNA, 22 bp, Homo sapiens
agtgatttgctatcatatatta

SEQ ID NO: 426249 - DNA, 15 bp, Homo sapiens
agtgatttgtaatat

SEQ ID NO: 426250 - DNA, 20 bp, Homo sapiens
agtgatttgtaatatgattt

SEQ ID NO: 426251 - DNA, 19 bp, Homo sapiens
agtgcaacggcatgatttt

SEQ ID NO: 426252 - DNA, 18 bp, Homo sapiens
agtgcaattgcacaaata

SEQ ID NO: 426253 - DNA, 21 bp, Homo sapiens
agtgcaattgcacaaatacaa

SEQ ID NO: 426254 - DNA, 17 bp, Homo sapiens
agtgcacccactctgct

SEQ ID NO: 426255 - DNA, 22 bp, Homo sapiens
agtgcacctctcatcagcccag

SEQ ID NO: 426256 - DNA, 24 bp, Homo sapiens
agtgcagcccgtgtggccccttca

SEQ ID NO: 426257 - DNA, 18 bp, Homo sapiens
agtgcagctgattttaac

SEQ ID NO: 426258 - DNA, 20 bp, Homo sapiens
agtgcagctgattttaacaa

SEQ ID NO: 426259 - DNA, 17 bp, Homo sapiens
agtgcatctcagcccac

SEQ ID NO: 426260 - DNA, 16 bp, Homo sapiens
agtgcatgacgtttaa

SEQ ID NO: 426261 - DNA, 14 bp, Homo sapiens
agtgcatgctgtcc

SEQ ID NO: 426262 - DNA, 16 bp, Homo sapiens
agtgcatgctgtccct

SEQ ID NO: 426263 - DNA, 14 bp, Homo sapiens
agtgcatggccaca

SEQ ID NO: 426264 - DNA, 18 bp, Homo sapiens
agtgcatggccacagcca

SEQ ID NO: 426265 - DNA, 23 bp, Homo sapiens
agtgcatggccacagccacctcc

SEQ ID NO: 426266 - DNA, 21 bp, Homo sapiens
agtgcatttctgaatagaaat

SEQ ID NO: 426267 - DNA, 22 bp, Homo sapiens
agtgcatttctgaatagaaatg

SEQ ID NO: 426268 - DNA, 17 bp, Homo sapiens
agtgcatttttatctgt

SEQ ID NO: 426269 - DNA, 20 bp, Homo sapiens
agtgcatttttatctgtgag

SEQ ID NO: 426270 - DNA, 13 bp, Homo sapiens
agtgccacctatg

SEQ ID NO: 426271 - DNA, 17 bp, Homo sapiens
agtgccacctatgcctg

SEQ ID NO: 426272 - DNA, 17 bp, Homo sapiens
agtgccacttgacattc

SEQ ID NO: 426273 - DNA, 20 bp, Homo sapiens
agtgccagaaagagagaacc

SEQ ID NO: 426274 - DNA, 21 bp, Homo sapiens
agtgccaggtggctcagtgcc

SEQ ID NO: 426275 - DNA, 23 bp, Homo sapiens
agtgccatacatgttattgtttt

SEQ ID NO: 426276 - DNA, 13 bp, Homo sapiens
agtgcccaaagtg

SEQ ID NO: 426277 - DNA, 14 bp, Homo sapiens
agtgcccagtgatg

SEQ ID NO: 426278 - DNA, 13 bp, Homo sapiens
agtgccccacctg

SEQ ID NO: 426279 - DNA, 16 bp, Homo sapiens
agtgccccacctgcca

SEQ ID NO: 426280 - DNA, 20 bp, Homo sapiens
agtgccccagaaatgccgct

SEQ ID NO: 426281 - DNA, 20 bp, Homo sapiens
agtgcccctcccatggccca

SEQ ID NO: 426282 - DNA, 11 bp, Homo sapiens
agtgcccctgc

SEQ ID NO: 426283 - DNA, 14 bp, Homo sapiens
agtgcccctgcagg

SEQ ID NO: 426284 - DNA, 15 bp, Homo sapiens
agtgcccctgcaggg

SEQ ID NO: 426285 - DNA, 18 bp, Homo sapiens
agtgcccctgcaggggag

SEQ ID NO: 426286 - DNA, 13 bp, Homo sapiens
agtgcccctgctg

SEQ ID NO: 426287 - DNA, 21 bp, Homo sapiens
agtgcccctgctgcctcccca

SEQ ID NO: 426288 - DNA, 22 bp, Homo sapiens
agtgccgtagggagtacctgct

SEQ ID NO: 426289 - DNA, 22 bp, Homo sapiens
agtgccgtgtgttgcatgcagc

SEQ ID NO: 426290 - DNA, 11 bp, Homo sapiens
agtgcctcagc

SEQ ID NO: 426291 - DNA, 12 bp, Homo sapiens
agtgcctcctgg

SEQ ID NO: 426292 - DNA, 13 bp, Homo sapiens
agtgcctcgaggc

SEQ ID NO: 426293 - DNA, 15 bp, Homo sapiens
agtgcctcgaggcac

SEQ ID NO: 426294 - DNA, 13 bp, Homo sapiens
agtgcctgccact

SEQ ID NO: 426295 - DNA, 23 bp, Homo sapiens
agtgcctggatcccctctgtcta

SEQ ID NO: 426296 - DNA, 17 bp, Homo sapiens
agtgcctgggaatgtat

SEQ ID NO: 426297 - DNA, 23 bp, Homo sapiens
agtgcctgtacaagctgatgttt

SEQ ID NO: 426298 - DNA, 15 bp, Homo sapiens
agtgcctgtatcttt

SEQ ID NO: 426299 - DNA, 20 bp, Homo sapiens
agtgccttaatagtagggta

SEQ ID NO: 426300 - DNA, 16 bp, Homo sapiens
agtgccttccataatt

SEQ ID NO: 426301 - DNA, 20 bp, Homo sapiens
agtgcgctcttggtccctgg

SEQ ID NO: 426302 - DNA, 17 bp, Homo sapiens
agtgctacttgagagtg

SEQ ID NO: 426303 - DNA, 15 bp, Homo sapiens
agtgctcagttccaa

SEQ ID NO: 426304 - DNA, 16 bp, Homo sapiens
agtgctcagttccaat

SEQ ID NO: 426305 - DNA, 15 bp, Homo sapiens
agtgctcagttgtac

SEQ ID NO: 426306 - DNA, 19 bp, Homo sapiens
agtgctctttgtggcagtg

SEQ ID NO: 426307 - DNA, 15 bp, Homo sapiens
agtgctgaacagtgg

SEQ ID NO: 426308 - DNA, 16 bp, Homo sapiens
agtgctgaacagtgga

SEQ ID NO: 426309 - DNA, 13 bp, Homo sapiens
agtgctgaagctt

SEQ ID NO: 426310 - DNA, 21 bp, Homo sapiens
agtgctgaagcttattaatgc

SEQ ID NO: 426311 - DNA, 18 bp, Homo sapiens
agtgctgaccccaggaag

SEQ ID NO: 426312 - DNA, 14 bp, Homo sapiens
agtgctgccatgcc

SEQ ID NO: 426313 - DNA, 24 bp, Homo sapiens
agtgctgccatgccactgccaggc

SEQ ID NO: 426314 - DNA, 19 bp, Homo sapiens
agtgctgcttgtgcctccc

SEQ ID NO: 426315 - DNA, 21 bp, Homo sapiens
agtgctgcttgtgcctccctt

SEQ ID NO: 426316 - DNA, 18 bp, Homo sapiens
agtgctgggattacaggt

SEQ ID NO: 426317 - DNA, 16 bp, Homo sapiens
agtgctgtacccttcc

SEQ ID NO: 426318 - DNA, 17 bp, Homo sapiens
agtgctgtacccttcca

SEQ ID NO: 426319 - DNA, 21 bp, Homo sapiens
agtgctgtacccttccacctc

SEQ ID NO: 426320 - DNA, 15 bp, Homo sapiens
agtgctgttggtggc

SEQ ID NO: 426321 - DNA, 17 bp, Homo sapiens
agtgcttaaaaatcatt

SEQ ID NO: 426322 - DNA, 14 bp, Homo sapiens
agtgcttcttacta

SEQ ID NO: 426323 - DNA, 13 bp, Homo sapiens
agtgcttcttgta

SEQ ID NO: 426324 - DNA, 18 bp, Homo sapiens
agtgcttcttgtaatatt

SEQ ID NO: 426325 - DNA, 17 bp, Homo sapiens
agtgcttgctgttccca

SEQ ID NO: 426326 - DNA, 18 bp, Homo sapiens
agtgcttggcacatagtg

SEQ ID NO: 426327 - DNA, 14 bp, Homo sapiens
agtgcttggctgcc

SEQ ID NO: 426328 - DNA, 15 bp, Homo sapiens
agtgcttggctgccc

SEQ ID NO: 426329 - DNA, 16 bp, Homo sapiens
agtgcttggctgcccc

SEQ ID NO: 426330 - DNA, 13 bp, Homo sapiens
agtgcttggttga

SEQ ID NO: 426331 - DNA, 17 bp, Homo sapiens
agtgcttggttgaaaag

SEQ ID NO: 426332 - DNA, 16 bp, Homo sapiens
agtgctttatggctct

SEQ ID NO: 426333 - DNA, 15 bp, Homo sapiens
agtgctttctcaaaa

SEQ ID NO: 426334 - DNA, 23 bp, Homo sapiens
agtgctttgctggagtcctgttc

SEQ ID NO: 426335 - DNA, 19 bp, Homo sapiens
agtggaaaaaagagaaaaa

SEQ ID NO: 426336 - DNA, 18 bp, Homo sapiens
agtggaaagattgtgtct

SEQ ID NO: 426337 - DNA, 19 bp, Homo sapiens
agtggaaagattgtgtctg

SEQ ID NO: 426338 - DNA, 16 bp, Homo sapiens
agtggaaagtgatttg

SEQ ID NO: 426339 - DNA, 13 bp, Homo sapiens
agtggaagagcag

SEQ ID NO: 426340 - DNA, 22 bp, Homo sapiens
agtggaagagcagcctgatggc

SEQ ID NO: 426341 - DNA, 16 bp, Homo sapiens
agtggaatgcagggaa

SEQ ID NO: 426342 - DNA, 20 bp, Homo sapiens
agtggaatgcagggaagagg

SEQ ID NO: 426343 - DNA, 21 bp, Homo sapiens
agtggaatgcagggaagaggg

SEQ ID NO: 426344 - DNA, 15 bp, Homo sapiens
agtggacagagggag

SEQ ID NO: 426345 - DNA, 14 bp, Homo sapiens
agtggacccagctg

SEQ ID NO: 426346 - DNA, 15 bp, Homo sapiens
agtggactcttccct

SEQ ID NO: 426347 - DNA, 16 bp, Homo sapiens
agtggactcttccctc

SEQ ID NO: 426348 - DNA, 17 bp, Homo sapiens
agtggactttccacccc

SEQ ID NO: 426349 - DNA, 14 bp, Homo sapiens
agtggagaggggac

SEQ ID NO: 426350 - DNA, 16 bp, Homo sapiens
agtggaggcattgttt

SEQ ID NO: 426351 - DNA, 17 bp, Homo sapiens
agtggaggggtcagcag

SEQ ID NO: 426352 - DNA, 23 bp, Homo sapiens
agtggaggggtcagcaggggggt

SEQ ID NO: 426353 - DNA, 17 bp, Homo sapiens
agtggattggctttgtg

SEQ ID NO: 426354 - DNA, 21 bp, Homo sapiens
agtggattgtaggtgcaagat

SEQ ID NO: 426355 - DNA, 13 bp, Homo sapiens
agtggcagccatg

SEQ ID NO: 426356 - DNA, 17 bp, Homo sapiens
agtggcagccatgcctc

SEQ ID NO: 426357 - DNA, 23 bp, Homo sapiens
agtggcatgtgggttgtgatatt

SEQ ID NO: 426358 - DNA, 19 bp, Homo sapiens
agtggccagaccagagctc

SEQ ID NO: 426359 - DNA, 22 bp, Homo sapiens
agtggccagaccagagctctgg

SEQ ID NO: 426360 - DNA, 19 bp, Homo sapiens
agtggccccatccagcatg

SEQ ID NO: 426361 - DNA, 22 bp, Homo sapiens
agtggccccatccagcatgtgt

SEQ ID NO: 426362 - DNA, 15 bp, Homo sapiens
agtggcctcaaccct

SEQ ID NO: 426363 - DNA, 22 bp, Homo sapiens
agtggcctcaaccctccctcag

SEQ ID NO: 426364 - DNA, 21 bp, Homo sapiens
agtggcctgagaagagtcgag

SEQ ID NO: 426365 - DNA, 18 bp, Homo sapiens
agtggcctggccaggagc

SEQ ID NO: 426366 - DNA, 22 bp, Homo sapiens
agtggcctggccaggagctctt

SEQ ID NO: 426367 - DNA, 14 bp, Homo sapiens
agtggcctggctcc

SEQ ID NO: 426368 - DNA, 17 bp, Homo sapiens
agtggcctggctccgct

SEQ ID NO: 426369 - DNA, 21 bp, Homo sapiens
agtggctcctcccggtgccca

SEQ ID NO: 426370 - DNA, 14 bp, Homo sapiens
agtggctgggtggg

SEQ ID NO: 426371 - DNA, 21 bp, Homo sapiens
agtggctgggtgggcccagaa

SEQ ID NO: 426372 - DNA, 15 bp, Homo sapiens
agtggcttcagcccc

SEQ ID NO: 426373 - DNA, 16 bp, Homo sapiens
agtggcttcagcccct

SEQ ID NO: 426374 - DNA, 15 bp, Homo sapiens
agtggcttggagcag

SEQ ID NO: 426375 - DNA, 15 bp, Homo sapiens
agtgggacagagtct

SEQ ID NO: 426376 - DNA, 16 bp, Homo sapiens
agtgggagaagtggcc

SEQ ID NO: 426377 - DNA, 15 bp, Homo sapiens
agtgggagatgaaaa

SEQ ID NO: 426378 - DNA, 14 bp, Homo sapiens
agtgggagcccagc

SEQ ID NO: 426379 - DNA, 20 bp, Homo sapiens
agtgggaggagagggcagag

SEQ ID NO: 426380 - DNA, 16 bp, Homo sapiens
agtgggaggcgcgagc

SEQ ID NO: 426381 - DNA, 16 bp, Homo sapiens
agtgggaggcgtgccc

SEQ ID NO: 426382 - DNA, 18 bp, Homo sapiens
agtgggaggcgtgccccc

SEQ ID NO: 426383 - DNA, 19 bp, Homo sapiens
agtgggagtgggagaggaa

SEQ ID NO: 426384 - DNA, 14 bp, Homo sapiens
agtgggccagtgtg

SEQ ID NO: 426385 - DNA, 16 bp, Homo sapiens
agtgggccccctctct

SEQ ID NO: 426386 - DNA, 18 bp, Homo sapiens
agtgggccctctctctgg

SEQ ID NO: 426387 - DNA, 19 bp, Homo sapiens
agtgggctttccagggtct

SEQ ID NO: 426388 - DNA, 23 bp, Homo sapiens
agtggggacgggggctgcttctc

SEQ ID NO: 426389 - DNA, 18 bp, Homo sapiens
agtggggagacacctcag

SEQ ID NO: 426390 - DNA, 20 bp, Homo sapiens
agtggggaggagactcaggc

SEQ ID NO: 426391 - DNA, 22 bp, Homo sapiens
agtggggccccaaagcccagcc

SEQ ID NO: 426392 - DNA, 15 bp, Homo sapiens
agtgggggagaatgg

SEQ ID NO: 426393 - DNA, 16 bp, Homo sapiens
agtgggggagagcagg

SEQ ID NO: 426394 - DNA, 23 bp, Homo sapiens
agtggggtcccccctgagtgggc

SEQ ID NO: 426395 - DNA, 15 bp, Homo sapiens
agtgggtatttctta

SEQ ID NO: 426396 - DNA, 19 bp, Homo sapiens
agtgggtatttcttatttg

SEQ ID NO: 426397 - DNA, 20 bp, Homo sapiens
agtgggtcacctgacctctg

SEQ ID NO: 426398 - DNA, 13 bp, Homo sapiens
agtgggtgagaaa

SEQ ID NO: 426399 - DNA, 15 bp, Homo sapiens
agtgggtgagaaatt

SEQ ID NO: 426400 - DNA, 15 bp, Homo sapiens
agtgggtggggctgt

SEQ ID NO: 426401 - DNA, 12 bp, Homo sapiens
agtgggtttttt

SEQ ID NO: 426402 - DNA, 23 bp, Homo sapiens
agtgggttttttagttgaatttt

SEQ ID NO: 426403 - DNA, 17 bp, Homo sapiens
agtggtaacaagaggag

SEQ ID NO: 426404 - DNA, 18 bp, Homo sapiens
agtggtagaggtgtgtgc

SEQ ID NO: 426405 - DNA, 15 bp, Homo sapiens
agtggtatgtctctt

SEQ ID NO: 426406 - DNA, 23 bp, Homo sapiens
agtggtcaggagttgtttctgac

SEQ ID NO: 426407 - DNA, 20 bp, Homo sapiens
agtggtcatttggtggctct

SEQ ID NO: 426408 - DNA, 19 bp, Homo sapiens
agtggtccacattctgctg

SEQ ID NO: 426409 - DNA, 22 bp, Homo sapiens
agtggtcgcttactttgagtga

SEQ ID NO: 426410 - DNA, 16 bp, Homo sapiens
agtggtctcctctcag

SEQ ID NO: 426411 - DNA, 19 bp, Homo sapiens
agtggtctcctctcagctt

SEQ ID NO: 426412 - DNA, 20 bp, Homo sapiens
agtggtctttctggagaggt

SEQ ID NO: 426413 - DNA, 14 bp, Homo sapiens
agtggtggcagctc

SEQ ID NO: 426414 - DNA, 20 bp, Homo sapiens
agtggtgtgatctcggctca

SEQ ID NO: 426415 - DNA, 22 bp, Homo sapiens
agtggtgttttaaagagaatgt

SEQ ID NO: 426416 - DNA, 20 bp, Homo sapiens
agtggttctacaatctattt

SEQ ID NO: 426417 - DNA, 21 bp, Homo sapiens
agtggtttgggccccattcag

SEQ ID NO: 426418 - DNA, 11 bp, Homo sapiens
agtgtaaaata

SEQ ID NO: 426419 - DNA, 13 bp, Homo sapiens
agtgtaaaataga

SEQ ID NO: 426420 - DNA, 13 bp, Homo sapiens
agtgtaacagctg

SEQ ID NO: 426421 - DNA, 14 bp, Homo sapiens
agtgtaacagctga

SEQ ID NO: 426422 - DNA, 19 bp, Homo sapiens
agtgtacaattttcatccc

SEQ ID NO: 426423 - DNA, 14 bp, Homo sapiens
agtgtacagaagaa

SEQ ID NO: 426424 - DNA, 18 bp, Homo sapiens
agtgtacagtatttacct

SEQ ID NO: 426425 - DNA, 13 bp, Homo sapiens
agtgtacatcatg

SEQ ID NO: 426426 - DNA, 13 bp, Homo sapiens
agtgtaccataat

SEQ ID NO: 426427 - DNA, 15 bp, Homo sapiens
agtgtactgctttca

SEQ ID NO: 426428 - DNA, 18 bp, Homo sapiens
agtgtagactggccatgc

SEQ ID NO: 426429 - DNA, 20 bp, Homo sapiens
agtgtagatgtagcattgtt

SEQ ID NO: 426430 - DNA, 23 bp, Homo sapiens
agtgtagcccacacttgagagga

SEQ ID NO: 426431 - DNA, 17 bp, Homo sapiens
agtgtagccccaagaag

SEQ ID NO: 426432 - DNA, 21 bp, Homo sapiens
agtgtagccccaagaaggctg

SEQ ID NO: 426433 - DNA, 22 bp, Homo sapiens
agtgtagccccaagaaggctgg

SEQ ID NO: 426434 - DNA, 17 bp, Homo sapiens
agtgtataccacctgta

SEQ ID NO: 426435 - DNA, 21 bp, Homo sapiens
agtgtataccacctgtacata

SEQ ID NO: 426436 - DNA, 22 bp, Homo sapiens
agtgtataccacctgtacatac

SEQ ID NO: 426437 - DNA, 21 bp, Homo sapiens
agtgtatctcgaagtcttcca

SEQ ID NO: 426438 - DNA, 22 bp, Homo sapiens
agtgtattggtttctgtttgaa

SEQ ID NO: 426439 - DNA, 17 bp, Homo sapiens
agtgtcaactccaggac

SEQ ID NO: 426440 - DNA, 14 bp, Homo sapiens
agtgtcaagttgtg

SEQ ID NO: 426441 - DNA, 20 bp, Homo sapiens
agtgtcatcagaagataact

SEQ ID NO: 426442 - DNA, 23 bp, Homo sapiens
agtgtcattttattttttccctc

SEQ ID NO: 426443 - DNA, 16 bp, Homo sapiens
agtgtccgagaactaa

SEQ ID NO: 426444 - DNA, 17 bp, Homo sapiens
agtgtcctataattcta

SEQ ID NO: 426445 - DNA, 21 bp, Homo sapiens
agtgtcgccgtccctctgcct

SEQ ID NO: 426446 - DNA, 22 bp, Homo sapiens
agtgtctcggagggattcccct

SEQ ID NO: 426447 - DNA, 21 bp, Homo sapiens
agtgtctgctgctgcctccct

SEQ ID NO: 426448 - DNA, 18 bp, Homo sapiens
agtgtctgtccatctgtc

SEQ ID NO: 426449 - DNA, 13 bp, Homo sapiens
agtgtcttccata

SEQ ID NO: 426450 - DNA, 14 bp, Homo sapiens
agtgtcttccataa

SEQ ID NO: 426451 - DNA, 10 bp, Homo sapiens
agtgtgaagc

SEQ ID NO: 426452 - DNA, 15 bp, Homo sapiens
agtgtgaagcctgtc

SEQ ID NO: 426453 - DNA, 19 bp, Homo sapiens
agtgtgagtaagagctggt

SEQ ID NO: 426454 - DNA, 15 bp, Homo sapiens
agtgtgagtggcagc

SEQ ID NO: 426455 - DNA, 16 bp, Homo sapiens
agtgtgagtggcagcc

SEQ ID NO: 426456 - DNA, 20 bp, Homo sapiens
agtgtgagtggcagccatgc

SEQ ID NO: 426457 - DNA, 19 bp, Homo sapiens
agtgtgcacgagtgggaag

SEQ ID NO: 426458 - DNA, 14 bp, Homo sapiens
agtgtgccaccctc

SEQ ID NO: 426459 - DNA, 15 bp, Homo sapiens
agtgtgccaccctct

SEQ ID NO: 426460 - DNA, 18 bp, Homo sapiens
agtgtgccaccctctgca

SEQ ID NO: 426461 - DNA, 20 bp, Homo sapiens
agtgtgccaccctctgcagg

SEQ ID NO: 426462 - DNA, 22 bp, Homo sapiens
agtgtgccaccctctgcagggc

SEQ ID NO: 426463 - DNA, 12 bp, Homo sapiens
agtgtgcctgct

SEQ ID NO: 426464 - DNA, 16 bp, Homo sapiens
agtgtgcctgctatcc

SEQ ID NO: 426465 - DNA, 23 bp, Homo sapiens
agtgtgcctgctatccagccgca

SEQ ID NO: 426466 - DNA, 20 bp, Homo sapiens
agtgtgcctgtcactactgg

SEQ ID NO: 426467 - DNA, 17 bp, Homo sapiens
agtgtgctcggacacag

SEQ ID NO: 426468 - DNA, 18 bp, Homo sapiens
agtgtgctcggacacagt

SEQ ID NO: 426469 - DNA, 20 bp, Homo sapiens
agtgtggaagccggagggtg

SEQ ID NO: 426470 - DNA, 19 bp, Homo sapiens
agtgtggagctgcttccag

SEQ ID NO: 426471 - DNA, 16 bp, Homo sapiens
agtgtggatgtaaatt

SEQ ID NO: 426472 - DNA, 17 bp, Homo sapiens
agtgtggctcccctcta

SEQ ID NO: 426473 - DNA, 14 bp, Homo sapiens
agtgtggctggtgt

SEQ ID NO: 426474 - DNA, 18 bp, Homo sapiens
agtgtggctggtgtcccc

SEQ ID NO: 426475 - DNA, 17 bp, Homo sapiens
agtgtggcttaaacatt

SEQ ID NO: 426476 - DNA, 22 bp, Homo sapiens
agtgtgggactccaggccagct

SEQ ID NO: 426477 - DNA, 13 bp, Homo sapiens
agtgtggtccctc

SEQ ID NO: 426478 - DNA, 17 bp, Homo sapiens
agtgtggtgggaggggt

SEQ ID NO: 426479 - DNA, 17 bp, Homo sapiens
agtgtggttttctgttt

SEQ ID NO: 426480 - DNA, 17 bp, Homo sapiens
agtgtgtacttcttcat

SEQ ID NO: 426481 - DNA, 21 bp, Homo sapiens
agtgtgtagaaacacagccta

SEQ ID NO: 426482 - DNA, 16 bp, Homo sapiens
agtgtgtatgtgcgtg

SEQ ID NO: 426483 - DNA, 21 bp, Homo sapiens
agtgtgtccaagtgtgtgtgc

SEQ ID NO: 426484 - DNA, 14 bp, Homo sapiens
agtgtgtctaaatt

SEQ ID NO: 426485 - DNA, 13 bp, Homo sapiens
agtgtgtctcctg

SEQ ID NO: 426486 - DNA, 17 bp, Homo sapiens
agtgtgtgcatgtgtgt

SEQ ID NO: 426487 - DNA, 18 bp, Homo sapiens
agtgtgtgcatgtgtgtg

SEQ ID NO: 426488 - DNA, 23 bp, Homo sapiens
agtgtgtgcatgtgtgtgctcag

SEQ ID NO: 426489 - DNA, 14 bp, Homo sapiens
agtgtgtgtctttc

SEQ ID NO: 426490 - DNA, 12 bp, Homo sapiens
agtgtgtgtgca

SEQ ID NO: 426491 - DNA, 17 bp, Homo sapiens
agtgtgtgtgcaatgtt

SEQ ID NO: 426492 - DNA, 20 bp, Homo sapiens
agtgtgtttgtgagtatgtg

SEQ ID NO: 426493 - DNA, 20 bp, Homo sapiens
agtgttagtgggaagagctg

SEQ ID NO: 426494 - DNA, 19 bp, Homo sapiens
agtgttataaaatctgtat

SEQ ID NO: 426495 - DNA, 21 bp, Homo sapiens
agtgttcaaactactgtacat

SEQ ID NO: 426496 - DNA, 22 bp, Homo sapiens
agtgttcaaactactgtacatt

SEQ ID NO: 426497 - DNA, 13 bp, Homo sapiens
agtgttctgagcc

SEQ ID NO: 426498 - DNA, 17 bp, Homo sapiens
agtgttctgtgggcttg

SEQ ID NO: 426499 - DNA, 22 bp, Homo sapiens
agtgttctgtgggcttggcctt

SEQ ID NO: 426500 - DNA, 16 bp, Homo sapiens
agtgttgactttttaa

SEQ ID NO: 426501 - DNA, 23 bp, Homo sapiens
agtgttgactttttaaaatataa

SEQ ID NO: 426502 - DNA, 21 bp, Homo sapiens
agtgttgatcagatcttacaa

SEQ ID NO: 426503 - DNA, 14 bp, Homo sapiens
agtgttgctcttgg

SEQ ID NO: 426504 - DNA, 14 bp, Homo sapiens
agtgttgtttgtaa

SEQ ID NO: 426505 - DNA, 18 bp, Homo sapiens
agtgttgtttgtaaataa

SEQ ID NO: 426506 - DNA, 19 bp, Homo sapiens
agtgttgtttgtaaataag

SEQ ID NO: 426507 - DNA, 20 bp, Homo sapiens
agtgttgtttgtaaataaga

SEQ ID NO: 426508 - DNA, 17 bp, Homo sapiens
agtgtttagcattaaaa

SEQ ID NO: 426509 - DNA, 19 bp, Homo sapiens
agtgtttatttttcatatt

SEQ ID NO: 426510 - DNA, 14 bp, Homo sapiens
agtgtttctgttct

SEQ ID NO: 426511 - DNA, 15 bp, Homo sapiens
agtgtttctgttctg

SEQ ID NO: 426512 - DNA, 13 bp, Homo sapiens
agtgttttactct

SEQ ID NO: 426513 - DNA, 13 bp, Homo sapiens
agtgttttctggg

SEQ ID NO: 426514 - DNA, 14 bp, Homo sapiens
agtgtttttcttta

SEQ ID NO: 426515 - DNA, 15 bp, Homo sapiens
agttaaaaaaaataa

SEQ ID NO: 426516 - DNA, 16 bp, Homo sapiens
agttaaaaaaaataat

SEQ ID NO: 426517 - DNA, 16 bp, Homo sapiens
agttaaaagcatttta

SEQ ID NO: 426518 - DNA, 17 bp, Homo sapiens
agttaaagagacaaata

SEQ ID NO: 426519 - DNA, 18 bp, Homo sapiens
agttaaagagacaaatag

SEQ ID NO: 426520 - DNA, 12 bp, Homo sapiens
agttaaaggcag

SEQ ID NO: 426521 - DNA, 18 bp, Homo sapiens
agttaaaggcagtccaga

SEQ ID NO: 426522 - DNA, 12 bp, Homo sapiens
agttaaataaat

SEQ ID NO: 426523 - DNA, 14 bp, Homo sapiens
agttaaatttctgg

SEQ ID NO: 426524 - DNA, 23 bp, Homo sapiens
agttaacaaggaatgcctgtgcc

SEQ ID NO: 426525 - DNA, 23 bp, Homo sapiens
agttaacattcagtactttatga

SEQ ID NO: 426526 - DNA, 17 bp, Homo sapiens
agttaagaaaaaaataa

SEQ ID NO: 426527 - DNA, 20 bp, Homo sapiens
agttaagaaaaaaataattt

SEQ ID NO: 426528 - DNA, 15 bp, Homo sapiens
agttaagacaacagg

SEQ ID NO: 426529 - DNA, 16 bp, Homo sapiens
agttaagcagcctttc

SEQ ID NO: 426530 - DNA, 20 bp, Homo sapiens
agttaagcagcctttctgtg

SEQ ID NO: 426531 - DNA, 16 bp, Homo sapiens
agttaagccccctcct

SEQ ID NO: 426532 - DNA, 23 bp, Homo sapiens
agttaatattggaagtgaaatta

SEQ ID NO: 426533 - DNA, 18 bp, Homo sapiens
agttaatcttgctttctt

SEQ ID NO: 426534 - DNA, 22 bp, Homo sapiens
agttaatgaaggtgtgctacag

SEQ ID NO: 426535 - DNA, 15 bp, Homo sapiens
agttaatgtactctt

SEQ ID NO: 426536 - DNA, 16 bp, Homo sapiens
agttaatgtactcttt

SEQ ID NO: 426537 - DNA, 16 bp, Homo sapiens
agttacagacaaagcg

SEQ ID NO: 426538 - DNA, 18 bp, Homo sapiens
agttacagacaaagcgtg

SEQ ID NO: 426539 - DNA, 20 bp, Homo sapiens
agttacccaccctaatttgc

SEQ ID NO: 426540 - DNA, 13 bp, Homo sapiens
agttacttccttc

SEQ ID NO: 426541 - DNA, 16 bp, Homo sapiens
agttacttccttcctg

SEQ ID NO: 426542 - DNA, 15 bp, Homo sapiens
agttacttgaatttc

SEQ ID NO: 426543 - DNA, 20 bp, Homo sapiens
agttacttgtctgaggcctc

SEQ ID NO: 426544 - DNA, 18 bp, Homo sapiens
agttagagatgcctccct

SEQ ID NO: 426545 - DNA, 14 bp, Homo sapiens
agttagcaggaaat

SEQ ID NO: 426546 - DNA, 17 bp, Homo sapiens
agttagcaggaaatagt

SEQ ID NO: 426547 - DNA, 23 bp, Homo sapiens
agttagccatctaatgcttgttt

SEQ ID NO: 426548 - DNA, 19 bp, Homo sapiens
agttagcccggccaaggac

SEQ ID NO: 426549 - DNA, 21 bp, Homo sapiens
agttagcccggccaaggacac

SEQ ID NO: 426550 - DNA, 14 bp, Homo sapiens
agttagccctcagt

SEQ ID NO: 426551 - DNA, 13 bp, Homo sapiens
agttaggaaataa

SEQ ID NO: 426552 - DNA, 20 bp, Homo sapiens
agttaggaaataaaaccttt

SEQ ID NO: 426553 - DNA, 21 bp, Homo sapiens
agttaggaaataaaacctttc

SEQ ID NO: 426554 - DNA, 22 bp, Homo sapiens
agttaggaaataaaacctttca

SEQ ID NO: 426555 - DNA, 20 bp, Homo sapiens
agttaggggagaggaaaagt

SEQ ID NO: 426556 - DNA, 16 bp, Homo sapiens
agttataccagcaaaa

SEQ ID NO: 426557 - DNA, 13 bp, Homo sapiens
agttatagtttca

SEQ ID NO: 426558 - DNA, 16 bp, Homo sapiens
agttatagtttcagat

SEQ ID NO: 426559 - DNA, 18 bp, Homo sapiens
agttatggcctatacact

SEQ ID NO: 426560 - DNA, 14 bp, Homo sapiens
agttatgtgaatga

SEQ ID NO: 426561 - DNA, 21 bp, Homo sapiens
agttattgaatcttaattttt

SEQ ID NO: 426562 - DNA, 19 bp, Homo sapiens
agttattgtacagctgttt

SEQ ID NO: 426563 - DNA, 21 bp, Homo sapiens
agttattgtacagctgtttaa

SEQ ID NO: 426564 - DNA, 22 bp, Homo sapiens
agttattgtacagctgtttaag

SEQ ID NO: 426565 - DNA, 14 bp, Homo sapiens
agttatttactttt

SEQ ID NO: 426566 - DNA, 16 bp, Homo sapiens
agttattttaatacct

SEQ ID NO: 426567 - DNA, 22 bp, Homo sapiens
agttattttaatacctttaaat

SEQ ID NO: 426568 - DNA, 15 bp, Homo sapiens
agttattttaggaga

SEQ ID NO: 426569 - DNA, 23 bp, Homo sapiens
agttcaataaacttaactttaac

SEQ ID NO: 426570 - DNA, 22 bp, Homo sapiens
agttcaatctcccgctgctgct

SEQ ID NO: 426571 - DNA, 12 bp, Homo sapiens
agttcaatgatc

SEQ ID NO: 426572 - DNA, 13 bp, Homo sapiens
agttcaatgatct

SEQ ID NO: 426573 - DNA, 20 bp, Homo sapiens
agttcaatgatctaggttta

SEQ ID NO: 426574 - DNA, 14 bp, Homo sapiens
atatttatgtagat

SEQ ID NO: 426575 - DNA, 14 bp, Homo sapiens
atatttattgaatt

SEQ ID NO: 426576 - DNA, 13 bp, Homo sapiens
atatttattgtat

SEQ ID NO: 426577 - DNA, 23 bp, Homo sapiens
atatttattgtttatttatcagt

SEQ ID NO: 426578 - DNA, 18 bp, Homo sapiens
atatttatttttttaagc

SEQ ID NO: 426579 - DNA, 14 bp, Homo sapiens
atatttcattgaat

SEQ ID NO: 426580 - DNA, 19 bp, Homo sapiens
atatttccctaaaatacat

SEQ ID NO: 426581 - DNA, 21 bp, Homo sapiens
atatttccttaaactgtgtgg

SEQ ID NO: 426582 - DNA, 16 bp, Homo sapiens
atatttcttcaagtga

SEQ ID NO: 426583 - DNA, 19 bp, Homo sapiens
atatttcttcaagtgagtg

SEQ ID NO: 426584 - DNA, 20 bp, Homo sapiens
atatttcttgctttcaatta

SEQ ID NO: 426585 - DNA, 14 bp, Homo sapiens
atatttgaaagaag

SEQ ID NO: 426586 - DNA, 15 bp, Homo sapiens
atatttgcaataaaa

SEQ ID NO: 426587 - DNA, 17 bp, Homo sapiens
atatttgcttatttata

SEQ ID NO: 426588 - DNA, 20 bp, Homo sapiens
atatttgcttatttatattc

SEQ ID NO: 426589 - DNA, 14 bp, Homo sapiens
atatttgtgttcag

SEQ ID NO: 426590 - DNA, 19 bp, Homo sapiens
atatttgttatgataaaag

SEQ ID NO: 426591 - DNA, 23 bp, Homo sapiens
atatttgttatgataaaaggaag

SEQ ID NO: 426592 - DNA, 21 bp, Homo sapiens
atatttgtttgggtggtttgt

SEQ ID NO: 426593 - DNA, 15 bp, Homo sapiens
atattttagaagcta

SEQ ID NO: 426594 - DNA, 14 bp, Homo sapiens
atattttagattac

SEQ ID NO: 426595 - DNA, 15 bp, Homo sapiens
atattttatgtgaga

SEQ ID NO: 426596 - DNA, 14 bp, Homo sapiens
atattttattttca

SEQ ID NO: 426597 - DNA, 20 bp, Homo sapiens
atattttcaacgcagccctg

SEQ ID NO: 426598 - DNA, 15 bp, Homo sapiens
atattttcctttaga

SEQ ID NO: 426599 - DNA, 23 bp, Homo sapiens
atattttgataataaattgaaat

SEQ ID NO: 426600 - DNA, 21 bp, Homo sapiens
atattttgtatatatctgctt

SEQ ID NO: 426601 - DNA, 12 bp, Homo sapiens
atatttttacaa

SEQ ID NO: 426602 - DNA, 18 bp, Homo sapiens
atatttttacaaataatt

SEQ ID NO: 426603 - DNA, 18 bp, Homo sapiens
atatttttatatttagtt

SEQ ID NO: 426604 - DNA, 22 bp, Homo sapiens
atatttttccctccgggcaggg

SEQ ID NO: 426605 - DNA, 18 bp, Homo sapiens
atatttttggttgtcaat

SEQ ID NO: 426606 - DNA, 21 bp, Homo sapiens
atatttttggttgtcaatatt

SEQ ID NO: 426607 - DNA, 19 bp, Homo sapiens
atatttttgtttgttttgt

SEQ ID NO: 426608 - DNA, 14 bp, Homo sapiens
atattttttacaaa

SEQ ID NO: 426609 - DNA, 19 bp, Homo sapiens
atattttttatttctaagt

SEQ ID NO: 426610 - DNA, 22 bp, Homo sapiens
atattttttttaactgcattct

SEQ ID NO: 426611 - DNA, 17 bp, Homo sapiens
atcaaaaaaagactcag

SEQ ID NO: 426612 - DNA, 16 bp, Homo sapiens
atcaaaaatattccat

SEQ ID NO: 426613 - DNA, 14 bp, Homo sapiens
atcaaaataaaaag

SEQ ID NO: 426614 - DNA, 21 bp, Homo sapiens
atcaaaatctgtagagcaggg

SEQ ID NO: 426615 - DNA, 14 bp, Homo sapiens
atcaaacagctcag

SEQ ID NO: 426616 - DNA, 13 bp, Homo sapiens
atcaaacatgaaa

SEQ ID NO: 426617 - DNA, 14 bp, Homo sapiens
atcaaacatgaaaa

SEQ ID NO: 426618 - DNA, 15 bp, Homo sapiens
atcaaacatgaaaac

SEQ ID NO: 426619 - DNA, 18 bp, Homo sapiens
atcaaagactccgagaag

SEQ ID NO: 426620 - DNA, 16 bp, Homo sapiens
atcaaagctaggaaag

SEQ ID NO: 426621 - DNA, 21 bp, Homo sapiens
atcaaagctaggaaaggcaga

SEQ ID NO: 426622 - DNA, 19 bp, Homo sapiens
atcaaaggcagaaaggaga

SEQ ID NO: 426623 - DNA, 17 bp, Homo sapiens
atcaaataatacatctt

SEQ ID NO: 426624 - DNA, 13 bp, Homo sapiens
atcaaatttttct

SEQ ID NO: 426625 - DNA, 15 bp, Homo sapiens
atcaaatttttctgg

SEQ ID NO: 426626 - DNA, 14 bp, Homo sapiens
atcaacaacaagtt

SEQ ID NO: 426627 - DNA, 21 bp, Homo sapiens
atcaacagcatgtctactgct

SEQ ID NO: 426628 - DNA, 20 bp, Homo sapiens
atcaacagtgaacagcttca

SEQ ID NO: 426629 - DNA, 22 bp, Homo sapiens
atcaacttttgaaatttaaaaa

SEQ ID NO: 426630 - DNA, 16 bp, Homo sapiens
atcaagaaaacagcaa

SEQ ID NO: 426631 - DNA, 13 bp, Homo sapiens
atcaagatacctt

SEQ ID NO: 426632 - DNA, 12 bp, Homo sapiens
atcaagcccctg

SEQ ID NO: 426633 - DNA, 17 bp, Homo sapiens
atcaagcccctgtctaa

SEQ ID NO: 426634 - DNA, 18 bp, Homo sapiens
atcaagctgtacatttgg

SEQ ID NO: 426635 - DNA, 15 bp, Homo sapiens
atcaagcttgtgtac

SEQ ID NO: 426636 - DNA, 19 bp, Homo sapiens
atcaagcttgtgtacttga

SEQ ID NO: 426637 - DNA, 19 bp, Homo sapiens
atcaaggagtgaagtaatt

SEQ ID NO: 426638 - DNA, 18 bp, Homo sapiens
atcaaggctgcctggaga

SEQ ID NO: 426639 - DNA, 19 bp, Homo sapiens
atcaaggctgcctggagaa

SEQ ID NO: 426640 - DNA, 20 bp, Homo sapiens
atcaaggctgcctggagaaa

SEQ ID NO: 426641 - DNA, 22 bp, Homo sapiens
atcaaggctgcctggagaaagg

SEQ ID NO: 426642 - DNA, 23 bp, Homo sapiens
atcaaggctgcctggagaaagga

SEQ ID NO: 426643 - DNA, 15 bp, Homo sapiens
atcaagtcaatcatt

SEQ ID NO: 426644 - DNA, 17 bp, Homo sapiens
atcaagtcaatcatttc

SEQ ID NO: 426645 - DNA, 17 bp, Homo sapiens
atcaatacttttgtgta

SEQ ID NO: 426646 - DNA, 21 bp, Homo sapiens
atcaatagaaagtcatctttg

SEQ ID NO: 426647 - DNA, 20 bp, Homo sapiens
atcaatcatctgtgtgaaaa

SEQ ID NO: 426648 - DNA, 15 bp, Homo sapiens
atcaatgttcattgt

SEQ ID NO: 426649 - DNA, 16 bp, Homo sapiens
atcaattcatatctat

SEQ ID NO: 426650 - DNA, 19 bp, Homo sapiens
atcaatttaaaatcattca

SEQ ID NO: 426651 - DNA, 14 bp, Homo sapiens
atcacaaaagctgt

SEQ ID NO: 426652 - DNA, 15 bp, Homo sapiens
atcacaaaagctgtg

SEQ ID NO: 426653 - DNA, 21 bp, Homo sapiens
atcacaaccaccgttacaagt

SEQ ID NO: 426654 - DNA, 13 bp, Homo sapiens
atcacaatacaga

SEQ ID NO: 426655 - DNA, 16 bp, Homo sapiens
atcacaatacagataa

SEQ ID NO: 426656 - DNA, 16 bp, Homo sapiens
atcacacactttctga

SEQ ID NO: 426657 - DNA, 16 bp, Homo sapiens
atcacacctctgggct

SEQ ID NO: 426658 - DNA, 16 bp, Homo sapiens
atcacacttctgtgag

SEQ ID NO: 426659 - DNA, 13 bp, Homo sapiens
atcacagaaaaaa

SEQ ID NO: 426660 - DNA, 18 bp, Homo sapiens
atcacagatgtgcccaga

SEQ ID NO: 426661 - DNA, 19 bp, Homo sapiens
atcacagatgtgcccagag

SEQ ID NO: 426662 - DNA, 18 bp, Homo sapiens
atcacagccagcccagct

SEQ ID NO: 426663 - DNA, 21 bp, Homo sapiens
atcacagcttgttttggactt

SEQ ID NO: 426664 - DNA, 15 bp, Homo sapiens
atcacaggctctgca

SEQ ID NO: 426665 - DNA, 15 bp, Homo sapiens
atcacaggggcgggg

SEQ ID NO: 426666 - DNA, 18 bp, Homo sapiens
atcacaggggcggggcag

SEQ ID NO: 426667 - DNA, 20 bp, Homo sapiens
atcacaggggcggggcagga

SEQ ID NO: 426668 - DNA, 18 bp, Homo sapiens
atcacagggttgggccca

SEQ ID NO: 426669 - DNA, 15 bp, Homo sapiens
atcacattatttgca

SEQ ID NO: 426670 - DNA, 16 bp, Homo sapiens
atcacattatttgcat

SEQ ID NO: 426671 - DNA, 22 bp, Homo sapiens
atcacattatttgcatgttacc

SEQ ID NO: 426672 - DNA, 14 bp, Homo sapiens
atcacatttgtaaa

SEQ ID NO: 426673 - DNA, 16 bp, Homo sapiens
atcaccctcagctggc

SEQ ID NO: 426674 - DNA, 13 bp, Homo sapiens
atcacctcccctc

SEQ ID NO: 426675 - DNA, 11 bp, Homo sapiens
atcacctgtca

SEQ ID NO: 426676 - DNA, 18 bp, Homo sapiens
atcacgagatcttccttc

SEQ ID NO: 426677 - DNA, 19 bp, Homo sapiens
atcacgagatcttccttcc

SEQ ID NO: 426678 - DNA, 14 bp, Homo sapiens
atcacgggcccgct

SEQ ID NO: 426679 - DNA, 21 bp, Homo sapiens
atcactctcagtgcttcttac

SEQ ID NO: 426680 - DNA, 18 bp, Homo sapiens
atcactgctgtccctcct

SEQ ID NO: 426681 - DNA, 19 bp, Homo sapiens
atcactgctgtccctcctg

SEQ ID NO: 426682 - DNA, 18 bp, Homo sapiens
atcactgtctttcctaga

SEQ ID NO: 426683 - DNA, 19 bp, Homo sapiens
atcactgtctttcctagat

SEQ ID NO: 426684 - DNA, 17 bp, Homo sapiens
atcacttgagcccagga

SEQ ID NO: 426685 - DNA, 16 bp, Homo sapiens
atcactttgtattctc

SEQ ID NO: 426686 - DNA, 14 bp, Homo sapiens
atcacttttcagtg

SEQ ID NO: 426687 - DNA, 15 bp, Homo sapiens
atcagaaaagggaag

SEQ ID NO: 426688 - DNA, 14 bp, Homo sapiens
atcagaaattttta

SEQ ID NO: 426689 - DNA, 13 bp, Homo sapiens
atcagaacatgaa

SEQ ID NO: 426690 - DNA, 22 bp, Homo sapiens
atcagaagaccacaaaaattga

SEQ ID NO: 426691 - DNA, 13 bp, Homo sapiens
atcagaagataac

SEQ ID NO: 426692 - DNA, 23 bp, Homo sapiens
atcagaagcctattgtaaataca

SEQ ID NO: 426693 - DNA, 18 bp, Homo sapiens
atcagaagtttctcagct

SEQ ID NO: 426694 - DNA, 22 bp, Homo sapiens
atcagacaatttatccaaagca

SEQ ID NO: 426695 - DNA, 11 bp, Homo sapiens
atcagacacaa

SEQ ID NO: 426696 - DNA, 20 bp, Homo sapiens
atcagaccataatgttacat

SEQ ID NO: 426697 - DNA, 15 bp, Homo sapiens
atcagacctctgatc

SEQ ID NO: 426698 - DNA, 15 bp, Homo sapiens
atcagacctgtcttc

SEQ ID NO: 426699 - DNA, 22 bp, Homo sapiens
atcagactagtgacaagctcct

SEQ ID NO: 426700 - DNA, 22 bp, Homo sapiens
atcagagagtgtacatcatgtt

SEQ ID NO: 426701 - DNA, 22 bp, Homo sapiens
atcagagcagtgattctctctt

SEQ ID NO: 426702 - DNA, 14 bp, Homo sapiens
atcagagctcttaa

SEQ ID NO: 426703 - DNA, 14 bp, Homo sapiens
atcagatggaaata

SEQ ID NO: 426704 - DNA, 14 bp, Homo sapiens
atcagattgctttt

SEQ ID NO: 426705 - DNA, 18 bp, Homo sapiens
atcagattgcttttgtgc

SEQ ID NO: 426706 - DNA, 21 bp, Homo sapiens
atcagcaaaccggggcctact

SEQ ID NO: 426707 - DNA, 17 bp, Homo sapiens
atcagcagacactccag

SEQ ID NO: 426708 - DNA, 16 bp, Homo sapiens
atcagcattcaaaata

SEQ ID NO: 426709 - DNA, 20 bp, Homo sapiens
atcagcccaacgggaagcaa

SEQ ID NO: 426710 - DNA, 17 bp, Homo sapiens
atcagccccgctcctcc

SEQ ID NO: 426711 - DNA, 13 bp, Homo sapiens
atcagcccctgct

SEQ ID NO: 426712 - DNA, 13 bp, Homo sapiens
atcagcctcttaa

SEQ ID NO: 426713 - DNA, 22 bp, Homo sapiens
atcagcctgagtctcctgtgcc

SEQ ID NO: 426714 - DNA, 20 bp, Homo sapiens
atcagcctggggcctgggga

SEQ ID NO: 426715 - DNA, 13 bp, Homo sapiens
atcagctagattt

SEQ ID NO: 426716 - DNA, 14 bp, Homo sapiens
atcagctatttact

SEQ ID NO: 426717 - DNA, 15 bp, Homo sapiens
atcagctatttactg

SEQ ID NO: 426718 - DNA, 19 bp, Homo sapiens
atcagctgctttgttacct

SEQ ID NO: 426719 - DNA, 16 bp, Homo sapiens
atcagcttaatttaag

SEQ ID NO: 426720 - DNA, 16 bp, Homo sapiens
atcagctttccctggc

SEQ ID NO: 426721 - DNA, 14 bp, Homo sapiens
atcagtacaattct

SEQ ID NO: 426722 - DNA, 23 bp, Homo sapiens
atcagtacaattctttgttgctt

SEQ ID NO: 426723 - DNA, 15 bp, Homo sapiens
atcagtatgaagaca

SEQ ID NO: 426724 - DNA, 15 bp, Homo sapiens
atcagtgaatataaa

SEQ ID NO: 426725 - DNA, 22 bp, Homo sapiens
atcagtgaatataaatgtacta

SEQ ID NO: 426726 - DNA, 22 bp, Homo sapiens
atcagtgagctcaggagagagc

SEQ ID NO: 426727 - DNA, 20 bp, Homo sapiens
atcagtgctctgcttttagt

SEQ ID NO: 426728 - DNA, 22 bp, Homo sapiens
atcagtggcatggctccagtct

SEQ ID NO: 426729 - DNA, 22 bp, Homo sapiens
atcagtgggcaggataaactga

SEQ ID NO: 426730 - DNA, 17 bp, Homo sapiens
atcagtgtcctcttgct

SEQ ID NO: 426731 - DNA, 13 bp, Homo sapiens
atcagttactggt

SEQ ID NO: 426732 - DNA, 14 bp, Homo sapiens
atcagttactggtt

SEQ ID NO: 426733 - DNA, 22 bp, Homo sapiens
atcagttactggtttcagttga

SEQ ID NO: 426734 - DNA, 19 bp, Homo sapiens
atcagttgcgcgttctgaa

SEQ ID NO: 426735 - DNA, 22 bp, Homo sapiens
atcagttttgtgtacagtatgt

SEQ ID NO: 426736 - DNA, 23 bp, Homo sapiens
atcataaaaggtgacccttctgt

SEQ ID NO: 426737 - DNA, 13 bp, Homo sapiens
atcataaaataaa

SEQ ID NO: 426738 - DNA, 21 bp, Homo sapiens
atcatagaaggagagcccagg

SEQ ID NO: 426739 - DNA, 15 bp, Homo sapiens
atcataggctgacac

SEQ ID NO: 426740 - DNA, 20 bp, Homo sapiens
atcatataataaatgtacat

SEQ ID NO: 426741 - DNA, 14 bp, Homo sapiens
atcatatgcctgac

SEQ ID NO: 426742 - DNA, 21 bp, Homo sapiens
atcatattggtattcactaat

SEQ ID NO: 426743 - DNA, 15 bp, Homo sapiens
atcatccacgccaag

SEQ ID NO: 426744 - DNA, 17 bp, Homo sapiens
atcatccagactcctca

SEQ ID NO: 426745 - DNA, 16 bp, Homo sapiens
atcatctgtgtgaaaa

SEQ ID NO: 426746 - DNA, 17 bp, Homo sapiens
atcatcttctctttttc

SEQ ID NO: 426747 - DNA, 22 bp, Homo sapiens
atcatctttgctgaatgtcatt

SEQ ID NO: 426748 - DNA, 15 bp, Homo sapiens
atcatgaaaagtgct

SEQ ID NO: 426749 - DNA, 14 bp, Homo sapiens
atcatgaaatatgc

SEQ ID NO: 426750 - DNA, 16 bp, Homo sapiens
atcatgaaatatgcat

SEQ ID NO: 426751 - DNA, 15 bp, Homo sapiens
atcatgaagccttgc

SEQ ID NO: 426752 - DNA, 16 bp, Homo sapiens
atcatgaagccttgct

SEQ ID NO: 426753 - DNA, 13 bp, Homo sapiens
atcatgacatgtt

SEQ ID NO: 426754 - DNA, 18 bp, Homo sapiens
atcatgacatgttatata

SEQ ID NO: 426755 - DNA, 21 bp, Homo sapiens
atcatgcattgttgaggtggt

SEQ ID NO: 426756 - DNA, 22 bp, Homo sapiens
atcatgcattgttgaggtggtc

SEQ ID NO: 426757 - DNA, 21 bp, Homo sapiens
atcatggattcattacagctt

SEQ ID NO: 426758 - DNA, 21 bp, Homo sapiens
atcatggctaagcttaaaaaa

SEQ ID NO: 426759 - DNA, 18 bp, Homo sapiens
atcatggctcactgcagc

SEQ ID NO: 426760 - DNA, 18 bp, Homo sapiens
atcatgggggatttttca

SEQ ID NO: 426761 - DNA, 14 bp, Homo sapiens
atcattaaacatga

SEQ ID NO: 426762 - DNA, 15 bp, Homo sapiens
atcattaaacatgaa

SEQ ID NO: 426763 - DNA, 22 bp, Homo sapiens
atcattaaacatgaatttaatg

SEQ ID NO: 426764 - DNA, 20 bp, Homo sapiens
atcattatagcatgtaatat

SEQ ID NO: 426765 - DNA, 17 bp, Homo sapiens
atcattctttgtatctt

SEQ ID NO: 426766 - DNA, 11 bp, Homo sapiens
atcattgctta

SEQ ID NO: 426767 - DNA, 19 bp, Homo sapiens
atcattggtatctgatatc

SEQ ID NO: 426768 - DNA, 20 bp, Homo sapiens
atcattggtatctgatatct

SEQ ID NO: 426769 - DNA, 17 bp, Homo sapiens
atcatttattttaagca

SEQ ID NO: 426770 - DNA, 21 bp, Homo sapiens
atcatttccagcaaaatatat

SEQ ID NO: 426771 - DNA, 23 bp, Homo sapiens
atcatttctttttgggagagact

SEQ ID NO: 426772 - DNA, 17 bp, Homo sapiens
atcatttgcagctgctg

SEQ ID NO: 426773 - DNA, 19 bp, Homo sapiens
atcatttgcagctgctggt

SEQ ID NO: 426774 - DNA, 15 bp, Homo sapiens
atcatttgcccttaa

SEQ ID NO: 426775 - DNA, 18 bp, Homo sapiens
atcatttgcccttaagga

SEQ ID NO: 426776 - DNA, 14 bp, Homo sapiens
atcattttaattat

SEQ ID NO: 426777 - DNA, 13 bp, Homo sapiens
atcattttattca

SEQ ID NO: 426778 - DNA, 17 bp, Homo sapiens
atcattttattcacata

SEQ ID NO: 426779 - DNA, 15 bp, Homo sapiens
atcattttcctggga

SEQ ID NO: 426780 - DNA, 14 bp, Homo sapiens
atcattttgggaaa

SEQ ID NO: 426781 - DNA, 20 bp, Homo sapiens
atccaaagaacttgatttgc

SEQ ID NO: 426782 - DNA, 22 bp, Homo sapiens
atccaaagaacttgatttgcat

SEQ ID NO: 426783 - DNA, 23 bp, Homo sapiens
atccaaagaacttgatttgcatg

SEQ ID NO: 426784 - DNA, 21 bp, Homo sapiens
atccaaagcattgcagaacat

SEQ ID NO: 426785 - DNA, 17 bp, Homo sapiens
atccaaatgcattcatg

SEQ ID NO: 426786 - DNA, 23 bp, Homo sapiens
atccaaatgctgtgcaaacagtg

SEQ ID NO: 426787 - DNA, 17 bp, Homo sapiens
atccaatcctcactggg

SEQ ID NO: 426788 - DNA, 19 bp, Homo sapiens
atccaatcctcactgggtg

SEQ ID NO: 426789 - DNA, 16 bp, Homo sapiens
atccaattatgtgaca

SEQ ID NO: 426790 - DNA, 14 bp, Homo sapiens
atccacaagccatt

SEQ ID NO: 426791 - DNA, 18 bp, Homo sapiens
atccacacaacaccagga

SEQ ID NO: 426792 - DNA, 14 bp, Homo sapiens
atccacagtattgt

SEQ ID NO: 426793 - DNA, 14 bp, Homo sapiens
atccacccacctgg

SEQ ID NO: 426794 - DNA, 15 bp, Homo sapiens
atccacccagtgctg

SEQ ID NO: 426795 - DNA, 16 bp, Homo sapiens
atccacccagtgctgc

SEQ ID NO: 426796 - DNA, 18 bp, Homo sapiens
atccacccagtgctgcca

SEQ ID NO: 426797 - DNA, 18 bp, Homo sapiens
atccacctgcctcggcct

SEQ ID NO: 426798 - DNA, 16 bp, Homo sapiens
atccacgctcatcttg

SEQ ID NO: 426799 - DNA, 18 bp, Homo sapiens
atccacgctcatcttgca

SEQ ID NO: 426800 - DNA, 16 bp, Homo sapiens
atccactaggtgccca

SEQ ID NO: 426801 - DNA, 19 bp, Homo sapiens
atccactatgggaagctct

SEQ ID NO: 426802 - DNA, 19 bp, Homo sapiens
atccactctaccctcccac

SEQ ID NO: 426803 - DNA, 20 bp, Homo sapiens
atccactctaccctcccacc

SEQ ID NO: 426804 - DNA, 23 bp, Homo sapiens
atccactctaccctcccaccccc

SEQ ID NO: 426805 - DNA, 22 bp, Homo sapiens
atccagaagttttaacttccag

SEQ ID NO: 426806 - DNA, 20 bp, Homo sapiens
atccagaattgaccttttga

SEQ ID NO: 426807 - DNA, 19 bp, Homo sapiens
atccagactgtaagatgtt

SEQ ID NO: 426808 - DNA, 18 bp, Homo sapiens
atccagatccagactgta

SEQ ID NO: 426809 - DNA, 13 bp, Homo sapiens
atccagcatgtgt

SEQ ID NO: 426810 - DNA, 22 bp, Homo sapiens
atccagcatgtgtgtgtctcta

SEQ ID NO: 426811 - DNA, 20 bp, Homo sapiens
atccagcctgtgtgttctgt

SEQ ID NO: 426812 - DNA, 13 bp, Homo sapiens
atccaggcctgag

SEQ ID NO: 426813 - DNA, 18 bp, Homo sapiens
atccaggcctgaggctgc

SEQ ID NO: 426814 - DNA, 23 bp, Homo sapiens
atccaggcgtgggacgtggtcag

SEQ ID NO: 426815 - DNA, 18 bp, Homo sapiens
atccagggatgccatctg

SEQ ID NO: 426816 - DNA, 18 bp, Homo sapiens
atccaggtcctttccttc

SEQ ID NO: 426817 - DNA, 21 bp, Homo sapiens
atccaggtcctttccttctcg

SEQ ID NO: 426818 - DNA, 16 bp, Homo sapiens
atccagtcaaagacgc

SEQ ID NO: 426819 - DNA, 16 bp, Homo sapiens
atccagtgcttccaca

SEQ ID NO: 426820 - DNA, 18 bp, Homo sapiens
atccagtgcttccacaga

SEQ ID NO: 426821 - DNA, 11 bp, Homo sapiens
atccatacaaa

SEQ ID NO: 426822 - DNA, 15 bp, Homo sapiens
atccataccccctgc

SEQ ID NO: 426823 - DNA, 21 bp, Homo sapiens
atccataccccctgccccaga

SEQ ID NO: 426824 - DNA, 23 bp, Homo sapiens
atccataccccctgccccagaga

SEQ ID NO: 426825 - DNA, 23 bp, Homo sapiens
atccatatcttaaagaaacagct

SEQ ID NO: 426826 - DNA, 14 bp, Homo sapiens
atccatatttcttt

SEQ ID NO: 426827 - DNA, 15 bp, Homo sapiens
atccatcagctccct

SEQ ID NO: 426828 - DNA, 13 bp, Homo sapiens
atccatcaggcca

SEQ ID NO: 426829 - DNA, 14 bp, Homo sapiens
atccatccatctcc

SEQ ID NO: 426830 - DNA, 19 bp, Homo sapiens
atccatcggtttatactat

SEQ ID NO: 426831 - DNA, 15 bp, Homo sapiens
atccatgcaccaaac

SEQ ID NO: 426832 - DNA, 14 bp, Homo sapiens
atccatgtactgta

SEQ ID NO: 426833 - DNA, 18 bp, Homo sapiens
atccatgtactgtagttt

SEQ ID NO: 426834 - DNA, 22 bp, Homo sapiens
atccatgtactgtagtttttct

SEQ ID NO: 426835 - DNA, 13 bp, Homo sapiens
atccattctttct

SEQ ID NO: 426836 - DNA, 15 bp, Homo sapiens
atccattctttctga

SEQ ID NO: 426837 - DNA, 17 bp, Homo sapiens
atcccaagctagtgagc

SEQ ID NO: 426838 - DNA, 11 bp, Homo sapiens
atcccaagtca

SEQ ID NO: 426839 - DNA, 16 bp, Homo sapiens
atcccaataaagtcct

SEQ ID NO: 426840 - DNA, 18 bp, Homo sapiens
atcccaatctttctatat

SEQ ID NO: 426841 - DNA, 16 bp, Homo sapiens
atcccaattctgtccc

SEQ ID NO: 426842 - DNA, 14 bp, Homo sapiens
atcccacaccctgg

SEQ ID NO: 426843 - DNA, 13 bp, Homo sapiens
atcccacctccag

SEQ ID NO: 426844 - DNA, 16 bp, Homo sapiens
atcccacctccagccc

SEQ ID NO: 426845 - DNA, 18 bp, Homo sapiens
atcccacctccagcccac

SEQ ID NO: 426846 - DNA, 22 bp, Homo sapiens
atcccacctccagcccacagtg

SEQ ID NO: 426847 - DNA, 20 bp, Homo sapiens
atcccacctctggataattt

SEQ ID NO: 426848 - DNA, 23 bp, Homo sapiens
atcccacggaaaatgccaatctc

SEQ ID NO: 426849 - DNA, 18 bp, Homo sapiens
atcccactggatctggct

SEQ ID NO: 426850 - DNA, 12 bp, Homo sapiens
atcccactggcg

SEQ ID NO: 426851 - DNA, 20 bp, Homo sapiens
atcccacttatcaaatcatt

SEQ ID NO: 426852 - DNA, 15 bp, Homo sapiens
atcccagacccctct

SEQ ID NO: 426853 - DNA, 15 bp, Homo sapiens
atcccagagaacaat

SEQ ID NO: 426854 - DNA, 16 bp, Homo sapiens
atcccagagaacaatc

SEQ ID NO: 426855 - DNA, 19 bp, Homo sapiens
atcccagagaacaatcact

SEQ ID NO: 426856 - DNA, 23 bp, Homo sapiens
atcccagaggtgggatcctccct

SEQ ID NO: 426857 - DNA, 15 bp, Homo sapiens
atcccagcacctgcc

SEQ ID NO: 426858 - DNA, 16 bp, Homo sapiens
atcccagcacctgcca

SEQ ID NO: 426859 - DNA, 18 bp, Homo sapiens
atcccagcacctgccagg

SEQ ID NO: 426860 - DNA, 14 bp, Homo sapiens
atcccagcagccca

SEQ ID NO: 426861 - DNA, 17 bp, Homo sapiens
atcccagcagcccaagc

SEQ ID NO: 426862 - DNA, 15 bp, Homo sapiens
atcccaggaggggcc

SEQ ID NO: 426863 - DNA, 18 bp, Homo sapiens
atcccaggaggggcctct

SEQ ID NO: 426864 - DNA, 15 bp, Homo sapiens
atcccagttcatgtt

SEQ ID NO: 426865 - DNA, 18 bp, Homo sapiens
atcccagttcatgttgct

SEQ ID NO: 426866 - DNA, 15 bp, Homo sapiens
atcccataaagaaag

SEQ ID NO: 426867 - DNA, 15 bp, Homo sapiens
atcccatccatcagc

SEQ ID NO: 426868 - DNA, 15 bp, Homo sapiens
atcccatctctaaaa

SEQ ID NO: 426869 - DNA, 13 bp, Homo sapiens
atccccaagctgg

SEQ ID NO: 426870 - DNA, 17 bp, Homo sapiens
atccccaagctggccac

SEQ ID NO: 426871 - DNA, 12 bp, Homo sapiens
atccccaccagc

SEQ ID NO: 426872 - DNA, 15 bp, Homo sapiens
atccccaggccaggt

SEQ ID NO: 426873 - DNA, 16 bp, Homo sapiens
atccccaggccaggtc

SEQ ID NO: 426874 - DNA, 23 bp, Homo sapiens
atccccaggggtcccagccaccc

SEQ ID NO: 426875 - DNA, 13 bp, Homo sapiens
atcccccaaagtt

SEQ ID NO: 426876 - DNA, 22 bp, Homo sapiens
atccccctccaaagtcttgata

SEQ ID NO: 426877 - DNA, 13 bp, Homo sapiens
atccccgctggct

SEQ ID NO: 426878 - DNA, 16 bp, Homo sapiens
atccccgctggctggg

SEQ ID NO: 426879 - DNA, 15 bp, Homo sapiens
atcccctccctgcct

SEQ ID NO: 426880 - DNA, 18 bp, Homo sapiens
atcccctccctgcctgct

SEQ ID NO: 426881 - DNA, 21 bp, Homo sapiens
atcccctccctgcctgctcct

SEQ ID NO: 426882 - DNA, 19 bp, Homo sapiens
atcccctccctgtcaaagc

SEQ ID NO: 426883 - DNA, 22 bp, Homo sapiens
atcccctcgcttcataggcaga

SEQ ID NO: 426884 - DNA, 16 bp, Homo sapiens
atcccctcgtcctgtc

SEQ ID NO: 426885 - DNA, 21 bp, Homo sapiens
atcccctcgtcctgtcccaga

SEQ ID NO: 426886 - DNA, 23 bp, Homo sapiens
atcccctcgtcctgtcccagagg

SEQ ID NO: 426887 - DNA, 15 bp, Homo sapiens
atccccttctcccct

SEQ ID NO: 426888 - DNA, 23 bp, Homo sapiens
atccccttctcccctgcactgta

SEQ ID NO: 426889 - DNA, 15 bp, Homo sapiens
atcccggcctcttcc

SEQ ID NO: 426890 - DNA, 19 bp, Homo sapiens
atcccgtgcaaaacatgct

SEQ ID NO: 426891 - DNA, 17 bp, Homo sapiens
atccctaagaattccca

SEQ ID NO: 426892 - DNA, 20 bp, Homo sapiens
atccctagtccccctgtttt

SEQ ID NO: 426893 - DNA, 18 bp, Homo sapiens
atccctatgtcccagccc

SEQ ID NO: 426894 - DNA, 19 bp, Homo sapiens
atccctatgtcccagcccc

SEQ ID NO: 426895 - DNA, 17 bp, Homo sapiens
atccctcggtcagcacc

SEQ ID NO: 426896 - DNA, 18 bp, Homo sapiens
atccctgaaacattgcat

SEQ ID NO: 426897 - DNA, 14 bp, Homo sapiens
atcccttctcacag

SEQ ID NO: 426898 - DNA, 19 bp, Homo sapiens
atcccttggcccctctctg

SEQ ID NO: 426899 - DNA, 15 bp, Homo sapiens
atccctttctcttct

SEQ ID NO: 426900 - DNA, 12 bp, Homo sapiens
atccgcatgtgt

SEQ ID NO: 426901 - DNA, 14 bp, Homo sapiens
atccgcatgtgtct

SEQ ID NO: 426902 - DNA, 18 bp, Homo sapiens
atccgcatgtgtctgtat

SEQ ID NO: 426903 - DNA, 19 bp, Homo sapiens
atccgcatgtgtctgtatt

SEQ ID NO: 426904 - DNA, 21 bp, Homo sapiens
atccgcatgtgtctgtattca

SEQ ID NO: 426905 - DNA, 21 bp, Homo sapiens
atccgcctctgagccaggagc

SEQ ID NO: 426906 - DNA, 13 bp, Homo sapiens
atccgctgccacc

SEQ ID NO: 426907 - DNA, 24 bp, Homo sapiens
atccggcatgagggctgagatgcg

SEQ ID NO: 426908 - DNA, 20 bp, Homo sapiens
atccggttttagttgagtct

SEQ ID NO: 426909 - DNA, 19 bp, Homo sapiens
atcctaagttacctttcta

SEQ ID NO: 426910 - DNA, 12 bp, Homo sapiens
atcctaccaaag

SEQ ID NO: 426911 - DNA, 16 bp, Homo sapiens
atcctaccaatgcatg

SEQ ID NO: 426912 - DNA, 17 bp, Homo sapiens
atcctaccaatgcatgc

SEQ ID NO: 426913 - DNA, 17 bp, Homo sapiens
atcctaccttttgataa

SEQ ID NO: 426914 - DNA, 15 bp, Homo sapiens
atcctagacttgaaa

SEQ ID NO: 426915 - DNA, 23 bp, Homo sapiens
atcctagagattcttagctcttg

SEQ ID NO: 426916 - DNA, 23 bp, Homo sapiens
atcctagcactttgggaggctga

SEQ ID NO: 426917 - DNA, 15 bp, Homo sapiens
atcctagctgtgtgc

SEQ ID NO: 426918 - DNA, 20 bp, Homo sapiens
atcctagttccattcttggt

SEQ ID NO: 426919 - DNA, 12 bp, Homo sapiens
atcctcagcaag

SEQ ID NO: 426920 - DNA, 15 bp, Homo sapiens
atcctcagccccagg

SEQ ID NO: 426921 - DNA, 19 bp, Homo sapiens
atcctcagccccagggccc

SEQ ID NO: 426922 - DNA, 23 bp, Homo sapiens
atcctcagccccagggccctgct

SEQ ID NO: 426923 - DNA, 14 bp, Homo sapiens
atcctcagttcctg

SEQ ID NO: 426924 - DNA, 22 bp, Homo sapiens
atcctcagttcctgcagcagag

SEQ ID NO: 426925 - DNA, 21 bp, Homo sapiens
atcctcatatggcccagtgtc

SEQ ID NO: 426926 - DNA, 20 bp, Homo sapiens
atcctccaacgttaaaagac

SEQ ID NO: 426927 - DNA, 14 bp, Homo sapiens
atcctccagcttct

SEQ ID NO: 426928 - DNA, 23 bp, Homo sapiens
atcctccagggggcctgcaggcc

SEQ ID NO: 426929 - DNA, 13 bp, Homo sapiens
atcctccccttcc

SEQ ID NO: 426930 - DNA, 19 bp, Homo sapiens
atcctcctggacccagcag

SEQ ID NO: 426931 - DNA, 22 bp, Homo sapiens
atcctcttctgcttaggagaga

SEQ ID NO: 426932 - DNA, 17 bp, Homo sapiens
atcctcttgctatataa

SEQ ID NO: 426933 - DNA, 23 bp, Homo sapiens
atcctgacctcctggactgtagg

SEQ ID NO: 426934 - DNA, 12 bp, Homo sapiens
atcctgagccat

SEQ ID NO: 426935 - DNA, 20 bp, Homo sapiens
atcctgataaacattaaaca

SEQ ID NO: 426936 - DNA, 18 bp, Homo sapiens
atcctgattattgaatgt

SEQ ID NO: 426937 - DNA, 13 bp, Homo sapiens
atcctgcacccca

SEQ ID NO: 426938 - DNA, 14 bp, Homo sapiens
atcctgcaccccag

SEQ ID NO: 426939 - DNA, 16 bp, Homo sapiens
atcctgcaccccagca

SEQ ID NO: 426940 - DNA, 14 bp, Homo sapiens
atcctgcaccctct

SEQ ID NO: 426941 - DNA, 17 bp, Homo sapiens
atcctgcaccctctgct

SEQ ID NO: 426942 - DNA, 19 bp, Homo sapiens
atcctgcaggaacgagcac

SEQ ID NO: 426943 - DNA, 21 bp, Homo sapiens
atcctgcaggaacgagcactg

SEQ ID NO: 426944 - DNA, 22 bp, Homo sapiens
atcctgcaggaacgagcactgg

SEQ ID NO: 426945 - DNA, 23 bp, Homo sapiens
atcctgcaggaacgagcactggc

SEQ ID NO: 426946 - DNA, 14 bp, Homo sapiens
atcctgccaggagc

SEQ ID NO: 426947 - DNA, 15 bp, Homo sapiens
atcctgcccagtgtt

SEQ ID NO: 426948 - DNA, 16 bp, Homo sapiens
atcctgctagctgtag

SEQ ID NO: 426949 - DNA, 19 bp, Homo sapiens
atcctgctagctgtagaaa

SEQ ID NO: 426950 - DNA, 20 bp, Homo sapiens
atcctgcttctcttttcctc

SEQ ID NO: 426951 - DNA, 22 bp, Homo sapiens
atcctgcttctcttttcctcgc

SEQ ID NO: 426952 - DNA, 10 bp, Homo sapiens
atcctggagc

SEQ ID NO: 426953 - DNA, 16 bp, Homo sapiens
atcctggagcccctgt

SEQ ID NO: 426954 - DNA, 11 bp, Homo sapiens
atcctggcccc

SEQ ID NO: 426955 - DNA, 14 bp, Homo sapiens
atcctggcccctcc

SEQ ID NO: 426956 - DNA, 22 bp, Homo sapiens
atcctggcccctccagaccctg

SEQ ID NO: 426957 - DNA, 13 bp, Homo sapiens
atcctggcctcct

SEQ ID NO: 426958 - DNA, 14 bp, Homo sapiens
atcctggcctcctt

SEQ ID NO: 426959 - DNA, 18 bp, Homo sapiens
atcctggctttgcccaac

SEQ ID NO: 426960 - DNA, 20 bp, Homo sapiens
atcctggggctcccttcatc

SEQ ID NO: 426961 - DNA, 16 bp, Homo sapiens
atcctgtcaatgtttg

SEQ ID NO: 426962 - DNA, 14 bp, Homo sapiens
atcctgtcctcagc

SEQ ID NO: 426963 - DNA, 18 bp, Homo sapiens
atcctgtcctcagcttct

SEQ ID NO: 426964 - DNA, 17 bp, Homo sapiens
atcctgtctgttcatgg

SEQ ID NO: 426965 - DNA, 13 bp, Homo sapiens
atcctgtgctaca

SEQ ID NO: 426966 - DNA, 19 bp, Homo sapiens
atcctgtgtcccctgacct

SEQ ID NO: 426967 - DNA, 18 bp, Homo sapiens
atcctgtgtggagaggga

SEQ ID NO: 426968 - DNA, 19 bp, Homo sapiens
atcctgttaggggaaaata

SEQ ID NO: 426969 - DNA, 15 bp, Homo sapiens
atcctgttcttcccc

SEQ ID NO: 426970 - DNA, 19 bp, Homo sapiens
atcctgttggctgctgcca

SEQ ID NO: 426971 - DNA, 18 bp, Homo sapiens
atccttaagtatcagaaa

SEQ ID NO: 426972 - DNA, 15 bp, Homo sapiens
atccttagcaacagc

SEQ ID NO: 426973 - DNA, 17 bp, Homo sapiens
atccttcacaggcagtg

SEQ ID NO: 426974 - DNA, 20 bp, Homo sapiens
atccttcacaggcagtgcat

SEQ ID NO: 426975 - DNA, 19 bp, Homo sapiens
atccttccaaaaaattaaa

SEQ ID NO: 426976 - DNA, 18 bp, Homo sapiens
atccttccaaaaattatt

SEQ ID NO: 426977 - DNA, 19 bp, Homo sapiens
atccttccaaaaattatta

SEQ ID NO: 426978 - DNA, 23 bp, Homo sapiens
atccttccaaaaattattataag

SEQ ID NO: 426979 - DNA, 18 bp, Homo sapiens
atccttccaaagaattct

SEQ ID NO: 426980 - DNA, 15 bp, Homo sapiens
atccttcccgcagca

SEQ ID NO: 426981 - DNA, 24 bp, Homo sapiens
atccttcccgcagcaccagcctga

SEQ ID NO: 426982 - DNA, 11 bp, Homo sapiens
atccttctgcc

SEQ ID NO: 426983 - DNA, 13 bp, Homo sapiens
atccttctgcctt

SEQ ID NO: 426984 - DNA, 13 bp, Homo sapiens
atccttgactgaa

SEQ ID NO: 426985 - DNA, 22 bp, Homo sapiens
atccttgaggacctccacctgg

SEQ ID NO: 426986 - DNA, 17 bp, Homo sapiens
atccttgcctccaacgt

SEQ ID NO: 426987 - DNA, 13 bp, Homo sapiens
atccttttttctc

SEQ ID NO: 426988 - DNA, 14 bp, Homo sapiens
atcgacctcactgt

SEQ ID NO: 426989 - DNA, 15 bp, Homo sapiens
atcgacctcactgtc

SEQ ID NO: 426990 - DNA, 15 bp, Homo sapiens
atcgagagtttctat

SEQ ID NO: 426991 - DNA, 20 bp, Homo sapiens
atcgagcatgttgttttttc

SEQ ID NO: 426992 - DNA, 17 bp, Homo sapiens
atcgagttggcaaaatg

SEQ ID NO: 426993 - DNA, 19 bp, Homo sapiens
atcgatctggaaagagctg

SEQ ID NO: 426994 - DNA, 21 bp, Homo sapiens
atcgatgttaaacgtcacagc

SEQ ID NO: 426995 - DNA, 12 bp, Homo sapiens
atcgattggctt

SEQ ID NO: 426996 - DNA, 22 bp, Homo sapiens
atcgcaccttttataccagaga

SEQ ID NO: 426997 - DNA, 21 bp, Homo sapiens
atcgccttatgagaacatggt

SEQ ID NO: 426998 - DNA, 22 bp, Homo sapiens
atcgccttatgagaacatggtg

SEQ ID NO: 426999 - DNA, 18 bp, Homo sapiens
atcgccttatttatattc

SEQ ID NO: 427000 - DNA, 13 bp, Homo sapiens
atcgcttcttttt

SEQ ID NO: 427001 - DNA, 19 bp, Homo sapiens
atcgcttgaacctgggaag

SEQ ID NO: 427002 - DNA, 22 bp, Homo sapiens
atcggaagcagtgccttccata

SEQ ID NO: 427003 - DNA, 19 bp, Homo sapiens
atcggacctcagtttctgt

SEQ ID NO: 427004 - DNA, 16 bp, Homo sapiens
atcgggagcagtgtct

SEQ ID NO: 427005 - DNA, 21 bp, Homo sapiens
atcgggagcagtgtcttccat

SEQ ID NO: 427006 - DNA, 18 bp, Homo sapiens
atcggtgaaactaacaga

SEQ ID NO: 427007 - DNA, 23 bp, Homo sapiens
atcggtgtccatttatagaataa

SEQ ID NO: 427008 - DNA, 17 bp, Homo sapiens
atcggttcaagttgatg

SEQ ID NO: 427009 - DNA, 13 bp, Homo sapiens
atcgtagaagaga

SEQ ID NO: 427010 - DNA, 12 bp, Homo sapiens
atcgtgaaaccc

SEQ ID NO: 427011 - DNA, 20 bp, Homo sapiens
atcgtgaaaccctgtctcta

SEQ ID NO: 427012 - DNA, 18 bp, Homo sapiens
atcgtgacccttcagggc

SEQ ID NO: 427013 - DNA, 21 bp, Homo sapiens
atcgtgacccttcagggccag

SEQ ID NO: 427014 - DNA, 17 bp, Homo sapiens
atcgtgctaaattttca

SEQ ID NO: 427015 - DNA, 14 bp, Homo sapiens
atcgttctctgcct

SEQ ID NO: 427016 - DNA, 20 bp, Homo sapiens
atcgtttattgcttaatccc

SEQ ID NO: 427017 - DNA, 22 bp, Homo sapiens
atcgttttctttgctgtgccaa

SEQ ID NO: 427018 - DNA, 16 bp, Homo sapiens
atctaaaaaataactg

SEQ ID NO: 427019 - DNA, 17 bp, Homo sapiens
atctaaaagttaagtgt

SEQ ID NO: 427020 - DNA, 23 bp, Homo sapiens
atctaaatagatacttttgataa

SEQ ID NO: 427021 - DNA, 14 bp, Homo sapiens
atctaaatgatgag

SEQ ID NO: 427022 - DNA, 16 bp, Homo sapiens
atctaaattaacttct

SEQ ID NO: 427023 - DNA, 19 bp, Homo sapiens
atctaaattaacttctatt

SEQ ID NO: 427024 - DNA, 13 bp, Homo sapiens
atctaaattgatc

SEQ ID NO: 427025 - DNA, 14 bp, Homo sapiens
atctaaggcatgct

SEQ ID NO: 427026 - DNA, 22 bp, Homo sapiens
atctaatagcgggttactttca

SEQ ID NO: 427027 - DNA, 16 bp, Homo sapiens
atctacagctcacctc

SEQ ID NO: 427028 - DNA, 18 bp, Homo sapiens
atctacccagtcatgtac

SEQ ID NO: 427029 - DNA, 13 bp, Homo sapiens
atctacctcccga

SEQ ID NO: 427030 - DNA, 13 bp, Homo sapiens
atctactgagcca

SEQ ID NO: 427031 - DNA, 16 bp, Homo sapiens
atctagatttctagaa

SEQ ID NO: 427032 - DNA, 19 bp, Homo sapiens
atctagcaagaagattcta

SEQ ID NO: 427033 - DNA, 20 bp, Homo sapiens
atctagcaagaagattctaa

SEQ ID NO: 427034 - DNA, 17 bp, Homo sapiens
atctagcacagctgtga

SEQ ID NO: 427035 - DNA, 23 bp, Homo sapiens
atctagccagagcccttcactgc

SEQ ID NO: 427036 - DNA, 20 bp, Homo sapiens
atctagccaggcctcccgca

SEQ ID NO: 427037 - DNA, 14 bp, Homo sapiens
atctagccatggct

SEQ ID NO: 427038 - DNA, 18 bp, Homo sapiens
atctaggtggagttgaaa

SEQ ID NO: 427039 - DNA, 22 bp, Homo sapiens
atctaggtggagttgaaagagt

SEQ ID NO: 427040 - DNA, 13 bp, Homo sapiens
atctaggtttaac

SEQ ID NO: 427041 - DNA, 14 bp, Homo sapiens
atctaggtttaact

SEQ ID NO: 427042 - DNA, 16 bp, Homo sapiens
atctaggtttaactca

SEQ ID NO: 427043 - DNA, 17 bp, Homo sapiens
atctaggtttaactcag

SEQ ID NO: 427044 - DNA, 20 bp, Homo sapiens
atctagtaggtctgcacaca

SEQ ID NO: 427045 - DNA, 18 bp, Homo sapiens
atctagtgcagctgattt

SEQ ID NO: 427046 - DNA, 16 bp, Homo sapiens
atctagttaagtcgct

SEQ ID NO: 427047 - DNA, 18 bp, Homo sapiens
atctagtttacagaaaaa

SEQ ID NO: 427048 - DNA, 20 bp, Homo sapiens
atctagtttacagaaaaatc

SEQ ID NO: 427049 - DNA, 22 bp, Homo sapiens
atctagtttacagaaaaatctt

SEQ ID NO: 427050 - DNA, 17 bp, Homo sapiens
atctagttttttttgta

SEQ ID NO: 427051 - DNA, 14 bp, Homo sapiens
atctataaaatgag

SEQ ID NO: 427052 - DNA, 21 bp, Homo sapiens
atctataaagcgatatacaga

SEQ ID NO: 427053 - DNA, 19 bp, Homo sapiens
atctatctatatatacata

SEQ ID NO: 427054 - DNA, 13 bp, Homo sapiens
atctatgactgtg

SEQ ID NO: 427055 - DNA, 14 bp, Homo sapiens
atctatgactgtgt

SEQ ID NO: 427056 - DNA, 14 bp, Homo sapiens
atctattgcagata

SEQ ID NO: 427057 - DNA, 19 bp, Homo sapiens
atctattgtttctcctctg

SEQ ID NO: 427058 - DNA, 19 bp, Homo sapiens
atctatttatctgtctgag

SEQ ID NO: 427059 - DNA, 13 bp, Homo sapiens
atctatttattgg

SEQ ID NO: 427060 - DNA, 12 bp, Homo sapiens
atctattttcag

SEQ ID NO: 427061 - DNA, 13 bp, Homo sapiens
atctcaagtatat

SEQ ID NO: 427062 - DNA, 23 bp, Homo sapiens
atctcaccccatcccacaccctg

SEQ ID NO: 427063 - DNA, 19 bp, Homo sapiens
atctcacttaatacagatg

SEQ ID NO: 427064 - DNA, 15 bp, Homo sapiens
atctcacttttctcc

SEQ ID NO: 427065 - DNA, 19 bp, Homo sapiens
atctcagaggctatagctg

SEQ ID NO: 427066 - DNA, 11 bp, Homo sapiens
atctcagccca

SEQ ID NO: 427067 - DNA, 14 bp, Homo sapiens
atctcagcctcctg

SEQ ID NO: 427068 - DNA, 21 bp, Homo sapiens
atctcagcctcctgagcctgt

SEQ ID NO: 427069 - DNA, 17 bp, Homo sapiens
atctcaggccacctgcc

SEQ ID NO: 427070 - DNA, 19 bp, Homo sapiens
atctcaggccacctgcccc

SEQ ID NO: 427071 - DNA, 15 bp, Homo sapiens
atctcaggtgccact

SEQ ID NO: 427072 - DNA, 16 bp, Homo sapiens
atctcaggtgccactc

SEQ ID NO: 427073 - DNA, 17 bp, Homo sapiens
atctcaggtgccactcc

SEQ ID NO: 427074 - DNA, 22 bp, Homo sapiens
atctcattcaggtgttctcttc

SEQ ID NO: 427075 - DNA, 16 bp, Homo sapiens
atctcattcagtatta

SEQ ID NO: 427076 - DNA, 14 bp, Homo sapiens
atctccaggcccag

SEQ ID NO: 427077 - DNA, 16 bp, Homo sapiens
atctccaggcccagcc

SEQ ID NO: 427078 - DNA, 22 bp, Homo sapiens
atctccaggcccagcctggccc

SEQ ID NO: 427079 - DNA, 16 bp, Homo sapiens
atctccagggagcaag

SEQ ID NO: 427080 - DNA, 19 bp, Homo sapiens
atctccagggagtcccctc

SEQ ID NO: 427081 - DNA, 21 bp, Homo sapiens
atctccagggagtcccctccc

SEQ ID NO: 427082 - DNA, 17 bp, Homo sapiens
atctccagggctgcccc

SEQ ID NO: 427083 - DNA, 17 bp, Homo sapiens
atctcccagacttgttt

SEQ ID NO: 427084 - DNA, 20 bp, Homo sapiens
atctcccatggtccctagca

SEQ ID NO: 427085 - DNA, 16 bp, Homo sapiens
atctccccaggcctcc

SEQ ID NO: 427086 - DNA, 23 bp, Homo sapiens
atctccctcgaacccacactgca

SEQ ID NO: 427087 - DNA, 19 bp, Homo sapiens
atctccctgcttcatatct

SEQ ID NO: 427088 - DNA, 22 bp, Homo sapiens
atctcccttccacctcacaact

SEQ ID NO: 427089 - DNA, 21 bp, Homo sapiens
atctcctatttttcagaatgc

SEQ ID NO: 427090 - DNA, 20 bp, Homo sapiens
atctcctcaccccagtgcct

SEQ ID NO: 427091 - DNA, 20 bp, Homo sapiens
atctcctcccatggccttcc

SEQ ID NO: 427092 - DNA, 14 bp, Homo sapiens
atctcctctcccca

SEQ ID NO: 427093 - DNA, 23 bp, Homo sapiens
atctcctctccccaacccttcca

SEQ ID NO: 427094 - DNA, 14 bp, Homo sapiens
atctcctcttttgt

SEQ ID NO: 427095 - DNA, 14 bp, Homo sapiens
atctcctgacctca

SEQ ID NO: 427096 - DNA, 12 bp, Homo sapiens
atctcctgctct

SEQ ID NO: 427097 - DNA, 19 bp, Homo sapiens
atctcctgtcttttcaggt

SEQ ID NO: 427098 - DNA, 14 bp, Homo sapiens
atctcctgtgcatg

SEQ ID NO: 427099 - DNA, 16 bp, Homo sapiens
atctccttcccccagc

SEQ ID NO: 427100 - DNA, 21 bp, Homo sapiens
atctccttcccccagcccaat

SEQ ID NO: 427101 - DNA, 14 bp, Homo sapiens
atctcctttgtcca

SEQ ID NO: 427102 - DNA, 15 bp, Homo sapiens
atctcgagccccctg

SEQ ID NO: 427103 - DNA, 16 bp, Homo sapiens
atctcgagccccctgg

SEQ ID NO: 427104 - DNA, 14 bp, Homo sapiens
atctcgtgggagag

SEQ ID NO: 427105 - DNA, 19 bp, Homo sapiens
atctctaaaattctagtct

SEQ ID NO: 427106 - DNA, 21 bp, Homo sapiens
atctctaaaattctagtctct

SEQ ID NO: 427107 - DNA, 20 bp, Homo sapiens
atctctaacagctcaggatc

SEQ ID NO: 427108 - DNA, 19 bp, Homo sapiens
atctctactaccacaagga

SEQ ID NO: 427109 - DNA, 16 bp, Homo sapiens
atctctagaattttaa

SEQ ID NO: 427110 - DNA, 21 bp, Homo sapiens
atctctagaattttaagtgct

SEQ ID NO: 427111 - DNA, 15 bp, Homo sapiens
atctctagtccctgt

SEQ ID NO: 427112 - DNA, 17 bp, Homo sapiens
atctctataacagatcc

SEQ ID NO: 427113 - DNA, 14 bp, Homo sapiens
atctctcaaaactt

SEQ ID NO: 427114 - DNA, 19 bp, Homo sapiens
atctctcaaaatgtgccgt

SEQ ID NO: 427115 - DNA, 17 bp, Homo sapiens
atctctcaggagcacag

SEQ ID NO: 427116 - DNA, 22 bp, Homo sapiens
atctctcaggagcacaggcagc

SEQ ID NO: 427117 - DNA, 23 bp, Homo sapiens
atctctcaggagcacaggcagct

SEQ ID NO: 427118 - DNA, 17 bp, Homo sapiens
atctctccccaatgctc

SEQ ID NO: 427119 - DNA, 17 bp, Homo sapiens
atctctccccatatata

SEQ ID NO: 427120 - DNA, 18 bp, Homo sapiens
atctctccccatatataa

SEQ ID NO: 427121 - DNA, 11 bp, Homo sapiens
atctctccctc

SEQ ID NO: 427122 - DNA, 14 bp, Homo sapiens
atctctccctcccc

SEQ ID NO: 427123 - DNA, 15 bp, Homo sapiens
atctctccctcccct

SEQ ID NO: 427124 - DNA, 19 bp, Homo sapiens
atctctcggttccacgtcc

SEQ ID NO: 427125 - DNA, 20 bp, Homo sapiens
atctctcggttccacgtccc

SEQ ID NO: 427126 - DNA, 15 bp, Homo sapiens
atctctctctgttgt

SEQ ID NO: 427127 - DNA, 23 bp, Homo sapiens
atctctcttccctaatcctccaa

SEQ ID NO: 427128 - DNA, 19 bp, Homo sapiens
atctctgaagcatgtttca

SEQ ID NO: 427129 - DNA, 20 bp, Homo sapiens
atctctgaagcatgtttcat

SEQ ID NO: 427130 - DNA, 19 bp, Homo sapiens
atctctgattaaatttaat

SEQ ID NO: 427131 - DNA, 23 bp, Homo sapiens
atctctgcaccctggggcctgga

SEQ ID NO: 427132 - DNA, 12 bp, Homo sapiens
atctctgccttt

SEQ ID NO: 427133 - DNA, 15 bp, Homo sapiens
atctctgcctttgag

SEQ ID NO: 427134 - DNA, 19 bp, Homo sapiens
atctctgctgcttctgggc

SEQ ID NO: 427135 - DNA, 12 bp, Homo sapiens
atctctgtaaaa

SEQ ID NO: 427136 - DNA, 19 bp, Homo sapiens
atctctgtctaccatctcc

SEQ ID NO: 427137 - DNA, 18 bp, Homo sapiens
atctctgttctgctccca

SEQ ID NO: 427138 - DNA, 15 bp, Homo sapiens
atctcttattctaat

SEQ ID NO: 427139 - DNA, 18 bp, Homo sapiens
atctcttattctaataaa

SEQ ID NO: 427140 - DNA, 13 bp, Homo sapiens
atctcttcttcct

SEQ ID NO: 427141 - DNA, 15 bp, Homo sapiens
atctgaaaagaaatg

SEQ ID NO: 427142 - DNA, 17 bp, Homo sapiens
atctgaaacacagtcat

SEQ ID NO: 427143 - DNA, 19 bp, Homo sapiens
atctgaactttgtttccag

SEQ ID NO: 427144 - DNA, 21 bp, Homo sapiens
atctgaactttgtttccagaa

SEQ ID NO: 427145 - DNA, 22 bp, Homo sapiens
atctgaactttgtttccagaaa

SEQ ID NO: 427146 - DNA, 22 bp, Homo sapiens
atctgaatacctctttgaaaga

SEQ ID NO: 427147 - DNA, 18 bp, Homo sapiens
atctgaattaaataaata

SEQ ID NO: 427148 - DNA, 19 bp, Homo sapiens
atctgacagttactcttca

SEQ ID NO: 427149 - DNA, 22 bp, Homo sapiens
atctgagccctccctcttccca

SEQ ID NO: 427150 - DNA, 16 bp, Homo sapiens
atctgaggagtccaaa

SEQ ID NO: 427151 - DNA, 16 bp, Homo sapiens
atctgaggatgagaca

SEQ ID NO: 427152 - DNA, 13 bp, Homo sapiens
atctgagggcact

SEQ ID NO: 427153 - DNA, 22 bp, Homo sapiens
atctgagggcactctctgccag

SEQ ID NO: 427154 - DNA, 23 bp, Homo sapiens
atctgagggcactctctgccagc

SEQ ID NO: 427155 - DNA, 19 bp, Homo sapiens
atctgatattcaaacacac

SEQ ID NO: 427156 - DNA, 21 bp, Homo sapiens
atctgatattcaaacacacag

SEQ ID NO: 427157 - DNA, 18 bp, Homo sapiens
atctgatcccataaagaa

SEQ ID NO: 427158 - DNA, 16 bp, Homo sapiens
atctgatggtgagctg

SEQ ID NO: 427159 - DNA, 19 bp, Homo sapiens
atctgattggacattttct

SEQ ID NO: 427160 - DNA, 23 bp, Homo sapiens
atctgcaaatagtttcaaatgag

SEQ ID NO: 427161 - DNA, 15 bp, Homo sapiens
atctgcaatatgaat

SEQ ID NO: 427162 - DNA, 22 bp, Homo sapiens
atctgcaatgtttttgtgtaga

SEQ ID NO: 427163 - DNA, 14 bp, Homo sapiens
atctgcagggagca

SEQ ID NO: 427164 - DNA, 17 bp, Homo sapiens
atctgcatttagcacaa

SEQ ID NO: 427165 - DNA, 22 bp, Homo sapiens
atctgcattttcaccccaccct

SEQ ID NO: 427166 - DNA, 23 bp, Homo sapiens
atctgcattttctgggttctggg

SEQ ID NO: 427167 - DNA, 13 bp, Homo sapiens
atctgcctggcct

SEQ ID NO: 427168 - DNA, 12 bp, Homo sapiens
atctgcctgggc

SEQ ID NO: 427169 - DNA, 13 bp, Homo sapiens
atctgcctgggcc

SEQ ID NO: 427170 - DNA, 14 bp, Homo sapiens
atctgcctgggcct

SEQ ID NO: 427171 - DNA, 17 bp, Homo sapiens
atctgcctgggcctgtg

SEQ ID NO: 427172 - DNA, 18 bp, Homo sapiens
atctgcctgggcctgtgc

SEQ ID NO: 427173 - DNA, 19 bp, Homo sapiens
atctgcctgggcctgtgca

SEQ ID NO: 427174 - DNA, 20 bp, Homo sapiens
atctgcctgggcctgtgcag

SEQ ID NO: 427175 - DNA, 15 bp, Homo sapiens
atctgcctgtggcct

SEQ ID NO: 427176 - DNA, 18 bp, Homo sapiens
atctgcctgtggccttgc

SEQ ID NO: 427177 - DNA, 13 bp, Homo sapiens
atctgccttccag

SEQ ID NO: 427178 - DNA, 18 bp, Homo sapiens
atctgccttccagcccag

SEQ ID NO: 427179 - DNA, 21 bp, Homo sapiens
atctgccttccagcccagacc

SEQ ID NO: 427180 - DNA, 20 bp, Homo sapiens
atctgctagggaatatcaat

SEQ ID NO: 427181 - DNA, 13 bp, Homo sapiens
atctgctcatctg

SEQ ID NO: 427182 - DNA, 12 bp, Homo sapiens
atctgctctgag

SEQ ID NO: 427183 - DNA, 20 bp, Homo sapiens
atctgctgagctctgacctg

SEQ ID NO: 427184 - DNA, 18 bp, Homo sapiens
atctgctgcctctgaaaa

SEQ ID NO: 427185 - DNA, 14 bp, Homo sapiens
atctgctgttgcca

SEQ ID NO: 427186 - DNA, 15 bp, Homo sapiens
atctgctgttgccat

SEQ ID NO: 427187 - DNA, 17 bp, Homo sapiens
atctgctgttgccatag

SEQ ID NO: 427188 - DNA, 19 bp, Homo sapiens
atctgctgttgccatagcc

SEQ ID NO: 427189 - DNA, 21 bp, Homo sapiens
atctgctttgttaatgaaaat

SEQ ID NO: 427190 - DNA, 22 bp, Homo sapiens
atctggactcctctgtccaggc

SEQ ID NO: 427191 - DNA, 19 bp, Homo sapiens
atctggcattctacacctg

SEQ ID NO: 427192 - DNA, 23 bp, Homo sapiens
atctggcctggcctggccctgcc

SEQ ID NO: 427193 - DNA, 14 bp, Homo sapiens
atctggctcctgtt

SEQ ID NO: 427194 - DNA, 19 bp, Homo sapiens
atctgggaactcccaagaa

SEQ ID NO: 427195 - DNA, 20 bp, Homo sapiens
atctgggaactcccaagaac

SEQ ID NO: 427196 - DNA, 12 bp, Homo sapiens
atctgggcacaa

SEQ ID NO: 427197 - DNA, 19 bp, Homo sapiens
atctgggcacaatcattgg

SEQ ID NO: 427198 - DNA, 11 bp, Homo sapiens
atctgggccac

SEQ ID NO: 427199 - DNA, 13 bp, Homo sapiens
atctgggcctggg

SEQ ID NO: 427200 - DNA, 16 bp, Homo sapiens
atctgggcctgggcta

SEQ ID NO: 427201 - DNA, 15 bp, Homo sapiens
atctgggctggcaga

SEQ ID NO: 427202 - DNA, 18 bp, Homo sapiens
atctggggaaggaccaac

SEQ ID NO: 427203 - DNA, 19 bp, Homo sapiens
atctgggtggtaactgcca

SEQ ID NO: 427204 - DNA, 17 bp, Homo sapiens
atctggtgcgtgtggcc

SEQ ID NO: 427205 - DNA, 18 bp, Homo sapiens
atctggtgcgtgtggccc

SEQ ID NO: 427206 - DNA, 15 bp, Homo sapiens
atctgtaaaaaagaa

SEQ ID NO: 427207 - DNA, 16 bp, Homo sapiens
atctgtaaaaaagaaa

SEQ ID NO: 427208 - DNA, 19 bp, Homo sapiens
atctgtaacccttgaattt

SEQ ID NO: 427209 - DNA, 22 bp, Homo sapiens
atctgtaacccttgaatttcta

SEQ ID NO: 427210 - DNA, 15 bp, Homo sapiens
atctgtacgtaagaa

SEQ ID NO: 427211 - DNA, 22 bp, Homo sapiens
atctgtagatactagctatcta

SEQ ID NO: 427212 - DNA, 14 bp, Homo sapiens
atctgtagggctgg

SEQ ID NO: 427213 - DNA, 17 bp, Homo sapiens
atctgtagggctggacc

SEQ ID NO: 427214 - DNA, 18 bp, Homo sapiens
atctgtcagcttcccaac

SEQ ID NO: 427215 - DNA, 19 bp, Homo sapiens
atctgtccaaaggaggctg

SEQ ID NO: 427216 - DNA, 21 bp, Homo sapiens
atctgtccaaaggaggctggc

SEQ ID NO: 427217 - DNA, 14 bp, Homo sapiens
atctgtctgagccc

SEQ ID NO: 427218 - DNA, 17 bp, Homo sapiens
atctgtctgagccctgc

SEQ ID NO: 427219 - DNA, 21 bp, Homo sapiens
atctgtctgagccctgccctc

SEQ ID NO: 427220 - DNA, 22 bp, Homo sapiens
atctgtctgagccctgccctca

SEQ ID NO: 427221 - DNA, 16 bp, Homo sapiens
atctgtctgattctat

SEQ ID NO: 427222 - DNA, 15 bp, Homo sapiens
atctgtctttatgat

SEQ ID NO: 427223 - DNA, 16 bp, Homo sapiens
atctgtgaattcagat

SEQ ID NO: 427224 - DNA, 21 bp, Homo sapiens
atctgtgcagtcatcaacaaa

SEQ ID NO: 427225 - DNA, 12 bp, Homo sapiens
atctgtgcccca

SEQ ID NO: 427226 - DNA, 13 bp, Homo sapiens
atctgtgccccat

SEQ ID NO: 427227 - DNA, 19 bp, Homo sapiens
atctgtgcgtgaaacacac

SEQ ID NO: 427228 - DNA, 19 bp, Homo sapiens
atctgtggattcagcttct

SEQ ID NO: 427229 - DNA, 23 bp, Homo sapiens
atctgtggcgatatgagagggat

SEQ ID NO: 427230 - DNA, 17 bp, Homo sapiens
atctgtgtgaaaatggg

SEQ ID NO: 427231 - DNA, 19 bp, Homo sapiens
atctgtgttctatgcaaag

SEQ ID NO: 427232 - DNA, 23 bp, Homo sapiens
atctgttagatgctactaagaaa

SEQ ID NO: 427233 - DNA, 23 bp, Homo sapiens
atctgttgtgtacgtggagaggg

SEQ ID NO: 427234 - DNA, 13 bp, Homo sapiens
atctgttgtttga

SEQ ID NO: 427235 - DNA, 14 bp, Homo sapiens
atctgtttgcttct

SEQ ID NO: 427236 - DNA, 16 bp, Homo sapiens
atctgtttgcttctaa

SEQ ID NO: 427237 - DNA, 17 bp, Homo sapiens
atctgtttgcttctaaa

SEQ ID NO: 427238 - DNA, 18 bp, Homo sapiens
atctgttttactgctttt

SEQ ID NO: 427239 - DNA, 19 bp, Homo sapiens
atcttaaagaaacagcttt

SEQ ID NO: 427240 - DNA, 23 bp, Homo sapiens
atcttaaagaaacagctttcaag

SEQ ID NO: 427241 - DNA, 13 bp, Homo sapiens
atcttaatcttta

SEQ ID NO: 427242 - DNA, 15 bp, Homo sapiens
atcttaatctttatt

SEQ ID NO: 427243 - DNA, 22 bp, Homo sapiens
atcttaattaagctccttcagt

SEQ ID NO: 427244 - DNA, 22 bp, Homo sapiens
atcttacaacaggcttatgaat

SEQ ID NO: 427245 - DNA, 13 bp, Homo sapiens
atcttacaagttt

SEQ ID NO: 427246 - DNA, 14 bp, Homo sapiens
atcttacaagttta

SEQ ID NO: 427247 - DNA, 15 bp, Homo sapiens
atcttacatctgcag

SEQ ID NO: 427248 - DNA, 16 bp, Homo sapiens
atcttagctgccaagt

SEQ ID NO: 427249 - DNA, 16 bp, Homo sapiens
atcttaggatttacca

SEQ ID NO: 427250 - DNA, 20 bp, Homo sapiens
atcttaggggagagctttct

SEQ ID NO: 427251 - DNA, 18 bp, Homo sapiens
atcttagtgcctgagagt

SEQ ID NO: 427252 - DNA, 18 bp, Homo sapiens
atcttatcatggtctcag

SEQ ID NO: 427253 - DNA, 13 bp, Homo sapiens
atcttatgttgat

SEQ ID NO: 427254 - DNA, 19 bp, Homo sapiens
atcttcaaactttcacttt

SEQ ID NO: 427255 - DNA, 15 bp, Homo sapiens
atcttcaaagcttga

SEQ ID NO: 427256 - DNA, 16 bp, Homo sapiens
atcttcactgaatatc

SEQ ID NO: 427257 - DNA, 19 bp, Homo sapiens
atcttcactgaatatcata

SEQ ID NO: 427258 - DNA, 13 bp, Homo sapiens
atcttcagctggt

SEQ ID NO: 427259 - DNA, 14 bp, Homo sapiens
atcttcagctggtg

SEQ ID NO: 427260 - DNA, 19 bp, Homo sapiens
atcttcagctggtggatgg

SEQ ID NO: 427261 - DNA, 14 bp, Homo sapiens
atcttcagttttat

SEQ ID NO: 427262 - DNA, 15 bp, Homo sapiens
atcttcatataaact

SEQ ID NO: 427263 - DNA, 17 bp, Homo sapiens
atcttcccgcctcagcc

SEQ ID NO: 427264 - DNA, 21 bp, Homo sapiens
atcttccctagagggttcctg

SEQ ID NO: 427265 - DNA, 12 bp, Homo sapiens
atcttcctgctg

SEQ ID NO: 427266 - DNA, 13 bp, Homo sapiens
atcttctccctcc

SEQ ID NO: 427267 - DNA, 15 bp, Homo sapiens
atcttctctcttgat

SEQ ID NO: 427268 - DNA, 16 bp, Homo sapiens
atcttctctcttgatt

SEQ ID NO: 427269 - DNA, 12 bp, Homo sapiens
atcttctgtttt

SEQ ID NO: 427270 - DNA, 18 bp, Homo sapiens
atcttctgtttttctcaa

SEQ ID NO: 427271 - DNA, 22 bp, Homo sapiens
atcttctgtttttctcaaataa

SEQ ID NO: 427272 - DNA, 14 bp, Homo sapiens
atcttctttataat

SEQ ID NO: 427273 - DNA, 17 bp, Homo sapiens
atcttctttataattct

SEQ ID NO: 427274 - DNA, 12 bp, Homo sapiens
atcttgaagaat

SEQ ID NO: 427275 - DNA, 15 bp, Homo sapiens
atcttgaagaatatt

SEQ ID NO: 427276 - DNA, 17 bp, Homo sapiens
atcttgaagacttttct

SEQ ID NO: 427277 - DNA, 18 bp, Homo sapiens
atcttgaagacttttctt

SEQ ID NO: 427278 - DNA, 14 bp, Homo sapiens
atcttgaagggccc

SEQ ID NO: 427279 - DNA, 17 bp, Homo sapiens
atcttgaagggcccagg

SEQ ID NO: 427280 - DNA, 18 bp, Homo sapiens
atcttgaattgtaaggaa

SEQ ID NO: 427281 - DNA, 15 bp, Homo sapiens
atcttgagagctgct

SEQ ID NO: 427282 - DNA, 17 bp, Homo sapiens
atcttgagcaaggcaag

SEQ ID NO: 427283 - DNA, 17 bp, Homo sapiens
atcttgatgtctttgtt

SEQ ID NO: 427284 - DNA, 11 bp, Homo sapiens
atcttgattaa

SEQ ID NO: 427285 - DNA, 21 bp, Homo sapiens
atcttgctggattaatgtttt

SEQ ID NO: 427286 - DNA, 19 bp, Homo sapiens
atcttggccctgttaaggc

SEQ ID NO: 427287 - DNA, 18 bp, Homo sapiens
atcttggtagtacatttt

SEQ ID NO: 427288 - DNA, 18 bp, Homo sapiens
atcttggtagttctgtgc

SEQ ID NO: 427289 - DNA, 12 bp, Homo sapiens
atcttgtcatgt

SEQ ID NO: 427290 - DNA, 14 bp, Homo sapiens
atcttgtcatgtgt

SEQ ID NO: 427291 - DNA, 19 bp, Homo sapiens
atcttgtcatgtgtataaa

SEQ ID NO: 427292 - DNA, 15 bp, Homo sapiens
atcttgtctctgggc

SEQ ID NO: 427293 - DNA, 15 bp, Homo sapiens
atcttgtcttttccc

SEQ ID NO: 427294 - DNA, 18 bp, Homo sapiens
atcttgtcttttcccctc

SEQ ID NO: 427295 - DNA, 22 bp, Homo sapiens
atcttgtgctagaatacttttt

SEQ ID NO: 427296 - DNA, 15 bp, Homo sapiens
atcttgtgtatggat

SEQ ID NO: 427297 - DNA, 20 bp, Homo sapiens
atctttaaagacttgatgaa

SEQ ID NO: 427298 - DNA, 21 bp, Homo sapiens
atctttaaagacttgatgaat

SEQ ID NO: 427299 - DNA, 15 bp, Homo sapiens
atctttaaatataat

SEQ ID NO: 427300 - DNA, 17 bp, Homo sapiens
atctttaattgtatctc

SEQ ID NO: 427301 - DNA, 18 bp, Homo sapiens
atctttatacttaaacag

SEQ ID NO: 427302 - DNA, 19 bp, Homo sapiens
atctttattaacctcagca

SEQ ID NO: 427303 - DNA, 14 bp, Homo sapiens
atctttattttatt

SEQ ID NO: 427304 - DNA, 13 bp, Homo sapiens
atctttcagaata

SEQ ID NO: 427305 - DNA, 19 bp, Homo sapiens
atctttcagaatacaattc

SEQ ID NO: 427306 - DNA, 14 bp, Homo sapiens
atctttcagcctgc

SEQ ID NO: 427307 - DNA, 17 bp, Homo sapiens
atctttcatagttctgt

SEQ ID NO: 427308 - DNA, 23 bp, Homo sapiens
atctttccaggcttccctgactt

SEQ ID NO: 427309 - DNA, 19 bp, Homo sapiens
atctttcctccaaactcct

SEQ ID NO: 427310 - DNA, 21 bp, Homo sapiens
atctttcctccaaactcctgc

SEQ ID NO: 427311 - DNA, 15 bp, Homo sapiens
atctttcctttgctc

SEQ ID NO: 427312 - DNA, 18 bp, Homo sapiens
atctttcctttgctctgg

SEQ ID NO: 427313 - DNA, 24 bp, Homo sapiens
atctttcgttggttgtttctctga

SEQ ID NO: 427314 - DNA, 17 bp, Homo sapiens
atctttctttacctgag

SEQ ID NO: 427315 - DNA, 21 bp, Homo sapiens
atctttctttacctgagacca

SEQ ID NO: 427316 - DNA, 15 bp, Homo sapiens
atctttgacctcaat

SEQ ID NO: 427317 - DNA, 13 bp, Homo sapiens
atctttgccttgg

SEQ ID NO: 427318 - DNA, 22 bp, Homo sapiens
atctttgccttgggctgctcct

SEQ ID NO: 427319 - DNA, 13 bp, Homo sapiens
atcttttaactgc

SEQ ID NO: 427320 - DNA, 22 bp, Homo sapiens
atcttttactgtggaggtggct

SEQ ID NO: 427321 - DNA, 18 bp, Homo sapiens
atcttttagagtaaacta

SEQ ID NO: 427322 - DNA, 23 bp, Homo sapiens
atcttttagagtaaactattcta

SEQ ID NO: 427323 - DNA, 13 bp, Homo sapiens
atcttttatttca

SEQ ID NO: 427324 - DNA, 13 bp, Homo sapiens
atcttttcattct

SEQ ID NO: 427325 - DNA, 22 bp, Homo sapiens
atcttttcatttaggtgaggaa

SEQ ID NO: 427326 - DNA, 17 bp, Homo sapiens
atctttttctccaccca

SEQ ID NO: 427327 - DNA, 21 bp, Homo sapiens
atcttttttttaggcaaaacc

SEQ ID NO: 427328 - DNA, 15 bp, Homo sapiens
atgaaaaaaatatat

SEQ ID NO: 427329 - DNA, 19 bp, Homo sapiens
atgaaaaacacggcagctg

SEQ ID NO: 427330 - DNA, 20 bp, Homo sapiens
atgaaaaacacggcagctgt

SEQ ID NO: 427331 - DNA, 18 bp, Homo sapiens
atgaaaaatttaagcatt

SEQ ID NO: 427332 - DNA, 20 bp, Homo sapiens
atgaaaaatttaagcattgt

SEQ ID NO: 427333 - DNA, 21 bp, Homo sapiens
atgaaaaatttaagcattgtt

SEQ ID NO: 427334 - DNA, 13 bp, Homo sapiens
atgaaaacatgta

SEQ ID NO: 427335 - DNA, 13 bp, Homo sapiens
atgaaaacattga

SEQ ID NO: 427336 - DNA, 20 bp, Homo sapiens
atgaaaacattgatgaatga

SEQ ID NO: 427337 - DNA, 12 bp, Homo sapiens
atgaaaacctgc

SEQ ID NO: 427338 - DNA, 18 bp, Homo sapiens
atgaaaacgttttattgt

SEQ ID NO: 427339 - DNA, 19 bp, Homo sapiens
atgaaaacgttttattgtg

SEQ ID NO: 427340 - DNA, 12 bp, Homo sapiens
atgaaaagagaa

SEQ ID NO: 427341 - DNA, 15 bp, Homo sapiens
atgaaaagatttaag

SEQ ID NO: 427342 - DNA, 17 bp, Homo sapiens
atgaaaatcctaccaac

SEQ ID NO: 427343 - DNA, 20 bp, Homo sapiens
atgaaacactcagttgttca

SEQ ID NO: 427344 - DNA, 14 bp, Homo sapiens
atgaaaccttcctc

SEQ ID NO: 427345 - DNA, 16 bp, Homo sapiens
atgaaactcacaaatg

SEQ ID NO: 427346 - DNA, 19 bp, Homo sapiens
atgaaactcctgattttgt

SEQ ID NO: 427347 - DNA, 19 bp, Homo sapiens
atgaaagatggctgtgcct

SEQ ID NO: 427348 - DNA, 18 bp, Homo sapiens
atgaaagcatgtggcatg

SEQ ID NO: 427349 - DNA, 22 bp, Homo sapiens
atgaaagctgattactgtcaat

SEQ ID NO: 427350 - DNA, 14 bp, Homo sapiens
atgaaaggtaatct

SEQ ID NO: 427351 - DNA, 18 bp, Homo sapiens
atgaaaggtaatctgaaa

SEQ ID NO: 427352 - DNA, 21 bp, Homo sapiens
atgaaaggtttacattgtcaa

SEQ ID NO: 427353 - DNA, 18 bp, Homo sapiens
atgaaagtcttgtgacta

SEQ ID NO: 427354 - DNA, 19 bp, Homo sapiens
atgaaataaatcatgttaa

SEQ ID NO: 427355 - DNA, 19 bp, Homo sapiens
atgaaatacttgacaacat

SEQ ID NO: 427356 - DNA, 20 bp, Homo sapiens
atgaaatagttattttaata

SEQ ID NO: 427357 - DNA, 22 bp, Homo sapiens
atgaaatagttattttaatacc

SEQ ID NO: 427358 - DNA, 15 bp, Homo sapiens
atgaaatataaactg

SEQ ID NO: 427359 - DNA, 18 bp, Homo sapiens
atgaaatataaactgtga

SEQ ID NO: 427360 - DNA, 17 bp, Homo sapiens
atgaaatatttgcttat

SEQ ID NO: 427361 - DNA, 17 bp, Homo sapiens
atgaaatctattttcag

SEQ ID NO: 427362 - DNA, 21 bp, Homo sapiens
atgaaattataagtagatttg

SEQ ID NO: 427363 - DNA, 23 bp, Homo sapiens
atgaaattgccaaaaaaatttat

SEQ ID NO: 427364 - DNA, 21 bp, Homo sapiens
atgaaattttctagactttct

SEQ ID NO: 427365 - DNA, 23 bp, Homo sapiens
atgaaattttctagactttctgt

SEQ ID NO: 427366 - DNA, 16 bp, Homo sapiens
atgaacagggcccagg

SEQ ID NO: 427367 - DNA, 21 bp, Homo sapiens
atgaacagggcccaggcctgg

SEQ ID NO: 427368 - DNA, 23 bp, Homo sapiens
atgaacagggcccaggcctggag

SEQ ID NO: 427369 - DNA, 22 bp, Homo sapiens
atgaacccaggacgcttctgaa

SEQ ID NO: 427370 - DNA, 20 bp, Homo sapiens
atgaaccgcaatatgggagg

SEQ ID NO: 427371 - DNA, 17 bp, Homo sapiens
atgaactgaagtttcac

SEQ ID NO: 427372 - DNA, 19 bp, Homo sapiens
atgaactgaagtttcacat

SEQ ID NO: 427373 - DNA, 19 bp, Homo sapiens
atgaactgcatgtataaat

SEQ ID NO: 427374 - DNA, 13 bp, Homo sapiens
atgaactgtgaca

SEQ ID NO: 427375 - DNA, 14 bp, Homo sapiens
atgaactgtgacag

SEQ ID NO: 427376 - DNA, 19 bp, Homo sapiens
atgaacttgaggacacatg

SEQ ID NO: 427377 - DNA, 21 bp, Homo sapiens
atgaacttgaggacacatgtc

SEQ ID NO: 427378 - DNA, 21 bp, Homo sapiens
atgaagaaaagtgggccagtg

SEQ ID NO: 427379 - DNA, 19 bp, Homo sapiens
atgaagaacacagcatgtg

SEQ ID NO: 427380 - DNA, 23 bp, Homo sapiens
atgaagcaaacacacagactctg

SEQ ID NO: 427381 - DNA, 15 bp, Homo sapiens
atgaagctacctcaa

SEQ ID NO: 427382 - DNA, 13 bp, Homo sapiens
atgaaggaattac

SEQ ID NO: 427383 - DNA, 16 bp, Homo sapiens
atgaaggttaggattt

SEQ ID NO: 427384 - DNA, 21 bp, Homo sapiens
atgaaggttaggatttaacag

SEQ ID NO: 427385 - DNA, 11 bp, Homo sapiens
atgaagtactt

SEQ ID NO: 427386 - DNA, 14 bp, Homo sapiens
atgaagtactttta

SEQ ID NO: 427387 - DNA, 15 bp, Homo sapiens
atgaagtacttttaa

SEQ ID NO: 427388 - DNA, 14 bp, Homo sapiens
atgaagtttataca

SEQ ID NO: 427389 - DNA, 15 bp, Homo sapiens
atgaataattatgtt

SEQ ID NO: 427390 - DNA, 16 bp, Homo sapiens
atgaataattatgttt

SEQ ID NO: 427391 - DNA, 15 bp, Homo sapiens
atgaataatttccca

SEQ ID NO: 427392 - DNA, 17 bp, Homo sapiens
atgaatagtacatgcag

SEQ ID NO: 427393 - DNA, 23 bp, Homo sapiens
atgaatctgtctcccagttatga

SEQ ID NO: 427394 - DNA, 13 bp, Homo sapiens
atgaatgaaatat

SEQ ID NO: 427395 - DNA, 16 bp, Homo sapiens
atgaatgaaatataaa

SEQ ID NO: 427396 - DNA, 18 bp, Homo sapiens
atgaatgcagtataaaat

SEQ ID NO: 427397 - DNA, 19 bp, Homo sapiens
atgaatgcagtataaaatg

SEQ ID NO: 427398 - DNA, 12 bp, Homo sapiens
atgaatgtaaat

SEQ ID NO: 427399 - DNA, 15 bp, Homo sapiens
atgaatgtaaatttg

SEQ ID NO: 427400 - DNA, 16 bp, Homo sapiens
atgaatgtatgtgcac

SEQ ID NO: 427401 - DNA, 17 bp, Homo sapiens
atgaattaaatattgaa

SEQ ID NO: 427402 - DNA, 17 bp, Homo sapiens
atgaattcaagaaagga

SEQ ID NO: 427403 - DNA, 13 bp, Homo sapiens
atgaattcatact

SEQ ID NO: 427404 - DNA, 14 bp, Homo sapiens
atgaattcatactc

SEQ ID NO: 427405 - DNA, 14 bp, Homo sapiens
atgaattgaatgct

SEQ ID NO: 427406 - DNA, 12 bp, Homo sapiens
atgaattgtaaa

SEQ ID NO: 427407 - DNA, 11 bp, Homo sapiens
atgaatttaaa

SEQ ID NO: 427408 - DNA, 15 bp, Homo sapiens
atgaatttgactggt

SEQ ID NO: 427409 - DNA, 16 bp, Homo sapiens
atgaattttaaaagca

SEQ ID NO: 427410 - DNA, 13 bp, Homo sapiens
atgaattttatgt

SEQ ID NO: 427411 - DNA, 22 bp, Homo sapiens
atgaattttcaagtaattgtga

SEQ ID NO: 427412 - DNA, 14 bp, Homo sapiens
atgacaaagaaaat

SEQ ID NO: 427413 - DNA, 16 bp, Homo sapiens
atgacaaagttacaaa

SEQ ID NO: 427414 - DNA, 20 bp, Homo sapiens
atgacaacttctaattgcca

SEQ ID NO: 427415 - DNA, 15 bp, Homo sapiens
atgacaagccccagg

SEQ ID NO: 427416 - DNA, 16 bp, Homo sapiens
atgacacataaatctg

SEQ ID NO: 427417 - DNA, 16 bp, Homo sapiens
atgacactgagaacag

SEQ ID NO: 427418 - DNA, 22 bp, Homo sapiens
atgacactggaagggtccggct

SEQ ID NO: 427419 - DNA, 20 bp, Homo sapiens
atgacagaaatatgattgat

SEQ ID NO: 427420 - DNA, 13 bp, Homo sapiens
atgacagagagtt

SEQ ID NO: 427421 - DNA, 14 bp, Homo sapiens
atgacagctgttcc

SEQ ID NO: 427422 - DNA, 12 bp, Homo sapiens
atgacagggagc

SEQ ID NO: 427423 - DNA, 22 bp, Homo sapiens
atgacagttatactgtcggttt

SEQ ID NO: 427424 - DNA, 15 bp, Homo sapiens
atgacatttctcaaa

SEQ ID NO: 427425 - DNA, 19 bp, Homo sapiens
atgacatttgtcctgcaga

SEQ ID NO: 427426 - DNA, 14 bp, Homo sapiens
atgaccacacctgc

SEQ ID NO: 427427 - DNA, 19 bp, Homo sapiens
atgaccaggccaccatctg

SEQ ID NO: 427428 - DNA, 16 bp, Homo sapiens
atgaccagtttacctg

SEQ ID NO: 427429 - DNA, 22 bp, Homo sapiens
atgacccggcccccgccctctg

SEQ ID NO: 427430 - DNA, 13 bp, Homo sapiens
atgacctaaatcc

SEQ ID NO: 427431 - DNA, 23 bp, Homo sapiens
atgacctaaatccattttctaaa

SEQ ID NO: 427432 - DNA, 16 bp, Homo sapiens
atgacctcaacaaaga

SEQ ID NO: 427433 - DNA, 19 bp, Homo sapiens
atgacctccttagaaaaga

SEQ ID NO: 427434 - DNA, 19 bp, Homo sapiens
atgacctgtgaccagcact

SEQ ID NO: 427435 - DNA, 17 bp, Homo sapiens
atgaccttggggtacaa

SEQ ID NO: 427436 - DNA, 20 bp, Homo sapiens
atgaccttttggcctttgta

SEQ ID NO: 427437 - DNA, 16 bp, Homo sapiens
atgacggaagaacata

SEQ ID NO: 427438 - DNA, 19 bp, Homo sapiens
atgacgtattgtgaaattt

SEQ ID NO: 427439 - DNA, 14 bp, Homo sapiens
atgacgtgaatgtg

SEQ ID NO: 427440 - DNA, 15 bp, Homo sapiens
atgacgtgaatgtgt

SEQ ID NO: 427441 - DNA, 17 bp, Homo sapiens
atgacgtttaaggccac

SEQ ID NO: 427442 - DNA, 12 bp, Homo sapiens
atgactaaagag

SEQ ID NO: 427443 - DNA, 13 bp, Homo sapiens
atgactaaagaga

SEQ ID NO: 427444 - DNA, 18 bp, Homo sapiens
atgactaaagagagaatg

SEQ ID NO: 427445 - DNA, 19 bp, Homo sapiens
atgactaaagagagaatgt

SEQ ID NO: 427446 - DNA, 21 bp, Homo sapiens
atgactaaagagagaatgtag

SEQ ID NO: 427447 - DNA, 14 bp, Homo sapiens
atgactataaacat

SEQ ID NO: 427448 - DNA, 17 bp, Homo sapiens
atgactcacatgatgca

SEQ ID NO: 427449 - DNA, 16 bp, Homo sapiens
atgactccagaatttc

SEQ ID NO: 427450 - DNA, 23 bp, Homo sapiens
atgactgaaagaagaacagctgt

SEQ ID NO: 427451 - DNA, 16 bp, Homo sapiens
atgactggctgtctgc

SEQ ID NO: 427452 - DNA, 19 bp, Homo sapiens
atgactggctgtctgcctg

SEQ ID NO: 427453 - DNA, 19 bp, Homo sapiens
atgactgtcccattctcca

SEQ ID NO: 427454 - DNA, 18 bp, Homo sapiens
atgactgtttttgtagtg

SEQ ID NO: 427455 - DNA, 21 bp, Homo sapiens
atgacttcatttctgatgtga

SEQ ID NO: 427456 - DNA, 17 bp, Homo sapiens
atgacttcttgttcatg

SEQ ID NO: 427457 - DNA, 15 bp, Homo sapiens
atgacttttattatg

SEQ ID NO: 427458 - DNA, 11 bp, Homo sapiens
atgagaaaaaa

SEQ ID NO: 427459 - DNA, 15 bp, Homo sapiens
atgagaaacaacaga

SEQ ID NO: 427460 - DNA, 19 bp, Homo sapiens
atgagaaatacagtgcttt

SEQ ID NO: 427461 - DNA, 16 bp, Homo sapiens
atgagaaatataaaaa

SEQ ID NO: 427462 - DNA, 23 bp, Homo sapiens
atgagaacaagtcacagctgcag

SEQ ID NO: 427463 - DNA, 13 bp, Homo sapiens
atgagaactaaat

SEQ ID NO: 427464 - DNA, 18 bp, Homo sapiens
atgagaactggttcttgc

SEQ ID NO: 427465 - DNA, 19 bp, Homo sapiens
atgagaagttaagcagcct

SEQ ID NO: 427466 - DNA, 21 bp, Homo sapiens
atgagaagttaagcagccttt

SEQ ID NO: 427467 - DNA, 17 bp, Homo sapiens
atgagaatgtcatttgc

SEQ ID NO: 427468 - DNA, 20 bp, Homo sapiens
atgagaatgtcatttgctaa

SEQ ID NO: 427469 - DNA, 18 bp, Homo sapiens
atgagaattcagctgccc

SEQ ID NO: 427470 - DNA, 16 bp, Homo sapiens
atgagacaacacacac

SEQ ID NO: 427471 - DNA, 17 bp, Homo sapiens
atgagacaacacacaca

SEQ ID NO: 427472 - DNA, 18 bp, Homo sapiens
atgagaccactgttatca

SEQ ID NO: 427473 - DNA, 10 bp, Homo sapiens
atgagagagt

SEQ ID NO: 427474 - DNA, 15 bp, Homo sapiens
atgagatagaagatg

SEQ ID NO: 427475 - DNA, 21 bp, Homo sapiens
atgagatagaagatgtttgct

SEQ ID NO: 427476 - DNA, 23 bp, Homo sapiens
atgagatatatctttatacttaa

SEQ ID NO: 427477 - DNA, 19 bp, Homo sapiens
atgagatgcgttgttacag

SEQ ID NO: 427478 - DNA, 21 bp, Homo sapiens
atgagatgtatgcccaaagac

SEQ ID NO: 427479 - DNA, 19 bp, Homo sapiens
atgagattcagtgaactaa

SEQ ID NO: 427480 - DNA, 22 bp, Homo sapiens
atgagattgttttatcatgaca

SEQ ID NO: 427481 - DNA, 22 bp, Homo sapiens
atgagcaaggacattgccccaa

SEQ ID NO: 427482 - DNA, 12 bp, Homo sapiens
atgagcctctcc

SEQ ID NO: 427483 - DNA, 15 bp, Homo sapiens
atgagcctctccttg

SEQ ID NO: 427484 - DNA, 10 bp, Homo sapiens
atgagcctgc

SEQ ID NO: 427485 - DNA, 16 bp, Homo sapiens
atgagcctgcccgctg

SEQ ID NO: 427486 - DNA, 19 bp, Homo sapiens
atgagcgttaacacagtaa

SEQ ID NO: 427487 - DNA, 17 bp, Homo sapiens
atgagctccagaccccc

SEQ ID NO: 427488 - DNA, 21 bp, Homo sapiens
atgagctccagacccccagca

SEQ ID NO: 427489 - DNA, 21 bp, Homo sapiens
atgagctcgcatttgtcaatg

SEQ ID NO: 427490 - DNA, 20 bp, Homo sapiens
atgagctctctaatagaagt

SEQ ID NO: 427491 - DNA, 18 bp, Homo sapiens
atgagctgggccctgggt

SEQ ID NO: 427492 - DNA, 18 bp, Homo sapiens
atgaggaacaatcacaaa

SEQ ID NO: 427493 - DNA, 11 bp, Homo sapiens
atgaggaagaa

SEQ ID NO: 427494 - DNA, 14 bp, Homo sapiens
atgaggaggaagga

SEQ ID NO: 427495 - DNA, 18 bp, Homo sapiens
atgaggagtgaacatttg

SEQ ID NO: 427496 - DNA, 21 bp, Homo sapiens
atgaggccgctagaggcctga

SEQ ID NO: 427497 - DNA, 18 bp, Homo sapiens
atgaggcctcagtggact

SEQ ID NO: 427498 - DNA, 17 bp, Homo sapiens
atgaggctattaaaaga

SEQ ID NO: 427499 - DNA, 22 bp, Homo sapiens
atgagggagggggcgctcagga

SEQ ID NO: 427500 - DNA, 19 bp, Homo sapiens
atgagggcagaaaccttgt

SEQ ID NO: 427501 - DNA, 14 bp, Homo sapiens
atgagggtgactgt

SEQ ID NO: 427502 - DNA, 14 bp, Homo sapiens
atgaggtaaaagag

SEQ ID NO: 427503 - DNA, 22 bp, Homo sapiens
atgaggtaaaagagccaagttc

SEQ ID NO: 427504 - DNA, 14 bp, Homo sapiens
atgaggtctgaaat

SEQ ID NO: 427505 - DNA, 17 bp, Homo sapiens
atgaggtgctgggaggg

SEQ ID NO: 427506 - DNA, 16 bp, Homo sapiens
atgaggttatgagaaa

SEQ ID NO: 427507 - DNA, 22 bp, Homo sapiens
atgaggttcaactgttgattgc

SEQ ID NO: 427508 - DNA, 15 bp, Homo sapiens
atgagtaaataaact

SEQ ID NO: 427509 - DNA, 16 bp, Homo sapiens
atgagtcaatgtgcag

SEQ ID NO: 427510 - DNA, 17 bp, Homo sapiens
atgagtcaatgtgcagt

SEQ ID NO: 427511 - DNA, 15 bp, Homo sapiens
atgagtcccagtggg

SEQ ID NO: 427512 - DNA, 13 bp, Homo sapiens
atgagtcctgtta

SEQ ID NO: 427513 - DNA, 21 bp, Homo sapiens
atgagtgtcaactccaggact

SEQ ID NO: 427514 - DNA, 19 bp, Homo sapiens
atgagtttaaaaaaataac

SEQ ID NO: 427515 - DNA, 13 bp, Homo sapiens
atgagtttatggg

SEQ ID NO: 427516 - DNA, 13 bp, Homo sapiens
atgagtttttgat

SEQ ID NO: 427517 - DNA, 12 bp, Homo sapiens
atgataaaagga

SEQ ID NO: 427518 - DNA, 15 bp, Homo sapiens
atgataaaataagta

SEQ ID NO: 427519 - DNA, 16 bp, Homo sapiens
atgataaaataagtaa

SEQ ID NO: 427520 - DNA, 17 bp, Homo sapiens
atgataaaataagtaac

SEQ ID NO: 427521 - DNA, 15 bp, Homo sapiens
atgataaagatgtca

SEQ ID NO: 427522 - DNA, 17 bp, Homo sapiens
atgataagtaaatgcta

SEQ ID NO: 427523 - DNA, 15 bp, Homo sapiens
atgatactgtctaag

SEQ ID NO: 427524 - DNA, 19 bp, Homo sapiens
atgatacttattcaaaaaa

SEQ ID NO: 427525 - DNA, 17 bp, Homo sapiens
atgatagacttcgaaaa

SEQ ID NO: 427526 - DNA, 14 bp, Homo sapiens
atgatatataaacc

SEQ ID NO: 427527 - DNA, 23 bp, Homo sapiens
atgatatataaaccttaaatgaa

SEQ ID NO: 427528 - DNA, 14 bp, Homo sapiens
atgatatgcatgta

SEQ ID NO: 427529 - DNA, 16 bp, Homo sapiens
atgatatgtctttaaa

SEQ ID NO: 427530 - DNA, 20 bp, Homo sapiens
atgatatgtctttaaaatga

SEQ ID NO: 427531 - DNA, 23 bp, Homo sapiens
atgatattctcattatttcatca

SEQ ID NO: 427532 - DNA, 12 bp, Homo sapiens
atgatatttctt

SEQ ID NO: 427533 - DNA, 14 bp, Homo sapiens
atgatattttcaga

SEQ ID NO: 427534 - DNA, 15 bp, Homo sapiens
atgatcaacaattta

SEQ ID NO: 427535 - DNA, 23 bp, Homo sapiens
atgatcaaggagtgaagtaattg

SEQ ID NO: 427536 - DNA, 18 bp, Homo sapiens
atgatcagctgtttgtca

SEQ ID NO: 427537 - DNA, 19 bp, Homo sapiens
atgatcagctgtttgtcat

SEQ ID NO: 427538 - DNA, 20 bp, Homo sapiens
atgatccacccacctcagcc

SEQ ID NO: 427539 - DNA, 22 bp, Homo sapiens
atgatccacccacctcagcctc

SEQ ID NO: 427540 - DNA, 15 bp, Homo sapiens
atgatccagggattg

SEQ ID NO: 427541 - DNA, 18 bp, Homo sapiens
atgatccctgtgttgtct

SEQ ID NO: 427542 - DNA, 14 bp, Homo sapiens
atgatcgtgcctat

SEQ ID NO: 427543 - DNA, 20 bp, Homo sapiens
atgatcgttctgggtcagct

SEQ ID NO: 427544 - DNA, 18 bp, Homo sapiens
atgatctactcagaaatt

SEQ ID NO: 427545 - DNA, 20 bp, Homo sapiens
atgatgatgtggaagaactt

SEQ ID NO: 427546 - DNA, 17 bp, Homo sapiens
atgatgattaaacacct

SEQ ID NO: 427547 - DNA, 19 bp, Homo sapiens
atgatgattaaacacctga

SEQ ID NO: 427548 - DNA, 20 bp, Homo sapiens
atgatgattaaacacctgac

SEQ ID NO: 427549 - DNA, 15 bp, Homo sapiens
atgatgcatggagtg

SEQ ID NO: 427550 - DNA, 20 bp, Homo sapiens
atgatgcatggagtgtttga

SEQ ID NO: 427551 - DNA, 16 bp, Homo sapiens
atgatgccatgaggaa

SEQ ID NO: 427552 - DNA, 13 bp, Homo sapiens
atgatggaaagga

SEQ ID NO: 427553 - DNA, 18 bp, Homo sapiens
atgatggttgcaaaagac

SEQ ID NO: 427554 - DNA, 15 bp, Homo sapiens
atgatgtccagaaga

SEQ ID NO: 427555 - DNA, 18 bp, Homo sapiens
atgatgtccagaagaata

SEQ ID NO: 427556 - DNA, 23 bp, Homo sapiens
atgatgtccagaagaatattcag

SEQ ID NO: 427557 - DNA, 19 bp, Homo sapiens
atgatgtcgttcattttct

SEQ ID NO: 427558 - DNA, 15 bp, Homo sapiens
atgatgtctcttgta

SEQ ID NO: 427559 - DNA, 15 bp, Homo sapiens
atgatgtctgcaaag

SEQ ID NO: 427560 - DNA, 20 bp, Homo sapiens
atgatgtgatggaacacaca

SEQ ID NO: 427561 - DNA, 19 bp, Homo sapiens
atgatgtggagtggggcag

SEQ ID NO: 427562 - DNA, 23 bp, Homo sapiens
atgatgtggagtggggcagtaga

SEQ ID NO: 427563 - DNA, 13 bp, Homo sapiens
atgattaaacacc

SEQ ID NO: 427564 - DNA, 18 bp, Homo sapiens
atgattaaacacctgaca

SEQ ID NO: 427565 - DNA, 22 bp, Homo sapiens
atgattaaacacctgacacatc

SEQ ID NO: 427566 - DNA, 14 bp, Homo sapiens
atgattaatgtgta

SEQ ID NO: 427567 - DNA, 17 bp, Homo sapiens
atgattaatgtgtattt

SEQ ID NO: 427568 - DNA, 16 bp, Homo sapiens
atgattagacaatgtg

SEQ ID NO: 427569 - DNA, 23 bp, Homo sapiens
atgattagcaagttacagtgatg

SEQ ID NO: 427570 - DNA, 13 bp, Homo sapiens
atgattatcttga

SEQ ID NO: 427571 - DNA, 21 bp, Homo sapiens
atgattccaagggcccagagg

SEQ ID NO: 427572 - DNA, 23 bp, Homo sapiens
atgattcgcccaaagccagacag

SEQ ID NO: 427573 - DNA, 23 bp, Homo sapiens
atgattctaatttttaagcaaaa

SEQ ID NO: 427574 - DNA, 16 bp, Homo sapiens
atgattgtaacatatt

SEQ ID NO: 427575 - DNA, 17 bp, Homo sapiens
atgattgtaacatattt

SEQ ID NO: 427576 - DNA, 17 bp, Homo sapiens
atgattgtttaattgta

SEQ ID NO: 427577 - DNA, 21 bp, Homo sapiens
atgatttaagcattttactgt

SEQ ID NO: 427578 - DNA, 14 bp, Homo sapiens
atgatttactcatt

SEQ ID NO: 427579 - DNA, 15 bp, Homo sapiens
atgatttactcatta

SEQ ID NO: 427580 - DNA, 13 bp, Homo sapiens
atgatttatagtt

SEQ ID NO: 427581 - DNA, 14 bp, Homo sapiens
atgatttcagaaac

SEQ ID NO: 427582 - DNA, 15 bp, Homo sapiens
atgatttcagaaaca

SEQ ID NO: 427583 - DNA, 19 bp, Homo sapiens
atgatttcatgattagaca

SEQ ID NO: 427584 - DNA, 13 bp, Homo sapiens
atgatttggggga

SEQ ID NO: 427585 - DNA, 22 bp, Homo sapiens
atgatttgtgtccatttcaagt

SEQ ID NO: 427586 - DNA, 23 bp, Homo sapiens
atgattttatttgacaaaatttg

SEQ ID NO: 427587 - DNA, 17 bp, Homo sapiens
atgattttgatgcacaa

SEQ ID NO: 427588 - DNA, 15 bp, Homo sapiens
atgattttgcttttc

SEQ ID NO: 427589 - DNA, 19 bp, Homo sapiens
atgcaaaaattagccgggc

SEQ ID NO: 427590 - DNA, 18 bp, Homo sapiens
atgcaaaataaatgtttt

SEQ ID NO: 427591 - DNA, 13 bp, Homo sapiens
atgcaagagaagg

SEQ ID NO: 427592 - DNA, 15 bp, Homo sapiens
atgcaagagaaggag

SEQ ID NO: 427593 - DNA, 17 bp, Homo sapiens
atgcaagagaaggagat

SEQ ID NO: 427594 - DNA, 23 bp, Homo sapiens
atgcaagctagtggcttcaaaat

SEQ ID NO: 427595 - DNA, 15 bp, Homo sapiens
atgcaagctcagggt

SEQ ID NO: 427596 - DNA, 14 bp, Homo sapiens
atgcaaggaccagg

SEQ ID NO: 427597 - DNA, 22 bp, Homo sapiens
atgcaagtcactaaatttctca

SEQ ID NO: 427598 - DNA, 18 bp, Homo sapiens
atgcaagtgtttctgttc

SEQ ID NO: 427599 - DNA, 12 bp, Homo sapiens
atgcaatgagat

SEQ ID NO: 427600 - DNA, 23 bp, Homo sapiens
atgcaatgagatagaagatgttt

SEQ ID NO: 427601 - DNA, 22 bp, Homo sapiens
atgcaatgtcttaaataaaact

SEQ ID NO: 427602 - DNA, 19 bp, Homo sapiens
atgcaatttattaaaatga

SEQ ID NO: 427603 - DNA, 15 bp, Homo sapiens
atgcacaaagtgtat

SEQ ID NO: 427604 - DNA, 20 bp, Homo sapiens
atgcacaccaaattgctgag

SEQ ID NO: 427605 - DNA, 21 bp, Homo sapiens
atgcacaccaaattgctgaga

SEQ ID NO: 427606 - DNA, 13 bp, Homo sapiens
atgcacagagtcc

SEQ ID NO: 427607 - DNA, 18 bp, Homo sapiens
atgcacagattaaacttc

SEQ ID NO: 427608 - DNA, 15 bp, Homo sapiens
atgcacagtttgcaa

SEQ ID NO: 427609 - DNA, 12 bp, Homo sapiens
atgcacatttgt

SEQ ID NO: 427610 - DNA, 21 bp, Homo sapiens
atgcacatttgtgcataaatt

SEQ ID NO: 427611 - DNA, 20 bp, Homo sapiens
atgcaccaagtacagccttc

SEQ ID NO: 427612 - DNA, 18 bp, Homo sapiens
atgcacggtttctgttct

SEQ ID NO: 427613 - DNA, 22 bp, Homo sapiens
atgcacggtttctgttctgccc

SEQ ID NO: 427614 - DNA, 22 bp, Homo sapiens
atgcactactgaaatttacaca

SEQ ID NO: 427615 - DNA, 13 bp, Homo sapiens
atgcactatgagg

SEQ ID NO: 427616 - DNA, 16 bp, Homo sapiens
atgcactatgaggaat

SEQ ID NO: 427617 - DNA, 17 bp, Homo sapiens
atgcactgcaaatactt

SEQ ID NO: 427618 - DNA, 13 bp, Homo sapiens
atgcactggcctg

SEQ ID NO: 427619 - DNA, 14 bp, Homo sapiens
atgcactggcctgt

SEQ ID NO: 427620 - DNA, 24 bp, Homo sapiens
atgcactggcctgttctgtaggag

SEQ ID NO: 427621 - DNA, 20 bp, Homo sapiens
atgcacttattttttaatgt

SEQ ID NO: 427622 - DNA, 22 bp, Homo sapiens
atgcacttattttttaatgtga

SEQ ID NO: 427623 - DNA, 13 bp, Homo sapiens
atgcagaaggaag

SEQ ID NO: 427624 - DNA, 14 bp, Homo sapiens
atgcagacacacaa

SEQ ID NO: 427625 - DNA, 14 bp, Homo sapiens
atgcagacatttac

SEQ ID NO: 427626 - DNA, 18 bp, Homo sapiens
atgcagacatttacatgt

SEQ ID NO: 427627 - DNA, 19 bp, Homo sapiens
atgcagacatttacatgtt

SEQ ID NO: 427628 - DNA, 21 bp, Homo sapiens
atgcagactcctcagatctga

SEQ ID NO: 427629 - DNA, 17 bp, Homo sapiens
atgcagattcctgggcc

SEQ ID NO: 427630 - DNA, 18 bp, Homo sapiens
atgcagattcctgggcct

SEQ ID NO: 427631 - DNA, 19 bp, Homo sapiens
atgcagcagcttgctgcac

SEQ ID NO: 427632 - DNA, 19 bp, Homo sapiens
atgcagccgccttccttga

SEQ ID NO: 427633 - DNA, 16 bp, Homo sapiens
atgcaggaactgaaaa

SEQ ID NO: 427634 - DNA, 17 bp, Homo sapiens
atgcagggaagagggca

SEQ ID NO: 427635 - DNA, 23 bp, Homo sapiens
atgcagggaagagggcagtacct

SEQ ID NO: 427636 - DNA, 19 bp, Homo sapiens
atgcagtataaaatgtaaa

SEQ ID NO: 427637 - DNA, 23 bp, Homo sapiens
atgcagtgggtggggctgtacac

SEQ ID NO: 427638 - DNA, 17 bp, Homo sapiens
atgcagttcattatttt

SEQ ID NO: 427639 - DNA, 18 bp, Homo sapiens
atgcagttcattattttg

SEQ ID NO: 427640 - DNA, 15 bp, Homo sapiens
atgcagttttaagaa

SEQ ID NO: 427641 - DNA, 12 bp, Homo sapiens
atgcataaacaa

SEQ ID NO: 427642 - DNA, 18 bp, Homo sapiens
atgcataaacaacagtac

SEQ ID NO: 427643 - DNA, 13 bp, Homo sapiens
atgcatctttgag

SEQ ID NO: 427644 - DNA, 15 bp, Homo sapiens
atgcatgagaactaa

SEQ ID NO: 427645 - DNA, 21 bp, Homo sapiens
atgcatgagaactaaatagat

SEQ ID NO: 427646 - DNA, 18 bp, Homo sapiens
atgcatgatattgtatgt

SEQ ID NO: 427647 - DNA, 11 bp, Homo sapiens
atgcatgccag

SEQ ID NO: 427648 - DNA, 13 bp, Homo sapiens
atgcatgccaggc

SEQ ID NO: 427649 - DNA, 17 bp, Homo sapiens
atgcatgccaggctggg

SEQ ID NO: 427650 - DNA, 15 bp, Homo sapiens
atgcatgctttggaa

SEQ ID NO: 427651 - DNA, 20 bp, Homo sapiens
atgcatggaaacctgaaaaa

SEQ ID NO: 427652 - DNA, 22 bp, Homo sapiens
atgcatggagtgtttgacgaag

SEQ ID NO: 427653 - DNA, 19 bp, Homo sapiens
atgcatggcctcccagcca

SEQ ID NO: 427654 - DNA, 14 bp, Homo sapiens
atgcatgtaaggtc

SEQ ID NO: 427655 - DNA, 21 bp, Homo sapiens
atgcatgtaaggtcttcttgt

SEQ ID NO: 427656 - DNA, 17 bp, Homo sapiens
atgcatgtactttatat

SEQ ID NO: 427657 - DNA, 19 bp, Homo sapiens
atgcatgtagcatataaat

SEQ ID NO: 427658 - DNA, 18 bp, Homo sapiens
atgcatgttttatgtgca

SEQ ID NO: 427659 - DNA, 13 bp, Homo sapiens
atgcattcatgtt

SEQ ID NO: 427660 - DNA, 16 bp, Homo sapiens
atgcattgaaagaatt

SEQ ID NO: 427661 - DNA, 16 bp, Homo sapiens
atgcatttatgcatga

SEQ ID NO: 427662 - DNA, 14 bp, Homo sapiens
atgcatttgcattt

SEQ ID NO: 427663 - DNA, 15 bp, Homo sapiens
atgcattttatcaga

SEQ ID NO: 427664 - DNA, 19 bp, Homo sapiens
atgcattttatcagacaat

SEQ ID NO: 427665 - DNA, 16 bp, Homo sapiens
atgcatttttaagaat

SEQ ID NO: 427666 - DNA, 14 bp, Homo sapiens
atgccaaacagttg

SEQ ID NO: 427667 - DNA, 21 bp, Homo sapiens
atgccaaacagttgtaccact

SEQ ID NO: 427668 - DNA, 18 bp, Homo sapiens
atgccaacaccttcttgg

SEQ ID NO: 427669 - DNA, 19 bp, Homo sapiens
atgccaacagacactacat

SEQ ID NO: 427670 - DNA, 16 bp, Homo sapiens
atgccaactcgggagc

SEQ ID NO: 427671 - DNA, 18 bp, Homo sapiens
atgccaactcgggagcat

SEQ ID NO: 427672 - DNA, 20 bp, Homo sapiens
atgccaaggaggtcccagga

SEQ ID NO: 427673 - DNA, 22 bp, Homo sapiens
atgccaaggaggtcccaggaag

SEQ ID NO: 427674 - DNA, 18 bp, Homo sapiens
atgccacacagagtggtc

SEQ ID NO: 427675 - DNA, 13 bp, Homo sapiens
atgccacagccaa

SEQ ID NO: 427676 - DNA, 18 bp, Homo sapiens
atgccacagccaagccca

SEQ ID NO: 427677 - DNA, 14 bp, Homo sapiens
atgccaccacccac

SEQ ID NO: 427678 - DNA, 13 bp, Homo sapiens
atgccaccctcac

SEQ ID NO: 427679 - DNA, 17 bp, Homo sapiens
atgccacgggaagttta

SEQ ID NO: 427680 - DNA, 13 bp, Homo sapiens
atgccactgccag

SEQ ID NO: 427681 - DNA, 16 bp, Homo sapiens
atgccactgccaggca

SEQ ID NO: 427682 - DNA, 17 bp, Homo sapiens
atgccactgccaggcac

SEQ ID NO: 427683 - DNA, 10 bp, Homo sapiens
atgccagccc

SEQ ID NO: 427684 - DNA, 12 bp, Homo sapiens
atgccagcccaa

SEQ ID NO: 427685 - DNA, 18 bp, Homo sapiens
atgccataagcaggagtt

SEQ ID NO: 427686 - DNA, 14 bp, Homo sapiens
atgccatatttttg

SEQ ID NO: 427687 - DNA, 17 bp, Homo sapiens
atgccatgatatcactt

SEQ ID NO: 427688 - DNA, 23 bp, Homo sapiens
atgccatttgcacttacacaaga

SEQ ID NO: 427689 - DNA, 14 bp, Homo sapiens
atgcccacccctgc

SEQ ID NO: 427690 - DNA, 21 bp, Homo sapiens
atgcccacctgcccatcacag

SEQ ID NO: 427691 - DNA, 13 bp, Homo sapiens
atgcccaggtacc

SEQ ID NO: 427692 - DNA, 18 bp, Homo sapiens
atgccccacccacccctc

SEQ ID NO: 427693 - DNA, 19 bp, Homo sapiens
atgccccacccacccctcc

SEQ ID NO: 427694 - DNA, 20 bp, Homo sapiens
atgccctaagagtgtcactg

SEQ ID NO: 427695 - DNA, 19 bp, Homo sapiens
atgccctataacccctgcc

SEQ ID NO: 427696 - DNA, 20 bp, Homo sapiens
atgccctataacccctgcct

SEQ ID NO: 427697 - DNA, 19 bp, Homo sapiens
atgccctccaatcctttcc

SEQ ID NO: 427698 - DNA, 19 bp, Homo sapiens
atgccctgccaagcctgga

SEQ ID NO: 427699 - DNA, 21 bp, Homo sapiens
atgccctgccaagcctggagc

SEQ ID NO: 427700 - DNA, 15 bp, Homo sapiens
atgcccttaaatcat

SEQ ID NO: 427701 - DNA, 22 bp, Homo sapiens
atgccgctgcatccgtgagcag

SEQ ID NO: 427702 - DNA, 22 bp, Homo sapiens
atgccgtggattgcacgtggcc

SEQ ID NO: 427703 - DNA, 15 bp, Homo sapiens
atgcctacagataat

SEQ ID NO: 427704 - DNA, 23 bp, Homo sapiens
atgcctaccgggttctcctgatt

SEQ ID NO: 427705 - DNA, 23 bp, Homo sapiens
atgcctagacttcccaacagcct

SEQ ID NO: 427706 - DNA, 19 bp, Homo sapiens
atgcctagcacaagtacca

SEQ ID NO: 427707 - DNA, 18 bp, Homo sapiens
atgcctgacacaggggac

SEQ ID NO: 427708 - DNA, 12 bp, Homo sapiens
atgcctgacccc

SEQ ID NO: 427709 - DNA, 18 bp, Homo sapiens
atgcctgactaattttgt

SEQ ID NO: 427710 - DNA, 23 bp, Homo sapiens
atgcctgactaattttgtatttt

SEQ ID NO: 427711 - DNA, 19 bp, Homo sapiens
atgcctgactaatttttgt

SEQ ID NO: 427712 - DNA, 20 bp, Homo sapiens
atgcctgactaatttttgta

SEQ ID NO: 427713 - DNA, 19 bp, Homo sapiens
atgcctgccccaaacaaat

SEQ ID NO: 427714 - DNA, 15 bp, Homo sapiens
atgcctgcctgaaca

SEQ ID NO: 427715 - DNA, 13 bp, Homo sapiens
atgcctggccccc

SEQ ID NO: 427716 - DNA, 18 bp, Homo sapiens
atgcctggcccccctcca

SEQ ID NO: 427717 - DNA, 22 bp, Homo sapiens
atgcctggcccccctccaggca

SEQ ID NO: 427718 - DNA, 15 bp, Homo sapiens
atgcctgtatttcca

SEQ ID NO: 427719 - DNA, 21 bp, Homo sapiens
atgcctgtcagtttcatggag

SEQ ID NO: 427720 - DNA, 18 bp, Homo sapiens
atgcctgtccagcctggg

SEQ ID NO: 427721 - DNA, 22 bp, Homo sapiens
atgcctgtctctgttcagatgt

SEQ ID NO: 427722 - DNA, 23 bp, Homo sapiens
atgcctgtctctgttcagatgtg

SEQ ID NO: 427723 - DNA, 13 bp, Homo sapiens
atgcctgtgccaa

SEQ ID NO: 427724 - DNA, 23 bp, Homo sapiens
atgcctgtggtgaagtgtggctg

SEQ ID NO: 427725 - DNA, 17 bp, Homo sapiens
atgccttctagattcac

SEQ ID NO: 427726 - DNA, 22 bp, Homo sapiens
atgcctttctagcaattgcttc

SEQ ID NO: 427727 - DNA, 21 bp, Homo sapiens
atgcctttctagtcctattct

SEQ ID NO: 427728 - DNA, 13 bp, Homo sapiens
atgcctttgtaag

SEQ ID NO: 427729 - DNA, 17 bp, Homo sapiens
atgcctttttggttttg

SEQ ID NO: 427730 - DNA, 16 bp, Homo sapiens
atgcgaatgagctggg

SEQ ID NO: 427731 - DNA, 13 bp, Homo sapiens
atgcgccttgctg

SEQ ID NO: 427732 - DNA, 21 bp, Homo sapiens
atgcgccttgctgatggcttg

SEQ ID NO: 427733 - DNA, 16 bp, Homo sapiens
atgcgctcttcaccag

SEQ ID NO: 427734 - DNA, 18 bp, Homo sapiens
atgcgctcttcaccagga

SEQ ID NO: 427735 - DNA, 17 bp, Homo sapiens
atgcgctttattgccca

SEQ ID NO: 427736 - DNA, 18 bp, Homo sapiens
atgcggcaagaaggaatt

SEQ ID NO: 427737 - DNA, 22 bp, Homo sapiens
atgcggcccagccatgggccct

SEQ ID NO: 427738 - DNA, 23 bp, Homo sapiens
atgcggcccagccatgggccctc

SEQ ID NO: 427739 - DNA, 18 bp, Homo sapiens
atgcgggctgggcagctg

SEQ ID NO: 427740 - DNA, 19 bp, Homo sapiens
atgcggtttccaaggtgca

SEQ ID NO: 427741 - DNA, 20 bp, Homo sapiens
atgcggtttccaaggtgcac

SEQ ID NO: 427742 - DNA, 21 bp, Homo sapiens
atgcggtttccaaggtgcaca

SEQ ID NO: 427743 - DNA, 15 bp, Homo sapiens
atgctaataaactgt

SEQ ID NO: 427744 - DNA, 15 bp, Homo sapiens
atgctaatgtaatca

SEQ ID NO: 427745 - DNA, 21 bp, Homo sapiens
atgctacctctgatcaaagca

SEQ ID NO: 427746 - DNA, 18 bp, Homo sapiens
atgctaggttaattccaa

SEQ ID NO: 427747 - DNA, 18 bp, Homo sapiens
atgctatggactgcacaa

SEQ ID NO: 427748 - DNA, 16 bp, Homo sapiens
atgctcaatgtgctgt

SEQ ID NO: 427749 - DNA, 17 bp, Homo sapiens
atgctcaatgtgctgtt

SEQ ID NO: 427750 - DNA, 20 bp, Homo sapiens
atgctcaatgtgctgttgat

SEQ ID NO: 427751 - DNA, 12 bp, Homo sapiens
atgctcacctct

SEQ ID NO: 427752 - DNA, 13 bp, Homo sapiens
atgctcacctcta

SEQ ID NO: 427753 - DNA, 14 bp, Homo sapiens
atgctcacctctag

SEQ ID NO: 427754 - DNA, 16 bp, Homo sapiens
atgctcactgcttctg

SEQ ID NO: 427755 - DNA, 18 bp, Homo sapiens
atgctcagtattgagaca

SEQ ID NO: 427756 - DNA, 12 bp, Homo sapiens
atgctccagcca

SEQ ID NO: 427757 - DNA, 17 bp, Homo sapiens
atgctccagccaacccc

SEQ ID NO: 427758 - DNA, 15 bp, Homo sapiens
atgctcccccatcct

SEQ ID NO: 427759 - DNA, 16 bp, Homo sapiens
atgctccctcccctgc

SEQ ID NO: 427760 - DNA, 18 bp, Homo sapiens
atgctccctcccctgccc

SEQ ID NO: 427761 - DNA, 20 bp, Homo sapiens
atgctccctcccctgccctg

SEQ ID NO: 427762 - DNA, 22 bp, Homo sapiens
atgctccctcccctgccctggt

SEQ ID NO: 427763 - DNA, 16 bp, Homo sapiens
atgctcctcactgccc

SEQ ID NO: 427764 - DNA, 18 bp, Homo sapiens
atgctccttgttcctaga

SEQ ID NO: 427765 - DNA, 13 bp, Homo sapiens
atgctctaacaaa

SEQ ID NO: 427766 - DNA, 19 bp, Homo sapiens
atgctctccaaaccacttt

SEQ ID NO: 427767 - DNA, 12 bp, Homo sapiens
atgctctgcccc

SEQ ID NO: 427768 - DNA, 14 bp, Homo sapiens
atgctctgtgccag

SEQ ID NO: 427769 - DNA, 15 bp, Homo sapiens
atgctgaaacaggag

SEQ ID NO: 427770 - DNA, 15 bp, Homo sapiens
atgctgaaataaact

SEQ ID NO: 427771 - DNA, 17 bp, Homo sapiens
atgctgaaataaactag

SEQ ID NO: 427772 - DNA, 17 bp, Homo sapiens
atgctgaagtacagtcc

SEQ ID NO: 427773 - DNA, 21 bp, Homo sapiens
atgctgaagtacagtcccagc

SEQ ID NO: 427774 - DNA, 22 bp, Homo sapiens
atgctgaagtacagtcccagca

SEQ ID NO: 427775 - DNA, 19 bp, Homo sapiens
atgctgaatatctgttcac

SEQ ID NO: 427776 - DNA, 14 bp, Homo sapiens
atgctgagattctt

SEQ ID NO: 427777 - DNA, 14 bp, Homo sapiens
atgctgagtcatgc

SEQ ID NO: 427778 - DNA, 15 bp, Homo sapiens
atgctgatgatcaaa

SEQ ID NO: 427779 - DNA, 21 bp, Homo sapiens
atgctgcacaccagttactgt

SEQ ID NO: 427780 - DNA, 22 bp, Homo sapiens
atgctgcccagggtcagtgtat

SEQ ID NO: 427781 - DNA, 21 bp, Homo sapiens
atgctgccccgttccctgtca

SEQ ID NO: 427782 - DNA, 22 bp, Homo sapiens
atgctgccccgttccctgtcag

SEQ ID NO: 427783 - DNA, 14 bp, Homo sapiens
atgctgcctgcctc

SEQ ID NO: 427784 - DNA, 15 bp, Homo sapiens
atgctgcctgcctgt

SEQ ID NO: 427785 - DNA, 17 bp, Homo sapiens
atgctgcctgcctgtct

SEQ ID NO: 427786 - DNA, 23 bp, Homo sapiens
atgctgccttcccatgaatctgt

SEQ ID NO: 427787 - DNA, 16 bp, Homo sapiens
atgctgcgcccttccc

SEQ ID NO: 427788 - DNA, 19 bp, Homo sapiens
atgctgctggaggaatcag

SEQ ID NO: 427789 - DNA, 15 bp, Homo sapiens
atgctgctgtgaatt

SEQ ID NO: 427790 - DNA, 16 bp, Homo sapiens
atgctgctgtgaattt

SEQ ID NO: 427791 - DNA, 12 bp, Homo sapiens
atgctgctttaa

SEQ ID NO: 427792 - DNA, 21 bp, Homo sapiens
atgctgctttaattgtgaatt

SEQ ID NO: 427793 - DNA, 18 bp, Homo sapiens
atgctggacaggtctggg

SEQ ID NO: 427794 - DNA, 13 bp, Homo sapiens
atgctggagaggt

SEQ ID NO: 427795 - DNA, 14 bp, Homo sapiens
atgctggagcggct

SEQ ID NO: 427796 - DNA, 23 bp, Homo sapiens
atgctggcatttgcacctacctc

SEQ ID NO: 427797 - DNA, 14 bp, Homo sapiens
atgctggccagcct

SEQ ID NO: 427798 - DNA, 15 bp, Homo sapiens
atgctggccagcctg

SEQ ID NO: 427799 - DNA, 17 bp, Homo sapiens
atgctggccagcctggg

SEQ ID NO: 427800 - DNA, 22 bp, Homo sapiens
atgctggccagcctggggcctg

SEQ ID NO: 427801 - DNA, 18 bp, Homo sapiens
atgctggctcccagggcc

SEQ ID NO: 427802 - DNA, 19 bp, Homo sapiens
atgctggctcccagggcca

SEQ ID NO: 427803 - DNA, 14 bp, Homo sapiens
atgctgggaccctc

SEQ ID NO: 427804 - DNA, 16 bp, Homo sapiens
atgctggggtacacag

SEQ ID NO: 427805 - DNA, 20 bp, Homo sapiens
atgctggggtacacagtgag

SEQ ID NO: 427806 - DNA, 21 bp, Homo sapiens
atgctggggtacacagtgaga

SEQ ID NO: 427807 - DNA, 23 bp, Homo sapiens
atgctggtcaagccccctttgat

SEQ ID NO: 427808 - DNA, 23 bp, Homo sapiens
atgctgtcccttacgtgagtcct

SEQ ID NO: 427809 - DNA, 17 bp, Homo sapiens
atgctgtgcaaacagtg

SEQ ID NO: 427810 - DNA, 19 bp, Homo sapiens
atgctgtgcaaacagtgta

SEQ ID NO: 427811 - DNA, 14 bp, Homo sapiens
atgctgttcattga

SEQ ID NO: 427812 - DNA, 22 bp, Homo sapiens
atgctgttggcctcaagcaagg

SEQ ID NO: 427813 - DNA, 17 bp, Homo sapiens
atgctgttggtgagaat

SEQ ID NO: 427814 - DNA, 15 bp, Homo sapiens
atgctgttgtaaaca

SEQ ID NO: 427815 - DNA, 22 bp, Homo sapiens
atgctgttgtaaacaacgtgta

SEQ ID NO: 427816 - DNA, 19 bp, Homo sapiens
atgcttaatttctaaagat

SEQ ID NO: 427817 - DNA, 17 bp, Homo sapiens
atgcttcagttgtactt

SEQ ID NO: 427818 - DNA, 16 bp, Homo sapiens
atgcttcctgacaatc

SEQ ID NO: 427819 - DNA, 22 bp, Homo sapiens
atgcttcctgacaatcaactct

SEQ ID NO: 427820 - DNA, 13 bp, Homo sapiens
atgcttctgctca

SEQ ID NO: 427821 - DNA, 21 bp, Homo sapiens
atgcttctgctcacattccct

SEQ ID NO: 427822 - DNA, 22 bp, Homo sapiens
atgcttctgctcacattccctc

SEQ ID NO: 427823 - DNA, 18 bp, Homo sapiens
atgcttgatggtttatgt

SEQ ID NO: 427824 - DNA, 20 bp, Homo sapiens
atgcttgcctagggcctggt

SEQ ID NO: 427825 - DNA, 21 bp, Homo sapiens
atgcttgcctagggcctggtc

SEQ ID NO: 427826 - DNA, 20 bp, Homo sapiens
atgcttgtaacaagaaaaca

SEQ ID NO: 427827 - DNA, 14 bp, Homo sapiens
atgctttctccttt

SEQ ID NO: 427828 - DNA, 16 bp, Homo sapiens
atgctttgatcccttc

SEQ ID NO: 427829 - DNA, 17 bp, Homo sapiens
atgctttgattgttcat

SEQ ID NO: 427830 - DNA, 15 bp, Homo sapiens
atgctttgggaggcc

SEQ ID NO: 427831 - DNA, 23 bp, Homo sapiens
atgctttgttttcccacacatat

SEQ ID NO: 427832 - DNA, 18 bp, Homo sapiens
atgcttttctcatggtat

SEQ ID NO: 427833 - DNA, 22 bp, Homo sapiens
atgctttttgaatgttatttgt

SEQ ID NO: 427834 - DNA, 21 bp, Homo sapiens
atggaaaaaaaaaacaaaaaa

SEQ ID NO: 427835 - DNA, 17 bp, Homo sapiens
atggaaaacttagtttg

SEQ ID NO: 427836 - DNA, 20 bp, Homo sapiens
atggaaaaggaagactagag

SEQ ID NO: 427837 - DNA, 19 bp, Homo sapiens
atggaaaatgtcctgtggt

SEQ ID NO: 427838 - DNA, 16 bp, Homo sapiens
atggaaagggtgtggc

SEQ ID NO: 427839 - DNA, 18 bp, Homo sapiens
atggaaaggtcctgctgt

SEQ ID NO: 427840 - DNA, 13 bp, Homo sapiens
atggaacacacac

SEQ ID NO: 427841 - DNA, 18 bp, Homo sapiens
atggaacatatgcacagg

SEQ ID NO: 427842 - DNA, 21 bp, Homo sapiens
atggaacctgacgtagctgca

SEQ ID NO: 427843 - DNA, 16 bp, Homo sapiens
atggaactcgcccccc

SEQ ID NO: 427844 - DNA, 15 bp, Homo sapiens
atggaagaagtatat

SEQ ID NO: 427845 - DNA, 17 bp, Homo sapiens
atggaagaagtatattt

SEQ ID NO: 427846 - DNA, 19 bp, Homo sapiens
atggaagacaaaatgtttt

SEQ ID NO: 427847 - DNA, 14 bp, Homo sapiens
atggaaggagagag

SEQ ID NO: 427848 - DNA, 16 bp, Homo sapiens
atggaagggtttgtgg

SEQ ID NO: 427849 - DNA, 17 bp, Homo sapiens
atggaagtggcagtgaa

SEQ ID NO: 427850 - DNA, 18 bp, Homo sapiens
atggaagtgtattggttt

SEQ ID NO: 427851 - DNA, 17 bp, Homo sapiens
atggaatgctgtgttaa

SEQ ID NO: 427852 - DNA, 14 bp, Homo sapiens
atggaatgtgcccc

SEQ ID NO: 427853 - DNA, 19 bp, Homo sapiens
atggaatgtgcccctggcc

SEQ ID NO: 427854 - DNA, 21 bp, Homo sapiens
atggaatgtgcccctggccca

SEQ ID NO: 427855 - DNA, 19 bp, Homo sapiens
atggaattatgtataacaa

SEQ ID NO: 427856 - DNA, 14 bp, Homo sapiens
atggaattattttg

SEQ ID NO: 427857 - DNA, 20 bp, Homo sapiens
atggaattattttgaatgtc

SEQ ID NO: 427858 - DNA, 17 bp, Homo sapiens
atggaattgcttaccaa

SEQ ID NO: 427859 - DNA, 15 bp, Homo sapiens
atggaatttgtaagt

SEQ ID NO: 427860 - DNA, 22 bp, Homo sapiens
atggacacgctgcgcaaggcct

SEQ ID NO: 427861 - DNA, 15 bp, Homo sapiens
atggacagggccagg

SEQ ID NO: 427862 - DNA, 17 bp, Homo sapiens
atggacagggccagggt

SEQ ID NO: 427863 - DNA, 19 bp, Homo sapiens
atggacagttcacaccctg

SEQ ID NO: 427864 - DNA, 21 bp, Homo sapiens
atggacagttcacaccctgca

SEQ ID NO: 427865 - DNA, 18 bp, Homo sapiens
atggacatcgatatgaaa

SEQ ID NO: 427866 - DNA, 20 bp, Homo sapiens
atggacatcgatatgaaaaa

SEQ ID NO: 427867 - DNA, 13 bp, Homo sapiens
atggacccctccc

SEQ ID NO: 427868 - DNA, 18 bp, Homo sapiens
atggaccgggtgggcctg

SEQ ID NO: 427869 - DNA, 21 bp, Homo sapiens
atggaccgggtgggcctggcc

SEQ ID NO: 427870 - DNA, 16 bp, Homo sapiens
atggacgcctggctcc

SEQ ID NO: 427871 - DNA, 21 bp, Homo sapiens
atggacgcctggctccaggct

SEQ ID NO: 427872 - DNA, 23 bp, Homo sapiens
atggacgtgttatgactccagaa

SEQ ID NO: 427873 - DNA, 14 bp, Homo sapiens
atggactctacact

SEQ ID NO: 427874 - DNA, 16 bp, Homo sapiens
atggactggcttggcc

SEQ ID NO: 427875 - DNA, 20 bp, Homo sapiens
atggagaaggaaaaggctgg

SEQ ID NO: 427876 - DNA, 21 bp, Homo sapiens
atggagaaggaaaaggctggc

SEQ ID NO: 427877 - DNA, 23 bp, Homo sapiens
atggagacttcaggttgttctgt

SEQ ID NO: 427878 - DNA, 18 bp, Homo sapiens
atggagagaaaacagacc

SEQ ID NO: 427879 - DNA, 12 bp, Homo sapiens
atggagaggaga

SEQ ID NO: 427880 - DNA, 20 bp, Homo sapiens
atggagcaaaacaaagctga

SEQ ID NO: 427881 - DNA, 21 bp, Homo sapiens
atggagcaaaacaaagctgat

SEQ ID NO: 427882 - DNA, 16 bp, Homo sapiens
atggagcaagtgagca

SEQ ID NO: 427883 - DNA, 20 bp, Homo sapiens
atggagcccagccccgccct

SEQ ID NO: 427884 - DNA, 21 bp, Homo sapiens
atggagcccataggccacccc

SEQ ID NO: 427885 - DNA, 22 bp, Homo sapiens
atggagcccccagatagagctg

SEQ ID NO: 427886 - DNA, 23 bp, Homo sapiens
atggagcccccagatagagctgg

SEQ ID NO: 427887 - DNA, 24 bp, Homo sapiens
atggagcccccagatagagctggg

SEQ ID NO: 427888 - DNA, 12 bp, Homo sapiens
atggagcctctg

SEQ ID NO: 427889 - DNA, 20 bp, Homo sapiens
atggagcctctgcagactcg

SEQ ID NO: 427890 - DNA, 17 bp, Homo sapiens
atggagcttgtacatat

SEQ ID NO: 427891 - DNA, 13 bp, Homo sapiens
atggaggaatatg

SEQ ID NO: 427892 - DNA, 15 bp, Homo sapiens
atggaggaggaggca

SEQ ID NO: 427893 - DNA, 16 bp, Homo sapiens
atggaggaggaggcaa

SEQ ID NO: 427894 - DNA, 17 bp, Homo sapiens
atggaggccaagcctgc

SEQ ID NO: 427895 - DNA, 16 bp, Homo sapiens
atggagggaataatac

SEQ ID NO: 427896 - DNA, 17 bp, Homo sapiens
atggaggttctcagagc

SEQ ID NO: 427897 - DNA, 22 bp, Homo sapiens
atggaggttctcagagccaagt

SEQ ID NO: 427898 - DNA, 17 bp, Homo sapiens
atggagtagacccctgg

SEQ ID NO: 427899 - DNA, 21 bp, Homo sapiens
atggagtagacccctggctgg

SEQ ID NO: 427900 - DNA, 20 bp, Homo sapiens
atggagtccagacctgggcc

SEQ ID NO: 427901 - DNA, 21 bp, Homo sapiens
atggagtccagacctgggccc

SEQ ID NO: 427902 - DNA, 13 bp, Homo sapiens
atggagtgtttga

SEQ ID NO: 427903 - DNA, 18 bp, Homo sapiens
atggataacctatatgat

SEQ ID NO: 427904 - DNA, 22 bp, Homo sapiens
atggatatgtgtaaatgttatg

SEQ ID NO: 427905 - DNA, 23 bp, Homo sapiens
atggatatgtgtaaatgttatga

SEQ ID NO: 427906 - DNA, 22 bp, Homo sapiens
atggatatttttaatttatgat

SEQ ID NO: 427907 - DNA, 14 bp, Homo sapiens
atggatctgctcca

SEQ ID NO: 427908 - DNA, 12 bp, Homo sapiens
atggatgctcat

SEQ ID NO: 427909 - DNA, 13 bp, Homo sapiens
atggatggggaga

SEQ ID NO: 427910 - DNA, 15 bp, Homo sapiens
atggatggggcccag

SEQ ID NO: 427911 - DNA, 20 bp, Homo sapiens
atggatggggcccaggggct

SEQ ID NO: 427912 - DNA, 15 bp, Homo sapiens
atggatgtaatatag

SEQ ID NO: 427913 - DNA, 16 bp, Homo sapiens
atggattcacttctat

SEQ ID NO: 427914 - DNA, 18 bp, Homo sapiens
atggattcattacagctt

SEQ ID NO: 427915 - DNA, 18 bp, Homo sapiens
atggattcccctggacat

SEQ ID NO: 427916 - DNA, 22 bp, Homo sapiens
atggattctcagatatttatat

SEQ ID NO: 427917 - DNA, 23 bp, Homo sapiens
atggattgggtatcaaaatgaat

SEQ ID NO: 427918 - DNA, 23 bp, Homo sapiens
atggatttcgtttttcttggggt

SEQ ID NO: 427919 - DNA, 14 bp, Homo sapiens
atggatttgacaca

SEQ ID NO: 427920 - DNA, 18 bp, Homo sapiens
atggatttgacacactca

SEQ ID NO: 427921 - DNA, 20 bp, Homo sapiens
atggattttctattgttact

SEQ ID NO: 427922 - DNA, 21 bp, Homo sapiens
atggattttggataaatcatt

SEQ ID NO: 427923 - DNA, 23 bp, Homo sapiens
atggcaagaaagctggtaaacta

SEQ ID NO: 427924 - DNA, 19 bp, Homo sapiens
atggcaaggactgcaggga

SEQ ID NO: 427925 - DNA, 14 bp, Homo sapiens
atggcaataggaca

SEQ ID NO: 427926 - DNA, 14 bp, Homo sapiens
atggcacctgtggc

SEQ ID NO: 427927 - DNA, 17 bp, Homo sapiens
atggcaccttcagactt

SEQ ID NO: 427928 - DNA, 13 bp, Homo sapiens
atggcagaaggga

SEQ ID NO: 427929 - DNA, 16 bp, Homo sapiens
atggcagaagggaatt

SEQ ID NO: 427930 - DNA, 19 bp, Homo sapiens
atggcagcaggcctgttgc

SEQ ID NO: 427931 - DNA, 21 bp, Homo sapiens
atggcagcctcagggcttcct

SEQ ID NO: 427932 - DNA, 22 bp, Homo sapiens
atggcagcctcagggcttcctt

SEQ ID NO: 427933 - DNA, 12 bp, Homo sapiens
atggcaggaagg

SEQ ID NO: 427934 - DNA, 13 bp, Homo sapiens
atggcaggaaggc

SEQ ID NO: 427935 - DNA, 15 bp, Homo sapiens
atggcagtgggagac

SEQ ID NO: 427936 - DNA, 16 bp, Homo sapiens
atggcatgacaaggtg

SEQ ID NO: 427937 - DNA, 19 bp, Homo sapiens
atggcatgtgaaaagtaaa

SEQ ID NO: 427938 - DNA, 18 bp, Homo sapiens
atggccacagccacctcc

SEQ ID NO: 427939 - DNA, 18 bp, Homo sapiens
atggccaccccgtgccac

SEQ ID NO: 427940 - DNA, 22 bp, Homo sapiens
atggccaccccgtgccacccgt

SEQ ID NO: 427941 - DNA, 16 bp, Homo sapiens
atggccaggtggccac

SEQ ID NO: 427942 - DNA, 12 bp, Homo sapiens
atggccatggaa

SEQ ID NO: 427943 - DNA, 21 bp, Homo sapiens
atggcccagcagcttggctga

SEQ ID NO: 427944 - DNA, 14 bp, Homo sapiens
atggcccagcctgg

SEQ ID NO: 427945 - DNA, 17 bp, Homo sapiens
atggcccagcctggagc

SEQ ID NO: 427946 - DNA, 13 bp, Homo sapiens
atggccccagctg

SEQ ID NO: 427947 - DNA, 15 bp, Homo sapiens
atggccccagctggc

SEQ ID NO: 427948 - DNA, 14 bp, Homo sapiens
atggcccctccagg

SEQ ID NO: 427949 - DNA, 16 bp, Homo sapiens
atggcccctccaggaa

SEQ ID NO: 427950 - DNA, 21 bp, Homo sapiens
atggccctgtagccagcacct

SEQ ID NO: 427951 - DNA, 17 bp, Homo sapiens
atggccgggctgctgct

SEQ ID NO: 427952 - DNA, 17 bp, Homo sapiens
atggcctcagctgcctc

SEQ ID NO: 427953 - DNA, 18 bp, Homo sapiens
atggcctcagctgcctca

SEQ ID NO: 427954 - DNA, 15 bp, Homo sapiens
atggcctcccagcca

SEQ ID NO: 427955 - DNA, 17 bp, Homo sapiens
atggcctctaagagtgc

SEQ ID NO: 427956 - DNA, 18 bp, Homo sapiens
atggccttccctccccac

SEQ ID NO: 427957 - DNA, 19 bp, Homo sapiens
atggcgcagtgcctctggt

SEQ ID NO: 427958 - DNA, 17 bp, Homo sapiens
atggcggaggccatggg

SEQ ID NO: 427959 - DNA, 18 bp, Homo sapiens
atggcgtgtcccctgcct

SEQ ID NO: 427960 - DNA, 15 bp, Homo sapiens
atggctaaggcacca

SEQ ID NO: 427961 - DNA, 18 bp, Homo sapiens
atggctaaggcaccagcc

SEQ ID NO: 427962 - DNA, 16 bp, Homo sapiens
atggctagtactgtat

SEQ ID NO: 427963 - DNA, 21 bp, Homo sapiens
atggctagtactgtattggct

SEQ ID NO: 427964 - DNA, 16 bp, Homo sapiens
atggctataaatatat

SEQ ID NO: 427965 - DNA, 14 bp, Homo sapiens
atggctatatggca

SEQ ID NO: 427966 - DNA, 21 bp, Homo sapiens
atggctatcatcaaaagtgta

SEQ ID NO: 427967 - DNA, 15 bp, Homo sapiens
atggctattataatg

SEQ ID NO: 427968 - DNA, 16 bp, Homo sapiens
atggctcactgcagcc

SEQ ID NO: 427969 - DNA, 19 bp, Homo sapiens
atggctcactgcagcctcg

SEQ ID NO: 427970 - DNA, 20 bp, Homo sapiens
atggctcactgcagcctcga

SEQ ID NO: 427971 - DNA, 20 bp, Homo sapiens
atggctcaggcaagcccctc

SEQ ID NO: 427972 - DNA, 17 bp, Homo sapiens
atggctcctgtctggct

SEQ ID NO: 427973 - DNA, 17 bp, Homo sapiens
atggctcgtgggctctg

SEQ ID NO: 427974 - DNA, 23 bp, Homo sapiens
atggctctaacattactgccttc

SEQ ID NO: 427975 - DNA, 21 bp, Homo sapiens
atggctgaaggaaaccagtgc

SEQ ID NO: 427976 - DNA, 19 bp, Homo sapiens
atggctggaacactgtact

SEQ ID NO: 427977 - DNA, 20 bp, Homo sapiens
atggctggaacactgtactg

SEQ ID NO: 427978 - DNA, 20 bp, Homo sapiens
atggctgggagggggccctt

SEQ ID NO: 427979 - DNA, 16 bp, Homo sapiens
atggctgggtttgggc

SEQ ID NO: 427980 - DNA, 18 bp, Homo sapiens
atggctgtgaaaattaca

SEQ ID NO: 427981 - DNA, 20 bp, Homo sapiens
atggctgtgaaaattacacc

SEQ ID NO: 427982 - DNA, 14 bp, Homo sapiens
atggcttaatgttt

SEQ ID NO: 427983 - DNA, 16 bp, Homo sapiens
atggcttaatgtttat

SEQ ID NO: 427984 - DNA, 21 bp, Homo sapiens
atggcttaatgtttattcctg

SEQ ID NO: 427985 - DNA, 16 bp, Homo sapiens
atggcttattgtgtga

SEQ ID NO: 427986 - DNA, 20 bp, Homo sapiens
atggcttccgtgagacacaa

SEQ ID NO: 427987 - DNA, 16 bp, Homo sapiens
atggcttgacatgtgc

SEQ ID NO: 427988 - DNA, 18 bp, Homo sapiens
atggctttcatcctgtgt

SEQ ID NO: 427989 - DNA, 14 bp, Homo sapiens
atgggaaactgttg

SEQ ID NO: 427990 - DNA, 15 bp, Homo sapiens
atgggaaatgtcgat

SEQ ID NO: 427991 - DNA, 23 bp, Homo sapiens
atgggaaatgtcgattttcaata

SEQ ID NO: 427992 - DNA, 15 bp, Homo sapiens
atgggaacaagtgta

SEQ ID NO: 427993 - DNA, 23 bp, Homo sapiens
atgggaacctagtactctctgct

SEQ ID NO: 427994 - DNA, 13 bp, Homo sapiens
atgggaacgcagc

SEQ ID NO: 427995 - DNA, 15 bp, Homo sapiens
atgggaatgaatgtc

SEQ ID NO: 427996 - DNA, 14 bp, Homo sapiens
atgggaattgtgtg

SEQ ID NO: 427997 - DNA, 18 bp, Homo sapiens
atgggactgatgtcatct

SEQ ID NO: 427998 - DNA, 14 bp, Homo sapiens
atgggactgggagg

SEQ ID NO: 427999 - DNA, 15 bp, Homo sapiens
atgggactgggaggg

SEQ ID NO: 428000 - DNA, 23 bp, Homo sapiens
atgggagagtagatggtgaaatt

SEQ ID NO: 428001 - DNA, 19 bp, Homo sapiens
atgggagtcagggagccct

SEQ ID NO: 428002 - DNA, 17 bp, Homo sapiens
atgggagtgaacatttc

SEQ ID NO: 428003 - DNA, 16 bp, Homo sapiens
atgggagtgagacaga

SEQ ID NO: 428004 - DNA, 16 bp, Homo sapiens
atgggagtgggcacct

SEQ ID NO: 428005 - DNA, 20 bp, Homo sapiens
atgggcagctggggggctgt

SEQ ID NO: 428006 - DNA, 18 bp, Homo sapiens
atgggcattgggctgaca

SEQ ID NO: 428007 - DNA, 19 bp, Homo sapiens
atgggcattgggctgacac

SEQ ID NO: 428008 - DNA, 14 bp, Homo sapiens
atgggccaagccag

SEQ ID NO: 428009 - DNA, 12 bp, Homo sapiens
atgggccaccgg

SEQ ID NO: 428010 - DNA, 21 bp, Homo sapiens
atgggcctgcccaatgctttg

SEQ ID NO: 428011 - DNA, 15 bp, Homo sapiens
atgggcctgggcctg

SEQ ID NO: 428012 - DNA, 22 bp, Homo sapiens
atgggcggaagtacttccctca

SEQ ID NO: 428013 - DNA, 23 bp, Homo sapiens
atgggcggaagtacttccctcag

SEQ ID NO: 428014 - DNA, 18 bp, Homo sapiens
atgggcttgttttcttgc

SEQ ID NO: 428015 - DNA, 12 bp, Homo sapiens
atgggctttctc

SEQ ID NO: 428016 - DNA, 22 bp, Homo sapiens
atgggctttctctttggtttct

SEQ ID NO: 428017 - DNA, 16 bp, Homo sapiens
atggggagcagctggg

SEQ ID NO: 428018 - DNA, 13 bp, Homo sapiens
atgggggaggctc

SEQ ID NO: 428019 - DNA, 22 bp, Homo sapiens
atggggggccaacaccagggat

SEQ ID NO: 428020 - DNA, 17 bp, Homo sapiens
atgggggtgcaggcagc

SEQ ID NO: 428021 - DNA, 21 bp, Homo sapiens
atgggggtgcaggcagccttg

SEQ ID NO: 428022 - DNA, 22 bp, Homo sapiens
atgggggtgcaggcagccttga

SEQ ID NO: 428023 - DNA, 18 bp, Homo sapiens
atggggtgggcctctggt

SEQ ID NO: 428024 - DNA, 19 bp, Homo sapiens
atggggtggggtagggctg

SEQ ID NO: 428025 - DNA, 18 bp, Homo sapiens
atggggttgggctctgcg

SEQ ID NO: 428026 - DNA, 14 bp, Homo sapiens
atgggtagcttctg

SEQ ID NO: 428027 - DNA, 22 bp, Homo sapiens
atgggtcccgggttagcctggt

SEQ ID NO: 428028 - DNA, 14 bp, Homo sapiens
atgggtcctgctgc

SEQ ID NO: 428029 - DNA, 21 bp, Homo sapiens
atggtaatataacaatatatg

SEQ ID NO: 428030 - DNA, 17 bp, Homo sapiens
atggtaatctacagctc

SEQ ID NO: 428031 - DNA, 20 bp, Homo sapiens
atggtaccagccctggggct

SEQ ID NO: 428032 - DNA, 17 bp, Homo sapiens
atggtactaaggagaat

SEQ ID NO: 428033 - DNA, 18 bp, Homo sapiens
atggtagaaattttatct

SEQ ID NO: 428034 - DNA, 13 bp, Homo sapiens
atggtatatattt

SEQ ID NO: 428035 - DNA, 13 bp, Homo sapiens
atggtatctcttt

SEQ ID NO: 428036 - DNA, 15 bp, Homo sapiens
atggtatgcagcata

SEQ ID NO: 428037 - DNA, 19 bp, Homo sapiens
atggtatgcagcatacaaa

SEQ ID NO: 428038 - DNA, 22 bp, Homo sapiens
atggtatgcagcatacaaaaat

SEQ ID NO: 428039 - DNA, 19 bp, Homo sapiens
atggtattttcgtgcattt

SEQ ID NO: 428040 - DNA, 22 bp, Homo sapiens
atggtattttcgtgcatttgtg

SEQ ID NO: 428041 - DNA, 23 bp, Homo sapiens
atggtattttcgtgcatttgtga

SEQ ID NO: 428042 - DNA, 12 bp, Homo sapiens
atggtcagctcc

SEQ ID NO: 428043 - DNA, 18 bp, Homo sapiens
atggtcccaggaagcagg

SEQ ID NO: 428044 - DNA, 17 bp, Homo sapiens
atggtcccttcttccct

SEQ ID NO: 428045 - DNA, 18 bp, Homo sapiens
atggtcttgatctcctga

SEQ ID NO: 428046 - DNA, 17 bp, Homo sapiens
atggtgaaaatgtactg

SEQ ID NO: 428047 - DNA, 21 bp, Homo sapiens
atggtgaaaccccgtctctac

SEQ ID NO: 428048 - DNA, 14 bp, Homo sapiens
atggtgagctggga

SEQ ID NO: 428049 - DNA, 21 bp, Homo sapiens
atggtgatcctctattttgtg

SEQ ID NO: 428050 - DNA, 16 bp, Homo sapiens
atggtgatgcaagtca

SEQ ID NO: 428051 - DNA, 13 bp, Homo sapiens
atggtgatttctt

SEQ ID NO: 428052 - DNA, 16 bp, Homo sapiens
atggtgatttcttgct

SEQ ID NO: 428053 - DNA, 23 bp, Homo sapiens
atggtgatttcttgctaagctcc

SEQ ID NO: 428054 - DNA, 11 bp, Homo sapiens
atggtgcagtg

SEQ ID NO: 428055 - DNA, 16 bp, Homo sapiens
atggtgcagtgaagaa

SEQ ID NO: 428056 - DNA, 17 bp, Homo sapiens
atggtgcagtgaagaaa

SEQ ID NO: 428057 - DNA, 14 bp, Homo sapiens
atggtgcccttgga

SEQ ID NO: 428058 - DNA, 14 bp, Homo sapiens
atggtgcctctgga

SEQ ID NO: 428059 - DNA, 20 bp, Homo sapiens
atggtgctcacgactcttcc

SEQ ID NO: 428060 - DNA, 12 bp, Homo sapiens
atggtgctgaga

SEQ ID NO: 428061 - DNA, 23 bp, Homo sapiens
atggtggaagaggttctcagcaa

SEQ ID NO: 428062 - DNA, 17 bp, Homo sapiens
atggtggccctggggaa

SEQ ID NO: 428063 - DNA, 16 bp, Homo sapiens
atggtggcgcgcacct

SEQ ID NO: 428064 - DNA, 21 bp, Homo sapiens
atggtgggagagactgtgagg

SEQ ID NO: 428065 - DNA, 20 bp, Homo sapiens
atggtgtgccacaggctgca

SEQ ID NO: 428066 - DNA, 16 bp, Homo sapiens
atggtgtgtttcccta

SEQ ID NO: 428067 - DNA, 20 bp, Homo sapiens
atggttccatgcctgagggt

SEQ ID NO: 428068 - DNA, 19 bp, Homo sapiens
atggttcccaataaaagtg

SEQ ID NO: 428069 - DNA, 20 bp, Homo sapiens
atggttcccctgttcactct

SEQ ID NO: 428070 - DNA, 15 bp, Homo sapiens
atggttgccttaaag

SEQ ID NO: 428071 - DNA, 17 bp, Homo sapiens
atggtttactgctgtca

SEQ ID NO: 428072 - DNA, 20 bp, Homo sapiens
atggttttattctttgagaa

SEQ ID NO: 428073 - DNA, 14 bp, Homo sapiens
atggttttcttgtg

SEQ ID NO: 428074 - DNA, 18 bp, Homo sapiens
atgtaaaaaccctgctaa

SEQ ID NO: 428075 - DNA, 18 bp, Homo sapiens
atgtaaaaatgaaggaat

SEQ ID NO: 428076 - DNA, 12 bp, Homo sapiens
atgtaaaacaaa

SEQ ID NO: 428077 - DNA, 13 bp, Homo sapiens
atgtaaaacaaaa

SEQ ID NO: 428078 - DNA, 21 bp, Homo sapiens
atgtaaaatcttcagctggtg

SEQ ID NO: 428079 - DNA, 23 bp, Homo sapiens
atgtaaaatcttcagctggtgga

SEQ ID NO: 428080 - DNA, 13 bp, Homo sapiens
atgtaaaatcttg

SEQ ID NO: 428081 - DNA, 20 bp, Homo sapiens
atgtaaaatcttgtcatgtg

SEQ ID NO: 428082 - DNA, 12 bp, Homo sapiens
atgtaaaattca

SEQ ID NO: 428083 - DNA, 12 bp, Homo sapiens
atgtaaactctt

SEQ ID NO: 428084 - DNA, 17 bp, Homo sapiens
atgtaaactcttcacct

SEQ ID NO: 428085 - DNA, 18 bp, Homo sapiens
atgtaaagtatgtaaaca

SEQ ID NO: 428086 - DNA, 12 bp, Homo sapiens
atgtaaatagtg

SEQ ID NO: 428087 - DNA, 15 bp, Homo sapiens
atgtaaatgctcaaa

SEQ ID NO: 428088 - DNA, 19 bp, Homo sapiens
atgtaaattattgtaaact

SEQ ID NO: 428089 - DNA, 20 bp, Homo sapiens
atgtaagagcaccttcctca

SEQ ID NO: 428090 - DNA, 17 bp, Homo sapiens
atgtaagccaagtcatg

SEQ ID NO: 428091 - DNA, 19 bp, Homo sapiens
atgtaatatagggtttgtt

SEQ ID NO: 428092 - DNA, 16 bp, Homo sapiens
atgtaatcatttatct

SEQ ID NO: 428093 - DNA, 19 bp, Homo sapiens
atgtaatcatttatcttat

SEQ ID NO: 428094 - DNA, 18 bp, Homo sapiens
atgtaatgacagagagtt

SEQ ID NO: 428095 - DNA, 21 bp, Homo sapiens
atgtacaaaatcgattggctt

SEQ ID NO: 428096 - DNA, 23 bp, Homo sapiens
atgtacaaagatacttgatgcac

SEQ ID NO: 428097 - DNA, 19 bp, Homo sapiens
atgtacaaggtatgtacag

SEQ ID NO: 428098 - DNA, 20 bp, Homo sapiens
atgtacaagttttgtataaa

SEQ ID NO: 428099 - DNA, 18 bp, Homo sapiens
atgtacagtctcaatttt

SEQ ID NO: 428100 - DNA, 21 bp, Homo sapiens
atgtacagtctcaattttgta

SEQ ID NO: 428101 - DNA, 14 bp, Homo sapiens
atgtacagtctgtc

SEQ ID NO: 428102 - DNA, 15 bp, Homo sapiens
atgtacagtctgtca

SEQ ID NO: 428103 - DNA, 23 bp, Homo sapiens
atgtacagttcataaatttgttg

SEQ ID NO: 428104 - DNA, 14 bp, Homo sapiens
atgtacattaatta

SEQ ID NO: 428105 - DNA, 15 bp, Homo sapiens
atgtaccagtgtact

SEQ ID NO: 428106 - DNA, 18 bp, Homo sapiens
atgtaccatgaaacaaag

SEQ ID NO: 428107 - DNA, 11 bp, Homo sapiens
atgtacctttt

SEQ ID NO: 428108 - DNA, 16 bp, Homo sapiens
atgtactacatttgca

SEQ ID NO: 428109 - DNA, 17 bp, Homo sapiens
atgtactacatttgcat

SEQ ID NO: 428110 - DNA, 18 bp, Homo sapiens
atgtactatatgtatatc

SEQ ID NO: 428111 - DNA, 20 bp, Homo sapiens
atgtactcctctttacactg

SEQ ID NO: 428112 - DNA, 20 bp, Homo sapiens
atgtactggagagtggcaaa

SEQ ID NO: 428113 - DNA, 21 bp, Homo sapiens
atgtactttatattttctata

SEQ ID NO: 428114 - DNA, 17 bp, Homo sapiens
atgtagaaagatacact

SEQ ID NO: 428115 - DNA, 22 bp, Homo sapiens
atgtagaaagatacactgactt

SEQ ID NO: 428116 - DNA, 14 bp, Homo sapiens
atgtagaactcagc

SEQ ID NO: 428117 - DNA, 12 bp, Homo sapiens
atgtagaactgt

SEQ ID NO: 428118 - DNA, 23 bp, Homo sapiens
atgtagaacttcaagaagtaaga

SEQ ID NO: 428119 - DNA, 16 bp, Homo sapiens
atgtagaagagggaga

SEQ ID NO: 428120 - DNA, 21 bp, Homo sapiens
atgtagaagagggagaaggag

SEQ ID NO: 428121 - DNA, 22 bp, Homo sapiens
atgtagatacagatccgcatgt

SEQ ID NO: 428122 - DNA, 22 bp, Homo sapiens
atgtagatattgtgaagtacat

SEQ ID NO: 428123 - DNA, 21 bp, Homo sapiens
atgtagctgaaacaaaaatgc

SEQ ID NO: 428124 - DNA, 14 bp, Homo sapiens
atgtagctggtttc

SEQ ID NO: 428125 - DNA, 13 bp, Homo sapiens
atgtaggagctgg

SEQ ID NO: 428126 - DNA, 14 bp, Homo sapiens
atgtaggctccacc

SEQ ID NO: 428127 - DNA, 15 bp, Homo sapiens
atgtaggctccacct

SEQ ID NO: 428128 - DNA, 16 bp, Homo sapiens
atgtagtgagtgtaga

SEQ ID NO: 428129 - DNA, 21 bp, Homo sapiens
atgtagttctttgttcctgct

SEQ ID NO: 428130 - DNA, 18 bp, Homo sapiens
atgtatacttaatactga

SEQ ID NO: 428131 - DNA, 13 bp, Homo sapiens
atgtatataaaat

SEQ ID NO: 428132 - DNA, 17 bp, Homo sapiens
atgtatatctttgcact

SEQ ID NO: 428133 - DNA, 22 bp, Homo sapiens
atgtatatgaacttaacatgct

SEQ ID NO: 428134 - DNA, 16 bp, Homo sapiens
atgtatatgtttatat

SEQ ID NO: 428135 - DNA, 14 bp, Homo sapiens
atgtatattactga

SEQ ID NO: 428136 - DNA, 20 bp, Homo sapiens
atgtatccatgggggcaggg

SEQ ID NO: 428137 - DNA, 15 bp, Homo sapiens
atgtatctaaatgaa

SEQ ID NO: 428138 - DNA, 16 bp, Homo sapiens
atgtatctaaatgaaa

SEQ ID NO: 428139 - DNA, 21 bp, Homo sapiens
atgtatctaaatgaaaagaga

SEQ ID NO: 428140 - DNA, 15 bp, Homo sapiens
atgtatctacctcac

SEQ ID NO: 428141 - DNA, 22 bp, Homo sapiens
atgtatcttatttatatatgaa

SEQ ID NO: 428142 - DNA, 14 bp, Homo sapiens
atgtatgaaggctt

SEQ ID NO: 428143 - DNA, 12 bp, Homo sapiens
atgtatgtaaaa

SEQ ID NO: 428144 - DNA, 14 bp, Homo sapiens
atgtatgtaaaaat

SEQ ID NO: 428145 - DNA, 15 bp, Homo sapiens
atgtatgtaaaaatg

SEQ ID NO: 428146 - DNA, 15 bp, Homo sapiens
atgtatgtaaaatat

SEQ ID NO: 428147 - DNA, 17 bp, Homo sapiens
atgtatgtgcactgtca

SEQ ID NO: 428148 - DNA, 18 bp, Homo sapiens
atgtatgtgccaattttg

SEQ ID NO: 428149 - DNA, 12 bp, Homo sapiens
atgtatgtttac

SEQ ID NO: 428150 - DNA, 19 bp, Homo sapiens
atgtattaacctacctgtg

SEQ ID NO: 428151 - DNA, 23 bp, Homo sapiens
atgtattaacctacctgtgaatc

SEQ ID NO: 428152 - DNA, 17 bp, Homo sapiens
atgtattaccagccccc

SEQ ID NO: 428153 - DNA, 16 bp, Homo sapiens
atgtattatgcaaagt

SEQ ID NO: 428154 - DNA, 16 bp, Homo sapiens
atgtattattctgcag

SEQ ID NO: 428155 - DNA, 20 bp, Homo sapiens
atgtattattctgcagcatg

SEQ ID NO: 428156 - DNA, 19 bp, Homo sapiens
atgtattctagctaatgta

SEQ ID NO: 428157 - DNA, 20 bp, Homo sapiens
atgtattctagctaatgtaa

SEQ ID NO: 428158 - DNA, 15 bp, Homo sapiens
atgtattggcctgga

SEQ ID NO: 428159 - DNA, 19 bp, Homo sapiens
atgtattgtaaacatgtgt

SEQ ID NO: 428160 - DNA, 21 bp, Homo sapiens
atgtattgtaaacatgtgttt

SEQ ID NO: 428161 - DNA, 18 bp, Homo sapiens
atgtatttcattgctgtg

SEQ ID NO: 428162 - DNA, 23 bp, Homo sapiens
atgtatttcattgctgtgtcaca

SEQ ID NO: 428163 - DNA, 14 bp, Homo sapiens
atgtcaacttctgg

SEQ ID NO: 428164 - DNA, 17 bp, Homo sapiens
atgtcaaggtgctgttg

SEQ ID NO: 428165 - DNA, 16 bp, Homo sapiens
atgtcaatatgagata

SEQ ID NO: 428166 - DNA, 14 bp, Homo sapiens
atgtcacaaattga

SEQ ID NO: 428167 - DNA, 22 bp, Homo sapiens
atgtcactaaagcaggcctttt

SEQ ID NO: 428168 - DNA, 11 bp, Homo sapiens
atgtcagcctt

SEQ ID NO: 428169 - DNA, 12 bp, Homo sapiens
atgtcagccttg

SEQ ID NO: 428170 - DNA, 15 bp, Homo sapiens
atgtcagtgtgactg

SEQ ID NO: 428171 - DNA, 14 bp, Homo sapiens
atgtcatactctgt

SEQ ID NO: 428172 - DNA, 22 bp, Homo sapiens
atgtcatactctgtgtaatctc

SEQ ID NO: 428173 - DNA, 12 bp, Homo sapiens
atgtcatcttga

SEQ ID NO: 428174 - DNA, 21 bp, Homo sapiens
atgtcatgtaggttgtctaaa

SEQ ID NO: 428175 - DNA, 15 bp, Homo sapiens
atgtcattaatatat

SEQ ID NO: 428176 - DNA, 16 bp, Homo sapiens
atgtcattatttgata

SEQ ID NO: 428177 - DNA, 11 bp, Homo sapiens
atgtcatttgc

SEQ ID NO: 428178 - DNA, 16 bp, Homo sapiens
atgtcatttgctaatg

SEQ ID NO: 428179 - DNA, 21 bp, Homo sapiens
atgtcatttgctaatgaattt

SEQ ID NO: 428180 - DNA, 20 bp, Homo sapiens
atgtccaagttcttcacctc

SEQ ID NO: 428181 - DNA, 22 bp, Homo sapiens
atgtccaagttcttcacctcta

SEQ ID NO: 428182 - DNA, 22 bp, Homo sapiens
atgtccagctgctgtcaggtct

SEQ ID NO: 428183 - DNA, 17 bp, Homo sapiens
atgtcccaaataaattt

SEQ ID NO: 428184 - DNA, 18 bp, Homo sapiens
atgtcccatgaccttgac

SEQ ID NO: 428185 - DNA, 22 bp, Homo sapiens
atgtccccattctataaattca

SEQ ID NO: 428186 - DNA, 16 bp, Homo sapiens
atgtcccctgtcccac

SEQ ID NO: 428187 - DNA, 24 bp, Homo sapiens
atgtccctaccgagtctcttctcc

SEQ ID NO: 428188 - DNA, 20 bp, Homo sapiens
atgtccctttcttggccagt

SEQ ID NO: 428189 - DNA, 20 bp, Homo sapiens
atgtcctccagaagcctctg

SEQ ID NO: 428190 - DNA, 13 bp, Homo sapiens
atgtcctgccttt

SEQ ID NO: 428191 - DNA, 15 bp, Homo sapiens
atgtcctttccctgg

SEQ ID NO: 428192 - DNA, 16 bp, Homo sapiens
atgtcctttccctgga

SEQ ID NO: 428193 - DNA, 18 bp, Homo sapiens
atgtcctttccctggagt

SEQ ID NO: 428194 - DNA, 19 bp, Homo sapiens
atgtcctttccctggagtc

SEQ ID NO: 428195 - DNA, 13 bp, Homo sapiens
atgtctaaaattg

SEQ ID NO: 428196 - DNA, 13 bp, Homo sapiens
atgtctaaagagc

SEQ ID NO: 428197 - DNA, 12 bp, Homo sapiens
atgtctacaaaa

SEQ ID NO: 428198 - DNA, 21 bp, Homo sapiens
atgtctacaaaagcaaagtga

SEQ ID NO: 428199 - DNA, 22 bp, Homo sapiens
atgtctacaaaagcaaagtgaa

SEQ ID NO: 428200 - DNA, 12 bp, Homo sapiens
atgtctactgct

SEQ ID NO: 428201 - DNA, 22 bp, Homo sapiens
atgtctataatcccagcacttt

SEQ ID NO: 428202 - DNA, 12 bp, Homo sapiens
atgtctatgaca

SEQ ID NO: 428203 - DNA, 16 bp, Homo sapiens
atgtctctgcttccat

SEQ ID NO: 428204 - DNA, 13 bp, Homo sapiens
atgtctcttgtag

SEQ ID NO: 428205 - DNA, 23 bp, Homo sapiens
atgtctgcaaaggagggcctcag

SEQ ID NO: 428206 - DNA, 15 bp, Homo sapiens
atgtctgcatggcag

SEQ ID NO: 428207 - DNA, 20 bp, Homo sapiens
atgtctgggaaagcagagtg

SEQ ID NO: 428208 - DNA, 15 bp, Homo sapiens
atgtctggtaaatag

SEQ ID NO: 428209 - DNA, 10 bp, Homo sapiens
atgtctgtga

SEQ ID NO: 428210 - DNA, 11 bp, Homo sapiens
atgtctgtgat

SEQ ID NO: 428211 - DNA, 22 bp, Homo sapiens
atgtcttaaataaaactattta

SEQ ID NO: 428212 - DNA, 18 bp, Homo sapiens
atgtcttactactttaaa

SEQ ID NO: 428213 - DNA, 21 bp, Homo sapiens
atgtcttactactttaaatcc

SEQ ID NO: 428214 - DNA, 17 bp, Homo sapiens
atgtcttcatttcattg

SEQ ID NO: 428215 - DNA, 19 bp, Homo sapiens
atgtcttcatttcattgta

SEQ ID NO: 428216 - DNA, 22 bp, Homo sapiens
atgtcttcgtacagttcttcgg

SEQ ID NO: 428217 - DNA, 12 bp, Homo sapiens
atgtcttctgcc

SEQ ID NO: 428218 - DNA, 14 bp, Homo sapiens
atgtcttctgcctg

SEQ ID NO: 428219 - DNA, 19 bp, Homo sapiens
atgtcttctgcctgttata

SEQ ID NO: 428220 - DNA, 22 bp, Homo sapiens
atgtcttgagatgtattatgca

SEQ ID NO: 428221 - DNA, 22 bp, Homo sapiens
atgtctttaggcagcagctttt

SEQ ID NO: 428222 - DNA, 19 bp, Homo sapiens
atgtctttggcttcagaat

SEQ ID NO: 428223 - DNA, 18 bp, Homo sapiens
atgtcttttcaaaaggat

SEQ ID NO: 428224 - DNA, 20 bp, Homo sapiens
atgtgaaaaagcctaagaaa

SEQ ID NO: 428225 - DNA, 21 bp, Homo sapiens
atgtgaaaaagcctaagaaaa

SEQ ID NO: 428226 - DNA, 22 bp, Homo sapiens
atgtgaaaaagcctaagaaaaa

SEQ ID NO: 428227 - DNA, 15 bp, Homo sapiens
atgtgaaagtgtaaa

SEQ ID NO: 428228 - DNA, 23 bp, Homo sapiens
atgtgaaatttacatcatttctt

SEQ ID NO: 428229 - DNA, 19 bp, Homo sapiens
atgtgaagataatttgcat

SEQ ID NO: 428230 - DNA, 16 bp, Homo sapiens
atgtgaagcatgcttt

SEQ ID NO: 428231 - DNA, 16 bp, Homo sapiens
atgtgaattctgtgaa

SEQ ID NO: 428232 - DNA, 17 bp, Homo sapiens
atgtgaattgaagtcat

SEQ ID NO: 428233 - DNA, 20 bp, Homo sapiens
atgtgacaattttgtacaaa

SEQ ID NO: 428234 - DNA, 17 bp, Homo sapiens
atgtgacccaccagtgc

SEQ ID NO: 428235 - DNA, 15 bp, Homo sapiens
atgtgagaacttttc

SEQ ID NO: 428236 - DNA, 15 bp, Homo sapiens
atgtgagacagcaag

SEQ ID NO: 428237 - DNA, 17 bp, Homo sapiens
atgtgagacagcaagtt

SEQ ID NO: 428238 - DNA, 15 bp, Homo sapiens
atgtgagagaaagtg

SEQ ID NO: 428239 - DNA, 17 bp, Homo sapiens
atgtgagccaccgctgc

SEQ ID NO: 428240 - DNA, 21 bp, Homo sapiens
atgtgagtcccagagcccgct

SEQ ID NO: 428241 - DNA, 22 bp, Homo sapiens
atgtgagtgaaagtacttcagg

SEQ ID NO: 428242 - DNA, 22 bp, Homo sapiens
atgtgagtgtgtgtttgtgctg

SEQ ID NO: 428243 - DNA, 16 bp, Homo sapiens
atgtgatcactgagac

SEQ ID NO: 428244 - DNA, 18 bp, Homo sapiens
atgtgatcatctttgctg

SEQ ID NO: 428245 - DNA, 18 bp, Homo sapiens
atgtgatctattactctg

SEQ ID NO: 428246 - DNA, 16 bp, Homo sapiens
atgtgatggaacacac

SEQ ID NO: 428247 - DNA, 19 bp, Homo sapiens
atgtgatggaacacacaca

SEQ ID NO: 428248 - DNA, 15 bp, Homo sapiens
atgtgattctaatgt

SEQ ID NO: 428249 - DNA, 14 bp, Homo sapiens
atgtgatttatgca

SEQ ID NO: 428250 - DNA, 15 bp, Homo sapiens
atgtgatttttctga

SEQ ID NO: 428251 - DNA, 22 bp, Homo sapiens
atgtgcacatatcaagaagtca

SEQ ID NO: 428252 - DNA, 17 bp, Homo sapiens
atgtgcatttcacctgt

SEQ ID NO: 428253 - DNA, 21 bp, Homo sapiens
atgtgcatttttgtgaaatga

SEQ ID NO: 428254 - DNA, 22 bp, Homo sapiens
atgtgccaagattctactcttg

SEQ ID NO: 428255 - DNA, 23 bp, Homo sapiens
atgtgccaccaacataaaacaaa

SEQ ID NO: 428256 - DNA, 20 bp, Homo sapiens
atgtgcccagagtagcccag

SEQ ID NO: 428257 - DNA, 18 bp, Homo sapiens
atgtgcccagtcatgaca

SEQ ID NO: 428258 - DNA, 13 bp, Homo sapiens
atgtgcccctggc

SEQ ID NO: 428259 - DNA, 20 bp, Homo sapiens
atgtgcccctggcccatctc

SEQ ID NO: 428260 - DNA, 17 bp, Homo sapiens
atgtgccgaatgtgcag

SEQ ID NO: 428261 - DNA, 20 bp, Homo sapiens
atgtgcctgtaatctttttc

SEQ ID NO: 428262 - DNA, 20 bp, Homo sapiens
atgtgcctgtcacgctctgg

SEQ ID NO: 428263 - DNA, 19 bp, Homo sapiens
atgtgcgtgctgtctgtcc

SEQ ID NO: 428264 - DNA, 16 bp, Homo sapiens
atgtgctgctgtggca

SEQ ID NO: 428265 - DNA, 20 bp, Homo sapiens
atgtgctgttgattctttca

SEQ ID NO: 428266 - DNA, 13 bp, Homo sapiens
atgtgctttgtag

SEQ ID NO: 428267 - DNA, 15 bp, Homo sapiens
atgtgctttgtagct

SEQ ID NO: 428268 - DNA, 17 bp, Homo sapiens
atgtggaaaactcacag

SEQ ID NO: 428269 - DNA, 14 bp, Homo sapiens
atgtggaattacat

SEQ ID NO: 428270 - DNA, 17 bp, Homo sapiens
atgtggaattacataac

SEQ ID NO: 428271 - DNA, 20 bp, Homo sapiens
atgtggaattacataacagg

SEQ ID NO: 428272 - DNA, 23 bp, Homo sapiens
atgtggagcacaaaagcctctca

SEQ ID NO: 428273 - DNA, 18 bp, Homo sapiens
atgtggatacagtcatta

SEQ ID NO: 428274 - DNA, 14 bp, Homo sapiens
atgtggatgctctt

SEQ ID NO: 428275 - DNA, 16 bp, Homo sapiens
atgtggcatttgtgat

SEQ ID NO: 428276 - DNA, 17 bp, Homo sapiens
atgtggccttgagcaag

SEQ ID NO: 428277 - DNA, 14 bp, Homo sapiens
atgtgggattatgg

SEQ ID NO: 428278 - DNA, 16 bp, Homo sapiens
atgtggggacagggct

SEQ ID NO: 428279 - DNA, 15 bp, Homo sapiens
atgtgggtgagccag

SEQ ID NO: 428280 - DNA, 18 bp, Homo sapiens
atgtgggttgtgatattg

SEQ ID NO: 428281 - DNA, 15 bp, Homo sapiens
atgtggtaagtggag

SEQ ID NO: 428282 - DNA, 16 bp, Homo sapiens
atgtggtggtttctat

SEQ ID NO: 428283 - DNA, 21 bp, Homo sapiens
atgtggttaccgagtatctgt

SEQ ID NO: 428284 - DNA, 20 bp, Homo sapiens
atgtggttacttcctactgt

SEQ ID NO: 428285 - DNA, 15 bp, Homo sapiens
atgtgtaaatgttat

SEQ ID NO: 428286 - DNA, 16 bp, Homo sapiens
atgtgtaacttctaga

SEQ ID NO: 428287 - DNA, 19 bp, Homo sapiens
atgtgtaatatcatttcat

SEQ ID NO: 428288 - DNA, 11 bp, Homo sapiens
atgtgtaatga

SEQ ID NO: 428289 - DNA, 15 bp, Homo sapiens
atgtgtaatgatttg

SEQ ID NO: 428290 - DNA, 23 bp, Homo sapiens
atgtgtataaaaataaaaaagat

SEQ ID NO: 428291 - DNA, 21 bp, Homo sapiens
atgtgtcactactcacagtct

SEQ ID NO: 428292 - DNA, 19 bp, Homo sapiens
atgtgtcagctgtagaaag

SEQ ID NO: 428293 - DNA, 21 bp, Homo sapiens
atgtgtcagctgtagaaaggt

SEQ ID NO: 428294 - DNA, 18 bp, Homo sapiens
atgtgtcatgatttcaat

SEQ ID NO: 428295 - DNA, 16 bp, Homo sapiens
atgtgtccatgtgaaa

SEQ ID NO: 428296 - DNA, 21 bp, Homo sapiens
atgtgtcccagtgaacagttt

SEQ ID NO: 428297 - DNA, 17 bp, Homo sapiens
atgtgtctagcaaagcc

SEQ ID NO: 428298 - DNA, 18 bp, Homo sapiens
atgtgtctagcaaagcca

SEQ ID NO: 428299 - DNA, 17 bp, Homo sapiens
atgtgtctgtattcata

SEQ ID NO: 428300 - DNA, 21 bp, Homo sapiens
atgtgtctgtattcatacagc

SEQ ID NO: 428301 - DNA, 22 bp, Homo sapiens
atgtgtgagataacttccttca

SEQ ID NO: 428302 - DNA, 15 bp, Homo sapiens
atgtgtgaggagctg

SEQ ID NO: 428303 - DNA, 18 bp, Homo sapiens
atgtgtgccatagagttt

SEQ ID NO: 428304 - DNA, 22 bp, Homo sapiens
atgtgtgccatagagtttaaca

SEQ ID NO: 428305 - DNA, 12 bp, Homo sapiens
atgtgtgcctgt

SEQ ID NO: 428306 - DNA, 15 bp, Homo sapiens
atgtgtgcgagtgtg

SEQ ID NO: 428307 - DNA, 18 bp, Homo sapiens
atgtgtggatgtgtaaat

SEQ ID NO: 428308 - DNA, 19 bp, Homo sapiens
atgtgtggctcattctttt

SEQ ID NO: 428309 - DNA, 20 bp, Homo sapiens
atgtgtggctcattcttttc

SEQ ID NO: 428310 - DNA, 19 bp, Homo sapiens
atgtgtggtttataatctg

SEQ ID NO: 428311 - DNA, 13 bp, Homo sapiens
atgtgtgtgtctc

SEQ ID NO: 428312 - DNA, 17 bp, Homo sapiens
atgtgtgtgtctctatc

SEQ ID NO: 428313 - DNA, 12 bp, Homo sapiens
atgtgtgtttaa

SEQ ID NO: 428314 - DNA, 15 bp, Homo sapiens
atgtgtgtttaaata

SEQ ID NO: 428315 - DNA, 17 bp, Homo sapiens
atgtgtgtttaaataaa

SEQ ID NO: 428316 - DNA, 19 bp, Homo sapiens
atgtgttgcaaattattct

SEQ ID NO: 428317 - DNA, 14 bp, Homo sapiens
atgtgttgccaaag

SEQ ID NO: 428318 - DNA, 16 bp, Homo sapiens
atgtgttgccaaagct

SEQ ID NO: 428319 - DNA, 13 bp, Homo sapiens
atgtgttgtgata

SEQ ID NO: 428320 - DNA, 18 bp, Homo sapiens
atgtgtttggttctgggg

SEQ ID NO: 428321 - DNA, 15 bp, Homo sapiens
atgtgttttgctttt

SEQ ID NO: 428322 - DNA, 17 bp, Homo sapiens
atgtgttttgcttttat

SEQ ID NO: 428323 - DNA, 18 bp, Homo sapiens
atgttaaaacaaattaaa

SEQ ID NO: 428324 - DNA, 19 bp, Homo sapiens
atgttaaacgtcacagcag

SEQ ID NO: 428325 - DNA, 12 bp, Homo sapiens
atgttaaagagg

SEQ ID NO: 428326 - DNA, 22 bp, Homo sapiens
atgttaaagaggcgtcttgtat

SEQ ID NO: 428327 - DNA, 12 bp, Homo sapiens
atgttaaagcat

SEQ ID NO: 428328 - DNA, 19 bp, Homo sapiens
atgttaaagcatcagagat

SEQ ID NO: 428329 - DNA, 12 bp, Homo sapiens
atgttaagcaga

SEQ ID NO: 428330 - DNA, 18 bp, Homo sapiens
atgttaatcctagctgtg

SEQ ID NO: 428331 - DNA, 16 bp, Homo sapiens
atgttaattaaagtaa

SEQ ID NO: 428332 - DNA, 22 bp, Homo sapiens
atgttaattcagcactgatttc

SEQ ID NO: 428333 - DNA, 23 bp, Homo sapiens
atgttaattcagcactgatttca

SEQ ID NO: 428334 - DNA, 22 bp, Homo sapiens
atgttacagcatctactctttg

SEQ ID NO: 428335 - DNA, 21 bp, Homo sapiens
atgttaccatcttacttgagc

SEQ ID NO: 428336 - DNA, 13 bp, Homo sapiens
atgttactgatca

SEQ ID NO: 428337 - DNA, 19 bp, Homo sapiens
atgttactgatcatgcatt

SEQ ID NO: 428338 - DNA, 20 bp, Homo sapiens
atgttactgatcatgcattg

SEQ ID NO: 428339 - DNA, 18 bp, Homo sapiens
atgttagaattgatttcc

SEQ ID NO: 428340 - DNA, 20 bp, Homo sapiens
atgttaggctgggcccagag

SEQ ID NO: 428341 - DNA, 13 bp, Homo sapiens
atgttagtggcat

SEQ ID NO: 428342 - DNA, 14 bp, Homo sapiens
atgttattgaaaaa

SEQ ID NO: 428343 - DNA, 21 bp, Homo sapiens
atgttattttctgttgaagtt

SEQ ID NO: 428344 - DNA, 23 bp, Homo sapiens
atgttcaaagtcaaataactcct

SEQ ID NO: 428345 - DNA, 20 bp, Homo sapiens
atgttcatgtgtaacttcta

SEQ ID NO: 428346 - DNA, 14 bp, Homo sapiens
atgttcattgtaat

SEQ ID NO: 428347 - DNA, 19 bp, Homo sapiens
atgttccctcttgtccctt

SEQ ID NO: 428348 - DNA, 13 bp, Homo sapiens
atgttccctgcac

SEQ ID NO: 428349 - DNA, 18 bp, Homo sapiens
atgttccctgcaccctgg

SEQ ID NO: 428350 - DNA, 14 bp, Homo sapiens
atgttcccttctcc

SEQ ID NO: 428351 - DNA, 22 bp, Homo sapiens
atgttccgttcatctgaggagt

SEQ ID NO: 428352 - DNA, 22 bp, Homo sapiens
atgttctaacagatcagaacat

SEQ ID NO: 428353 - DNA, 14 bp, Homo sapiens
atgttctattgtgg

SEQ ID NO: 428354 - DNA, 15 bp, Homo sapiens
atgttctgacattaa

SEQ ID NO: 428355 - DNA, 21 bp, Homo sapiens
atgttctgagctataacattt

SEQ ID NO: 428356 - DNA, 18 bp, Homo sapiens
atgttgaagaatacagtt

SEQ ID NO: 428357 - DNA, 14 bp, Homo sapiens
atgttgatcgatgt

SEQ ID NO: 428358 - DNA, 19 bp, Homo sapiens
atgttggatagtcagctgt

SEQ ID NO: 428359 - DNA, 16 bp, Homo sapiens
atgttggccaggctgg

SEQ ID NO: 428360 - DNA, 19 bp, Homo sapiens
atgttggccaggctggtct

SEQ ID NO: 428361 - DNA, 21 bp, Homo sapiens
atgttggcctgtcagagcttg

SEQ ID NO: 428362 - DNA, 15 bp, Homo sapiens
atgttgggaaaaact

SEQ ID NO: 428363 - DNA, 23 bp, Homo sapiens
atgttgtaataaaacttatgcta

SEQ ID NO: 428364 - DNA, 21 bp, Homo sapiens
atgttgtagatacaatcagct

SEQ ID NO: 428365 - DNA, 16 bp, Homo sapiens
atgttgtcctgtgtca

SEQ ID NO: 428366 - DNA, 13 bp, Homo sapiens
atgttgttattta

SEQ ID NO: 428367 - DNA, 13 bp, Homo sapiens
atgttgttcctgg

SEQ ID NO: 428368 - DNA, 16 bp, Homo sapiens
atgttgttttttcata

SEQ ID NO: 428369 - DNA, 22 bp, Homo sapiens
atgtttaaactttgtgcctttg

SEQ ID NO: 428370 - DNA, 16 bp, Homo sapiens
atgtttaacaaatcta

SEQ ID NO: 428371 - DNA, 17 bp, Homo sapiens
atgtttaacaaatctaa

SEQ ID NO: 428372 - DNA, 16 bp, Homo sapiens
atgtttacactctttg

SEQ ID NO: 428373 - DNA, 18 bp, Homo sapiens
atgtttacactctttgta

SEQ ID NO: 428374 - DNA, 22 bp, Homo sapiens
atgtttacactctttgtaagag

SEQ ID NO: 428375 - DNA, 20 bp, Homo sapiens
atgtttacatatcacctcat

SEQ ID NO: 428376 - DNA, 19 bp, Homo sapiens
atgtttacctcactggtgc

SEQ ID NO: 428377 - DNA, 14 bp, Homo sapiens
atgtttagtagctg

SEQ ID NO: 428378 - DNA, 14 bp, Homo sapiens
atgtttatatactg

SEQ ID NO: 428379 - DNA, 13 bp, Homo sapiens
atgtttatattgt

SEQ ID NO: 428380 - DNA, 18 bp, Homo sapiens
atgtttatattgttttta

SEQ ID NO: 428381 - DNA, 14 bp, Homo sapiens
atgtttatgagcca

SEQ ID NO: 428382 - DNA, 15 bp, Homo sapiens
atgtttatgagccag

SEQ ID NO: 428383 - DNA, 16 bp, Homo sapiens
atgtttatgagccaga

SEQ ID NO: 428384 - DNA, 20 bp, Homo sapiens
atgtttatgagccagacaaa

SEQ ID NO: 428385 - DNA, 18 bp, Homo sapiens
atgtttcaggaggctgga

SEQ ID NO: 428386 - DNA, 13 bp, Homo sapiens
atgtttccagctg

SEQ ID NO: 428387 - DNA, 22 bp, Homo sapiens
atgtttcccgctccaagagaat

SEQ ID NO: 428388 - DNA, 15 bp, Homo sapiens
atgtttcttctaggt

SEQ ID NO: 428389 - DNA, 16 bp, Homo sapiens
atgtttgcattaaatg

SEQ ID NO: 428390 - DNA, 22 bp, Homo sapiens
atgtttgccctgttcaaagtac

SEQ ID NO: 428391 - DNA, 16 bp, Homo sapiens
atgtttgctattgaca

SEQ ID NO: 428392 - DNA, 19 bp, Homo sapiens
atgtttgctcagaacacat

SEQ ID NO: 428393 - DNA, 19 bp, Homo sapiens
atgtttggctgaaattatg

SEQ ID NO: 428394 - DNA, 14 bp, Homo sapiens
atgtttgtaaaact

SEQ ID NO: 428395 - DNA, 19 bp, Homo sapiens
atgtttgtaaattaatact

SEQ ID NO: 428396 - DNA, 22 bp, Homo sapiens
atgtttgtacacaacacctaaa

SEQ ID NO: 428397 - DNA, 19 bp, Homo sapiens
atgtttgtctgtgtgctgt

SEQ ID NO: 428398 - DNA, 17 bp, Homo sapiens
atgtttgtggcctcaga

SEQ ID NO: 428399 - DNA, 18 bp, Homo sapiens
atgtttgtggcctcagaa

SEQ ID NO: 428400 - DNA, 22 bp, Homo sapiens
atgtttgttttcaaaatacttc

SEQ ID NO: 428401 - DNA, 20 bp, Homo sapiens
atgttttaaatatagaattt

SEQ ID NO: 428402 - DNA, 21 bp, Homo sapiens
atgttttccccaattatcctc

SEQ ID NO: 428403 - DNA, 23 bp, Homo sapiens
atgttttcctttgtcatcattgt

SEQ ID NO: 428404 - DNA, 13 bp, Homo sapiens
atgttttgagaaa

SEQ ID NO: 428405 - DNA, 15 bp, Homo sapiens
atgttttgagaaaaa

SEQ ID NO: 428406 - DNA, 13 bp, Homo sapiens
atgttttgctaat

SEQ ID NO: 428407 - DNA, 14 bp, Homo sapiens
atgttttgctaatg

SEQ ID NO: 428408 - DNA, 14 bp, Homo sapiens
atgttttgtacaat

SEQ ID NO: 428409 - DNA, 19 bp, Homo sapiens
atgttttgtttctgaaaat

SEQ ID NO: 428410 - DNA, 21 bp, Homo sapiens
atgttttgtttctgaaaattc

SEQ ID NO: 428411 - DNA, 20 bp, Homo sapiens
atgtttttaaaagtttcaat

SEQ ID NO: 428412 - DNA, 22 bp, Homo sapiens
atgtttttaaaagtttcaatgt

SEQ ID NO: 428413 - DNA, 21 bp, Homo sapiens
atgtttttgttttctttgaat

SEQ ID NO: 428414 - DNA, 19 bp, Homo sapiens
atgttttttgaagttctgg

SEQ ID NO: 428415 - DNA, 19 bp, Homo sapiens
attaaaaaaaaaaactaga

SEQ ID NO: 428416 - DNA, 15 bp, Homo sapiens
attaaaaatataaac

SEQ ID NO: 428417 - DNA, 14 bp, Homo sapiens
attaaaaatatgga

SEQ ID NO: 428418 - DNA, 11 bp, Homo sapiens
attaaaacaat

SEQ ID NO: 428419 - DNA, 12 bp, Homo sapiens
attaaaactgct

SEQ ID NO: 428420 - DNA, 20 bp, Homo sapiens
attaaaataactaagcaagt

SEQ ID NO: 428421 - DNA, 22 bp, Homo sapiens
attaaaatatggctataaatat

SEQ ID NO: 428422 - DNA, 14 bp, Homo sapiens
attaaaattagtga

SEQ ID NO: 428423 - DNA, 16 bp, Homo sapiens
attaaaattagtgaga

SEQ ID NO: 428424 - DNA, 20 bp, Homo sapiens
attaaacaatttattttatt

SEQ ID NO: 428425 - DNA, 15 bp, Homo sapiens
attaaacacctgaca

SEQ ID NO: 428426 - DNA, 17 bp, Homo sapiens
attaaacacctgacaca

SEQ ID NO: 428427 - DNA, 13 bp, Homo sapiens
attaaacatgaat

SEQ ID NO: 428428 - DNA, 21 bp, Homo sapiens
attaaacccacaagctgcctc

SEQ ID NO: 428429 - DNA, 22 bp, Homo sapiens
attaaacccacaagctgcctct

SEQ ID NO: 428430 - DNA, 18 bp, Homo sapiens
attaaactaaaatacaag

SEQ ID NO: 428431 - DNA, 15 bp, Homo sapiens
attaaactctccttt

SEQ ID NO: 428432 - DNA, 22 bp, Homo sapiens
attaaactgtatgtcttataag

SEQ ID NO: 428433 - DNA, 12 bp, Homo sapiens
attaaacttgaa

SEQ ID NO: 428434 - DNA, 13 bp, Homo sapiens
attaaagacagag

SEQ ID NO: 428435 - DNA, 20 bp, Homo sapiens
attaaatacagacactaagt

SEQ ID NO: 428436 - DNA, 17 bp, Homo sapiens
attaaatcagttttgtg

SEQ ID NO: 428437 - DNA, 19 bp, Homo sapiens
attaaatcagttttgtgta

SEQ ID NO: 428438 - DNA, 14 bp, Homo sapiens
attaaatgaaatac

SEQ ID NO: 428439 - DNA, 17 bp, Homo sapiens
attaaatgaaatacttg

SEQ ID NO: 428440 - DNA, 12 bp, Homo sapiens
attaaatggcac

SEQ ID NO: 428441 - DNA, 17 bp, Homo sapiens
attaaatggcacctgta

SEQ ID NO: 428442 - DNA, 18 bp, Homo sapiens
attaaatggtgatttctt

SEQ ID NO: 428443 - DNA, 21 bp, Homo sapiens
attaaatggtgatttcttgct

SEQ ID NO: 428444 - DNA, 13 bp, Homo sapiens
attaaattaggaa

SEQ ID NO: 428445 - DNA, 17 bp, Homo sapiens
attaaattctctctaac

SEQ ID NO: 428446 - DNA, 17 bp, Homo sapiens
attaaatttaatatact

SEQ ID NO: 428447 - DNA, 19 bp, Homo sapiens
attaaatttcacaatataa

SEQ ID NO: 428448 - DNA, 15 bp, Homo sapiens
attaaatttctggat

SEQ ID NO: 428449 - DNA, 20 bp, Homo sapiens
attaacaacccataggcact

SEQ ID NO: 428450 - DNA, 18 bp, Homo sapiens
attaacaggtctttgaaa

SEQ ID NO: 428451 - DNA, 19 bp, Homo sapiens
attaacaggtctttgaaat

SEQ ID NO: 428452 - DNA, 21 bp, Homo sapiens
attaacagttttccatgaaaa

SEQ ID NO: 428453 - DNA, 22 bp, Homo sapiens
attaacagttttccatgaaaac

SEQ ID NO: 428454 - DNA, 17 bp, Homo sapiens
attaacatataatatat

SEQ ID NO: 428455 - DNA, 18 bp, Homo sapiens
attaacatataatatatg

SEQ ID NO: 428456 - DNA, 20 bp, Homo sapiens
attaacatataatatatgtt

SEQ ID NO: 428457 - DNA, 13 bp, Homo sapiens
attaacatatatt

SEQ ID NO: 428458 - DNA, 18 bp, Homo sapiens
attaaccaaagaaagtgg

SEQ ID NO: 428459 - DNA, 22 bp, Homo sapiens
attaaccagctgatttttctta

SEQ ID NO: 428460 - DNA, 15 bp, Homo sapiens
attaacctgcatgca

SEQ ID NO: 428461 - DNA, 14 bp, Homo sapiens
attaacctggtgct

SEQ ID NO: 428462 - DNA, 14 bp, Homo sapiens
attaactacattta

SEQ ID NO: 428463 - DNA, 17 bp, Homo sapiens
attaactacatttatga

SEQ ID NO: 428464 - DNA, 15 bp, Homo sapiens
attaactctgcatag

SEQ ID NO: 428465 - DNA, 21 bp, Homo sapiens
attaactctgcatagacaaag

SEQ ID NO: 428466 - DNA, 23 bp, Homo sapiens
attaactctgcatagacaaaggc

SEQ ID NO: 428467 - DNA, 17 bp, Homo sapiens
attaacttaaaagattc

SEQ ID NO: 428468 - DNA, 20 bp, Homo sapiens
attaacttctattttcaagt

SEQ ID NO: 428469 - DNA, 18 bp, Homo sapiens
attaacttctctggaaag

SEQ ID NO: 428470 - DNA, 13 bp, Homo sapiens
attaacttttgta

SEQ ID NO: 428471 - DNA, 14 bp, Homo sapiens
attaagaaacaatt

SEQ ID NO: 428472 - DNA, 11 bp, Homo sapiens
attaagaaact

SEQ ID NO: 428473 - DNA, 22 bp, Homo sapiens
attaagaagtacaataagcaga

SEQ ID NO: 428474 - DNA, 12 bp, Homo sapiens
attaagaatctc

SEQ ID NO: 428475 - DNA, 16 bp, Homo sapiens
attaagatacactcct

SEQ ID NO: 428476 - DNA, 18 bp, Homo sapiens
attaagatacactcctgc

SEQ ID NO: 428477 - DNA, 19 bp, Homo sapiens
attaagatacactcctgct

SEQ ID NO: 428478 - DNA, 20 bp, Homo sapiens
attaagatggattctcagat

SEQ ID NO: 428479 - DNA, 24 bp, Homo sapiens
attaagatggattctcagatattt

SEQ ID NO: 428480 - DNA, 15 bp, Homo sapiens
attaagcagtaaaaa

SEQ ID NO: 428481 - DNA, 22 bp, Homo sapiens
attaaggatcatagtcgggcat

SEQ ID NO: 428482 - DNA, 21 bp, Homo sapiens
attaagtctgggatgtagaac

SEQ ID NO: 428483 - DNA, 19 bp, Homo sapiens
attaagttcctatcttttg

SEQ ID NO: 428484 - DNA, 17 bp, Homo sapiens
attaagttcgaggtggc

SEQ ID NO: 428485 - DNA, 19 bp, Homo sapiens
attaagttctcaatgtgaa

SEQ ID NO: 428486 - DNA, 22 bp, Homo sapiens
attaataaaaaatggaaagaat

SEQ ID NO: 428487 - DNA, 21 bp, Homo sapiens
attaataggaaagatttaatg

SEQ ID NO: 428488 - DNA, 20 bp, Homo sapiens
attaatattattatgaattt

SEQ ID NO: 428489 - DNA, 13 bp, Homo sapiens
attaatctctaaa

SEQ ID NO: 428490 - DNA, 12 bp, Homo sapiens
attaatcttcag

SEQ ID NO: 428491 - DNA, 18 bp, Homo sapiens
attaatctttctttacct

SEQ ID NO: 428492 - DNA, 14 bp, Homo sapiens
attaatgacaacaa

SEQ ID NO: 428493 - DNA, 12 bp, Homo sapiens
attaatgagttt

SEQ ID NO: 428494 - DNA, 14 bp, Homo sapiens
attaatgctaaggg

SEQ ID NO: 428495 - DNA, 22 bp, Homo sapiens
attaatggcatgtaatattctg

SEQ ID NO: 428496 - DNA, 13 bp, Homo sapiens
attaatgttaatt

SEQ ID NO: 428497 - DNA, 18 bp, Homo sapiens
attaattcttaataggct

SEQ ID NO: 428498 - DNA, 11 bp, Homo sapiens
attaattgagg

SEQ ID NO: 428499 - DNA, 13 bp, Homo sapiens
attaatttctctc

SEQ ID NO: 428500 - DNA, 22 bp, Homo sapiens
attaatttctctcaatttgggt

SEQ ID NO: 428501 - DNA, 13 bp, Homo sapiens
attacaaacaaag

SEQ ID NO: 428502 - DNA, 15 bp, Homo sapiens
attacaaacaaagga

SEQ ID NO: 428503 - DNA, 20 bp, Homo sapiens
attacaaaggaatctaatta

SEQ ID NO: 428504 - DNA, 21 bp, Homo sapiens
attacaaattttcactgctgc

SEQ ID NO: 428505 - DNA, 20 bp, Homo sapiens
attacaacagatattccaga

SEQ ID NO: 428506 - DNA, 19 bp, Homo sapiens
attacaaccggttatcagt

SEQ ID NO: 428507 - DNA, 17 bp, Homo sapiens
attacaagtttcagtaa

SEQ ID NO: 428508 - DNA, 23 bp, Homo sapiens
attacaagtttcagtaatagctg

SEQ ID NO: 428509 - DNA, 22 bp, Homo sapiens
attacacacgtgtgatgtatgt

SEQ ID NO: 428510 - DNA, 19 bp, Homo sapiens
attacacagttcacaaaca

SEQ ID NO: 428511 - DNA, 14 bp, Homo sapiens
attacacccatgca

SEQ ID NO: 428512 - DNA, 16 bp, Homo sapiens
attacacccatgcaca

SEQ ID NO: 428513 - DNA, 15 bp, Homo sapiens
attacagagaggaga

SEQ ID NO: 428514 - DNA, 17 bp, Homo sapiens
attacagatttagttta

SEQ ID NO: 428515 - DNA, 21 bp, Homo sapiens
attacaggcgtgagccactgc

SEQ ID NO: 428516 - DNA, 15 bp, Homo sapiens
attacaggtgtgtgc

SEQ ID NO: 428517 - DNA, 14 bp, Homo sapiens
attacatctttatt

SEQ ID NO: 428518 - DNA, 15 bp, Homo sapiens
attaccatcttaatc

SEQ ID NO: 428519 - DNA, 16 bp, Homo sapiens
attaccatcttaatct

SEQ ID NO: 428520 - DNA, 18 bp, Homo sapiens
attaccatcttaatcttt

SEQ ID NO: 428521 - DNA, 20 bp, Homo sapiens
attaccatgagaagagggcc

SEQ ID NO: 428522 - DNA, 14 bp, Homo sapiens
attacccctcattt

SEQ ID NO: 428523 - DNA, 13 bp, Homo sapiens
attacctctgata

SEQ ID NO: 428524 - DNA, 15 bp, Homo sapiens
attactattaactct

SEQ ID NO: 428525 - DNA, 16 bp, Homo sapiens
attactattaactctg

SEQ ID NO: 428526 - DNA, 14 bp, Homo sapiens
attactctgacata

SEQ ID NO: 428527 - DNA, 15 bp, Homo sapiens
attactgtctttatt

SEQ ID NO: 428528 - DNA, 19 bp, Homo sapiens
attactgtctttattctta

SEQ ID NO: 428529 - DNA, 19 bp, Homo sapiens
attactgttgcatttactt

SEQ ID NO: 428530 - DNA, 15 bp, Homo sapiens
attactttaaattat

SEQ ID NO: 428531 - DNA, 18 bp, Homo sapiens
attactttaaattatatg

SEQ ID NO: 428532 - DNA, 19 bp, Homo sapiens
attactttaaattatatga

SEQ ID NO: 428533 - DNA, 15 bp, Homo sapiens
attactttgtcccgc

SEQ ID NO: 428534 - DNA, 15 bp, Homo sapiens
attacttttctgcaa

SEQ ID NO: 428535 - DNA, 15 bp, Homo sapiens
attacttttgtaaat

SEQ ID NO: 428536 - DNA, 16 bp, Homo sapiens
attacttttgtaaata

SEQ ID NO: 428537 - DNA, 16 bp, Homo sapiens
attagaaaaaaacaaa

SEQ ID NO: 428538 - DNA, 18 bp, Homo sapiens
attagaaacacacttttg

SEQ ID NO: 428539 - DNA, 22 bp, Homo sapiens
attagaaacacacttttgcaca

SEQ ID NO: 428540 - DNA, 23 bp, Homo sapiens
attagaaactgaaaactgtaaat

SEQ ID NO: 428541 - DNA, 18 bp, Homo sapiens
attagaacttagttttgt

SEQ ID NO: 428542 - DNA, 15 bp, Homo sapiens
attagagaagccttt

SEQ ID NO: 428543 - DNA, 15 bp, Homo sapiens
attagcacctctttt

SEQ ID NO: 428544 - DNA, 15 bp, Homo sapiens
attagccaggctggt

SEQ ID NO: 428545 - DNA, 15 bp, Homo sapiens
attagccaggtaatg

SEQ ID NO: 428546 - DNA, 18 bp, Homo sapiens
attagctaaaaatatata

SEQ ID NO: 428547 - DNA, 21 bp, Homo sapiens
attagctgtaaatacatgtgt

SEQ ID NO: 428548 - DNA, 18 bp, Homo sapiens
attaggaacagagtatat

SEQ ID NO: 428549 - DNA, 23 bp, Homo sapiens
attaggaacagagtatatatgta

SEQ ID NO: 428550 - DNA, 21 bp, Homo sapiens
attaggaagcttgatttgctt

SEQ ID NO: 428551 - DNA, 16 bp, Homo sapiens
attaggatttcatgat

SEQ ID NO: 428552 - DNA, 17 bp, Homo sapiens
attagggctctaatttc

SEQ ID NO: 428553 - DNA, 24 bp, Homo sapiens
attaggtctgcattttctcaggca

SEQ ID NO: 428554 - DNA, 16 bp, Homo sapiens
attagtccaaatgtga

SEQ ID NO: 428555 - DNA, 16 bp, Homo sapiens
attagtcctcacagcc

SEQ ID NO: 428556 - DNA, 19 bp, Homo sapiens
attagtcctcacagcctag

SEQ ID NO: 428557 - DNA, 15 bp, Homo sapiens
attagtgagatttgt

SEQ ID NO: 428558 - DNA, 17 bp, Homo sapiens
attagtggaaagtgatt

SEQ ID NO: 428559 - DNA, 23 bp, Homo sapiens
attataaaaagccactagactct

SEQ ID NO: 428560 - DNA, 12 bp, Homo sapiens
attataagcatt

SEQ ID NO: 428561 - DNA, 19 bp, Homo sapiens
attataagctatgtcacta

SEQ ID NO: 428562 - DNA, 13 bp, Homo sapiens
attataaggactg

SEQ ID NO: 428563 - DNA, 14 bp, Homo sapiens
attataagttgacc

SEQ ID NO: 428564 - DNA, 16 bp, Homo sapiens
attataagttgacctt

SEQ ID NO: 428565 - DNA, 16 bp, Homo sapiens
attataataatgttct

SEQ ID NO: 428566 - DNA, 13 bp, Homo sapiens
attataatgcaaa

SEQ ID NO: 428567 - DNA, 22 bp, Homo sapiens
attataatttttttcaatattt

SEQ ID NO: 428568 - DNA, 23 bp, Homo sapiens
attataatttttttcaatattta

SEQ ID NO: 428569 - DNA, 22 bp, Homo sapiens
attatacagacctaatatcatt

SEQ ID NO: 428570 - DNA, 21 bp, Homo sapiens
attatacatgggtagcttctg

SEQ ID NO: 428571 - DNA, 15 bp, Homo sapiens
attataccaagagta

SEQ ID NO: 428572 - DNA, 20 bp, Homo sapiens
attatactgtagctgatgaa

SEQ ID NO: 428573 - DNA, 15 bp, Homo sapiens
attatacttctttat

SEQ ID NO: 428574 - DNA, 13 bp, Homo sapiens
attatagaaatta

SEQ ID NO: 428575 - DNA, 15 bp, Homo sapiens
attatagcatgtaat

SEQ ID NO: 428576 - DNA, 19 bp, Homo sapiens
attataggtaatcaatgaa

SEQ ID NO: 428577 - DNA, 15 bp, Homo sapiens
attatagtttcaagc

SEQ ID NO: 428578 - DNA, 14 bp, Homo sapiens
attatattgagaca

SEQ ID NO: 428579 - DNA, 15 bp, Homo sapiens
attatcaagctaata

SEQ ID NO: 428580 - DNA, 17 bp, Homo sapiens
attatcaagctaataaa

SEQ ID NO: 428581 - DNA, 16 bp, Homo sapiens
attatcagtgaatata

SEQ ID NO: 428582 - DNA, 18 bp, Homo sapiens
attatcagtgaatataaa

SEQ ID NO: 428583 - DNA, 17 bp, Homo sapiens
attatcctgttactgaa

SEQ ID NO: 428584 - DNA, 16 bp, Homo sapiens
attatcggaagcagtg

SEQ ID NO: 428585 - DNA, 16 bp, Homo sapiens
attatcgggaacagtg

SEQ ID NO: 428586 - DNA, 17 bp, Homo sapiens
attatcgggaacagtgt

SEQ ID NO: 428587 - DNA, 18 bp, Homo sapiens
attatcgggaacagtgtt

SEQ ID NO: 428588 - DNA, 19 bp, Homo sapiens
attatcgggagcagtgtct

SEQ ID NO: 428589 - DNA, 20 bp, Homo sapiens
attatcgggagcagtgtctt

SEQ ID NO: 428590 - DNA, 23 bp, Homo sapiens
attatctaaagtgtgttgttgct

SEQ ID NO: 428591 - DNA, 23 bp, Homo sapiens
attatcttctggtgcatgttctt

SEQ ID NO: 428592 - DNA, 19 bp, Homo sapiens
attatcttgaaaaagtatt

SEQ ID NO: 428593 - DNA, 15 bp, Homo sapiens
attatctttaaaact

SEQ ID NO: 428594 - DNA, 18 bp, Homo sapiens
attatcttttggctctga

SEQ ID NO: 428595 - DNA, 14 bp, Homo sapiens
attatgacagttat

SEQ ID NO: 428596 - DNA, 18 bp, Homo sapiens
attatgaggctattaaaa

SEQ ID NO: 428597 - DNA, 12 bp, Homo sapiens
attatgatttta

SEQ ID NO: 428598 - DNA, 18 bp, Homo sapiens
attatgggaacaagtgta

SEQ ID NO: 428599 - DNA, 16 bp, Homo sapiens
attatgggtcacagga

SEQ ID NO: 428600 - DNA, 14 bp, Homo sapiens
attatggtgaaatt

SEQ ID NO: 428601 - DNA, 12 bp, Homo sapiens
attatgtagaaa

SEQ ID NO: 428602 - DNA, 15 bp, Homo sapiens
attatgtagaaatat

SEQ ID NO: 428603 - DNA, 15 bp, Homo sapiens
attatgtataacaag

SEQ ID NO: 428604 - DNA, 16 bp, Homo sapiens
attatgtatgtttaca

SEQ ID NO: 428605 - DNA, 12 bp, Homo sapiens
attatgtgacaa

SEQ ID NO: 428606 - DNA, 20 bp, Homo sapiens
attatgtggcttttatttca

SEQ ID NO: 428607 - DNA, 16 bp, Homo sapiens
attatgttattgaaaa

SEQ ID NO: 428608 - DNA, 19 bp, Homo sapiens
attatgttattgaaaaaaa

SEQ ID NO: 428609 - DNA, 15 bp, Homo sapiens
attattaaaaattat

SEQ ID NO: 428610 - DNA, 18 bp, Homo sapiens
attattaaaaattataga

SEQ ID NO: 428611 - DNA, 15 bp, Homo sapiens
attattaacactaat

SEQ ID NO: 428612 - DNA, 13 bp, Homo sapiens
attattactttaa

SEQ ID NO: 428613 - DNA, 17 bp, Homo sapiens
attattactttaaatta

SEQ ID NO: 428614 - DNA, 14 bp, Homo sapiens
attattacttttta

SEQ ID NO: 428615 - DNA, 13 bp, Homo sapiens
attattagattct

SEQ ID NO: 428616 - DNA, 22 bp, Homo sapiens
attattagccaggtaatgtgaa

SEQ ID NO: 428617 - DNA, 21 bp, Homo sapiens
attattcaagaaagatatcta

SEQ ID NO: 428618 - DNA, 18 bp, Homo sapiens
attattcaccatgtaaaa

SEQ ID NO: 428619 - DNA, 19 bp, Homo sapiens
attattcagaattatacag

SEQ ID NO: 428620 - DNA, 20 bp, Homo sapiens
attattcagaattatacaga

SEQ ID NO: 428621 - DNA, 18 bp, Homo sapiens
attattcagttaagaaaa

SEQ ID NO: 428622 - DNA, 21 bp, Homo sapiens
attattcagttaagaaaaaaa

SEQ ID NO: 428623 - DNA, 13 bp, Homo sapiens
attattcatttaa

SEQ ID NO: 428624 - DNA, 23 bp, Homo sapiens
attattctagtcaactgctgttt

SEQ ID NO: 428625 - DNA, 16 bp, Homo sapiens
attattgaatgttata

SEQ ID NO: 428626 - DNA, 20 bp, Homo sapiens
attattgaatgttatatcat

SEQ ID NO: 428627 - DNA, 14 bp, Homo sapiens
attattggaattaa

SEQ ID NO: 428628 - DNA, 19 bp, Homo sapiens
attattgtaaactttttca

SEQ ID NO: 428629 - DNA, 22 bp, Homo sapiens
attattgtaaactttttcaatg

SEQ ID NO: 428630 - DNA, 21 bp, Homo sapiens
attattgttcccctaagtgga

SEQ ID NO: 428631 - DNA, 13 bp, Homo sapiens
attatttaaagaa

SEQ ID NO: 428632 - DNA, 14 bp, Homo sapiens
attatttaaagaaa

SEQ ID NO: 428633 - DNA, 15 bp, Homo sapiens
attatttattaaatt

SEQ ID NO: 428634 - DNA, 23 bp, Homo sapiens
attatttattcagcttcatttgt

SEQ ID NO: 428635 - DNA, 17 bp, Homo sapiens
attatttatttaataac

SEQ ID NO: 428636 - DNA, 16 bp, Homo sapiens
attatttctccatccc

SEQ ID NO: 428637 - DNA, 17 bp, Homo sapiens
attatttgtgtaataga

SEQ ID NO: 428638 - DNA, 23 bp, Homo sapiens
attatttgtgtaatagaaaactg

SEQ ID NO: 428639 - DNA, 22 bp, Homo sapiens
attatttgttatttgtacagtt

SEQ ID NO: 428640 - DNA, 14 bp, Homo sapiens
attattttaaacaa

SEQ ID NO: 428641 - DNA, 15 bp, Homo sapiens
attattttaaacaaa

SEQ ID NO: 428642 - DNA, 18 bp, Homo sapiens
attattttaaattataag

SEQ ID NO: 428643 - DNA, 22 bp, Homo sapiens
attattttaaattataaggact

SEQ ID NO: 428644 - DNA, 14 bp, Homo sapiens
attattttaatatt

SEQ ID NO: 428645 - DNA, 16 bp, Homo sapiens
attattttgaatgtca

SEQ ID NO: 428646 - DNA, 21 bp, Homo sapiens
attattttgtggttctatttt

SEQ ID NO: 428647 - DNA, 18 bp, Homo sapiens
attattttgttactgtct

SEQ ID NO: 428648 - DNA, 11 bp, Homo sapiens
attatttttgt

SEQ ID NO: 428649 - DNA, 14 bp, Homo sapiens
attatttttgtgtt

SEQ ID NO: 428650 - DNA, 19 bp, Homo sapiens
attcaaaaacatggccaca

SEQ ID NO: 428651 - DNA, 16 bp, Homo sapiens
attcaaaaagtgttta

SEQ ID NO: 428652 - DNA, 16 bp, Homo sapiens
attcaaaatcttcact

SEQ ID NO: 428653 - DNA, 14 bp, Homo sapiens
attcaaagaatcac

SEQ ID NO: 428654 - DNA, 21 bp, Homo sapiens
attcaaagaatcacctaatta

SEQ ID NO: 428655 - DNA, 11 bp, Homo sapiens
attcaaatgca

SEQ ID NO: 428656 - DNA, 15 bp, Homo sapiens
attcaaatgcatgat

SEQ ID NO: 428657 - DNA, 16 bp, Homo sapiens
attcaaatgcatgata

SEQ ID NO: 428658 - DNA, 19 bp, Homo sapiens
attcaacacttattttctg

SEQ ID NO: 428659 - DNA, 18 bp, Homo sapiens
attcaacaggttttcctg

SEQ ID NO: 428660 - DNA, 16 bp, Homo sapiens
attcaaccactgtaaa

SEQ ID NO: 428661 - DNA, 15 bp, Homo sapiens
attcaagaaagatat

SEQ ID NO: 428662 - DNA, 17 bp, Homo sapiens
attcaagaaagatatct

SEQ ID NO: 428663 - DNA, 20 bp, Homo sapiens
attcaagaaagatatctatg

SEQ ID NO: 428664 - DNA, 15 bp, Homo sapiens
attcaagcaaacatc

SEQ ID NO: 428665 - DNA, 17 bp, Homo sapiens
attcaagcaaacatcaa

SEQ ID NO: 428666 - DNA, 19 bp, Homo sapiens
attcaaggagaatatgata

SEQ ID NO: 428667 - DNA, 18 bp, Homo sapiens
attcaatcattttgggaa

SEQ ID NO: 428668 - DNA, 16 bp, Homo sapiens
attcaattcctctggg

SEQ ID NO: 428669 - DNA, 13 bp, Homo sapiens
attcacaagctgc

SEQ ID NO: 428670 - DNA, 20 bp, Homo sapiens
attcacaagctgcctccctg

SEQ ID NO: 428671 - DNA, 19 bp, Homo sapiens
attcacaagttaagattct

SEQ ID NO: 428672 - DNA, 21 bp, Homo sapiens
attcacaagttaagattcttg

SEQ ID NO: 428673 - DNA, 13 bp, Homo sapiens
attcacacacaca

SEQ ID NO: 428674 - DNA, 15 bp, Homo sapiens
attcacacacacaca

SEQ ID NO: 428675 - DNA, 12 bp, Homo sapiens
attcacacacag

SEQ ID NO: 428676 - DNA, 18 bp, Homo sapiens
attcacacacagcctggc

SEQ ID NO: 428677 - DNA, 21 bp, Homo sapiens
attcacatatgtcttactact

SEQ ID NO: 428678 - DNA, 21 bp, Homo sapiens
attcacatttcaagatccaaa

SEQ ID NO: 428679 - DNA, 15 bp, Homo sapiens
attcaccatgtaaaa

SEQ ID NO: 428680 - DNA, 18 bp, Homo sapiens
attcaccatgtaaaacaa

SEQ ID NO: 428681 - DNA, 19 bp, Homo sapiens
attcaccatgtaaaacaaa

SEQ ID NO: 428682 - DNA, 22 bp, Homo sapiens
attcaccatgtaaaacaaaaaa

SEQ ID NO: 428683 - DNA, 13 bp, Homo sapiens
attcacctgtaaa

SEQ ID NO: 428684 - DNA, 23 bp, Homo sapiens
attcaccttccagtgtctcggag

SEQ ID NO: 428685 - DNA, 18 bp, Homo sapiens
attcactcagcatcccca

SEQ ID NO: 428686 - DNA, 20 bp, Homo sapiens
attcactgcccccagctctt

SEQ ID NO: 428687 - DNA, 14 bp, Homo sapiens
attcacttgcattt

SEQ ID NO: 428688 - DNA, 17 bp, Homo sapiens
attcacttgtgtttgta

SEQ ID NO: 428689 - DNA, 15 bp, Homo sapiens
attcacttttattgt

SEQ ID NO: 428690 - DNA, 17 bp, Homo sapiens
attcacttttattgtat

SEQ ID NO: 428691 - DNA, 15 bp, Homo sapiens
attcagaactctcag

SEQ ID NO: 428692 - DNA, 16 bp, Homo sapiens
attcagaactctcaga

SEQ ID NO: 428693 - DNA, 18 bp, Homo sapiens
attcagaactctcagact

SEQ ID NO: 428694 - DNA, 23 bp, Homo sapiens
attcagaatcaaacctttttata

SEQ ID NO: 428695 - DNA, 22 bp, Homo sapiens
attcagaattatacagacctaa

SEQ ID NO: 428696 - DNA, 23 bp, Homo sapiens
attcagaattatacagacctaat

SEQ ID NO: 428697 - DNA, 14 bp, Homo sapiens
attcagagatgtac

SEQ ID NO: 428698 - DNA, 24 bp, Homo sapiens
attcagatttaccataatgttcct

SEQ ID NO: 428699 - DNA, 16 bp, Homo sapiens
attcagcaccctgggt

SEQ ID NO: 428700 - DNA, 18 bp, Homo sapiens
attcagcaccctgggtgc

SEQ ID NO: 428701 - DNA, 14 bp, Homo sapiens
attcagcactgatt

SEQ ID NO: 428702 - DNA, 17 bp, Homo sapiens
attcagcactgatttca

SEQ ID NO: 428703 - DNA, 20 bp, Homo sapiens
attcagcttcatttgtgtca

SEQ ID NO: 428704 - DNA, 19 bp, Homo sapiens
attcaggaacctggaccaa

SEQ ID NO: 428705 - DNA, 15 bp, Homo sapiens
attcaggaccccatc

SEQ ID NO: 428706 - DNA, 21 bp, Homo sapiens
attcaggagagtagaacagat

SEQ ID NO: 428707 - DNA, 22 bp, Homo sapiens
attcaggagagtagaacagata

SEQ ID NO: 428708 - DNA, 14 bp, Homo sapiens
attcaggcacatgt

SEQ ID NO: 428709 - DNA, 11 bp, Homo sapiens
attcaggctgc

SEQ ID NO: 428710 - DNA, 13 bp, Homo sapiens
attcaggctgctt

SEQ ID NO: 428711 - DNA, 19 bp, Homo sapiens
attcagtattaaagggggg

SEQ ID NO: 428712 - DNA, 16 bp, Homo sapiens
attcagttgttagtgt

SEQ ID NO: 428713 - DNA, 20 bp, Homo sapiens
attcagttttagtttcaaaa

SEQ ID NO: 428714 - DNA, 14 bp, Homo sapiens
attcataaaaataa

SEQ ID NO: 428715 - DNA, 15 bp, Homo sapiens
attcataaaaataac

SEQ ID NO: 428716 - DNA, 16 bp, Homo sapiens
attcataaaaataacc

SEQ ID NO: 428717 - DNA, 23 bp, Homo sapiens
attcataacaatgtatgtgaaag

SEQ ID NO: 428718 - DNA, 19 bp, Homo sapiens
attcataatgacttaagca

SEQ ID NO: 428719 - DNA, 15 bp, Homo sapiens
attcatacagcacta

SEQ ID NO: 428720 - DNA, 13 bp, Homo sapiens
attcatactctgt

SEQ ID NO: 428721 - DNA, 17 bp, Homo sapiens
attcatactctgttgcc

SEQ ID NO: 428722 - DNA, 19 bp, Homo sapiens
attcatactctgttgcctc

SEQ ID NO: 428723 - DNA, 22 bp, Homo sapiens
attcatattcctgcctttcttc

SEQ ID NO: 428724 - DNA, 16 bp, Homo sapiens
attcatcaaactcttt

SEQ ID NO: 428725 - DNA, 12 bp, Homo sapiens
attcatcaaata

SEQ ID NO: 428726 - DNA, 18 bp, Homo sapiens
attcatcaaataaacctt

SEQ ID NO: 428727 - DNA, 16 bp, Homo sapiens
attcatcaagctgtac

SEQ ID NO: 428728 - DNA, 16 bp, Homo sapiens
attcatctgggctggc

SEQ ID NO: 428729 - DNA, 22 bp, Homo sapiens
attcatctgggctggcagaggg

SEQ ID NO: 428730 - DNA, 20 bp, Homo sapiens
attcatctttcctttgctct

SEQ ID NO: 428731 - DNA, 22 bp, Homo sapiens
attcatctttcctttgctctgg

SEQ ID NO: 428732 - DNA, 22 bp, Homo sapiens
attcatgagattggtcattaaa

SEQ ID NO: 428733 - DNA, 15 bp, Homo sapiens
attcatgctttctcc

SEQ ID NO: 428734 - DNA, 17 bp, Homo sapiens
attcatgctttctcctt

SEQ ID NO: 428735 - DNA, 17 bp, Homo sapiens
attcatgttttaaaagt

SEQ ID NO: 428736 - DNA, 14 bp, Homo sapiens
attcattacagctt

SEQ ID NO: 428737 - DNA, 18 bp, Homo sapiens
attcattctgtgatcatt

SEQ ID NO: 428738 - DNA, 19 bp, Homo sapiens
attcattctgtgatcattt

SEQ ID NO: 428739 - DNA, 16 bp, Homo sapiens
attcattctttataaa

SEQ ID NO: 428740 - DNA, 23 bp, Homo sapiens
attccaacaatggggtgggccca

SEQ ID NO: 428741 - DNA, 21 bp, Homo sapiens
attccaagtcaacactcttct

SEQ ID NO: 428742 - DNA, 21 bp, Homo sapiens
attccacagagttactgccac

SEQ ID NO: 428743 - DNA, 18 bp, Homo sapiens
attccacccctccttccc

SEQ ID NO: 428744 - DNA, 14 bp, Homo sapiens
attccaccttaaat

SEQ ID NO: 428745 - DNA, 18 bp, Homo sapiens
attccaccttaaattaaa

SEQ ID NO: 428746 - DNA, 19 bp, Homo sapiens
attccaccttaaattaaac

SEQ ID NO: 428747 - DNA, 18 bp, Homo sapiens
attccagagacatcagca

SEQ ID NO: 428748 - DNA, 21 bp, Homo sapiens
attccagagagtggctcctcc

SEQ ID NO: 428749 - DNA, 13 bp, Homo sapiens
attccagagctgt

SEQ ID NO: 428750 - DNA, 23 bp, Homo sapiens
attccagcagtgaaacttgtgct

SEQ ID NO: 428751 - DNA, 12 bp, Homo sapiens
attccagctctg

SEQ ID NO: 428752 - DNA, 16 bp, Homo sapiens
attccagctctgcccc

SEQ ID NO: 428753 - DNA, 18 bp, Homo sapiens
attccagctctgcccccg

SEQ ID NO: 428754 - DNA, 15 bp, Homo sapiens
attccaggagtggga

SEQ ID NO: 428755 - DNA, 20 bp, Homo sapiens
attccaggagtgggattatt

SEQ ID NO: 428756 - DNA, 19 bp, Homo sapiens
attccagtgtattttctgt

SEQ ID NO: 428757 - DNA, 20 bp, Homo sapiens
attccagttgcgtgtctgtt

SEQ ID NO: 428758 - DNA, 18 bp, Homo sapiens
attccatccatatacttt

SEQ ID NO: 428759 - DNA, 22 bp, Homo sapiens
attccatccctaagaattccca

SEQ ID NO: 428760 - DNA, 15 bp, Homo sapiens
attccatgaatgtat

SEQ ID NO: 428761 - DNA, 18 bp, Homo sapiens
attccatgaatgtatcag

SEQ ID NO: 428762 - DNA, 17 bp, Homo sapiens
attccattttatacaag

SEQ ID NO: 428763 - DNA, 20 bp, Homo sapiens
attccattttatacaagaag

SEQ ID NO: 428764 - DNA, 22 bp, Homo sapiens
attccatttttactaaagcagt

SEQ ID NO: 428765 - DNA, 19 bp, Homo sapiens
attcccactaagctttctc

SEQ ID NO: 428766 - DNA, 21 bp, Homo sapiens
attcccactaagctttctcct

SEQ ID NO: 428767 - DNA, 14 bp, Homo sapiens
attcccagaggtgg

SEQ ID NO: 428768 - DNA, 16 bp, Homo sapiens
attcccagaggtgggg

SEQ ID NO: 428769 - DNA, 20 bp, Homo sapiens
attcccatcactgctgtccc

SEQ ID NO: 428770 - DNA, 15 bp, Homo sapiens
attcccatctgtcac

SEQ ID NO: 428771 - DNA, 20 bp, Homo sapiens
attcccatggtagactgtga

SEQ ID NO: 428772 - DNA, 22 bp, Homo sapiens
attcccattgaaaatgtaagta

SEQ ID NO: 428773 - DNA, 15 bp, Homo sapiens
attccccatatttgt

SEQ ID NO: 428774 - DNA, 21 bp, Homo sapiens
attccccatatttgtgttcag

SEQ ID NO: 428775 - DNA, 22 bp, Homo sapiens
attccccatatttgtgttcagt

SEQ ID NO: 428776 - DNA, 21 bp, Homo sapiens
attcccctatctctagaattt

SEQ ID NO: 428777 - DNA, 16 bp, Homo sapiens
attcccggctggactt

SEQ ID NO: 428778 - DNA, 18 bp, Homo sapiens
attcccgggcccttcagt

SEQ ID NO: 428779 - DNA, 12 bp, Homo sapiens
attccctggaga

SEQ ID NO: 428780 - DNA, 20 bp, Homo sapiens
attccctgtaggagtaaaga

SEQ ID NO: 428781 - DNA, 18 bp, Homo sapiens
attcccttcaatgcaaaa

SEQ ID NO: 428782 - DNA, 18 bp, Homo sapiens
attccctttgacttcagc

SEQ ID NO: 428783 - DNA, 16 bp, Homo sapiens
attccctttttaaatg

SEQ ID NO: 428784 - DNA, 23 bp, Homo sapiens
attccctttttaaatgagctttc

SEQ ID NO: 428785 - DNA, 22 bp, Homo sapiens
attccgaaaaaaaaatgttcat

SEQ ID NO: 428786 - DNA, 14 bp, Homo sapiens
attccggccctggc

SEQ ID NO: 428787 - DNA, 13 bp, Homo sapiens
attccgttaggaa

SEQ ID NO: 428788 - DNA, 23 bp, Homo sapiens
attccgttaggaataacactgca

SEQ ID NO: 428789 - DNA, 14 bp, Homo sapiens
attccgtttacatt

SEQ ID NO: 428790 - DNA, 20 bp, Homo sapiens
attcctaagcagtgcttgta

SEQ ID NO: 428791 - DNA, 13 bp, Homo sapiens
attcctacttaaa

SEQ ID NO: 428792 - DNA, 14 bp, Homo sapiens
attcctacttaaac

SEQ ID NO: 428793 - DNA, 15 bp, Homo sapiens
attcctagataaaaa

SEQ ID NO: 428794 - DNA, 21 bp, Homo sapiens
attcctagataaaaagatggc

SEQ ID NO: 428795 - DNA, 13 bp, Homo sapiens
attcctcagctgc

SEQ ID NO: 428796 - DNA, 18 bp, Homo sapiens
attcctcatgaatgtaaa

SEQ ID NO: 428797 - DNA, 23 bp, Homo sapiens
attcctcatgaatgtaaatttgt

SEQ ID NO: 428798 - DNA, 18 bp, Homo sapiens
attcctcatttgttcatt

SEQ ID NO: 428799 - DNA, 23 bp, Homo sapiens
attcctcatttgttcattaaacg

SEQ ID NO: 428800 - DNA, 12 bp, Homo sapiens
attcctcctgtc

SEQ ID NO: 428801 - DNA, 13 bp, Homo sapiens
attcctctgggaa

SEQ ID NO: 428802 - DNA, 13 bp, Homo sapiens
attcctctgtatt

SEQ ID NO: 428803 - DNA, 13 bp, Homo sapiens
attcctcttttta

SEQ ID NO: 428804 - DNA, 17 bp, Homo sapiens
attcctgagattctggg

SEQ ID NO: 428805 - DNA, 18 bp, Homo sapiens
attcctgagattctggga

SEQ ID NO: 428806 - DNA, 20 bp, Homo sapiens
attcctgagattctgggaaa

SEQ ID NO: 428807 - DNA, 19 bp, Homo sapiens
attcctgatactgggtaca

SEQ ID NO: 428808 - DNA, 13 bp, Homo sapiens
attcctgcagcct

SEQ ID NO: 428809 - DNA, 20 bp, Homo sapiens
attccttagcagctcaggcg

SEQ ID NO: 428810 - DNA, 18 bp, Homo sapiens
attccttcctgttctgaa

SEQ ID NO: 428811 - DNA, 17 bp, Homo sapiens
attccttggagccactg

SEQ ID NO: 428812 - DNA, 13 bp, Homo sapiens
attccttggccca

SEQ ID NO: 428813 - DNA, 16 bp, Homo sapiens
attccttggcccagca

SEQ ID NO: 428814 - DNA, 17 bp, Homo sapiens
attccttgtcaccagca

SEQ ID NO: 428815 - DNA, 12 bp, Homo sapiens
attccttgtgaa

SEQ ID NO: 428816 - DNA, 18 bp, Homo sapiens
attcctttaaattctcca

SEQ ID NO: 428817 - DNA, 18 bp, Homo sapiens
attcctttcctgatcact

SEQ ID NO: 428818 - DNA, 14 bp, Homo sapiens
attcctttctttaa

SEQ ID NO: 428819 - DNA, 22 bp, Homo sapiens
attccttttataagatttaatt

SEQ ID NO: 428820 - DNA, 19 bp, Homo sapiens
attcgaggtgtcaccctgc

SEQ ID NO: 428821 - DNA, 21 bp, Homo sapiens
attcgcccaaagccagacagc

SEQ ID NO: 428822 - DNA, 20 bp, Homo sapiens
attcgtgcatttttggatca

SEQ ID NO: 428823 - DNA, 23 bp, Homo sapiens
attcgtggtgatcaattaaatgt

SEQ ID NO: 428824 - DNA, 15 bp, Homo sapiens
attctaaaacattct

SEQ ID NO: 428825 - DNA, 18 bp, Homo sapiens
attctaaaacattcttta

SEQ ID NO: 428826 - DNA, 15 bp, Homo sapiens
attctaaacagatgt

SEQ ID NO: 428827 - DNA, 20 bp, Homo sapiens
attctaaacagatgtccctg

SEQ ID NO: 428828 - DNA, 15 bp, Homo sapiens
attctaaatgaatgt

SEQ ID NO: 428829 - DNA, 17 bp, Homo sapiens
attctaaatttttactt

SEQ ID NO: 428830 - DNA, 23 bp, Homo sapiens
attctaagccagttttcattttg

SEQ ID NO: 428831 - DNA, 19 bp, Homo sapiens
attctaagttatttacttt

SEQ ID NO: 428832 - DNA, 13 bp, Homo sapiens
attctacacctgg

SEQ ID NO: 428833 - DNA, 17 bp, Homo sapiens
attctacacctggacca

SEQ ID NO: 428834 - DNA, 14 bp, Homo sapiens
attctactcttgtc

SEQ ID NO: 428835 - DNA, 16 bp, Homo sapiens
attctactcttgtcat

SEQ ID NO: 428836 - DNA, 17 bp, Homo sapiens
attctacttcagctttg

SEQ ID NO: 428837 - DNA, 13 bp, Homo sapiens
attctactttgag

SEQ ID NO: 428838 - DNA, 17 bp, Homo sapiens
attctagatcagagagc

SEQ ID NO: 428839 - DNA, 17 bp, Homo sapiens
attctagatcctgcacc

SEQ ID NO: 428840 - DNA, 15 bp, Homo sapiens
attctagctaatgta

SEQ ID NO: 428841 - DNA, 15 bp, Homo sapiens
attctagtcaactgc

SEQ ID NO: 428842 - DNA, 20 bp, Homo sapiens
attctagtcaactgctgttt

SEQ ID NO: 428843 - DNA, 17 bp, Homo sapiens
attctagtctctgattt

SEQ ID NO: 428844 - DNA, 21 bp, Homo sapiens
attctagtctctgatttgcaa

SEQ ID NO: 428845 - DNA, 16 bp, Homo sapiens
attctagttttgtcaa

SEQ ID NO: 428846 - DNA, 22 bp, Homo sapiens
attctataaacatatgcaaaca

SEQ ID NO: 428847 - DNA, 15 bp, Homo sapiens
attctataaattcaa

SEQ ID NO: 428848 - DNA, 17 bp, Homo sapiens
attctataaattcaaca

SEQ ID NO: 428849 - DNA, 13 bp, Homo sapiens
attctatatgaat

SEQ ID NO: 428850 - DNA, 14 bp, Homo sapiens
attctatatgaatt

SEQ ID NO: 428851 - DNA, 14 bp, Homo sapiens
attctatatttcat

SEQ ID NO: 428852 - DNA, 15 bp, Homo sapiens
attctatatttcata

SEQ ID NO: 428853 - DNA, 17 bp, Homo sapiens
attctatatttcatatt

SEQ ID NO: 428854 - DNA, 15 bp, Homo sapiens
attctatgagaacaa

SEQ ID NO: 428855 - DNA, 20 bp, Homo sapiens
attctatgcctgtatttcca

SEQ ID NO: 428856 - DNA, 15 bp, Homo sapiens
attctattaaaagcc

SEQ ID NO: 428857 - DNA, 14 bp, Homo sapiens
attctattaacttt

SEQ ID NO: 428858 - DNA, 19 bp, Homo sapiens
attctcactctgctttgca

SEQ ID NO: 428859 - DNA, 19 bp, Homo sapiens
attctcagaagtgaaaaag

SEQ ID NO: 428860 - DNA, 17 bp, Homo sapiens
attctcagagcatgtgt

SEQ ID NO: 428861 - DNA, 23 bp, Homo sapiens
attctcagatatttatattttta

SEQ ID NO: 428862 - DNA, 23 bp, Homo sapiens
attctcatgcactgcaaatactt

SEQ ID NO: 428863 - DNA, 22 bp, Homo sapiens
attctcatgcctcatcctccca

SEQ ID NO: 428864 - DNA, 14 bp, Homo sapiens
attctcattatttc

SEQ ID NO: 428865 - DNA, 15 bp, Homo sapiens
attctcattatttca

SEQ ID NO: 428866 - DNA, 14 bp, Homo sapiens
attctccaaatgat

SEQ ID NO: 428867 - DNA, 15 bp, Homo sapiens
attctccaaatgatt

SEQ ID NO: 428868 - DNA, 11 bp, Homo sapiens
attctcctctc

SEQ ID NO: 428869 - DNA, 13 bp, Homo sapiens
attctcctgtgct

SEQ ID NO: 428870 - DNA, 17 bp, Homo sapiens
attctctctaaaaataa

SEQ ID NO: 428871 - DNA, 22 bp, Homo sapiens
attctctctaaaaataaaatga

SEQ ID NO: 428872 - DNA, 16 bp, Homo sapiens
attctctgcaatttgt

SEQ ID NO: 428873 - DNA, 20 bp, Homo sapiens
attctctgtccagggcttca

SEQ ID NO: 428874 - DNA, 21 bp, Homo sapiens
attctctgtccagggcttcag

SEQ ID NO: 428875 - DNA, 12 bp, Homo sapiens
attctcttcgct

SEQ ID NO: 428876 - DNA, 18 bp, Homo sapiens
attctcttcgctgtgatg

SEQ ID NO: 428877 - DNA, 22 bp, Homo sapiens
attctgaagtttcctatgacta

SEQ ID NO: 428878 - DNA, 23 bp, Homo sapiens
attctgagcacgggcaaagaaaa

SEQ ID NO: 428879 - DNA, 17 bp, Homo sapiens
attctgataatgtattg

SEQ ID NO: 428880 - DNA, 16 bp, Homo sapiens
attctgatacagcctt

SEQ ID NO: 428881 - DNA, 17 bp, Homo sapiens
attctgatacagcctta

SEQ ID NO: 428882 - DNA, 13 bp, Homo sapiens
attctgctgcccc

SEQ ID NO: 428883 - DNA, 16 bp, Homo sapiens
attctgctgcccccag

SEQ ID NO: 428884 - DNA, 12 bp, Homo sapiens
attctgctgctt

SEQ ID NO: 428885 - DNA, 22 bp, Homo sapiens
attctgctttcttgccacacag

SEQ ID NO: 428886 - DNA, 19 bp, Homo sapiens
attctggctgataaaagat

SEQ ID NO: 428887 - DNA, 21 bp, Homo sapiens
attctgggaaaggtgctcaaa

SEQ ID NO: 428888 - DNA, 22 bp, Homo sapiens
attctgggaaaggtgctcaaag

SEQ ID NO: 428889 - DNA, 22 bp, Homo sapiens
attctgggaagcttgagcctcc

SEQ ID NO: 428890 - DNA, 15 bp, Homo sapiens
attctgggaagggag

SEQ ID NO: 428891 - DNA, 21 bp, Homo sapiens
attctgggctcctggaaccaa

SEQ ID NO: 428892 - DNA, 12 bp, Homo sapiens
attctgtaaatg

SEQ ID NO: 428893 - DNA, 17 bp, Homo sapiens
attctgtcaatgaaaag

SEQ ID NO: 428894 - DNA, 16 bp, Homo sapiens
attctgtccctgtccc

SEQ ID NO: 428895 - DNA, 20 bp, Homo sapiens
attctgtcttccaggcccag

SEQ ID NO: 428896 - DNA, 17 bp, Homo sapiens
attctgtggattctata

SEQ ID NO: 428897 - DNA, 23 bp, Homo sapiens
attctgtgtgttttcataataaa

SEQ ID NO: 428898 - DNA, 19 bp, Homo sapiens
attctgttaaaatcaggat

SEQ ID NO: 428899 - DNA, 19 bp, Homo sapiens
attctgttctacttgatat

SEQ ID NO: 428900 - DNA, 21 bp, Homo sapiens
attctgttgggcaacaattgt

SEQ ID NO: 428901 - DNA, 20 bp, Homo sapiens
attcttaaaattcaagaaaa

SEQ ID NO: 428902 - DNA, 22 bp, Homo sapiens
attcttaagcactttgaaaata

SEQ ID NO: 428903 - DNA, 19 bp, Homo sapiens
attcttacaattgcactgc

SEQ ID NO: 428904 - DNA, 16 bp, Homo sapiens
attcttatttttccta

SEQ ID NO: 428905 - DNA, 21 bp, Homo sapiens
attcttcggaggaggtggaca

SEQ ID NO: 428906 - DNA, 19 bp, Homo sapiens
attcttcttcttttatgta

SEQ ID NO: 428907 - DNA, 12 bp, Homo sapiens
attcttgatgta

SEQ ID NO: 428908 - DNA, 18 bp, Homo sapiens
attcttgatgtaaaatct

SEQ ID NO: 428909 - DNA, 21 bp, Homo sapiens
attcttgattttcaagctttc

SEQ ID NO: 428910 - DNA, 14 bp, Homo sapiens
attcttgcactgta

SEQ ID NO: 428911 - DNA, 12 bp, Homo sapiens
attcttgctggg

SEQ ID NO: 428912 - DNA, 20 bp, Homo sapiens
attcttgctgggcatacttt

SEQ ID NO: 428913 - DNA, 19 bp, Homo sapiens
attcttgctttcacaaata

SEQ ID NO: 428914 - DNA, 19 bp, Homo sapiens
attctttacaaaatgaatg

SEQ ID NO: 428915 - DNA, 21 bp, Homo sapiens
attctttcaatccacagtatt

SEQ ID NO: 428916 - DNA, 14 bp, Homo sapiens
attctttccatgca

SEQ ID NO: 428917 - DNA, 21 bp, Homo sapiens
attctttccattatgattctt

SEQ ID NO: 428918 - DNA, 13 bp, Homo sapiens
attctttccccag

SEQ ID NO: 428919 - DNA, 14 bp, Homo sapiens
attctttccccaga

SEQ ID NO: 428920 - DNA, 15 bp, Homo sapiens
attctttctgataac

SEQ ID NO: 428921 - DNA, 14 bp, Homo sapiens
attctttcttcctc

SEQ ID NO: 428922 - DNA, 19 bp, Homo sapiens
attctttcttcctccagtc

SEQ ID NO: 428923 - DNA, 13 bp, Homo sapiens
attctttgagaag

SEQ ID NO: 428924 - DNA, 19 bp, Homo sapiens
attctttgggcgttggtca

SEQ ID NO: 428925 - DNA, 18 bp, Homo sapiens
attctttgtatcttaaat

SEQ ID NO: 428926 - DNA, 18 bp, Homo sapiens
attctttgtttcctcttt

SEQ ID NO: 428927 - DNA, 16 bp, Homo sapiens
attcttttaaatgggt

SEQ ID NO: 428928 - DNA, 21 bp, Homo sapiens
attcttttcagcttgtttcta

SEQ ID NO: 428929 - DNA, 20 bp, Homo sapiens
attcttttccagaaagaaaa

SEQ ID NO: 428930 - DNA, 22 bp, Homo sapiens
attgaaaaaaattggcattaaa

SEQ ID NO: 428931 - DNA, 13 bp, Homo sapiens
attgaaaacttca

SEQ ID NO: 428932 - DNA, 22 bp, Homo sapiens
attgaaaagaagaaagtctatg

SEQ ID NO: 428933 - DNA, 18 bp, Homo sapiens
attgaaagagaaccagtt

SEQ ID NO: 428934 - DNA, 20 bp, Homo sapiens
attgaaagtggggtgttgaa

SEQ ID NO: 428935 - DNA, 22 bp, Homo sapiens
attgaaagtttttaatatttat

SEQ ID NO: 428936 - DNA, 19 bp, Homo sapiens
attgaaattatagtttcaa

SEQ ID NO: 428937 - DNA, 12 bp, Homo sapiens
attgaacacagg

SEQ ID NO: 428938 - DNA, 15 bp, Homo sapiens
attgaacacaggcaa

SEQ ID NO: 428939 - DNA, 18 bp, Homo sapiens
attgaaccagctcatctc

SEQ ID NO: 428940 - DNA, 23 bp, Homo sapiens
attgaaccagctcatctccaagg

SEQ ID NO: 428941 - DNA, 15 bp, Homo sapiens
attgaagccctccaa

SEQ ID NO: 428942 - DNA, 16 bp, Homo sapiens
attgaagtaatgaatt

SEQ ID NO: 428943 - DNA, 18 bp, Homo sapiens
attgaagtatctgtacct

SEQ ID NO: 428944 - DNA, 22 bp, Homo sapiens
attgaattattttgttactgtc

SEQ ID NO: 428945 - DNA, 11 bp, Homo sapiens
attgaatttag

SEQ ID NO: 428946 - DNA, 20 bp, Homo sapiens
attgacaacattttattacc

SEQ ID NO: 428947 - DNA, 20 bp, Homo sapiens
attgacaactgaagagacac

SEQ ID NO: 428948 - DNA, 10 bp, Homo sapiens
attgacattt

SEQ ID NO: 428949 - DNA, 18 bp, Homo sapiens
attgacattttgtagcta

SEQ ID NO: 428950 - DNA, 14 bp, Homo sapiens
attgaccaagaact

SEQ ID NO: 428951 - DNA, 15 bp, Homo sapiens
attgaccaagaactg

SEQ ID NO: 428952 - DNA, 21 bp, Homo sapiens
attgacctcagctgcacattc

SEQ ID NO: 428953 - DNA, 22 bp, Homo sapiens
attgactcaaatctccagtatt

SEQ ID NO: 428954 - DNA, 16 bp, Homo sapiens
attgacttcagcaggg

SEQ ID NO: 428955 - DNA, 15 bp, Homo sapiens
attgagacactgtca

SEQ ID NO: 428956 - DNA, 22 bp, Homo sapiens
attgagagatgttttgttgata

SEQ ID NO: 428957 - DNA, 22 bp, Homo sapiens
attgagatgtaattcagattag

SEQ ID NO: 428958 - DNA, 19 bp, Homo sapiens
attgagattagagggaggt

SEQ ID NO: 428959 - DNA, 14 bp, Homo sapiens
attgagggaaaaca

SEQ ID NO: 428960 - DNA, 17 bp, Homo sapiens
attgagggaaaacataa

SEQ ID NO: 428961 - DNA, 22 bp, Homo sapiens
attgagggaaaacataatatct

SEQ ID NO: 428962 - DNA, 13 bp, Homo sapiens
attgatagaataa

SEQ ID NO: 428963 - DNA, 21 bp, Homo sapiens
attgatatacacggatgactt

SEQ ID NO: 428964 - DNA, 20 bp, Homo sapiens
attgatcacagatgtgccca

SEQ ID NO: 428965 - DNA, 21 bp, Homo sapiens
attgatcacagatgtgcccag

SEQ ID NO: 428966 - DNA, 20 bp, Homo sapiens
attgatcattttccccccac

SEQ ID NO: 428967 - DNA, 21 bp, Homo sapiens
attgatgaaaagatttaagca

SEQ ID NO: 428968 - DNA, 22 bp, Homo sapiens
attgatgtacagtctgtcatga

SEQ ID NO: 428969 - DNA, 14 bp, Homo sapiens
attgatgtatatgt

SEQ ID NO: 428970 - DNA, 19 bp, Homo sapiens
attgatgtgtttatttata

SEQ ID NO: 428971 - DNA, 14 bp, Homo sapiens
attgattaaaagca

SEQ ID NO: 428972 - DNA, 15 bp, Homo sapiens
attgattaaactgta

SEQ ID NO: 428973 - DNA, 15 bp, Homo sapiens
attgattgaaaaaag

SEQ ID NO: 428974 - DNA, 13 bp, Homo sapiens
attgatttttaaa

SEQ ID NO: 428975 - DNA, 20 bp, Homo sapiens
attgcaaaaggttaagccat

SEQ ID NO: 428976 - DNA, 21 bp, Homo sapiens
attgcacattgttgttttttt

SEQ ID NO: 428977 - DNA, 15 bp, Homo sapiens
attgcacgtggcctc

SEQ ID NO: 428978 - DNA, 16 bp, Homo sapiens
attgcacgtggcctct

SEQ ID NO: 428979 - DNA, 14 bp, Homo sapiens
attgcactaaaagt

SEQ ID NO: 428980 - DNA, 16 bp, Homo sapiens
attgcactaaaagtga

SEQ ID NO: 428981 - DNA, 17 bp, Homo sapiens
attgcactgctgttcct

SEQ ID NO: 428982 - DNA, 16 bp, Homo sapiens
attgcagatgccaaaa

SEQ ID NO: 428983 - DNA, 15 bp, Homo sapiens
attgcaggccagtgg

SEQ ID NO: 428984 - DNA, 19 bp, Homo sapiens
attgcataagtggacccag

SEQ ID NO: 428985 - DNA, 16 bp, Homo sapiens
attgcatgctgcttta

SEQ ID NO: 428986 - DNA, 20 bp, Homo sapiens
attgcatgctgctttaattg

SEQ ID NO: 428987 - DNA, 16 bp, Homo sapiens
attgcatttcctgaca

SEQ ID NO: 428988 - DNA, 17 bp, Homo sapiens
attgcatttttaccttt

SEQ ID NO: 428989 - DNA, 19 bp, Homo sapiens
attgcattttttaaaacaa

SEQ ID NO: 428990 - DNA, 15 bp, Homo sapiens
attgccaaattgaca

SEQ ID NO: 428991 - DNA, 14 bp, Homo sapiens
attgccaccaggag

SEQ ID NO: 428992 - DNA, 21 bp, Homo sapiens
attgccaccaggagaaccact

SEQ ID NO: 428993 - DNA, 17 bp, Homo sapiens
attgccacctctggcca

SEQ ID NO: 428994 - DNA, 21 bp, Homo sapiens
attgccacctctggccaaata

SEQ ID NO: 428995 - DNA, 18 bp, Homo sapiens
attgccaggaatgtttca

SEQ ID NO: 428996 - DNA, 20 bp, Homo sapiens
attgccagtatataagctgt

SEQ ID NO: 428997 - DNA, 21 bp, Homo sapiens
attgccagtatataagctgtt

SEQ ID NO: 428998 - DNA, 23 bp, Homo sapiens
attgccatcgggtgccaaataaa

SEQ ID NO: 428999 - DNA, 19 bp, Homo sapiens
attgccatttcttcccaag

SEQ ID NO: 429000 - DNA, 21 bp, Homo sapiens
attgcccacacctgcctctga

SEQ ID NO: 429001 - DNA, 13 bp, Homo sapiens
attgcctcccttc

SEQ ID NO: 429002 - DNA, 17 bp, Homo sapiens
attgcctcccttcctcc

SEQ ID NO: 429003 - DNA, 17 bp, Homo sapiens
attgcctgggcagtgcc

SEQ ID NO: 429004 - DNA, 20 bp, Homo sapiens
attgccttcctaccctctct

SEQ ID NO: 429005 - DNA, 18 bp, Homo sapiens
attgccttgagcttttca

SEQ ID NO: 429006 - DNA, 21 bp, Homo sapiens
attgcctttagaaactgagtc

SEQ ID NO: 429007 - DNA, 16 bp, Homo sapiens
attgcctttgtagtta

SEQ ID NO: 429008 - DNA, 21 bp, Homo sapiens
attgctaatcaccaaaggctc

SEQ ID NO: 429009 - DNA, 20 bp, Homo sapiens
attgctacacttacaagtaa

SEQ ID NO: 429010 - DNA, 18 bp, Homo sapiens
attgctagccagcattcc

SEQ ID NO: 429011 - DNA, 22 bp, Homo sapiens
attgctagccagcattccatat

SEQ ID NO: 429012 - DNA, 19 bp, Homo sapiens
attgctattactagtacta

SEQ ID NO: 429013 - DNA, 17 bp, Homo sapiens
attgctcataatctggt

SEQ ID NO: 429014 - DNA, 16 bp, Homo sapiens
attgctcccagtgcca

SEQ ID NO: 429015 - DNA, 16 bp, Homo sapiens
attgctccctaagact

SEQ ID NO: 429016 - DNA, 13 bp, Homo sapiens
attgctgagatgt

SEQ ID NO: 429017 - DNA, 23 bp, Homo sapiens
attgctgagatgtttagtagctg

SEQ ID NO: 429018 - DNA, 19 bp, Homo sapiens
attgcttacatttttacaa

SEQ ID NO: 429019 - DNA, 14 bp, Homo sapiens
attgcttctctaaa

SEQ ID NO: 429020 - DNA, 17 bp, Homo sapiens
attgcttggactaccta

SEQ ID NO: 429021 - DNA, 18 bp, Homo sapiens
attgctttcgtgtaaatt

SEQ ID NO: 429022 - DNA, 23 bp, Homo sapiens
attgctttgaagcagttgtgtca

SEQ ID NO: 429023 - DNA, 19 bp, Homo sapiens
attgcttttggacaaggaa

SEQ ID NO: 429024 - DNA, 22 bp, Homo sapiens
attggaaagacaggaagaccaa

SEQ ID NO: 429025 - DNA, 21 bp, Homo sapiens
attggaagtgttcaagaaata

SEQ ID NO: 429026 - DNA, 17 bp, Homo sapiens
attggacattttcttca

SEQ ID NO: 429027 - DNA, 17 bp, Homo sapiens
attggagccaccatgcc

SEQ ID NO: 429028 - DNA, 15 bp, Homo sapiens
attggataacaccac

SEQ ID NO: 429029 - DNA, 18 bp, Homo sapiens
attggattattcatttaa

SEQ ID NO: 429030 - DNA, 19 bp, Homo sapiens
attggattattcatttaaa

SEQ ID NO: 429031 - DNA, 22 bp, Homo sapiens
attggattattcatttaaaatg

SEQ ID NO: 429032 - DNA, 16 bp, Homo sapiens
attggcagcttcaaaa

SEQ ID NO: 429033 - DNA, 23 bp, Homo sapiens
attggcatctctccccatatata

SEQ ID NO: 429034 - DNA, 14 bp, Homo sapiens
attggcatggcttt

SEQ ID NO: 429035 - DNA, 20 bp, Homo sapiens
attggccactgggtctcact

SEQ ID NO: 429036 - DNA, 18 bp, Homo sapiens
attggctccaattcataa

SEQ ID NO: 429037 - DNA, 14 bp, Homo sapiens
attggctcctttcc

SEQ ID NO: 429038 - DNA, 23 bp, Homo sapiens
attggctttaaacacccttcaca

SEQ ID NO: 429039 - DNA, 22 bp, Homo sapiens
attggctttttaaattttccat

SEQ ID NO: 429040 - DNA, 13 bp, Homo sapiens
attgggagtagga

SEQ ID NO: 429041 - DNA, 18 bp, Homo sapiens
attgggcaagtgattgaa

SEQ ID NO: 429042 - DNA, 18 bp, Homo sapiens
attggggcctcacccaga

SEQ ID NO: 429043 - DNA, 12 bp, Homo sapiens
attggggttatt

SEQ ID NO: 429044 - DNA, 14 bp, Homo sapiens
attggggttatttt

SEQ ID NO: 429045 - DNA, 18 bp, Homo sapiens
attggggtttctggttgg

SEQ ID NO: 429046 - DNA, 23 bp, Homo sapiens
attggggtttctggttggaggcc

SEQ ID NO: 429047 - DNA, 18 bp, Homo sapiens
attgggtgggtaaattca

SEQ ID NO: 429048 - DNA, 16 bp, Homo sapiens
attgggtgtgccctgg

SEQ ID NO: 429049 - DNA, 19 bp, Homo sapiens
attgggtgtgccctggctc

SEQ ID NO: 429050 - DNA, 15 bp, Homo sapiens
attggtaccagagcc

SEQ ID NO: 429051 - DNA, 18 bp, Homo sapiens
attggtattcactaatct

SEQ ID NO: 429052 - DNA, 23 bp, Homo sapiens
attggtccaacagtttgatgctg

SEQ ID NO: 429053 - DNA, 13 bp, Homo sapiens
attggtgataagt

SEQ ID NO: 429054 - DNA, 16 bp, Homo sapiens
attggtgataagtgga

SEQ ID NO: 429055 - DNA, 19 bp, Homo sapiens
attggtgataagtggaaaa

SEQ ID NO: 429056 - DNA, 12 bp, Homo sapiens
attggtgtatat

SEQ ID NO: 429057 - DNA, 18 bp, Homo sapiens
attggtgtatatcatgaa

SEQ ID NO: 429058 - DNA, 21 bp, Homo sapiens
attggtgtgaatgctgtacct

SEQ ID NO: 429059 - DNA, 17 bp, Homo sapiens
attggttaatctggact

SEQ ID NO: 429060 - DNA, 16 bp, Homo sapiens
attggttccctttgct

SEQ ID NO: 429061 - DNA, 18 bp, Homo sapiens
attggttgggggctcctg

SEQ ID NO: 429062 - DNA, 20 bp, Homo sapiens
attgtaaaacctgtcaatga

SEQ ID NO: 429063 - DNA, 19 bp, Homo sapiens
attgtaaaatagcttgtat

SEQ ID NO: 429064 - DNA, 15 bp, Homo sapiens
attgtaaacatgtgt

SEQ ID NO: 429065 - DNA, 16 bp, Homo sapiens
attgtaaacatgtgtt

SEQ ID NO: 429066 - DNA, 19 bp, Homo sapiens
attgtaaaggtaggtgcat

SEQ ID NO: 429067 - DNA, 15 bp, Homo sapiens
attgtaaatacaagt

SEQ ID NO: 429068 - DNA, 15 bp, Homo sapiens
attgtaaatgtttaa

SEQ ID NO: 429069 - DNA, 18 bp, Homo sapiens
attgtaaatgtttaatat

SEQ ID NO: 429070 - DNA, 10 bp, Homo sapiens
attgtaactc

SEQ ID NO: 429071 - DNA, 16 bp, Homo sapiens
attgtaacttatttca

SEQ ID NO: 429072 - DNA, 15 bp, Homo sapiens
attgtaatgttactg

SEQ ID NO: 429073 - DNA, 17 bp, Homo sapiens
attgtaatgttactgat

SEQ ID NO: 429074 - DNA, 20 bp, Homo sapiens
attgtacagaatcattgctt

SEQ ID NO: 429075 - DNA, 14 bp, Homo sapiens
attgtacagctgtt

SEQ ID NO: 429076 - DNA, 19 bp, Homo sapiens
attgtagaaacacagtttt

SEQ ID NO: 429077 - DNA, 18 bp, Homo sapiens
attgtagcatttcttgat

SEQ ID NO: 429078 - DNA, 19 bp, Homo sapiens
attgtagggttattagtcc

SEQ ID NO: 429079 - DNA, 17 bp, Homo sapiens
attgtataaactatcag

SEQ ID NO: 429080 - DNA, 21 bp, Homo sapiens
attgtatagagatatgcagaa

SEQ ID NO: 429081 - DNA, 16 bp, Homo sapiens
attgtataggccatct

SEQ ID NO: 429082 - DNA, 16 bp, Homo sapiens
attgtatatatggata

SEQ ID NO: 429083 - DNA, 18 bp, Homo sapiens
attgtatctagtgcagct

SEQ ID NO: 429084 - DNA, 13 bp, Homo sapiens
attgtatcttcat

SEQ ID NO: 429085 - DNA, 23 bp, Homo sapiens
attgtattaggtgtcatttccat

SEQ ID NO: 429086 - DNA, 12 bp, Homo sapiens
attgtattgtct

SEQ ID NO: 429087 - DNA, 19 bp, Homo sapiens
attgtattttactttgtgc

SEQ ID NO: 429088 - DNA, 21 bp, Homo sapiens
attgtattttactttgtgcaa

SEQ ID NO: 429089 - DNA, 19 bp, Homo sapiens
attgtcaaaaaccagaatt

SEQ ID NO: 429090 - DNA, 20 bp, Homo sapiens
attgtccatatcagacctct

SEQ ID NO: 429091 - DNA, 21 bp, Homo sapiens
attgtccatatcagacctctg

SEQ ID NO: 429092 - DNA, 23 bp, Homo sapiens
attgtccatgcctacagataatt

SEQ ID NO: 429093 - DNA, 13 bp, Homo sapiens
attgtccttcaga

SEQ ID NO: 429094 - DNA, 14 bp, Homo sapiens
attgtccttcagag

SEQ ID NO: 429095 - DNA, 17 bp, Homo sapiens
attgtccttcagagctc

SEQ ID NO: 429096 - DNA, 18 bp, Homo sapiens
attgtccttcagagctct

SEQ ID NO: 429097 - DNA, 20 bp, Homo sapiens
attgtctcattgccagtggt

SEQ ID NO: 429098 - DNA, 20 bp, Homo sapiens
attgtgaaatttgttaatat

SEQ ID NO: 429099 - DNA, 14 bp, Homo sapiens
attgtgaactcatt

SEQ ID NO: 429100 - DNA, 15 bp, Homo sapiens
attgtgaactcattg

SEQ ID NO: 429101 - DNA, 15 bp, Homo sapiens
attgtgaagtacata

SEQ ID NO: 429102 - DNA, 23 bp, Homo sapiens
attgtgatcagaccataatgtta

SEQ ID NO: 429103 - DNA, 22 bp, Homo sapiens
attgtgctggtcatacatttgt

SEQ ID NO: 429104 - DNA, 14 bp, Homo sapiens
attgtggagaggag

SEQ ID NO: 429105 - DNA, 12 bp, Homo sapiens
attgtggctcct

SEQ ID NO: 429106 - DNA, 13 bp, Homo sapiens
attgtggctttat

SEQ ID NO: 429107 - DNA, 14 bp, Homo sapiens
attgtggtgtctta

SEQ ID NO: 429108 - DNA, 24 bp, Homo sapiens
attgtgtaaattcctgttgtctga

SEQ ID NO: 429109 - DNA, 23 bp, Homo sapiens
attgtgtaacaattttaatgcta

SEQ ID NO: 429110 - DNA, 14 bp, Homo sapiens
attgtgtacaaagt

SEQ ID NO: 429111 - DNA, 15 bp, Homo sapiens
attgtgtatattcat

SEQ ID NO: 429112 - DNA, 21 bp, Homo sapiens
attgttaagtctaaatatttc

SEQ ID NO: 429113 - DNA, 22 bp, Homo sapiens
attgttaagtctaaatatttcc

SEQ ID NO: 429114 - DNA, 17 bp, Homo sapiens
attgttaatttttccta

SEQ ID NO: 429115 - DNA, 16 bp, Homo sapiens
attgttagtctcttga

SEQ ID NO: 429116 - DNA, 15 bp, Homo sapiens
attgttccaagacat

SEQ ID NO: 429117 - DNA, 17 bp, Homo sapiens
attgttccaagacattg

SEQ ID NO: 429118 - DNA, 19 bp, Homo sapiens
attgttcccagtgacactt

SEQ ID NO: 429119 - DNA, 13 bp, Homo sapiens
attgttcctcttt

SEQ ID NO: 429120 - DNA, 21 bp, Homo sapiens
attgttgaggtggtctgaatg

SEQ ID NO: 429121 - DNA, 17 bp, Homo sapiens
attgttgtttttttaat

SEQ ID NO: 429122 - DNA, 14 bp, Homo sapiens
attgtttaaaagca

SEQ ID NO: 429123 - DNA, 15 bp, Homo sapiens
attgtttatttatca

SEQ ID NO: 429124 - DNA, 14 bp, Homo sapiens
attgtttgcttatt

SEQ ID NO: 429125 - DNA, 16 bp, Homo sapiens
attgtttgcttattgt

SEQ ID NO: 429126 - DNA, 22 bp, Homo sapiens
attgtttgcttattgttccaag

SEQ ID NO: 429127 - DNA, 13 bp, Homo sapiens
attgttttatcat

SEQ ID NO: 429128 - DNA, 10 bp, Homo sapiens
attgttttca

SEQ ID NO: 429129 - DNA, 18 bp, Homo sapiens
attgttttccagtgtcac

SEQ ID NO: 429130 - DNA, 21 bp, Homo sapiens
attgttttctgtaaataacct

SEQ ID NO: 429131 - DNA, 20 bp, Homo sapiens
attgtttttaagaaaaacat

SEQ ID NO: 429132 - DNA, 16 bp, Homo sapiens
attgtttttagaaatt

SEQ ID NO: 429133 - DNA, 15 bp, Homo sapiens
attgtttttatatat

SEQ ID NO: 429134 - DNA, 19 bp, Homo sapiens
attgtttttatatattata

SEQ ID NO: 429135 - DNA, 22 bp, Homo sapiens
attgtttttgaatttaaataaa

SEQ ID NO: 429136 - DNA, 13 bp, Homo sapiens
atttaaaagacaa

SEQ ID NO: 429137 - DNA, 19 bp, Homo sapiens
atttaaaatggacttttgt

SEQ ID NO: 429138 - DNA, 11 bp, Homo sapiens
atttaaaatgt

SEQ ID NO: 429139 - DNA, 14 bp, Homo sapiens
atttaaaattggca

SEQ ID NO: 429140 - DNA, 11 bp, Homo sapiens
atttaaactat

SEQ ID NO: 429141 - DNA, 17 bp, Homo sapiens
atttaaactattcagag

SEQ ID NO: 429142 - DNA, 19 bp, Homo sapiens
atttaaagaaactgatttt

SEQ ID NO: 429143 - DNA, 19 bp, Homo sapiens
atttaaagaacaccctata

SEQ ID NO: 429144 - DNA, 13 bp, Homo sapiens
atttaaagcacat

SEQ ID NO: 429145 - DNA, 19 bp, Homo sapiens
atttaaatataattctgta

SEQ ID NO: 429146 - DNA, 20 bp, Homo sapiens
atttaaatataattctgtaa

SEQ ID NO: 429147 - DNA, 22 bp, Homo sapiens
atttaaatcattttaacttcta

SEQ ID NO: 429148 - DNA, 15 bp, Homo sapiens
atttaacagtcattt

SEQ ID NO: 429149 - DNA, 17 bp, Homo sapiens
atttaacagtcatttaa

SEQ ID NO: 429150 - DNA, 17 bp, Homo sapiens
atttaaccctgcctctc

SEQ ID NO: 429151 - DNA, 18 bp, Homo sapiens
atttaactactaagaata

SEQ ID NO: 429152 - DNA, 13 bp, Homo sapiens
atttaactgactt

SEQ ID NO: 429153 - DNA, 18 bp, Homo sapiens
atttaactgcatatagat

SEQ ID NO: 429154 - DNA, 23 bp, Homo sapiens
atttaacttgagggtaataaact

SEQ ID NO: 429155 - DNA, 17 bp, Homo sapiens
atttaagaaaatacaat

SEQ ID NO: 429156 - DNA, 12 bp, Homo sapiens
atttaagcatga

SEQ ID NO: 429157 - DNA, 19 bp, Homo sapiens
atttaagcatgagtggcct

SEQ ID NO: 429158 - DNA, 13 bp, Homo sapiens
atttaagcattgt

SEQ ID NO: 429159 - DNA, 13 bp, Homo sapiens
atttaagcatttt

SEQ ID NO: 429160 - DNA, 22 bp, Homo sapiens
atttaagccaataaataatatt

SEQ ID NO: 429161 - DNA, 21 bp, Homo sapiens
atttaagtcgggaaattctgc

SEQ ID NO: 429162 - DNA, 13 bp, Homo sapiens
atttaataacttt

SEQ ID NO: 429163 - DNA, 15 bp, Homo sapiens
atttaataactttgc

SEQ ID NO: 429164 - DNA, 13 bp, Homo sapiens
atttaatacagca

SEQ ID NO: 429165 - DNA, 15 bp, Homo sapiens
atttaatacagcagt

SEQ ID NO: 429166 - DNA, 14 bp, Homo sapiens
atttaatatactgc

SEQ ID NO: 429167 - DNA, 22 bp, Homo sapiens
atttaatcatttccagcaaaat

SEQ ID NO: 429168 - DNA, 18 bp, Homo sapiens
atttaatcttttttatgt

SEQ ID NO: 429169 - DNA, 23 bp, Homo sapiens
atttaattcctctttttagggct

SEQ ID NO: 429170 - DNA, 13 bp, Homo sapiens
atttaatttcata

SEQ ID NO: 429171 - DNA, 17 bp, Homo sapiens
atttaatttcataaatt

SEQ ID NO: 429172 - DNA, 18 bp, Homo sapiens
atttaatttcataaattg

SEQ ID NO: 429173 - DNA, 16 bp, Homo sapiens
atttaatttttaaaag

SEQ ID NO: 429174 - DNA, 21 bp, Homo sapiens
atttacagcctcacttgaatg

SEQ ID NO: 429175 - DNA, 18 bp, Homo sapiens
atttacagttactgccta

SEQ ID NO: 429176 - DNA, 18 bp, Homo sapiens
atttacatgaattgcatt

SEQ ID NO: 429177 - DNA, 17 bp, Homo sapiens
atttaccataatgttcc

SEQ ID NO: 429178 - DNA, 14 bp, Homo sapiens
atttaccctttata

SEQ ID NO: 429179 - DNA, 14 bp, Homo sapiens
atttacgtatattt

SEQ ID NO: 429180 - DNA, 15 bp, Homo sapiens
atttactaagccaca

SEQ ID NO: 429181 - DNA, 21 bp, Homo sapiens
atttactaagccacaagaaat

SEQ ID NO: 429182 - DNA, 20 bp, Homo sapiens
atttactgagcttctctgtg

SEQ ID NO: 429183 - DNA, 18 bp, Homo sapiens
atttactggaaacctgtt

SEQ ID NO: 429184 - DNA, 19 bp, Homo sapiens
atttactggaaacctgtta

SEQ ID NO: 429185 - DNA, 17 bp, Homo sapiens
atttactgtactaatta

SEQ ID NO: 429186 - DNA, 12 bp, Homo sapiens
atttacttttaa

SEQ ID NO: 429187 - DNA, 15 bp, Homo sapiens
atttacttttaataa

SEQ ID NO: 429188 - DNA, 22 bp, Homo sapiens
atttagaatttgaaaggaaaaa

SEQ ID NO: 429189 - DNA, 22 bp, Homo sapiens
atttagagatgaattaaattta

SEQ ID NO: 429190 - DNA, 23 bp, Homo sapiens
atttagagatgaattaaatttaa

SEQ ID NO: 429191 - DNA, 19 bp, Homo sapiens
atttagagctagtctttca

SEQ ID NO: 429192 - DNA, 13 bp, Homo sapiens
atttagcacaaaa

SEQ ID NO: 429193 - DNA, 20 bp, Homo sapiens
atttagcacccttctgctgt

SEQ ID NO: 429194 - DNA, 22 bp, Homo sapiens
atttagcatgacaagccccagg

SEQ ID NO: 429195 - DNA, 15 bp, Homo sapiens
atttagctgtatcaa

SEQ ID NO: 429196 - DNA, 19 bp, Homo sapiens
atttaggaatgctcaatgt

SEQ ID NO: 429197 - DNA, 18 bp, Homo sapiens
atttaggcatgagctctt

SEQ ID NO: 429198 - DNA, 14 bp, Homo sapiens
atttagggaagcag

SEQ ID NO: 429199 - DNA, 20 bp, Homo sapiens
atttagggagaaatgttgtt

SEQ ID NO: 429200 - DNA, 13 bp, Homo sapiens
atttagttatagt

SEQ ID NO: 429201 - DNA, 18 bp, Homo sapiens
atttagttgaaaaatcta

SEQ ID NO: 429202 - DNA, 21 bp, Homo sapiens
atttagttgattttaattact

SEQ ID NO: 429203 - DNA, 22 bp, Homo sapiens
atttagttgggtctgaaaggaa

SEQ ID NO: 429204 - DNA, 18 bp, Homo sapiens
atttataaactagatctc

SEQ ID NO: 429205 - DNA, 23 bp, Homo sapiens
atttataaatatattcaggagtt

SEQ ID NO: 429206 - DNA, 22 bp, Homo sapiens
atttataaatatatttaagata

SEQ ID NO: 429207 - DNA, 15 bp, Homo sapiens
atttataaatgtgtg

SEQ ID NO: 429208 - DNA, 13 bp, Homo sapiens
atttataaatttg

SEQ ID NO: 429209 - DNA, 18 bp, Homo sapiens
atttataaccccagcctg

SEQ ID NO: 429210 - DNA, 19 bp, Homo sapiens
atttataaccccagcctga

SEQ ID NO: 429211 - DNA, 15 bp, Homo sapiens
atttataactcatca

SEQ ID NO: 429212 - DNA, 17 bp, Homo sapiens
atttataactcatcata

SEQ ID NO: 429213 - DNA, 16 bp, Homo sapiens
atttataatgttagta

SEQ ID NO: 429214 - DNA, 20 bp, Homo sapiens
atttataatgttagtagaaa

SEQ ID NO: 429215 - DNA, 14 bp, Homo sapiens
atttataatgtttg

SEQ ID NO: 429216 - DNA, 14 bp, Homo sapiens
atttatataattat

SEQ ID NO: 429217 - DNA, 20 bp, Homo sapiens
atttatataattatgttatt

SEQ ID NO: 429218 - DNA, 14 bp, Homo sapiens
atttatatatgtat

SEQ ID NO: 429219 - DNA, 16 bp, Homo sapiens
atttatatatttataa

SEQ ID NO: 429220 - DNA, 14 bp, Homo sapiens
atttatattagagt

SEQ ID NO: 429221 - DNA, 20 bp, Homo sapiens
atttatattagagtgccctt

SEQ ID NO: 429222 - DNA, 23 bp, Homo sapiens
atttatattcagagatgtaccat

SEQ ID NO: 429223 - DNA, 15 bp, Homo sapiens
atttatattttaaag

SEQ ID NO: 429224 - DNA, 22 bp, Homo sapiens
atttatcgaaagtaaaaaagat

SEQ ID NO: 429225 - DNA, 20 bp, Homo sapiens
atttatctgggattatggtt

SEQ ID NO: 429226 - DNA, 14 bp, Homo sapiens
atttatctgtctga

SEQ ID NO: 429227 - DNA, 15 bp, Homo sapiens
atttatcttctgttt

SEQ ID NO: 429228 - DNA, 19 bp, Homo sapiens
atttatcttctgtttttct

SEQ ID NO: 429229 - DNA, 23 bp, Homo sapiens
atttatcttctgtttttctcaaa

SEQ ID NO: 429230 - DNA, 20 bp, Homo sapiens
atttatgagtaactattatt

SEQ ID NO: 429231 - DNA, 15 bp, Homo sapiens
atttatgagtttttg

SEQ ID NO: 429232 - DNA, 15 bp, Homo sapiens
atttatgcatgagaa

SEQ ID NO: 429233 - DNA, 16 bp, Homo sapiens
atttatgcatgagaac

SEQ ID NO: 429234 - DNA, 19 bp, Homo sapiens
atttatgcatggaaacctg

SEQ ID NO: 429235 - DNA, 12 bp, Homo sapiens
atttatgtgtga

SEQ ID NO: 429236 - DNA, 22 bp, Homo sapiens
atttatgtgtgaggagctgctg

SEQ ID NO: 429237 - DNA, 14 bp, Homo sapiens
atttatgtttaagt

SEQ ID NO: 429238 - DNA, 15 bp, Homo sapiens
atttatgtttaagtg

SEQ ID NO: 429239 - DNA, 19 bp, Homo sapiens
atttattaaaatgattgta

SEQ ID NO: 429240 - DNA, 16 bp, Homo sapiens
atttattaaacttcag

SEQ ID NO: 429241 - DNA, 18 bp, Homo sapiens
atttattaaacttcagca

SEQ ID NO: 429242 - DNA, 23 bp, Homo sapiens
atttattaagatggattctcaga

SEQ ID NO: 429243 - DNA, 14 bp, Homo sapiens
atttattacctctg

SEQ ID NO: 429244 - DNA, 15 bp, Homo sapiens
atttattagctgtaa

SEQ ID NO: 429245 - DNA, 11 bp, Homo sapiens
atttattatgt

SEQ ID NO: 429246 - DNA, 13 bp, Homo sapiens
atttattatgtcc

SEQ ID NO: 429247 - DNA, 12 bp, Homo sapiens
atttattattga

SEQ ID NO: 429248 - DNA, 17 bp, Homo sapiens
atttattattttaatat

SEQ ID NO: 429249 - DNA, 19 bp, Homo sapiens
atttattcaattcctctgg

SEQ ID NO: 429250 - DNA, 15 bp, Homo sapiens
atttattgaattatt

SEQ ID NO: 429251 - DNA, 20 bp, Homo sapiens
atttattgtttatttatcag

SEQ ID NO: 429252 - DNA, 14 bp, Homo sapiens
atttatttattaag

SEQ ID NO: 429253 - DNA, 19 bp, Homo sapiens
atttatttggagtggaggc

SEQ ID NO: 429254 - DNA, 22 bp, Homo sapiens
atttatttggagtggaggcatt

SEQ ID NO: 429255 - DNA, 23 bp, Homo sapiens
atttatttggagtggaggcattg

SEQ ID NO: 429256 - DNA, 14 bp, Homo sapiens
atttattttcagta

SEQ ID NO: 429257 - DNA, 22 bp, Homo sapiens
atttattttcagtatactgtgt

SEQ ID NO: 429258 - DNA, 20 bp, Homo sapiens
atttattttgactgtgattt

SEQ ID NO: 429259 - DNA, 21 bp, Homo sapiens
atttattttgtatttttgaat

SEQ ID NO: 429260 - DNA, 22 bp, Homo sapiens
atttatttttagccattgtcgt

SEQ ID NO: 429261 - DNA, 15 bp, Homo sapiens
atttcaaaaatataa

SEQ ID NO: 429262 - DNA, 13 bp, Homo sapiens
atttcaaaatata

SEQ ID NO: 429263 - DNA, 12 bp, Homo sapiens
atttcaaaatgc

SEQ ID NO: 429264 - DNA, 21 bp, Homo sapiens
atttcaacaagaatattgtat

SEQ ID NO: 429265 - DNA, 14 bp, Homo sapiens
atttcaagatccaa

SEQ ID NO: 429266 - DNA, 19 bp, Homo sapiens
atttcaagatccaaatgct

SEQ ID NO: 429267 - DNA, 23 bp, Homo sapiens
atttcaaggtccgagctctgtcc

SEQ ID NO: 429268 - DNA, 17 bp, Homo sapiens
atttcaatttgttcagt

SEQ ID NO: 429269 - DNA, 13 bp, Homo sapiens
atttcacaacaga

SEQ ID NO: 429270 - DNA, 14 bp, Homo sapiens
atttcacagataat

SEQ ID NO: 429271 - DNA, 16 bp, Homo sapiens
atttcacctgtgacaa

SEQ ID NO: 429272 - DNA, 16 bp, Homo sapiens
atttcactagagacaa

SEQ ID NO: 429273 - DNA, 14 bp, Homo sapiens
atttcagatgcttt

SEQ ID NO: 429274 - DNA, 20 bp, Homo sapiens
atttcagctagttaataatt

SEQ ID NO: 429275 - DNA, 22 bp, Homo sapiens
atttcaggttaaattaaaccaa

SEQ ID NO: 429276 - DNA, 20 bp, Homo sapiens
atttcagtatcatctccatc

SEQ ID NO: 429277 - DNA, 12 bp, Homo sapiens
atttcagtgcca

SEQ ID NO: 429278 - DNA, 13 bp, Homo sapiens
atttcagtgccat

SEQ ID NO: 429279 - DNA, 19 bp, Homo sapiens
atttcagtgccatacatgt

SEQ ID NO: 429280 - DNA, 19 bp, Homo sapiens
atttcataaattggctcct

SEQ ID NO: 429281 - DNA, 22 bp, Homo sapiens
atttcataaattggctcctttc

SEQ ID NO: 429282 - DNA, 22 bp, Homo sapiens
atttcatagctatttagagata

SEQ ID NO: 429283 - DNA, 17 bp, Homo sapiens
atttcatccatatttct

SEQ ID NO: 429284 - DNA, 15 bp, Homo sapiens
atttcatgtgatcta

SEQ ID NO: 429285 - DNA, 17 bp, Homo sapiens
atttcatgttagtctta

SEQ ID NO: 429286 - DNA, 20 bp, Homo sapiens
atttcattaaccaaagaaag

SEQ ID NO: 429287 - DNA, 14 bp, Homo sapiens
atttcattcatatc

SEQ ID NO: 429288 - DNA, 17 bp, Homo sapiens
atttcattgctgtgtca

SEQ ID NO: 429289 - DNA, 14 bp, Homo sapiens
atttcattgtatga

SEQ ID NO: 429290 - DNA, 15 bp, Homo sapiens
atttcattgtatgat

SEQ ID NO: 429291 - DNA, 21 bp, Homo sapiens
atttcattgtatgatgtgttg

SEQ ID NO: 429292 - DNA, 15 bp, Homo sapiens
atttccaaataaaat

SEQ ID NO: 429293 - DNA, 22 bp, Homo sapiens
atttccaacaccacagacacac

SEQ ID NO: 429294 - DNA, 15 bp, Homo sapiens
atttccaccaagggt

SEQ ID NO: 429295 - DNA, 18 bp, Homo sapiens
atttccagcaaaatatat

SEQ ID NO: 429296 - DNA, 11 bp, Homo sapiens
atttccaggcc

SEQ ID NO: 429297 - DNA, 12 bp, Homo sapiens
atttccaggccc

SEQ ID NO: 429298 - DNA, 15 bp, Homo sapiens
atttccaggcccctg

SEQ ID NO: 429299 - DNA, 23 bp, Homo sapiens
atttccaggcccctgaggactgg

SEQ ID NO: 429300 - DNA, 13 bp, Homo sapiens
atttccagtacct

SEQ ID NO: 429301 - DNA, 17 bp, Homo sapiens
atttccagtacctttgt

SEQ ID NO: 429302 - DNA, 20 bp, Homo sapiens
atttccagtacctttgtcac

SEQ ID NO: 429303 - DNA, 15 bp, Homo sapiens
atttccatatggatt

SEQ ID NO: 429304 - DNA, 16 bp, Homo sapiens
atttccattccagaat

SEQ ID NO: 429305 - DNA, 19 bp, Homo sapiens
atttccattcttttaaatg

SEQ ID NO: 429306 - DNA, 22 bp, Homo sapiens
atttccattcttttaaatgggt

SEQ ID NO: 429307 - DNA, 14 bp, Homo sapiens
atttccatttctga

SEQ ID NO: 429308 - DNA, 14 bp, Homo sapiens
atttcccaagctgg

SEQ ID NO: 429309 - DNA, 17 bp, Homo sapiens
atttccccaccccagct

SEQ ID NO: 429310 - DNA, 20 bp, Homo sapiens
atttccccaggggaaaatga

SEQ ID NO: 429311 - DNA, 21 bp, Homo sapiens
atttccccaggggaaaatgaa

SEQ ID NO: 429312 - DNA, 21 bp, Homo sapiens
atttcccctttccaattccaa

SEQ ID NO: 429313 - DNA, 14 bp, Homo sapiens
atttccctaaaaat

SEQ ID NO: 429314 - DNA, 17 bp, Homo sapiens
atttccggtcccggctg

SEQ ID NO: 429315 - DNA, 14 bp, Homo sapiens
atttcctatctgta

SEQ ID NO: 429316 - DNA, 24 bp, Homo sapiens
atttcctcaacgttgctccccatc

SEQ ID NO: 429317 - DNA, 18 bp, Homo sapiens
atttcctctattgatgta

SEQ ID NO: 429318 - DNA, 19 bp, Homo sapiens
atttcctctattgatgtac

SEQ ID NO: 429319 - DNA, 22 bp, Homo sapiens
atttcctctattgatgtacagt

SEQ ID NO: 429320 - DNA, 20 bp, Homo sapiens
atttcctctctatctttttt

SEQ ID NO: 429321 - DNA, 21 bp, Homo sapiens
atttcctctgagctgttatct

SEQ ID NO: 429322 - DNA, 21 bp, Homo sapiens
atttccttcaccacctcatgt

SEQ ID NO: 429323 - DNA, 16 bp, Homo sapiens
atttcggtgcttccct

SEQ ID NO: 429324 - DNA, 17 bp, Homo sapiens
atttctaaaacattaat

SEQ ID NO: 429325 - DNA, 20 bp, Homo sapiens
atttctaaaacattaattga

SEQ ID NO: 429326 - DNA, 21 bp, Homo sapiens
atttctaaagataatattact

SEQ ID NO: 429327 - DNA, 17 bp, Homo sapiens
atttctaaatcctcact

SEQ ID NO: 429328 - DNA, 18 bp, Homo sapiens
atttctaagcttatttct

SEQ ID NO: 429329 - DNA, 21 bp, Homo sapiens
atttctaagcttatttctaac

SEQ ID NO: 429330 - DNA, 14 bp, Homo sapiens
atttctaagtattt

SEQ ID NO: 429331 - DNA, 15 bp, Homo sapiens
atttctaatttgaat

SEQ ID NO: 429332 - DNA, 21 bp, Homo sapiens
atttctacaactgatcatttg

SEQ ID NO: 429333 - DNA, 16 bp, Homo sapiens
atttctactttgacta

SEQ ID NO: 429334 - DNA, 24 bp, Homo sapiens
atttctagaaaagcttcctagctt

SEQ ID NO: 429335 - DNA, 23 bp, Homo sapiens
atttctagcaaacagatgtttgt

SEQ ID NO: 429336 - DNA, 14 bp, Homo sapiens
atttctatctgcaa

SEQ ID NO: 429337 - DNA, 14 bp, Homo sapiens
atttctatgtatgt

SEQ ID NO: 429338 - DNA, 20 bp, Homo sapiens
atttctatgtatgtgccaat

SEQ ID NO: 429339 - DNA, 22 bp, Homo sapiens
atttctatgtatgtgccaattt

SEQ ID NO: 429340 - DNA, 18 bp, Homo sapiens
atttctattttgcagcag

SEQ ID NO: 429341 - DNA, 15 bp, Homo sapiens
atttctcaaagtttt

SEQ ID NO: 429342 - DNA, 22 bp, Homo sapiens
atttctcaacaaagcacagtgt

SEQ ID NO: 429343 - DNA, 14 bp, Homo sapiens
atttctcactgaga

SEQ ID NO: 429344 - DNA, 11 bp, Homo sapiens
atttctcatgt

SEQ ID NO: 429345 - DNA, 12 bp, Homo sapiens
atttctcatgtg

SEQ ID NO: 429346 - DNA, 19 bp, Homo sapiens
atttctcatgtgctttgta

SEQ ID NO: 429347 - DNA, 21 bp, Homo sapiens
atttctcattgatcacagatg

SEQ ID NO: 429348 - DNA, 11 bp, Homo sapiens
atttctcccag

SEQ ID NO: 429349 - DNA, 15 bp, Homo sapiens
atttctctcaatttg

SEQ ID NO: 429350 - DNA, 15 bp, Homo sapiens
atttctgggatattt

SEQ ID NO: 429351 - DNA, 18 bp, Homo sapiens
atttctgggatatttaac

SEQ ID NO: 429352 - DNA, 16 bp, Homo sapiens
atttctgtagaatgct

SEQ ID NO: 429353 - DNA, 18 bp, Homo sapiens
atttctgtagaatgctgt

SEQ ID NO: 429354 - DNA, 16 bp, Homo sapiens
atttctgtctttaaga

SEQ ID NO: 429355 - DNA, 17 bp, Homo sapiens
atttctgtctttaagaa

SEQ ID NO: 429356 - DNA, 14 bp, Homo sapiens
atttctgtttctca

SEQ ID NO: 429357 - DNA, 15 bp, Homo sapiens
atttcttatttgaaa

SEQ ID NO: 429358 - DNA, 17 bp, Homo sapiens
atttcttatttgaaagt

SEQ ID NO: 429359 - DNA, 19 bp, Homo sapiens
atttcttatttgaaagtgt

SEQ ID NO: 429360 - DNA, 21 bp, Homo sapiens
atttcttcaaatccttccaaa

SEQ ID NO: 429361 - DNA, 13 bp, Homo sapiens
atttcttcactgt

SEQ ID NO: 429362 - DNA, 14 bp, Homo sapiens
atttcttcagaggg

SEQ ID NO: 429363 - DNA, 16 bp, Homo sapiens
atttcttcgctgctct

SEQ ID NO: 429364 - DNA, 21 bp, Homo sapiens
atttcttcgctgctctagctg

SEQ ID NO: 429365 - DNA, 14 bp, Homo sapiens
atttcttgcgagcc

SEQ ID NO: 429366 - DNA, 13 bp, Homo sapiens
atttcttgctttc

SEQ ID NO: 429367 - DNA, 14 bp, Homo sapiens
atttcttgggccct

SEQ ID NO: 429368 - DNA, 16 bp, Homo sapiens
atttcttgggccctcc

SEQ ID NO: 429369 - DNA, 18 bp, Homo sapiens
atttcttgggccctcctg

SEQ ID NO: 429370 - DNA, 19 bp, Homo sapiens
atttcttggtatgatcatt

SEQ ID NO: 429371 - DNA, 17 bp, Homo sapiens
atttctttatttctgtc

SEQ ID NO: 429372 - DNA, 17 bp, Homo sapiens
atttctttctttcctta

SEQ ID NO: 429373 - DNA, 21 bp, Homo sapiens
atttctttgttatcaaacttc

SEQ ID NO: 429374 - DNA, 23 bp, Homo sapiens
atttctttgttatcaaacttcag

SEQ ID NO: 429375 - DNA, 12 bp, Homo sapiens
atttcttttata

SEQ ID NO: 429376 - DNA, 13 bp, Homo sapiens
atttcttttatat

SEQ ID NO: 429377 - DNA, 15 bp, Homo sapiens
atttcttttatatat

SEQ ID NO: 429378 - DNA, 23 bp, Homo sapiens
atttcttttatatataaaataaa

SEQ ID NO: 429379 - DNA, 15 bp, Homo sapiens
atttgaaagaagtca

SEQ ID NO: 429380 - DNA, 14 bp, Homo sapiens
atttgaaaggaaaa

SEQ ID NO: 429381 - DNA, 23 bp, Homo sapiens
atttgaaagtgggtttcaattta

SEQ ID NO: 429382 - DNA, 19 bp, Homo sapiens
atttgaaatcaccttttct

SEQ ID NO: 429383 - DNA, 21 bp, Homo sapiens
atttgaaatcaccttttctaa

SEQ ID NO: 429384 - DNA, 23 bp, Homo sapiens
atttgaaggtctgcaagaacctg

SEQ ID NO: 429385 - DNA, 20 bp, Homo sapiens
atttgaagtggaaaaagaaa

SEQ ID NO: 429386 - DNA, 13 bp, Homo sapiens
atttgaatgaaaa

SEQ ID NO: 429387 - DNA, 14 bp, Homo sapiens
atttgaatgaaaaa

SEQ ID NO: 429388 - DNA, 16 bp, Homo sapiens
atttgaatgactgctg

SEQ ID NO: 429389 - DNA, 14 bp, Homo sapiens
atttgaatggtgca

SEQ ID NO: 429390 - DNA, 19 bp, Homo sapiens
atttgaatgttaagcagat

SEQ ID NO: 429391 - DNA, 23 bp, Homo sapiens
atttgacaaaatttgttgaaatt

SEQ ID NO: 429392 - DNA, 15 bp, Homo sapiens
atttgacacataaaa

SEQ ID NO: 429393 - DNA, 21 bp, Homo sapiens
atttgacacataaaagtaatt

SEQ ID NO: 429394 - DNA, 22 bp, Homo sapiens
atttgacacataaaagtaatta

SEQ ID NO: 429395 - DNA, 23 bp, Homo sapiens
atttgaccagaaaatatgatata

SEQ ID NO: 429396 - DNA, 18 bp, Homo sapiens
atttgactttctgtctgt

SEQ ID NO: 429397 - DNA, 14 bp, Homo sapiens
atttgagactattt

SEQ ID NO: 429398 - DNA, 22 bp, Homo sapiens
atttgagagaatctactaagtt

SEQ ID NO: 429399 - DNA, 22 bp, Homo sapiens
atttgaggtcaagtaagaagac

SEQ ID NO: 429400 - DNA, 18 bp, Homo sapiens
atttgagtgattatttgt

SEQ ID NO: 429401 - DNA, 17 bp, Homo sapiens
atttgagtttcctttaa

SEQ ID NO: 429402 - DNA, 18 bp, Homo sapiens
atttgagtttgacattta

SEQ ID NO: 429403 - DNA, 15 bp, Homo sapiens
atttgataacatttt

SEQ ID NO: 429404 - DNA, 11 bp, Homo sapiens
atttgatgaaa

SEQ ID NO: 429405 - DNA, 17 bp, Homo sapiens
atttgatgctggagagg

SEQ ID NO: 429406 - DNA, 19 bp, Homo sapiens
atttgatgctggagaggtt

SEQ ID NO: 429407 - DNA, 16 bp, Homo sapiens
atttgatggtgaatat

SEQ ID NO: 429408 - DNA, 13 bp, Homo sapiens
atttgatttctat

SEQ ID NO: 429409 - DNA, 22 bp, Homo sapiens
atttgcaacaggaagacactgg

SEQ ID NO: 429410 - DNA, 14 bp, Homo sapiens
atttgcaacattta

SEQ ID NO: 429411 - DNA, 13 bp, Homo sapiens
atttgcaataaaa

SEQ ID NO: 429412 - DNA, 16 bp, Homo sapiens
atttgcaataaaaaag

SEQ ID NO: 429413 - DNA, 17 bp, Homo sapiens
atttgcacaggttttca

SEQ ID NO: 429414 - DNA, 13 bp, Homo sapiens
atttgcagctgct

SEQ ID NO: 429415 - DNA, 9 bp, Homo sapiens
atttgcata

SEQ ID NO: 429416 - DNA, 23 bp, Homo sapiens
atttgcataatactaatttattg

SEQ ID NO: 429417 - DNA, 22 bp, Homo sapiens
atttgcatattctattgtatta

SEQ ID NO: 429418 - DNA, 14 bp, Homo sapiens
atttgcatgccttt

SEQ ID NO: 429419 - DNA, 18 bp, Homo sapiens
atttgccaaaaactaaaa

SEQ ID NO: 429420 - DNA, 20 bp, Homo sapiens
atttgccaggggcatccaag

SEQ ID NO: 429421 - DNA, 18 bp, Homo sapiens
atttgccttttaaattct

SEQ ID NO: 429422 - DNA, 18 bp, Homo sapiens
atttgcgcacaacttaaa

SEQ ID NO: 429423 - DNA, 13 bp, Homo sapiens
atttgctcctttc

SEQ ID NO: 429424 - DNA, 19 bp, Homo sapiens
atttgctggagtgctggct

SEQ ID NO: 429425 - DNA, 22 bp, Homo sapiens
atttgctggagtgctggctcca

SEQ ID NO: 429426 - DNA, 17 bp, Homo sapiens
atttgctgtttgtccag

SEQ ID NO: 429427 - DNA, 18 bp, Homo sapiens
atttgcttatttatattc

SEQ ID NO: 429428 - DNA, 11 bp, Homo sapiens
atttggaatag

SEQ ID NO: 429429 - DNA, 21 bp, Homo sapiens
atttggagacacaactatttt

SEQ ID NO: 429430 - DNA, 21 bp, Homo sapiens
atttggagtggaggcattgtt

SEQ ID NO: 429431 - DNA, 22 bp, Homo sapiens
atttggagtggaggcattgttt

SEQ ID NO: 429432 - DNA, 20 bp, Homo sapiens
attttggcaagaagactgta

SEQ ID NO: 429433 - DNA, 12 bp, Homo sapiens
attttggccact

SEQ ID NO: 429434 - DNA, 16 bp, Homo sapiens
attttggccactttgc

SEQ ID NO: 429435 - DNA, 22 bp, Homo sapiens
attttgggaaattcttgcactg

SEQ ID NO: 429436 - DNA, 23 bp, Homo sapiens
attttgggaaattcttgcactgt

SEQ ID NO: 429437 - DNA, 20 bp, Homo sapiens
attttgggtggccaaagtgt

SEQ ID NO: 429438 - DNA, 19 bp, Homo sapiens
attttggtgatgtaaaaca

SEQ ID NO: 429439 - DNA, 18 bp, Homo sapiens
attttgtacgtatgaatg

SEQ ID NO: 429440 - DNA, 23 bp, Homo sapiens
attttgtagtagttgatgaccaa

SEQ ID NO: 429441 - DNA, 19 bp, Homo sapiens
attttgtattacatctaat

SEQ ID NO: 429442 - DNA, 24 bp, Homo sapiens
attttgtattacatctaatgcttc

SEQ ID NO: 429443 - DNA, 14 bp, Homo sapiens
attttgtattgcca

SEQ ID NO: 429444 - DNA, 21 bp, Homo sapiens
attttgtcacagctcttgttt

SEQ ID NO: 429445 - DNA, 20 bp, Homo sapiens
attttgtccaagttcacagt

SEQ ID NO: 429446 - DNA, 19 bp, Homo sapiens
attttgtgctctttcctgc

SEQ ID NO: 429447 - DNA, 15 bp, Homo sapiens
attttgtgtcttaag

SEQ ID NO: 429448 - DNA, 22 bp, Homo sapiens
attttgttactgtctgtagtgt

SEQ ID NO: 429449 - DNA, 22 bp, Homo sapiens
attttgttatagaatacttttt

SEQ ID NO: 429450 - DNA, 13 bp, Homo sapiens
attttgttgcctt

SEQ ID NO: 429451 - DNA, 20 bp, Homo sapiens
attttgttttattttgaatg

SEQ ID NO: 429452 - DNA, 16 bp, Homo sapiens
atttttaaaagacttt

SEQ ID NO: 429453 - DNA, 19 bp, Homo sapiens
atttttaaaggacaaacag

SEQ ID NO: 429454 - DNA, 18 bp, Homo sapiens
atttttaaagtttaaata

SEQ ID NO: 429455 - DNA, 16 bp, Homo sapiens
atttttaaataccaca

SEQ ID NO: 429456 - DNA, 14 bp, Homo sapiens
atttttaaatcatt

SEQ ID NO: 429457 - DNA, 21 bp, Homo sapiens
atttttaagcaaaatattatt

SEQ ID NO: 429458 - DNA, 14 bp, Homo sapiens
atttttaagtacaa

SEQ ID NO: 429459 - DNA, 19 bp, Homo sapiens
atttttaagtacaaaaaag

SEQ ID NO: 429460 - DNA, 18 bp, Homo sapiens
atttttaatatgtaagga

SEQ ID NO: 429461 - DNA, 14 bp, Homo sapiens
atttttactaaagc

SEQ ID NO: 429462 - DNA, 19 bp, Homo sapiens
atttttactactattctgt

SEQ ID NO: 429463 - DNA, 21 bp, Homo sapiens
atttttactactattctgtta

SEQ ID NO: 429464 - DNA, 16 bp, Homo sapiens
atttttagagattaat

SEQ ID NO: 429465 - DNA, 20 bp, Homo sapiens
atttttagatattcattaat

SEQ ID NO: 429466 - DNA, 17 bp, Homo sapiens
atttttagccattgtcg

SEQ ID NO: 429467 - DNA, 19 bp, Homo sapiens
atttttaggtgtcttttaa

SEQ ID NO: 429468 - DNA, 18 bp, Homo sapiens
atttttatatcagcctga

SEQ ID NO: 429469 - DNA, 15 bp, Homo sapiens
atttttatatttagt

SEQ ID NO: 429470 - DNA, 11 bp, Homo sapiens
atttttatcag

SEQ ID NO: 429471 - DNA, 13 bp, Homo sapiens
atttttatttcta

SEQ ID NO: 429472 - DNA, 13 bp, Homo sapiens
atttttcatattg

SEQ ID NO: 429473 - DNA, 15 bp, Homo sapiens
atttttcattttctc

SEQ ID NO: 429474 - DNA, 15 bp, Homo sapiens
atttttccaaaataa

SEQ ID NO: 429475 - DNA, 10 bp, Homo sapiens
atttttccta

SEQ ID NO: 429476 - DNA, 18 bp, Homo sapiens
atttttctactgctcttt

SEQ ID NO: 429477 - DNA, 20 bp, Homo sapiens
atttttcttgttgcatcttt

SEQ ID NO: 429478 - DNA, 23 bp, Homo sapiens
atttttgatttatgcatggaaac

SEQ ID NO: 429479 - DNA, 18 bp, Homo sapiens
atttttgccatacatcag

SEQ ID NO: 429480 - DNA, 19 bp, Homo sapiens
atttttggttgtcaatatt

SEQ ID NO: 429481 - DNA, 23 bp, Homo sapiens
atttttgtcttatatatatttct

SEQ ID NO: 429482 - DNA, 21 bp, Homo sapiens
atttttgtctttatctcaagt

SEQ ID NO: 429483 - DNA, 16 bp, Homo sapiens
atttttgtgtatccag

SEQ ID NO: 429484 - DNA, 15 bp, Homo sapiens
atttttgtgtttcta

SEQ ID NO: 429485 - DNA, 19 bp, Homo sapiens
atttttgttaagctcagga

SEQ ID NO: 429486 - DNA, 19 bp, Homo sapiens
atttttgttaatcatcttc

SEQ ID NO: 429487 - DNA, 22 bp, Homo sapiens
atttttgttggagccactctgt

SEQ ID NO: 429488 - DNA, 17 bp, Homo sapiens
atttttgtttgttttgt

SEQ ID NO: 429489 - DNA, 15 bp, Homo sapiens
attttttaaaaagca

SEQ ID NO: 429490 - DNA, 18 bp, Homo sapiens
attttttaaaaagcaaaa

SEQ ID NO: 429491 - DNA, 11 bp, Homo sapiens
attttttaagt

SEQ ID NO: 429492 - DNA, 15 bp, Homo sapiens
attttttaagttcaa

SEQ ID NO: 429493 - DNA, 14 bp, Homo sapiens
attttttccctcct

SEQ ID NO: 429494 - DNA, 19 bp, Homo sapiens
attttttccctcctgacaa

SEQ ID NO: 429495 - DNA, 21 bp, Homo sapiens
attttttctttcttggcctca

SEQ ID NO: 429496 - DNA, 19 bp, Homo sapiens
attttttgatgtcagcctt

SEQ ID NO: 429497 - DNA, 14 bp, Homo sapiens
attttttgttctgt

SEQ ID NO: 429498 - DNA, 18 bp, Homo sapiens
atttttttaaagaaaact

SEQ ID NO: 429499 - DNA, 21 bp, Homo sapiens
atttttttaactgaaaatgta

SEQ ID NO: 429500 - DNA, 18 bp, Homo sapiens
atttttttaagctgtaaa

SEQ ID NO: 429501 - DNA, 15 bp, Homo sapiens
atttttttcaatatt

SEQ ID NO: 429502 - DNA, 16 bp, Homo sapiens
atttttttccagaatt

SEQ ID NO: 429503 - DNA, 15 bp, Homo sapiens
atttttttctagcta

SEQ ID NO: 429504 - DNA, 18 bp, Homo sapiens
atttttttgatggctaag

SEQ ID NO: 429505 - DNA, 15 bp, Homo sapiens
atttttttgttgctg

SEQ ID NO: 429506 - DNA, 14 bp, Homo sapiens
attttttttaacat

SEQ ID NO: 429507 - DNA, 14 bp, Homo sapiens
attttttttaactg

SEQ ID NO: 429508 - DNA, 19 bp, Homo sapiens
attttttttggttgtttgc

SEQ ID NO: 429509 - DNA, 23 bp, Homo sapiens
atttttttttagaacagaaaaca

SEQ ID NO: 429510 - DNA, 18 bp, Homo sapiens
attttttttttaaaacta

SEQ ID NO: 429511 - DNA, 23 bp, Homo sapiens
attttttttttaaatgattccaa

SEQ ID NO: 429512 - DNA, 19 bp, Homo sapiens
attttttttttaaattatt

SEQ ID NO: 429513 - DNA, 19 bp, Homo sapiens
caaaaaaaaaaaaatgcac

SEQ ID NO: 429514 - DNA, 18 bp, Homo sapiens
caaaaaaacaagtttaga

SEQ ID NO: 429515 - DNA, 20 bp, Homo sapiens
caaaaaaagttgaaggcctt

SEQ ID NO: 429516 - DNA, 12 bp, Homo sapiens
caaaaaacaata

SEQ ID NO: 429517 - DNA, 18 bp, Homo sapiens
caaaaaacaatatttatt

SEQ ID NO: 429518 - DNA, 17 bp, Homo sapiens
caaaaaagggacagcat

SEQ ID NO: 429519 - DNA, 12 bp, Homo sapiens
caaaaaagttta

SEQ ID NO: 429520 - DNA, 16 bp, Homo sapiens
caaaaaatgcttgctt

SEQ ID NO: 429521 - DNA, 16 bp, Homo sapiens
caaaaacatggccaca

SEQ ID NO: 429522 - DNA, 17 bp, Homo sapiens
caaaaacttttttggaa

SEQ ID NO: 429523 - DNA, 22 bp, Homo sapiens
caaaaagagtcttaattttcta

SEQ ID NO: 429524 - DNA, 11 bp, Homo sapiens
caaaaagcaca

SEQ ID NO: 429525 - DNA, 18 bp, Homo sapiens
caaaaagctttaaaaaat

SEQ ID NO: 429526 - DNA, 20 bp, Homo sapiens
caaaaaggagcgggcagggc

SEQ ID NO: 429527 - DNA, 14 bp, Homo sapiens
caaaaagtcattgt

SEQ ID NO: 429528 - DNA, 15 bp, Homo sapiens
caaaaatataactta

SEQ ID NO: 429529 - DNA, 13 bp, Homo sapiens
caaaaatatatta

SEQ ID NO: 429530 - DNA, 17 bp, Homo sapiens
caaaaatgccacttaac

SEQ ID NO: 429531 - DNA, 23 bp, Homo sapiens
caaaaattatctatttgtatata

SEQ ID NO: 429532 - DNA, 17 bp, Homo sapiens
caaaaattcacaagctg

SEQ ID NO: 429533 - DNA, 20 bp, Homo sapiens
caaaaattcacaagctgcct

SEQ ID NO: 429534 - DNA, 23 bp, Homo sapiens
caaaacaaagctgatttcccttt

SEQ ID NO: 429535 - DNA, 15 bp, Homo sapiens
caaaacaagaaagaa

SEQ ID NO: 429536 - DNA, 11 bp, Homo sapiens
caaaacagaac

SEQ ID NO: 429537 - DNA, 15 bp, Homo sapiens
caaaacattccgttt

SEQ ID NO: 429538 - DNA, 16 bp, Homo sapiens
caaaaccacagccctg

SEQ ID NO: 429539 - DNA, 19 bp, Homo sapiens
caaaaccacagccctgtca

SEQ ID NO: 429540 - DNA, 16 bp, Homo sapiens
caaaaccattgcttca

SEQ ID NO: 429541 - DNA, 23 bp, Homo sapiens
caaaacccatcgtggtatgtgaa

SEQ ID NO: 429542 - DNA, 19 bp, Homo sapiens
caaaaccggcaacctgtaa

SEQ ID NO: 429543 - DNA, 13 bp, Homo sapiens
caaaacctgtgcc

SEQ ID NO: 429544 - DNA, 20 bp, Homo sapiens
caaaacctgtgccaggctga

SEQ ID NO: 429545 - DNA, 19 bp, Homo sapiens
caaaacgcatggagtgtgt

SEQ ID NO: 429546 - DNA, 14 bp, Homo sapiens
caaaactagttctt

SEQ ID NO: 429547 - DNA, 20 bp, Homo sapiens
caaaagaaaccatgcaaagc

SEQ ID NO: 429548 - DNA, 11 bp, Homo sapiens
caaaagacatc

SEQ ID NO: 429549 - DNA, 22 bp, Homo sapiens
caaaagacatcctcaaaagaaa

SEQ ID NO: 429550 - DNA, 16 bp, Homo sapiens
caaaagactagtttgt

SEQ ID NO: 429551 - DNA, 16 bp, Homo sapiens
caaaagagacagggag

SEQ ID NO: 429552 - DNA, 12 bp, Homo sapiens
caaaagatgaaa

SEQ ID NO: 429553 - DNA, 15 bp, Homo sapiens
caaaagcaaagtgaa

SEQ ID NO: 429554 - DNA, 16 bp, Homo sapiens
caaaagcaagactgtt

SEQ ID NO: 429555 - DNA, 19 bp, Homo sapiens
caaaagcacaaaccctggg

SEQ ID NO: 429556 - DNA, 20 bp, Homo sapiens
caaaagcacaaaccctgggg

SEQ ID NO: 429557 - DNA, 22 bp, Homo sapiens
caaaagcacaaaccctggggac

SEQ ID NO: 429558 - DNA, 19 bp, Homo sapiens
caaaagcatttatcattct

SEQ ID NO: 429559 - DNA, 17 bp, Homo sapiens
caaaagctgtgtctctg

SEQ ID NO: 429560 - DNA, 23 bp, Homo sapiens
caaaagctgtgtctctgtatata

SEQ ID NO: 429561 - DNA, 12 bp, Homo sapiens
caaaaggaaacc

SEQ ID NO: 429562 - DNA, 16 bp, Homo sapiens
caaagataacgcagga

SEQ ID NO: 429563 - DNA, 12 bp, Homo sapiens
caaagatattat

SEQ ID NO: 429564 - DNA, 17 bp, Homo sapiens
caaagatcaaaataaaa

SEQ ID NO: 429565 - DNA, 19 bp, Homo sapiens
caaagatgtactgagagga

SEQ ID NO: 429566 - DNA, 20 bp, Homo sapiens
caaagatgtactgagaggag

SEQ ID NO: 429567 - DNA, 17 bp, Homo sapiens
caaagcaacgactactt

SEQ ID NO: 429568 - DNA, 19 bp, Homo sapiens
caaagcaagggctccagca

SEQ ID NO: 429569 - DNA, 20 bp, Homo sapiens
caaagcaatgtgagtcccag

SEQ ID NO: 429570 - DNA, 23 bp, Homo sapiens
caaagcacttggactcttgctct

SEQ ID NO: 429571 - DNA, 10 bp, Homo sapiens
caaagcagga

SEQ ID NO: 429572 - DNA, 16 bp, Homo sapiens
caaagcaggagtggaa

SEQ ID NO: 429573 - DNA, 18 bp, Homo sapiens
caaagcaggagtggaagg

SEQ ID NO: 429574 - DNA, 22 bp, Homo sapiens
caaagcagtgcatgctgtccct

SEQ ID NO: 429575 - DNA, 18 bp, Homo sapiens
caaagcagttgggagtac

SEQ ID NO: 429576 - DNA, 15 bp, Homo sapiens
caaagcatcaaataa

SEQ ID NO: 429577 - DNA, 16 bp, Homo sapiens
caaagcatgctcagta

SEQ ID NO: 429578 - DNA, 20 bp, Homo sapiens
caaagcatttgactttctgt

SEQ ID NO: 429579 - DNA, 17 bp, Homo sapiens
caaagccacaaggctgg

SEQ ID NO: 429580 - DNA, 22 bp, Homo sapiens
caaagccacaaggctggccagc

SEQ ID NO: 429581 - DNA, 14 bp, Homo sapiens
caaagcccagcccg

SEQ ID NO: 429582 - DNA, 23 bp, Homo sapiens
caaagccccttgctctcccctgc

SEQ ID NO: 429583 - DNA, 17 bp, Homo sapiens
caaagcggggggagggt

SEQ ID NO: 429584 - DNA, 14 bp, Homo sapiens
caaagctaggaaag

SEQ ID NO: 429585 - DNA, 18 bp, Homo sapiens
caaagctcaaataaaaat

SEQ ID NO: 429586 - DNA, 20 bp, Homo sapiens
caaagctcaaataaaaataa

SEQ ID NO: 429587 - DNA, 20 bp, Homo sapiens
caaagctccttaaagttctg

SEQ ID NO: 429588 - DNA, 22 bp, Homo sapiens
caaagctgaagccgccaggacc

SEQ ID NO: 429589 - DNA, 16 bp, Homo sapiens
caaagctgaatatttt

SEQ ID NO: 429590 - DNA, 19 bp, Homo sapiens
caaagcttctatcccagga

SEQ ID NO: 429591 - DNA, 21 bp, Homo sapiens
caaagcttggtgtcttggcac

SEQ ID NO: 429592 - DNA, 13 bp, Homo sapiens
caaagctttcctg

SEQ ID NO: 429593 - DNA, 23 bp, Homo sapiens
caaagctttcctgccccaggcct

SEQ ID NO: 429594 - DNA, 20 bp, Homo sapiens
caaagctttttgaaaaccaa

SEQ ID NO: 429595 - DNA, 20 bp, Homo sapiens
caaaggaagctttctctgct

SEQ ID NO: 429596 - DNA, 23 bp, Homo sapiens
caaaggactgttttttcctgagc

SEQ ID NO: 429597 - DNA, 17 bp, Homo sapiens
caaaggaggctggcagg

SEQ ID NO: 429598 - DNA, 19 bp, Homo sapiens
caaaggagggcctcagaga

SEQ ID NO: 429599 - DNA, 12 bp, Homo sapiens
caaaggatgaag

SEQ ID NO: 429600 - DNA, 14 bp, Homo sapiens
caaaggatttgaaa

SEQ ID NO: 429601 - DNA, 19 bp, Homo sapiens
caaaggattttggaaaaga

SEQ ID NO: 429602 - DNA, 23 bp, Homo sapiens
caaaggattttggaaaagaaaca

SEQ ID NO: 429603 - DNA, 11 bp, Homo sapiens
caaaggcagaa

SEQ ID NO: 429604 - DNA, 13 bp, Homo sapiens
caaaggcagaaag

SEQ ID NO: 429605 - DNA, 16 bp, Homo sapiens
caaaggccagcagcag

SEQ ID NO: 429606 - DNA, 17 bp, Homo sapiens
caaagggaaatatcatt

SEQ ID NO: 429607 - DNA, 23 bp, Homo sapiens
caaagggttgggagctgatgaaa

SEQ ID NO: 429608 - DNA, 15 bp, Homo sapiens
caaaggttgtacata

SEQ ID NO: 429609 - DNA, 17 bp, Homo sapiens
caaaggttgtacatagt

SEQ ID NO: 429610 - DNA, 20 bp, Homo sapiens
caaagtaaataaaagtacaa

SEQ ID NO: 429611 - DNA, 21 bp, Homo sapiens
caaagtaacctgggcttaagt

SEQ ID NO: 429612 - DNA, 16 bp, Homo sapiens
caaagtagagaagtat

SEQ ID NO: 429613 - DNA, 19 bp, Homo sapiens
caaagtaggtatacaaaag

SEQ ID NO: 429614 - DNA, 21 bp, Homo sapiens
caaagtataaatttgtgtaat

SEQ ID NO: 429615 - DNA, 16 bp, Homo sapiens
caaagtcatgaagctc

SEQ ID NO: 429616 - DNA, 18 bp, Homo sapiens
caaagtgactgtttggct

SEQ ID NO: 429617 - DNA, 22 bp, Homo sapiens
caaagtgcagcccttcctcctg

SEQ ID NO: 429618 - DNA, 14 bp, Homo sapiens
caaagtgctgtacc

SEQ ID NO: 429619 - DNA, 21 bp, Homo sapiens
caaagtgctgtacccttccac

SEQ ID NO: 429620 - DNA, 18 bp, Homo sapiens
caaagtggggagggacaa

SEQ ID NO: 429621 - DNA, 18 bp, Homo sapiens
caaataaaaatattgtgt

SEQ ID NO: 429622 - DNA, 14 bp, Homo sapiens
caaataaaccttgt

SEQ ID NO: 429623 - DNA, 17 bp, Homo sapiens
caaataaactctaaaca

SEQ ID NO: 429624 - DNA, 20 bp, Homo sapiens
caaataaactgactttttcc

SEQ ID NO: 429625 - DNA, 18 bp, Homo sapiens
caaataaagttaaaagta

SEQ ID NO: 429626 - DNA, 19 bp, Homo sapiens
caaataactactgcaaaaa

SEQ ID NO: 429627 - DNA, 14 bp, Homo sapiens
caaataattatcac

SEQ ID NO: 429628 - DNA, 16 bp, Homo sapiens
caaataccaaagcagt

SEQ ID NO: 429629 - DNA, 23 bp, Homo sapiens
caaatagaagcttcttgctcctg

SEQ ID NO: 429630 - DNA, 22 bp, Homo sapiens
caaatagtaggctaaaaacatt

SEQ ID NO: 429631 - DNA, 19 bp, Homo sapiens
caaatatagttgaacaaga

SEQ ID NO: 429632 - DNA, 19 bp, Homo sapiens
caaatatatttaggccagg

SEQ ID NO: 429633 - DNA, 14 bp, Homo sapiens
caaatatgcacttt

SEQ ID NO: 429634 - DNA, 17 bp, Homo sapiens
caaatatgctaaatgtt

SEQ ID NO: 429635 - DNA, 18 bp, Homo sapiens
caaatatttatgacctca

SEQ ID NO: 429636 - DNA, 23 bp, Homo sapiens
caaatattttagaagctaatgta

SEQ ID NO: 429637 - DNA, 15 bp, Homo sapiens
caaatcacacctctg

SEQ ID NO: 429638 - DNA, 16 bp, Homo sapiens
caaatcacacctctgg

SEQ ID NO: 429639 - DNA, 17 bp, Homo sapiens
caaatcagcaagcttgt

SEQ ID NO: 429640 - DNA, 12 bp, Homo sapiens
caaatcattcaa

SEQ ID NO: 429641 - DNA, 14 bp, Homo sapiens
caaatcattcaaaa

SEQ ID NO: 429642 - DNA, 23 bp, Homo sapiens
caaatccaacgcttttcccacct

SEQ ID NO: 429643 - DNA, 17 bp, Homo sapiens
caaatccataccccctg

SEQ ID NO: 429644 - DNA, 20 bp, Homo sapiens
caaatccataccccctgccc

SEQ ID NO: 429645 - DNA, 14 bp, Homo sapiens
caaatcccagggaa

SEQ ID NO: 429646 - DNA, 20 bp, Homo sapiens
caaatcctccctacttccaa

SEQ ID NO: 429647 - DNA, 22 bp, Homo sapiens
caaatcctgggcatccccagcc

SEQ ID NO: 429648 - DNA, 18 bp, Homo sapiens
caaatccttccaaaaatt

SEQ ID NO: 429649 - DNA, 19 bp, Homo sapiens
caaatccttccaaaaatta

SEQ ID NO: 429650 - DNA, 15 bp, Homo sapiens
caaatctaatctctt

SEQ ID NO: 429651 - DNA, 18 bp, Homo sapiens
caaatctactgagccacg

SEQ ID NO: 429652 - DNA, 19 bp, Homo sapiens
caaatctactgagccacgg

SEQ ID NO: 429653 - DNA, 15 bp, Homo sapiens
caaatctgtatatgt

SEQ ID NO: 429654 - DNA, 23 bp, Homo sapiens
caaatctgtatatgttgtaataa

SEQ ID NO: 429655 - DNA, 16 bp, Homo sapiens
caaatcttcctctgga

SEQ ID NO: 429656 - DNA, 12 bp, Homo sapiens
caaatgaatgag

SEQ ID NO: 429657 - DNA, 22 bp, Homo sapiens
caaatgaccagcagattcaaat

SEQ ID NO: 429658 - DNA, 23 bp, Homo sapiens
caaatgagtttaaaaaaataaca

SEQ ID NO: 429659 - DNA, 20 bp, Homo sapiens
caaatgattttcatcaattt

SEQ ID NO: 429660 - DNA, 16 bp, Homo sapiens
caaatgcacaagctca

SEQ ID NO: 429661 - DNA, 18 bp, Homo sapiens
caaatgcacatttgtcac

SEQ ID NO: 429662 - DNA, 17 bp, Homo sapiens
caaatgcattcatgttt

SEQ ID NO: 429663 - DNA, 20 bp, Homo sapiens
caaatgctgcgcccttcccc

SEQ ID NO: 429664 - DNA, 14 bp, Homo sapiens
caaatggatgtaat

SEQ ID NO: 429665 - DNA, 15 bp, Homo sapiens
caaatggatgtaata

SEQ ID NO: 429666 - DNA, 13 bp, Homo sapiens
caaatgggactga

SEQ ID NO: 429667 - DNA, 19 bp, Homo sapiens
caaatgggactgatgtcat

SEQ ID NO: 429668 - DNA, 20 bp, Homo sapiens
caaatgggactgatgtcatc

SEQ ID NO: 429669 - DNA, 22 bp, Homo sapiens
caaatgggggcggctggaaaga

SEQ ID NO: 429670 - DNA, 18 bp, Homo sapiens
caaatgtatatttaactt

SEQ ID NO: 429671 - DNA, 16 bp, Homo sapiens
caaatgtcattatgta

SEQ ID NO: 429672 - DNA, 14 bp, Homo sapiens
caaatgtccaagca

SEQ ID NO: 429673 - DNA, 20 bp, Homo sapiens
caaatgtgatcaactgttca

SEQ ID NO: 429674 - DNA, 19 bp, Homo sapiens
caaatgtgtcccagtgaac

SEQ ID NO: 429675 - DNA, 21 bp, Homo sapiens
caaatgttattcaataactat

SEQ ID NO: 429676 - DNA, 13 bp, Homo sapiens
caaatgttgacct

SEQ ID NO: 429677 - DNA, 18 bp, Homo sapiens
caaattaaagggcagata

SEQ ID NO: 429678 - DNA, 18 bp, Homo sapiens
caaattatcaagctaata

SEQ ID NO: 429679 - DNA, 20 bp, Homo sapiens
caaattatcaagctaataaa

SEQ ID NO: 429680 - DNA, 21 bp, Homo sapiens
caaattatcaagctaataaaa

SEQ ID NO: 429681 - DNA, 16 bp, Homo sapiens
caaattattctagtca

SEQ ID NO: 429682 - DNA, 17 bp, Homo sapiens
caaattatttgtgtaat

SEQ ID NO: 429683 - DNA, 21 bp, Homo sapiens
caaattcaaggagatataaaa

SEQ ID NO: 429684 - DNA, 14 bp, Homo sapiens
caaattcatttttt

SEQ ID NO: 429685 - DNA, 23 bp, Homo sapiens
caaattccacccctccttccctg

SEQ ID NO: 429686 - DNA, 22 bp, Homo sapiens
caaattctttattcttccttga

SEQ ID NO: 429687 - DNA, 22 bp, Homo sapiens
caaattgatcaagatattaaaa

SEQ ID NO: 429688 - DNA, 15 bp, Homo sapiens
caaattgccttcagc

SEQ ID NO: 429689 - DNA, 21 bp, Homo sapiens
caaattggactttcaaaatta

SEQ ID NO: 429690 - DNA, 22 bp, Homo sapiens
caaattgtatctagtgcagctg

SEQ ID NO: 429691 - DNA, 15 bp, Homo sapiens
caaatttaaaacaaa

SEQ ID NO: 429692 - DNA, 11 bp, Homo sapiens
caaatttcaca

SEQ ID NO: 429693 - DNA, 13 bp, Homo sapiens
caaatttgctttg

SEQ ID NO: 429694 - DNA, 19 bp, Homo sapiens
caaatttgtacctctaagt

SEQ ID NO: 429695 - DNA, 18 bp, Homo sapiens
caaattttcactgctgct

SEQ ID NO: 429696 - DNA, 19 bp, Homo sapiens
caacaaaagggagaacatg

SEQ ID NO: 429697 - DNA, 15 bp, Homo sapiens
caacaaacactgtga

SEQ ID NO: 429698 - DNA, 23 bp, Homo sapiens
caacaaacctgtttctgcagcca

SEQ ID NO: 429699 - DNA, 20 bp, Homo sapiens
caacaaagagcgagtcccct

SEQ ID NO: 429700 - DNA, 17 bp, Homo sapiens
caacaaagcatgctcag

SEQ ID NO: 429701 - DNA, 13 bp, Homo sapiens
caacaacaacaga

SEQ ID NO: 429702 - DNA, 17 bp, Homo sapiens
caacaaccacacttaaa

SEQ ID NO: 429703 - DNA, 19 bp, Homo sapiens
caacaactccaggaaaact

SEQ ID NO: 429704 - DNA, 21 bp, Homo sapiens
caacaagggagagacctcatc

SEQ ID NO: 429705 - DNA, 19 bp, Homo sapiens
caacaaggttggcacccca

SEQ ID NO: 429706 - DNA, 16 bp, Homo sapiens
caacacaaggtgggca

SEQ ID NO: 429707 - DNA, 21 bp, Homo sapiens
caacacacacacacacaaaac

SEQ ID NO: 429708 - DNA, 15 bp, Homo sapiens
caacaccacagacac

SEQ ID NO: 429709 - DNA, 18 bp, Homo sapiens
caacacccaagtccaccc

SEQ ID NO: 429710 - DNA, 12 bp, Homo sapiens
caacaccttctt

SEQ ID NO: 429711 - DNA, 20 bp, Homo sapiens
caacactcttcttgagcaga

SEQ ID NO: 429712 - DNA, 18 bp, Homo sapiens
caacactgccagaagtgt

SEQ ID NO: 429713 - DNA, 15 bp, Homo sapiens
caacacttattttct

SEQ ID NO: 429714 - DNA, 16 bp, Homo sapiens
caacacttattttctg

SEQ ID NO: 429715 - DNA, 21 bp, Homo sapiens
caacactttgagcatttttaa

SEQ ID NO: 429716 - DNA, 14 bp, Homo sapiens
caacagaacaacaa

SEQ ID NO: 429717 - DNA, 19 bp, Homo sapiens
caacagaacaacaacaaag

SEQ ID NO: 429718 - DNA, 21 bp, Homo sapiens
caacagaacaacaacaaagca

SEQ ID NO: 429719 - DNA, 16 bp, Homo sapiens
caacagatattccaga

SEQ ID NO: 429720 - DNA, 22 bp, Homo sapiens
caacagcaacaacaacagaaca

SEQ ID NO: 429721 - DNA, 12 bp, Homo sapiens
caacagcactgg

SEQ ID NO: 429722 - DNA, 15 bp, Homo sapiens
caacagcactggctc

SEQ ID NO: 429723 - DNA, 23 bp, Homo sapiens
caacagcacttgcttgcggaact

SEQ ID NO: 429724 - DNA, 19 bp, Homo sapiens
caacagcatgtctactgct

SEQ ID NO: 429725 - DNA, 11 bp, Homo sapiens
caacagcctgt

SEQ ID NO: 429726 - DNA, 13 bp, Homo sapiens
caacagcttcttg

SEQ ID NO: 429727 - DNA, 21 bp, Homo sapiens
caacaggttgaggctaaaaca

SEQ ID NO: 429728 - DNA, 13 bp, Homo sapiens
caacaggttttat

SEQ ID NO: 429729 - DNA, 14 bp, Homo sapiens
caacagtcagccag

SEQ ID NO: 429730 - DNA, 17 bp, Homo sapiens
caacagtcagccagctt

SEQ ID NO: 429731 - DNA, 21 bp, Homo sapiens
caacagtgaacagcttcactt

SEQ ID NO: 429732 - DNA, 13 bp, Homo sapiens
caacagttaaact

SEQ ID NO: 429733 - DNA, 20 bp, Homo sapiens
caacataaaacaaaaccaag

SEQ ID NO: 429734 - DNA, 22 bp, Homo sapiens
caacatagtgagatcccatttc

SEQ ID NO: 429735 - DNA, 15 bp, Homo sapiens
caacatcaatgttca

SEQ ID NO: 429736 - DNA, 16 bp, Homo sapiens
caacatcaatgttcat

SEQ ID NO: 429737 - DNA, 13 bp, Homo sapiens
caacatcagcttg

SEQ ID NO: 429738 - DNA, 15 bp, Homo sapiens
caacatcagcttgac

SEQ ID NO: 429739 - DNA, 19 bp, Homo sapiens
caacatctttttcctccct

SEQ ID NO: 429740 - DNA, 20 bp, Homo sapiens
caacatggattccaaagcat

SEQ ID NO: 429741 - DNA, 21 bp, Homo sapiens
caacatggattccaaagcatt

SEQ ID NO: 429742 - DNA, 18 bp, Homo sapiens
caacatggtgaaaccccg

SEQ ID NO: 429743 - DNA, 15 bp, Homo sapiens
caacatgtatgtgga

SEQ ID NO: 429744 - DNA, 20 bp, Homo sapiens
caacatgttactgaccagca

SEQ ID NO: 429745 - DNA, 14 bp, Homo sapiens
caacatttccgaag

SEQ ID NO: 429746 - DNA, 14 bp, Homo sapiens
caacatttgctttt

SEQ ID NO: 429747 - DNA, 18 bp, Homo sapiens
caaccaagtcatgtgcat

SEQ ID NO: 429748 - DNA, 14 bp, Homo sapiens
caaccacacacctc

SEQ ID NO: 429749 - DNA, 20 bp, Homo sapiens
caaccacacacctcaccaga

SEQ ID NO: 429750 - DNA, 14 bp, Homo sapiens
caaccacctctggc

SEQ ID NO: 429751 - DNA, 15 bp, Homo sapiens
caaccacctctggcc

SEQ ID NO: 429752 - DNA, 14 bp, Homo sapiens
caaccactaatttg

SEQ ID NO: 429753 - DNA, 14 bp, Homo sapiens
caaccactgtaaaa

SEQ ID NO: 429754 - DNA, 19 bp, Homo sapiens
caaccaggaggggtctgcc

SEQ ID NO: 429755 - DNA, 18 bp, Homo sapiens
caaccatgagaccactgt

SEQ ID NO: 429756 - DNA, 23 bp, Homo sapiens
caaccatgagaccactgttatca

SEQ ID NO: 429757 - DNA, 20 bp, Homo sapiens
caaccatgaggtaaaagagc

SEQ ID NO: 429758 - DNA, 14 bp, Homo sapiens
caaccattccccat

SEQ ID NO: 429759 - DNA, 17 bp, Homo sapiens
caacccatgcatggcct

SEQ ID NO: 429760 - DNA, 18 bp, Homo sapiens
caacccatgcatggcctc

SEQ ID NO: 429761 - DNA, 17 bp, Homo sapiens
caacccccaccccacac

SEQ ID NO: 429762 - DNA, 14 bp, Homo sapiens
caacccccacctcc

SEQ ID NO: 429763 - DNA, 16 bp, Homo sapiens
caacccccatttctat

SEQ ID NO: 429764 - DNA, 22 bp, Homo sapiens
caaccccccatcacaaacttaa

SEQ ID NO: 429765 - DNA, 18 bp, Homo sapiens
caacccccctcccagaca

SEQ ID NO: 429766 - DNA, 18 bp, Homo sapiens
caaccccgcggtgctctg

SEQ ID NO: 429767 - DNA, 21 bp, Homo sapiens
caaccccgcggtgctctggcg

SEQ ID NO: 429768 - DNA, 14 bp, Homo sapiens
caacccctgtggag

SEQ ID NO: 429769 - DNA, 16 bp, Homo sapiens
caacccctgtggagcc

SEQ ID NO: 429770 - DNA, 14 bp, Homo sapiens
caacccgctgcttc

SEQ ID NO: 429771 - DNA, 15 bp, Homo sapiens
caaccctcctatcac

SEQ ID NO: 429772 - DNA, 11 bp, Homo sapiens
caaccctgccc

SEQ ID NO: 429773 - DNA, 14 bp, Homo sapiens
caaccctgcccctg

SEQ ID NO: 429774 - DNA, 18 bp, Homo sapiens
caaccctgccctgcacct

SEQ ID NO: 429775 - DNA, 20 bp, Homo sapiens
caacccttaccccttagcct

SEQ ID NO: 429776 - DNA, 22 bp, Homo sapiens
caacccttaccccttagcctcc

SEQ ID NO: 429777 - DNA, 23 bp, Homo sapiens
caacccttagagattgccccaga

SEQ ID NO: 429778 - DNA, 13 bp, Homo sapiens
caaccctttccaa

SEQ ID NO: 429779 - DNA, 14 bp, Homo sapiens
caaccgatgctcca

SEQ ID NO: 429780 - DNA, 18 bp, Homo sapiens
caaccgatgctccagcca

SEQ ID NO: 429781 - DNA, 19 bp, Homo sapiens
caaccggggagcccccgcc

SEQ ID NO: 429782 - DNA, 13 bp, Homo sapiens
caacctaaatttg

SEQ ID NO: 429783 - DNA, 14 bp, Homo sapiens
caacctatttgact

SEQ ID NO: 429784 - DNA, 17 bp, Homo sapiens
caacctcaatgccctgc

SEQ ID NO: 429785 - DNA, 18 bp, Homo sapiens
caacctcaatgccctgcc

SEQ ID NO: 429786 - DNA, 20 bp, Homo sapiens
caacctcaatgccctgccat

SEQ ID NO: 429787 - DNA, 21 bp, Homo sapiens
caacctcaatgccctgccatt

SEQ ID NO: 429788 - DNA, 12 bp, Homo sapiens
caacctccacct

SEQ ID NO: 429789 - DNA, 16 bp, Homo sapiens
caacctcccaacccag

SEQ ID NO: 429790 - DNA, 17 bp, Homo sapiens
caacctcccaacccaga

SEQ ID NO: 429791 - DNA, 22 bp, Homo sapiens
caacctcggcttgtgggctggt

SEQ ID NO: 429792 - DNA, 15 bp, Homo sapiens
caacctctctgatct

SEQ ID NO: 429793 - DNA, 14 bp, Homo sapiens
caacctgcccctcc

SEQ ID NO: 429794 - DNA, 16 bp, Homo sapiens
caacctgcctgtgcat

SEQ ID NO: 429795 - DNA, 21 bp, Homo sapiens
caacctgctctcctcttgcca

SEQ ID NO: 429796 - DNA, 16 bp, Homo sapiens
caacctggtcacagga

SEQ ID NO: 429797 - DNA, 12 bp, Homo sapiens
caacctgtaaat

SEQ ID NO: 429798 - DNA, 21 bp, Homo sapiens
caacctgtaaattattttaaa

SEQ ID NO: 429799 - DNA, 18 bp, Homo sapiens
caacctgtgtgagagaat

SEQ ID NO: 429800 - DNA, 16 bp, Homo sapiens
caaccttctgtggctc

SEQ ID NO: 429801 - DNA, 13 bp, Homo sapiens
caacctttgtgta

SEQ ID NO: 429802 - DNA, 14 bp, Homo sapiens
caacgaagaaaaaa

SEQ ID NO: 429803 - DNA, 12 bp, Homo sapiens
caacgcagccct

SEQ ID NO: 429804 - DNA, 13 bp, Homo sapiens
caacgtcccctcc

SEQ ID NO: 429805 - DNA, 14 bp, Homo sapiens
caacgtcccctccg

SEQ ID NO: 429806 - DNA, 23 bp, Homo sapiens
caacgtgcgtgtctctgccatgt

SEQ ID NO: 429807 - DNA, 15 bp, Homo sapiens
caacgtggggcagca

SEQ ID NO: 429808 - DNA, 18 bp, Homo sapiens
caacgttaaaagacagtg

SEQ ID NO: 429809 - DNA, 22 bp, Homo sapiens
caactaacaagaaactcacccc

SEQ ID NO: 429810 - DNA, 17 bp, Homo sapiens
caactaacaatgccttg

SEQ ID NO: 429811 - DNA, 13 bp, Homo sapiens
caactaagccctc

SEQ ID NO: 429812 - DNA, 14 bp, Homo sapiens
caactaagccctcg

SEQ ID NO: 429813 - DNA, 16 bp, Homo sapiens
caactaatcaagagtg

SEQ ID NO: 429814 - DNA, 17 bp, Homo sapiens
caactatttataaacta

SEQ ID NO: 429815 - DNA, 15 bp, Homo sapiens
caactcactgtgctc

SEQ ID NO: 429816 - DNA, 13 bp, Homo sapiens
caactccaaggca

SEQ ID NO: 429817 - DNA, 13 bp, Homo sapiens
caactccagccac

SEQ ID NO: 429818 - DNA, 22 bp, Homo sapiens
caactccagccacccagccagg

SEQ ID NO: 429819 - DNA, 23 bp, Homo sapiens
caactccagccacccagccagga

SEQ ID NO: 429820 - DNA, 17 bp, Homo sapiens
caactccaggggcacct

SEQ ID NO: 429821 - DNA, 23 bp, Homo sapiens
caactccagggttaaagaaaggc

SEQ ID NO: 429822 - DNA, 19 bp, Homo sapiens
caactccatgaccaggcca

SEQ ID NO: 429823 - DNA, 20 bp, Homo sapiens
caactccatgaccaggccac

SEQ ID NO: 429824 - DNA, 22 bp, Homo sapiens
caactccatgaccaggccacca

SEQ ID NO: 429825 - DNA, 14 bp, Homo sapiens
caactccatgccta

SEQ ID NO: 429826 - DNA, 11 bp, Homo sapiens
caactcccagc

SEQ ID NO: 429827 - DNA, 12 bp, Homo sapiens
caactcccagcc

SEQ ID NO: 429828 - DNA, 13 bp, Homo sapiens
caactcccagcca

SEQ ID NO: 429829 - DNA, 19 bp, Homo sapiens
caactcccagccaccacca

SEQ ID NO: 429830 - DNA, 15 bp, Homo sapiens
caactccgcccagcc

SEQ ID NO: 429831 - DNA, 22 bp, Homo sapiens
caactcgggagcattctgcctg

SEQ ID NO: 429832 - DNA, 23 bp, Homo sapiens
caactcgggagcattctgcctgc

SEQ ID NO: 429833 - DNA, 12 bp, Homo sapiens
caactctccaaa

SEQ ID NO: 429834 - DNA, 13 bp, Homo sapiens
caactctccactc

SEQ ID NO: 429835 - DNA, 19 bp, Homo sapiens
caactctccccagtgcctg

SEQ ID NO: 429836 - DNA, 22 bp, Homo sapiens
caactctccccagtgcctgcca

SEQ ID NO: 429837 - DNA, 23 bp, Homo sapiens
caactctccccagtgcctgccac

SEQ ID NO: 429838 - DNA, 18 bp, Homo sapiens
caactctgactgtaaaat

SEQ ID NO: 429839 - DNA, 15 bp, Homo sapiens
caactctgcactcca

SEQ ID NO: 429840 - DNA, 23 bp, Homo sapiens
caactctgcactccatggccacc

SEQ ID NO: 429841 - DNA, 11 bp, Homo sapiens
caactctggcc

SEQ ID NO: 429842 - DNA, 13 bp, Homo sapiens
caactgaacgaca

SEQ ID NO: 429843 - DNA, 17 bp, Homo sapiens
caactgacttctgctag

SEQ ID NO: 429844 - DNA, 19 bp, Homo sapiens
caactgacttctgctaggt

SEQ ID NO: 429845 - DNA, 13 bp, Homo sapiens
caactgagccaaa

SEQ ID NO: 429846 - DNA, 22 bp, Homo sapiens
caactgagccaaaaacaataaa

SEQ ID NO: 429847 - DNA, 18 bp, Homo sapiens
caactgcatccaggcctg

SEQ ID NO: 429848 - DNA, 22 bp, Homo sapiens
caactgcatccaggcctgaggc

SEQ ID NO: 429849 - DNA, 13 bp, Homo sapiens
caactgctgcccc

SEQ ID NO: 429850 - DNA, 14 bp, Homo sapiens
caactgctgcccca

SEQ ID NO: 429851 - DNA, 21 bp, Homo sapiens
caactgctgccccaaaggaag

SEQ ID NO: 429852 - DNA, 23 bp, Homo sapiens
caactgtggtcccagctacaggg

SEQ ID NO: 429853 - DNA, 14 bp, Homo sapiens
caacttaaatcact

SEQ ID NO: 429854 - DNA, 23 bp, Homo sapiens
caacttaagtttagaaattacaa

SEQ ID NO: 429855 - DNA, 18 bp, Homo sapiens
caacttaggctacagaat

SEQ ID NO: 429856 - DNA, 14 bp, Homo sapiens
caacttatggactc

SEQ ID NO: 429857 - DNA, 22 bp, Homo sapiens
caacttcaccaccccctgtccc

SEQ ID NO: 429858 - DNA, 17 bp, Homo sapiens
caacttccctgttcttt

SEQ ID NO: 429859 - DNA, 14 bp, Homo sapiens
caacttctgtccct

SEQ ID NO: 429860 - DNA, 9 bp, Homo sapiens
caacttgag

SEQ ID NO: 429861 - DNA, 17 bp, Homo sapiens
caacttggttctgcttc

SEQ ID NO: 429862 - DNA, 15 bp, Homo sapiens
caactttcatttgaa

SEQ ID NO: 429863 - DNA, 23 bp, Homo sapiens
caactttcatttgaaagtgggtt

SEQ ID NO: 429864 - DNA, 15 bp, Homo sapiens
caactttccagactt

SEQ ID NO: 429865 - DNA, 15 bp, Homo sapiens
caactttctcttgta

SEQ ID NO: 429866 - DNA, 16 bp, Homo sapiens
caactttctgtaaact

SEQ ID NO: 429867 - DNA, 12 bp, Homo sapiens
caactttggaaa

SEQ ID NO: 429868 - DNA, 13 bp, Homo sapiens
caactttggaaaa

SEQ ID NO: 429869 - DNA, 17 bp, Homo sapiens
caactttggaatttgaa

SEQ ID NO: 429870 - DNA, 15 bp, Homo sapiens
caacttttcatccag

SEQ ID NO: 429871 - DNA, 17 bp, Homo sapiens
caacttttcatttttgc

SEQ ID NO: 429872 - DNA, 17 bp, Homo sapiens
caagaaactcaccccca

SEQ ID NO: 429873 - DNA, 14 bp, Homo sapiens
caagaaagtttccc

SEQ ID NO: 429874 - DNA, 23 bp, Homo sapiens
caagaaatcgccttatgagaaca

SEQ ID NO: 429875 - DNA, 22 bp, Homo sapiens
caagaaattcattaaagaaaaa

SEQ ID NO: 429876 - DNA, 13 bp, Homo sapiens
caagaaatttgat

SEQ ID NO: 429877 - DNA, 16 bp, Homo sapiens
caagaaatttgatttc

SEQ ID NO: 429878 - DNA, 13 bp, Homo sapiens
caagaacaaacag

SEQ ID NO: 429879 - DNA, 17 bp, Homo sapiens
caagaacagcaggccca

SEQ ID NO: 429880 - DNA, 20 bp, Homo sapiens
caagaactttccaggaaggc

SEQ ID NO: 429881 - DNA, 13 bp, Homo sapiens
caagaagaatata

SEQ ID NO: 429882 - DNA, 18 bp, Homo sapiens
caagaagaatataaataa

SEQ ID NO: 429883 - DNA, 12 bp, Homo sapiens
caagaagacatg

SEQ ID NO: 429884 - DNA, 16 bp, Homo sapiens
caagaagactgtattt

SEQ ID NO: 429885 - DNA, 21 bp, Homo sapiens
caagaagccctccttgccacc

SEQ ID NO: 429886 - DNA, 14 bp, Homo sapiens
caagaatacagaaa

SEQ ID NO: 429887 - DNA, 21 bp, Homo sapiens
caagaatcggcatgtatactt

SEQ ID NO: 429888 - DNA, 22 bp, Homo sapiens
caagaatcggcatgtatactta

SEQ ID NO: 429889 - DNA, 19 bp, Homo sapiens
caagaattctccaaaacaa

SEQ ID NO: 429890 - DNA, 21 bp, Homo sapiens
caagaattctccaaaacaatt

SEQ ID NO: 429891 - DNA, 13 bp, Homo sapiens
caagacacccaag

SEQ ID NO: 429892 - DNA, 16 bp, Homo sapiens
caagacacccagtgga

SEQ ID NO: 429893 - DNA, 21 bp, Homo sapiens
caagacacccagtggaaccaa

SEQ ID NO: 429894 - DNA, 13 bp, Homo sapiens
caagacagatgcc

SEQ ID NO: 429895 - DNA, 13 bp, Homo sapiens
caagacattgtca

SEQ ID NO: 429896 - DNA, 20 bp, Homo sapiens
caagacccccatctctgcaa

SEQ ID NO: 429897 - DNA, 15 bp, Homo sapiens
caagacccctgctcc

SEQ ID NO: 429898 - DNA, 16 bp, Homo sapiens
caagacccctgctcct

SEQ ID NO: 429899 - DNA, 13 bp, Homo sapiens
caagacctgactc

SEQ ID NO: 429900 - DNA, 14 bp, Homo sapiens
caagacctgttggt

SEQ ID NO: 429901 - DNA, 22 bp, Homo sapiens
caagactagactactcaatatt

SEQ ID NO: 429902 - DNA, 14 bp, Homo sapiens
caagactctgtctc

SEQ ID NO: 429903 - DNA, 15 bp, Homo sapiens
caagactctgtctca

SEQ ID NO: 429904 - DNA, 17 bp, Homo sapiens
caagactgcctccctct

SEQ ID NO: 429905 - DNA, 17 bp, Homo sapiens
caagactgttgctcaaa

SEQ ID NO: 429906 - DNA, 21 bp, Homo sapiens
caagacttcagattcagccga

SEQ ID NO: 429907 - DNA, 19 bp, Homo sapiens
caagacttcgggaaggtgt

SEQ ID NO: 429908 - DNA, 21 bp, Homo sapiens
caagacttggtgtcctttccc

SEQ ID NO: 429909 - DNA, 15 bp, Homo sapiens
caagacttttctttg

SEQ ID NO: 429910 - DNA, 20 bp, Homo sapiens
caagagaaatgaggaagaat

SEQ ID NO: 429911 - DNA, 22 bp, Homo sapiens
caagagaaatgaggaagaatcc

SEQ ID NO: 429912 - DNA, 14 bp, Homo sapiens
caagagaaggagat

SEQ ID NO: 429913 - DNA, 16 bp, Homo sapiens
caagagaaggagatgt

SEQ ID NO: 429914 - DNA, 20 bp, Homo sapiens
caagagaaggagatgtaatg

SEQ ID NO: 429915 - DNA, 22 bp, Homo sapiens
caagagaattgcttgaacccag

SEQ ID NO: 429916 - DNA, 13 bp, Homo sapiens
caagagagaaaga

SEQ ID NO: 429917 - DNA, 13 bp, Homo sapiens
caagagagatgtt

SEQ ID NO: 429918 - DNA, 15 bp, Homo sapiens
caagagagatgtttt

SEQ ID NO: 429919 - DNA, 22 bp, Homo sapiens
caagagatgagaaacaacagaa

SEQ ID NO: 429920 - DNA, 15 bp, Homo sapiens
caagagcagcctgtg

SEQ ID NO: 429921 - DNA, 18 bp, Homo sapiens
caagagcagcctgtggca

SEQ ID NO: 429922 - DNA, 15 bp, Homo sapiens
caagaggaagagaga

SEQ ID NO: 429923 - DNA, 13 bp, Homo sapiens
caagaggagcagg

SEQ ID NO: 429924 - DNA, 17 bp, Homo sapiens
caagaggagcaggaagc

SEQ ID NO: 429925 - DNA, 19 bp, Homo sapiens
caagaggctagccccaggg

SEQ ID NO: 429926 - DNA, 21 bp, Homo sapiens
caagaggctagccccagggtg

SEQ ID NO: 429927 - DNA, 21 bp, Homo sapiens
caagagggactgtatttctgt

SEQ ID NO: 429928 - DNA, 18 bp, Homo sapiens
caagagggcactggtggc

SEQ ID NO: 429929 - DNA, 19 bp, Homo sapiens
caagagggcactggtggcc

SEQ ID NO: 429930 - DNA, 18 bp, Homo sapiens
caagagtggtggcagctc

SEQ ID NO: 429931 - DNA, 15 bp, Homo sapiens
caagataaaaaacga

SEQ ID NO: 429932 - DNA, 21 bp, Homo sapiens
caagatacatatgaggacaag

SEQ ID NO: 429933 - DNA, 14 bp, Homo sapiens
caagatcacaaata

SEQ ID NO: 429934 - DNA, 19 bp, Homo sapiens
caagatccaaatgctgtgc

SEQ ID NO: 429935 - DNA, 19 bp, Homo sapiens
caagatgagctgcagcccc

SEQ ID NO: 429936 - DNA, 21 bp, Homo sapiens
caagatgagctgcagcccccc

SEQ ID NO: 429937 - DNA, 22 bp, Homo sapiens
caagattaagttataccagcaa

SEQ ID NO: 429938 - DNA, 21 bp, Homo sapiens
caagattatattataataatg

SEQ ID NO: 429939 - DNA, 14 bp, Homo sapiens
caagattggaaaga

SEQ ID NO: 429940 - DNA, 17 bp, Homo sapiens
caagattggaaagacag

SEQ ID NO: 429941 - DNA, 20 bp, Homo sapiens
caagattggaaagacaggaa

SEQ ID NO: 429942 - DNA, 14 bp, Homo sapiens
caagatttagaaaa

SEQ ID NO: 429943 - DNA, 23 bp, Homo sapiens
caagatttccctaaaaattccac

SEQ ID NO: 429944 - DNA, 22 bp, Homo sapiens
caagattttgaatgcttcctga

SEQ ID NO: 429945 - DNA, 19 bp, Homo sapiens
caagcaaaccaatggtgat

SEQ ID NO: 429946 - DNA, 17 bp, Homo sapiens
caagcaatcctcctgag

SEQ ID NO: 429947 - DNA, 20 bp, Homo sapiens
caagcactcgagaccatcct

SEQ ID NO: 429948 - DNA, 22 bp, Homo sapiens
caagcactcgagaccatcctgg

SEQ ID NO: 429949 - DNA, 19 bp, Homo sapiens
caagcacttttcctgtctc

SEQ ID NO: 429950 - DNA, 13 bp, Homo sapiens
caagcagagacct

SEQ ID NO: 429951 - DNA, 18 bp, Homo sapiens
caagcagccagccagtct

SEQ ID NO: 429952 - DNA, 15 bp, Homo sapiens
caaggtcctctcagt

SEQ ID NO: 429953 - DNA, 10 bp, Homo sapiens
caaggtcctg

SEQ ID NO: 429954 - DNA, 21 bp, Homo sapiens
caaggtctaggtggaggtggg

SEQ ID NO: 429955 - DNA, 19 bp, Homo sapiens
caaggtgagggatgccata

SEQ ID NO: 429956 - DNA, 15 bp, Homo sapiens
caaggtgataggaaa

SEQ ID NO: 429957 - DNA, 17 bp, Homo sapiens
caaggtgggggagcctg

SEQ ID NO: 429958 - DNA, 17 bp, Homo sapiens
caaggtgggttccaggg

SEQ ID NO: 429959 - DNA, 17 bp, Homo sapiens
caaggtggtcttggaga

SEQ ID NO: 429960 - DNA, 19 bp, Homo sapiens
caaggtggtcttggagagg

SEQ ID NO: 429961 - DNA, 20 bp, Homo sapiens
caaggtggtcttggagagga

SEQ ID NO: 429962 - DNA, 22 bp, Homo sapiens
caaggtggtcttggagaggagg

SEQ ID NO: 429963 - DNA, 16 bp, Homo sapiens
caaggttgctgttgtg

SEQ ID NO: 429964 - DNA, 20 bp, Homo sapiens
caagtaaccaggccccagcc

SEQ ID NO: 429965 - DNA, 23 bp, Homo sapiens
caagtaaccaggccccagcctcc

SEQ ID NO: 429966 - DNA, 16 bp, Homo sapiens
caagtaagaagacatg

SEQ ID NO: 429967 - DNA, 14 bp, Homo sapiens
caagtaatgaattt

SEQ ID NO: 429968 - DNA, 17 bp, Homo sapiens
caagtaatgaattttat

SEQ ID NO: 429969 - DNA, 21 bp, Homo sapiens
caagtagattgatctaaggca

SEQ ID NO: 429970 - DNA, 14 bp, Homo sapiens
caagtagcacactg

SEQ ID NO: 429971 - DNA, 15 bp, Homo sapiens
caagtagctttccac

SEQ ID NO: 429972 - DNA, 17 bp, Homo sapiens
caagtagctttccacat

SEQ ID NO: 429973 - DNA, 15 bp, Homo sapiens
caagtaggagacaca

SEQ ID NO: 429974 - DNA, 15 bp, Homo sapiens
caagtatgtgagtgt

SEQ ID NO: 429975 - DNA, 20 bp, Homo sapiens
caagtatttattattgaaga

SEQ ID NO: 429976 - DNA, 16 bp, Homo sapiens
caagtcaatcatttct

SEQ ID NO: 429977 - DNA, 13 bp, Homo sapiens
caagtcacagctg

SEQ ID NO: 429978 - DNA, 14 bp, Homo sapiens
caagtcacagctgc

SEQ ID NO: 429979 - DNA, 17 bp, Homo sapiens
caagtcacagctgcagc

SEQ ID NO: 429980 - DNA, 20 bp, Homo sapiens
caagtcacagctgcagctgg

SEQ ID NO: 429981 - DNA, 23 bp, Homo sapiens
caagtcacagctgcagctgggcc

SEQ ID NO: 429982 - DNA, 12 bp, Homo sapiens
caagtcatttta

SEQ ID NO: 429983 - DNA, 18 bp, Homo sapiens
caagtccaacctgcctgt

SEQ ID NO: 429984 - DNA, 21 bp, Homo sapiens
caagtccaccccaattaactg

SEQ ID NO: 429985 - DNA, 20 bp, Homo sapiens
caagtccaggtcgggctcag

SEQ ID NO: 429986 - DNA, 16 bp, Homo sapiens
caagtcccgaggcagc

SEQ ID NO: 429987 - DNA, 23 bp, Homo sapiens
caagtcccgaggcagcaacagga

SEQ ID NO: 429988 - DNA, 16 bp, Homo sapiens
caagtcccttgacctt

SEQ ID NO: 429989 - DNA, 20 bp, Homo sapiens
caagtcccttgacctttcca

SEQ ID NO: 429990 - DNA, 14 bp, Homo sapiens
caagtcctgccttt

SEQ ID NO: 429991 - DNA, 17 bp, Homo sapiens
caagtcctggctacatc

SEQ ID NO: 429992 - DNA, 22 bp, Homo sapiens
caagtcctggctacatcccagc

SEQ ID NO: 429993 - DNA, 15 bp, Homo sapiens
caagtccttacctct

SEQ ID NO: 429994 - DNA, 17 bp, Homo sapiens
caagtcgcggctgcagg

SEQ ID NO: 429995 - DNA, 15 bp, Homo sapiens
caagtctagtggaac

SEQ ID NO: 429996 - DNA, 15 bp, Homo sapiens
caagtctctctgtga

SEQ ID NO: 429997 - DNA, 19 bp, Homo sapiens
caagtctctgctggcccag

SEQ ID NO: 429998 - DNA, 12 bp, Homo sapiens
caagtctgtgaa

SEQ ID NO: 429999 - DNA, 14 bp, Homo sapiens
caagtctgtgcctg

SEQ ID NO: 430000 - DNA, 18 bp, Homo sapiens
caagtctgtgcctggagc

SEQ ID NO: 430001 - DNA, 19 bp, Homo sapiens
caagtctgtgcctggagct

SEQ ID NO: 430002 - DNA, 20 bp, Homo sapiens
caagtgaatgagtttccagc

SEQ ID NO: 430003 - DNA, 19 bp, Homo sapiens
caagtgagcaaacctgccc

SEQ ID NO: 430004 - DNA, 21 bp, Homo sapiens
caagtgagcaaacctgcccca

SEQ ID NO: 430005 - DNA, 13 bp, Homo sapiens
caagtgagcactg

SEQ ID NO: 430006 - DNA, 16 bp, Homo sapiens
caagtgaggcaagaga

SEQ ID NO: 430007 - DNA, 14 bp, Homo sapiens
caagtgattctcct

SEQ ID NO: 430008 - DNA, 16 bp, Homo sapiens
caagtgattctcctgc

SEQ ID NO: 430009 - DNA, 20 bp, Homo sapiens
caagtgattctcctgcctca

SEQ ID NO: 430010 - DNA, 19 bp, Homo sapiens
caagtgattgaaaatagta

SEQ ID NO: 430011 - DNA, 21 bp, Homo sapiens
caagtgattgacaactgaaga

SEQ ID NO: 430012 - DNA, 23 bp, Homo sapiens
caagtgcatttttatctgtgagt

SEQ ID NO: 430013 - DNA, 16 bp, Homo sapiens
caagtgcctgctttta

SEQ ID NO: 430014 - DNA, 20 bp, Homo sapiens
caagtgctcagttccaatgt

SEQ ID NO: 430015 - DNA, 16 bp, Homo sapiens
caagtgctgaacagtg

SEQ ID NO: 430016 - DNA, 18 bp, Homo sapiens
caagtgggagatgaaaac

SEQ ID NO: 430017 - DNA, 19 bp, Homo sapiens
caagtgggagatgaaaacc

SEQ ID NO: 430018 - DNA, 12 bp, Homo sapiens
caagtgggctgg

SEQ ID NO: 430019 - DNA, 20 bp, Homo sapiens
caagtggggcctccttgtcc

SEQ ID NO: 430020 - DNA, 23 bp, Homo sapiens
caagtggtttgggccccattcag

SEQ ID NO: 430021 - DNA, 14 bp, Homo sapiens
caagtgtacagtat

SEQ ID NO: 430022 - DNA, 16 bp, Homo sapiens
caagtgtatatcagaa

SEQ ID NO: 430023 - DNA, 20 bp, Homo sapiens
caagtgtctcagtccacctg

SEQ ID NO: 430024 - DNA, 14 bp, Homo sapiens
caagtgtcttccat

SEQ ID NO: 430025 - DNA, 16 bp, Homo sapiens
caagtgtgcctgctat

SEQ ID NO: 430026 - DNA, 23 bp, Homo sapiens
caagtgtgtatgtgcgtgtgtgc

SEQ ID NO: 430027 - DNA, 14 bp, Homo sapiens
caagtgtgtgcaca

SEQ ID NO: 430028 - DNA, 21 bp, Homo sapiens
caagtgtgtgcacatgtgtgc

SEQ ID NO: 430029 - DNA, 17 bp, Homo sapiens
caagtgtgtgcatgtgt

SEQ ID NO: 430030 - DNA, 11 bp, Homo sapiens
caagtgtgtgt

SEQ ID NO: 430031 - DNA, 14 bp, Homo sapiens
caagtgtgtgtgca

SEQ ID NO: 430032 - DNA, 20 bp, Homo sapiens
caagttataaatcaatgtca

SEQ ID NO: 430033 - DNA, 15 bp, Homo sapiens
caagttattaatttc

SEQ ID NO: 430034 - DNA, 21 bp, Homo sapiens
caagttattaatttcttcaca

SEQ ID NO: 430035 - DNA, 10 bp, Homo sapiens
caagttcaat

SEQ ID NO: 430036 - DNA, 15 bp, Homo sapiens
caagttcaatatgga

SEQ ID NO: 430037 - DNA, 18 bp, Homo sapiens
caagttcattacctccct

SEQ ID NO: 430038 - DNA, 20 bp, Homo sapiens
caagttccgtctcctctcca

SEQ ID NO: 430039 - DNA, 18 bp, Homo sapiens
caagttcttcacctctat

SEQ ID NO: 430040 - DNA, 15 bp, Homo sapiens
caagttgagaacaaa

SEQ ID NO: 430041 - DNA, 15 bp, Homo sapiens
caagttgcgacggag

SEQ ID NO: 430042 - DNA, 23 bp, Homo sapiens
caagttgcgacggagagaaaaaa

SEQ ID NO: 430043 - DNA, 14 bp, Homo sapiens
caagttggactggg

SEQ ID NO: 430044 - DNA, 19 bp, Homo sapiens
caagttggctagaagaaag

SEQ ID NO: 430045 - DNA, 15 bp, Homo sapiens
caagttgtgcctttc

SEQ ID NO: 430046 - DNA, 13 bp, Homo sapiens
caagttgtgcttg

SEQ ID NO: 430047 - DNA, 17 bp, Homo sapiens
caagttgtgcttgttta

SEQ ID NO: 430048 - DNA, 19 bp, Homo sapiens
caagttgtttggtactttt

SEQ ID NO: 430049 - DNA, 16 bp, Homo sapiens
caagtttataaaacat

SEQ ID NO: 430050 - DNA, 15 bp, Homo sapiens
caagtttcagacagg

SEQ ID NO: 430051 - DNA, 21 bp, Homo sapiens
caagtttcagtaatagctgaa

SEQ ID NO: 430052 - DNA, 19 bp, Homo sapiens
caagttttgtataaataat

SEQ ID NO: 430053 - DNA, 12 bp, Homo sapiens
caagtttttggt

SEQ ID NO: 430054 - DNA, 15 bp, Homo sapiens
caataaaacaagaat

SEQ ID NO: 430055 - DNA, 13 bp, Homo sapiens
caataaaacattc

SEQ ID NO: 430056 - DNA, 12 bp, Homo sapiens
caataaaagtga

SEQ ID NO: 430057 - DNA, 13 bp, Homo sapiens
caataaaagtgac

SEQ ID NO: 430058 - DNA, 19 bp, Homo sapiens
caataaaagtgactctcag

SEQ ID NO: 430059 - DNA, 20 bp, Homo sapiens
caataaaagttttctccaac

SEQ ID NO: 430060 - DNA, 15 bp, Homo sapiens
caataaaatgtgatt

SEQ ID NO: 430061 - DNA, 20 bp, Homo sapiens
caataaaatgtgatttttct

SEQ ID NO: 430062 - DNA, 21 bp, Homo sapiens
caataaaatgtgatttttctg

SEQ ID NO: 430063 - DNA, 22 bp, Homo sapiens
caataaaatgtgatttttctga

SEQ ID NO: 430064 - DNA, 14 bp, Homo sapiens
caataaacatcctt

SEQ ID NO: 430065 - DNA, 23 bp, Homo sapiens
caataaaccaggtttagacagta

SEQ ID NO: 430066 - DNA, 19 bp, Homo sapiens
caataaagaaaaaaatagt

SEQ ID NO: 430067 - DNA, 11 bp, Homo sapiens
caataaagaat

SEQ ID NO: 430068 - DNA, 11 bp, Homo sapiens
caataaagctg

SEQ ID NO: 430069 - DNA, 15 bp, Homo sapiens
caataaagctgctga

SEQ ID NO: 430070 - DNA, 17 bp, Homo sapiens
caataaagctgctgaga

SEQ ID NO: 430071 - DNA, 22 bp, Homo sapiens
caataaagctgctgagaatcta

SEQ ID NO: 430072 - DNA, 19 bp, Homo sapiens
caataaagctggacaagaa

SEQ ID NO: 430073 - DNA, 23 bp, Homo sapiens
caataaagctggacaagaagctg

SEQ ID NO: 430074 - DNA, 23 bp, Homo sapiens
caataaaggtcccttagccccga

SEQ ID NO: 430075 - DNA, 14 bp, Homo sapiens
caataaatatttgt

SEQ ID NO: 430076 - DNA, 22 bp, Homo sapiens
caataaatggctcgtgggctct

SEQ ID NO: 430077 - DNA, 19 bp, Homo sapiens
caataaattttatctcagt

SEQ ID NO: 430078 - DNA, 14 bp, Homo sapiens
caataactactgtg

SEQ ID NO: 430079 - DNA, 17 bp, Homo sapiens
caataactactgtgttc

SEQ ID NO: 430080 - DNA, 19 bp, Homo sapiens
caataactactgtgttcct

SEQ ID NO: 430081 - DNA, 21 bp, Homo sapiens
caataactcggtgtgtggccg

SEQ ID NO: 430082 - DNA, 15 bp, Homo sapiens
caattaggtctgcat

SEQ ID NO: 430083 - DNA, 22 bp, Homo sapiens
caattaggtctgcattttctca

SEQ ID NO: 430084 - DNA, 20 bp, Homo sapiens
caattatgtgacaacctttg

SEQ ID NO: 430085 - DNA, 23 bp, Homo sapiens
caattcagagaatagcagtttca

SEQ ID NO: 430086 - DNA, 16 bp, Homo sapiens
caattccaaaattcca

SEQ ID NO: 430087 - DNA, 13 bp, Homo sapiens
caattccacctgc

SEQ ID NO: 430088 - DNA, 13 bp, Homo sapiens
caattccagagct

SEQ ID NO: 430089 - DNA, 15 bp, Homo sapiens
caattccagagctgt

SEQ ID NO: 430090 - DNA, 16 bp, Homo sapiens
caattcctagataaaa

SEQ ID NO: 430091 - DNA, 18 bp, Homo sapiens
caattcctagataaaaag

SEQ ID NO: 430092 - DNA, 22 bp, Homo sapiens
caattcctcatttgttcattaa

SEQ ID NO: 430093 - DNA, 16 bp, Homo sapiens
caattctcctgcctca

SEQ ID NO: 430094 - DNA, 13 bp, Homo sapiens
caattctgtccct

SEQ ID NO: 430095 - DNA, 22 bp, Homo sapiens
caattgaaatttttaaatcatt

SEQ ID NO: 430096 - DNA, 14 bp, Homo sapiens
caattgcacaaata

SEQ ID NO: 430097 - DNA, 16 bp, Homo sapiens
caattgcacaaataca

SEQ ID NO: 430098 - DNA, 17 bp, Homo sapiens
caattgcacaaatacaa

SEQ ID NO: 430099 - DNA, 15 bp, Homo sapiens
caattgcactgctgt

SEQ ID NO: 430100 - DNA, 16 bp, Homo sapiens
caattgcactgctgtt

SEQ ID NO: 430101 - DNA, 13 bp, Homo sapiens
caattgccctgcc

SEQ ID NO: 430102 - DNA, 15 bp, Homo sapiens
caattgccctgccag

SEQ ID NO: 430103 - DNA, 18 bp, Homo sapiens
caattgccctgccaggct

SEQ ID NO: 430104 - DNA, 12 bp, Homo sapiens
caattgccctgt

SEQ ID NO: 430105 - DNA, 17 bp, Homo sapiens
caattggacaattattt

SEQ ID NO: 430106 - DNA, 22 bp, Homo sapiens
caattgggatggcgctaggcat

SEQ ID NO: 430107 - DNA, 16 bp, Homo sapiens
caattgtcatttataa

SEQ ID NO: 430108 - DNA, 21 bp, Homo sapiens
caattgtgagccaccacgtcc

SEQ ID NO: 430109 - DNA, 22 bp, Homo sapiens
caatttaaggaacacagagcag

SEQ ID NO: 430110 - DNA, 18 bp, Homo sapiens
caatttactttttaaaca

SEQ ID NO: 430111 - DNA, 21 bp, Homo sapiens
caatttactttttaaacagtg

SEQ ID NO: 430112 - DNA, 23 bp, Homo sapiens
caatttaggaatgctcaatgtgc

SEQ ID NO: 430113 - DNA, 19 bp, Homo sapiens
caatttattttattttagc

SEQ ID NO: 430114 - DNA, 19 bp, Homo sapiens
caatttcaaaatgcatgtg

SEQ ID NO: 430115 - DNA, 20 bp, Homo sapiens
caatttcaaaatgcatgtga

SEQ ID NO: 430116 - DNA, 21 bp, Homo sapiens
caatttccattcttttaaatg

SEQ ID NO: 430117 - DNA, 21 bp, Homo sapiens
caatttcctttatatttagtg

SEQ ID NO: 430118 - DNA, 19 bp, Homo sapiens
caatttcttctgtagctat

SEQ ID NO: 430119 - DNA, 22 bp, Homo sapiens
caatttctttctttccttaata

SEQ ID NO: 430120 - DNA, 21 bp, Homo sapiens
caatttgaaatcaccttttct

SEQ ID NO: 430121 - DNA, 23 bp, Homo sapiens
caatttgcataatactaatttat

SEQ ID NO: 430122 - DNA, 13 bp, Homo sapiens
caatttgccttag

SEQ ID NO: 430123 - DNA, 23 bp, Homo sapiens
caatttgttcagtctttcattta

SEQ ID NO: 430124 - DNA, 22 bp, Homo sapiens
caatttgttcatcctattgttg

SEQ ID NO: 430125 - DNA, 15 bp, Homo sapiens
caatttgtttaaaga

SEQ ID NO: 430126 - DNA, 16 bp, Homo sapiens
caattttaaaaaataa

SEQ ID NO: 430127 - DNA, 17 bp, Homo sapiens
caattttaatgctattt

SEQ ID NO: 430128 - DNA, 16 bp, Homo sapiens
caattttgtatttaat

SEQ ID NO: 430129 - DNA, 14 bp, Homo sapiens
caattttttaaacc

SEQ ID NO: 430130 - DNA, 22 bp, Homo sapiens
cacaaaaaaaatttaaaaaaat

SEQ ID NO: 430131 - DNA, 15 bp, Homo sapiens
cacaaaaaggagcgg

SEQ ID NO: 430132 - DNA, 11 bp, Homo sapiens
cacaaaacaac

SEQ ID NO: 430133 - DNA, 14 bp, Homo sapiens
cacaaaagattatg

SEQ ID NO: 430134 - DNA, 14 bp, Homo sapiens
cacaaaagcctctc

SEQ ID NO: 430135 - DNA, 15 bp, Homo sapiens
cacaaaatatttcta

SEQ ID NO: 430136 - DNA, 13 bp, Homo sapiens
cacaaacacctcc

SEQ ID NO: 430137 - DNA, 13 bp, Homo sapiens
cacaaaccctggg

SEQ ID NO: 430138 - DNA, 15 bp, Homo sapiens
cacaaaccctgggga

SEQ ID NO: 430139 - DNA, 18 bp, Homo sapiens
cacaaagcccttccatgt

SEQ ID NO: 430140 - DNA, 13 bp, Homo sapiens
cacaaagccttat

SEQ ID NO: 430141 - DNA, 19 bp, Homo sapiens
cacaaatattgcttggact

SEQ ID NO: 430142 - DNA, 10 bp, Homo sapiens
cacaaatgca

SEQ ID NO: 430143 - DNA, 15 bp, Homo sapiens
cacaaatgcagacac

SEQ ID NO: 430144 - DNA, 16 bp, Homo sapiens
cacaaatgcagacaca

SEQ ID NO: 430145 - DNA, 17 bp, Homo sapiens
cacaaatgcagacacac

SEQ ID NO: 430146 - DNA, 18 bp, Homo sapiens
cacaaatgcagacacaca

SEQ ID NO: 430147 - DNA, 16 bp, Homo sapiens
cacaaatgtcctcaga

SEQ ID NO: 430148 - DNA, 20 bp, Homo sapiens
cacaaatgtgtcccagtgaa

SEQ ID NO: 430149 - DNA, 15 bp, Homo sapiens
cacaaattgaaagct

SEQ ID NO: 430150 - DNA, 22 bp, Homo sapiens
cacaacaaaaatttgaaccaaa

SEQ ID NO: 430151 - DNA, 18 bp, Homo sapiens
cacaacctctctgatctt

SEQ ID NO: 430152 - DNA, 15 bp, Homo sapiens
cacaactaacaatgc

SEQ ID NO: 430153 - DNA, 16 bp, Homo sapiens
cacaactaacaatgcc

SEQ ID NO: 430154 - DNA, 13 bp, Homo sapiens
cacaactcagcat

SEQ ID NO: 430155 - DNA, 21 bp, Homo sapiens
cacaactccttccatccttga

SEQ ID NO: 430156 - DNA, 20 bp, Homo sapiens
cacaactgtttttgaagaag

SEQ ID NO: 430157 - DNA, 20 bp, Homo sapiens
cacaagaaatttgatttcta

SEQ ID NO: 430158 - DNA, 14 bp, Homo sapiens
cacaagaagtggga

SEQ ID NO: 430159 - DNA, 15 bp, Homo sapiens
cacaagccagggtgt

SEQ ID NO: 430160 - DNA, 23 bp, Homo sapiens
cacaagccattttttgaggagag

SEQ ID NO: 430161 - DNA, 18 bp, Homo sapiens
cacaagcctcttctgaag

SEQ ID NO: 430162 - DNA, 15 bp, Homo sapiens
cacaagctgcctccc

SEQ ID NO: 430163 - DNA, 22 bp, Homo sapiens
cacaagctgcctccctgtccac

SEQ ID NO: 430164 - DNA, 20 bp, Homo sapiens
cacaaggaaaatagtttagg

SEQ ID NO: 430165 - DNA, 16 bp, Homo sapiens
cacaaggagtgcccgc

SEQ ID NO: 430166 - DNA, 20 bp, Homo sapiens
cacaaggctgaaaagtgctt

SEQ ID NO: 430167 - DNA, 21 bp, Homo sapiens
cacaaggctgaaaagtgcttt

SEQ ID NO: 430168 - DNA, 20 bp, Homo sapiens
cacaaggtccactccctgct

SEQ ID NO: 430169 - DNA, 22 bp, Homo sapiens
cacaagtagatgcctgaacttg

SEQ ID NO: 430170 - DNA, 16 bp, Homo sapiens
cacaagtcctgtgaat

SEQ ID NO: 430171 - DNA, 22 bp, Homo sapiens
cacaagtgccactgcccgagct

SEQ ID NO: 430172 - DNA, 19 bp, Homo sapiens
cacaagttgtttggtactt

SEQ ID NO: 430173 - DNA, 21 bp, Homo sapiens
cacaagttgtttggtactttt

SEQ ID NO: 430174 - DNA, 19 bp, Homo sapiens
cacaatacagataacatta

SEQ ID NO: 430175 - DNA, 17 bp, Homo sapiens
cacaatagacagaaaca

SEQ ID NO: 430176 - DNA, 22 bp, Homo sapiens
cacaatgatgattaaacacctg

SEQ ID NO: 430177 - DNA, 23 bp, Homo sapiens
cacaatgatgattaaacacctga

SEQ ID NO: 430178 - DNA, 20 bp, Homo sapiens
cacaatgttgcactgaaaac

SEQ ID NO: 430179 - DNA, 21 bp, Homo sapiens
cacaatgttgcactgaaaacc

SEQ ID NO: 430180 - DNA, 14 bp, Homo sapiens
cacaattagagctt

SEQ ID NO: 430181 - DNA, 17 bp, Homo sapiens
cacaattctgtccctgt

SEQ ID NO: 430182 - DNA, 18 bp, Homo sapiens
cacaattctgtccctgtc

SEQ ID NO: 430183 - DNA, 19 bp, Homo sapiens
cacaattctgtccctgtcc

SEQ ID NO: 430184 - DNA, 20 bp, Homo sapiens
cacaattctgtccctgtccc

SEQ ID NO: 430185 - DNA, 18 bp, Homo sapiens
cacacaaaaaggagcggg

SEQ ID NO: 430186 - DNA, 15 bp, Homo sapiens
cacacaaacacctcc

SEQ ID NO: 430187 - DNA, 20 bp, Homo sapiens
cacacaaatgcagacacaca

SEQ ID NO: 430188 - DNA, 22 bp, Homo sapiens
cacacaaatgcagacacacaac

SEQ ID NO: 430189 - DNA, 13 bp, Homo sapiens
cacacaacaaaaa

SEQ ID NO: 430190 - DNA, 14 bp, Homo sapiens
cacacaacaccagg

SEQ ID NO: 430191 - DNA, 16 bp, Homo sapiens
cacacaacatcaagaa

SEQ ID NO: 430192 - DNA, 20 bp, Homo sapiens
cacacaacatcaagaaaaca

SEQ ID NO: 430193 - DNA, 13 bp, Homo sapiens
cacacacaaaaca

SEQ ID NO: 430194 - DNA, 19 bp, Homo sapiens
cacacacaaaacaacagca

SEQ ID NO: 430195 - DNA, 11 bp, Homo sapiens
cacacacacaa

SEQ ID NO: 430196 - DNA, 13 bp, Homo sapiens
cacacacacaaaa

SEQ ID NO: 430197 - DNA, 15 bp, Homo sapiens
cacacacacaaaaca

SEQ ID NO: 430198 - DNA, 11 bp, Homo sapiens
cacacacacac

SEQ ID NO: 430199 - DNA, 12 bp, Homo sapiens
cacacacacaca

SEQ ID NO: 430200 - DNA, 13 bp, Homo sapiens
cacacacacacaa

SEQ ID NO: 430201 - DNA, 13 bp, Homo sapiens
cacacacacacac

SEQ ID NO: 430202 - DNA, 15 bp, Homo sapiens
cacacacacacacaa

SEQ ID NO: 430203 - DNA, 15 bp, Homo sapiens
cacacacacacacac

SEQ ID NO: 430204 - DNA, 16 bp, Homo sapiens
cacacacacacacagg

SEQ ID NO: 430205 - DNA, 16 bp, Homo sapiens
cacacacacacaggag

SEQ ID NO: 430206 - DNA, 14 bp, Homo sapiens
cacacacacccttc

SEQ ID NO: 430207 - DNA, 11 bp, Homo sapiens
cacacacagct

SEQ ID NO: 430208 - DNA, 14 bp, Homo sapiens
cacacacagctcct

SEQ ID NO: 430209 - DNA, 13 bp, Homo sapiens
cacacaccccaat

SEQ ID NO: 430210 - DNA, 14 bp, Homo sapiens
cacacacccttccc

SEQ ID NO: 430211 - DNA, 14 bp, Homo sapiens
cacacacctcacca

SEQ ID NO: 430212 - DNA, 12 bp, Homo sapiens
cacacacctgcc

SEQ ID NO: 430213 - DNA, 14 bp, Homo sapiens
cacagcctccaggg

SEQ ID NO: 430214 - DNA, 15 bp, Homo sapiens
cacagcctggcctcc

SEQ ID NO: 430215 - DNA, 13 bp, Homo sapiens
cacagcctttctg

SEQ ID NO: 430216 - DNA, 15 bp, Homo sapiens
cacagctacctgaga

SEQ ID NO: 430217 - DNA, 19 bp, Homo sapiens
cacagctctcactggccag

SEQ ID NO: 430218 - DNA, 16 bp, Homo sapiens
cacagctcttgtttgg

SEQ ID NO: 430219 - DNA, 19 bp, Homo sapiens
cacagctgagagactttta

SEQ ID NO: 430220 - DNA, 17 bp, Homo sapiens
cacagctgagctggcct

SEQ ID NO: 430221 - DNA, 16 bp, Homo sapiens
cacagctgcagctggg

SEQ ID NO: 430222 - DNA, 18 bp, Homo sapiens
cacagctgcagctgggcc

SEQ ID NO: 430223 - DNA, 21 bp, Homo sapiens
cacagctgcagctgggcccca

SEQ ID NO: 430224 - DNA, 12 bp, Homo sapiens
cacagctgctgg

SEQ ID NO: 430225 - DNA, 21 bp, Homo sapiens
cacagctggagctctcaaact

SEQ ID NO: 430226 - DNA, 14 bp, Homo sapiens
cacagctgtgagga

SEQ ID NO: 430227 - DNA, 15 bp, Homo sapiens
cacagctttcccagg

SEQ ID NO: 430228 - DNA, 23 bp, Homo sapiens
cacagcttttagtacccacctga

SEQ ID NO: 430229 - DNA, 15 bp, Homo sapiens
cacaggaaagagtca

SEQ ID NO: 430230 - DNA, 23 bp, Homo sapiens
cacaggacgatttcactgacact

SEQ ID NO: 430231 - DNA, 16 bp, Homo sapiens
cacaggactctgcctc

SEQ ID NO: 430232 - DNA, 22 bp, Homo sapiens
cacaggaggagaaatctcactt

SEQ ID NO: 430233 - DNA, 15 bp, Homo sapiens
cacaggaggcaagca

SEQ ID NO: 430234 - DNA, 12 bp, Homo sapiens
cacaggagggta

SEQ ID NO: 430235 - DNA, 19 bp, Homo sapiens
cacaggagtcctttctttt

SEQ ID NO: 430236 - DNA, 22 bp, Homo sapiens
cacaggagtcctttcttttgaa

SEQ ID NO: 430237 - DNA, 15 bp, Homo sapiens
cacaggatctgaact

SEQ ID NO: 430238 - DNA, 20 bp, Homo sapiens
cacaggcaacattacaaaca

SEQ ID NO: 430239 - DNA, 12 bp, Homo sapiens
cacaggcagacg

SEQ ID NO: 430240 - DNA, 15 bp, Homo sapiens
cacaggccacacgct

SEQ ID NO: 430241 - DNA, 18 bp, Homo sapiens
cacaggccacacgctgcc

SEQ ID NO: 430242 - DNA, 19 bp, Homo sapiens
cacaggccacacgctgccc

SEQ ID NO: 430243 - DNA, 17 bp, Homo sapiens
cacaggccacttgctca

SEQ ID NO: 430244 - DNA, 16 bp, Homo sapiens
cacaggcccttcctct

SEQ ID NO: 430245 - DNA, 19 bp, Homo sapiens
cacaggcccttcctctcca

SEQ ID NO: 430246 - DNA, 16 bp, Homo sapiens
cacaggcctggcccag

SEQ ID NO: 430247 - DNA, 22 bp, Homo sapiens
cacaggcctggcccagccagca

SEQ ID NO: 430248 - DNA, 13 bp, Homo sapiens
cacaggctgcccc

SEQ ID NO: 430249 - DNA, 15 bp, Homo sapiens
cacaggctgccccac

SEQ ID NO: 430250 - DNA, 20 bp, Homo sapiens
cacaggctgccccacccctc

SEQ ID NO: 430251 - DNA, 19 bp, Homo sapiens
cacagggcctgacttttac

SEQ ID NO: 430252 - DNA, 13 bp, Homo sapiens
cacagggcgagac

SEQ ID NO: 430253 - DNA, 23 bp, Homo sapiens
cacagggctctttgatggaccca

SEQ ID NO: 430254 - DNA, 22 bp, Homo sapiens
cacaggggaaggaaataacatt

SEQ ID NO: 430255 - DNA, 22 bp, Homo sapiens
cacaggggcaaagaactgcccc

SEQ ID NO: 430256 - DNA, 15 bp, Homo sapiens
cacaggggcaggcct

SEQ ID NO: 430257 - DNA, 16 bp, Homo sapiens
cacaggggcaggcctg

SEQ ID NO: 430258 - DNA, 23 bp, Homo sapiens
cacaggggccccagatctgcctg

SEQ ID NO: 430259 - DNA, 15 bp, Homo sapiens
cacaggggcggggca

SEQ ID NO: 430260 - DNA, 22 bp, Homo sapiens
cacagggtgggatgagcctctc

SEQ ID NO: 430261 - DNA, 18 bp, Homo sapiens
cacagggttgggcccaga

SEQ ID NO: 430262 - DNA, 14 bp, Homo sapiens
cacaggtgtcccca

SEQ ID NO: 430263 - DNA, 19 bp, Homo sapiens
cacagtagagtagggtaga

SEQ ID NO: 430264 - DNA, 15 bp, Homo sapiens
cacagtatgggctac

SEQ ID NO: 430265 - DNA, 22 bp, Homo sapiens
cacagtattatttctccatccc

SEQ ID NO: 430266 - DNA, 23 bp, Homo sapiens
cacagtattatttctccatcccc

SEQ ID NO: 430267 - DNA, 20 bp, Homo sapiens
cacagtattcgtgaataagt

SEQ ID NO: 430268 - DNA, 17 bp, Homo sapiens
cacagtccctcctgttg

SEQ ID NO: 430269 - DNA, 18 bp, Homo sapiens
cacagtctctccctgggg

SEQ ID NO: 430270 - DNA, 18 bp, Homo sapiens
cacagtgcatctcagccc

SEQ ID NO: 430271 - DNA, 11 bp, Homo sapiens
cacagtgctgc

SEQ ID NO: 430272 - DNA, 15 bp, Homo sapiens
cacagtgctgcttct

SEQ ID NO: 430273 - DNA, 17 bp, Homo sapiens
cacagtggggcccatgg

SEQ ID NO: 430274 - DNA, 13 bp, Homo sapiens
cacagtgggtggc

SEQ ID NO: 430275 - DNA, 21 bp, Homo sapiens
cacagtgtaatccaggggtgt

SEQ ID NO: 430276 - DNA, 23 bp, Homo sapiens
cacagtgttaaatgaaattgtaa

SEQ ID NO: 430277 - DNA, 20 bp, Homo sapiens
cacagttctggctataaact

SEQ ID NO: 430278 - DNA, 22 bp, Homo sapiens
cacagttgtctattctgagcct

SEQ ID NO: 430279 - DNA, 23 bp, Homo sapiens
cacagttgtctattctgagcctt

SEQ ID NO: 430280 - DNA, 23 bp, Homo sapiens
cacagtttgcaatcttatgttga

SEQ ID NO: 430281 - DNA, 22 bp, Homo sapiens
cacagttttgaaagaaaaatac

SEQ ID NO: 430282 - DNA, 15 bp, Homo sapiens
cacataaatctgtct

SEQ ID NO: 430283 - DNA, 20 bp, Homo sapiens
cacataaatctgtctgattc

SEQ ID NO: 430284 - DNA, 22 bp, Homo sapiens
cacataaatctgtctgattcta

SEQ ID NO: 430285 - DNA, 13 bp, Homo sapiens
cacataacacaca

SEQ ID NO: 430286 - DNA, 13 bp, Homo sapiens
cacataatttgaa

SEQ ID NO: 430287 - DNA, 15 bp, Homo sapiens
cacatactagaaagc

SEQ ID NO: 430288 - DNA, 17 bp, Homo sapiens
cacatagctgggatttg

SEQ ID NO: 430289 - DNA, 21 bp, Homo sapiens
cacatagtgatggttcccctg

SEQ ID NO: 430290 - DNA, 16 bp, Homo sapiens
cacatagtttcttttt

SEQ ID NO: 430291 - DNA, 21 bp, Homo sapiens
cacatataaacatcacacaca

SEQ ID NO: 430292 - DNA, 17 bp, Homo sapiens
cacatatattttttaca

SEQ ID NO: 430293 - DNA, 20 bp, Homo sapiens
cacatatgataaaaaagtgt

SEQ ID NO: 430294 - DNA, 23 bp, Homo sapiens
cacatattaagaatagtctctgg

SEQ ID NO: 430295 - DNA, 19 bp, Homo sapiens
cacatattcaaatcagcaa

SEQ ID NO: 430296 - DNA, 15 bp, Homo sapiens
cacatatttgatagt

SEQ ID NO: 430297 - DNA, 21 bp, Homo sapiens
cacatccaacatttcctcagg

SEQ ID NO: 430298 - DNA, 21 bp, Homo sapiens
cacatccaggcaatggcctaa

SEQ ID NO: 430299 - DNA, 18 bp, Homo sapiens
cacatcccagcagcccaa

SEQ ID NO: 430300 - DNA, 12 bp, Homo sapiens
cacatcccaggc

SEQ ID NO: 430301 - DNA, 20 bp, Homo sapiens
cacatccccaccctcccctc

SEQ ID NO: 430302 - DNA, 19 bp, Homo sapiens
cacatccccaccttccaag

SEQ ID NO: 430303 - DNA, 21 bp, Homo sapiens
cacatccccaccttccaagga

SEQ ID NO: 430304 - DNA, 16 bp, Homo sapiens
cacatccccgctggct

SEQ ID NO: 430305 - DNA, 18 bp, Homo sapiens
cacatccccgctggctgg

SEQ ID NO: 430306 - DNA, 14 bp, Homo sapiens
cacatcccggcctc

SEQ ID NO: 430307 - DNA, 17 bp, Homo sapiens
cacatctaaattgatca

SEQ ID NO: 430308 - DNA, 22 bp, Homo sapiens
cacatctaaattgatcattcat

SEQ ID NO: 430309 - DNA, 12 bp, Homo sapiens
cacatctccctt

SEQ ID NO: 430310 - DNA, 22 bp, Homo sapiens
cacatctcccttccacctcaca

SEQ ID NO: 430311 - DNA, 21 bp, Homo sapiens
cacatcttaattaagctcctt

SEQ ID NO: 430312 - DNA, 20 bp, Homo sapiens
cacatctttaacttagtatt

SEQ ID NO: 430313 - DNA, 18 bp, Homo sapiens
cacatgagctatttccat

SEQ ID NO: 430314 - DNA, 17 bp, Homo sapiens
cacatgagtcccagtgg

SEQ ID NO: 430315 - DNA, 15 bp, Homo sapiens
cacatgctggacagg

SEQ ID NO: 430316 - DNA, 12 bp, Homo sapiens
cacatgctggcc

SEQ ID NO: 430317 - DNA, 15 bp, Homo sapiens
cacatgctggccagc

SEQ ID NO: 430318 - DNA, 16 bp, Homo sapiens
cacatgctggccagcc

SEQ ID NO: 430319 - DNA, 17 bp, Homo sapiens
cacatggaaggtgatgg

SEQ ID NO: 430320 - DNA, 16 bp, Homo sapiens
cacatggggcctggcc

SEQ ID NO: 430321 - DNA, 17 bp, Homo sapiens
cacattatcgggagcag

SEQ ID NO: 430322 - DNA, 22 bp, Homo sapiens
cacattatcgggagcagtgtct

SEQ ID NO: 430323 - DNA, 13 bp, Homo sapiens
cacattatttgca

SEQ ID NO: 430324 - DNA, 13 bp, Homo sapiens
cacattcctggcc

SEQ ID NO: 430325 - DNA, 13 bp, Homo sapiens
cacattctccctt

SEQ ID NO: 430326 - DNA, 14 bp, Homo sapiens
cacattctcccttg

SEQ ID NO: 430327 - DNA, 14 bp, Homo sapiens
cacattctgctgcc

SEQ ID NO: 430328 - DNA, 21 bp, Homo sapiens
cacattctgctgcccccagac

SEQ ID NO: 430329 - DNA, 22 bp, Homo sapiens
cacattgttgtttttttaatag

SEQ ID NO: 430330 - DNA, 23 bp, Homo sapiens
cacatttagaatttgaaaggaaa

SEQ ID NO: 430331 - DNA, 20 bp, Homo sapiens
cacatttctggccatttaac

SEQ ID NO: 430332 - DNA, 19 bp, Homo sapiens
cacatttgtgcataaattt

SEQ ID NO: 430333 - DNA, 22 bp, Homo sapiens
cacatttgtgcataaatttcca

SEQ ID NO: 430334 - DNA, 13 bp, Homo sapiens
cacattttaacag

SEQ ID NO: 430335 - DNA, 21 bp, Homo sapiens
cacattttgcctttctcgtgg

SEQ ID NO: 430336 - DNA, 14 bp, Homo sapiens
cacattttgcttta

SEQ ID NO: 430337 - DNA, 15 bp, Homo sapiens
caccaaagatgcagc

SEQ ID NO: 430338 - DNA, 20 bp, Homo sapiens
caccaaaggaaacccaattc

SEQ ID NO: 430339 - DNA, 17 bp, Homo sapiens
caccaaatgcctctgcc

SEQ ID NO: 430340 - DNA, 20 bp, Homo sapiens
caccaaattgctgagatgtt

SEQ ID NO: 430341 - DNA, 17 bp, Homo sapiens
caccaacataaaacaaa

SEQ ID NO: 430342 - DNA, 18 bp, Homo sapiens
cacccagcaactccaact

SEQ ID NO: 430343 - DNA, 15 bp, Homo sapiens
cacccagcaaggcac

SEQ ID NO: 430344 - DNA, 22 bp, Homo sapiens
cacccagcaaggcacaggctcc

SEQ ID NO: 430345 - DNA, 16 bp, Homo sapiens
cacccagccaggaggg

SEQ ID NO: 430346 - DNA, 10 bp, Homo sapiens
cacccagccc

SEQ ID NO: 430347 - DNA, 17 bp, Homo sapiens
cacccagcccaaccggg

SEQ ID NO: 430348 - DNA, 11 bp, Homo sapiens
cacccagcccc

SEQ ID NO: 430349 - DNA, 14 bp, Homo sapiens
cacccagccccagc

SEQ ID NO: 430350 - DNA, 18 bp, Homo sapiens
cacccagccccagcgagt

SEQ ID NO: 430351 - DNA, 14 bp, Homo sapiens
cacccagcccctgg

SEQ ID NO: 430352 - DNA, 11 bp, Homo sapiens
cacccaggagg

SEQ ID NO: 430353 - DNA, 12 bp, Homo sapiens
cacccaggctgc

SEQ ID NO: 430354 - DNA, 13 bp, Homo sapiens
cacccaggctgca

SEQ ID NO: 430355 - DNA, 18 bp, Homo sapiens
cacccaggctgcactgca

SEQ ID NO: 430356 - DNA, 20 bp, Homo sapiens
cacccaggctgcactgcagt

SEQ ID NO: 430357 - DNA, 19 bp, Homo sapiens
cacccagggcccggcacag

SEQ ID NO: 430358 - DNA, 19 bp, Homo sapiens
cacccagtgctgccatgcc

SEQ ID NO: 430359 - DNA, 19 bp, Homo sapiens
cacccatcttcctgctgct

SEQ ID NO: 430360 - DNA, 22 bp, Homo sapiens
cacccatgactgccccttgctt

SEQ ID NO: 430361 - DNA, 21 bp, Homo sapiens
cacccattcccccatgtggct

SEQ ID NO: 430362 - DNA, 14 bp, Homo sapiens
cacccattgtctca

SEQ ID NO: 430363 - DNA, 18 bp, Homo sapiens
cacccattgtctcattgc

SEQ ID NO: 430364 - DNA, 20 bp, Homo sapiens
cacccattgtctcattgcca

SEQ ID NO: 430365 - DNA, 13 bp, Homo sapiens
caccccaaacccc

SEQ ID NO: 430366 - DNA, 17 bp, Homo sapiens
caccccaactctcccca

SEQ ID NO: 430367 - DNA, 20 bp, Homo sapiens
caccccaactctccccagtg

SEQ ID NO: 430368 - DNA, 18 bp, Homo sapiens
caccccaattaactgaag

SEQ ID NO: 430369 - DNA, 20 bp, Homo sapiens
caccccacaccccagcccac

SEQ ID NO: 430370 - DNA, 11 bp, Homo sapiens
caccccacact

SEQ ID NO: 430371 - DNA, 12 bp, Homo sapiens
caccccacactt

SEQ ID NO: 430372 - DNA, 13 bp, Homo sapiens
caccccagcattc

SEQ ID NO: 430373 - DNA, 16 bp, Homo sapiens
caccccagcattccag

SEQ ID NO: 430374 - DNA, 19 bp, Homo sapiens
caccccagcctaagatgaa

SEQ ID NO: 430375 - DNA, 12 bp, Homo sapiens
caccccagcgcc

SEQ ID NO: 430376 - DNA, 18 bp, Homo sapiens
caccccagctgctcccct

SEQ ID NO: 430377 - DNA, 19 bp, Homo sapiens
caccccagctgctcccctc

SEQ ID NO: 430378 - DNA, 22 bp, Homo sapiens
caccccagctgctcccctccct

SEQ ID NO: 430379 - DNA, 17 bp, Homo sapiens
caccccagtgcacccac

SEQ ID NO: 430380 - DNA, 21 bp, Homo sapiens
caccccatgtgggtgaccagg

SEQ ID NO: 430381 - DNA, 20 bp, Homo sapiens
cacccccaacttcaccaccc

SEQ ID NO: 430382 - DNA, 12 bp, Homo sapiens
cacccccaagaa

SEQ ID NO: 430383 - DNA, 12 bp, Homo sapiens
cacccccaaggg

SEQ ID NO: 430384 - DNA, 19 bp, Homo sapiens
cacccccaaggggcagtct

SEQ ID NO: 430385 - DNA, 22 bp, Homo sapiens
cacccccaccactcttgactca

SEQ ID NO: 430386 - DNA, 11 bp, Homo sapiens
cacccccaccc

SEQ ID NO: 430387 - DNA, 13 bp, Homo sapiens
cacccccacccac

SEQ ID NO: 430388 - DNA, 12 bp, Homo sapiens
cacccccagcct

SEQ ID NO: 430389 - DNA, 16 bp, Homo sapiens
cacccccatccacagt

SEQ ID NO: 430390 - DNA, 14 bp, Homo sapiens
cacccccatgctgc

SEQ ID NO: 430391 - DNA, 16 bp, Homo sapiens
cacccccatgctgcct

SEQ ID NO: 430392 - DNA, 20 bp, Homo sapiens
cacccccatgctgccttcag

SEQ ID NO: 430393 - DNA, 15 bp, Homo sapiens
cacccccattgtgaa

SEQ ID NO: 430394 - DNA, 15 bp, Homo sapiens
caccccccgccggca

SEQ ID NO: 430395 - DNA, 16 bp, Homo sapiens
cacccccgcctccctc

SEQ ID NO: 430396 - DNA, 13 bp, Homo sapiens
caccccctccctg

SEQ ID NO: 430397 - DNA, 14 bp, Homo sapiens
caccccctccctgg

SEQ ID NO: 430398 - DNA, 23 bp, Homo sapiens
caccccctgtcccattctagatc

SEQ ID NO: 430399 - DNA, 16 bp, Homo sapiens
cacccccttctctgct

SEQ ID NO: 430400 - DNA, 17 bp, Homo sapiens
cacccccttctctgctc

SEQ ID NO: 430401 - DNA, 18 bp, Homo sapiens
cacccccttctctgctcc

SEQ ID NO: 430402 - DNA, 18 bp, Homo sapiens
caccccctttgctgtgag

SEQ ID NO: 430403 - DNA, 13 bp, Homo sapiens
caccccgctgcct

SEQ ID NO: 430404 - DNA, 17 bp, Homo sapiens
caccccgctgcctggcg

SEQ ID NO: 430405 - DNA, 14 bp, Homo sapiens
caccccggcaggcc

SEQ ID NO: 430406 - DNA, 18 bp, Homo sapiens
caccccgtcccggccccg

SEQ ID NO: 430407 - DNA, 14 bp, Homo sapiens
caccccgtctgccc

SEQ ID NO: 430408 - DNA, 20 bp, Homo sapiens
caccccgttacagctcccca

SEQ ID NO: 430409 - DNA, 16 bp, Homo sapiens
cacccctaagtgccca

SEQ ID NO: 430410 - DNA, 17 bp, Homo sapiens
cacccctacagcctgca

SEQ ID NO: 430411 - DNA, 18 bp, Homo sapiens
cacccctcaagccaggag

SEQ ID NO: 430412 - DNA, 20 bp, Homo sapiens
cacccctcagcgctccctgt

SEQ ID NO: 430413 - DNA, 21 bp, Homo sapiens
cacccctccctctgctctcat

SEQ ID NO: 430414 - DNA, 15 bp, Homo sapiens
cacccctccttccct

SEQ ID NO: 430415 - DNA, 13 bp, Homo sapiens
cacccctcttccc

SEQ ID NO: 430416 - DNA, 14 bp, Homo sapiens
cacccctcttcccc

SEQ ID NO: 430417 - DNA, 18 bp, Homo sapiens
cacccctcttcccccttc

SEQ ID NO: 430418 - DNA, 19 bp, Homo sapiens
cacccctcttcccccttcc

SEQ ID NO: 430419 - DNA, 13 bp, Homo sapiens
cacccctgcactt

SEQ ID NO: 430420 - DNA, 13 bp, Homo sapiens
cacccctgccggc

SEQ ID NO: 430421 - DNA, 22 bp, Homo sapiens
cacccctgcctcccgccccctt

SEQ ID NO: 430422 - DNA, 14 bp, Homo sapiens
cacccctgcctttg

SEQ ID NO: 430423 - DNA, 12 bp, Homo sapiens
cacccctgggca

SEQ ID NO: 430424 - DNA, 16 bp, Homo sapiens
cacccctgtacccagc

SEQ ID NO: 430425 - DNA, 18 bp, Homo sapiens
cacccctgtacccagcca

SEQ ID NO: 430426 - DNA, 13 bp, Homo sapiens
caccccttcccca

SEQ ID NO: 430427 - DNA, 17 bp, Homo sapiens
caccccttgcccaacca

SEQ ID NO: 430428 - DNA, 12 bp, Homo sapiens
cacccctttcta

SEQ ID NO: 430429 - DNA, 14 bp, Homo sapiens
cacccgccccagag

SEQ ID NO: 430430 - DNA, 15 bp, Homo sapiens
cacccgccccagaga

SEQ ID NO: 430431 - DNA, 17 bp, Homo sapiens
cacccgcccgcccccgc

SEQ ID NO: 430432 - DNA, 20 bp, Homo sapiens
cacccgccctgcccttccct

SEQ ID NO: 430433 - DNA, 15 bp, Homo sapiens
cacccgctgcccagc

SEQ ID NO: 430434 - DNA, 12 bp, Homo sapiens
cacccggaaaga

SEQ ID NO: 430435 - DNA, 17 bp, Homo sapiens
cacccggatctccaggc

SEQ ID NO: 430436 - DNA, 18 bp, Homo sapiens
cacccggatctccaggcc

SEQ ID NO: 430437 - DNA, 20 bp, Homo sapiens
cacccggatctccaggccca

SEQ ID NO: 430438 - DNA, 22 bp, Homo sapiens
cacccggatctccaggcccagc

SEQ ID NO: 430439 - DNA, 14 bp, Homo sapiens
cacccgtcttcaat

SEQ ID NO: 430440 - DNA, 21 bp, Homo sapiens
cacccgtcttggggctcgccc

SEQ ID NO: 430441 - DNA, 14 bp, Homo sapiens
cacccgttaattta

SEQ ID NO: 430442 - DNA, 21 bp, Homo sapiens
cacccgttcccactgccctgg

SEQ ID NO: 430443 - DNA, 18 bp, Homo sapiens
cacccgttctgctggcct

SEQ ID NO: 430444 - DNA, 19 bp, Homo sapiens
cacccgtttccaagcctgg

SEQ ID NO: 430445 - DNA, 23 bp, Homo sapiens
cacccgtttccaagcctgggcca

SEQ ID NO: 430446 - DNA, 14 bp, Homo sapiens
caccctaactcttg

SEQ ID NO: 430447 - DNA, 19 bp, Homo sapiens
caccctaactcttgctcac

SEQ ID NO: 430448 - DNA, 16 bp, Homo sapiens
caccctaactgagctg

SEQ ID NO: 430449 - DNA, 20 bp, Homo sapiens
caccctaatgtggcagctgt

SEQ ID NO: 430450 - DNA, 12 bp, Homo sapiens
caccctaatttg

SEQ ID NO: 430451 - DNA, 20 bp, Homo sapiens
caccctagtcccttcccctc

SEQ ID NO: 430452 - DNA, 17 bp, Homo sapiens
caccctagtttccctga

SEQ ID NO: 430453 - DNA, 14 bp, Homo sapiens
caccctattcccta

SEQ ID NO: 430454 - DNA, 18 bp, Homo sapiens
caccctcacacacacagc

SEQ ID NO: 430455 - DNA, 22 bp, Homo sapiens
caccctcacacacacagctggg

SEQ ID NO: 430456 - DNA, 17 bp, Homo sapiens
caccctcactctgccag

SEQ ID NO: 430457 - DNA, 18 bp, Homo sapiens
caccctcactctgccagg

SEQ ID NO: 430458 - DNA, 14 bp, Homo sapiens
caccctcagctggc

SEQ ID NO: 430459 - DNA, 19 bp, Homo sapiens
caccctccagcacagactg

SEQ ID NO: 430460 - DNA, 22 bp, Homo sapiens
caccctccatgctcctcacctg

SEQ ID NO: 430461 - DNA, 16 bp, Homo sapiens
caccctcccacccggc

SEQ ID NO: 430462 - DNA, 14 bp, Homo sapiens
caccctcccctctc

SEQ ID NO: 430463 - DNA, 14 bp, Homo sapiens
caccctcctgaacc

SEQ ID NO: 430464 - DNA, 11 bp, Homo sapiens
caccctccttc

SEQ ID NO: 430465 - DNA, 17 bp, Homo sapiens
caccctcgtggacacct

SEQ ID NO: 430466 - DNA, 20 bp, Homo sapiens
caccctcgtggacacctgcc

SEQ ID NO: 430467 - DNA, 16 bp, Homo sapiens
caccctctgcagggca

SEQ ID NO: 430468 - DNA, 20 bp, Homo sapiens
caccctctgcagggcagcct

SEQ ID NO: 430469 - DNA, 21 bp, Homo sapiens
caccctctgctatgtctgtga

SEQ ID NO: 430470 - DNA, 23 bp, Homo sapiens
caccctctgctatgtctgtgatg

SEQ ID NO: 430471 - DNA, 23 bp, Homo sapiens
caccctgaatggttccatgcctg

SEQ ID NO: 430472 - DNA, 21 bp, Homo sapiens
caccctgcaaggcccacagga

SEQ ID NO: 430473 - DNA, 18 bp, Homo sapiens
cacctgcctgcagagcag

SEQ ID NO: 430474 - DNA, 16 bp, Homo sapiens
cacctgcgcctggctc

SEQ ID NO: 430475 - DNA, 19 bp, Homo sapiens
cacctgcgcctggctctgt

SEQ ID NO: 430476 - DNA, 11 bp, Homo sapiens
cacctgctgga

SEQ ID NO: 430477 - DNA, 22 bp, Homo sapiens
cacctgctggaaaccacacttc

SEQ ID NO: 430478 - DNA, 17 bp, Homo sapiens
cacctgctggcccctca

SEQ ID NO: 430479 - DNA, 14 bp, Homo sapiens
cacctggagactgt

SEQ ID NO: 430480 - DNA, 16 bp, Homo sapiens
cacctggagcccacag

SEQ ID NO: 430481 - DNA, 14 bp, Homo sapiens
cacctggcacacca

SEQ ID NO: 430482 - DNA, 15 bp, Homo sapiens
cacctggccaggatt

SEQ ID NO: 430483 - DNA, 19 bp, Homo sapiens
cacctggccgggtcaccct

SEQ ID NO: 430484 - DNA, 20 bp, Homo sapiens
cacctggccgggtcaccctg

SEQ ID NO: 430485 - DNA, 18 bp, Homo sapiens
cacctggcctgctgggaa

SEQ ID NO: 430486 - DNA, 15 bp, Homo sapiens
cacctggcttcccag

SEQ ID NO: 430487 - DNA, 16 bp, Homo sapiens
cacctggcttcccagg

SEQ ID NO: 430488 - DNA, 16 bp, Homo sapiens
cacctgggagatgctg

SEQ ID NO: 430489 - DNA, 23 bp, Homo sapiens
cacctgggcccgggcaggccagc

SEQ ID NO: 430490 - DNA, 12 bp, Homo sapiens
cacctgggctgg

SEQ ID NO: 430491 - DNA, 16 bp, Homo sapiens
cacctgggctgggaga

SEQ ID NO: 430492 - DNA, 16 bp, Homo sapiens
cacctgggctgggcgc

SEQ ID NO: 430493 - DNA, 17 bp, Homo sapiens
cacctgggctttctgga

SEQ ID NO: 430494 - DNA, 23 bp, Homo sapiens
cacctggggcagtcacctgccca

SEQ ID NO: 430495 - DNA, 19 bp, Homo sapiens
cacctgggtgctctggctg

SEQ ID NO: 430496 - DNA, 21 bp, Homo sapiens
cacctggttccggaatcctgt

SEQ ID NO: 430497 - DNA, 13 bp, Homo sapiens
cacctgtaaaact

SEQ ID NO: 430498 - DNA, 21 bp, Homo sapiens
cacctgtaatcccagctactt

SEQ ID NO: 430499 - DNA, 13 bp, Homo sapiens
cacctgtagtccc

SEQ ID NO: 430500 - DNA, 14 bp, Homo sapiens
cacctgtagtccca

SEQ ID NO: 430501 - DNA, 16 bp, Homo sapiens
cacctgtagtcccagc

SEQ ID NO: 430502 - DNA, 12 bp, Homo sapiens
cacctgtgacaa

SEQ ID NO: 430503 - DNA, 20 bp, Homo sapiens
cacctgtgagtttaaagcaa

SEQ ID NO: 430504 - DNA, 15 bp, Homo sapiens
cacctgtgctgctgc

SEQ ID NO: 430505 - DNA, 21 bp, Homo sapiens
cacctgtgctgctgcaccaac

SEQ ID NO: 430506 - DNA, 10 bp, Homo sapiens
cacctgtggc

SEQ ID NO: 430507 - DNA, 19 bp, Homo sapiens
cacctgtgtgttcttttga

SEQ ID NO: 430508 - DNA, 21 bp, Homo sapiens
cacctgttgcacctcaggcag

SEQ ID NO: 430509 - DNA, 20 bp, Homo sapiens
cacctgtttttaagctgttt

SEQ ID NO: 430510 - DNA, 18 bp, Homo sapiens
caccttaaattaaacaat

SEQ ID NO: 430511 - DNA, 21 bp, Homo sapiens
caccttaccctactggctgta

SEQ ID NO: 430512 - DNA, 23 bp, Homo sapiens
caccttaccctactggctgtaaa

SEQ ID NO: 430513 - DNA, 21 bp, Homo sapiens
caccttccctagttctttgca

SEQ ID NO: 430514 - DNA, 14 bp, Homo sapiens
caccttcctcactt

SEQ ID NO: 430515 - DNA, 20 bp, Homo sapiens
caccttctgtccccagccct

SEQ ID NO: 430516 - DNA, 18 bp, Homo sapiens
caccttcttggcttctgg

SEQ ID NO: 430517 - DNA, 19 bp, Homo sapiens
caccttcttggcttctggg

SEQ ID NO: 430518 - DNA, 18 bp, Homo sapiens
caccttgccaatggtgta

SEQ ID NO: 430519 - DNA, 22 bp, Homo sapiens
caccttgtacagaaccagcact

SEQ ID NO: 430520 - DNA, 20 bp, Homo sapiens
caccttgtcatgtaccatca

SEQ ID NO: 430521 - DNA, 19 bp, Homo sapiens
caccttgttggagcctgca

SEQ ID NO: 430522 - DNA, 21 bp, Homo sapiens
caccttgttggagcctgcagg

SEQ ID NO: 430523 - DNA, 11 bp, Homo sapiens
cacctttccca

SEQ ID NO: 430524 - DNA, 18 bp, Homo sapiens
cacctttgggatcagcct

SEQ ID NO: 430525 - DNA, 18 bp, Homo sapiens
caccttttaactcacctc

SEQ ID NO: 430526 - DNA, 15 bp, Homo sapiens
caccttttataccag

SEQ ID NO: 430527 - DNA, 13 bp, Homo sapiens
caccttttctaaa

SEQ ID NO: 430528 - DNA, 19 bp, Homo sapiens
cacgaagccttaagccata

SEQ ID NO: 430529 - DNA, 17 bp, Homo sapiens
cacgagatcttccttcc

SEQ ID NO: 430530 - DNA, 19 bp, Homo sapiens
cacgaggccttcagaaaag

SEQ ID NO: 430531 - DNA, 22 bp, Homo sapiens
cacgaggtggtagctctgagcc

SEQ ID NO: 430532 - DNA, 15 bp, Homo sapiens
cacgagtcacctgca

SEQ ID NO: 430533 - DNA, 20 bp, Homo sapiens
cacgagtcacctgcaagccc

SEQ ID NO: 430534 - DNA, 14 bp, Homo sapiens
cacgatctcagctc

SEQ ID NO: 430535 - DNA, 20 bp, Homo sapiens
cacgcacacacacacacagg

SEQ ID NO: 430536 - DNA, 21 bp, Homo sapiens
cacgcacctgtagtcccagct

SEQ ID NO: 430537 - DNA, 12 bp, Homo sapiens
cacgcagacaca

SEQ ID NO: 430538 - DNA, 16 bp, Homo sapiens
cacgcagagccccgga

SEQ ID NO: 430539 - DNA, 21 bp, Homo sapiens
cacgcagagccccggagcacc

SEQ ID NO: 430540 - DNA, 15 bp, Homo sapiens
cacgcagccaggaca

SEQ ID NO: 430541 - DNA, 14 bp, Homo sapiens
cacgccccgtgtct

SEQ ID NO: 430542 - DNA, 16 bp, Homo sapiens
cacgcccgactagcag

SEQ ID NO: 430543 - DNA, 21 bp, Homo sapiens
cacgccggggctggccctgcc

SEQ ID NO: 430544 - DNA, 20 bp, Homo sapiens
cacgcctgtaatcccagcac

SEQ ID NO: 430545 - DNA, 15 bp, Homo sapiens
cacgcgcgcacacac

SEQ ID NO: 430546 - DNA, 13 bp, Homo sapiens
cacgctcatcttg

SEQ ID NO: 430547 - DNA, 17 bp, Homo sapiens
cacgctcccccgcagtc

SEQ ID NO: 430548 - DNA, 12 bp, Homo sapiens
cacgctcctgcc

SEQ ID NO: 430549 - DNA, 15 bp, Homo sapiens
cacgctcctgccctc

SEQ ID NO: 430550 - DNA, 18 bp, Homo sapiens
cacgctcctgccctcgtc

SEQ ID NO: 430551 - DNA, 13 bp, Homo sapiens
cacgctgcccagg

SEQ ID NO: 430552 - DNA, 14 bp, Homo sapiens
cacgctgcccaggc

SEQ ID NO: 430553 - DNA, 16 bp, Homo sapiens
cacgctgcccaggctc

SEQ ID NO: 430554 - DNA, 18 bp, Homo sapiens
cacgctgcccaggctctg

SEQ ID NO: 430555 - DNA, 17 bp, Homo sapiens
cacgctgggacacagac

SEQ ID NO: 430556 - DNA, 13 bp, Homo sapiens
cacgctgtctcca

SEQ ID NO: 430557 - DNA, 17 bp, Homo sapiens
cacgctgtctccagacc

SEQ ID NO: 430558 - DNA, 22 bp, Homo sapiens
cacgctgtgggcaggtgggagc

SEQ ID NO: 430559 - DNA, 15 bp, Homo sapiens
cacggacaggaagca

SEQ ID NO: 430560 - DNA, 16 bp, Homo sapiens
cacggacgctggctcc

SEQ ID NO: 430561 - DNA, 18 bp, Homo sapiens
cacggacgtttccatcag

SEQ ID NO: 430562 - DNA, 14 bp, Homo sapiens
cacggactctttgc

SEQ ID NO: 430563 - DNA, 18 bp, Homo sapiens
cacggactctttgctgtt

SEQ ID NO: 430564 - DNA, 17 bp, Homo sapiens
cacggcagaccagaacg

SEQ ID NO: 430565 - DNA, 11 bp, Homo sapiens
cacggccaccc

SEQ ID NO: 430566 - DNA, 13 bp, Homo sapiens
cacggccaccctc

SEQ ID NO: 430567 - DNA, 14 bp, Homo sapiens
cacggccactgcag

SEQ ID NO: 430568 - DNA, 16 bp, Homo sapiens
cacggccactgcagtc

SEQ ID NO: 430569 - DNA, 13 bp, Homo sapiens
cacggccctgtca

SEQ ID NO: 430570 - DNA, 21 bp, Homo sapiens
cacggccgtccctgacttccc

SEQ ID NO: 430571 - DNA, 12 bp, Homo sapiens
cacggcctggga

SEQ ID NO: 430572 - DNA, 14 bp, Homo sapiens
cacggcctgggagg

SEQ ID NO: 430573 - DNA, 22 bp, Homo sapiens
cacggctccgagggcggccagg

SEQ ID NO: 430574 - DNA, 13 bp, Homo sapiens
cacgggagagcgc

SEQ ID NO: 430575 - DNA, 21 bp, Homo sapiens
cacgggagagcgccacccgcc

SEQ ID NO: 430576 - DNA, 15 bp, Homo sapiens
cacgggagatttctt

SEQ ID NO: 430577 - DNA, 15 bp, Homo sapiens
cacgggcagcctggc

SEQ ID NO: 430578 - DNA, 18 bp, Homo sapiens
cacgggcagcctggctcc

SEQ ID NO: 430579 - DNA, 22 bp, Homo sapiens
cacgggcagcctggctcccagg

SEQ ID NO: 430580 - DNA, 22 bp, Homo sapiens
cacgggggaggccgaggcaggg

SEQ ID NO: 430581 - DNA, 23 bp, Homo sapiens
cacggggtcgggggaggagcacc

SEQ ID NO: 430582 - DNA, 16 bp, Homo sapiens
cacggtgcgtggctgt

SEQ ID NO: 430583 - DNA, 23 bp, Homo sapiens
cacggtgcgtggctgtggcacag

SEQ ID NO: 430584 - DNA, 13 bp, Homo sapiens
cacgtaattcaat

SEQ ID NO: 430585 - DNA, 17 bp, Homo sapiens
cacgtaattcaatttct

SEQ ID NO: 430586 - DNA, 23 bp, Homo sapiens
cacgtagtagggtcaggccacgg

SEQ ID NO: 430587 - DNA, 22 bp, Homo sapiens
cacgtccaaaggagtgcatggc

SEQ ID NO: 430588 - DNA, 13 bp, Homo sapiens
cacgtccccctgg

SEQ ID NO: 430589 - DNA, 16 bp, Homo sapiens
cacgtccccctggggc

SEQ ID NO: 430590 - DNA, 18 bp, Homo sapiens
cacgtctgaccctctcca

SEQ ID NO: 430591 - DNA, 20 bp, Homo sapiens
cacgtctgccaggcccatct

SEQ ID NO: 430592 - DNA, 21 bp, Homo sapiens
cacgtctgccaggcccatctc

SEQ ID NO: 430593 - DNA, 12 bp, Homo sapiens
cacgtctggcca

SEQ ID NO: 430594 - DNA, 21 bp, Homo sapiens
cacgtctgtgagtctgtcctt

SEQ ID NO: 430595 - DNA, 21 bp, Homo sapiens
cacgtgcagcagcaacacaat

SEQ ID NO: 430596 - DNA, 13 bp, Homo sapiens
cacgtggagagct

SEQ ID NO: 430597 - DNA, 15 bp, Homo sapiens
cacgtggagagctgg

SEQ ID NO: 430598 - DNA, 20 bp, Homo sapiens
cacgtggaggaatgctcccc

SEQ ID NO: 430599 - DNA, 15 bp, Homo sapiens
cacgtggcacctcct

SEQ ID NO: 430600 - DNA, 13 bp, Homo sapiens
cacgtggcctctt

SEQ ID NO: 430601 - DNA, 12 bp, Homo sapiens
cacgtgtgtgac

SEQ ID NO: 430602 - DNA, 13 bp, Homo sapiens
cacgttcacccct

SEQ ID NO: 430603 - DNA, 19 bp, Homo sapiens
cacgtttagtaactgtttt

SEQ ID NO: 430604 - DNA, 13 bp, Homo sapiens
cactgaacctctg

SEQ ID NO: 430605 - DNA, 22 bp, Homo sapiens
cactgaaccttgttgatgccag

SEQ ID NO: 430606 - DNA, 20 bp, Homo sapiens
cactgaagtgaatacatggt

SEQ ID NO: 430607 - DNA, 21 bp, Homo sapiens
cactgaagtgaatacatggta

SEQ ID NO: 430608 - DNA, 18 bp, Homo sapiens
cactgaatcgtttcatgt

SEQ ID NO: 430609 - DNA, 19 bp, Homo sapiens
cactgaatcgtttcatgta

SEQ ID NO: 430610 - DNA, 17 bp, Homo sapiens
cactgacagcctcccac

SEQ ID NO: 430611 - DNA, 15 bp, Homo sapiens
cactgaccacactgt

SEQ ID NO: 430612 - DNA, 23 bp, Homo sapiens
cactgaccatccactctaccctc

SEQ ID NO: 430613 - DNA, 14 bp, Homo sapiens
cactgacctggaag

SEQ ID NO: 430614 - DNA, 20 bp, Homo sapiens
cactgacctggaagagctgg

SEQ ID NO: 430615 - DNA, 22 bp, Homo sapiens
cactgagcccttgcacaggcca

SEQ ID NO: 430616 - DNA, 20 bp, Homo sapiens
cactgaggcgctcgctccca

SEQ ID NO: 430617 - DNA, 23 bp, Homo sapiens
cactgaggcgctcgctcccatgc

SEQ ID NO: 430618 - DNA, 13 bp, Homo sapiens
cactgagggccac

SEQ ID NO: 430619 - DNA, 14 bp, Homo sapiens
cactgagggccaca

SEQ ID NO: 430620 - DNA, 14 bp, Homo sapiens
cactgagtttgaac

SEQ ID NO: 430621 - DNA, 17 bp, Homo sapiens
cactgataatatgtttg

SEQ ID NO: 430622 - DNA, 22 bp, Homo sapiens
cactgatctctactaccacaag

SEQ ID NO: 430623 - DNA, 24 bp, Homo sapiens
cactgatctctactaccacaagga

SEQ ID NO: 430624 - DNA, 16 bp, Homo sapiens
cactgatgggtcctgc

SEQ ID NO: 430625 - DNA, 21 bp, Homo sapiens
cactgatgggtcctgctgctc

SEQ ID NO: 430626 - DNA, 18 bp, Homo sapiens
cactgatttcacaacaga

SEQ ID NO: 430627 - DNA, 15 bp, Homo sapiens
cactgcaacaggaac

SEQ ID NO: 430628 - DNA, 14 bp, Homo sapiens
cactgcaacctctg

SEQ ID NO: 430629 - DNA, 20 bp, Homo sapiens
cactgcaagctccaactccc

SEQ ID NO: 430630 - DNA, 15 bp, Homo sapiens
cactgcagtgatggc

SEQ ID NO: 430631 - DNA, 11 bp, Homo sapiens
cactgccacac

SEQ ID NO: 430632 - DNA, 13 bp, Homo sapiens
cactgccagagct

SEQ ID NO: 430633 - DNA, 14 bp, Homo sapiens
cactgccaggcacc

SEQ ID NO: 430634 - DNA, 22 bp, Homo sapiens
cactgccaggcacctggcctgc

SEQ ID NO: 430635 - DNA, 23 bp, Homo sapiens
cactgccaggcacctggcctgct

SEQ ID NO: 430636 - DNA, 21 bp, Homo sapiens
cactgccattagactgaattt

SEQ ID NO: 430637 - DNA, 17 bp, Homo sapiens
cactgcccgagctggtg

SEQ ID NO: 430638 - DNA, 19 bp, Homo sapiens
cactgcccgagctggtgca

SEQ ID NO: 430639 - DNA, 21 bp, Homo sapiens
cactgcccgagctggtgcatt

SEQ ID NO: 430640 - DNA, 20 bp, Homo sapiens
cactgccctctccacaccca

SEQ ID NO: 430641 - DNA, 20 bp, Homo sapiens
cactgccctgcctgcccact

SEQ ID NO: 430642 - DNA, 12 bp, Homo sapiens
cactgcctctgc

SEQ ID NO: 430643 - DNA, 23 bp, Homo sapiens
cactgcctctgccttagaggagc

SEQ ID NO: 430644 - DNA, 16 bp, Homo sapiens
cactgcctcttcctcc

SEQ ID NO: 430645 - DNA, 14 bp, Homo sapiens
cactgcgaactctc

SEQ ID NO: 430646 - DNA, 13 bp, Homo sapiens
cactgctaaattt

SEQ ID NO: 430647 - DNA, 18 bp, Homo sapiens
cactgctaataaatgacc

SEQ ID NO: 430648 - DNA, 19 bp, Homo sapiens
cactgctaataaatgacca

SEQ ID NO: 430649 - DNA, 22 bp, Homo sapiens
cactgctaggtgggccagcccc

SEQ ID NO: 430650 - DNA, 23 bp, Homo sapiens
cactgctaggtgggccagcccct

SEQ ID NO: 430651 - DNA, 13 bp, Homo sapiens
cactgctgcacca

SEQ ID NO: 430652 - DNA, 14 bp, Homo sapiens
cactgctgcaccag

SEQ ID NO: 430653 - DNA, 18 bp, Homo sapiens
cactgctgctcctctttc

SEQ ID NO: 430654 - DNA, 21 bp, Homo sapiens
cactgctgctcctctttcccc

SEQ ID NO: 430655 - DNA, 22 bp, Homo sapiens
cactgctgctcctctttcccct

SEQ ID NO: 430656 - DNA, 13 bp, Homo sapiens
cactgctggctgc

SEQ ID NO: 430657 - DNA, 13 bp, Homo sapiens
cactgctgggaag

SEQ ID NO: 430658 - DNA, 13 bp, Homo sapiens
cactgctggggag

SEQ ID NO: 430659 - DNA, 18 bp, Homo sapiens
cactgctggggagtccct

SEQ ID NO: 430660 - DNA, 18 bp, Homo sapiens
cactgctgtccctcctga

SEQ ID NO: 430661 - DNA, 11 bp, Homo sapiens
cactgctgtga

SEQ ID NO: 430662 - DNA, 19 bp, Homo sapiens
cactgctgttcctgctcca

SEQ ID NO: 430663 - DNA, 18 bp, Homo sapiens
cactgcttctcggaggcc

SEQ ID NO: 430664 - DNA, 17 bp, Homo sapiens
cactggaacactaatga

SEQ ID NO: 430665 - DNA, 17 bp, Homo sapiens
cactggaacctccctgg

SEQ ID NO: 430666 - DNA, 14 bp, Homo sapiens
cactggaagggtcc

SEQ ID NO: 430667 - DNA, 18 bp, Homo sapiens
cactggagtgcagggagg

SEQ ID NO: 430668 - DNA, 23 bp, Homo sapiens
cactggagtgcagggaggagagg

SEQ ID NO: 430669 - DNA, 22 bp, Homo sapiens
cactggagtggtaacaagagga

SEQ ID NO: 430670 - DNA, 23 bp, Homo sapiens
cactggatgcaaagaaaatcaga

SEQ ID NO: 430671 - DNA, 19 bp, Homo sapiens
cactggcatctctggagtg

SEQ ID NO: 430672 - DNA, 19 bp, Homo sapiens
cactggcattgtccctgtg

SEQ ID NO: 430673 - DNA, 15 bp, Homo sapiens
cactggccagagagg

SEQ ID NO: 430674 - DNA, 17 bp, Homo sapiens
cactggccagagagggc

SEQ ID NO: 430675 - DNA, 22 bp, Homo sapiens
cactggcccctagaatcagcct

SEQ ID NO: 430676 - DNA, 16 bp, Homo sapiens
cactggctctctccag

SEQ ID NO: 430677 - DNA, 18 bp, Homo sapiens
cactggctctctccagga

SEQ ID NO: 430678 - DNA, 22 bp, Homo sapiens
cactggctggggcagaggggca

SEQ ID NO: 430679 - DNA, 18 bp, Homo sapiens
cactggctgtgcctcccc

SEQ ID NO: 430680 - DNA, 15 bp, Homo sapiens
cactgggaagctgga

SEQ ID NO: 430681 - DNA, 12 bp, Homo sapiens
cactgggagagc

SEQ ID NO: 430682 - DNA, 14 bp, Homo sapiens
cactgggagagctg

SEQ ID NO: 430683 - DNA, 17 bp, Homo sapiens
cactgggccccattctc

SEQ ID NO: 430684 - DNA, 19 bp, Homo sapiens
cactgggccggcagcctgg

SEQ ID NO: 430685 - DNA, 13 bp, Homo sapiens
cactgggcctgct

SEQ ID NO: 430686 - DNA, 15 bp, Homo sapiens
cactgggcctgctag

SEQ ID NO: 430687 - DNA, 16 bp, Homo sapiens
cactggggagtgctgg

SEQ ID NO: 430688 - DNA, 19 bp, Homo sapiens
cactggggatcccgtgctg

SEQ ID NO: 430689 - DNA, 20 bp, Homo sapiens
cactggggatcccgtgctgg

SEQ ID NO: 430690 - DNA, 19 bp, Homo sapiens
cactgggggaacagatgct

SEQ ID NO: 430691 - DNA, 23 bp, Homo sapiens
cactgggggaacagatgctaata

SEQ ID NO: 430692 - DNA, 18 bp, Homo sapiens
cactgggtctcactcctg

SEQ ID NO: 430693 - DNA, 19 bp, Homo sapiens
cactgggtctcactcctga

SEQ ID NO: 430694 - DNA, 21 bp, Homo sapiens
cactgggtctcactcctgagt

SEQ ID NO: 430695 - DNA, 22 bp, Homo sapiens
cactggtccgaggagtgtgctc

SEQ ID NO: 430696 - DNA, 16 bp, Homo sapiens
cactggtctcagagga

SEQ ID NO: 430697 - DNA, 17 bp, Homo sapiens
cactggtctcagaggag

SEQ ID NO: 430698 - DNA, 20 bp, Homo sapiens
cactggtctcagaggaggga

SEQ ID NO: 430699 - DNA, 23 bp, Homo sapiens
cactggtggcccgacagcctggc

SEQ ID NO: 430700 - DNA, 18 bp, Homo sapiens
cactggtgggcagctgag

SEQ ID NO: 430701 - DNA, 19 bp, Homo sapiens
cactggtgggcagctgagg

SEQ ID NO: 430702 - DNA, 19 bp, Homo sapiens
cactggtggtttttgctct

SEQ ID NO: 430703 - DNA, 18 bp, Homo sapiens
cactggtttgtttctcaa

SEQ ID NO: 430704 - DNA, 12 bp, Homo sapiens
cactgtaaaatg

SEQ ID NO: 430705 - DNA, 21 bp, Homo sapiens
cactgtaatcttaaaagtgta

SEQ ID NO: 430706 - DNA, 22 bp, Homo sapiens
cactgtagcctgcgtcatggct

SEQ ID NO: 430707 - DNA, 19 bp, Homo sapiens
cactgtatctaaaaaataa

SEQ ID NO: 430708 - DNA, 18 bp, Homo sapiens
cactgtcactgtttctct

SEQ ID NO: 430709 - DNA, 19 bp, Homo sapiens
cactgtcactttgctctgg

SEQ ID NO: 430710 - DNA, 13 bp, Homo sapiens
cactgtccaccac

SEQ ID NO: 430711 - DNA, 14 bp, Homo sapiens
cactgtccctacca

SEQ ID NO: 430712 - DNA, 12 bp, Homo sapiens
cactgtccgcct

SEQ ID NO: 430713 - DNA, 15 bp, Homo sapiens
cactgtcctggcttt

SEQ ID NO: 430714 - DNA, 14 bp, Homo sapiens
cactgtcctgggcg

SEQ ID NO: 430715 - DNA, 23 bp, Homo sapiens
cactgtcctgggcgccctggaag

SEQ ID NO: 430716 - DNA, 13 bp, Homo sapiens
cactgtcctttct

SEQ ID NO: 430717 - DNA, 15 bp, Homo sapiens
cactgtcctttctcc

SEQ ID NO: 430718 - DNA, 17 bp, Homo sapiens
cactgtcctttctccag

SEQ ID NO: 430719 - DNA, 18 bp, Homo sapiens
cactgtcctttctccagg

SEQ ID NO: 430720 - DNA, 16 bp, Homo sapiens
cactgtgatgttggga

SEQ ID NO: 430721 - DNA, 14 bp, Homo sapiens
cactgtgcttgctc

SEQ ID NO: 430722 - DNA, 21 bp, Homo sapiens
cactgtgcttgctcctaagca

SEQ ID NO: 430723 - DNA, 12 bp, Homo sapiens
cactgtggccag

SEQ ID NO: 430724 - DNA, 18 bp, Homo sapiens
cactgtggccagagctgg

SEQ ID NO: 430725 - DNA, 20 bp, Homo sapiens
cactgtggccagagctggaa

SEQ ID NO: 430726 - DNA, 22 bp, Homo sapiens
cactgttagctttttaaaacat

SEQ ID NO: 430727 - DNA, 19 bp, Homo sapiens
cactgttattttcagcatg

SEQ ID NO: 430728 - DNA, 22 bp, Homo sapiens
cactgttccctctgctcctgga

SEQ ID NO: 430729 - DNA, 21 bp, Homo sapiens
cactgttgaaaattattttaa

SEQ ID NO: 430730 - DNA, 17 bp, Homo sapiens
cactgttgcttaattgt

SEQ ID NO: 430731 - DNA, 14 bp, Homo sapiens
cacttaaaaaatgt

SEQ ID NO: 430732 - DNA, 13 bp, Homo sapiens
cacttaaaatcaa

SEQ ID NO: 430733 - DNA, 21 bp, Homo sapiens
cagaacctggtggctggaggc

SEQ ID NO: 430734 - DNA, 14 bp, Homo sapiens
cagaacctttgtca

SEQ ID NO: 430735 - DNA, 15 bp, Homo sapiens
cagaacctttgtcaa

SEQ ID NO: 430736 - DNA, 14 bp, Homo sapiens
cagaacgcacccca

SEQ ID NO: 430737 - DNA, 16 bp, Homo sapiens
cagaacgggcctcccc

SEQ ID NO: 430738 - DNA, 18 bp, Homo sapiens
cagaacgggcctccccgg

SEQ ID NO: 430739 - DNA, 16 bp, Homo sapiens
cagaactcctgtgtgt

SEQ ID NO: 430740 - DNA, 13 bp, Homo sapiens
cagaactgagctc

SEQ ID NO: 430741 - DNA, 15 bp, Homo sapiens
cagaactgagctcct

SEQ ID NO: 430742 - DNA, 20 bp, Homo sapiens
cagaactgagctcctctggg

SEQ ID NO: 430743 - DNA, 12 bp, Homo sapiens
cagaactgcccc

SEQ ID NO: 430744 - DNA, 19 bp, Homo sapiens
cagaactgctaccatgaag

SEQ ID NO: 430745 - DNA, 18 bp, Homo sapiens
cagaactgggaaaacagt

SEQ ID NO: 430746 - DNA, 18 bp, Homo sapiens
cagaactgttggctgctc

SEQ ID NO: 430747 - DNA, 14 bp, Homo sapiens
cagaagaatattca

SEQ ID NO: 430748 - DNA, 15 bp, Homo sapiens
cagaagaatattcag

SEQ ID NO: 430749 - DNA, 18 bp, Homo sapiens
cagaagaatattcaggac

SEQ ID NO: 430750 - DNA, 21 bp, Homo sapiens
cagaagagatgggcttgtttt

SEQ ID NO: 430751 - DNA, 23 bp, Homo sapiens
cagaagatagagattcccctgga

SEQ ID NO: 430752 - DNA, 14 bp, Homo sapiens
cagaagatgccctc

SEQ ID NO: 430753 - DNA, 13 bp, Homo sapiens
cagaagatgtatt

SEQ ID NO: 430754 - DNA, 23 bp, Homo sapiens
cagaagatgtattcagagccacc

SEQ ID NO: 430755 - DNA, 14 bp, Homo sapiens
cagaagcaggctgg

SEQ ID NO: 430756 - DNA, 11 bp, Homo sapiens
cagaagcccca

SEQ ID NO: 430757 - DNA, 20 bp, Homo sapiens
cagaagccccatttgcacag

SEQ ID NO: 430758 - DNA, 21 bp, Homo sapiens
cagaagcctccaagcctgcct

SEQ ID NO: 430759 - DNA, 17 bp, Homo sapiens
cagaagcgtctcccttg

SEQ ID NO: 430760 - DNA, 18 bp, Homo sapiens
cagaagcgtctcccttgg

SEQ ID NO: 430761 - DNA, 19 bp, Homo sapiens
cagaagcgtctcccttggc

SEQ ID NO: 430762 - DNA, 18 bp, Homo sapiens
cagaagctcaaggctgca

SEQ ID NO: 430763 - DNA, 12 bp, Homo sapiens
cagaagcttcca

SEQ ID NO: 430764 - DNA, 12 bp, Homo sapiens
cagaaggaagct

SEQ ID NO: 430765 - DNA, 15 bp, Homo sapiens
cagaaggaaggagga

SEQ ID NO: 430766 - DNA, 14 bp, Homo sapiens
cagaaggacctcct

SEQ ID NO: 430767 - DNA, 17 bp, Homo sapiens
cagaaggccttgaagaa

SEQ ID NO: 430768 - DNA, 15 bp, Homo sapiens
cagaagggaattgct

SEQ ID NO: 430769 - DNA, 15 bp, Homo sapiens
cagaagggggccatg

SEQ ID NO: 430770 - DNA, 20 bp, Homo sapiens
cagaaggggtttggtctggg

SEQ ID NO: 430771 - DNA, 17 bp, Homo sapiens
cagaagtactggcatca

SEQ ID NO: 430772 - DNA, 22 bp, Homo sapiens
cagaagtcagcccgaatgcctg

SEQ ID NO: 430773 - DNA, 18 bp, Homo sapiens
cagaagtcctccctcctg

SEQ ID NO: 430774 - DNA, 14 bp, Homo sapiens
cagaagtgaaaaag

SEQ ID NO: 430775 - DNA, 13 bp, Homo sapiens
cagaagtgctctt

SEQ ID NO: 430776 - DNA, 14 bp, Homo sapiens
cagaagtggagctg

SEQ ID NO: 430777 - DNA, 16 bp, Homo sapiens
cagaagtggagctggg

SEQ ID NO: 430778 - DNA, 15 bp, Homo sapiens
cagaagtttctcagc

SEQ ID NO: 430779 - DNA, 19 bp, Homo sapiens
cagaagtttctcagctccc

SEQ ID NO: 430780 - DNA, 16 bp, Homo sapiens
cagaagtttgcttctt

SEQ ID NO: 430781 - DNA, 16 bp, Homo sapiens
cagaagtttggcaata

SEQ ID NO: 430782 - DNA, 19 bp, Homo sapiens
cagaagttttaacttccag

SEQ ID NO: 430783 - DNA, 21 bp, Homo sapiens
cagaagttttaacttccagtg

SEQ ID NO: 430784 - DNA, 23 bp, Homo sapiens
cagaataaatgggtaacactgat

SEQ ID NO: 430785 - DNA, 18 bp, Homo sapiens
cagaataatgttctattg

SEQ ID NO: 430786 - DNA, 22 bp, Homo sapiens
cagaatattctgtaaacctaat

SEQ ID NO: 430787 - DNA, 16 bp, Homo sapiens
cagaatcctggccctc

SEQ ID NO: 430788 - DNA, 17 bp, Homo sapiens
cagaatctgctgttgcc

SEQ ID NO: 430789 - DNA, 14 bp, Homo sapiens
cagaatctttgcaa

SEQ ID NO: 430790 - DNA, 23 bp, Homo sapiens
cagaattagtcctcacagcctag

SEQ ID NO: 430791 - DNA, 22 bp, Homo sapiens
cagaattatacagacctaatat

SEQ ID NO: 430792 - DNA, 12 bp, Homo sapiens
cagaattcacta

SEQ ID NO: 430793 - DNA, 24 bp, Homo sapiens
cagaatttcccaaagcagtgcatg

SEQ ID NO: 430794 - DNA, 22 bp, Homo sapiens
cagacaaatgtggttacacact

SEQ ID NO: 430795 - DNA, 22 bp, Homo sapiens
cagacaagtggctaagtgtcca

SEQ ID NO: 430796 - DNA, 16 bp, Homo sapiens
cagacacaattagaga

SEQ ID NO: 430797 - DNA, 14 bp, Homo sapiens
cagacacacaacat

SEQ ID NO: 430798 - DNA, 22 bp, Homo sapiens
cagacacacacacacacacaaa

SEQ ID NO: 430799 - DNA, 14 bp, Homo sapiens
cagacacacacacg

SEQ ID NO: 430800 - DNA, 15 bp, Homo sapiens
cagacacacacacgc

SEQ ID NO: 430801 - DNA, 21 bp, Homo sapiens
cagacacacacacgcacgcac

SEQ ID NO: 430802 - DNA, 16 bp, Homo sapiens
cagacacacggggcac

SEQ ID NO: 430803 - DNA, 18 bp, Homo sapiens
cagacaccacagacgcca

SEQ ID NO: 430804 - DNA, 18 bp, Homo sapiens
cagacactaagttatagt

SEQ ID NO: 430805 - DNA, 21 bp, Homo sapiens
cagacactgaccatccactct

SEQ ID NO: 430806 - DNA, 15 bp, Homo sapiens
cagacactttggaag

SEQ ID NO: 430807 - DNA, 15 bp, Homo sapiens
cagacagacagacag

SEQ ID NO: 430808 - DNA, 20 bp, Homo sapiens
cagacaggaaagggaaggcc

SEQ ID NO: 430809 - DNA, 14 bp, Homo sapiens
cagacaggctctta

SEQ ID NO: 430810 - DNA, 20 bp, Homo sapiens
cagacaggctcttagcagct

SEQ ID NO: 430811 - DNA, 15 bp, Homo sapiens
cagacagggtctgaa

SEQ ID NO: 430812 - DNA, 19 bp, Homo sapiens
cagacagggtggggcttag

SEQ ID NO: 430813 - DNA, 19 bp, Homo sapiens
cagacagtgttttctggga

SEQ ID NO: 430814 - DNA, 20 bp, Homo sapiens
cagacagttaagagaaatga

SEQ ID NO: 430815 - DNA, 19 bp, Homo sapiens
cagacatccatgtttgtaa

SEQ ID NO: 430816 - DNA, 16 bp, Homo sapiens
cagaccaccagccgcc

SEQ ID NO: 430817 - DNA, 23 bp, Homo sapiens
cagaccaccagccgccccagccc

SEQ ID NO: 430818 - DNA, 16 bp, Homo sapiens
cagaccagagctgtct

SEQ ID NO: 430819 - DNA, 16 bp, Homo sapiens
cagacccagggcagtg

SEQ ID NO: 430820 - DNA, 13 bp, Homo sapiens
cagaccccagggc

SEQ ID NO: 430821 - DNA, 14 bp, Homo sapiens
cagaccccagggca

SEQ ID NO: 430822 - DNA, 20 bp, Homo sapiens
cagaccccatccagccaggg

SEQ ID NO: 430823 - DNA, 14 bp, Homo sapiens
cagacccccacccc

SEQ ID NO: 430824 - DNA, 15 bp, Homo sapiens
cagacccccacccct

SEQ ID NO: 430825 - DNA, 17 bp, Homo sapiens
cagacccccaccccttc

SEQ ID NO: 430826 - DNA, 15 bp, Homo sapiens
cagacccctaccctt

SEQ ID NO: 430827 - DNA, 13 bp, Homo sapiens
cagacccctctca

SEQ ID NO: 430828 - DNA, 18 bp, Homo sapiens
cagacccctctggccagg

SEQ ID NO: 430829 - DNA, 11 bp, Homo sapiens
cagacccctgc

SEQ ID NO: 430830 - DNA, 19 bp, Homo sapiens
cagacccctgcctggactt

SEQ ID NO: 430831 - DNA, 14 bp, Homo sapiens
cagacccctggctt

SEQ ID NO: 430832 - DNA, 22 bp, Homo sapiens
cagacccctggcttttcactgc

SEQ ID NO: 430833 - DNA, 23 bp, Homo sapiens
cagacccctggcttttcactgct

SEQ ID NO: 430834 - DNA, 16 bp, Homo sapiens
cagaccctgcctgagc

SEQ ID NO: 430835 - DNA, 17 bp, Homo sapiens
cagaccctgcctgagcc

SEQ ID NO: 430836 - DNA, 17 bp, Homo sapiens
cagacccttgaagatgt

SEQ ID NO: 430837 - DNA, 20 bp, Homo sapiens
cagaccggccgcatgtctgc

SEQ ID NO: 430838 - DNA, 15 bp, Homo sapiens
cagacctaatatcat

SEQ ID NO: 430839 - DNA, 16 bp, Homo sapiens
cagacctaatatcatt

SEQ ID NO: 430840 - DNA, 19 bp, Homo sapiens
cagacctaatatcatttta

SEQ ID NO: 430841 - DNA, 17 bp, Homo sapiens
cagacctaatgctcctt

SEQ ID NO: 430842 - DNA, 15 bp, Homo sapiens
cagacctcccctctt

SEQ ID NO: 430843 - DNA, 21 bp, Homo sapiens
cagacctcccctcttcctgga

SEQ ID NO: 430844 - DNA, 11 bp, Homo sapiens
cagacctctga

SEQ ID NO: 430845 - DNA, 17 bp, Homo sapiens
cagacctgaatgcttct

SEQ ID NO: 430846 - DNA, 20 bp, Homo sapiens
cagacctgaatgcttctgag

SEQ ID NO: 430847 - DNA, 12 bp, Homo sapiens
cagacctgagct

SEQ ID NO: 430848 - DNA, 23 bp, Homo sapiens
cagacctgtcttccaaggagacc

SEQ ID NO: 430849 - DNA, 15 bp, Homo sapiens
cagacgcagcagctg

SEQ ID NO: 430850 - DNA, 17 bp, Homo sapiens
cagacgcttgcgccgag

SEQ ID NO: 430851 - DNA, 20 bp, Homo sapiens
cagacggacgggacagcggc

SEQ ID NO: 430852 - DNA, 18 bp, Homo sapiens
cagacggcccgccgtgcc

SEQ ID NO: 430853 - DNA, 23 bp, Homo sapiens
cagactcagagaccgtgagcgcc

SEQ ID NO: 430854 - DNA, 15 bp, Homo sapiens
cagactcaggttcca

SEQ ID NO: 430855 - DNA, 16 bp, Homo sapiens
cagactcaggttccag

SEQ ID NO: 430856 - DNA, 18 bp, Homo sapiens
cagactcaggttccagaa

SEQ ID NO: 430857 - DNA, 19 bp, Homo sapiens
cagactcaggttccagaac

SEQ ID NO: 430858 - DNA, 22 bp, Homo sapiens
cagactcaggttccagaacagc

SEQ ID NO: 430859 - DNA, 18 bp, Homo sapiens
cagactcagtttgtcaga

SEQ ID NO: 430860 - DNA, 18 bp, Homo sapiens
cagactcatacagaaggt

SEQ ID NO: 430861 - DNA, 19 bp, Homo sapiens
cagactcatacagaaggtg

SEQ ID NO: 430862 - DNA, 21 bp, Homo sapiens
cagactcatacagaaggtggg

SEQ ID NO: 430863 - DNA, 22 bp, Homo sapiens
cagaggagtgattgaaccagct

SEQ ID NO: 430864 - DNA, 21 bp, Homo sapiens
cagaggattctgtcttccagg

SEQ ID NO: 430865 - DNA, 18 bp, Homo sapiens
cagaggcagaaccctggt

SEQ ID NO: 430866 - DNA, 12 bp, Homo sapiens
cagaggcagggc

SEQ ID NO: 430867 - DNA, 18 bp, Homo sapiens
cagaggcagggccctggg

SEQ ID NO: 430868 - DNA, 21 bp, Homo sapiens
cagaggcagggccctggggtc

SEQ ID NO: 430869 - DNA, 14 bp, Homo sapiens
cagaggcagtggca

SEQ ID NO: 430870 - DNA, 17 bp, Homo sapiens
cagaggctaagatgaga

SEQ ID NO: 430871 - DNA, 13 bp, Homo sapiens
cagaggctcctgg

SEQ ID NO: 430872 - DNA, 14 bp, Homo sapiens
cagaggctcctgga

SEQ ID NO: 430873 - DNA, 22 bp, Homo sapiens
cagaggctgagttttctctttg

SEQ ID NO: 430874 - DNA, 15 bp, Homo sapiens
cagaggctggcctca

SEQ ID NO: 430875 - DNA, 19 bp, Homo sapiens
cagagggaaactcagatgt

SEQ ID NO: 430876 - DNA, 19 bp, Homo sapiens
cagagggaaaggctgaaca

SEQ ID NO: 430877 - DNA, 20 bp, Homo sapiens
cagagggaaggggcctacac

SEQ ID NO: 430878 - DNA, 18 bp, Homo sapiens
cagagggaatgttccctg

SEQ ID NO: 430879 - DNA, 14 bp, Homo sapiens
cagagggaccagct

SEQ ID NO: 430880 - DNA, 15 bp, Homo sapiens
cagagggaccagctg

SEQ ID NO: 430881 - DNA, 19 bp, Homo sapiens
cagagggaccagctggggg

SEQ ID NO: 430882 - DNA, 18 bp, Homo sapiens
cagagggactgtcagctg

SEQ ID NO: 430883 - DNA, 13 bp, Homo sapiens
cagaggggcagcc

SEQ ID NO: 430884 - DNA, 14 bp, Homo sapiens
cagaggggcagccg

SEQ ID NO: 430885 - DNA, 18 bp, Homo sapiens
cagaggggcagccgctag

SEQ ID NO: 430886 - DNA, 21 bp, Homo sapiens
cagaggggcagccgctaggag

SEQ ID NO: 430887 - DNA, 16 bp, Homo sapiens
cagagggtccctaggt

SEQ ID NO: 430888 - DNA, 14 bp, Homo sapiens
cagaggtcccctga

SEQ ID NO: 430889 - DNA, 21 bp, Homo sapiens
cagaggtcccctgaggtcatg

SEQ ID NO: 430890 - DNA, 19 bp, Homo sapiens
cagaggtctctgccggctc

SEQ ID NO: 430891 - DNA, 23 bp, Homo sapiens
cagaggtctctgccggctctttc

SEQ ID NO: 430892 - DNA, 19 bp, Homo sapiens
cagaggtgagggaggcctg

SEQ ID NO: 430893 - DNA, 19 bp, Homo sapiens
cagaggtgggaggcccctg

SEQ ID NO: 430894 - DNA, 22 bp, Homo sapiens
cagaggtgggaggcccctggtg

SEQ ID NO: 430895 - DNA, 19 bp, Homo sapiens
cagaggtggggaagagagc

SEQ ID NO: 430896 - DNA, 14 bp, Homo sapiens
cagagtacatccat

SEQ ID NO: 430897 - DNA, 17 bp, Homo sapiens
cagagtaggtgggtctt

SEQ ID NO: 430898 - DNA, 17 bp, Homo sapiens
cagagtagttttggttt

SEQ ID NO: 430899 - DNA, 20 bp, Homo sapiens
cagagtatttgaaaaatgta

SEQ ID NO: 430900 - DNA, 12 bp, Homo sapiens
cagagtcattgt

SEQ ID NO: 430901 - DNA, 16 bp, Homo sapiens
cagagtccaggcccca

SEQ ID NO: 430902 - DNA, 15 bp, Homo sapiens
cagagtctcccgctg

SEQ ID NO: 430903 - DNA, 13 bp, Homo sapiens
cagagtctcgctc

SEQ ID NO: 430904 - DNA, 19 bp, Homo sapiens
cagagtctcgctctgtcgc

SEQ ID NO: 430905 - DNA, 16 bp, Homo sapiens
cagagtctgacaggaa

SEQ ID NO: 430906 - DNA, 15 bp, Homo sapiens
cagagtctgagcccc

SEQ ID NO: 430907 - DNA, 17 bp, Homo sapiens
cagagtctggcctgcca

SEQ ID NO: 430908 - DNA, 19 bp, Homo sapiens
cagagtctggcctgccagg

SEQ ID NO: 430909 - DNA, 18 bp, Homo sapiens
cagagtctgggcctctga

SEQ ID NO: 430910 - DNA, 20 bp, Homo sapiens
cagagtgaaagggctatggc

SEQ ID NO: 430911 - DNA, 16 bp, Homo sapiens
cagagtgaatcatcca

SEQ ID NO: 430912 - DNA, 15 bp, Homo sapiens
cagagtgccccacct

SEQ ID NO: 430913 - DNA, 21 bp, Homo sapiens
cagagtgccccacctgccact

SEQ ID NO: 430914 - DNA, 18 bp, Homo sapiens
cagagtggactcttccct

SEQ ID NO: 430915 - DNA, 15 bp, Homo sapiens
cagagtggatctgga

SEQ ID NO: 430916 - DNA, 19 bp, Homo sapiens
cagagtggatctggagtct

SEQ ID NO: 430917 - DNA, 12 bp, Homo sapiens
cagagtggcctg

SEQ ID NO: 430918 - DNA, 16 bp, Homo sapiens
cagagtggcctggcca

SEQ ID NO: 430919 - DNA, 18 bp, Homo sapiens
cagagtggcctggccagg

SEQ ID NO: 430920 - DNA, 19 bp, Homo sapiens
cagagtggtttcattgcct

SEQ ID NO: 430921 - DNA, 15 bp, Homo sapiens
cagagtgtggtccct

SEQ ID NO: 430922 - DNA, 21 bp, Homo sapiens
cagagtgtggtccctccacta

SEQ ID NO: 430923 - DNA, 16 bp, Homo sapiens
cagagttattgaatct

SEQ ID NO: 430924 - DNA, 20 bp, Homo sapiens
cagagttcactataaatggt

SEQ ID NO: 430925 - DNA, 19 bp, Homo sapiens
cagataagaatgctggttt

SEQ ID NO: 430926 - DNA, 20 bp, Homo sapiens
cagataagacatatctctaa

SEQ ID NO: 430927 - DNA, 23 bp, Homo sapiens
cagataaggaaactgaggcccag

SEQ ID NO: 430928 - DNA, 15 bp, Homo sapiens
cagataatcagcctc

SEQ ID NO: 430929 - DNA, 19 bp, Homo sapiens
cagataatcagcctcttaa

SEQ ID NO: 430930 - DNA, 20 bp, Homo sapiens
cagataatgcttttactaag

SEQ ID NO: 430931 - DNA, 18 bp, Homo sapiens
cagataatttattttgta

SEQ ID NO: 430932 - DNA, 19 bp, Homo sapiens
cagataccttgaaaggaag

SEQ ID NO: 430933 - DNA, 16 bp, Homo sapiens
cagatactgaaacatt

SEQ ID NO: 430934 - DNA, 18 bp, Homo sapiens
cagatactgaaacatttg

SEQ ID NO: 430935 - DNA, 18 bp, Homo sapiens
cagatactggaagttttg

SEQ ID NO: 430936 - DNA, 16 bp, Homo sapiens
cagatagaatcaatca

SEQ ID NO: 430937 - DNA, 14 bp, Homo sapiens
cagatagagctggg

SEQ ID NO: 430938 - DNA, 16 bp, Homo sapiens
cagatagagctgggtg

SEQ ID NO: 430939 - DNA, 14 bp, Homo sapiens
cagatagtcccagc

SEQ ID NO: 430940 - DNA, 18 bp, Homo sapiens
cagatataaatggctggt

SEQ ID NO: 430941 - DNA, 21 bp, Homo sapiens
cagatatcgagagtttctatg

SEQ ID NO: 430942 - DNA, 17 bp, Homo sapiens
cagatatgtattacttt

SEQ ID NO: 430943 - DNA, 20 bp, Homo sapiens
cagatattgttataaataaa

SEQ ID NO: 430944 - DNA, 12 bp, Homo sapiens
cagatatttata

SEQ ID NO: 430945 - DNA, 15 bp, Homo sapiens
cagatcaactgagtt

SEQ ID NO: 430946 - DNA, 15 bp, Homo sapiens
cagatccagactgta

SEQ ID NO: 430947 - DNA, 22 bp, Homo sapiens
cagatccagactgtaagatgtt

SEQ ID NO: 430948 - DNA, 20 bp, Homo sapiens
cagatccctcggtcagcacc

SEQ ID NO: 430949 - DNA, 12 bp, Homo sapiens
cagatcctaccc

SEQ ID NO: 430950 - DNA, 16 bp, Homo sapiens
cagatcctgctgccgc

SEQ ID NO: 430951 - DNA, 18 bp, Homo sapiens
cagatctagccaggcctc

SEQ ID NO: 430952 - DNA, 16 bp, Homo sapiens
cagatctccaaagctt

SEQ ID NO: 430953 - DNA, 22 bp, Homo sapiens
cagatctgacatgattccttcc

SEQ ID NO: 430954 - DNA, 23 bp, Homo sapiens
cagatctgacatgattccttcct

SEQ ID NO: 430955 - DNA, 17 bp, Homo sapiens
cagatctgcctgggcct

SEQ ID NO: 430956 - DNA, 13 bp, Homo sapiens
cagatctgtgccc

SEQ ID NO: 430957 - DNA, 18 bp, Homo sapiens
cagatctgtgccccatgc

SEQ ID NO: 430958 - DNA, 20 bp, Homo sapiens
cagatctgtgccccatgcct

SEQ ID NO: 430959 - DNA, 23 bp, Homo sapiens
cagatctgtgccccatgcctgtc

SEQ ID NO: 430960 - DNA, 12 bp, Homo sapiens
cagatcttacaa

SEQ ID NO: 430961 - DNA, 17 bp, Homo sapiens
cagatcttacaagttta

SEQ ID NO: 430962 - DNA, 16 bp, Homo sapiens
cagatgaactgagaag

SEQ ID NO: 430963 - DNA, 18 bp, Homo sapiens
cagatgacacataaatct

SEQ ID NO: 430964 - DNA, 19 bp, Homo sapiens
cagatgacacataaatctg

SEQ ID NO: 430965 - DNA, 14 bp, Homo sapiens
cagatgacagggag

SEQ ID NO: 430966 - DNA, 12 bp, Homo sapiens
cagatgagaagt

SEQ ID NO: 430967 - DNA, 13 bp, Homo sapiens
cagatgagaagtt

SEQ ID NO: 430968 - DNA, 17 bp, Homo sapiens
cagatgagcaaggacat

SEQ ID NO: 430969 - DNA, 18 bp, Homo sapiens
cagatgagcaaggacatt

SEQ ID NO: 430970 - DNA, 20 bp, Homo sapiens
cagatgagcaaggacattgc

SEQ ID NO: 430971 - DNA, 15 bp, Homo sapiens
cagatgataaaagga

SEQ ID NO: 430972 - DNA, 12 bp, Homo sapiens
cagatgccaaaa

SEQ ID NO: 430973 - DNA, 18 bp, Homo sapiens
cagatgccagagcaaagg

SEQ ID NO: 430974 - DNA, 20 bp, Homo sapiens
cagatgccatggcctgtgct

SEQ ID NO: 430975 - DNA, 13 bp, Homo sapiens
cagatgccccaga

SEQ ID NO: 430976 - DNA, 15 bp, Homo sapiens
cagatgccttctaga

SEQ ID NO: 430977 - DNA, 16 bp, Homo sapiens
cagatgccttctagat

SEQ ID NO: 430978 - DNA, 16 bp, Homo sapiens
cagatggaatgctgtg

SEQ ID NO: 430979 - DNA, 17 bp, Homo sapiens
cagatggaatgctgtgt

SEQ ID NO: 430980 - DNA, 19 bp, Homo sapiens
cagatggaatgctgtgtta

SEQ ID NO: 430981 - DNA, 23 bp, Homo sapiens
cagatggaggttctcagagccaa

SEQ ID NO: 430982 - DNA, 11 bp, Homo sapiens
cagatggatgt

SEQ ID NO: 430983 - DNA, 19 bp, Homo sapiens
cagatggatgtagatacag

SEQ ID NO: 430984 - DNA, 23 bp, Homo sapiens
cagatggatgtagatacagatcc

SEQ ID NO: 430985 - DNA, 15 bp, Homo sapiens
cagatggatttgcct

SEQ ID NO: 430986 - DNA, 14 bp, Homo sapiens
cagatggcacctgt

SEQ ID NO: 430987 - DNA, 16 bp, Homo sapiens
cagatggcacctgtgg

SEQ ID NO: 430988 - DNA, 23 bp, Homo sapiens
cagatggcggtgatcagcagaga

SEQ ID NO: 430989 - DNA, 13 bp, Homo sapiens
cagatggctgtga

SEQ ID NO: 430990 - DNA, 14 bp, Homo sapiens
cagatggctgtgaa

SEQ ID NO: 430991 - DNA, 14 bp, Homo sapiens
cagatgtccctgaa

SEQ ID NO: 430992 - DNA, 20 bp, Homo sapiens
cagatgtccctgaagtcttg

SEQ ID NO: 430993 - DNA, 19 bp, Homo sapiens
cagcattttcacattttgc

SEQ ID NO: 430994 - DNA, 17 bp, Homo sapiens
cagccaaatgcagggag

SEQ ID NO: 430995 - DNA, 22 bp, Homo sapiens
cagccaaatgtaattgaataaa

SEQ ID NO: 430996 - DNA, 14 bp, Homo sapiens
cagccaacccctgt

SEQ ID NO: 430997 - DNA, 13 bp, Homo sapiens
cagccaagtgcct

SEQ ID NO: 430998 - DNA, 16 bp, Homo sapiens
cagccaatttgtctcc

SEQ ID NO: 430999 - DNA, 14 bp, Homo sapiens
cagccaccaccact

SEQ ID NO: 431000 - DNA, 19 bp, Homo sapiens
cagccacccagccaggagg

SEQ ID NO: 431001 - DNA, 20 bp, Homo sapiens
cagccaccccgggctctctg

SEQ ID NO: 431002 - DNA, 21 bp, Homo sapiens
cagccaccccgggctctctgc

SEQ ID NO: 431003 - DNA, 19 bp, Homo sapiens
cagccacccggatctccag

SEQ ID NO: 431004 - DNA, 14 bp, Homo sapiens
cagccaccttcctg

SEQ ID NO: 431005 - DNA, 17 bp, Homo sapiens
cagccaccttcctgact

SEQ ID NO: 431006 - DNA, 19 bp, Homo sapiens
cagccaccttcctgactgg

SEQ ID NO: 431007 - DNA, 15 bp, Homo sapiens
cagccacgaggtggt

SEQ ID NO: 431008 - DNA, 20 bp, Homo sapiens
cagccacggacgctggctcc

SEQ ID NO: 431009 - DNA, 13 bp, Homo sapiens
cagccacttggtt

SEQ ID NO: 431010 - DNA, 17 bp, Homo sapiens
cagccagaaccccgagc

SEQ ID NO: 431011 - DNA, 22 bp, Homo sapiens
cagccagaaccccgagccctac

SEQ ID NO: 431012 - DNA, 14 bp, Homo sapiens
cagccagagctggg

SEQ ID NO: 431013 - DNA, 16 bp, Homo sapiens
cagccagagctgggtg

SEQ ID NO: 431014 - DNA, 22 bp, Homo sapiens
cagccagcaatgatgtccagaa

SEQ ID NO: 431015 - DNA, 17 bp, Homo sapiens
cagccagccagtcttgc

SEQ ID NO: 431016 - DNA, 21 bp, Homo sapiens
cagccagcccttcccaggcca

SEQ ID NO: 431017 - DNA, 22 bp, Homo sapiens
cagccagcccttccctggcccc

SEQ ID NO: 431018 - DNA, 15 bp, Homo sapiens
cagccagcgcaggcc

SEQ ID NO: 431019 - DNA, 22 bp, Homo sapiens
cagccagcgcaggccctggtgg

SEQ ID NO: 431020 - DNA, 22 bp, Homo sapiens
cagccagctgcccacaagccat

SEQ ID NO: 431021 - DNA, 11 bp, Homo sapiens
cagccaggagg

SEQ ID NO: 431022 - DNA, 12 bp, Homo sapiens
cagccaggctgc

SEQ ID NO: 431023 - DNA, 13 bp, Homo sapiens
cagccaggctgcc

SEQ ID NO: 431024 - DNA, 12 bp, Homo sapiens
cagccagggagc

SEQ ID NO: 431025 - DNA, 18 bp, Homo sapiens
cagccagtcttgcctagg

SEQ ID NO: 431026 - DNA, 19 bp, Homo sapiens
cagccagtcttgcctaggc

SEQ ID NO: 431027 - DNA, 23 bp, Homo sapiens
cagccagtcttgcctaggccaaa

SEQ ID NO: 431028 - DNA, 12 bp, Homo sapiens
cagccagtggcc

SEQ ID NO: 431029 - DNA, 16 bp, Homo sapiens
cagccagtggccgaac

SEQ ID NO: 431030 - DNA, 17 bp, Homo sapiens
cagccatgcctcatgcc

SEQ ID NO: 431031 - DNA, 14 bp, Homo sapiens
cagccatgggccct

SEQ ID NO: 431032 - DNA, 17 bp, Homo sapiens
cagccattcatctgggc

SEQ ID NO: 431033 - DNA, 19 bp, Homo sapiens
cagccattcatctgggctg

SEQ ID NO: 431034 - DNA, 20 bp, Homo sapiens
cagccattcatctgggctgg

SEQ ID NO: 431035 - DNA, 21 bp, Homo sapiens
cagccattcatctgggctggc

SEQ ID NO: 431036 - DNA, 17 bp, Homo sapiens
cagccattcctgttctc

SEQ ID NO: 431037 - DNA, 12 bp, Homo sapiens
cagcccaaccag

SEQ ID NO: 431038 - DNA, 13 bp, Homo sapiens
cagcccaaccagg

SEQ ID NO: 431039 - DNA, 14 bp, Homo sapiens
cagcccaaccagga

SEQ ID NO: 431040 - DNA, 15 bp, Homo sapiens
cagcccaaccaggag

SEQ ID NO: 431041 - DNA, 21 bp, Homo sapiens
cagcccaaccaggaggggtct

SEQ ID NO: 431042 - DNA, 13 bp, Homo sapiens
cagcccacagagg

SEQ ID NO: 431043 - DNA, 18 bp, Homo sapiens
cagcccacagtgctcagt

SEQ ID NO: 431044 - DNA, 24 bp, Homo sapiens
cagcccacagtgctcagttgtact

SEQ ID NO: 431045 - DNA, 19 bp, Homo sapiens
cagcccacatagtgatggt

SEQ ID NO: 431046 - DNA, 14 bp, Homo sapiens
cagcccacccccct

SEQ ID NO: 431047 - DNA, 19 bp, Homo sapiens
cagcccaccctgctcctcc

SEQ ID NO: 431048 - DNA, 21 bp, Homo sapiens
cagcccaccctgctcctcctg

SEQ ID NO: 431049 - DNA, 17 bp, Homo sapiens
cagcccagaacgggcct

SEQ ID NO: 431050 - DNA, 19 bp, Homo sapiens
cagcccagaacgggcctcc

SEQ ID NO: 431051 - DNA, 16 bp, Homo sapiens
cagcccagacatcctg

SEQ ID NO: 431052 - DNA, 11 bp, Homo sapiens
cagcccagaga

SEQ ID NO: 431053 - DNA, 12 bp, Homo sapiens
cagcccagagag

SEQ ID NO: 431054 - DNA, 23 bp, Homo sapiens
cagcccagagagaccctgccaac

SEQ ID NO: 431055 - DNA, 15 bp, Homo sapiens
cagcccagccacgga

SEQ ID NO: 431056 - DNA, 14 bp, Homo sapiens
cagcccagcccagc

SEQ ID NO: 431057 - DNA, 13 bp, Homo sapiens
cagcccagctcca

SEQ ID NO: 431058 - DNA, 24 bp, Homo sapiens
cagcccagctccactcagggctgg

SEQ ID NO: 431059 - DNA, 11 bp, Homo sapiens
cagcccagctg

SEQ ID NO: 431060 - DNA, 20 bp, Homo sapiens
cagcccagctgctctgccca

SEQ ID NO: 431061 - DNA, 11 bp, Homo sapiens
cagcccaggat

SEQ ID NO: 431062 - DNA, 14 bp, Homo sapiens
cagcccatcttgcc

SEQ ID NO: 431063 - DNA, 17 bp, Homo sapiens
cagcccatcttgcctcc

SEQ ID NO: 431064 - DNA, 21 bp, Homo sapiens
cagcccatgcccacctgccca

SEQ ID NO: 431065 - DNA, 17 bp, Homo sapiens
cagccccaactccaggg

SEQ ID NO: 431066 - DNA, 21 bp, Homo sapiens
cagccccaactccaggggcac

SEQ ID NO: 431067 - DNA, 22 bp, Homo sapiens
cagccccacccaggagggaggg

SEQ ID NO: 431068 - DNA, 15 bp, Homo sapiens
cagccccagcccagc

SEQ ID NO: 431069 - DNA, 19 bp, Homo sapiens
cagccccagcgagtctgga

SEQ ID NO: 431070 - DNA, 12 bp, Homo sapiens
cagccccagggc

SEQ ID NO: 431071 - DNA, 17 bp, Homo sapiens
cagccccagggccctgc

SEQ ID NO: 431072 - DNA, 21 bp, Homo sapiens
cagccccatccttcccgcagc

SEQ ID NO: 431073 - DNA, 19 bp, Homo sapiens
cagccccccaccccacaga

SEQ ID NO: 431074 - DNA, 14 bp, Homo sapiens
cagccccccagtgt

SEQ ID NO: 431075 - DNA, 21 bp, Homo sapiens
cagccccccagtgtccccagg

SEQ ID NO: 431076 - DNA, 15 bp, Homo sapiens
cagccccctccacac

SEQ ID NO: 431077 - DNA, 20 bp, Homo sapiens
cagccccgctcctcccctct

SEQ ID NO: 431078 - DNA, 13 bp, Homo sapiens
cagccccggccac

SEQ ID NO: 431079 - DNA, 23 bp, Homo sapiens
cagcccctagcagagcgtctggc

SEQ ID NO: 431080 - DNA, 13 bp, Homo sapiens
cagcccctcccca

SEQ ID NO: 431081 - DNA, 13 bp, Homo sapiens
cagcccctgcaca

SEQ ID NO: 431082 - DNA, 20 bp, Homo sapiens
cagcccctggagctcctgct

SEQ ID NO: 431083 - DNA, 13 bp, Homo sapiens
cagcccctggggt

SEQ ID NO: 431084 - DNA, 22 bp, Homo sapiens
cagcccgagtggtctcctctca

SEQ ID NO: 431085 - DNA, 15 bp, Homo sapiens
cagcccgcatgcagc

SEQ ID NO: 431086 - DNA, 15 bp, Homo sapiens
cagcccgccgtcagg

SEQ ID NO: 431087 - DNA, 20 bp, Homo sapiens
cagcccggcctgctcccagc

SEQ ID NO: 431088 - DNA, 21 bp, Homo sapiens
cagcccggcctgctcccagca

SEQ ID NO: 431089 - DNA, 15 bp, Homo sapiens
cagcccggcgccacc

SEQ ID NO: 431090 - DNA, 17 bp, Homo sapiens
cagccctaaggatctct

SEQ ID NO: 431091 - DNA, 18 bp, Homo sapiens
cagccctaaggatctctc

SEQ ID NO: 431092 - DNA, 21 bp, Homo sapiens
cagccctaaggatctctcagg

SEQ ID NO: 431093 - DNA, 21 bp, Homo sapiens
cagccctagaggcgagccagg

SEQ ID NO: 431094 - DNA, 22 bp, Homo sapiens
cagccctagaggcgagccaggc

SEQ ID NO: 431095 - DNA, 22 bp, Homo sapiens
cagccctagtgggagcccagca

SEQ ID NO: 431096 - DNA, 24 bp, Homo sapiens
cagccctagtgggagcccagcaca

SEQ ID NO: 431097 - DNA, 12 bp, Homo sapiens
cagccctccaga

SEQ ID NO: 431098 - DNA, 13 bp, Homo sapiens
cagccctcccagc

SEQ ID NO: 431099 - DNA, 19 bp, Homo sapiens
cagccctcccagctggtgt

SEQ ID NO: 431100 - DNA, 17 bp, Homo sapiens
cagccctccctgcccct

SEQ ID NO: 431101 - DNA, 23 bp, Homo sapiens
cagccctccctggctgtgagcag

SEQ ID NO: 431102 - DNA, 14 bp, Homo sapiens
cagccctcggcctc

SEQ ID NO: 431103 - DNA, 13 bp, Homo sapiens
cagccctgctgct

SEQ ID NO: 431104 - DNA, 20 bp, Homo sapiens
cagccctgctgctgcctgcc

SEQ ID NO: 431105 - DNA, 22 bp, Homo sapiens
cagccctggcccagagctggaa

SEQ ID NO: 431106 - DNA, 22 bp, Homo sapiens
cagccctggttctccatcccca

SEQ ID NO: 431107 - DNA, 17 bp, Homo sapiens
cagccctgtcctggttc

SEQ ID NO: 431108 - DNA, 13 bp, Homo sapiens
cagccctgttctg

SEQ ID NO: 431109 - DNA, 14 bp, Homo sapiens
cagcccttcccagg

SEQ ID NO: 431110 - DNA, 15 bp, Homo sapiens
cagcccttcccaggc

SEQ ID NO: 431111 - DNA, 18 bp, Homo sapiens
cagcccttcccaggccag

SEQ ID NO: 431112 - DNA, 22 bp, Homo sapiens
cagcccttccctgctttgagga

SEQ ID NO: 431113 - DNA, 14 bp, Homo sapiens
cagcccttcctcct

SEQ ID NO: 431114 - DNA, 13 bp, Homo sapiens
cagcccttgggca

SEQ ID NO: 431115 - DNA, 15 bp, Homo sapiens
cagccctttccaggg

SEQ ID NO: 431116 - DNA, 17 bp, Homo sapiens
cagccctttgcaggccc

SEQ ID NO: 431117 - DNA, 22 bp, Homo sapiens
cagccctttgcaggcccagcag

SEQ ID NO: 431118 - DNA, 22 bp, Homo sapiens
cagccgagctcgtgtatcctgg

SEQ ID NO: 431119 - DNA, 21 bp, Homo sapiens
cagccgagtggatagatgccc

SEQ ID NO: 431120 - DNA, 23 bp, Homo sapiens
cagccgccacatccccgctggct

SEQ ID NO: 431121 - DNA, 19 bp, Homo sapiens
cagccgccattgccaccag

SEQ ID NO: 431122 - DNA, 14 bp, Homo sapiens
cagccgccttcctt

SEQ ID NO: 431123 - DNA, 16 bp, Homo sapiens
cagctactctgtccag

SEQ ID NO: 431124 - DNA, 19 bp, Homo sapiens
cagctactctgtccaggcc

SEQ ID NO: 431125 - DNA, 21 bp, Homo sapiens
cagctactctgtccaggccac

SEQ ID NO: 431126 - DNA, 16 bp, Homo sapiens
cagctacttgggaagc

SEQ ID NO: 431127 - DNA, 17 bp, Homo sapiens
cagctacttgggagcct

SEQ ID NO: 431128 - DNA, 21 bp, Homo sapiens
cagctacttgggagcctgagg

SEQ ID NO: 431129 - DNA, 22 bp, Homo sapiens
cagctacttgggagcctgaggc

SEQ ID NO: 431130 - DNA, 16 bp, Homo sapiens
cagctacttgggaggc

SEQ ID NO: 431131 - DNA, 20 bp, Homo sapiens
cagctagaaagtggcagagc

SEQ ID NO: 431132 - DNA, 22 bp, Homo sapiens
cagctagaaagtggcagagcca

SEQ ID NO: 431133 - DNA, 13 bp, Homo sapiens
cagctagactgga

SEQ ID NO: 431134 - DNA, 18 bp, Homo sapiens
cagctagactggagtgag

SEQ ID NO: 431135 - DNA, 13 bp, Homo sapiens
cagctagagcttc

SEQ ID NO: 431136 - DNA, 12 bp, Homo sapiens
cagctaggactg

SEQ ID NO: 431137 - DNA, 17 bp, Homo sapiens
cagctaggactgaggag

SEQ ID NO: 431138 - DNA, 14 bp, Homo sapiens
cagctaggctgaga

SEQ ID NO: 431139 - DNA, 17 bp, Homo sapiens
cagctaggctgagatgc

SEQ ID NO: 431140 - DNA, 18 bp, Homo sapiens
cagctaggctgagatgca

SEQ ID NO: 431141 - DNA, 23 bp, Homo sapiens
cagctaggttaataggaggacag

SEQ ID NO: 431142 - DNA, 20 bp, Homo sapiens
cagctatgggagccccaggg

SEQ ID NO: 431143 - DNA, 18 bp, Homo sapiens
cagctattaagaaaatca

SEQ ID NO: 431144 - DNA, 13 bp, Homo sapiens
cagctcacccctg

SEQ ID NO: 431145 - DNA, 15 bp, Homo sapiens
cagctcacccctggg

SEQ ID NO: 431146 - DNA, 17 bp, Homo sapiens
cagctcacccctgggca

SEQ ID NO: 431147 - DNA, 19 bp, Homo sapiens
cagctcacctctgaaggca

SEQ ID NO: 431148 - DNA, 18 bp, Homo sapiens
cagctcactgcaagctcc

SEQ ID NO: 431149 - DNA, 20 bp, Homo sapiens
cagctcagcagttcacttcc

SEQ ID NO: 431150 - DNA, 20 bp, Homo sapiens
cagctcagccccggccactc

SEQ ID NO: 431151 - DNA, 11 bp, Homo sapiens
cagctcaggat

SEQ ID NO: 431152 - DNA, 14 bp, Homo sapiens
cagctcaggcgcag

SEQ ID NO: 431153 - DNA, 18 bp, Homo sapiens
cagctcaggcgcagccct

SEQ ID NO: 431154 - DNA, 17 bp, Homo sapiens
cagctcatgcccccttt

SEQ ID NO: 431155 - DNA, 13 bp, Homo sapiens
cagctccacaggg

SEQ ID NO: 431156 - DNA, 16 bp, Homo sapiens
cagctccactggcctg

SEQ ID NO: 431157 - DNA, 13 bp, Homo sapiens
cagctccaggggc

SEQ ID NO: 431158 - DNA, 19 bp, Homo sapiens
cagctccaggggcccttgg

SEQ ID NO: 431159 - DNA, 17 bp, Homo sapiens
cagctccatccttgcat

SEQ ID NO: 431160 - DNA, 21 bp, Homo sapiens
cagctcccaaggctctgagca

SEQ ID NO: 431161 - DNA, 12 bp, Homo sapiens
cagctccccaag

SEQ ID NO: 431162 - DNA, 13 bp, Homo sapiens
cagctccccaaga

SEQ ID NO: 431163 - DNA, 20 bp, Homo sapiens
cagctccccaggagctcagg

SEQ ID NO: 431164 - DNA, 20 bp, Homo sapiens
cagctcccccttgcccgcca

SEQ ID NO: 431165 - DNA, 14 bp, Homo sapiens
cagctccctagact

SEQ ID NO: 431166 - DNA, 16 bp, Homo sapiens
cagctccctagactgc

SEQ ID NO: 431167 - DNA, 23 bp, Homo sapiens
cagctccctagactgcatcccgt

SEQ ID NO: 431168 - DNA, 15 bp, Homo sapiens
cagctccctggaaag

SEQ ID NO: 431169 - DNA, 21 bp, Homo sapiens
cagctcccttcccctgcctgg

SEQ ID NO: 431170 - DNA, 14 bp, Homo sapiens
cagctcccttctct

SEQ ID NO: 431171 - DNA, 14 bp, Homo sapiens
cagctccgcctggc

SEQ ID NO: 431172 - DNA, 15 bp, Homo sapiens
cagctccgcctggca

SEQ ID NO: 431173 - DNA, 19 bp, Homo sapiens
cagctcctcctcttggagc

SEQ ID NO: 431174 - DNA, 22 bp, Homo sapiens
cagctcctcctcttggagctga

SEQ ID NO: 431175 - DNA, 18 bp, Homo sapiens
cagctcctctccttgggc

SEQ ID NO: 431176 - DNA, 23 bp, Homo sapiens
cagctcctctccttgggctcctg

SEQ ID NO: 431177 - DNA, 18 bp, Homo sapiens
cagctccttggttccctc

SEQ ID NO: 431178 - DNA, 20 bp, Homo sapiens
cagctccttttgtccccagg

SEQ ID NO: 431179 - DNA, 23 bp, Homo sapiens
cagctccttttgtccccagggcc

SEQ ID NO: 431180 - DNA, 21 bp, Homo sapiens
cagctcgtttttcagcacccc

SEQ ID NO: 431181 - DNA, 20 bp, Homo sapiens
cagctctagacaaccctgca

SEQ ID NO: 431182 - DNA, 11 bp, Homo sapiens
cagctctccag

SEQ ID NO: 431183 - DNA, 12 bp, Homo sapiens
cagctctccagt

SEQ ID NO: 431184 - DNA, 16 bp, Homo sapiens
cagctctcccctgcgc

SEQ ID NO: 431185 - DNA, 21 bp, Homo sapiens
cagctctcccctgcgcaggcc

SEQ ID NO: 431186 - DNA, 15 bp, Homo sapiens
cagctctgcccccgc

SEQ ID NO: 431187 - DNA, 23 bp, Homo sapiens
cagctctggctcagggcccacct

SEQ ID NO: 431188 - DNA, 14 bp, Homo sapiens
cagctctgtggcct

SEQ ID NO: 431189 - DNA, 20 bp, Homo sapiens
cagctctgtggcctgtgtcc

SEQ ID NO: 431190 - DNA, 22 bp, Homo sapiens
cagctctgtggcctgtgtccag

SEQ ID NO: 431191 - DNA, 18 bp, Homo sapiens
cagctcttctccccaggt

SEQ ID NO: 431192 - DNA, 15 bp, Homo sapiens
cagctcttctgggca

SEQ ID NO: 431193 - DNA, 19 bp, Homo sapiens
cagctcttctgggcagagc

SEQ ID NO: 431194 - DNA, 13 bp, Homo sapiens
cagctcttgtttg

SEQ ID NO: 431195 - DNA, 16 bp, Homo sapiens
cagctctttcctcctt

SEQ ID NO: 431196 - DNA, 14 bp, Homo sapiens
cagctgaaaacccg

SEQ ID NO: 431197 - DNA, 20 bp, Homo sapiens
cagctgacacataatttgaa

SEQ ID NO: 431198 - DNA, 13 bp, Homo sapiens
cagctgactgtgg

SEQ ID NO: 431199 - DNA, 15 bp, Homo sapiens
cagctgaggccccag

SEQ ID NO: 431200 - DNA, 17 bp, Homo sapiens
cagctgaggccccaggg

SEQ ID NO: 431201 - DNA, 21 bp, Homo sapiens
cagctgattttaacaataact

SEQ ID NO: 431202 - DNA, 16 bp, Homo sapiens
cagctgcacattcctg

SEQ ID NO: 431203 - DNA, 15 bp, Homo sapiens
cagctgcagctgggc

SEQ ID NO: 431204 - DNA, 16 bp, Homo sapiens
cagctgcagctgggcc

SEQ ID NO: 431205 - DNA, 18 bp, Homo sapiens
cagctgcagctgggcccc

SEQ ID NO: 431206 - DNA, 23 bp, Homo sapiens
cagctgcagctgggccccatgct

SEQ ID NO: 431207 - DNA, 14 bp, Homo sapiens
cagctgcaggtgcc

SEQ ID NO: 431208 - DNA, 16 bp, Homo sapiens
cagctgcaggtgccca

SEQ ID NO: 431209 - DNA, 14 bp, Homo sapiens
cagctgccagagaa

SEQ ID NO: 431210 - DNA, 15 bp, Homo sapiens
cagctgccagagaag

SEQ ID NO: 431211 - DNA, 16 bp, Homo sapiens
cagctgccagagaagc

SEQ ID NO: 431212 - DNA, 10 bp, Homo sapiens
cagctgcctt

SEQ ID NO: 431213 - DNA, 16 bp, Homo sapiens
cagctgctcccctccc

SEQ ID NO: 431214 - DNA, 13 bp, Homo sapiens
cagctgctctgcc

SEQ ID NO: 431215 - DNA, 16 bp, Homo sapiens
cagctgctctgcccag

SEQ ID NO: 431216 - DNA, 17 bp, Homo sapiens
cagctgctctgcccaga

SEQ ID NO: 431217 - DNA, 18 bp, Homo sapiens
cagctgctctgcccagag

SEQ ID NO: 431218 - DNA, 19 bp, Homo sapiens
cagctgctctgcccagagc

SEQ ID NO: 431219 - DNA, 20 bp, Homo sapiens
cagctgctctgcccagagct

SEQ ID NO: 431220 - DNA, 16 bp, Homo sapiens
cagctgctctgcccct

SEQ ID NO: 431221 - DNA, 20 bp, Homo sapiens
cagctgctcttagtgcccgc

SEQ ID NO: 431222 - DNA, 14 bp, Homo sapiens
cagctgctggagaa

SEQ ID NO: 431223 - DNA, 22 bp, Homo sapiens
cagctgctggagaataaatttg

SEQ ID NO: 431224 - DNA, 14 bp, Homo sapiens
cagctgctggccag

SEQ ID NO: 431225 - DNA, 15 bp, Homo sapiens
cagctgctggccagg

SEQ ID NO: 431226 - DNA, 16 bp, Homo sapiens
cagctgctggccaggg

SEQ ID NO: 431227 - DNA, 15 bp, Homo sapiens
cagctgctgtgccag

SEQ ID NO: 431228 - DNA, 21 bp, Homo sapiens
cagctggatgagacttccaaa

SEQ ID NO: 431229 - DNA, 17 bp, Homo sapiens
cagctggcagcgcctcc

SEQ ID NO: 431230 - DNA, 23 bp, Homo sapiens
cagctggcagcgcctcccgccgc

SEQ ID NO: 431231 - DNA, 22 bp, Homo sapiens
cagctggcaggagagagccttg

SEQ ID NO: 431232 - DNA, 21 bp, Homo sapiens
cagctggccgggttggaggcc

SEQ ID NO: 431233 - DNA, 16 bp, Homo sapiens
cagctggcggaacctg

SEQ ID NO: 431234 - DNA, 16 bp, Homo sapiens
cagctggctctccacc

SEQ ID NO: 431235 - DNA, 23 bp, Homo sapiens
cagctggctgggtcgcccctcct

SEQ ID NO: 431236 - DNA, 12 bp, Homo sapiens
cagctgggcccc

SEQ ID NO: 431237 - DNA, 19 bp, Homo sapiens
cagctgggccccacctact

SEQ ID NO: 431238 - DNA, 15 bp, Homo sapiens
cagctgggctctgcc

SEQ ID NO: 431239 - DNA, 11 bp, Homo sapiens
cagctgggctg

SEQ ID NO: 431240 - DNA, 20 bp, Homo sapiens
cagctgggctgttggctggg

SEQ ID NO: 431241 - DNA, 17 bp, Homo sapiens
cagctggggagcagctg

SEQ ID NO: 431242 - DNA, 19 bp, Homo sapiens
cagctggggagcagctgag

SEQ ID NO: 431243 - DNA, 20 bp, Homo sapiens
cagctggggagcagctgaga

SEQ ID NO: 431244 - DNA, 14 bp, Homo sapiens
cagctggggcccct

SEQ ID NO: 431245 - DNA, 19 bp, Homo sapiens
cagctggggcccctcggct

SEQ ID NO: 431246 - DNA, 15 bp, Homo sapiens
cagctggtggatggt

SEQ ID NO: 431247 - DNA, 19 bp, Homo sapiens
cagctggtggatggtgact

SEQ ID NO: 431248 - DNA, 20 bp, Homo sapiens
cagctggtgtcactctgcct

SEQ ID NO: 431249 - DNA, 18 bp, Homo sapiens
cagctgtaacacagctga

SEQ ID NO: 431250 - DNA, 19 bp, Homo sapiens
cagctgtaagaagagactg

SEQ ID NO: 431251 - DNA, 22 bp, Homo sapiens
cagctgtaagaagagactggga

SEQ ID NO: 431252 - DNA, 16 bp, Homo sapiens
cagctgtaatctatga

SEQ ID NO: 431253 - DNA, 16 bp, Homo sapiens
caggacgcagggagac

SEQ ID NO: 431254 - DNA, 20 bp, Homo sapiens
caggacgcagggagaccctg

SEQ ID NO: 431255 - DNA, 14 bp, Homo sapiens
caggacgcttctga

SEQ ID NO: 431256 - DNA, 21 bp, Homo sapiens
caggacgcttctgaatgctgc

SEQ ID NO: 431257 - DNA, 22 bp, Homo sapiens
caggacgcttctgaatgctgct

SEQ ID NO: 431258 - DNA, 17 bp, Homo sapiens
caggacgttaggcccgg

SEQ ID NO: 431259 - DNA, 15 bp, Homo sapiens
caggactccctcctc

SEQ ID NO: 431260 - DNA, 19 bp, Homo sapiens
caggactccctcctcacct

SEQ ID NO: 431261 - DNA, 20 bp, Homo sapiens
caggactccctcctcacctc

SEQ ID NO: 431262 - DNA, 21 bp, Homo sapiens
caggactccctcctcacctct

SEQ ID NO: 431263 - DNA, 13 bp, Homo sapiens
caggactctgcct

SEQ ID NO: 431264 - DNA, 15 bp, Homo sapiens
caggactgaggacag

SEQ ID NO: 431265 - DNA, 17 bp, Homo sapiens
caggagaaccactacat

SEQ ID NO: 431266 - DNA, 14 bp, Homo sapiens
caggagaaggcctg

SEQ ID NO: 431267 - DNA, 15 bp, Homo sapiens
caggagaaggcctgc

SEQ ID NO: 431268 - DNA, 19 bp, Homo sapiens
caggagacactggtctcag

SEQ ID NO: 431269 - DNA, 22 bp, Homo sapiens
caggagacactggtctcagagg

SEQ ID NO: 431270 - DNA, 14 bp, Homo sapiens
caggagactgagtt

SEQ ID NO: 431271 - DNA, 22 bp, Homo sapiens
caggagagagagagagaaagaa

SEQ ID NO: 431272 - DNA, 17 bp, Homo sapiens
caggagagagccttggc

SEQ ID NO: 431273 - DNA, 18 bp, Homo sapiens
caggagagagccttggcc

SEQ ID NO: 431274 - DNA, 19 bp, Homo sapiens
caggagagagcttcctgtt

SEQ ID NO: 431275 - DNA, 23 bp, Homo sapiens
caggagagagcttcctgtttcta

SEQ ID NO: 431276 - DNA, 22 bp, Homo sapiens
caggagagcccccaccagcagc

SEQ ID NO: 431277 - DNA, 19 bp, Homo sapiens
caggagagccctctgctgc

SEQ ID NO: 431278 - DNA, 24 bp, Homo sapiens
caggagagtaaaaattcatataaa

SEQ ID NO: 431279 - DNA, 12 bp, Homo sapiens
caggagagtaga

SEQ ID NO: 431280 - DNA, 20 bp, Homo sapiens
caggagcaatgggactggag

SEQ ID NO: 431281 - DNA, 23 bp, Homo sapiens
caggagccaggtgtcctgactgt

SEQ ID NO: 431282 - DNA, 12 bp, Homo sapiens
caggagccccag

SEQ ID NO: 431283 - DNA, 19 bp, Homo sapiens
caggagctagcccagtccc

SEQ ID NO: 431284 - DNA, 23 bp, Homo sapiens
caggagctagcccagtccctgga

SEQ ID NO: 431285 - DNA, 12 bp, Homo sapiens
caggagctcaga

SEQ ID NO: 431286 - DNA, 12 bp, Homo sapiens
caggagctcttc

SEQ ID NO: 431287 - DNA, 15 bp, Homo sapiens
caggagctcttcagg

SEQ ID NO: 431288 - DNA, 22 bp, Homo sapiens
caggagctcttcaggcctccct

SEQ ID NO: 431289 - DNA, 19 bp, Homo sapiens
caggagctgagtcacctcc

SEQ ID NO: 431290 - DNA, 21 bp, Homo sapiens
caggagctgagtcacctcctc

SEQ ID NO: 431291 - DNA, 16 bp, Homo sapiens
caggaggaactggtcc

SEQ ID NO: 431292 - DNA, 17 bp, Homo sapiens
caggaggaactggtcca

SEQ ID NO: 431293 - DNA, 21 bp, Homo sapiens
caggaggaactggtccaggcc

SEQ ID NO: 431294 - DNA, 21 bp, Homo sapiens
caggaggactgccccgtgcag

SEQ ID NO: 431295 - DNA, 14 bp, Homo sapiens
caggaggagacagt

SEQ ID NO: 431296 - DNA, 17 bp, Homo sapiens
caggaggagacagtcag

SEQ ID NO: 431297 - DNA, 21 bp, Homo sapiens
caggaggagacagtcaggaag

SEQ ID NO: 431298 - DNA, 24 bp, Homo sapiens
caggaggagagagatgctgctccc

SEQ ID NO: 431299 - DNA, 22 bp, Homo sapiens
caggaggagggcgcatgtgtgt

SEQ ID NO: 431300 - DNA, 18 bp, Homo sapiens
caggaggcaagcaagctc

SEQ ID NO: 431301 - DNA, 14 bp, Homo sapiens
caggaggcagggtt

SEQ ID NO: 431302 - DNA, 19 bp, Homo sapiens
caggaggcagtggcttgga

SEQ ID NO: 431303 - DNA, 16 bp, Homo sapiens
caggaggcccctggcc

SEQ ID NO: 431304 - DNA, 17 bp, Homo sapiens
caggaggcccctggccc

SEQ ID NO: 431305 - DNA, 19 bp, Homo sapiens
caggaggcccctggcccag

SEQ ID NO: 431306 - DNA, 20 bp, Homo sapiens
caggaggccggggggagcag

SEQ ID NO: 431307 - DNA, 14 bp, Homo sapiens
caggaggcctggga

SEQ ID NO: 431308 - DNA, 15 bp, Homo sapiens
caggaggcctgggag

SEQ ID NO: 431309 - DNA, 21 bp, Homo sapiens
caggaggcggcagctcttctg

SEQ ID NO: 431310 - DNA, 22 bp, Homo sapiens
caggaggcggcagctcttctgg

SEQ ID NO: 431311 - DNA, 20 bp, Homo sapiens
caggaggctggcagtacaga

SEQ ID NO: 431312 - DNA, 24 bp, Homo sapiens
caggaggctggcagtacagagtgc

SEQ ID NO: 431313 - DNA, 19 bp, Homo sapiens
caggaggctttaagctcca

SEQ ID NO: 431314 - DNA, 21 bp, Homo sapiens
caggaggctttaagctccagc

SEQ ID NO: 431315 - DNA, 16 bp, Homo sapiens
caggagggcatcagct

SEQ ID NO: 431316 - DNA, 17 bp, Homo sapiens
caggaggggcctctgaa

SEQ ID NO: 431317 - DNA, 18 bp, Homo sapiens
caggaggggtctgcctcc

SEQ ID NO: 431318 - DNA, 20 bp, Homo sapiens
caggaggggtctgcctccca

SEQ ID NO: 431319 - DNA, 21 bp, Homo sapiens
caggaggggtctgcctcccac

SEQ ID NO: 431320 - DNA, 13 bp, Homo sapiens
caggaggtgcctg

SEQ ID NO: 431321 - DNA, 21 bp, Homo sapiens
caggaggttggtgactgaaac

SEQ ID NO: 431322 - DNA, 23 bp, Homo sapiens
caggagtatcttacctgtaaagt

SEQ ID NO: 431323 - DNA, 15 bp, Homo sapiens
caggagtcctttctt

SEQ ID NO: 431324 - DNA, 16 bp, Homo sapiens
caggagtcctttcttt

SEQ ID NO: 431325 - DNA, 16 bp, Homo sapiens
caggagtctctgccac

SEQ ID NO: 431326 - DNA, 19 bp, Homo sapiens
caggagtctctgccaccca

SEQ ID NO: 431327 - DNA, 21 bp, Homo sapiens
caggagtctctgccacccact

SEQ ID NO: 431328 - DNA, 15 bp, Homo sapiens
caggagtctgtgctc

SEQ ID NO: 431329 - DNA, 23 bp, Homo sapiens
caggagtctttgtaatgcttgta

SEQ ID NO: 431330 - DNA, 21 bp, Homo sapiens
caggagtggcagctgtcccct

SEQ ID NO: 431331 - DNA, 24 bp, Homo sapiens
caggagtgggtgggacacagagac

SEQ ID NO: 431332 - DNA, 21 bp, Homo sapiens
caggagttcgagaccaaccta

SEQ ID NO: 431333 - DNA, 22 bp, Homo sapiens
caggagttggaatgttgtagtt

SEQ ID NO: 431334 - DNA, 20 bp, Homo sapiens
caggagttgtttctgaccca

SEQ ID NO: 431335 - DNA, 24 bp, Homo sapiens
caggagtttgagacaagccctggc

SEQ ID NO: 431336 - DNA, 22 bp, Homo sapiens
caggataaggagactgaggctt

SEQ ID NO: 431337 - DNA, 14 bp, Homo sapiens
caggatacatgtgc

SEQ ID NO: 431338 - DNA, 15 bp, Homo sapiens
caggatagttgctcc

SEQ ID NO: 431339 - DNA, 13 bp, Homo sapiens
caggatcctgcag

SEQ ID NO: 431340 - DNA, 12 bp, Homo sapiens
caggatctgaac

SEQ ID NO: 431341 - DNA, 13 bp, Homo sapiens
caggatctgaact

SEQ ID NO: 431342 - DNA, 14 bp, Homo sapiens
caggatctgaactt

SEQ ID NO: 431343 - DNA, 15 bp, Homo sapiens
caggatgaacccagg

SEQ ID NO: 431344 - DNA, 15 bp, Homo sapiens
caggatggaggggtg

SEQ ID NO: 431345 - DNA, 19 bp, Homo sapiens
caggatggcgtgtcccctg

SEQ ID NO: 431346 - DNA, 17 bp, Homo sapiens
caggatggttactgagg

SEQ ID NO: 431347 - DNA, 18 bp, Homo sapiens
caggatggttactgagga

SEQ ID NO: 431348 - DNA, 21 bp, Homo sapiens
caggatggttactgaggacca

SEQ ID NO: 431349 - DNA, 19 bp, Homo sapiens
caggattgtacgtgggaga

SEQ ID NO: 431350 - DNA, 15 bp, Homo sapiens
caggatttaaaaact

SEQ ID NO: 431351 - DNA, 19 bp, Homo sapiens
caggatttaaaaactggaa

SEQ ID NO: 431352 - DNA, 12 bp, Homo sapiens
caggatttggtt

SEQ ID NO: 431353 - DNA, 14 bp, Homo sapiens
caggatttggtttt

SEQ ID NO: 431354 - DNA, 14 bp, Homo sapiens
caggattttgtatt

SEQ ID NO: 431355 - DNA, 17 bp, Homo sapiens
caggattttgtgttttt

SEQ ID NO: 431356 - DNA, 19 bp, Homo sapiens
caggcaaaaaagggacagc

SEQ ID NO: 431357 - DNA, 17 bp, Homo sapiens
caggcaaaacacgcaag

SEQ ID NO: 431358 - DNA, 20 bp, Homo sapiens
caggcaaaacacgcaagggc

SEQ ID NO: 431359 - DNA, 16 bp, Homo sapiens
caggcaaagaggtgct

SEQ ID NO: 431360 - DNA, 19 bp, Homo sapiens
caggcaaagaggtgctgct

SEQ ID NO: 431361 - DNA, 23 bp, Homo sapiens
caggcaacgtgcgtgtctctgcc

SEQ ID NO: 431362 - DNA, 20 bp, Homo sapiens
caggcaacttcagtcctggg

SEQ ID NO: 431363 - DNA, 13 bp, Homo sapiens
caggcaagcatgt

SEQ ID NO: 431364 - DNA, 21 bp, Homo sapiens
caggcaagcccctcagccctt

SEQ ID NO: 431365 - DNA, 23 bp, Homo sapiens
caggcaagcccctcagcccttgc

SEQ ID NO: 431366 - DNA, 19 bp, Homo sapiens
caggcaaggcagctcccag

SEQ ID NO: 431367 - DNA, 18 bp, Homo sapiens
caggcaccagcagcagaa

SEQ ID NO: 431368 - DNA, 16 bp, Homo sapiens
caggcaccgagaatgt

SEQ ID NO: 431369 - DNA, 18 bp, Homo sapiens
caggcactgccttctcct

SEQ ID NO: 431370 - DNA, 23 bp, Homo sapiens
caggcactgctgcccagcctcca

SEQ ID NO: 431371 - DNA, 14 bp, Homo sapiens
caggcactggtggc

SEQ ID NO: 431372 - DNA, 24 bp, Homo sapiens
caggcagaaaactggcagtgcacc

SEQ ID NO: 431373 - DNA, 16 bp, Homo sapiens
caggcagacacatgct

SEQ ID NO: 431374 - DNA, 22 bp, Homo sapiens
caggcagaggatgttctggacc

SEQ ID NO: 431375 - DNA, 15 bp, Homo sapiens
caggcagatctgtgc

SEQ ID NO: 431376 - DNA, 19 bp, Homo sapiens
caggcagcacctggagccc

SEQ ID NO: 431377 - DNA, 18 bp, Homo sapiens
caggcagctggatgagac

SEQ ID NO: 431378 - DNA, 18 bp, Homo sapiens
caggcaggaagggcagga

SEQ ID NO: 431379 - DNA, 19 bp, Homo sapiens
caggcaggaagggcaggaa

SEQ ID NO: 431380 - DNA, 12 bp, Homo sapiens
caggcaggctgt

SEQ ID NO: 431381 - DNA, 22 bp, Homo sapiens
caggctgcagcaggcagaggag

SEQ ID NO: 431382 - DNA, 15 bp, Homo sapiens
caggctgccccaccc

SEQ ID NO: 431383 - DNA, 18 bp, Homo sapiens
caggctgccccacccctc

SEQ ID NO: 431384 - DNA, 23 bp, Homo sapiens
caggctgcgcctgcccgcccgcc

SEQ ID NO: 431385 - DNA, 20 bp, Homo sapiens
caggctgcggtgggcagcca

SEQ ID NO: 431386 - DNA, 20 bp, Homo sapiens
caggctggaggtaaggcctt

SEQ ID NO: 431387 - DNA, 17 bp, Homo sapiens
caggctggcagctctcc

SEQ ID NO: 431388 - DNA, 11 bp, Homo sapiens
caggctggggc

SEQ ID NO: 431389 - DNA, 17 bp, Homo sapiens
caggctggggcctggcc

SEQ ID NO: 431390 - DNA, 18 bp, Homo sapiens
caggctggggcctggcct

SEQ ID NO: 431391 - DNA, 23 bp, Homo sapiens
caggctggtcttgaactcctgac

SEQ ID NO: 431392 - DNA, 16 bp, Homo sapiens
caggctgtcagcgcct

SEQ ID NO: 431393 - DNA, 15 bp, Homo sapiens
caggcttcaccctga

SEQ ID NO: 431394 - DNA, 22 bp, Homo sapiens
caggcttcaccctgaatggttc

SEQ ID NO: 431395 - DNA, 21 bp, Homo sapiens
caggcttcctgcaattttcta

SEQ ID NO: 431396 - DNA, 22 bp, Homo sapiens
caggcttcctgcaattttctaa

SEQ ID NO: 431397 - DNA, 20 bp, Homo sapiens
caggcttctcttgctacctg

SEQ ID NO: 431398 - DNA, 21 bp, Homo sapiens
caggcttggaatgaattctct

SEQ ID NO: 431399 - DNA, 21 bp, Homo sapiens
caggcttgggctccattccca

SEQ ID NO: 431400 - DNA, 15 bp, Homo sapiens
cagggaactgcttgc

SEQ ID NO: 431401 - DNA, 14 bp, Homo sapiens
cagggaagaggcca

SEQ ID NO: 431402 - DNA, 12 bp, Homo sapiens
cagggaagaggg

SEQ ID NO: 431403 - DNA, 16 bp, Homo sapiens
cagggaagagggcagt

SEQ ID NO: 431404 - DNA, 17 bp, Homo sapiens
cagggaagagggcagta

SEQ ID NO: 431405 - DNA, 20 bp, Homo sapiens
cagggaagagggcagtacct

SEQ ID NO: 431406 - DNA, 14 bp, Homo sapiens
cagggaagctggcc

SEQ ID NO: 431407 - DNA, 19 bp, Homo sapiens
cagggaaggacttggagag

SEQ ID NO: 431408 - DNA, 12 bp, Homo sapiens
cagggaatccag

SEQ ID NO: 431409 - DNA, 17 bp, Homo sapiens
cagggaatccagctccc

SEQ ID NO: 431410 - DNA, 14 bp, Homo sapiens
cagggaatttctat

SEQ ID NO: 431411 - DNA, 15 bp, Homo sapiens
cagggacacgggcag

SEQ ID NO: 431412 - DNA, 15 bp, Homo sapiens
cagggacagcagcct

SEQ ID NO: 431413 - DNA, 23 bp, Homo sapiens
cagggacccacatccaaacatgt

SEQ ID NO: 431414 - DNA, 18 bp, Homo sapiens
cagggactgtacctgtag

SEQ ID NO: 431415 - DNA, 20 bp, Homo sapiens
cagggactgtacctgtagga

SEQ ID NO: 431416 - DNA, 23 bp, Homo sapiens
cagggactgtacctgtaggaaac

SEQ ID NO: 431417 - DNA, 20 bp, Homo sapiens
cagggagagttggggaaggc

SEQ ID NO: 431418 - DNA, 22 bp, Homo sapiens
cagggagagttggggaaggcaa

SEQ ID NO: 431419 - DNA, 17 bp, Homo sapiens
cagggagcaactctcca

SEQ ID NO: 431420 - DNA, 16 bp, Homo sapiens
cagggagcaagacaga

SEQ ID NO: 431421 - DNA, 19 bp, Homo sapiens
cagggagcaagacagagac

SEQ ID NO: 431422 - DNA, 13 bp, Homo sapiens
cagggagcccggg

SEQ ID NO: 431423 - DNA, 15 bp, Homo sapiens
cagggagcccggggc

SEQ ID NO: 431424 - DNA, 13 bp, Homo sapiens
cagggagccctgg

SEQ ID NO: 431425 - DNA, 15 bp, Homo sapiens
cagggagccctgggg

SEQ ID NO: 431426 - DNA, 22 bp, Homo sapiens
cagggaggcaccattcaggaac

SEQ ID NO: 431427 - DNA, 20 bp, Homo sapiens
cagggagggaaacccgggga

SEQ ID NO: 431428 - DNA, 12 bp, Homo sapiens
cagggagggaac

SEQ ID NO: 431429 - DNA, 19 bp, Homo sapiens
cagggagggaacagacctc

SEQ ID NO: 431430 - DNA, 13 bp, Homo sapiens
cagggaggggagg

SEQ ID NO: 431431 - DNA, 18 bp, Homo sapiens
cagggaggggaggcagat

SEQ ID NO: 431432 - DNA, 15 bp, Homo sapiens
cagggaggggctgag

SEQ ID NO: 431433 - DNA, 23 bp, Homo sapiens
cagggagtcccctccccggccct

SEQ ID NO: 431434 - DNA, 18 bp, Homo sapiens
cagggagtgtctgcagtc

SEQ ID NO: 431435 - DNA, 18 bp, Homo sapiens
cagggataccttaattct

SEQ ID NO: 431436 - DNA, 23 bp, Homo sapiens
cagggatgccaacaccttcttgg

SEQ ID NO: 431437 - DNA, 18 bp, Homo sapiens
cagggatggggccacagc

SEQ ID NO: 431438 - DNA, 17 bp, Homo sapiens
cagggattaacctctgc

SEQ ID NO: 431439 - DNA, 11 bp, Homo sapiens
cagggcactgc

SEQ ID NO: 431440 - DNA, 14 bp, Homo sapiens
cagggcagcagccg

SEQ ID NO: 431441 - DNA, 18 bp, Homo sapiens
cagggcagcctgtgggag

SEQ ID NO: 431442 - DNA, 11 bp, Homo sapiens
cagggcagggc

SEQ ID NO: 431443 - DNA, 19 bp, Homo sapiens
cagggcagggcggctaggc

SEQ ID NO: 431444 - DNA, 15 bp, Homo sapiens
cagggcagggctctg

SEQ ID NO: 431445 - DNA, 19 bp, Homo sapiens
cagggcagggctctgatat

SEQ ID NO: 431446 - DNA, 22 bp, Homo sapiens
cagggcagtgctagtgagctgg

SEQ ID NO: 431447 - DNA, 22 bp, Homo sapiens
cagggcagtgtggtgggagggg

SEQ ID NO: 431448 - DNA, 23 bp, Homo sapiens
cagggcagtgtggtgggaggggt

SEQ ID NO: 431449 - DNA, 17 bp, Homo sapiens
cagggcatctccaggaa

SEQ ID NO: 431450 - DNA, 21 bp, Homo sapiens
cagggcatctccaggaaggcg

SEQ ID NO: 431451 - DNA, 20 bp, Homo sapiens
cagggcatggccaggtggcc

SEQ ID NO: 431452 - DNA, 12 bp, Homo sapiens
cagggccagggt

SEQ ID NO: 431453 - DNA, 14 bp, Homo sapiens
cagggccagggttg

SEQ ID NO: 431454 - DNA, 14 bp, Homo sapiens
cagggcccacctcc

SEQ ID NO: 431455 - DNA, 12 bp, Homo sapiens
cagggcccagag

SEQ ID NO: 431456 - DNA, 16 bp, Homo sapiens
cagggcccagaggctg

SEQ ID NO: 431457 - DNA, 17 bp, Homo sapiens
cagggcccagaggctga

SEQ ID NO: 431458 - DNA, 14 bp, Homo sapiens
cagggcccaggcct

SEQ ID NO: 431459 - DNA, 16 bp, Homo sapiens
cagggcccaggcctgg

SEQ ID NO: 431460 - DNA, 18 bp, Homo sapiens
cagggcccccggccacgc

SEQ ID NO: 431461 - DNA, 21 bp, Homo sapiens
cagggcccccggccacgctcc

SEQ ID NO: 431462 - DNA, 22 bp, Homo sapiens
cagggcccctcaccctgcctta

SEQ ID NO: 431463 - DNA, 20 bp, Homo sapiens
cagggcccctccctctgccc

SEQ ID NO: 431464 - DNA, 15 bp, Homo sapiens
cagggcccggcacag

SEQ ID NO: 431465 - DNA, 17 bp, Homo sapiens
cagggcccggcacagag

SEQ ID NO: 431466 - DNA, 14 bp, Homo sapiens
cagggccctcagag

SEQ ID NO: 431467 - DNA, 15 bp, Homo sapiens
cagggccctcagagg

SEQ ID NO: 431468 - DNA, 13 bp, Homo sapiens
cagggccctgctc

SEQ ID NO: 431469 - DNA, 14 bp, Homo sapiens
cagggccctgctca

SEQ ID NO: 431470 - DNA, 21 bp, Homo sapiens
cagggccctgctcaggcctca

SEQ ID NO: 431471 - DNA, 17 bp, Homo sapiens
cagggccctggggtctc

SEQ ID NO: 431472 - DNA, 14 bp, Homo sapiens
cagggccgcagggc

SEQ ID NO: 431473 - DNA, 15 bp, Homo sapiens
cagggccgcagggcg

SEQ ID NO: 431474 - DNA, 17 bp, Homo sapiens
cagggccgcagggcgct

SEQ ID NO: 431475 - DNA, 18 bp, Homo sapiens
cagggccgcagggcgctc

SEQ ID NO: 431476 - DNA, 19 bp, Homo sapiens
cagggccgcagggcgctcc

SEQ ID NO: 431477 - DNA, 20 bp, Homo sapiens
cagggccgcagggcgctccg

SEQ ID NO: 431478 - DNA, 22 bp, Homo sapiens
cagggccgcccgggcccagagg

SEQ ID NO: 431479 - DNA, 16 bp, Homo sapiens
cagggccgctcgatgc

SEQ ID NO: 431480 - DNA, 22 bp, Homo sapiens
cagggccgctcgatgcctttgc

SEQ ID NO: 431481 - DNA, 21 bp, Homo sapiens
cagggcctactgccacccgct

SEQ ID NO: 431482 - DNA, 23 bp, Homo sapiens
cagggcctccagccctctcactg

SEQ ID NO: 431483 - DNA, 20 bp, Homo sapiens
cagggcctgacttttacagc

SEQ ID NO: 431484 - DNA, 16 bp, Homo sapiens
cagggcctgggggcag

SEQ ID NO: 431485 - DNA, 20 bp, Homo sapiens
cagggcctgggggcagtgac

SEQ ID NO: 431486 - DNA, 15 bp, Homo sapiens
cagggccttgacaag

SEQ ID NO: 431487 - DNA, 19 bp, Homo sapiens
cagggccttggcccagggg

SEQ ID NO: 431488 - DNA, 13 bp, Homo sapiens
cagggcgagactc

SEQ ID NO: 431489 - DNA, 15 bp, Homo sapiens
cagggcgctccggca

SEQ ID NO: 431490 - DNA, 18 bp, Homo sapiens
cagggcgctccggcagag

SEQ ID NO: 431491 - DNA, 19 bp, Homo sapiens
cagggcgctccggcagagg

SEQ ID NO: 431492 - DNA, 13 bp, Homo sapiens
cagggcgggccag

SEQ ID NO: 431493 - DNA, 17 bp, Homo sapiens
cagggcgggccaggaga

SEQ ID NO: 431494 - DNA, 14 bp, Homo sapiens
cagggctagtgact

SEQ ID NO: 431495 - DNA, 15 bp, Homo sapiens
cagggctagtgactt

SEQ ID NO: 431496 - DNA, 18 bp, Homo sapiens
cagggctagtgacttgtg

SEQ ID NO: 431497 - DNA, 12 bp, Homo sapiens
cagggctcagct

SEQ ID NO: 431498 - DNA, 22 bp, Homo sapiens
cagggctccacgggggcctagt

SEQ ID NO: 431499 - DNA, 13 bp, Homo sapiens
cagggctcccgga

SEQ ID NO: 431500 - DNA, 14 bp, Homo sapiens
cagggctccctcct

SEQ ID NO: 431501 - DNA, 21 bp, Homo sapiens
cagggctccctcctggagcat

SEQ ID NO: 431502 - DNA, 19 bp, Homo sapiens
cagggctctggcaggtggc

SEQ ID NO: 431503 - DNA, 12 bp, Homo sapiens
cagggctgcccc

SEQ ID NO: 431504 - DNA, 21 bp, Homo sapiens
cagggctgggctctgtcttcc

SEQ ID NO: 431505 - DNA, 23 bp, Homo sapiens
cagggctgggctctgtcttcctg

SEQ ID NO: 431506 - DNA, 16 bp, Homo sapiens
cagggctgtccttaga

SEQ ID NO: 431507 - DNA, 16 bp, Homo sapiens
caggggaaaatgaagg

SEQ ID NO: 431508 - DNA, 19 bp, Homo sapiens
caggggaaggaaataacat

SEQ ID NO: 431509 - DNA, 22 bp, Homo sapiens
caggggacactgaaccttgttg

SEQ ID NO: 431510 - DNA, 15 bp, Homo sapiens
caggggactcagccc

SEQ ID NO: 431511 - DNA, 16 bp, Homo sapiens
cagtaccatcccactg

SEQ ID NO: 431512 - DNA, 14 bp, Homo sapiens
cagtaccatctgaa

SEQ ID NO: 431513 - DNA, 17 bp, Homo sapiens
cagtacccacctgagct

SEQ ID NO: 431514 - DNA, 19 bp, Homo sapiens
cagtacccacctgagcttt

SEQ ID NO: 431515 - DNA, 20 bp, Homo sapiens
cagtacctataaagtaaagc

SEQ ID NO: 431516 - DNA, 16 bp, Homo sapiens
cagtacctccaagcaa

SEQ ID NO: 431517 - DNA, 14 bp, Homo sapiens
cagtacctgggaaa

SEQ ID NO: 431518 - DNA, 21 bp, Homo sapiens
cagtacttgagggaccaatat

SEQ ID NO: 431519 - DNA, 14 bp, Homo sapiens
cagtacttgctcaa

SEQ ID NO: 431520 - DNA, 19 bp, Homo sapiens
cagtacttgctcaataaag

SEQ ID NO: 431521 - DNA, 18 bp, Homo sapiens
cagtagaaataatatgca

SEQ ID NO: 431522 - DNA, 21 bp, Homo sapiens
cagtagacctgattttcaaaa

SEQ ID NO: 431523 - DNA, 16 bp, Homo sapiens
cagtagagtcatctcc

SEQ ID NO: 431524 - DNA, 17 bp, Homo sapiens
cagtagatgtgcttctg

SEQ ID NO: 431525 - DNA, 18 bp, Homo sapiens
cagtagatgtgcttctga

SEQ ID NO: 431526 - DNA, 16 bp, Homo sapiens
cagtagcagctgtgtt

SEQ ID NO: 431527 - DNA, 22 bp, Homo sapiens
cagtagctgtggggagctggtg

SEQ ID NO: 431528 - DNA, 23 bp, Homo sapiens
cagtagctgtggggagctggtgg

SEQ ID NO: 431529 - DNA, 12 bp, Homo sapiens
cagtaggagagg

SEQ ID NO: 431530 - DNA, 15 bp, Homo sapiens
cagtagtgcctgtga

SEQ ID NO: 431531 - DNA, 18 bp, Homo sapiens
cagtagtgcctgtgatcg

SEQ ID NO: 431532 - DNA, 13 bp, Homo sapiens
cagtataaaatta

SEQ ID NO: 431533 - DNA, 12 bp, Homo sapiens
cagtatataagc

SEQ ID NO: 431534 - DNA, 14 bp, Homo sapiens
cagtatcaaggctg

SEQ ID NO: 431535 - DNA, 17 bp, Homo sapiens
cagtatcaaggctgcct

SEQ ID NO: 431536 - DNA, 18 bp, Homo sapiens
cagtatcaaggctgcctg

SEQ ID NO: 431537 - DNA, 20 bp, Homo sapiens
cagtatcaaggctgcctgga

SEQ ID NO: 431538 - DNA, 22 bp, Homo sapiens
cagtatcactgtctttcctaga

SEQ ID NO: 431539 - DNA, 14 bp, Homo sapiens
cagtatcaggcctg

SEQ ID NO: 431540 - DNA, 17 bp, Homo sapiens
cagtatcaggcctgcca

SEQ ID NO: 431541 - DNA, 24 bp, Homo sapiens
cagtatcaggcctgccagacggca

SEQ ID NO: 431542 - DNA, 15 bp, Homo sapiens
cagtatgaagacact

SEQ ID NO: 431543 - DNA, 15 bp, Homo sapiens
cagtatgaatgatgt

SEQ ID NO: 431544 - DNA, 21 bp, Homo sapiens
cagtatgaatgatgttttaga

SEQ ID NO: 431545 - DNA, 21 bp, Homo sapiens
cagtatgagtcaatgtgcagt

SEQ ID NO: 431546 - DNA, 17 bp, Homo sapiens
cagtatgtattcttttg

SEQ ID NO: 431547 - DNA, 22 bp, Homo sapiens
cagtatgtgtctagcaaagcca

SEQ ID NO: 431548 - DNA, 19 bp, Homo sapiens
cagtattaaactctccttt

SEQ ID NO: 431549 - DNA, 21 bp, Homo sapiens
cagtattaaaggggggagggg

SEQ ID NO: 431550 - DNA, 21 bp, Homo sapiens
cagtattatagatataaatat

SEQ ID NO: 431551 - DNA, 20 bp, Homo sapiens
cagtattccctttttaaatg

SEQ ID NO: 431552 - DNA, 23 bp, Homo sapiens
cagtattccctttttaaatgagc

SEQ ID NO: 431553 - DNA, 17 bp, Homo sapiens
cagtattgaaaacttca

SEQ ID NO: 431554 - DNA, 19 bp, Homo sapiens
cagtattgaaaacttcaaa

SEQ ID NO: 431555 - DNA, 23 bp, Homo sapiens
cagtattgaaaacttcaaagctg

SEQ ID NO: 431556 - DNA, 13 bp, Homo sapiens
cagtattgagaca

SEQ ID NO: 431557 - DNA, 17 bp, Homo sapiens
cagtattgagacactgt

SEQ ID NO: 431558 - DNA, 14 bp, Homo sapiens
cagtattgtgtaaa

SEQ ID NO: 431559 - DNA, 15 bp, Homo sapiens
cagtattgtgtaaag

SEQ ID NO: 431560 - DNA, 23 bp, Homo sapiens
cagtattgttcttgtaaaactgt

SEQ ID NO: 431561 - DNA, 17 bp, Homo sapiens
cagtattttggagaaat

SEQ ID NO: 431562 - DNA, 15 bp, Homo sapiens
cagtcaacatttaca

SEQ ID NO: 431563 - DNA, 23 bp, Homo sapiens
cagtcaagttccgtctcctctcc

SEQ ID NO: 431564 - DNA, 16 bp, Homo sapiens
cagtcacactgctggg

SEQ ID NO: 431565 - DNA, 19 bp, Homo sapiens
cagtcacactgctgggaag

SEQ ID NO: 431566 - DNA, 12 bp, Homo sapiens
cagtcacagcca

SEQ ID NO: 431567 - DNA, 17 bp, Homo sapiens
cagtcacagccatttca

SEQ ID NO: 431568 - DNA, 17 bp, Homo sapiens
cagtcactgaattccat

SEQ ID NO: 431569 - DNA, 23 bp, Homo sapiens
cagtcagatttccagtctccacc

SEQ ID NO: 431570 - DNA, 15 bp, Homo sapiens
cagtcagccagcttg

SEQ ID NO: 431571 - DNA, 16 bp, Homo sapiens
cagtcagccagcttgg

SEQ ID NO: 431572 - DNA, 21 bp, Homo sapiens
cagtcaggaagcctcctgctg

SEQ ID NO: 431573 - DNA, 13 bp, Homo sapiens
cagtcagggacag

SEQ ID NO: 431574 - DNA, 16 bp, Homo sapiens
cagtcagggacagcag

SEQ ID NO: 431575 - DNA, 17 bp, Homo sapiens
cagtcagggacagcagc

SEQ ID NO: 431576 - DNA, 19 bp, Homo sapiens
cagtcagggacagcagcct

SEQ ID NO: 431577 - DNA, 20 bp, Homo sapiens
cagtcagttcccggagcaca

SEQ ID NO: 431578 - DNA, 15 bp, Homo sapiens
cagtcataactaaat

SEQ ID NO: 431579 - DNA, 12 bp, Homo sapiens
cagtcatgcact

SEQ ID NO: 431580 - DNA, 13 bp, Homo sapiens
cagtcattatgag

SEQ ID NO: 431581 - DNA, 21 bp, Homo sapiens
cagtccaaatgtcctccagaa

SEQ ID NO: 431582 - DNA, 22 bp, Homo sapiens
cagtccaaatgtcctccagaag

SEQ ID NO: 431583 - DNA, 20 bp, Homo sapiens
cagtccacccccattgtgaa

SEQ ID NO: 431584 - DNA, 18 bp, Homo sapiens
cagtccacctgagctgcc

SEQ ID NO: 431585 - DNA, 20 bp, Homo sapiens
cagtccacctgagctgccat

SEQ ID NO: 431586 - DNA, 15 bp, Homo sapiens
cagtccactggggag

SEQ ID NO: 431587 - DNA, 11 bp, Homo sapiens
cagtccagagc

SEQ ID NO: 431588 - DNA, 20 bp, Homo sapiens
cagtccagtcaagaaaagaa

SEQ ID NO: 431589 - DNA, 14 bp, Homo sapiens
cagtccccagccct

SEQ ID NO: 431590 - DNA, 15 bp, Homo sapiens
cagtccccagccctt

SEQ ID NO: 431591 - DNA, 17 bp, Homo sapiens
cagtccccagcccttct

SEQ ID NO: 431592 - DNA, 19 bp, Homo sapiens
cagtccccctatccttggc

SEQ ID NO: 431593 - DNA, 16 bp, Homo sapiens
cagtccccctgcccca

SEQ ID NO: 431594 - DNA, 23 bp, Homo sapiens
cagtccccgtgaaggagagccct

SEQ ID NO: 431595 - DNA, 18 bp, Homo sapiens
cagtccccgtgccccgcc

SEQ ID NO: 431596 - DNA, 17 bp, Homo sapiens
cagtccctacttaggaa

SEQ ID NO: 431597 - DNA, 16 bp, Homo sapiens
cagtccctccctcctg

SEQ ID NO: 431598 - DNA, 20 bp, Homo sapiens
cagtcctcacagcctctccc

SEQ ID NO: 431599 - DNA, 21 bp, Homo sapiens
cagtcctccagaccaccagcc

SEQ ID NO: 431600 - DNA, 21 bp, Homo sapiens
cagtcctctcccaagtccaca

SEQ ID NO: 431601 - DNA, 19 bp, Homo sapiens
cagtcctgcctcagcctcc

SEQ ID NO: 431602 - DNA, 18 bp, Homo sapiens
cagtcctgcctggccagg

SEQ ID NO: 431603 - DNA, 12 bp, Homo sapiens
cagtcctgggag

SEQ ID NO: 431604 - DNA, 13 bp, Homo sapiens
cagtcctggtggg

SEQ ID NO: 431605 - DNA, 22 bp, Homo sapiens
cagtcctggtggggctgagcct

SEQ ID NO: 431606 - DNA, 19 bp, Homo sapiens
cagtcctggttcagtggga

SEQ ID NO: 431607 - DNA, 20 bp, Homo sapiens
cagtcgcaggatccgctgcc

SEQ ID NO: 431608 - DNA, 23 bp, Homo sapiens
cagtcgcaggatccgctgccacc

SEQ ID NO: 431609 - DNA, 14 bp, Homo sapiens
cagtcgccctctgt

SEQ ID NO: 431610 - DNA, 22 bp, Homo sapiens
cagtcgccctctgtgcctaata

SEQ ID NO: 431611 - DNA, 15 bp, Homo sapiens
cagtctacttctgtg

SEQ ID NO: 431612 - DNA, 23 bp, Homo sapiens
cagtctcaaaaatacaaaataaa

SEQ ID NO: 431613 - DNA, 19 bp, Homo sapiens
cagtctcaagcactaaaaa

SEQ ID NO: 431614 - DNA, 13 bp, Homo sapiens
cagtctcaatttt

SEQ ID NO: 431615 - DNA, 16 bp, Homo sapiens
cagtctcaattttgta

SEQ ID NO: 431616 - DNA, 14 bp, Homo sapiens
cagtctcacccact

SEQ ID NO: 431617 - DNA, 20 bp, Homo sapiens
cagtctcccaggccccctgc

SEQ ID NO: 431618 - DNA, 22 bp, Homo sapiens
cagtctccctttcccttcttgg

SEQ ID NO: 431619 - DNA, 16 bp, Homo sapiens
cagtctctgcagtgtc

SEQ ID NO: 431620 - DNA, 15 bp, Homo sapiens
cagtctgctgccctc

SEQ ID NO: 431621 - DNA, 18 bp, Homo sapiens
cagtctgctgccctccat

SEQ ID NO: 431622 - DNA, 22 bp, Homo sapiens
cagtctgctgccctccatcccg

SEQ ID NO: 431623 - DNA, 12 bp, Homo sapiens
cagtctggaggg

SEQ ID NO: 431624 - DNA, 21 bp, Homo sapiens
cagtctggaggggcatggcca

SEQ ID NO: 431625 - DNA, 20 bp, Homo sapiens
cagtctggccaatatggaga

SEQ ID NO: 431626 - DNA, 23 bp, Homo sapiens
cagtcttccctagggctgggtgt

SEQ ID NO: 431627 - DNA, 22 bp, Homo sapiens
cagtcttctaccaaatgtgtaa

SEQ ID NO: 431628 - DNA, 13 bp, Homo sapiens
cagtcttctccct

SEQ ID NO: 431629 - DNA, 15 bp, Homo sapiens
cagtcttgagtgggc

SEQ ID NO: 431630 - DNA, 16 bp, Homo sapiens
cagtcttgcctaggcc

SEQ ID NO: 431631 - DNA, 17 bp, Homo sapiens
cagtcttgcctaggcca

SEQ ID NO: 431632 - DNA, 16 bp, Homo sapiens
cagtcttggctcactg

SEQ ID NO: 431633 - DNA, 22 bp, Homo sapiens
cagtgaaaaatatgttgagtgt

SEQ ID NO: 431634 - DNA, 13 bp, Homo sapiens
cagtgaacagctt

SEQ ID NO: 431635 - DNA, 21 bp, Homo sapiens
cagtgaactaatttggttttt

SEQ ID NO: 431636 - DNA, 20 bp, Homo sapiens
cagtgaacttacacttggag

SEQ ID NO: 431637 - DNA, 22 bp, Homo sapiens
cagtgaaggagccacgtgaatg

SEQ ID NO: 431638 - DNA, 17 bp, Homo sapiens
cagtgaatataaatgta

SEQ ID NO: 431639 - DNA, 16 bp, Homo sapiens
cagtgacacttcagag

SEQ ID NO: 431640 - DNA, 13 bp, Homo sapiens
cagttatgaatca

SEQ ID NO: 431641 - DNA, 20 bp, Homo sapiens
cagttatgtgaatgatctct

SEQ ID NO: 431642 - DNA, 13 bp, Homo sapiens
cagttcacaccct

SEQ ID NO: 431643 - DNA, 16 bp, Homo sapiens
cagttcacaccctgca

SEQ ID NO: 431644 - DNA, 17 bp, Homo sapiens
cagttcacaccctgcaa

SEQ ID NO: 431645 - DNA, 18 bp, Homo sapiens
cagttcacaccctgcaag

SEQ ID NO: 431646 - DNA, 17 bp, Homo sapiens
cagttcagcaccaccct

SEQ ID NO: 431647 - DNA, 18 bp, Homo sapiens
cagttcaggaatttttgt

SEQ ID NO: 431648 - DNA, 17 bp, Homo sapiens
cagttcatctctgctga

SEQ ID NO: 431649 - DNA, 18 bp, Homo sapiens
cagttcatctctgctgaa

SEQ ID NO: 431650 - DNA, 23 bp, Homo sapiens
cagttcatctctgctgaacattt

SEQ ID NO: 431651 - DNA, 16 bp, Homo sapiens
cagttccaatgtgccc

SEQ ID NO: 431652 - DNA, 21 bp, Homo sapiens
cagttccaatgtgcccagtca

SEQ ID NO: 431653 - DNA, 15 bp, Homo sapiens
cagttcccccagtac

SEQ ID NO: 431654 - DNA, 18 bp, Homo sapiens
cagttcccccagtacctc

SEQ ID NO: 431655 - DNA, 17 bp, Homo sapiens
cagttcccggagcacag

SEQ ID NO: 431656 - DNA, 20 bp, Homo sapiens
cagttcccggagcacagccc

SEQ ID NO: 431657 - DNA, 14 bp, Homo sapiens
cagttcccttggcc

SEQ ID NO: 431658 - DNA, 16 bp, Homo sapiens
cagttcccttggcctc

SEQ ID NO: 431659 - DNA, 17 bp, Homo sapiens
cagttcctctttgcatg

SEQ ID NO: 431660 - DNA, 18 bp, Homo sapiens
cagttcctctttgcatgg

SEQ ID NO: 431661 - DNA, 14 bp, Homo sapiens
cagttctcactcct

SEQ ID NO: 431662 - DNA, 20 bp, Homo sapiens
cagttctcactcctaggaga

SEQ ID NO: 431663 - DNA, 18 bp, Homo sapiens
cagttctctcccttcctc

SEQ ID NO: 431664 - DNA, 20 bp, Homo sapiens
cagttctgaataacttgaag

SEQ ID NO: 431665 - DNA, 20 bp, Homo sapiens
cagttctgcaaatagaaaac

SEQ ID NO: 431666 - DNA, 24 bp, Homo sapiens
cagttcttcgggaagagaggagtt

SEQ ID NO: 431667 - DNA, 18 bp, Homo sapiens
cagttcttggacccctga

SEQ ID NO: 431668 - DNA, 21 bp, Homo sapiens
cagttctttataacaaaacag

SEQ ID NO: 431669 - DNA, 22 bp, Homo sapiens
cagttgagtttcttctaaagag

SEQ ID NO: 431670 - DNA, 13 bp, Homo sapiens
cagttgcacttgg

SEQ ID NO: 431671 - DNA, 20 bp, Homo sapiens
cagttgccatgtagacccct

SEQ ID NO: 431672 - DNA, 17 bp, Homo sapiens
cagttgcgcgttctgaa

SEQ ID NO: 431673 - DNA, 20 bp, Homo sapiens
cagttgctagcaacaactta

SEQ ID NO: 431674 - DNA, 19 bp, Homo sapiens
cagttggacagtaagattt

SEQ ID NO: 431675 - DNA, 16 bp, Homo sapiens
cagttggactctcagg

SEQ ID NO: 431676 - DNA, 13 bp, Homo sapiens
cagttggcagaga

SEQ ID NO: 431677 - DNA, 15 bp, Homo sapiens
cagttggcagagaag

SEQ ID NO: 431678 - DNA, 20 bp, Homo sapiens
cagttggcagagaaggcctc

SEQ ID NO: 431679 - DNA, 21 bp, Homo sapiens
cagttggcagagaaggcctct

SEQ ID NO: 431680 - DNA, 17 bp, Homo sapiens
cagttgggtgagaacaa

SEQ ID NO: 431681 - DNA, 17 bp, Homo sapiens
cagttggtgattttaga

SEQ ID NO: 431682 - DNA, 17 bp, Homo sapiens
cagttgtaccactgcta

SEQ ID NO: 431683 - DNA, 18 bp, Homo sapiens
cagttgtcccgattgtaa

SEQ ID NO: 431684 - DNA, 21 bp, Homo sapiens
cagttgtcccgattgtaactc

SEQ ID NO: 431685 - DNA, 22 bp, Homo sapiens
cagttgtctattctgagccttg

SEQ ID NO: 431686 - DNA, 14 bp, Homo sapiens
cagttgtgaaagca

SEQ ID NO: 431687 - DNA, 22 bp, Homo sapiens
cagttgtgaaagcaccatcatc

SEQ ID NO: 431688 - DNA, 13 bp, Homo sapiens
cagttgtgaagag

SEQ ID NO: 431689 - DNA, 22 bp, Homo sapiens
cagttgttagtgtgtcttagtg

SEQ ID NO: 431690 - DNA, 19 bp, Homo sapiens
cagttgttatattcattct

SEQ ID NO: 431691 - DNA, 23 bp, Homo sapiens
cagttgttcaataataaatattt

SEQ ID NO: 431692 - DNA, 14 bp, Homo sapiens
cagttgttttcccg

SEQ ID NO: 431693 - DNA, 15 bp, Homo sapiens
cagtttagtgcttta

SEQ ID NO: 431694 - DNA, 23 bp, Homo sapiens
cagtttcactttcacatagatgt

SEQ ID NO: 431695 - DNA, 15 bp, Homo sapiens
cagtttcaggtgttt

SEQ ID NO: 431696 - DNA, 11 bp, Homo sapiens
cagtttccaag

SEQ ID NO: 431697 - DNA, 16 bp, Homo sapiens
cagtttctccatcagc

SEQ ID NO: 431698 - DNA, 16 bp, Homo sapiens
cagtttgagacaggag

SEQ ID NO: 431699 - DNA, 22 bp, Homo sapiens
cagtttgcaatcttatgttgat

SEQ ID NO: 431700 - DNA, 11 bp, Homo sapiens
cagtttgccca

SEQ ID NO: 431701 - DNA, 14 bp, Homo sapiens
cagtttggaagtgt

SEQ ID NO: 431702 - DNA, 14 bp, Homo sapiens
cagtttggctgtaa

SEQ ID NO: 431703 - DNA, 17 bp, Homo sapiens
cagtttggctgtaattt

SEQ ID NO: 431704 - DNA, 13 bp, Homo sapiens
cagtttgtcagac

SEQ ID NO: 431705 - DNA, 13 bp, Homo sapiens
cagtttgtgaagt

SEQ ID NO: 431706 - DNA, 16 bp, Homo sapiens
cagttttaactagaat

SEQ ID NO: 431707 - DNA, 14 bp, Homo sapiens
cagttttccaggag

SEQ ID NO: 431708 - DNA, 12 bp, Homo sapiens
cagttttccatg

SEQ ID NO: 431709 - DNA, 13 bp, Homo sapiens
cagttttgataca

SEQ ID NO: 431710 - DNA, 12 bp, Homo sapiens
cagttttgtgta

SEQ ID NO: 431711 - DNA, 14 bp, Homo sapiens
cagttttgtgtaca

SEQ ID NO: 431712 - DNA, 15 bp, Homo sapiens
cagttttgtgtacag

SEQ ID NO: 431713 - DNA, 15 bp, Homo sapiens
cagtttttcaggagc

SEQ ID NO: 431714 - DNA, 22 bp, Homo sapiens
cagtttttgctgattgctaagg

SEQ ID NO: 431715 - DNA, 12 bp, Homo sapiens
cataaaacaaaa

SEQ ID NO: 431716 - DNA, 21 bp, Homo sapiens
cataaaacaaaaccaagcctt

SEQ ID NO: 431717 - DNA, 22 bp, Homo sapiens
cataaaactcatgactgagtct

SEQ ID NO: 431718 - DNA, 17 bp, Homo sapiens
cataaaagtaattaatt

SEQ ID NO: 431719 - DNA, 22 bp, Homo sapiens
cataaaccaataaaacaagaat

SEQ ID NO: 431720 - DNA, 16 bp, Homo sapiens
cataaacccatctgta

SEQ ID NO: 431721 - DNA, 15 bp, Homo sapiens
cataaactgacttta

SEQ ID NO: 431722 - DNA, 15 bp, Homo sapiens
cataaagtaaatgct

SEQ ID NO: 431723 - DNA, 16 bp, Homo sapiens
cataaatccagttcta

SEQ ID NO: 431724 - DNA, 15 bp, Homo sapiens
cataaatctgtctga

SEQ ID NO: 431725 - DNA, 16 bp, Homo sapiens
cataaatcttccaaag

SEQ ID NO: 431726 - DNA, 18 bp, Homo sapiens
cataaattatttctaaaa

SEQ ID NO: 431727 - DNA, 21 bp, Homo sapiens
cataaattggctcctttccca

SEQ ID NO: 431728 - DNA, 21 bp, Homo sapiens
cataaatttgttgtcatgtgt

SEQ ID NO: 431729 - DNA, 13 bp, Homo sapiens
cataacaatgtat

SEQ ID NO: 431730 - DNA, 11 bp, Homo sapiens
cataacacaca

SEQ ID NO: 431731 - DNA, 22 bp, Homo sapiens
cataacatagttgaaaaaagaa

SEQ ID NO: 431732 - DNA, 14 bp, Homo sapiens
cataaccactgctt

SEQ ID NO: 431733 - DNA, 15 bp, Homo sapiens
cataaccactgcttc

SEQ ID NO: 431734 - DNA, 17 bp, Homo sapiens
cataactacagagtctg

SEQ ID NO: 431735 - DNA, 21 bp, Homo sapiens
cataagaccgtgtcccaagga

SEQ ID NO: 431736 - DNA, 21 bp, Homo sapiens
cataagcctccatttagttct

SEQ ID NO: 431737 - DNA, 22 bp, Homo sapiens
cataaggaatgtagctggtttc

SEQ ID NO: 431738 - DNA, 16 bp, Homo sapiens
cataaggcctgccctc

SEQ ID NO: 431739 - DNA, 18 bp, Homo sapiens
cataaggcctgccctccc

SEQ ID NO: 431740 - DNA, 12 bp, Homo sapiens
cataagtttctg

SEQ ID NO: 431741 - DNA, 14 bp, Homo sapiens
cataatactaattt

SEQ ID NO: 431742 - DNA, 18 bp, Homo sapiens
cataatactaatttattg

SEQ ID NO: 431743 - DNA, 17 bp, Homo sapiens
cataatcatcctttttt

SEQ ID NO: 431744 - DNA, 22 bp, Homo sapiens
cataatctagtttacagaaaaa

SEQ ID NO: 431745 - DNA, 20 bp, Homo sapiens
cataatctggactcctctgt

SEQ ID NO: 431746 - DNA, 20 bp, Homo sapiens
cataatgagtaatgcagaca

SEQ ID NO: 431747 - DNA, 19 bp, Homo sapiens
cataatgcttaatttctaa

SEQ ID NO: 431748 - DNA, 23 bp, Homo sapiens
cataatgtagtgagtgtagactg

SEQ ID NO: 431749 - DNA, 20 bp, Homo sapiens
cataatgttagtagcactga

SEQ ID NO: 431750 - DNA, 23 bp, Homo sapiens
cataatgttagtagcactgagac

SEQ ID NO: 431751 - DNA, 14 bp, Homo sapiens
cataatgttcctta

SEQ ID NO: 431752 - DNA, 22 bp, Homo sapiens
cataatgttgaacattcattca

SEQ ID NO: 431753 - DNA, 18 bp, Homo sapiens
cataattaaattttaatg

SEQ ID NO: 431754 - DNA, 15 bp, Homo sapiens
cataattatgacagt

SEQ ID NO: 431755 - DNA, 19 bp, Homo sapiens
cataattatgacagttata

SEQ ID NO: 431756 - DNA, 23 bp, Homo sapiens
cataattatgggaacaagtgtac

SEQ ID NO: 431757 - DNA, 19 bp, Homo sapiens
cataattgcaagggaagag

SEQ ID NO: 431758 - DNA, 14 bp, Homo sapiens
cataattttatcta

SEQ ID NO: 431759 - DNA, 14 bp, Homo sapiens
cataattttcttca

SEQ ID NO: 431760 - DNA, 22 bp, Homo sapiens
catacaaaaatatattaaaaat

SEQ ID NO: 431761 - DNA, 12 bp, Homo sapiens
catacagctcta

SEQ ID NO: 431762 - DNA, 20 bp, Homo sapiens
catacaggagagctgcagtt

SEQ ID NO: 431763 - DNA, 16 bp, Homo sapiens
catacagtttgcactt

SEQ ID NO: 431764 - DNA, 17 bp, Homo sapiens
catacatgttattgttt

SEQ ID NO: 431765 - DNA, 13 bp, Homo sapiens
catacattcctaa

SEQ ID NO: 431766 - DNA, 22 bp, Homo sapiens
catacattgtataggccatctg

SEQ ID NO: 431767 - DNA, 23 bp, Homo sapiens
catacatttataatgtttgctat

SEQ ID NO: 431768 - DNA, 23 bp, Homo sapiens
cataccaggtgctagggtgcctg

SEQ ID NO: 431769 - DNA, 12 bp, Homo sapiens
cataccagtcag

SEQ ID NO: 431770 - DNA, 16 bp, Homo sapiens
catatttgcaataaaa

SEQ ID NO: 431771 - DNA, 18 bp, Homo sapiens
catatttgcttctaatgt

SEQ ID NO: 431772 - DNA, 14 bp, Homo sapiens
catatttgtagcta

SEQ ID NO: 431773 - DNA, 14 bp, Homo sapiens
catatttgtgttca

SEQ ID NO: 431774 - DNA, 15 bp, Homo sapiens
catatttgtgttcag

SEQ ID NO: 431775 - DNA, 23 bp, Homo sapiens
catattttacttggaaatattaa

SEQ ID NO: 431776 - DNA, 15 bp, Homo sapiens
catattttctccgaa

SEQ ID NO: 431777 - DNA, 13 bp, Homo sapiens
catatttttacaa

SEQ ID NO: 431778 - DNA, 12 bp, Homo sapiens
catcaaaaagag

SEQ ID NO: 431779 - DNA, 14 bp, Homo sapiens
catcaaaaagagtc

SEQ ID NO: 431780 - DNA, 19 bp, Homo sapiens
catcaaacctactataaaa

SEQ ID NO: 431781 - DNA, 21 bp, Homo sapiens
catcaaataaaccttgtttct

SEQ ID NO: 431782 - DNA, 14 bp, Homo sapiens
catcaaataaattt

SEQ ID NO: 431783 - DNA, 19 bp, Homo sapiens
catcaaataatacatcttt

SEQ ID NO: 431784 - DNA, 18 bp, Homo sapiens
catcaagatacacttgta

SEQ ID NO: 431785 - DNA, 11 bp, Homo sapiens
catcaatgttc

SEQ ID NO: 431786 - DNA, 15 bp, Homo sapiens
catcaatgttcattg

SEQ ID NO: 431787 - DNA, 16 bp, Homo sapiens
catcaatgttcattgt

SEQ ID NO: 431788 - DNA, 12 bp, Homo sapiens
catcacacacac

SEQ ID NO: 431789 - DNA, 13 bp, Homo sapiens
catcacagccagc

SEQ ID NO: 431790 - DNA, 18 bp, Homo sapiens
catcacagccagcccagc

SEQ ID NO: 431791 - DNA, 22 bp, Homo sapiens
catcacagccagcccagctcca

SEQ ID NO: 431792 - DNA, 13 bp, Homo sapiens
catcacagcttgt

SEQ ID NO: 431793 - DNA, 14 bp, Homo sapiens
catcacagcttgtt

SEQ ID NO: 431794 - DNA, 21 bp, Homo sapiens
catcacatttgtaaatgtctt

SEQ ID NO: 431795 - DNA, 15 bp, Homo sapiens
catcaccaccacacc

SEQ ID NO: 431796 - DNA, 13 bp, Homo sapiens
catcaccccttcc

SEQ ID NO: 431797 - DNA, 14 bp, Homo sapiens
catcaccccttccc

SEQ ID NO: 431798 - DNA, 15 bp, Homo sapiens
catcactgctgtccc

SEQ ID NO: 431799 - DNA, 17 bp, Homo sapiens
catcacttctccccgca

SEQ ID NO: 431800 - DNA, 13 bp, Homo sapiens
catcagaactgaa

SEQ ID NO: 431801 - DNA, 18 bp, Homo sapiens
catcagaagcctattgta

SEQ ID NO: 431802 - DNA, 20 bp, Homo sapiens
catcagaagcctattgtaaa

SEQ ID NO: 431803 - DNA, 14 bp, Homo sapiens
catcagcaagacaa

SEQ ID NO: 431804 - DNA, 13 bp, Homo sapiens
catcagcagcttg

SEQ ID NO: 431805 - DNA, 23 bp, Homo sapiens
catcagcccaggtcccagtgcca

SEQ ID NO: 431806 - DNA, 15 bp, Homo sapiens
catcagcctctggcc

SEQ ID NO: 431807 - DNA, 18 bp, Homo sapiens
catcagcctctggccaga

SEQ ID NO: 431808 - DNA, 15 bp, Homo sapiens
catcagcgtggcagt

SEQ ID NO: 431809 - DNA, 17 bp, Homo sapiens
catcagcgtggcagtca

SEQ ID NO: 431810 - DNA, 14 bp, Homo sapiens
catcagctcccttt

SEQ ID NO: 431811 - DNA, 19 bp, Homo sapiens
catcagctgtaagaagaga

SEQ ID NO: 431812 - DNA, 23 bp, Homo sapiens
catcagctgtaagaagagactgg

SEQ ID NO: 431813 - DNA, 13 bp, Homo sapiens
catcagctttccc

SEQ ID NO: 431814 - DNA, 13 bp, Homo sapiens
catcaggatgaac

SEQ ID NO: 431815 - DNA, 17 bp, Homo sapiens
catcaggatgaacccag

SEQ ID NO: 431816 - DNA, 19 bp, Homo sapiens
catcaggatgaacccagga

SEQ ID NO: 431817 - DNA, 17 bp, Homo sapiens
catcaggcactggtggc

SEQ ID NO: 431818 - DNA, 22 bp, Homo sapiens
catcaggccgggtgcagtggct

SEQ ID NO: 431819 - DNA, 20 bp, Homo sapiens
catcaggtgatccacctgcc

SEQ ID NO: 431820 - DNA, 15 bp, Homo sapiens
catcagtattgtgta

SEQ ID NO: 431821 - DNA, 16 bp, Homo sapiens
catcagtattgtgtaa

SEQ ID NO: 431822 - DNA, 18 bp, Homo sapiens
catcagtggcatggctcc

SEQ ID NO: 431823 - DNA, 17 bp, Homo sapiens
catcagtgttaaaaaat

SEQ ID NO: 431824 - DNA, 15 bp, Homo sapiens
catcagttcccccag

SEQ ID NO: 431825 - DNA, 20 bp, Homo sapiens
catcataaaataaagtatat

SEQ ID NO: 431826 - DNA, 22 bp, Homo sapiens
catcataaaataaagtatatat

SEQ ID NO: 431827 - DNA, 14 bp, Homo sapiens
catcatatgcctga

SEQ ID NO: 431828 - DNA, 12 bp, Homo sapiens
catcatctctgc

SEQ ID NO: 431829 - DNA, 15 bp, Homo sapiens
catcatctctgcctt

SEQ ID NO: 431830 - DNA, 13 bp, Homo sapiens
catcatctgtaga

SEQ ID NO: 431831 - DNA, 23 bp, Homo sapiens
catcatgacactcgtataagcat

SEQ ID NO: 431832 - DNA, 18 bp, Homo sapiens
catcatgagccgttgcta

SEQ ID NO: 431833 - DNA, 13 bp, Homo sapiens
catcatgcctgac

SEQ ID NO: 431834 - DNA, 10 bp, Homo sapiens
catcatgtca

SEQ ID NO: 431835 - DNA, 22 bp, Homo sapiens
catcattggaatacaggaagta

SEQ ID NO: 431836 - DNA, 18 bp, Homo sapiens
catccaaataagaaacct

SEQ ID NO: 431837 - DNA, 12 bp, Homo sapiens
catccaaatcta

SEQ ID NO: 431838 - DNA, 15 bp, Homo sapiens
catccaactgagaaa

SEQ ID NO: 431839 - DNA, 16 bp, Homo sapiens
catccaatcctcactg

SEQ ID NO: 431840 - DNA, 17 bp, Homo sapiens
catccaatcctcactgg

SEQ ID NO: 431841 - DNA, 18 bp, Homo sapiens
catccaatcctcactggg

SEQ ID NO: 431842 - DNA, 19 bp, Homo sapiens
catccaatcctcactgggt

SEQ ID NO: 431843 - DNA, 13 bp, Homo sapiens
catccacaggatt

SEQ ID NO: 431844 - DNA, 13 bp, Homo sapiens
catccaccacctt

SEQ ID NO: 431845 - DNA, 14 bp, Homo sapiens
catccacccagtgc

SEQ ID NO: 431846 - DNA, 16 bp, Homo sapiens
catccacccagtgctg

SEQ ID NO: 431847 - DNA, 17 bp, Homo sapiens
catccactctaccctcc

SEQ ID NO: 431848 - DNA, 16 bp, Homo sapiens
catccagacatcatga

SEQ ID NO: 431849 - DNA, 13 bp, Homo sapiens
catccagcatgtg

SEQ ID NO: 431850 - DNA, 12 bp, Homo sapiens
catccagcctgt

SEQ ID NO: 431851 - DNA, 16 bp, Homo sapiens
catccaggtcctttcc

SEQ ID NO: 431852 - DNA, 17 bp, Homo sapiens
catccaggtcctttcct

SEQ ID NO: 431853 - DNA, 20 bp, Homo sapiens
catccaggtcctttccttct

SEQ ID NO: 431854 - DNA, 23 bp, Homo sapiens
catccagtctcccaacttgtatt

SEQ ID NO: 431855 - DNA, 15 bp, Homo sapiens
catccatagacacag

SEQ ID NO: 431856 - DNA, 18 bp, Homo sapiens
catccatagacacagtat

SEQ ID NO: 431857 - DNA, 19 bp, Homo sapiens
catccatagacacagtatt

SEQ ID NO: 431858 - DNA, 15 bp, Homo sapiens
catccatagtgcact

SEQ ID NO: 431859 - DNA, 16 bp, Homo sapiens
catccatcagctccct

SEQ ID NO: 431860 - DNA, 13 bp, Homo sapiens
catccatctccag

SEQ ID NO: 431861 - DNA, 22 bp, Homo sapiens
catccatgcggccggcctgggg

SEQ ID NO: 431862 - DNA, 17 bp, Homo sapiens
catccatgtgtggactc

SEQ ID NO: 431863 - DNA, 19 bp, Homo sapiens
catcccaaacccttcagtg

SEQ ID NO: 431864 - DNA, 21 bp, Homo sapiens
catcccaataaagtcctcttc

SEQ ID NO: 431865 - DNA, 22 bp, Homo sapiens
catcccaataaagtcctcttcc

SEQ ID NO: 431866 - DNA, 23 bp, Homo sapiens
catcccaataaagtcctcttccc

SEQ ID NO: 431867 - DNA, 18 bp, Homo sapiens
catcccactgatatcacg

SEQ ID NO: 431868 - DNA, 13 bp, Homo sapiens
catcccagcacct

SEQ ID NO: 431869 - DNA, 15 bp, Homo sapiens
catcccagcacctgc

SEQ ID NO: 431870 - DNA, 16 bp, Homo sapiens
catcccagcacctgcc

SEQ ID NO: 431871 - DNA, 14 bp, Homo sapiens
catcccagcagccc

SEQ ID NO: 431872 - DNA, 18 bp, Homo sapiens
catcccagcagcccaagc

SEQ ID NO: 431873 - DNA, 18 bp, Homo sapiens
catcccagcctgtggtta

SEQ ID NO: 431874 - DNA, 16 bp, Homo sapiens
catcccaggaggggcc

SEQ ID NO: 431875 - DNA, 22 bp, Homo sapiens
catcccaggcgggcggcacgcc

SEQ ID NO: 431876 - DNA, 19 bp, Homo sapiens
catcccaggcttcaccctg

SEQ ID NO: 431877 - DNA, 14 bp, Homo sapiens
catccccaccagct

SEQ ID NO: 431878 - DNA, 17 bp, Homo sapiens
catccccaccagctcgt

SEQ ID NO: 431879 - DNA, 11 bp, Homo sapiens
catccccacct

SEQ ID NO: 431880 - DNA, 11 bp, Homo sapiens
catccccaggg

SEQ ID NO: 431881 - DNA, 18 bp, Homo sapiens
catccccatcctccagct

SEQ ID NO: 431882 - DNA, 20 bp, Homo sapiens
catccccctccttgccgctg

SEQ ID NO: 431883 - DNA, 16 bp, Homo sapiens
catcccctccctgcct

SEQ ID NO: 431884 - DNA, 22 bp, Homo sapiens
catcccctccctgcctgctcct

SEQ ID NO: 431885 - DNA, 22 bp, Homo sapiens
catcccctcgtcctgtcccaga

SEQ ID NO: 431886 - DNA, 21 bp, Homo sapiens
catcccgaagccatcacttct

SEQ ID NO: 431887 - DNA, 12 bp, Homo sapiens
catcccggcctc

SEQ ID NO: 431888 - DNA, 16 bp, Homo sapiens
catcccggcctcttcc

SEQ ID NO: 431889 - DNA, 16 bp, Homo sapiens
catcccggggccatgg

SEQ ID NO: 431890 - DNA, 21 bp, Homo sapiens
catcccgtgcaaaacatgcta

SEQ ID NO: 431891 - DNA, 19 bp, Homo sapiens
catccctaagaattcccag

SEQ ID NO: 431892 - DNA, 17 bp, Homo sapiens
catccctgaggagccag

SEQ ID NO: 431893 - DNA, 19 bp, Homo sapiens
catccctgattcctgttgt

SEQ ID NO: 431894 - DNA, 23 bp, Homo sapiens
catccctgcttgcccgctcccac

SEQ ID NO: 431895 - DNA, 13 bp, Homo sapiens
catcccttggccc

SEQ ID NO: 431896 - DNA, 15 bp, Homo sapiens
catcccttggcccct

SEQ ID NO: 431897 - DNA, 19 bp, Homo sapiens
catcccttggcccctctct

SEQ ID NO: 431898 - DNA, 22 bp, Homo sapiens
catccgcctctgagccaggagc

SEQ ID NO: 431899 - DNA, 22 bp, Homo sapiens
catccggcatgagggctgagat

SEQ ID NO: 431900 - DNA, 17 bp, Homo sapiens
catccgtgagcagtgtg

SEQ ID NO: 431901 - DNA, 23 bp, Homo sapiens
catctttgccttgggctgctcct

SEQ ID NO: 431902 - DNA, 12 bp, Homo sapiens
catctttgctga

SEQ ID NO: 431903 - DNA, 23 bp, Homo sapiens
catctttgctgaatgtcattatt

SEQ ID NO: 431904 - DNA, 20 bp, Homo sapiens
catcttttaatatgctgtgg

SEQ ID NO: 431905 - DNA, 23 bp, Homo sapiens
catcttttgttaagttcaccgta

SEQ ID NO: 431906 - DNA, 13 bp, Homo sapiens
catctttttcccc

SEQ ID NO: 431907 - DNA, 21 bp, Homo sapiens
catctttttcctccctttccc

SEQ ID NO: 431908 - DNA, 14 bp, Homo sapiens
catctttttgtgtg

SEQ ID NO: 431909 - DNA, 22 bp, Homo sapiens
catgaaaaacacggcagctgta

SEQ ID NO: 431910 - DNA, 23 bp, Homo sapiens
catgaaaaagcagctaccaggtg

SEQ ID NO: 431911 - DNA, 15 bp, Homo sapiens
catgaaaacattgat

SEQ ID NO: 431912 - DNA, 21 bp, Homo sapiens
catgaaaacgttttattgtgt

SEQ ID NO: 431913 - DNA, 15 bp, Homo sapiens
catgaaaatgtgtgt

SEQ ID NO: 431914 - DNA, 18 bp, Homo sapiens
catgaaaggtaatctgaa

SEQ ID NO: 431915 - DNA, 14 bp, Homo sapiens
catgaagaagctgg

SEQ ID NO: 431916 - DNA, 20 bp, Homo sapiens
catgaagaatgcattcaaaa

SEQ ID NO: 431917 - DNA, 12 bp, Homo sapiens
catgaatcatag

SEQ ID NO: 431918 - DNA, 16 bp, Homo sapiens
catgaatgtaaatttg

SEQ ID NO: 431919 - DNA, 17 bp, Homo sapiens
catgaatgtaaatttgt

SEQ ID NO: 431920 - DNA, 15 bp, Homo sapiens
catgaattcatactc

SEQ ID NO: 431921 - DNA, 18 bp, Homo sapiens
catgaattcatactctgt

SEQ ID NO: 431922 - DNA, 19 bp, Homo sapiens
catgaattcatactctgtt

SEQ ID NO: 431923 - DNA, 23 bp, Homo sapiens
catgaattcatactctgttgcct

SEQ ID NO: 431924 - DNA, 14 bp, Homo sapiens
catgaatttaatgt

SEQ ID NO: 431925 - DNA, 12 bp, Homo sapiens
catgacaaagtt

SEQ ID NO: 431926 - DNA, 16 bp, Homo sapiens
catgacaagccccagg

SEQ ID NO: 431927 - DNA, 15 bp, Homo sapiens
catgacagtagcata

SEQ ID NO: 431928 - DNA, 15 bp, Homo sapiens
catgacatgttatat

SEQ ID NO: 431929 - DNA, 19 bp, Homo sapiens
catgacatgttatatattt

SEQ ID NO: 431930 - DNA, 14 bp, Homo sapiens
catgacatttctca

SEQ ID NO: 431931 - DNA, 16 bp, Homo sapiens
catgacatttctcaaa

SEQ ID NO: 431932 - DNA, 17 bp, Homo sapiens
catgaccactgggcctg

SEQ ID NO: 431933 - DNA, 21 bp, Homo sapiens
catgaccactgggcctgctag

SEQ ID NO: 431934 - DNA, 14 bp, Homo sapiens
catgaccaggccac

SEQ ID NO: 431935 - DNA, 18 bp, Homo sapiens
catgaccatactgaggga

SEQ ID NO: 431936 - DNA, 17 bp, Homo sapiens
catgacctgtgaccagc

SEQ ID NO: 431937 - DNA, 19 bp, Homo sapiens
catgaccttgacgtgtgtg

SEQ ID NO: 431938 - DNA, 23 bp, Homo sapiens
catgaccttgacgtgtgtggtcc

SEQ ID NO: 431939 - DNA, 14 bp, Homo sapiens
catgaccttttggc

SEQ ID NO: 431940 - DNA, 21 bp, Homo sapiens
catgaccttttggcctttgta

SEQ ID NO: 431941 - DNA, 20 bp, Homo sapiens
catgactcgtatatgtctca

SEQ ID NO: 431942 - DNA, 11 bp, Homo sapiens
catgactgcac

SEQ ID NO: 431943 - DNA, 23 bp, Homo sapiens
catgactgcattttactgtacag

SEQ ID NO: 431944 - DNA, 22 bp, Homo sapiens
catgactgggcctcccttgggc

SEQ ID NO: 431945 - DNA, 19 bp, Homo sapiens
catgactgtgaccaccttc

SEQ ID NO: 431946 - DNA, 16 bp, Homo sapiens
catgacttatttagta

SEQ ID NO: 431947 - DNA, 18 bp, Homo sapiens
catgagaactaaatagat

SEQ ID NO: 431948 - DNA, 14 bp, Homo sapiens
catgagaagagggc

SEQ ID NO: 431949 - DNA, 15 bp, Homo sapiens
catgagaagagggcc

SEQ ID NO: 431950 - DNA, 18 bp, Homo sapiens
catgagaagagggcctgt

SEQ ID NO: 431951 - DNA, 23 bp, Homo sapiens
catgagaatgtcatttgctaatg

SEQ ID NO: 431952 - DNA, 19 bp, Homo sapiens
catgagaccactgttatca

SEQ ID NO: 431953 - DNA, 20 bp, Homo sapiens
catgagattggtcattaaat

SEQ ID NO: 431954 - DNA, 12 bp, Homo sapiens
catgagcctgcc

SEQ ID NO: 431955 - DNA, 16 bp, Homo sapiens
catgagctatttccat

SEQ ID NO: 431956 - DNA, 23 bp, Homo sapiens
catgagctatttccattccagaa

SEQ ID NO: 431957 - DNA, 13 bp, Homo sapiens
catgagctccaga

SEQ ID NO: 431958 - DNA, 15 bp, Homo sapiens
catgagctccagacc

SEQ ID NO: 431959 - DNA, 17 bp, Homo sapiens
catgagctccagacccc

SEQ ID NO: 431960 - DNA, 19 bp, Homo sapiens
catgagctccagaccccca

SEQ ID NO: 431961 - DNA, 21 bp, Homo sapiens
catgagctccagacccccagc

SEQ ID NO: 431962 - DNA, 16 bp, Homo sapiens
catgagctccctcgct

SEQ ID NO: 431963 - DNA, 18 bp, Homo sapiens
catgagctccctcgctgt

SEQ ID NO: 431964 - DNA, 22 bp, Homo sapiens
catgagctccctcgctgtatga

SEQ ID NO: 431965 - DNA, 16 bp, Homo sapiens
catgaggaacaaggca

SEQ ID NO: 431966 - DNA, 14 bp, Homo sapiens
catgaggaggcaga

SEQ ID NO: 431967 - DNA, 21 bp, Homo sapiens
catgaggcctcagtggacttt

SEQ ID NO: 431968 - DNA, 17 bp, Homo sapiens
catgagggctgagatgc

SEQ ID NO: 431969 - DNA, 16 bp, Homo sapiens
catgaggggcccgagc

SEQ ID NO: 431970 - DNA, 15 bp, Homo sapiens
catgagtcccagtgg

SEQ ID NO: 431971 - DNA, 16 bp, Homo sapiens
catgagtcccagtggg

SEQ ID NO: 431972 - DNA, 13 bp, Homo sapiens
catgagtgctgat

SEQ ID NO: 431973 - DNA, 20 bp, Homo sapiens
catgagtggccttaataaat

SEQ ID NO: 431974 - DNA, 15 bp, Homo sapiens
catgagttcaaatac

SEQ ID NO: 431975 - DNA, 21 bp, Homo sapiens
catgagttgtcagctttgact

SEQ ID NO: 431976 - DNA, 15 bp, Homo sapiens
catgagtttgccctg

SEQ ID NO: 431977 - DNA, 22 bp, Homo sapiens
catgagttttttctcttgggct

SEQ ID NO: 431978 - DNA, 14 bp, Homo sapiens
catgataaaataag

SEQ ID NO: 431979 - DNA, 16 bp, Homo sapiens
catgataaaataagta

SEQ ID NO: 431980 - DNA, 22 bp, Homo sapiens
catgataatgagttttacatta

SEQ ID NO: 431981 - DNA, 19 bp, Homo sapiens
catgatacttattcaaaaa

SEQ ID NO: 431982 - DNA, 21 bp, Homo sapiens
catgatccacccacctcagcc

SEQ ID NO: 431983 - DNA, 14 bp, Homo sapiens
catgatctgtcaaa

SEQ ID NO: 431984 - DNA, 23 bp, Homo sapiens
catgatggagtcaggtttggggt

SEQ ID NO: 431985 - DNA, 12 bp, Homo sapiens
catgatgtcctt

SEQ ID NO: 431986 - DNA, 18 bp, Homo sapiens
catgatgtcgttcatttt

SEQ ID NO: 431987 - DNA, 16 bp, Homo sapiens
catgatgtctgcaaag

SEQ ID NO: 431988 - DNA, 16 bp, Homo sapiens
catgattagacaatgt

SEQ ID NO: 431989 - DNA, 18 bp, Homo sapiens
catgattagacaatgtgg

SEQ ID NO: 431990 - DNA, 20 bp, Homo sapiens
catgattagacaatgtggaa

SEQ ID NO: 431991 - DNA, 22 bp, Homo sapiens
catgattccaagggcccagagg

SEQ ID NO: 431992 - DNA, 21 bp, Homo sapiens
catgattcgcccaaagccaga

SEQ ID NO: 431993 - DNA, 17 bp, Homo sapiens
catgcacacaaacacct

SEQ ID NO: 431994 - DNA, 20 bp, Homo sapiens
catgcacacaaacacctcct

SEQ ID NO: 431995 - DNA, 12 bp, Homo sapiens
catgcaccaaac

SEQ ID NO: 431996 - DNA, 17 bp, Homo sapiens
catgcacccctgatgtt

SEQ ID NO: 431997 - DNA, 18 bp, Homo sapiens
catgcacccctgatgttc

SEQ ID NO: 431998 - DNA, 17 bp, Homo sapiens
catgcactactgaaatt

SEQ ID NO: 431999 - DNA, 14 bp, Homo sapiens
catgcactagccaa

SEQ ID NO: 432000 - DNA, 22 bp, Homo sapiens
catgcagactcctcagatctga

SEQ ID NO: 432001 - DNA, 16 bp, Homo sapiens
catgcagatctagcca

SEQ ID NO: 432002 - DNA, 17 bp, Homo sapiens
catgcagatctagccag

SEQ ID NO: 432003 - DNA, 21 bp, Homo sapiens
catgcagatctagccaggcct

SEQ ID NO: 432004 - DNA, 23 bp, Homo sapiens
catgcagatctagccaggcctcc

SEQ ID NO: 432005 - DNA, 13 bp, Homo sapiens
catgcagcagctt

SEQ ID NO: 432006 - DNA, 14 bp, Homo sapiens
catgcagcagcttg

SEQ ID NO: 432007 - DNA, 16 bp, Homo sapiens
catgcagcccatgccc

SEQ ID NO: 432008 - DNA, 23 bp, Homo sapiens
catgcagcccatgcccacctgcc

SEQ ID NO: 432009 - DNA, 13 bp, Homo sapiens
catgcaggaactg

SEQ ID NO: 432010 - DNA, 13 bp, Homo sapiens
catgcaggtctcc

SEQ ID NO: 432011 - DNA, 18 bp, Homo sapiens
catgcagttattagaact

SEQ ID NO: 432012 - DNA, 19 bp, Homo sapiens
catgcagttattagaactt

SEQ ID NO: 432013 - DNA, 16 bp, Homo sapiens
catgcatggcctccca

SEQ ID NO: 432014 - DNA, 22 bp, Homo sapiens
catgcatggcctcccagccacc

SEQ ID NO: 432015 - DNA, 22 bp, Homo sapiens
catgcattgttgaggtggtctg

SEQ ID NO: 432016 - DNA, 14 bp, Homo sapiens
catgcattttgcag

SEQ ID NO: 432017 - DNA, 17 bp, Homo sapiens
catgccaccacccaccc

SEQ ID NO: 432018 - DNA, 19 bp, Homo sapiens
catgccaccacccacccca

SEQ ID NO: 432019 - DNA, 21 bp, Homo sapiens
catgccaccatggccagccaa

SEQ ID NO: 432020 - DNA, 12 bp, Homo sapiens
catgccaccctc

SEQ ID NO: 432021 - DNA, 20 bp, Homo sapiens
catgccacgccccgtgtctg

SEQ ID NO: 432022 - DNA, 15 bp, Homo sapiens
catgccactgccagg

SEQ ID NO: 432023 - DNA, 16 bp, Homo sapiens
catgccactgccaggc

SEQ ID NO: 432024 - DNA, 20 bp, Homo sapiens
catgccactgccaggcacct

SEQ ID NO: 432025 - DNA, 23 bp, Homo sapiens
catgccactgccaggcacctggc

SEQ ID NO: 432026 - DNA, 16 bp, Homo sapiens
catgccagcagcacgt

SEQ ID NO: 432027 - DNA, 14 bp, Homo sapiens
catgccaggctggg

SEQ ID NO: 432028 - DNA, 17 bp, Homo sapiens
catgcccatattttact

SEQ ID NO: 432029 - DNA, 16 bp, Homo sapiens
catgccccacccaccc

SEQ ID NO: 432030 - DNA, 17 bp, Homo sapiens
catgccccacccacccc

SEQ ID NO: 432031 - DNA, 20 bp, Homo sapiens
catggctcaggcaagcccct

SEQ ID NO: 432032 - DNA, 16 bp, Homo sapiens
catggctcctcaccac

SEQ ID NO: 432033 - DNA, 13 bp, Homo sapiens
catggctcctgtc

SEQ ID NO: 432034 - DNA, 16 bp, Homo sapiens
catggctcctgtctgg

SEQ ID NO: 432035 - DNA, 18 bp, Homo sapiens
catggctgttatctgtct

SEQ ID NO: 432036 - DNA, 15 bp, Homo sapiens
catggcttcctgaga

SEQ ID NO: 432037 - DNA, 20 bp, Homo sapiens
catggctttcatcctgtgtc

SEQ ID NO: 432038 - DNA, 14 bp, Homo sapiens
catgggaaagtgca

SEQ ID NO: 432039 - DNA, 20 bp, Homo sapiens
catgggaaatgtcaacaagt

SEQ ID NO: 432040 - DNA, 17 bp, Homo sapiens
catgggaacgcagcctc

SEQ ID NO: 432041 - DNA, 18 bp, Homo sapiens
catgggaacgcagcctcc

SEQ ID NO: 432042 - DNA, 12 bp, Homo sapiens
catgggaagaac

SEQ ID NO: 432043 - DNA, 15 bp, Homo sapiens
catgggaatgaatgt

SEQ ID NO: 432044 - DNA, 16 bp, Homo sapiens
catgggaatgaatgtc

SEQ ID NO: 432045 - DNA, 22 bp, Homo sapiens
catgggaatgaatgtcagtgtg

SEQ ID NO: 432046 - DNA, 13 bp, Homo sapiens
catgggagaacct

SEQ ID NO: 432047 - DNA, 17 bp, Homo sapiens
catgggagtcagggagc

SEQ ID NO: 432048 - DNA, 18 bp, Homo sapiens
catgggcacctctgctgt

SEQ ID NO: 432049 - DNA, 19 bp, Homo sapiens
catgggcctcccactcctg

SEQ ID NO: 432050 - DNA, 15 bp, Homo sapiens
catgggcctgctgcg

SEQ ID NO: 432051 - DNA, 13 bp, Homo sapiens
catgggcctggcc

SEQ ID NO: 432052 - DNA, 24 bp, Homo sapiens
catgggcctggccacctctctcct

SEQ ID NO: 432053 - DNA, 12 bp, Homo sapiens
catgggcctggg

SEQ ID NO: 432054 - DNA, 13 bp, Homo sapiens
catgggcctgggc

SEQ ID NO: 432055 - DNA, 14 bp, Homo sapiens
catgggcctgggcc

SEQ ID NO: 432056 - DNA, 15 bp, Homo sapiens
catgggcctgggcct

SEQ ID NO: 432057 - DNA, 16 bp, Homo sapiens
catgggcctgggcctg

SEQ ID NO: 432058 - DNA, 18 bp, Homo sapiens
catgggcctgggcctgct

SEQ ID NO: 432059 - DNA, 12 bp, Homo sapiens
catgggcttgga

SEQ ID NO: 432060 - DNA, 20 bp, Homo sapiens
catgggcttggacttcctgg

SEQ ID NO: 432061 - DNA, 19 bp, Homo sapiens
catgggggcagggcatgac

SEQ ID NO: 432062 - DNA, 22 bp, Homo sapiens
catggggtggaataaaggctga

SEQ ID NO: 432063 - DNA, 16 bp, Homo sapiens
catggggtgggcctct

SEQ ID NO: 432064 - DNA, 17 bp, Homo sapiens
catggggtgggcctctg

SEQ ID NO: 432065 - DNA, 17 bp, Homo sapiens
catggggttcgagactc

SEQ ID NO: 432066 - DNA, 21 bp, Homo sapiens
catggggttcgagactccatc

SEQ ID NO: 432067 - DNA, 19 bp, Homo sapiens
catggggttggctgggccc

SEQ ID NO: 432068 - DNA, 15 bp, Homo sapiens
catgggtagcttctg

SEQ ID NO: 432069 - DNA, 21 bp, Homo sapiens
catgggtccatgggaataaag

SEQ ID NO: 432070 - DNA, 16 bp, Homo sapiens
catgggtcccttcccc

SEQ ID NO: 432071 - DNA, 23 bp, Homo sapiens
catgggtgaagggagagccagct

SEQ ID NO: 432072 - DNA, 12 bp, Homo sapiens
catgggtggagg

SEQ ID NO: 432073 - DNA, 14 bp, Homo sapiens
catgggtggagggt

SEQ ID NO: 432074 - DNA, 23 bp, Homo sapiens
catgggttatgtgtatgtgccat

SEQ ID NO: 432075 - DNA, 13 bp, Homo sapiens
catggtaatttat

SEQ ID NO: 432076 - DNA, 14 bp, Homo sapiens
catggtaccagccc

SEQ ID NO: 432077 - DNA, 15 bp, Homo sapiens
catggtagactgtga

SEQ ID NO: 432078 - DNA, 14 bp, Homo sapiens
catggtccatttca

SEQ ID NO: 432079 - DNA, 18 bp, Homo sapiens
catggtgaaaatgtactg

SEQ ID NO: 432080 - DNA, 21 bp, Homo sapiens
catggtgctagtgggccctct

SEQ ID NO: 432081 - DNA, 20 bp, Homo sapiens
catggtggcacgtgcctgta

SEQ ID NO: 432082 - DNA, 19 bp, Homo sapiens
catggttaaggtaaagtaa

SEQ ID NO: 432083 - DNA, 14 bp, Homo sapiens
catggttccttccc

SEQ ID NO: 432084 - DNA, 20 bp, Homo sapiens
catggttccttccctgggaa

SEQ ID NO: 432085 - DNA, 13 bp, Homo sapiens
catgtaaaacaaa

SEQ ID NO: 432086 - DNA, 17 bp, Homo sapiens
catgtaaaatcttcagc

SEQ ID NO: 432087 - DNA, 22 bp, Homo sapiens
catgtaaaatcttcagctggtg

SEQ ID NO: 432088 - DNA, 23 bp, Homo sapiens
catgtaaaatcttcagctggtgg

SEQ ID NO: 432089 - DNA, 23 bp, Homo sapiens
catgtaaataccagactgcaggt

SEQ ID NO: 432090 - DNA, 18 bp, Homo sapiens
catgtaaccaagagtatt

SEQ ID NO: 432091 - DNA, 18 bp, Homo sapiens
catgtaagaatccaaagt

SEQ ID NO: 432092 - DNA, 14 bp, Homo sapiens
catgtaatattaaa

SEQ ID NO: 432093 - DNA, 23 bp, Homo sapiens
catgtacaaaatcgattggcttt

SEQ ID NO: 432094 - DNA, 19 bp, Homo sapiens
catgtactgctagtacctg

SEQ ID NO: 432095 - DNA, 20 bp, Homo sapiens
catgtactgctagtacctgt

SEQ ID NO: 432096 - DNA, 21 bp, Homo sapiens
catgtagaagagggagaagga

SEQ ID NO: 432097 - DNA, 10 bp, Homo sapiens
catgtagcat

SEQ ID NO: 432098 - DNA, 12 bp, Homo sapiens
catgtagcatat

SEQ ID NO: 432099 - DNA, 15 bp, Homo sapiens
catgtagcatataaa

SEQ ID NO: 432100 - DNA, 19 bp, Homo sapiens
catgtagcatataaatgtt

SEQ ID NO: 432101 - DNA, 22 bp, Homo sapiens
catgtaggttgtctaaaaataa

SEQ ID NO: 432102 - DNA, 13 bp, Homo sapiens
catgtataaatga

SEQ ID NO: 432103 - DNA, 21 bp, Homo sapiens
catgtataaatgaagtttata

SEQ ID NO: 432104 - DNA, 17 bp, Homo sapiens
catgtatattttctcta

SEQ ID NO: 432105 - DNA, 21 bp, Homo sapiens
catgtatcccaactcctataa

SEQ ID NO: 432106 - DNA, 14 bp, Homo sapiens
catgtatctacctc

SEQ ID NO: 432107 - DNA, 19 bp, Homo sapiens
catgtattagccagtcatt

SEQ ID NO: 432108 - DNA, 20 bp, Homo sapiens
catgtattagccagtcattg

SEQ ID NO: 432109 - DNA, 14 bp, Homo sapiens
catgtattcactaa

SEQ ID NO: 432110 - DNA, 15 bp, Homo sapiens
catgtattggcctgg

SEQ ID NO: 432111 - DNA, 16 bp, Homo sapiens
catgtattggcctgga

SEQ ID NO: 432112 - DNA, 18 bp, Homo sapiens
catgtcaacttctggctc

SEQ ID NO: 432113 - DNA, 22 bp, Homo sapiens
catgtcaacttctggctcctca

SEQ ID NO: 432114 - DNA, 16 bp, Homo sapiens
catgtcactgtggtcc

SEQ ID NO: 432115 - DNA, 22 bp, Homo sapiens
catgtcatgtaggttgtctaaa

SEQ ID NO: 432116 - DNA, 15 bp, Homo sapiens
catgtcatttctcat

SEQ ID NO: 432117 - DNA, 19 bp, Homo sapiens
catgtccaagtccaacctg

SEQ ID NO: 432118 - DNA, 23 bp, Homo sapiens
catgtccaagttcttcacctcta

SEQ ID NO: 432119 - DNA, 22 bp, Homo sapiens
catgtccctaccgagtctcttc

SEQ ID NO: 432120 - DNA, 16 bp, Homo sapiens
catgtcggagtagaaa

SEQ ID NO: 432121 - DNA, 14 bp, Homo sapiens
catgtctacaaaag

SEQ ID NO: 432122 - DNA, 12 bp, Homo sapiens
catgtctactgc

SEQ ID NO: 432123 - DNA, 22 bp, Homo sapiens
catgtctataatcccagcactt

SEQ ID NO: 432124 - DNA, 16 bp, Homo sapiens
catgtctgcatggcag

SEQ ID NO: 432125 - DNA, 20 bp, Homo sapiens
catgtctgcatggcagaagc

SEQ ID NO: 432126 - DNA, 18 bp, Homo sapiens
catgtgaaaagtaaaaca

SEQ ID NO: 432127 - DNA, 15 bp, Homo sapiens
catgtgaacccggga

SEQ ID NO: 432128 - DNA, 13 bp, Homo sapiens
catgtgaagaggg

SEQ ID NO: 432129 - DNA, 19 bp, Homo sapiens
catgtgaattctgtgaaga

SEQ ID NO: 432130 - DNA, 12 bp, Homo sapiens
catgtgagccac

SEQ ID NO: 432131 - DNA, 18 bp, Homo sapiens
catgtgagccaccgctgc

SEQ ID NO: 432132 - DNA, 21 bp, Homo sapiens
catgtgattggcagcttcaaa

SEQ ID NO: 432133 - DNA, 11 bp, Homo sapiens
catgtgccaag

SEQ ID NO: 432134 - DNA, 14 bp, Homo sapiens
catgtgcccagtta

SEQ ID NO: 432135 - DNA, 18 bp, Homo sapiens
catgtgcctgcaccagga

SEQ ID NO: 432136 - DNA, 21 bp, Homo sapiens
catgtgctctgttttgacata

SEQ ID NO: 432137 - DNA, 14 bp, Homo sapiens
catgtgctttgtag

SEQ ID NO: 432138 - DNA, 16 bp, Homo sapiens
catgtgctttgtagct

SEQ ID NO: 432139 - DNA, 18 bp, Homo sapiens
catgtggaaaactcacag

SEQ ID NO: 432140 - DNA, 18 bp, Homo sapiens
catgtggaaagtgaattt

SEQ ID NO: 432141 - DNA, 20 bp, Homo sapiens
catgtggcaaaatatggttt

SEQ ID NO: 432142 - DNA, 18 bp, Homo sapiens
catgtggccccaggtgcc

SEQ ID NO: 432143 - DNA, 19 bp, Homo sapiens
catgtggccccaggtgcca

SEQ ID NO: 432144 - DNA, 18 bp, Homo sapiens
catgtggccttgagcaag

SEQ ID NO: 432145 - DNA, 14 bp, Homo sapiens
catgtggggccagg

SEQ ID NO: 432146 - DNA, 16 bp, Homo sapiens
catgtgggtgagccag

SEQ ID NO: 432147 - DNA, 23 bp, Homo sapiens
catgtgggtgagccagtggaaca

SEQ ID NO: 432148 - DNA, 21 bp, Homo sapiens
catgtgggttgtgatattgac

SEQ ID NO: 432149 - DNA, 14 bp, Homo sapiens
catgtgtataaaaa

SEQ ID NO: 432150 - DNA, 19 bp, Homo sapiens
catgtgtcagctgtagaaa

SEQ ID NO: 432151 - DNA, 21 bp, Homo sapiens
catgtgtcagctgtagaaagg

SEQ ID NO: 432152 - DNA, 14 bp, Homo sapiens
catgtgtcccagga

SEQ ID NO: 432153 - DNA, 18 bp, Homo sapiens
catgtgtcccaggagcag

SEQ ID NO: 432154 - DNA, 21 bp, Homo sapiens
catgtgtgagataacttcctt

SEQ ID NO: 432155 - DNA, 13 bp, Homo sapiens
catgtgtgcctgt

SEQ ID NO: 432156 - DNA, 17 bp, Homo sapiens
catgtgtgcctgtggca

SEQ ID NO: 432157 - DNA, 17 bp, Homo sapiens
catgtgtggatgtgtaa

SEQ ID NO: 432158 - DNA, 13 bp, Homo sapiens
catgtgtgtgtct

SEQ ID NO: 432159 - DNA, 14 bp, Homo sapiens
catgtgtttatcct

SEQ ID NO: 432160 - DNA, 16 bp, Homo sapiens
catgtgttttgctttt

SEQ ID NO: 432161 - DNA, 20 bp, Homo sapiens
cattccttgataatgttgtg

SEQ ID NO: 432162 - DNA, 16 bp, Homo sapiens
cattccttgtcaccag

SEQ ID NO: 432163 - DNA, 17 bp, Homo sapiens
cattccttgtcaccagc

SEQ ID NO: 432164 - DNA, 18 bp, Homo sapiens
cattccttgtcaccagca

SEQ ID NO: 432165 - DNA, 21 bp, Homo sapiens
cattcctttaaattctccaac

SEQ ID NO: 432166 - DNA, 18 bp, Homo sapiens
cattcgaggtgtcaccct

SEQ ID NO: 432167 - DNA, 23 bp, Homo sapiens
cattcgaggtgtcaccctgcaga

SEQ ID NO: 432168 - DNA, 21 bp, Homo sapiens
cattcgcagtgcccagtgatg

SEQ ID NO: 432169 - DNA, 17 bp, Homo sapiens
cattctaaaccaaaaca

SEQ ID NO: 432170 - DNA, 18 bp, Homo sapiens
cattctacacctggacca

SEQ ID NO: 432171 - DNA, 16 bp, Homo sapiens
cattctagatcctgca

SEQ ID NO: 432172 - DNA, 14 bp, Homo sapiens
cattctcactccta

SEQ ID NO: 432173 - DNA, 16 bp, Homo sapiens
cattctccactcactg

SEQ ID NO: 432174 - DNA, 13 bp, Homo sapiens
cattctcctgcct

SEQ ID NO: 432175 - DNA, 15 bp, Homo sapiens
cattctgcctgcctg

SEQ ID NO: 432176 - DNA, 16 bp, Homo sapiens
cattctgcctgcctgg

SEQ ID NO: 432177 - DNA, 19 bp, Homo sapiens
cattctgcctgcctgggaa

SEQ ID NO: 432178 - DNA, 20 bp, Homo sapiens
cattctgctgcccccagacc

SEQ ID NO: 432179 - DNA, 18 bp, Homo sapiens
cattctgctttcttgcca

SEQ ID NO: 432180 - DNA, 16 bp, Homo sapiens
cattctggggtggggc

SEQ ID NO: 432181 - DNA, 17 bp, Homo sapiens
cattctgtgatcattta

SEQ ID NO: 432182 - DNA, 20 bp, Homo sapiens
cattctgttgcccaggctgg

SEQ ID NO: 432183 - DNA, 16 bp, Homo sapiens
cattcttacaaaacat

SEQ ID NO: 432184 - DNA, 24 bp, Homo sapiens
cattcttacaattgcactgctgtt

SEQ ID NO: 432185 - DNA, 17 bp, Homo sapiens
cattcttaggctttcag

SEQ ID NO: 432186 - DNA, 15 bp, Homo sapiens
cattcttattttaga

SEQ ID NO: 432187 - DNA, 15 bp, Homo sapiens
cattcttctctccca

SEQ ID NO: 432188 - DNA, 21 bp, Homo sapiens
cattcttggtcaagtttttct

SEQ ID NO: 432189 - DNA, 20 bp, Homo sapiens
cattctttaacatacatcta

SEQ ID NO: 432190 - DNA, 23 bp, Homo sapiens
cattctttacagcaaatgttata

SEQ ID NO: 432191 - DNA, 15 bp, Homo sapiens
cattctttcttcctc

SEQ ID NO: 432192 - DNA, 20 bp, Homo sapiens
cattctttcttggtgcattc

SEQ ID NO: 432193 - DNA, 16 bp, Homo sapiens
cattctttgtatctta

SEQ ID NO: 432194 - DNA, 16 bp, Homo sapiens
cattgaaaatgtaagt

SEQ ID NO: 432195 - DNA, 12 bp, Homo sapiens
cattgaaagaag

SEQ ID NO: 432196 - DNA, 17 bp, Homo sapiens
cattgaaagaagagatg

SEQ ID NO: 432197 - DNA, 12 bp, Homo sapiens
cattgaaataat

SEQ ID NO: 432198 - DNA, 16 bp, Homo sapiens
cattgaccaagaactg

SEQ ID NO: 432199 - DNA, 17 bp, Homo sapiens
cattgaccaagaactgc

SEQ ID NO: 432200 - DNA, 13 bp, Homo sapiens
cattgacctcagc

SEQ ID NO: 432201 - DNA, 15 bp, Homo sapiens
cattgacctcagctg

SEQ ID NO: 432202 - DNA, 19 bp, Homo sapiens
cattgacttcaagatgcct

SEQ ID NO: 432203 - DNA, 22 bp, Homo sapiens
cattgagggaaaacataatatc

SEQ ID NO: 432204 - DNA, 15 bp, Homo sapiens
cattgatcacagatg

SEQ ID NO: 432205 - DNA, 16 bp, Homo sapiens
cattgatcacagatgt

SEQ ID NO: 432206 - DNA, 22 bp, Homo sapiens
cattgatgaatgaggaacaatc

SEQ ID NO: 432207 - DNA, 21 bp, Homo sapiens
cattgatgagcactcctgatt

SEQ ID NO: 432208 - DNA, 19 bp, Homo sapiens
cattgcaaaaggttaagcc

SEQ ID NO: 432209 - DNA, 22 bp, Homo sapiens
cattgcaaaaggttaagccata

SEQ ID NO: 432210 - DNA, 13 bp, Homo sapiens
cattgcactaaaa

SEQ ID NO: 432211 - DNA, 14 bp, Homo sapiens
cattgcactaaaag

SEQ ID NO: 432212 - DNA, 19 bp, Homo sapiens
cattgcactaaaagtgatg

SEQ ID NO: 432213 - DNA, 21 bp, Homo sapiens
cattgcactaaaagtgatgtg

SEQ ID NO: 432214 - DNA, 20 bp, Homo sapiens
cattgcactctagcctgggc

SEQ ID NO: 432215 - DNA, 18 bp, Homo sapiens
cattgcactttataaaca

SEQ ID NO: 432216 - DNA, 18 bp, Homo sapiens
cattgcagaacatgagtg

SEQ ID NO: 432217 - DNA, 22 bp, Homo sapiens
cattgcagaacatgagtgctga

SEQ ID NO: 432218 - DNA, 22 bp, Homo sapiens
cattgcaggaagagatgctcta

SEQ ID NO: 432219 - DNA, 21 bp, Homo sapiens
cattgcaggccagtggacaga

SEQ ID NO: 432220 - DNA, 18 bp, Homo sapiens
cattgcatcatgaaactc

SEQ ID NO: 432221 - DNA, 17 bp, Homo sapiens
cattgcattcaaaatct

SEQ ID NO: 432222 - DNA, 15 bp, Homo sapiens
cattgccaccaggag

SEQ ID NO: 432223 - DNA, 11 bp, Homo sapiens
cattgccccaa

SEQ ID NO: 432224 - DNA, 15 bp, Homo sapiens
cattgccccaagata

SEQ ID NO: 432225 - DNA, 20 bp, Homo sapiens
cattgccttgagcttttcag

SEQ ID NO: 432226 - DNA, 13 bp, Homo sapiens
cattgctacactt

SEQ ID NO: 432227 - DNA, 18 bp, Homo sapiens
cattgctagcgagccgcc

SEQ ID NO: 432228 - DNA, 16 bp, Homo sapiens
cattgctcccagtgcc

SEQ ID NO: 432229 - DNA, 15 bp, Homo sapiens
cattgcttcactacc

SEQ ID NO: 432230 - DNA, 18 bp, Homo sapiens
cattgctttcgtgtaaat

SEQ ID NO: 432231 - DNA, 16 bp, Homo sapiens
cattgctttgaagcag

SEQ ID NO: 432232 - DNA, 22 bp, Homo sapiens
cattgctttgaagcagttgtgt

SEQ ID NO: 432233 - DNA, 21 bp, Homo sapiens
cattgcttttggacaaggaag

SEQ ID NO: 432234 - DNA, 18 bp, Homo sapiens
cattgggtgggtaaattc

SEQ ID NO: 432235 - DNA, 19 bp, Homo sapiens
cattgggttttatcagtgc

SEQ ID NO: 432236 - DNA, 15 bp, Homo sapiens
cattggtctgcatgt

SEQ ID NO: 432237 - DNA, 18 bp, Homo sapiens
cattggttccctttgctc

SEQ ID NO: 432238 - DNA, 22 bp, Homo sapiens
cattgtaatctgctttgttaat

SEQ ID NO: 432239 - DNA, 16 bp, Homo sapiens
cattgtaatgttactg

SEQ ID NO: 432240 - DNA, 15 bp, Homo sapiens
cattgtactccagcc

SEQ ID NO: 432241 - DNA, 17 bp, Homo sapiens
cattgtactccagcctg

SEQ ID NO: 432242 - DNA, 19 bp, Homo sapiens
cattgtactccagcctggg

SEQ ID NO: 432243 - DNA, 14 bp, Homo sapiens
cattgtagaaacac

SEQ ID NO: 432244 - DNA, 17 bp, Homo sapiens
cattgtagagcttctgg

SEQ ID NO: 432245 - DNA, 20 bp, Homo sapiens
cattgtataggccatctgta

SEQ ID NO: 432246 - DNA, 21 bp, Homo sapiens
cattgtataggccatctgtaa

SEQ ID NO: 432247 - DNA, 22 bp, Homo sapiens
cattgtataggccatctgtaaa

SEQ ID NO: 432248 - DNA, 23 bp, Homo sapiens
cattgtattgtctgacacatgct

SEQ ID NO: 432249 - DNA, 19 bp, Homo sapiens
cattgtattttactttgtg

SEQ ID NO: 432250 - DNA, 21 bp, Homo sapiens
cattgtctcattgccagtggt

SEQ ID NO: 432251 - DNA, 18 bp, Homo sapiens
cattgtctttcctccctt

SEQ ID NO: 432252 - DNA, 19 bp, Homo sapiens
cattgtctttcctcccttc

SEQ ID NO: 432253 - DNA, 15 bp, Homo sapiens
cattgtgaagcacct

SEQ ID NO: 432254 - DNA, 13 bp, Homo sapiens
cattgtggctcct

SEQ ID NO: 432255 - DNA, 21 bp, Homo sapiens
cattgtgggatgttcagcact

SEQ ID NO: 432256 - DNA, 18 bp, Homo sapiens
cattgtgtgagcttctac

SEQ ID NO: 432257 - DNA, 18 bp, Homo sapiens
cattgttcagaagacctc

SEQ ID NO: 432258 - DNA, 14 bp, Homo sapiens
cattgttccacaca

SEQ ID NO: 432259 - DNA, 21 bp, Homo sapiens
cattgtttttaagaaaaacat

SEQ ID NO: 432260 - DNA, 23 bp, Homo sapiens
cattgtttttaagaaaaacatgt

SEQ ID NO: 432261 - DNA, 12 bp, Homo sapiens
catttaaaacat

SEQ ID NO: 432262 - DNA, 13 bp, Homo sapiens
catttaaaatgat

SEQ ID NO: 432263 - DNA, 15 bp, Homo sapiens
catttaaaatgatta

SEQ ID NO: 432264 - DNA, 13 bp, Homo sapiens
catttaaaatgga

SEQ ID NO: 432265 - DNA, 23 bp, Homo sapiens
catttaaaatgtaaactcttcac

SEQ ID NO: 432266 - DNA, 20 bp, Homo sapiens
catttaaactaaccttttat

SEQ ID NO: 432267 - DNA, 20 bp, Homo sapiens
catttaataactttgctgga

SEQ ID NO: 432268 - DNA, 12 bp, Homo sapiens
catttaatcatt

SEQ ID NO: 432269 - DNA, 14 bp, Homo sapiens
catttacctggaaa

SEQ ID NO: 432270 - DNA, 15 bp, Homo sapiens
catttagaaaataga

SEQ ID NO: 432271 - DNA, 19 bp, Homo sapiens
catttagaactttctgctt

SEQ ID NO: 432272 - DNA, 14 bp, Homo sapiens
catttagtcctcac

SEQ ID NO: 432273 - DNA, 17 bp, Homo sapiens
catttagtcctcacctt

SEQ ID NO: 432274 - DNA, 23 bp, Homo sapiens
catttagtcctcaccttctgttt

SEQ ID NO: 432275 - DNA, 20 bp, Homo sapiens
catttagttctttgttattt

SEQ ID NO: 432276 - DNA, 23 bp, Homo sapiens
catttataaccccagcctgacct

SEQ ID NO: 432277 - DNA, 21 bp, Homo sapiens
catttataatgtttgctattg

SEQ ID NO: 432278 - DNA, 22 bp, Homo sapiens
catttatacatcacctttttga

SEQ ID NO: 432279 - DNA, 18 bp, Homo sapiens
catttatcaagcagagac

SEQ ID NO: 432280 - DNA, 14 bp, Homo sapiens
catttatcactctg

SEQ ID NO: 432281 - DNA, 16 bp, Homo sapiens
catttatcttctgttt

SEQ ID NO: 432282 - DNA, 22 bp, Homo sapiens
catttatcttctgtttttctca

SEQ ID NO: 432283 - DNA, 22 bp, Homo sapiens
catttatgcatgagaactaaat

SEQ ID NO: 432284 - DNA, 12 bp, Homo sapiens
catttatttatg

SEQ ID NO: 432285 - DNA, 13 bp, Homo sapiens
catttattttgac

SEQ ID NO: 432286 - DNA, 14 bp, Homo sapiens
catttcaaatctgt

SEQ ID NO: 432287 - DNA, 15 bp, Homo sapiens
catttcaaatctgta

SEQ ID NO: 432288 - DNA, 14 bp, Homo sapiens
catttcacaccctt

SEQ ID NO: 432289 - DNA, 15 bp, Homo sapiens
catttcatcctgttg

SEQ ID NO: 432290 - DNA, 23 bp, Homo sapiens
ccaaataatattttagattacag

SEQ ID NO: 432291 - DNA, 13 bp, Homo sapiens
ccaaatagggcaa

SEQ ID NO: 432292 - DNA, 17 bp, Homo sapiens
ccaaatatgcactttcc

SEQ ID NO: 432293 - DNA, 22 bp, Homo sapiens
ccaaatatgcactttccctaga

SEQ ID NO: 432294 - DNA, 17 bp, Homo sapiens
ccaaatccacaagccat

SEQ ID NO: 432295 - DNA, 17 bp, Homo sapiens
ccaaatcctgggcatcc

SEQ ID NO: 432296 - DNA, 17 bp, Homo sapiens
ccaaatctactgagcca

SEQ ID NO: 432297 - DNA, 20 bp, Homo sapiens
ccaaatctagccagagccct

SEQ ID NO: 432298 - DNA, 19 bp, Homo sapiens
ccaaatcttgaatttctgc

SEQ ID NO: 432299 - DNA, 13 bp, Homo sapiens
ccaaatgcattca

SEQ ID NO: 432300 - DNA, 18 bp, Homo sapiens
ccaaatgcattcatgttt

SEQ ID NO: 432301 - DNA, 14 bp, Homo sapiens
ccaaatgcctctgc

SEQ ID NO: 432302 - DNA, 22 bp, Homo sapiens
ccaaatgtaattgaataaagtt

SEQ ID NO: 432303 - DNA, 21 bp, Homo sapiens
ccaaatgtgatcaactgttca

SEQ ID NO: 432304 - DNA, 11 bp, Homo sapiens
ccaaattattt

SEQ ID NO: 432305 - DNA, 18 bp, Homo sapiens
ccaaattgatgggtgggc

SEQ ID NO: 432306 - DNA, 16 bp, Homo sapiens
ccaaattgccttcagc

SEQ ID NO: 432307 - DNA, 18 bp, Homo sapiens
ccaaattgctgagatgtt

SEQ ID NO: 432308 - DNA, 16 bp, Homo sapiens
ccaacaacagtcagcc

SEQ ID NO: 432309 - DNA, 19 bp, Homo sapiens
ccaacaacagtcagccagc

SEQ ID NO: 432310 - DNA, 14 bp, Homo sapiens
ccaacaatggggtg

SEQ ID NO: 432311 - DNA, 14 bp, Homo sapiens
ccaacaccacagac

SEQ ID NO: 432312 - DNA, 16 bp, Homo sapiens
ccaacaccacagacac

SEQ ID NO: 432313 - DNA, 17 bp, Homo sapiens
ccaacaccacagacaca

SEQ ID NO: 432314 - DNA, 21 bp, Homo sapiens
ccaacaccatcacagcttgtt

SEQ ID NO: 432315 - DNA, 19 bp, Homo sapiens
ccaacacttgtgttgcttt

SEQ ID NO: 432316 - DNA, 21 bp, Homo sapiens
ccaacacttgtgttgctttct

SEQ ID NO: 432317 - DNA, 12 bp, Homo sapiens
ccaacagtgagt

SEQ ID NO: 432318 - DNA, 19 bp, Homo sapiens
ccaacattcaaaagcacaa

SEQ ID NO: 432319 - DNA, 20 bp, Homo sapiens
ccaacattcaaaagcacaaa

SEQ ID NO: 432320 - DNA, 13 bp, Homo sapiens
ccaacattgcctt

SEQ ID NO: 432321 - DNA, 15 bp, Homo sapiens
ccaacatttcctcag

SEQ ID NO: 432322 - DNA, 18 bp, Homo sapiens
ccaaccacctctggccct

SEQ ID NO: 432323 - DNA, 15 bp, Homo sapiens
ccaaccagaataaaa

SEQ ID NO: 432324 - DNA, 14 bp, Homo sapiens
ccaaccagcttgtc

SEQ ID NO: 432325 - DNA, 21 bp, Homo sapiens
ccaacccaactgacttctgct

SEQ ID NO: 432326 - DNA, 22 bp, Homo sapiens
ccaacccaactgacttctgcta

SEQ ID NO: 432327 - DNA, 14 bp, Homo sapiens
ccaacccatgcatg

SEQ ID NO: 432328 - DNA, 15 bp, Homo sapiens
ccaacccatgccctg

SEQ ID NO: 432329 - DNA, 19 bp, Homo sapiens
ccaacccccaccccacact

SEQ ID NO: 432330 - DNA, 20 bp, Homo sapiens
ccaacccccaccccacactt

SEQ ID NO: 432331 - DNA, 14 bp, Homo sapiens
ccaaccctcagagc

SEQ ID NO: 432332 - DNA, 16 bp, Homo sapiens
ccaacctcaatgccct

SEQ ID NO: 432333 - DNA, 20 bp, Homo sapiens
ccaacctcaatgccctgcca

SEQ ID NO: 432334 - DNA, 21 bp, Homo sapiens
ccaacctcaatgccctgccat

SEQ ID NO: 432335 - DNA, 12 bp, Homo sapiens
ccaacctcagca

SEQ ID NO: 432336 - DNA, 18 bp, Homo sapiens
ccaacctgatgccccttc

SEQ ID NO: 432337 - DNA, 20 bp, Homo sapiens
ccaacctgatgccccttccc

SEQ ID NO: 432338 - DNA, 18 bp, Homo sapiens
ccaacctgcctgtgcatg

SEQ ID NO: 432339 - DNA, 12 bp, Homo sapiens
ccaacctgctga

SEQ ID NO: 432340 - DNA, 19 bp, Homo sapiens
ccaacgaaaagcacatcca

SEQ ID NO: 432341 - DNA, 17 bp, Homo sapiens
ccaacgtggacctgcct

SEQ ID NO: 432342 - DNA, 15 bp, Homo sapiens
ccaactaagccctcg

SEQ ID NO: 432343 - DNA, 16 bp, Homo sapiens
ccaactcactgtgctc

SEQ ID NO: 432344 - DNA, 22 bp, Homo sapiens
ccaactcccgggttcacgccat

SEQ ID NO: 432345 - DNA, 21 bp, Homo sapiens
ccaactccgcccagcctctcc

SEQ ID NO: 432346 - DNA, 12 bp, Homo sapiens
ccaactccttcc

SEQ ID NO: 432347 - DNA, 13 bp, Homo sapiens
ccaactccttcct

SEQ ID NO: 432348 - DNA, 14 bp, Homo sapiens
ccaactccttcctc

SEQ ID NO: 432349 - DNA, 15 bp, Homo sapiens
ccaactcgggagcat

SEQ ID NO: 432350 - DNA, 14 bp, Homo sapiens
ccaactctccccag

SEQ ID NO: 432351 - DNA, 18 bp, Homo sapiens
ccaactctccccagtgcc

SEQ ID NO: 432352 - DNA, 22 bp, Homo sapiens
ccaactctccccagtgcctgcc

SEQ ID NO: 432353 - DNA, 23 bp, Homo sapiens
ccaactctccccagtgcctgcca

SEQ ID NO: 432354 - DNA, 16 bp, Homo sapiens
ccaactctctcctgta

SEQ ID NO: 432355 - DNA, 13 bp, Homo sapiens
ccaactctgcact

SEQ ID NO: 432356 - DNA, 14 bp, Homo sapiens
ccaactctgcactc

SEQ ID NO: 432357 - DNA, 15 bp, Homo sapiens
ccaactctgcactcc

SEQ ID NO: 432358 - DNA, 16 bp, Homo sapiens
ccaactctgcactcca

SEQ ID NO: 432359 - DNA, 20 bp, Homo sapiens
ccaactctgcactccatggc

SEQ ID NO: 432360 - DNA, 17 bp, Homo sapiens
ccaactgacttctgcta

SEQ ID NO: 432361 - DNA, 22 bp, Homo sapiens
ccaactgagaaaacgaaactgc

SEQ ID NO: 432362 - DNA, 17 bp, Homo sapiens
ccaactgcatccaggcc

SEQ ID NO: 432363 - DNA, 16 bp, Homo sapiens
ccaacttcaccacccc

SEQ ID NO: 432364 - DNA, 10 bp, Homo sapiens
ccaacttgag

SEQ ID NO: 432365 - DNA, 19 bp, Homo sapiens
ccaacttggttctgcttca

SEQ ID NO: 432366 - DNA, 11 bp, Homo sapiens
ccaacttgtaa

SEQ ID NO: 432367 - DNA, 12 bp, Homo sapiens
ccaactttcatt

SEQ ID NO: 432368 - DNA, 14 bp, Homo sapiens
ccaactttctgtaa

SEQ ID NO: 432369 - DNA, 22 bp, Homo sapiens
ccaactttgtggatgtcttcct

SEQ ID NO: 432370 - DNA, 11 bp, Homo sapiens
ccaacttttct

SEQ ID NO: 432371 - DNA, 18 bp, Homo sapiens
ccaagaaaatgaagggat

SEQ ID NO: 432372 - DNA, 11 bp, Homo sapiens
ccaagaaactt

SEQ ID NO: 432373 - DNA, 15 bp, Homo sapiens
ccaagaactctgggc

SEQ ID NO: 432374 - DNA, 16 bp, Homo sapiens
ccaagaactgaaaaca

SEQ ID NO: 432375 - DNA, 18 bp, Homo sapiens
ccaagaactgaaaacata

SEQ ID NO: 432376 - DNA, 14 bp, Homo sapiens
ccaagaactgcatg

SEQ ID NO: 432377 - DNA, 18 bp, Homo sapiens
ccaagaagccctccttgc

SEQ ID NO: 432378 - DNA, 18 bp, Homo sapiens
ccaagacagatgccccag

SEQ ID NO: 432379 - DNA, 23 bp, Homo sapiens
ccaagacagatgccccagagctg

SEQ ID NO: 432380 - DNA, 13 bp, Homo sapiens
ccaagacagtggc

SEQ ID NO: 432381 - DNA, 15 bp, Homo sapiens
ccaagacagtggcag

SEQ ID NO: 432382 - DNA, 18 bp, Homo sapiens
ccaagaggctagccccag

SEQ ID NO: 432383 - DNA, 19 bp, Homo sapiens
ccaagaggctagccccagg

SEQ ID NO: 432384 - DNA, 21 bp, Homo sapiens
ccaagaggctagccccagggt

SEQ ID NO: 432385 - DNA, 16 bp, Homo sapiens
ccaagataggggcaca

SEQ ID NO: 432386 - DNA, 16 bp, Homo sapiens
ccaagatgagctgcag

SEQ ID NO: 432387 - DNA, 22 bp, Homo sapiens
ccaagattctactcttgtcatt

SEQ ID NO: 432388 - DNA, 20 bp, Homo sapiens
ccaagcactcgagaccatcc

SEQ ID NO: 432389 - DNA, 21 bp, Homo sapiens
ccaagcactcgagaccatcct

SEQ ID NO: 432390 - DNA, 12 bp, Homo sapiens
ccaagcagccag

SEQ ID NO: 432391 - DNA, 13 bp, Homo sapiens
ccaagcatgcccc

SEQ ID NO: 432392 - DNA, 21 bp, Homo sapiens
ccaagccaaaaaccttagctc

SEQ ID NO: 432393 - DNA, 18 bp, Homo sapiens
ccaagccagggttccaga

SEQ ID NO: 432394 - DNA, 22 bp, Homo sapiens
ccaagccagggttccagacagg

SEQ ID NO: 432395 - DNA, 22 bp, Homo sapiens
ccaagcccacaggtgtccccag

SEQ ID NO: 432396 - DNA, 15 bp, Homo sapiens
ccaagcccaccctgg

SEQ ID NO: 432397 - DNA, 16 bp, Homo sapiens
ccaagcccaccctggg

SEQ ID NO: 432398 - DNA, 15 bp, Homo sapiens
ccaagccctgcccct

SEQ ID NO: 432399 - DNA, 15 bp, Homo sapiens
ccaagccggtgccca

SEQ ID NO: 432400 - DNA, 13 bp, Homo sapiens
ccaagccgtggct

SEQ ID NO: 432401 - DNA, 12 bp, Homo sapiens
ccaagccttggc

SEQ ID NO: 432402 - DNA, 18 bp, Homo sapiens
ccaagcgtggtcccgagg

SEQ ID NO: 432403 - DNA, 15 bp, Homo sapiens
ccaagctcagagcag

SEQ ID NO: 432404 - DNA, 20 bp, Homo sapiens
ccaagcttaaggagaggaga

SEQ ID NO: 432405 - DNA, 18 bp, Homo sapiens
ccaagcttaatagccctc

SEQ ID NO: 432406 - DNA, 19 bp, Homo sapiens
ccaagcttaatagccctcc

SEQ ID NO: 432407 - DNA, 20 bp, Homo sapiens
ccaagcttaatagccctccc

SEQ ID NO: 432408 - DNA, 21 bp, Homo sapiens
ccaagcttaatagccctcccc

SEQ ID NO: 432409 - DNA, 17 bp, Homo sapiens
ccaagcttcctttgttt

SEQ ID NO: 432410 - DNA, 15 bp, Homo sapiens
ccaagcttggcagcc

SEQ ID NO: 432411 - DNA, 17 bp, Homo sapiens
ccaagcttggcagccga

SEQ ID NO: 432412 - DNA, 19 bp, Homo sapiens
ccaagcttgtttccctgct

SEQ ID NO: 432413 - DNA, 23 bp, Homo sapiens
ccaagctttcttctacaaccaga

SEQ ID NO: 432414 - DNA, 18 bp, Homo sapiens
ccaaggaagaacaaatat

SEQ ID NO: 432415 - DNA, 21 bp, Homo sapiens
ccaaggacactgatgggtcct

SEQ ID NO: 432416 - DNA, 22 bp, Homo sapiens
ccaaggacactgatgggtcctg

SEQ ID NO: 432417 - DNA, 18 bp, Homo sapiens
ccaaggacccctcacctt

SEQ ID NO: 432418 - DNA, 13 bp, Homo sapiens
ccaaggagcccct

SEQ ID NO: 432419 - DNA, 21 bp, Homo sapiens
ccaaggaggcggccgctggcc

SEQ ID NO: 432420 - DNA, 17 bp, Homo sapiens
ccaaggaggtcccagga

SEQ ID NO: 432421 - DNA, 22 bp, Homo sapiens
ccaccccggctccccctgccag

SEQ ID NO: 432422 - DNA, 17 bp, Homo sapiens
ccaccccgggctctctg

SEQ ID NO: 432423 - DNA, 20 bp, Homo sapiens
ccaccccgggctctctgctg

SEQ ID NO: 432424 - DNA, 22 bp, Homo sapiens
ccaccccgtcccggccccgcgc

SEQ ID NO: 432425 - DNA, 17 bp, Homo sapiens
ccaccccgtgccacccg

SEQ ID NO: 432426 - DNA, 20 bp, Homo sapiens
ccacccctaccgatggtccc

SEQ ID NO: 432427 - DNA, 19 bp, Homo sapiens
ccacccctccctctgctct

SEQ ID NO: 432428 - DNA, 13 bp, Homo sapiens
ccacccctcctgg

SEQ ID NO: 432429 - DNA, 14 bp, Homo sapiens
ccacccctcctggg

SEQ ID NO: 432430 - DNA, 22 bp, Homo sapiens
ccacccctcctgggcccaggca

SEQ ID NO: 432431 - DNA, 14 bp, Homo sapiens
ccacccctgcccag

SEQ ID NO: 432432 - DNA, 15 bp, Homo sapiens
ccaccccttccccac

SEQ ID NO: 432433 - DNA, 12 bp, Homo sapiens
ccaccccttgcc

SEQ ID NO: 432434 - DNA, 17 bp, Homo sapiens
ccacccgccccagagac

SEQ ID NO: 432435 - DNA, 19 bp, Homo sapiens
ccacccgccccagagactg

SEQ ID NO: 432436 - DNA, 23 bp, Homo sapiens
ccacccgccccagagactgccca

SEQ ID NO: 432437 - DNA, 12 bp, Homo sapiens
ccacccgcccgc

SEQ ID NO: 432438 - DNA, 21 bp, Homo sapiens
ccacccgcccgcccccgccct

SEQ ID NO: 432439 - DNA, 17 bp, Homo sapiens
ccacccggatctccagg

SEQ ID NO: 432440 - DNA, 22 bp, Homo sapiens
ccacccggatctccaggcccag

SEQ ID NO: 432441 - DNA, 23 bp, Homo sapiens
ccacccggatctccaggcccagc

SEQ ID NO: 432442 - DNA, 19 bp, Homo sapiens
ccacccggccacagctgct

SEQ ID NO: 432443 - DNA, 19 bp, Homo sapiens
ccacccgtaggcagcctct

SEQ ID NO: 432444 - DNA, 15 bp, Homo sapiens
ccacccgtcttcaat

SEQ ID NO: 432445 - DNA, 15 bp, Homo sapiens
ccacccgtttccaag

SEQ ID NO: 432446 - DNA, 18 bp, Homo sapiens
ccaccctaactgagctgc

SEQ ID NO: 432447 - DNA, 20 bp, Homo sapiens
ccaccctaatttgcccttca

SEQ ID NO: 432448 - DNA, 12 bp, Homo sapiens
ccaccctacctg

SEQ ID NO: 432449 - DNA, 22 bp, Homo sapiens
ccaccctacctgttcagtgtcc

SEQ ID NO: 432450 - DNA, 17 bp, Homo sapiens
ccaccctcgtggacacc

SEQ ID NO: 432451 - DNA, 21 bp, Homo sapiens
ccaccctcgtggacacctgcc

SEQ ID NO: 432452 - DNA, 18 bp, Homo sapiens
ccaccctctgcagggcag

SEQ ID NO: 432453 - DNA, 19 bp, Homo sapiens
ccaccctctgcagggcagc

SEQ ID NO: 432454 - DNA, 21 bp, Homo sapiens
ccaccctctgcagggcagcct

SEQ ID NO: 432455 - DNA, 12 bp, Homo sapiens
ccaccctctggt

SEQ ID NO: 432456 - DNA, 12 bp, Homo sapiens
ccaccctgaggg

SEQ ID NO: 432457 - DNA, 13 bp, Homo sapiens
ccaccctgctcct

SEQ ID NO: 432458 - DNA, 17 bp, Homo sapiens
ccaccctgctcctcctg

SEQ ID NO: 432459 - DNA, 16 bp, Homo sapiens
ccaccctgctgccttc

SEQ ID NO: 432460 - DNA, 14 bp, Homo sapiens
ccacccttcagacc

SEQ ID NO: 432461 - DNA, 14 bp, Homo sapiens
ccacccttcccctc

SEQ ID NO: 432462 - DNA, 16 bp, Homo sapiens
ccacccttggcctgtc

SEQ ID NO: 432463 - DNA, 17 bp, Homo sapiens
ccacccttggcctgtct

SEQ ID NO: 432464 - DNA, 19 bp, Homo sapiens
ccacccttggcctgtctca

SEQ ID NO: 432465 - DNA, 16 bp, Homo sapiens
ccaccgaggttcccag

SEQ ID NO: 432466 - DNA, 22 bp, Homo sapiens
ccaccgaggttcccagggctgg

SEQ ID NO: 432467 - DNA, 14 bp, Homo sapiens
ccaccgatggagcc

SEQ ID NO: 432468 - DNA, 17 bp, Homo sapiens
ccaccgatggagccccc

SEQ ID NO: 432469 - DNA, 18 bp, Homo sapiens
ccaccgatggagccccca

SEQ ID NO: 432470 - DNA, 20 bp, Homo sapiens
ccaccgatggagcccccaga

SEQ ID NO: 432471 - DNA, 21 bp, Homo sapiens
ccaccgatggagcccccagat

SEQ ID NO: 432472 - DNA, 19 bp, Homo sapiens
ccaccgccctcctcgctgt

SEQ ID NO: 432473 - DNA, 21 bp, Homo sapiens
ccaccgccctcctcgctgtgc

SEQ ID NO: 432474 - DNA, 17 bp, Homo sapiens
ccaccgctccccagccc

SEQ ID NO: 432475 - DNA, 16 bp, Homo sapiens
ccaccgctgccagcac

SEQ ID NO: 432476 - DNA, 17 bp, Homo sapiens
ccaccggggcactggct

SEQ ID NO: 432477 - DNA, 23 bp, Homo sapiens
ccaccggggcactggctgctctg

SEQ ID NO: 432478 - DNA, 17 bp, Homo sapiens
ccaccggttgcttctgg

SEQ ID NO: 432479 - DNA, 20 bp, Homo sapiens
ccaccggttgcttctgggaa

SEQ ID NO: 432480 - DNA, 14 bp, Homo sapiens
ccaccgtgcccggc

SEQ ID NO: 432481 - DNA, 19 bp, Homo sapiens
ccacctaccttcaaagctg

SEQ ID NO: 432482 - DNA, 13 bp, Homo sapiens
ccacctatgcctg

SEQ ID NO: 432483 - DNA, 14 bp, Homo sapiens
ccacctatgcctgt

SEQ ID NO: 432484 - DNA, 15 bp, Homo sapiens
ccacctatgcctgtg

SEQ ID NO: 432485 - DNA, 18 bp, Homo sapiens
ccacctatgcctgtggtg

SEQ ID NO: 432486 - DNA, 19 bp, Homo sapiens
ccacctatgcctgtggtga

SEQ ID NO: 432487 - DNA, 20 bp, Homo sapiens
ccacctatgcctgtggtgaa

SEQ ID NO: 432488 - DNA, 15 bp, Homo sapiens
ccacctcactcctgt

SEQ ID NO: 432489 - DNA, 13 bp, Homo sapiens
ccacctccaccca

SEQ ID NO: 432490 - DNA, 14 bp, Homo sapiens
ccacctccaccccc

SEQ ID NO: 432491 - DNA, 12 bp, Homo sapiens
ccacctccagcc

SEQ ID NO: 432492 - DNA, 13 bp, Homo sapiens
ccacctccagccc

SEQ ID NO: 432493 - DNA, 17 bp, Homo sapiens
ccacctccagcccacag

SEQ ID NO: 432494 - DNA, 14 bp, Homo sapiens
ccacctccagtccc

SEQ ID NO: 432495 - DNA, 17 bp, Homo sapiens
ccacctccctgcccagg

SEQ ID NO: 432496 - DNA, 23 bp, Homo sapiens
ccacctcctagaggtgggcagct

SEQ ID NO: 432497 - DNA, 13 bp, Homo sapiens
ccacctcctccag

SEQ ID NO: 432498 - DNA, 14 bp, Homo sapiens
ccacctcctccagc

SEQ ID NO: 432499 - DNA, 14 bp, Homo sapiens
ccacctcctctctt

SEQ ID NO: 432500 - DNA, 21 bp, Homo sapiens
ccacctcgcggcgcagcccct

SEQ ID NO: 432501 - DNA, 23 bp, Homo sapiens
ccacctctcaatattcaataaag

SEQ ID NO: 432502 - DNA, 16 bp, Homo sapiens
ccacctctccaagtct

SEQ ID NO: 432503 - DNA, 23 bp, Homo sapiens
ccacctctccaagtctctctgtg

SEQ ID NO: 432504 - DNA, 14 bp, Homo sapiens
ccacctctctcctt

SEQ ID NO: 432505 - DNA, 13 bp, Homo sapiens
ccacctctgagga

SEQ ID NO: 432506 - DNA, 14 bp, Homo sapiens
ccacctctgctgcc

SEQ ID NO: 432507 - DNA, 18 bp, Homo sapiens
ccacctctggccctgttg

SEQ ID NO: 432508 - DNA, 16 bp, Homo sapiens
ccacctgaaagcctgt

SEQ ID NO: 432509 - DNA, 12 bp, Homo sapiens
ccacctgagctt

SEQ ID NO: 432510 - DNA, 20 bp, Homo sapiens
ccacctgagctttggacaca

SEQ ID NO: 432511 - DNA, 16 bp, Homo sapiens
ccacctgcagcccttt

SEQ ID NO: 432512 - DNA, 14 bp, Homo sapiens
ccacctgccactag

SEQ ID NO: 432513 - DNA, 23 bp, Homo sapiens
ccacctgccactaggctgggtgc

SEQ ID NO: 432514 - DNA, 14 bp, Homo sapiens
ccacctgcccaacc

SEQ ID NO: 432515 - DNA, 16 bp, Homo sapiens
ccacctgcccatcaca

SEQ ID NO: 432516 - DNA, 20 bp, Homo sapiens
ccacctgcccatcacagggt

SEQ ID NO: 432517 - DNA, 19 bp, Homo sapiens
ccacctgcctatccatcct

SEQ ID NO: 432518 - DNA, 22 bp, Homo sapiens
ccacctgcctcggcctcccaaa

SEQ ID NO: 432519 - DNA, 14 bp, Homo sapiens
ccacctgcggctcc

SEQ ID NO: 432520 - DNA, 19 bp, Homo sapiens
ccacctggatggatctgct

SEQ ID NO: 432521 - DNA, 12 bp, Homo sapiens
ccacctgggaga

SEQ ID NO: 432522 - DNA, 13 bp, Homo sapiens
ccacctgggccct

SEQ ID NO: 432523 - DNA, 16 bp, Homo sapiens
ccacctgggccctagg

SEQ ID NO: 432524 - DNA, 18 bp, Homo sapiens
ccacctgggccctaggca

SEQ ID NO: 432525 - DNA, 19 bp, Homo sapiens
ccacctgggccctaggcat

SEQ ID NO: 432526 - DNA, 17 bp, Homo sapiens
ccacctgggcctcccat

SEQ ID NO: 432527 - DNA, 13 bp, Homo sapiens
ccacctgggctgg

SEQ ID NO: 432528 - DNA, 12 bp, Homo sapiens
ccacctgtacat

SEQ ID NO: 432529 - DNA, 14 bp, Homo sapiens
ccacctgtcccacc

SEQ ID NO: 432530 - DNA, 20 bp, Homo sapiens
ccacctgtctcagcctccca

SEQ ID NO: 432531 - DNA, 12 bp, Homo sapiens
ccacctgtctgt

SEQ ID NO: 432532 - DNA, 12 bp, Homo sapiens
ccacctgtgctg

SEQ ID NO: 432533 - DNA, 16 bp, Homo sapiens
ccacctgtgctgctgc

SEQ ID NO: 432534 - DNA, 20 bp, Homo sapiens
ccaccttaaattaaacaatt

SEQ ID NO: 432535 - DNA, 21 bp, Homo sapiens
ccaccttctgtccccagccct

SEQ ID NO: 432536 - DNA, 14 bp, Homo sapiens
ccaccttgatccca

SEQ ID NO: 432537 - DNA, 19 bp, Homo sapiens
ccaccttgccaagctttct

SEQ ID NO: 432538 - DNA, 18 bp, Homo sapiens
ccaccttgttggagcctg

SEQ ID NO: 432539 - DNA, 19 bp, Homo sapiens
ccaccttgttggagcctgc

SEQ ID NO: 432540 - DNA, 22 bp, Homo sapiens
ccaccttgttggagcctgcagg

SEQ ID NO: 432541 - DNA, 22 bp, Homo sapiens
ccacctttgggatcagcctccg

SEQ ID NO: 432542 - DNA, 19 bp, Homo sapiens
ccacgaggaaaagaacaaa

SEQ ID NO: 432543 - DNA, 20 bp, Homo sapiens
ccacgaggtggtagctctga

SEQ ID NO: 432544 - DNA, 15 bp, Homo sapiens
ccacgagtcacctgc

SEQ ID NO: 432545 - DNA, 15 bp, Homo sapiens
ccacgcagagccccg

SEQ ID NO: 432546 - DNA, 16 bp, Homo sapiens
ccacgcagccaggaca

SEQ ID NO: 432547 - DNA, 22 bp, Homo sapiens
ccacgccccgtgtctggatgca

SEQ ID NO: 432548 - DNA, 19 bp, Homo sapiens
ccacgcccgactagcaggc

SEQ ID NO: 432549 - DNA, 20 bp, Homo sapiens
ccacgcccgactagcaggca

SEQ ID NO: 432550 - DNA, 12 bp, Homo sapiens
ccacgccctggg

SEQ ID NO: 432551 - DNA, 14 bp, Homo sapiens
ccacgctcctgccc

SEQ ID NO: 432552 - DNA, 21 bp, Homo sapiens
ccagagcgcccctccctagtg

SEQ ID NO: 432553 - DNA, 17 bp, Homo sapiens
ccagagctccgatgccc

SEQ ID NO: 432554 - DNA, 16 bp, Homo sapiens
ccagagctctggagcc

SEQ ID NO: 432555 - DNA, 14 bp, Homo sapiens
ccagagctggaagg

SEQ ID NO: 432556 - DNA, 19 bp, Homo sapiens
ccagagctggaaggcaggg

SEQ ID NO: 432557 - DNA, 23 bp, Homo sapiens
ccagagctggaaggcagggcaga

SEQ ID NO: 432558 - DNA, 20 bp, Homo sapiens
ccagagctgggtgagtgggg

SEQ ID NO: 432559 - DNA, 20 bp, Homo sapiens
ccagagctgggtggggacag

SEQ ID NO: 432560 - DNA, 24 bp, Homo sapiens
ccagagctgtttatggcctcagct

SEQ ID NO: 432561 - DNA, 21 bp, Homo sapiens
ccagagcttattggccactgg

SEQ ID NO: 432562 - DNA, 14 bp, Homo sapiens
ccagagcttttcag

SEQ ID NO: 432563 - DNA, 20 bp, Homo sapiens
ccagaggagctgggagccgg

SEQ ID NO: 432564 - DNA, 13 bp, Homo sapiens
ccagaggctccca

SEQ ID NO: 432565 - DNA, 13 bp, Homo sapiens
ccagaggctcctg

SEQ ID NO: 432566 - DNA, 15 bp, Homo sapiens
ccagaggctcctgga

SEQ ID NO: 432567 - DNA, 17 bp, Homo sapiens
ccagaggctcctggagc

SEQ ID NO: 432568 - DNA, 20 bp, Homo sapiens
ccagaggggcggggccagga

SEQ ID NO: 432569 - DNA, 21 bp, Homo sapiens
ccagaggggcggggccaggat

SEQ ID NO: 432570 - DNA, 17 bp, Homo sapiens
ccagaggtgagggaggc

SEQ ID NO: 432571 - DNA, 21 bp, Homo sapiens
ccagaggtgagggaggcctga

SEQ ID NO: 432572 - DNA, 22 bp, Homo sapiens
ccagaggtgggatcctccctca

SEQ ID NO: 432573 - DNA, 18 bp, Homo sapiens
ccagaggtggggaagaga

SEQ ID NO: 432574 - DNA, 24 bp, Homo sapiens
ccagaggtggggaagagagcctgc

SEQ ID NO: 432575 - DNA, 20 bp, Homo sapiens
ccagaggttatctgcctggc

SEQ ID NO: 432576 - DNA, 16 bp, Homo sapiens
ccagagtctgagcccc

SEQ ID NO: 432577 - DNA, 17 bp, Homo sapiens
ccagagtctgagccccc

SEQ ID NO: 432578 - DNA, 19 bp, Homo sapiens
ccagagtgaaagggctatg

SEQ ID NO: 432579 - DNA, 13 bp, Homo sapiens
ccagagtggcctg

SEQ ID NO: 432580 - DNA, 15 bp, Homo sapiens
ccagagtggcctggc

SEQ ID NO: 432581 - DNA, 14 bp, Homo sapiens
ccagataagaatgc

SEQ ID NO: 432582 - DNA, 13 bp, Homo sapiens
ccagataccagcc

SEQ ID NO: 432583 - DNA, 18 bp, Homo sapiens
ccagatagagctgggtgg

SEQ ID NO: 432584 - DNA, 22 bp, Homo sapiens
ccagatagagctgggtggcctg

SEQ ID NO: 432585 - DNA, 14 bp, Homo sapiens
ccagatagtcccag

SEQ ID NO: 432586 - DNA, 15 bp, Homo sapiens
ccagatagtcccagc

SEQ ID NO: 432587 - DNA, 19 bp, Homo sapiens
ccagatatgaacagggccc

SEQ ID NO: 432588 - DNA, 22 bp, Homo sapiens
ccagatatgaacagggcccagg

SEQ ID NO: 432589 - DNA, 19 bp, Homo sapiens
ccagatattcaagtcacct

SEQ ID NO: 432590 - DNA, 16 bp, Homo sapiens
ccagatccagactgta

SEQ ID NO: 432591 - DNA, 13 bp, Homo sapiens
ccagatcccagaa

SEQ ID NO: 432592 - DNA, 17 bp, Homo sapiens
ccagatcccagaaggac

SEQ ID NO: 432593 - DNA, 18 bp, Homo sapiens
ccagatcccagaaggacc

SEQ ID NO: 432594 - DNA, 20 bp, Homo sapiens
ccagatctgcctgggcctgt

SEQ ID NO: 432595 - DNA, 21 bp, Homo sapiens
ccagatctgcctgggcctgtg

SEQ ID NO: 432596 - DNA, 13 bp, Homo sapiens
ccagatctggtcc

SEQ ID NO: 432597 - DNA, 19 bp, Homo sapiens
ccagatctggtcccttgca

SEQ ID NO: 432598 - DNA, 15 bp, Homo sapiens
ccagatgacacccta

SEQ ID NO: 432599 - DNA, 15 bp, Homo sapiens
ccagatgagaagtta

SEQ ID NO: 432600 - DNA, 23 bp, Homo sapiens
ccagatgagaagttaagcagcct

SEQ ID NO: 432601 - DNA, 22 bp, Homo sapiens
ccagatgccctttggaaagcca

SEQ ID NO: 432602 - DNA, 19 bp, Homo sapiens
ccagatgcctcctctgtcc

SEQ ID NO: 432603 - DNA, 16 bp, Homo sapiens
ccagatgccttctaga

SEQ ID NO: 432604 - DNA, 23 bp, Homo sapiens
ccagatgccttctagattcactg

SEQ ID NO: 432605 - DNA, 13 bp, Homo sapiens
ccagatgctactg

SEQ ID NO: 432606 - DNA, 14 bp, Homo sapiens
ccagatggggcctc

SEQ ID NO: 432607 - DNA, 17 bp, Homo sapiens
ccagatgttgttcctgg

SEQ ID NO: 432608 - DNA, 20 bp, Homo sapiens
ccagatgttgttcctggcta

SEQ ID NO: 432609 - DNA, 13 bp, Homo sapiens
ccagattgacgac

SEQ ID NO: 432610 - DNA, 19 bp, Homo sapiens
ccagattgacgacaagtgc

SEQ ID NO: 432611 - DNA, 18 bp, Homo sapiens
ccagattttgggattaca

SEQ ID NO: 432612 - DNA, 17 bp, Homo sapiens
ccagcaaagttttcaga

SEQ ID NO: 432613 - DNA, 17 bp, Homo sapiens
ccagcaaccctcctatc

SEQ ID NO: 432614 - DNA, 15 bp, Homo sapiens
ccagcaaggcaggtt

SEQ ID NO: 432615 - DNA, 23 bp, Homo sapiens
ccagcaaggcaggttggatggga

SEQ ID NO: 432616 - DNA, 14 bp, Homo sapiens
ccagcaagtcccag

SEQ ID NO: 432617 - DNA, 17 bp, Homo sapiens
ccagcaatatgtaaata

SEQ ID NO: 432618 - DNA, 18 bp, Homo sapiens
ccagcaatgatgtccaga

SEQ ID NO: 432619 - DNA, 17 bp, Homo sapiens
ccagcacactgcttctc

SEQ ID NO: 432620 - DNA, 13 bp, Homo sapiens
ccagcacaggggc

SEQ ID NO: 432621 - DNA, 24 bp, Homo sapiens
ccagcacaggggccccagatctgc

SEQ ID NO: 432622 - DNA, 17 bp, Homo sapiens
ccagcacatttcctctc

SEQ ID NO: 432623 - DNA, 12 bp, Homo sapiens
ccagcacctgcc

SEQ ID NO: 432624 - DNA, 15 bp, Homo sapiens
ccagcactcccaggg

SEQ ID NO: 432625 - DNA, 16 bp, Homo sapiens
ccagcactttgggagg

SEQ ID NO: 432626 - DNA, 17 bp, Homo sapiens
ccagcactttgggaggc

SEQ ID NO: 432627 - DNA, 19 bp, Homo sapiens
ccagcactttgggaggcct

SEQ ID NO: 432628 - DNA, 11 bp, Homo sapiens
ccagcagcaca

SEQ ID NO: 432629 - DNA, 20 bp, Homo sapiens
ccagcagcacaattctgtcc

SEQ ID NO: 432630 - DNA, 22 bp, Homo sapiens
ccagcagcacaattctgtccct

SEQ ID NO: 432631 - DNA, 14 bp, Homo sapiens
ccagcagcggccca

SEQ ID NO: 432632 - DNA, 23 bp, Homo sapiens
ccagcagctgcgggtctgaagga

SEQ ID NO: 432633 - DNA, 16 bp, Homo sapiens
ccagcagcttggctga

SEQ ID NO: 432634 - DNA, 19 bp, Homo sapiens
ccagcagcttggctgagcc

SEQ ID NO: 432635 - DNA, 22 bp, Homo sapiens
ccagcagcttggctgagccccc

SEQ ID NO: 432636 - DNA, 19 bp, Homo sapiens
ccagcagggcgggccagga

SEQ ID NO: 432637 - DNA, 18 bp, Homo sapiens
ccagcaggggcagaagga

SEQ ID NO: 432638 - DNA, 17 bp, Homo sapiens
ccagcaggtgtggtggc

SEQ ID NO: 432639 - DNA, 18 bp, Homo sapiens
ccagcaggttctctcctg

SEQ ID NO: 432640 - DNA, 13 bp, Homo sapiens
ccagcagtcacag

SEQ ID NO: 432641 - DNA, 16 bp, Homo sapiens
ccagcagtcacaggtc

SEQ ID NO: 432642 - DNA, 14 bp, Homo sapiens
ccagcatcaccagc

SEQ ID NO: 432643 - DNA, 18 bp, Homo sapiens
ccagcatcaccagctaga

SEQ ID NO: 432644 - DNA, 13 bp, Homo sapiens
ccagcatccagcc

SEQ ID NO: 432645 - DNA, 15 bp, Homo sapiens
ccagcatccagcctg

SEQ ID NO: 432646 - DNA, 14 bp, Homo sapiens
ccagcatcccttct

SEQ ID NO: 432647 - DNA, 18 bp, Homo sapiens
ccagcatgtgtgtgtctc

SEQ ID NO: 432648 - DNA, 18 bp, Homo sapiens
ccagcattccagctctgc

SEQ ID NO: 432649 - DNA, 17 bp, Homo sapiens
ccagcatttgtccaccc

SEQ ID NO: 432650 - DNA, 17 bp, Homo sapiens
ccagccaaaccctgtct

SEQ ID NO: 432651 - DNA, 15 bp, Homo sapiens
ccagccaagtgcctt

SEQ ID NO: 432652 - DNA, 20 bp, Homo sapiens
ccagccaccaccactgtccc

SEQ ID NO: 432653 - DNA, 19 bp, Homo sapiens
ccagccacccggatctcca

SEQ ID NO: 432654 - DNA, 21 bp, Homo sapiens
ccagccacccggatctccagg

SEQ ID NO: 432655 - DNA, 22 bp, Homo sapiens
ccagccacccggatctccaggc

SEQ ID NO: 432656 - DNA, 18 bp, Homo sapiens
ccagccaccttcctgact

SEQ ID NO: 432657 - DNA, 21 bp, Homo sapiens
ccagccacggacgctggctcc

SEQ ID NO: 432658 - DNA, 14 bp, Homo sapiens
ccagccactcctca

SEQ ID NO: 432659 - DNA, 16 bp, Homo sapiens
ccagccagcaggttct

SEQ ID NO: 432660 - DNA, 12 bp, Homo sapiens
ccagccagccct

SEQ ID NO: 432661 - DNA, 15 bp, Homo sapiens
ccagccagcccttcc

SEQ ID NO: 432662 - DNA, 19 bp, Homo sapiens
ccagccagcccttcccagg

SEQ ID NO: 432663 - DNA, 15 bp, Homo sapiens
ccagcccaataaagg

SEQ ID NO: 432664 - DNA, 16 bp, Homo sapiens
ccagcccaccctgctc

SEQ ID NO: 432665 - DNA, 21 bp, Homo sapiens
ccagcccaccctgctcctcct

SEQ ID NO: 432666 - DNA, 12 bp, Homo sapiens
ccagcccactgg

SEQ ID NO: 432667 - DNA, 16 bp, Homo sapiens
ccagcccagctccact

SEQ ID NO: 432668 - DNA, 17 bp, Homo sapiens
ccagcccagctgctctg

SEQ ID NO: 432669 - DNA, 18 bp, Homo sapiens
ccagcccagctgctctgc

SEQ ID NO: 432670 - DNA, 23 bp, Homo sapiens
ccagcccagctgctctgcccaga

SEQ ID NO: 432671 - DNA, 18 bp, Homo sapiens
ccagcccagggttccccc

SEQ ID NO: 432672 - DNA, 19 bp, Homo sapiens
ccagcccatcttgcctcca

SEQ ID NO: 432673 - DNA, 17 bp, Homo sapiens
ccagccccacccaggag

SEQ ID NO: 432674 - DNA, 22 bp, Homo sapiens
ccagccccagcaagagcacaag

SEQ ID NO: 432675 - DNA, 16 bp, Homo sapiens
ccagccccccacccca

SEQ ID NO: 432676 - DNA, 18 bp, Homo sapiens
ccagccccccaccccaca

SEQ ID NO: 432677 - DNA, 11 bp, Homo sapiens
ccagcccctcc

SEQ ID NO: 432678 - DNA, 13 bp, Homo sapiens
ccagcccctccca

SEQ ID NO: 432679 - DNA, 14 bp, Homo sapiens
ccagcccctcccac

SEQ ID NO: 432680 - DNA, 15 bp, Homo sapiens
ccagcccctcccacc

SEQ ID NO: 432681 - DNA, 16 bp, Homo sapiens
ccagcccctcccacca

SEQ ID NO: 432682 - DNA, 20 bp, Homo sapiens
ccaggctagtccggacccac

SEQ ID NO: 432683 - DNA, 17 bp, Homo sapiens
ccaggctcacaactgtt

SEQ ID NO: 432684 - DNA, 20 bp, Homo sapiens
ccaggctccaggctgactgg

SEQ ID NO: 432685 - DNA, 15 bp, Homo sapiens
ccaggctcccctgcc

SEQ ID NO: 432686 - DNA, 17 bp, Homo sapiens
ccaggctcccctggtct

SEQ ID NO: 432687 - DNA, 14 bp, Homo sapiens
ccaggctctccctc

SEQ ID NO: 432688 - DNA, 13 bp, Homo sapiens
ccaggctctgctg

SEQ ID NO: 432689 - DNA, 14 bp, Homo sapiens
ccaggctctgctga

SEQ ID NO: 432690 - DNA, 16 bp, Homo sapiens
ccaggctctgctgact

SEQ ID NO: 432691 - DNA, 17 bp, Homo sapiens
ccaggctcttcctggac

SEQ ID NO: 432692 - DNA, 20 bp, Homo sapiens
ccaggctcttcctggacctg

SEQ ID NO: 432693 - DNA, 17 bp, Homo sapiens
ccaggctgactgggggc

SEQ ID NO: 432694 - DNA, 22 bp, Homo sapiens
ccaggctgactgggggcctctg

SEQ ID NO: 432695 - DNA, 13 bp, Homo sapiens
ccaggctgcactg

SEQ ID NO: 432696 - DNA, 18 bp, Homo sapiens
ccaggctgcactgcagtg

SEQ ID NO: 432697 - DNA, 19 bp, Homo sapiens
ccaggctgccaaggccaga

SEQ ID NO: 432698 - DNA, 19 bp, Homo sapiens
ccaggctgcggtgggcagc

SEQ ID NO: 432699 - DNA, 16 bp, Homo sapiens
ccaggctggagggcag

SEQ ID NO: 432700 - DNA, 15 bp, Homo sapiens
ccaggctggggcctg

SEQ ID NO: 432701 - DNA, 16 bp, Homo sapiens
ccaggctggggcctgg

SEQ ID NO: 432702 - DNA, 23 bp, Homo sapiens
ccaggctggggcctggcctattt

SEQ ID NO: 432703 - DNA, 22 bp, Homo sapiens
ccaggctgtaagcattctgagc

SEQ ID NO: 432704 - DNA, 21 bp, Homo sapiens
ccaggctgtgggcctcaagga

SEQ ID NO: 432705 - DNA, 22 bp, Homo sapiens
ccaggctgtgggcctcaaggac

SEQ ID NO: 432706 - DNA, 16 bp, Homo sapiens
ccaggcttcaccctga

SEQ ID NO: 432707 - DNA, 17 bp, Homo sapiens
ccagggaagagaaagtg

SEQ ID NO: 432708 - DNA, 18 bp, Homo sapiens
ccagggactgtacctgta

SEQ ID NO: 432709 - DNA, 21 bp, Homo sapiens
ccagggactgtacctgtagga

SEQ ID NO: 432710 - DNA, 18 bp, Homo sapiens
ccagggatggggccacag

SEQ ID NO: 432711 - DNA, 20 bp, Homo sapiens
ccagggatggggccacagcc

SEQ ID NO: 432712 - DNA, 21 bp, Homo sapiens
ccagggatggggccacagcca

SEQ ID NO: 432713 - DNA, 12 bp, Homo sapiens
ccagggcagtgc

SEQ ID NO: 432714 - DNA, 18 bp, Homo sapiens
ccagggcagtgtggtggg

SEQ ID NO: 432715 - DNA, 19 bp, Homo sapiens
ccagggccccagaacacag

SEQ ID NO: 432716 - DNA, 12 bp, Homo sapiens
ccagggccccca

SEQ ID NO: 432717 - DNA, 21 bp, Homo sapiens
ccagggcccccaccgaggttc

SEQ ID NO: 432718 - DNA, 21 bp, Homo sapiens
ccagggcccctcaccctgcct

SEQ ID NO: 432719 - DNA, 17 bp, Homo sapiens
ccagggcccgacctggg

SEQ ID NO: 432720 - DNA, 22 bp, Homo sapiens
ccagggcccgagcgcgtgcctt

SEQ ID NO: 432721 - DNA, 12 bp, Homo sapiens
ccagggcccggc

SEQ ID NO: 432722 - DNA, 16 bp, Homo sapiens
ccagggccctgctcag

SEQ ID NO: 432723 - DNA, 19 bp, Homo sapiens
ccagggccctgctcaggcc

SEQ ID NO: 432724 - DNA, 22 bp, Homo sapiens
ccagggccctgctcaggcctca

SEQ ID NO: 432725 - DNA, 17 bp, Homo sapiens
ccagggcctactgccac

SEQ ID NO: 432726 - DNA, 22 bp, Homo sapiens
ccagggcctactgccacccgct

SEQ ID NO: 432727 - DNA, 19 bp, Homo sapiens
ccagggcctgggggcagtg

SEQ ID NO: 432728 - DNA, 16 bp, Homo sapiens
ccagggctagtgactt

SEQ ID NO: 432729 - DNA, 17 bp, Homo sapiens
ccagggctcagctcctt

SEQ ID NO: 432730 - DNA, 22 bp, Homo sapiens
ccagggctcagctccttggttc

SEQ ID NO: 432731 - DNA, 23 bp, Homo sapiens
ccagggctccacgggggcctagt

SEQ ID NO: 432732 - DNA, 17 bp, Homo sapiens
ccagggctccctcctgg

SEQ ID NO: 432733 - DNA, 21 bp, Homo sapiens
ccagggctccctcctggagca

SEQ ID NO: 432734 - DNA, 17 bp, Homo sapiens
ccagggctggagacttc

SEQ ID NO: 432735 - DNA, 19 bp, Homo sapiens
ccagggctggagacttcct

SEQ ID NO: 432736 - DNA, 12 bp, Homo sapiens
ccagggctgtcc

SEQ ID NO: 432737 - DNA, 15 bp, Homo sapiens
ccagggctgtcctta

SEQ ID NO: 432738 - DNA, 21 bp, Homo sapiens
ccagggcttacctgtacactg

SEQ ID NO: 432739 - DNA, 23 bp, Homo sapiens
ccaggggcatgtattggcctgga

SEQ ID NO: 432740 - DNA, 23 bp, Homo sapiens
ccaggggctttggtggcccctcc

SEQ ID NO: 432741 - DNA, 12 bp, Homo sapiens
ccaggggtcagc

SEQ ID NO: 432742 - DNA, 17 bp, Homo sapiens
ccaggggtctccctgag

SEQ ID NO: 432743 - DNA, 20 bp, Homo sapiens
ccaggggtctccctgagcct

SEQ ID NO: 432744 - DNA, 13 bp, Homo sapiens
ccaggggtgggga

SEQ ID NO: 432745 - DNA, 20 bp, Homo sapiens
ccagggtagacttggagctg

SEQ ID NO: 432746 - DNA, 20 bp, Homo sapiens
ccagggtccgcaccagctgc

SEQ ID NO: 432747 - DNA, 23 bp, Homo sapiens
ccagggtccgcaccagctgctct

SEQ ID NO: 432748 - DNA, 24 bp, Homo sapiens
ccagggtccgcaccagctgctctg

SEQ ID NO: 432749 - DNA, 19 bp, Homo sapiens
ccagggtcctgtgcctgga

SEQ ID NO: 432750 - DNA, 14 bp, Homo sapiens
ccagggtcttgggc

SEQ ID NO: 432751 - DNA, 20 bp, Homo sapiens
ccagggtcttgggctactgg

SEQ ID NO: 432752 - DNA, 23 bp, Homo sapiens
ccagggtcttgggctactggcag

SEQ ID NO: 432753 - DNA, 20 bp, Homo sapiens
ccagggtctttactgggaag

SEQ ID NO: 432754 - DNA, 17 bp, Homo sapiens
ccagggtgcaggcgcgc

SEQ ID NO: 432755 - DNA, 18 bp, Homo sapiens
ccagggtgtgagggatgg

SEQ ID NO: 432756 - DNA, 22 bp, Homo sapiens
ccagggttaaagaaaggcagag

SEQ ID NO: 432757 - DNA, 14 bp, Homo sapiens
ccagggttccagac

SEQ ID NO: 432758 - DNA, 21 bp, Homo sapiens
ccaggtactgatcctgtttct

SEQ ID NO: 432759 - DNA, 22 bp, Homo sapiens
ccaggtcagctgttactttctt

SEQ ID NO: 432760 - DNA, 19 bp, Homo sapiens
ccaggtcctgtgagcaaag

SEQ ID NO: 432761 - DNA, 21 bp, Homo sapiens
ccaggtcgggctcagctctgg

SEQ ID NO: 432762 - DNA, 17 bp, Homo sapiens
ccaggtctcactgcttt

SEQ ID NO: 432763 - DNA, 22 bp, Homo sapiens
ccaggtgagtgtgagggcagca

SEQ ID NO: 432764 - DNA, 14 bp, Homo sapiens
ccaggtgccctgtg

SEQ ID NO: 432765 - DNA, 20 bp, Homo sapiens
ccaggtgctagggtgcctgc

SEQ ID NO: 432766 - DNA, 12 bp, Homo sapiens
ccaggtggctca

SEQ ID NO: 432767 - DNA, 13 bp, Homo sapiens
ccaggtgtttata

SEQ ID NO: 432768 - DNA, 19 bp, Homo sapiens
ccaggttccatccaccacc

SEQ ID NO: 432769 - DNA, 23 bp, Homo sapiens
ccaggttctggttagctcagccc

SEQ ID NO: 432770 - DNA, 16 bp, Homo sapiens
ccaggttgaaagacct

SEQ ID NO: 432771 - DNA, 14 bp, Homo sapiens
ccaggttgcagctg

SEQ ID NO: 432772 - DNA, 19 bp, Homo sapiens
ccaggttgcagctgctctt

SEQ ID NO: 432773 - DNA, 23 bp, Homo sapiens
ccaggttgcagctgctcttgcat

SEQ ID NO: 432774 - DNA, 18 bp, Homo sapiens
ccaggttttctgctctgt

SEQ ID NO: 432775 - DNA, 19 bp, Homo sapiens
ccagtaacgcgtcttcctg

SEQ ID NO: 432776 - DNA, 20 bp, Homo sapiens
ccagtaaggcagctctgtcg

SEQ ID NO: 432777 - DNA, 22 bp, Homo sapiens
ccagtacagagaaattctgtgg

SEQ ID NO: 432778 - DNA, 19 bp, Homo sapiens
ccagtagccattttgtaac

SEQ ID NO: 432779 - DNA, 22 bp, Homo sapiens
ccagtagctacggttccctgcc

SEQ ID NO: 432780 - DNA, 19 bp, Homo sapiens
ccagtaggttgaggacagg

SEQ ID NO: 432781 - DNA, 18 bp, Homo sapiens
ccagtataaaattacagt

SEQ ID NO: 432782 - DNA, 13 bp, Homo sapiens
ccagtattctcag

SEQ ID NO: 432783 - DNA, 14 bp, Homo sapiens
ccagtattcttgtc

SEQ ID NO: 432784 - DNA, 19 bp, Homo sapiens
ccagtattgaaaacttcaa

SEQ ID NO: 432785 - DNA, 18 bp, Homo sapiens
ccagtcacagccatttca

SEQ ID NO: 432786 - DNA, 21 bp, Homo sapiens
ccagtccaaatgtcctccaga

SEQ ID NO: 432787 - DNA, 16 bp, Homo sapiens
ccagtccactggggag

SEQ ID NO: 432788 - DNA, 21 bp, Homo sapiens
ccagtccactggggagtgctg

SEQ ID NO: 432789 - DNA, 14 bp, Homo sapiens
ccagtccccctatc

SEQ ID NO: 432790 - DNA, 13 bp, Homo sapiens
ccagtccccggga

SEQ ID NO: 432791 - DNA, 15 bp, Homo sapiens
ccagtccccgtgccc

SEQ ID NO: 432792 - DNA, 22 bp, Homo sapiens
ccagtccccgtgccccgcctcc

SEQ ID NO: 432793 - DNA, 19 bp, Homo sapiens
ccagtcctcacatgcccgc

SEQ ID NO: 432794 - DNA, 22 bp, Homo sapiens
ccagtcctcacatgcccgctgt

SEQ ID NO: 432795 - DNA, 16 bp, Homo sapiens
ccagtcctccagacca

SEQ ID NO: 432796 - DNA, 22 bp, Homo sapiens
ccagtcctctcccaagtccaca

SEQ ID NO: 432797 - DNA, 21 bp, Homo sapiens
ccagtcctgcctggccaggca

SEQ ID NO: 432798 - DNA, 12 bp, Homo sapiens
ccagtcctgctc

SEQ ID NO: 432799 - DNA, 15 bp, Homo sapiens
ccagtcctgctctct

SEQ ID NO: 432800 - DNA, 21 bp, Homo sapiens
ccagtccttagcaaggggctc

SEQ ID NO: 432801 - DNA, 20 bp, Homo sapiens
ccagtcgccctctgtgccta

SEQ ID NO: 432802 - DNA, 14 bp, Homo sapiens
ccagtctcacccac

SEQ ID NO: 432803 - DNA, 19 bp, Homo sapiens
ccagtctcacccactagga

SEQ ID NO: 432804 - DNA, 16 bp, Homo sapiens
ccagtctccaccagga

SEQ ID NO: 432805 - DNA, 19 bp, Homo sapiens
ccagtctcccaggccccct

SEQ ID NO: 432806 - DNA, 21 bp, Homo sapiens
ccagtctcccaggccccctgc

SEQ ID NO: 432807 - DNA, 22 bp, Homo sapiens
ccagtctcccaggccccctgca

SEQ ID NO: 432808 - DNA, 18 bp, Homo sapiens
ccagtctgctgccctcca

SEQ ID NO: 432809 - DNA, 14 bp, Homo sapiens
ccagtctgtctact

SEQ ID NO: 432810 - DNA, 18 bp, Homo sapiens
cccaactccgcccagcct

SEQ ID NO: 432811 - DNA, 20 bp, Homo sapiens
cccaactccttcctctttgc

SEQ ID NO: 432812 - DNA, 15 bp, Homo sapiens
cccaactctccccag

SEQ ID NO: 432813 - DNA, 17 bp, Homo sapiens
cccaactctccccagtg

SEQ ID NO: 432814 - DNA, 19 bp, Homo sapiens
cccaactctccccagtgcc

SEQ ID NO: 432815 - DNA, 22 bp, Homo sapiens
cccaactctccccagtgcctgc

SEQ ID NO: 432816 - DNA, 16 bp, Homo sapiens
cccaacttcaccaccc

SEQ ID NO: 432817 - DNA, 14 bp, Homo sapiens
cccaagaacagcag

SEQ ID NO: 432818 - DNA, 23 bp, Homo sapiens
cccaagaggtcaaggctgcagtg

SEQ ID NO: 432819 - DNA, 19 bp, Homo sapiens
cccaagataggggcacact

SEQ ID NO: 432820 - DNA, 23 bp, Homo sapiens
cccaagcccgacttgctgttttg

SEQ ID NO: 432821 - DNA, 21 bp, Homo sapiens
cccaagcgttcctggccttct

SEQ ID NO: 432822 - DNA, 22 bp, Homo sapiens
cccaagctggagtgcagtggtg

SEQ ID NO: 432823 - DNA, 22 bp, Homo sapiens
cccaagcttggcagccgagctc

SEQ ID NO: 432824 - DNA, 14 bp, Homo sapiens
cccaaggagctgat

SEQ ID NO: 432825 - DNA, 22 bp, Homo sapiens
cccaaggcaaggggtgcctggg

SEQ ID NO: 432826 - DNA, 12 bp, Homo sapiens
cccaagggaggc

SEQ ID NO: 432827 - DNA, 12 bp, Homo sapiens
cccaaggggcag

SEQ ID NO: 432828 - DNA, 19 bp, Homo sapiens
cccaagggtgccctttggg

SEQ ID NO: 432829 - DNA, 11 bp, Homo sapiens
cccaagtccac

SEQ ID NO: 432830 - DNA, 14 bp, Homo sapiens
cccaagtccacccc

SEQ ID NO: 432831 - DNA, 21 bp, Homo sapiens
cccaagtccaggtcgggctca

SEQ ID NO: 432832 - DNA, 20 bp, Homo sapiens
cccaagtggtttccacatgc

SEQ ID NO: 432833 - DNA, 21 bp, Homo sapiens
cccaagtggtttccacatgct

SEQ ID NO: 432834 - DNA, 24 bp, Homo sapiens
cccaagtggtttccacatgctctg

SEQ ID NO: 432835 - DNA, 11 bp, Homo sapiens
cccaataaagc

SEQ ID NO: 432836 - DNA, 23 bp, Homo sapiens
cccaataaagcgaatggaccatc

SEQ ID NO: 432837 - DNA, 16 bp, Homo sapiens
cccaataaagctggac

SEQ ID NO: 432838 - DNA, 14 bp, Homo sapiens
cccaataaagtcct

SEQ ID NO: 432839 - DNA, 19 bp, Homo sapiens
cccaataaagtcctcttcc

SEQ ID NO: 432840 - DNA, 11 bp, Homo sapiens
cccaatattat

SEQ ID NO: 432841 - DNA, 21 bp, Homo sapiens
cccaatcacgagatcttcctt

SEQ ID NO: 432842 - DNA, 15 bp, Homo sapiens
cccaatcagcttttg

SEQ ID NO: 432843 - DNA, 22 bp, Homo sapiens
cccaatcagcttttgttctaga

SEQ ID NO: 432844 - DNA, 23 bp, Homo sapiens
cccaatcagcttttgttctagac

SEQ ID NO: 432845 - DNA, 13 bp, Homo sapiens
cccaatctttcta

SEQ ID NO: 432846 - DNA, 22 bp, Homo sapiens
cccaatgctttgggaggccaag

SEQ ID NO: 432847 - DNA, 18 bp, Homo sapiens
cccaattaaacccagaac

SEQ ID NO: 432848 - DNA, 20 bp, Homo sapiens
cccaattttaaaaaataaca

SEQ ID NO: 432849 - DNA, 21 bp, Homo sapiens
cccaattttaaaaaataacat

SEQ ID NO: 432850 - DNA, 20 bp, Homo sapiens
cccacaaactgcctgttaag

SEQ ID NO: 432851 - DNA, 22 bp, Homo sapiens
cccacaaagccttatcaagtgt

SEQ ID NO: 432852 - DNA, 16 bp, Homo sapiens
cccacaagctgcctct

SEQ ID NO: 432853 - DNA, 18 bp, Homo sapiens
cccacaatggctgggagg

SEQ ID NO: 432854 - DNA, 14 bp, Homo sapiens
cccacacaccccaa

SEQ ID NO: 432855 - DNA, 13 bp, Homo sapiens
cccacacaggcct

SEQ ID NO: 432856 - DNA, 16 bp, Homo sapiens
cccacaccaccgccct

SEQ ID NO: 432857 - DNA, 17 bp, Homo sapiens
cccacaccccagcccac

SEQ ID NO: 432858 - DNA, 21 bp, Homo sapiens
cccacacgccggggctggccc

SEQ ID NO: 432859 - DNA, 18 bp, Homo sapiens
cccacagctacctgagac

SEQ ID NO: 432860 - DNA, 18 bp, Homo sapiens
cccacagcttcctgaggg

SEQ ID NO: 432861 - DNA, 13 bp, Homo sapiens
cccacagcttggg

SEQ ID NO: 432862 - DNA, 22 bp, Homo sapiens
cccacaggaggcaagcaagctc

SEQ ID NO: 432863 - DNA, 21 bp, Homo sapiens
cccacaggccacacgctgccc

SEQ ID NO: 432864 - DNA, 17 bp, Homo sapiens
cccacagggcctgactt

SEQ ID NO: 432865 - DNA, 18 bp, Homo sapiens
cccacagggcctgacttt

SEQ ID NO: 432866 - DNA, 21 bp, Homo sapiens
cccacagtcctcacagcctct

SEQ ID NO: 432867 - DNA, 23 bp, Homo sapiens
cccacatacgtgagggggagctg

SEQ ID NO: 432868 - DNA, 14 bp, Homo sapiens
cccacatccagtgg

SEQ ID NO: 432869 - DNA, 16 bp, Homo sapiens
cccacatcccaggctt

SEQ ID NO: 432870 - DNA, 14 bp, Homo sapiens
cccacattccgaca

SEQ ID NO: 432871 - DNA, 15 bp, Homo sapiens
cccacattgcccaca

SEQ ID NO: 432872 - DNA, 17 bp, Homo sapiens
cccaccaaatgcctctg

SEQ ID NO: 432873 - DNA, 21 bp, Homo sapiens
cccaccaaatgcctctgcctt

SEQ ID NO: 432874 - DNA, 14 bp, Homo sapiens
cccaccaactctgc

SEQ ID NO: 432875 - DNA, 15 bp, Homo sapiens
cccaccaactctgca

SEQ ID NO: 432876 - DNA, 17 bp, Homo sapiens
cccaccaactctgcact

SEQ ID NO: 432877 - DNA, 18 bp, Homo sapiens
cccaccaactctgcactc

SEQ ID NO: 432878 - DNA, 20 bp, Homo sapiens
cccaccacaactaacaatgc

SEQ ID NO: 432879 - DNA, 12 bp, Homo sapiens
cccaccagcagc

SEQ ID NO: 432880 - DNA, 18 bp, Homo sapiens
cccaccagtctcacccac

SEQ ID NO: 432881 - DNA, 19 bp, Homo sapiens
cccaccagtctcacccact

SEQ ID NO: 432882 - DNA, 14 bp, Homo sapiens
cccaccagtgcctt

SEQ ID NO: 432883 - DNA, 21 bp, Homo sapiens
cccaccattccacatccccac

SEQ ID NO: 432884 - DNA, 17 bp, Homo sapiens
cccaccattctacctga

SEQ ID NO: 432885 - DNA, 22 bp, Homo sapiens
cccacccaagcttggcagccga

SEQ ID NO: 432886 - DNA, 13 bp, Homo sapiens
cccacccacaccc

SEQ ID NO: 432887 - DNA, 13 bp, Homo sapiens
cccacccacccct

SEQ ID NO: 432888 - DNA, 21 bp, Homo sapiens
cccacccagcacccagcaact

SEQ ID NO: 432889 - DNA, 13 bp, Homo sapiens
cccacccagggcc

SEQ ID NO: 432890 - DNA, 19 bp, Homo sapiens
cccacccagggcccggcac

SEQ ID NO: 432891 - DNA, 22 bp, Homo sapiens
cccacccatcttcctgctgctg

SEQ ID NO: 432892 - DNA, 23 bp, Homo sapiens
cccaccccaactctccccagtgc

SEQ ID NO: 432893 - DNA, 24 bp, Homo sapiens
cccacccccaaagacctgcctgtg

SEQ ID NO: 432894 - DNA, 18 bp, Homo sapiens
cccacccccgggtgcctg

SEQ ID NO: 432895 - DNA, 16 bp, Homo sapiens
cccaccccgctgcctg

SEQ ID NO: 432896 - DNA, 22 bp, Homo sapiens
cccaccccgctgcctggcgggc

SEQ ID NO: 432897 - DNA, 18 bp, Homo sapiens
cccacccctcttccccct

SEQ ID NO: 432898 - DNA, 22 bp, Homo sapiens
cccacccctcttcccccttccc

SEQ ID NO: 432899 - DNA, 13 bp, Homo sapiens
cccacccctgccc

SEQ ID NO: 432900 - DNA, 13 bp, Homo sapiens
cccacccctgctg

SEQ ID NO: 432901 - DNA, 13 bp, Homo sapiens
cccaccccttccc

SEQ ID NO: 432902 - DNA, 15 bp, Homo sapiens
cccaccccttcccca

SEQ ID NO: 432903 - DNA, 17 bp, Homo sapiens
cccaccccttccccact

SEQ ID NO: 432904 - DNA, 22 bp, Homo sapiens
cccaccccttccccactgcctg

SEQ ID NO: 432905 - DNA, 15 bp, Homo sapiens
cccacccgccccaga

SEQ ID NO: 432906 - DNA, 19 bp, Homo sapiens
cccacccggccacagctgc

SEQ ID NO: 432907 - DNA, 21 bp, Homo sapiens
cccacccgtcttcaatctctg

SEQ ID NO: 432908 - DNA, 21 bp, Homo sapiens
cccaccctcaaaccctgtggg

SEQ ID NO: 432909 - DNA, 20 bp, Homo sapiens
cccaccctcgtggacacctg

SEQ ID NO: 432910 - DNA, 13 bp, Homo sapiens
cccaccctgggcc

SEQ ID NO: 432911 - DNA, 14 bp, Homo sapiens
cccaccctgggcct

SEQ ID NO: 432912 - DNA, 19 bp, Homo sapiens
cccaccctgggcctcccgt

SEQ ID NO: 432913 - DNA, 14 bp, Homo sapiens
cccacccttctccc

SEQ ID NO: 432914 - DNA, 21 bp, Homo sapiens
cccaccgatggagcccccaga

SEQ ID NO: 432915 - DNA, 22 bp, Homo sapiens
cccaccgtaaagtgagcatgct

SEQ ID NO: 432916 - DNA, 13 bp, Homo sapiens
cccacctcacccc

SEQ ID NO: 432917 - DNA, 13 bp, Homo sapiens
cccacctcagcct

SEQ ID NO: 432918 - DNA, 20 bp, Homo sapiens
cccacctcatgcctggcccc

SEQ ID NO: 432919 - DNA, 12 bp, Homo sapiens
cccacctccacc

SEQ ID NO: 432920 - DNA, 17 bp, Homo sapiens
cccacctccacccagcc

SEQ ID NO: 432921 - DNA, 18 bp, Homo sapiens
cccacctccacccagccc

SEQ ID NO: 432922 - DNA, 21 bp, Homo sapiens
cccacctccacccagcccctg

SEQ ID NO: 432923 - DNA, 13 bp, Homo sapiens
cccacctccagcc

SEQ ID NO: 432924 - DNA, 14 bp, Homo sapiens
cccacctccagccc

SEQ ID NO: 432925 - DNA, 16 bp, Homo sapiens
cccacctctgaggact

SEQ ID NO: 432926 - DNA, 13 bp, Homo sapiens
cccacctctgctg

SEQ ID NO: 432927 - DNA, 17 bp, Homo sapiens
cccacctctgctgccca

SEQ ID NO: 432928 - DNA, 18 bp, Homo sapiens
cccacctctgctgcccac

SEQ ID NO: 432929 - DNA, 19 bp, Homo sapiens
cccacctctgctgcccacg

SEQ ID NO: 432930 - DNA, 22 bp, Homo sapiens
cccacctctgctgcccacggcc

SEQ ID NO: 432931 - DNA, 23 bp, Homo sapiens
cccacctctgctgcccacggcca

SEQ ID NO: 432932 - DNA, 17 bp, Homo sapiens
cccacctgagctttgga

SEQ ID NO: 432933 - DNA, 23 bp, Homo sapiens
cccacctgccactaggctgggtg

SEQ ID NO: 432934 - DNA, 13 bp, Homo sapiens
cccacctgcccat

SEQ ID NO: 432935 - DNA, 21 bp, Homo sapiens
cccacctgggccctaggcata

SEQ ID NO: 432936 - DNA, 14 bp, Homo sapiens
cccacctgggctgg

SEQ ID NO: 432937 - DNA, 17 bp, Homo sapiens
cccaccttcccccaact

SEQ ID NO: 432938 - DNA, 19 bp, Homo sapiens
cccacctttgggatcagcc

SEQ ID NO: 432939 - DNA, 20 bp, Homo sapiens
cccaggctggagtgcaatga

SEQ ID NO: 432940 - DNA, 23 bp, Homo sapiens
cccagggcagggtgggcagccta

SEQ ID NO: 432941 - DNA, 11 bp, Homo sapiens
cccagggcccc

SEQ ID NO: 432942 - DNA, 14 bp, Homo sapiens
cccagggcccctcc

SEQ ID NO: 432943 - DNA, 20 bp, Homo sapiens
cccagggcccctccctctgc

SEQ ID NO: 432944 - DNA, 22 bp, Homo sapiens
cccagggcccctccctctgccc

SEQ ID NO: 432945 - DNA, 19 bp, Homo sapiens
cccagggccctgctcaggc

SEQ ID NO: 432946 - DNA, 14 bp, Homo sapiens
cccagggcctgggg

SEQ ID NO: 432947 - DNA, 18 bp, Homo sapiens
cccagggcctgggggcag

SEQ ID NO: 432948 - DNA, 19 bp, Homo sapiens
cccagggctccctcctgga

SEQ ID NO: 432949 - DNA, 22 bp, Homo sapiens
cccagggctccctcctggagca

SEQ ID NO: 432950 - DNA, 14 bp, Homo sapiens
cccagggctggaga

SEQ ID NO: 432951 - DNA, 20 bp, Homo sapiens
cccaggggcacacttcccct

SEQ ID NO: 432952 - DNA, 15 bp, Homo sapiens
cccaggggtcagcag

SEQ ID NO: 432953 - DNA, 16 bp, Homo sapiens
cccaggggtcccagcc

SEQ ID NO: 432954 - DNA, 14 bp, Homo sapiens
cccaggggtctccc

SEQ ID NO: 432955 - DNA, 21 bp, Homo sapiens
cccaggggtctccctgagcct

SEQ ID NO: 432956 - DNA, 17 bp, Homo sapiens
cccagggtcctgtgcct

SEQ ID NO: 432957 - DNA, 18 bp, Homo sapiens
cccagggtcttccctacc

SEQ ID NO: 432958 - DNA, 19 bp, Homo sapiens
cccagggtgagcagggccc

SEQ ID NO: 432959 - DNA, 17 bp, Homo sapiens
cccaggtgccaccaata

SEQ ID NO: 432960 - DNA, 19 bp, Homo sapiens
cccaggtgccaccaataaa

SEQ ID NO: 432961 - DNA, 21 bp, Homo sapiens
cccaggtgccaccaataaaaa

SEQ ID NO: 432962 - DNA, 22 bp, Homo sapiens
cccaggtgctggaggcagactc

SEQ ID NO: 432963 - DNA, 16 bp, Homo sapiens
cccagtacctccaagc

SEQ ID NO: 432964 - DNA, 20 bp, Homo sapiens
cccagtagctacggttccct

SEQ ID NO: 432965 - DNA, 22 bp, Homo sapiens
cccagtccactggggagtgctg

SEQ ID NO: 432966 - DNA, 14 bp, Homo sapiens
cccagtccccggga

SEQ ID NO: 432967 - DNA, 15 bp, Homo sapiens
cccagtcctctccca

SEQ ID NO: 432968 - DNA, 15 bp, Homo sapiens
cccagtctctggcag

SEQ ID NO: 432969 - DNA, 19 bp, Homo sapiens
cccagtgaaaactagagct

SEQ ID NO: 432970 - DNA, 18 bp, Homo sapiens
cccagtgacacttcagag

SEQ ID NO: 432971 - DNA, 23 bp, Homo sapiens
cccagtgatggcattactctgca

SEQ ID NO: 432972 - DNA, 15 bp, Homo sapiens
cccagtgcacccact

SEQ ID NO: 432973 - DNA, 19 bp, Homo sapiens
cccagtggcctcaaccctc

SEQ ID NO: 432974 - DNA, 14 bp, Homo sapiens
cccagtgtccccag

SEQ ID NO: 432975 - DNA, 16 bp, Homo sapiens
cccagtgtccccaggg

SEQ ID NO: 432976 - DNA, 16 bp, Homo sapiens
cccagtgttgtttgta

SEQ ID NO: 432977 - DNA, 17 bp, Homo sapiens
cccagtgttgtttgtaa

SEQ ID NO: 432978 - DNA, 14 bp, Homo sapiens
cccagttagcccgg

SEQ ID NO: 432979 - DNA, 14 bp, Homo sapiens
cccagttcatccca

SEQ ID NO: 432980 - DNA, 12 bp, Homo sapiens
cccagttcatgt

SEQ ID NO: 432981 - DNA, 16 bp, Homo sapiens
cccagttctctaggga

SEQ ID NO: 432982 - DNA, 23 bp, Homo sapiens
cccataatagttagccctcagtc

SEQ ID NO: 432983 - DNA, 19 bp, Homo sapiens
cccataattttcttcatgc

SEQ ID NO: 432984 - DNA, 17 bp, Homo sapiens
cccatagatcttctgaa

SEQ ID NO: 432985 - DNA, 16 bp, Homo sapiens
cccatagcttccatga

SEQ ID NO: 432986 - DNA, 18 bp, Homo sapiens
cccataggccacccccta

SEQ ID NO: 432987 - DNA, 12 bp, Homo sapiens
cccatatataaa

SEQ ID NO: 432988 - DNA, 16 bp, Homo sapiens
cccatatttgtgttca

SEQ ID NO: 432989 - DNA, 16 bp, Homo sapiens
cccatcatctctgcct

SEQ ID NO: 432990 - DNA, 13 bp, Homo sapiens
cccatccacagtt

SEQ ID NO: 432991 - DNA, 14 bp, Homo sapiens
cccatccagcatgt

SEQ ID NO: 432992 - DNA, 14 bp, Homo sapiens
cccatccatcagct

SEQ ID NO: 432993 - DNA, 17 bp, Homo sapiens
cccatccatcagctccc

SEQ ID NO: 432994 - DNA, 13 bp, Homo sapiens
cccatccccacca

SEQ ID NO: 432995 - DNA, 17 bp, Homo sapiens
cccatccctcggaccca

SEQ ID NO: 432996 - DNA, 14 bp, Homo sapiens
cccatccctgaaac

SEQ ID NO: 432997 - DNA, 16 bp, Homo sapiens
cccatccctgcttgcc

SEQ ID NO: 432998 - DNA, 19 bp, Homo sapiens
cccatcctaccaatgcatg

SEQ ID NO: 432999 - DNA, 21 bp, Homo sapiens
cccatcctaccaatgcatgca

SEQ ID NO: 433000 - DNA, 15 bp, Homo sapiens
cccatcctccagctt

SEQ ID NO: 433001 - DNA, 16 bp, Homo sapiens
cccatcctccagcttc

SEQ ID NO: 433002 - DNA, 18 bp, Homo sapiens
cccatccttcccgcagca

SEQ ID NO: 433003 - DNA, 18 bp, Homo sapiens
cccatcgtataaggaaat

SEQ ID NO: 433004 - DNA, 12 bp, Homo sapiens
cccatctcactt

SEQ ID NO: 433005 - DNA, 14 bp, Homo sapiens
cccatctcagcctc

SEQ ID NO: 433006 - DNA, 15 bp, Homo sapiens
cccatctcagcctcc

SEQ ID NO: 433007 - DNA, 17 bp, Homo sapiens
cccatctcagcctcctg

SEQ ID NO: 433008 - DNA, 23 bp, Homo sapiens
cccatctcaggtgccactccctg

SEQ ID NO: 433009 - DNA, 19 bp, Homo sapiens
cccatctccccaggcctcc

SEQ ID NO: 433010 - DNA, 15 bp, Homo sapiens
cccatctctgctgct

SEQ ID NO: 433011 - DNA, 13 bp, Homo sapiens
cccatgactgcac

SEQ ID NO: 433012 - DNA, 19 bp, Homo sapiens
cccatgactgcacccagct

SEQ ID NO: 433013 - DNA, 14 bp, Homo sapiens
cccatgactgcccc

SEQ ID NO: 433014 - DNA, 17 bp, Homo sapiens
cccatgactgccccttg

SEQ ID NO: 433015 - DNA, 24 bp, Homo sapiens
cccatgactgccccttgcttctca

SEQ ID NO: 433016 - DNA, 16 bp, Homo sapiens
cccatgagcagtccag

SEQ ID NO: 433017 - DNA, 13 bp, Homo sapiens
cccatgagcctgc

SEQ ID NO: 433018 - DNA, 14 bp, Homo sapiens
cccatgagcctgcc

SEQ ID NO: 433019 - DNA, 21 bp, Homo sapiens
cccatgagcctgcccgctgca

SEQ ID NO: 433020 - DNA, 20 bp, Homo sapiens
cccatgcatggcctcccagc

SEQ ID NO: 433021 - DNA, 14 bp, Homo sapiens
cccatgcccacctg

SEQ ID NO: 433022 - DNA, 21 bp, Homo sapiens
cccatgccctccgtcctggca

SEQ ID NO: 433023 - DNA, 12 bp, Homo sapiens
cccatgccctgc

SEQ ID NO: 433024 - DNA, 13 bp, Homo sapiens
cccatgccctgcc

SEQ ID NO: 433025 - DNA, 12 bp, Homo sapiens
cccatgcctgtc

SEQ ID NO: 433026 - DNA, 12 bp, Homo sapiens
cccatgctctgc

SEQ ID NO: 433027 - DNA, 14 bp, Homo sapiens
cccatgctctgccc

SEQ ID NO: 433028 - DNA, 12 bp, Homo sapiens
cccatgctgcct

SEQ ID NO: 433029 - DNA, 18 bp, Homo sapiens
cccatggatgtttcttct

SEQ ID NO: 433030 - DNA, 13 bp, Homo sapiens
cccatggcccagc

SEQ ID NO: 433031 - DNA, 15 bp, Homo sapiens
cccatggccccagct

SEQ ID NO: 433032 - DNA, 19 bp, Homo sapiens
cccatggccccagctggct

SEQ ID NO: 433033 - DNA, 16 bp, Homo sapiens
cccatgggcagaagat

SEQ ID NO: 433034 - DNA, 17 bp, Homo sapiens
cccatgggcagaagata

SEQ ID NO: 433035 - DNA, 17 bp, Homo sapiens
cccatggtaatgtaact

SEQ ID NO: 433036 - DNA, 15 bp, Homo sapiens
cccatgtaaatacca

SEQ ID NO: 433037 - DNA, 12 bp, Homo sapiens
cccatgtgcctg

SEQ ID NO: 433038 - DNA, 13 bp, Homo sapiens
cccatgtgcctgt

SEQ ID NO: 433039 - DNA, 15 bp, Homo sapiens
cccatgtggctgaag

SEQ ID NO: 433040 - DNA, 14 bp, Homo sapiens
cccatgtgtgagtg

SEQ ID NO: 433041 - DNA, 20 bp, Homo sapiens
cccatgtgtgagtgtgtgca

SEQ ID NO: 433042 - DNA, 20 bp, Homo sapiens
cccatgttgcatgcctatgt

SEQ ID NO: 433043 - DNA, 20 bp, Homo sapiens
cccatgtttaaactttgtgc

SEQ ID NO: 433044 - DNA, 24 bp, Homo sapiens
cccatgtttaaactttgtgccttt

SEQ ID NO: 433045 - DNA, 13 bp, Homo sapiens
cccattcagaact

SEQ ID NO: 433046 - DNA, 19 bp, Homo sapiens
cccattcagaactctcaga

SEQ ID NO: 433047 - DNA, 17 bp, Homo sapiens
cccattcgtctgtccca

SEQ ID NO: 433048 - DNA, 19 bp, Homo sapiens
cccattcgtctgtcccaga

SEQ ID NO: 433049 - DNA, 15 bp, Homo sapiens
cccattctagatcct

SEQ ID NO: 433050 - DNA, 13 bp, Homo sapiens
cccattctccctc

SEQ ID NO: 433051 - DNA, 19 bp, Homo sapiens
cccattggtctgcatgtct

SEQ ID NO: 433052 - DNA, 16 bp, Homo sapiens
cccattgtctcattgc

SEQ ID NO: 433053 - DNA, 22 bp, Homo sapiens
cccattgtgaatgttgtcctgt

SEQ ID NO: 433054 - DNA, 23 bp, Homo sapiens
cccattgtgaatgttgtcctgtg

SEQ ID NO: 433055 - DNA, 15 bp, Homo sapiens
cccattgtggctcct

SEQ ID NO: 433056 - DNA, 14 bp, Homo sapiens
cccatttcctcttc

SEQ ID NO: 433057 - DNA, 19 bp, Homo sapiens
cccatttcctcttccttct

SEQ ID NO: 433058 - DNA, 18 bp, Homo sapiens
cccatttctaaaggcctc

SEQ ID NO: 433059 - DNA, 21 bp, Homo sapiens
cccatttctaaaggcctcttc

SEQ ID NO: 433060 - DNA, 16 bp, Homo sapiens
cccatttctatttatt

SEQ ID NO: 433061 - DNA, 17 bp, Homo sapiens
cccatttctatttattt

SEQ ID NO: 433062 - DNA, 20 bp, Homo sapiens
cccatttctatttatttact

SEQ ID NO: 433063 - DNA, 15 bp, Homo sapiens
cccatttctcactga

SEQ ID NO: 433064 - DNA, 15 bp, Homo sapiens
cccatttgctccttt

SEQ ID NO: 433065 - DNA, 16 bp, Homo sapiens
cccatttgtgtttcag

SEQ ID NO: 433066 - DNA, 19 bp, Homo sapiens
ccccaaaaccacagccctg

SEQ ID NO: 433067 - DNA, 20 bp, Homo sapiens
ccccaaaaccacagccctgt

SEQ ID NO: 433068 - DNA, 22 bp, Homo sapiens
ccccaaaaccacagccctgtca

SEQ ID NO: 433069 - DNA, 15 bp, Homo sapiens
ccccaaacatagccc

SEQ ID NO: 433070 - DNA, 13 bp, Homo sapiens
ccccttcttgggc

SEQ ID NO: 433071 - DNA, 20 bp, Homo sapiens
ccccttcttgggccccagac

SEQ ID NO: 433072 - DNA, 17 bp, Homo sapiens
ccccttgaccccacacg

SEQ ID NO: 433073 - DNA, 18 bp, Homo sapiens
ccccttgcccgccagcca

SEQ ID NO: 433074 - DNA, 16 bp, Homo sapiens
ccccttgctcccttca

SEQ ID NO: 433075 - DNA, 22 bp, Homo sapiens
ccccttgctctcccctgccctg

SEQ ID NO: 433076 - DNA, 14 bp, Homo sapiens
ccccttggctggat

SEQ ID NO: 433077 - DNA, 13 bp, Homo sapiens
ccccttgggcggc

SEQ ID NO: 433078 - DNA, 15 bp, Homo sapiens
ccccttgtctgctgc

SEQ ID NO: 433079 - DNA, 24 bp, Homo sapiens
cccctttcagatgtcttctgcctg

SEQ ID NO: 433080 - DNA, 12 bp, Homo sapiens
cccctttcccat

SEQ ID NO: 433081 - DNA, 18 bp, Homo sapiens
cccctttcccatcacccc

SEQ ID NO: 433082 - DNA, 13 bp, Homo sapiens
cccctttgaccct

SEQ ID NO: 433083 - DNA, 15 bp, Homo sapiens
ccccttttgcctggc

SEQ ID NO: 433084 - DNA, 20 bp, Homo sapiens
ccccttttttgtcccccaac

SEQ ID NO: 433085 - DNA, 19 bp, Homo sapiens
cccgaaactccacccgttc

SEQ ID NO: 433086 - DNA, 23 bp, Homo sapiens
cccgaagccatcacttctccccg

SEQ ID NO: 433087 - DNA, 13 bp, Homo sapiens
cccgaatcctgag

SEQ ID NO: 433088 - DNA, 14 bp, Homo sapiens
cccgaatcctgagg

SEQ ID NO: 433089 - DNA, 15 bp, Homo sapiens
cccgacaccagccct

SEQ ID NO: 433090 - DNA, 14 bp, Homo sapiens
cccgacactgctgc

SEQ ID NO: 433091 - DNA, 19 bp, Homo sapiens
cccgacactgctgcaccag

SEQ ID NO: 433092 - DNA, 14 bp, Homo sapiens
cccgacagtggctc

SEQ ID NO: 433093 - DNA, 14 bp, Homo sapiens
cccgaccccgagtc

SEQ ID NO: 433094 - DNA, 18 bp, Homo sapiens
cccgacgccacagcccag

SEQ ID NO: 433095 - DNA, 15 bp, Homo sapiens
cccgactagcaggca

SEQ ID NO: 433096 - DNA, 21 bp, Homo sapiens
cccgagcccagctacattcct

SEQ ID NO: 433097 - DNA, 17 bp, Homo sapiens
cccgagccccctgtcct

SEQ ID NO: 433098 - DNA, 22 bp, Homo sapiens
cccgagccgagctctcctgggc

SEQ ID NO: 433099 - DNA, 19 bp, Homo sapiens
cccgagcgcgtgccttccc

SEQ ID NO: 433100 - DNA, 20 bp, Homo sapiens
cccgagctgggggccatgag

SEQ ID NO: 433101 - DNA, 22 bp, Homo sapiens
cccgagctggtgcattacagag

SEQ ID NO: 433102 - DNA, 16 bp, Homo sapiens
cccgaggcagcaacag

SEQ ID NO: 433103 - DNA, 19 bp, Homo sapiens
cccgaggcagcaacaggac

SEQ ID NO: 433104 - DNA, 22 bp, Homo sapiens
cccgaggcagcaacaggaccag

SEQ ID NO: 433105 - DNA, 12 bp, Homo sapiens
cccgcacagcag

SEQ ID NO: 433106 - DNA, 12 bp, Homo sapiens
cccgcagcacca

SEQ ID NO: 433107 - DNA, 13 bp, Homo sapiens
cccgcagcaccag

SEQ ID NO: 433108 - DNA, 15 bp, Homo sapiens
cccgcagcaccagcc

SEQ ID NO: 433109 - DNA, 14 bp, Homo sapiens
cccgcagtccccag

SEQ ID NO: 433110 - DNA, 19 bp, Homo sapiens
cccgcagtccccagccctt

SEQ ID NO: 433111 - DNA, 16 bp, Homo sapiens
cccgcatgcagcagct

SEQ ID NO: 433112 - DNA, 18 bp, Homo sapiens
cccgcatgctgcctgcct

SEQ ID NO: 433113 - DNA, 23 bp, Homo sapiens
cccgccacacgctcactccaggt

SEQ ID NO: 433114 - DNA, 19 bp, Homo sapiens
cccgccacggccaccctcc

SEQ ID NO: 433115 - DNA, 13 bp, Homo sapiens
cccgccagcctca

SEQ ID NO: 433116 - DNA, 12 bp, Homo sapiens
cccgcccaccag

SEQ ID NO: 433117 - DNA, 15 bp, Homo sapiens
cccgcccacctctgc

SEQ ID NO: 433118 - DNA, 17 bp, Homo sapiens
cccgcccacctctgctg

SEQ ID NO: 433119 - DNA, 13 bp, Homo sapiens
cccgcccacctgg

SEQ ID NO: 433120 - DNA, 16 bp, Homo sapiens
cccgcccactgtcctg

SEQ ID NO: 433121 - DNA, 15 bp, Homo sapiens
cccgccccacattcc

SEQ ID NO: 433122 - DNA, 19 bp, Homo sapiens
cccgccccacattccgaca

SEQ ID NO: 433123 - DNA, 12 bp, Homo sapiens
cccgccccagag

SEQ ID NO: 433124 - DNA, 15 bp, Homo sapiens
cccgccccagagctc

SEQ ID NO: 433125 - DNA, 14 bp, Homo sapiens
cccgccccccagag

SEQ ID NO: 433126 - DNA, 16 bp, Homo sapiens
cccgccccccagagcc

SEQ ID NO: 433127 - DNA, 14 bp, Homo sapiens
cccgccccctccct

SEQ ID NO: 433128 - DNA, 16 bp, Homo sapiens
cccgcccctcgctgct

SEQ ID NO: 433129 - DNA, 14 bp, Homo sapiens
cccgcccctgggga

SEQ ID NO: 433130 - DNA, 13 bp, Homo sapiens
cccgccctcaggc

SEQ ID NO: 433131 - DNA, 14 bp, Homo sapiens
cccgccctcctctg

SEQ ID NO: 433132 - DNA, 17 bp, Homo sapiens
cccgccctttccttgcc

SEQ ID NO: 433133 - DNA, 23 bp, Homo sapiens
cccgccggcaggggcccctcctc

SEQ ID NO: 433134 - DNA, 12 bp, Homo sapiens
cccgcctcagcc

SEQ ID NO: 433135 - DNA, 12 bp, Homo sapiens
cccgcctccact

SEQ ID NO: 433136 - DNA, 18 bp, Homo sapiens
cccgcctccctcccctgc

SEQ ID NO: 433137 - DNA, 12 bp, Homo sapiens
cccgccttccct

SEQ ID NO: 433138 - DNA, 23 bp, Homo sapiens
cccgccttcctcctccacagtgc

SEQ ID NO: 433139 - DNA, 13 bp, Homo sapiens
cccgcgatgccct

SEQ ID NO: 433140 - DNA, 15 bp, Homo sapiens
cccgcgttcaagact

SEQ ID NO: 433141 - DNA, 23 bp, Homo sapiens
cccgctcaacctctcagatccct

SEQ ID NO: 433142 - DNA, 14 bp, Homo sapiens
cccgctcagccctc

SEQ ID NO: 433143 - DNA, 20 bp, Homo sapiens
cccgctcatgggcccctctg

SEQ ID NO: 433144 - DNA, 19 bp, Homo sapiens
cccgctcccacagcttcct

SEQ ID NO: 433145 - DNA, 15 bp, Homo sapiens
cccgctctgccatca

SEQ ID NO: 433146 - DNA, 15 bp, Homo sapiens
cccgctgcctggcgg

SEQ ID NO: 433147 - DNA, 11 bp, Homo sapiens
cccgctgctgt

SEQ ID NO: 433148 - DNA, 21 bp, Homo sapiens
cccgctgctgtgctctgggga

SEQ ID NO: 433149 - DNA, 23 bp, Homo sapiens
cccgctgctgtgctctggggatt

SEQ ID NO: 433150 - DNA, 13 bp, Homo sapiens
cccgctggctggg

SEQ ID NO: 433151 - DNA, 19 bp, Homo sapiens
cccgctgtcagccattcct

SEQ ID NO: 433152 - DNA, 16 bp, Homo sapiens
cccgctgtcccagggg

SEQ ID NO: 433153 - DNA, 22 bp, Homo sapiens
cccgcttttgttcttccccaca

SEQ ID NO: 433154 - DNA, 18 bp, Homo sapiens
cccggagagggagtcagt

SEQ ID NO: 433155 - DNA, 16 bp, Homo sapiens
cccggagcacagccct

SEQ ID NO: 433156 - DNA, 17 bp, Homo sapiens
cccggagcacagccctg

SEQ ID NO: 433157 - DNA, 12 bp, Homo sapiens
cccggagctggg

SEQ ID NO: 433158 - DNA, 17 bp, Homo sapiens
cccggaggcgcccacct

SEQ ID NO: 433159 - DNA, 19 bp, Homo sapiens
cccggaggcgcccacctgc

SEQ ID NO: 433160 - DNA, 21 bp, Homo sapiens
cccggaggcgcccacctgccc

SEQ ID NO: 433161 - DNA, 22 bp, Homo sapiens
cccggaggcgcccacctgccca

SEQ ID NO: 433162 - DNA, 15 bp, Homo sapiens
cccggatctccaggc

SEQ ID NO: 433163 - DNA, 16 bp, Homo sapiens
cccggatctccaggcc

SEQ ID NO: 433164 - DNA, 13 bp, Homo sapiens
cccggcaggccct

SEQ ID NO: 433165 - DNA, 17 bp, Homo sapiens
cccggcaggccctgcag

SEQ ID NO: 433166 - DNA, 17 bp, Homo sapiens
cccggccacagctgctg

SEQ ID NO: 433167 - DNA, 19 bp, Homo sapiens
cccggccacagctgctgga

SEQ ID NO: 433168 - DNA, 18 bp, Homo sapiens
cccggccactccctgcca

SEQ ID NO: 433169 - DNA, 19 bp, Homo sapiens
cccggcccccgccctctgc

SEQ ID NO: 433170 - DNA, 13 bp, Homo sapiens
cccggccccgcgc

SEQ ID NO: 433171 - DNA, 12 bp, Homo sapiens
cccggccggaga

SEQ ID NO: 433172 - DNA, 14 bp, Homo sapiens
cccggcctccaggc

SEQ ID NO: 433173 - DNA, 15 bp, Homo sapiens
cccggcctccaggct

SEQ ID NO: 433174 - DNA, 17 bp, Homo sapiens
cccggcctcttccaccc

SEQ ID NO: 433175 - DNA, 19 bp, Homo sapiens
cccggcctcttccacccat

SEQ ID NO: 433176 - DNA, 18 bp, Homo sapiens
cccggcctgctcccagca

SEQ ID NO: 433177 - DNA, 19 bp, Homo sapiens
cccggctccccctgccagc

SEQ ID NO: 433178 - DNA, 20 bp, Homo sapiens
cccggctccccctgccagca

SEQ ID NO: 433179 - DNA, 22 bp, Homo sapiens
cccggctgacacctcccttcgt

SEQ ID NO: 433180 - DNA, 13 bp, Homo sapiens
cccggctgcctgc

SEQ ID NO: 433181 - DNA, 14 bp, Homo sapiens
cccggctgcctgcc

SEQ ID NO: 433182 - DNA, 13 bp, Homo sapiens
cccggctggactt

SEQ ID NO: 433183 - DNA, 18 bp, Homo sapiens
cccgggaccacagctgct

SEQ ID NO: 433184 - DNA, 20 bp, Homo sapiens
cccgggaggaacgtggttca

SEQ ID NO: 433185 - DNA, 14 bp, Homo sapiens
cccgggccacgccc

SEQ ID NO: 433186 - DNA, 20 bp, Homo sapiens
cccgggcccgttgaggatga

SEQ ID NO: 433187 - DNA, 13 bp, Homo sapiens
cccggggagtttc

SEQ ID NO: 433188 - DNA, 18 bp, Homo sapiens
cccggggcagagctcaga

SEQ ID NO: 433189 - DNA, 12 bp, Homo sapiens
cccggggcagct

SEQ ID NO: 433190 - DNA, 18 bp, Homo sapiens
cccggggcagggcagccg

SEQ ID NO: 433191 - DNA, 20 bp, Homo sapiens
cccggggcatggacagggcc

SEQ ID NO: 433192 - DNA, 16 bp, Homo sapiens
cccgggggtccccgga

SEQ ID NO: 433193 - DNA, 14 bp, Homo sapiens
cccgggtgcctgtg

SEQ ID NO: 433194 - DNA, 21 bp, Homo sapiens
cccgggttcacgccattctcc

SEQ ID NO: 433195 - DNA, 17 bp, Homo sapiens
cccggtcccaggccgca

SEQ ID NO: 433196 - DNA, 15 bp, Homo sapiens
cccggtttcagaagc

SEQ ID NO: 433197 - DNA, 21 bp, Homo sapiens
cccgtacctcttcccatgact

SEQ ID NO: 433198 - DNA, 18 bp, Homo sapiens
cccgtccacggctctagg

SEQ ID NO: 433199 - DNA, 19 bp, Homo sapiens
cccgtcccctgggccaccc

SEQ ID NO: 433200 - DNA, 14 bp, Homo sapiens
cccgtccgtccgcc

SEQ ID NO: 433201 - DNA, 18 bp, Homo sapiens
cccgtccgtccgcccgcc

SEQ ID NO: 433202 - DNA, 22 bp, Homo sapiens
ccctgcacccacccctgcccag

SEQ ID NO: 433203 - DNA, 12 bp, Homo sapiens
ccctgcaccctt

SEQ ID NO: 433204 - DNA, 15 bp, Homo sapiens
ccctgcaccttgggc

SEQ ID NO: 433205 - DNA, 19 bp, Homo sapiens
ccctgcaccttgggcacgg

SEQ ID NO: 433206 - DNA, 17 bp, Homo sapiens
ccctgcacttcagacac

SEQ ID NO: 433207 - DNA, 20 bp, Homo sapiens
ccctgcagagatgcggtggc

SEQ ID NO: 433208 - DNA, 13 bp, Homo sapiens
ccctgcagagcta

SEQ ID NO: 433209 - DNA, 21 bp, Homo sapiens
ccctgcagagctatggtgagg

SEQ ID NO: 433210 - DNA, 17 bp, Homo sapiens
ccctgcaggaggcctgg

SEQ ID NO: 433211 - DNA, 22 bp, Homo sapiens
ccctgcaggcggtatccagagg

SEQ ID NO: 433212 - DNA, 21 bp, Homo sapiens
ccctgcagtgttcgcttggct

SEQ ID NO: 433213 - DNA, 22 bp, Homo sapiens
ccctgccaactccatgaccagg

SEQ ID NO: 433214 - DNA, 18 bp, Homo sapiens
ccctgccaactttccaga

SEQ ID NO: 433215 - DNA, 17 bp, Homo sapiens
ccctgccaagcctggag

SEQ ID NO: 433216 - DNA, 17 bp, Homo sapiens
ccctgccaccgtcacac

SEQ ID NO: 433217 - DNA, 14 bp, Homo sapiens
ccctgccacctccc

SEQ ID NO: 433218 - DNA, 17 bp, Homo sapiens
ccctgccacctccctga

SEQ ID NO: 433219 - DNA, 17 bp, Homo sapiens
ccctgccacctcctgcc

SEQ ID NO: 433220 - DNA, 13 bp, Homo sapiens
ccctgccacctgt

SEQ ID NO: 433221 - DNA, 14 bp, Homo sapiens
ccctgccacctgtc

SEQ ID NO: 433222 - DNA, 18 bp, Homo sapiens
ccctgccacctgtctgtc

SEQ ID NO: 433223 - DNA, 16 bp, Homo sapiens
ccctgccaggctgtca

SEQ ID NO: 433224 - DNA, 21 bp, Homo sapiens
ccctgccaggctgtcagcgcc

SEQ ID NO: 433225 - DNA, 14 bp, Homo sapiens
ccctgccagtgaag

SEQ ID NO: 433226 - DNA, 20 bp, Homo sapiens
ccctgcccaagggcctccca

SEQ ID NO: 433227 - DNA, 22 bp, Homo sapiens
ccctgcccaagggcctcccacc

SEQ ID NO: 433228 - DNA, 20 bp, Homo sapiens
ccctgcccaggcagtctttg

SEQ ID NO: 433229 - DNA, 22 bp, Homo sapiens
ccctgcccaggccggccagcct

SEQ ID NO: 433230 - DNA, 18 bp, Homo sapiens
ccctgccccacacaggcc

SEQ ID NO: 433231 - DNA, 21 bp, Homo sapiens
ccctgccccagagaagcctca

SEQ ID NO: 433232 - DNA, 21 bp, Homo sapiens
ccctgcccccatctccccagg

SEQ ID NO: 433233 - DNA, 22 bp, Homo sapiens
ccctgcccccatctccccaggc

SEQ ID NO: 433234 - DNA, 23 bp, Homo sapiens
ccctgcccccatctccccaggcc

SEQ ID NO: 433235 - DNA, 14 bp, Homo sapiens
ccctgccccgcccc

SEQ ID NO: 433236 - DNA, 16 bp, Homo sapiens
ccctgccccgcccccc

SEQ ID NO: 433237 - DNA, 21 bp, Homo sapiens
ccctgccccgccccccagagc

SEQ ID NO: 433238 - DNA, 22 bp, Homo sapiens
ccctgccccgccccccagagcc

SEQ ID NO: 433239 - DNA, 19 bp, Homo sapiens
ccctgcccctcccttcaac

SEQ ID NO: 433240 - DNA, 18 bp, Homo sapiens
ccctgcccctcctgtaca

SEQ ID NO: 433241 - DNA, 12 bp, Homo sapiens
ccctgcccctgc

SEQ ID NO: 433242 - DNA, 18 bp, Homo sapiens
ccctgcccctgcccgaga

SEQ ID NO: 433243 - DNA, 18 bp, Homo sapiens
ccctgccccttctacact

SEQ ID NO: 433244 - DNA, 17 bp, Homo sapiens
ccctgccctcactccac

SEQ ID NO: 433245 - DNA, 21 bp, Homo sapiens
ccctgccctcactccactccc

SEQ ID NO: 433246 - DNA, 17 bp, Homo sapiens
ccctgccctgaggaagg

SEQ ID NO: 433247 - DNA, 11 bp, Homo sapiens
ccctgccctgc

SEQ ID NO: 433248 - DNA, 13 bp, Homo sapiens
ccctgccctgcac

SEQ ID NO: 433249 - DNA, 14 bp, Homo sapiens
ccctgccctgcacc

SEQ ID NO: 433250 - DNA, 18 bp, Homo sapiens
ccctgccctgccacctgt

SEQ ID NO: 433251 - DNA, 12 bp, Homo sapiens
ccctgccctggt

SEQ ID NO: 433252 - DNA, 14 bp, Homo sapiens
ccctgccctggtcc

SEQ ID NO: 433253 - DNA, 19 bp, Homo sapiens
ccctgcccttcagcatcct

SEQ ID NO: 433254 - DNA, 20 bp, Homo sapiens
ccctgcctactctttgtttt

SEQ ID NO: 433255 - DNA, 14 bp, Homo sapiens
ccctgcctcacatc

SEQ ID NO: 433256 - DNA, 22 bp, Homo sapiens
ccctgcctccaccgagccagct

SEQ ID NO: 433257 - DNA, 21 bp, Homo sapiens
ccctgcctgagcccaggagct

SEQ ID NO: 433258 - DNA, 20 bp, Homo sapiens
ccctgcctgagggcccctct

SEQ ID NO: 433259 - DNA, 21 bp, Homo sapiens
ccctgcctgagggcccctctg

SEQ ID NO: 433260 - DNA, 22 bp, Homo sapiens
ccctgcctgagggcccctctgc

SEQ ID NO: 433261 - DNA, 11 bp, Homo sapiens
ccctgcctgga

SEQ ID NO: 433262 - DNA, 17 bp, Homo sapiens
ccctgcctggtatgagt

SEQ ID NO: 433263 - DNA, 12 bp, Homo sapiens
ccctgcctttgt

SEQ ID NO: 433264 - DNA, 13 bp, Homo sapiens
ccctgcgcaggcc

SEQ ID NO: 433265 - DNA, 23 bp, Homo sapiens
ccctgcgccctccctccctccac

SEQ ID NO: 433266 - DNA, 17 bp, Homo sapiens
ccctgcggagctgcatg

SEQ ID NO: 433267 - DNA, 21 bp, Homo sapiens
ccctgcgtcctgacgccctgc

SEQ ID NO: 433268 - DNA, 22 bp, Homo sapiens
ccctgcgtcctgacgccctgcg

SEQ ID NO: 433269 - DNA, 13 bp, Homo sapiens
ccctgctaagtgt

SEQ ID NO: 433270 - DNA, 20 bp, Homo sapiens
ccctgctaagtgttgacttt

SEQ ID NO: 433271 - DNA, 18 bp, Homo sapiens
ccctgctactccactgac

SEQ ID NO: 433272 - DNA, 22 bp, Homo sapiens
ccctgctagatgagaattcagc

SEQ ID NO: 433273 - DNA, 12 bp, Homo sapiens
ccctgctcagct

SEQ ID NO: 433274 - DNA, 17 bp, Homo sapiens
ccctgctcagctggccg

SEQ ID NO: 433275 - DNA, 16 bp, Homo sapiens
ccctgctcaggcctca

SEQ ID NO: 433276 - DNA, 17 bp, Homo sapiens
ccctgctcccagcctgc

SEQ ID NO: 433277 - DNA, 18 bp, Homo sapiens
ccctgctcccagcctgct

SEQ ID NO: 433278 - DNA, 21 bp, Homo sapiens
ccctgctcccattcctccctc

SEQ ID NO: 433279 - DNA, 15 bp, Homo sapiens
ccctgctctacccat

SEQ ID NO: 433280 - DNA, 13 bp, Homo sapiens
ccctgctgacctt

SEQ ID NO: 433281 - DNA, 13 bp, Homo sapiens
ccctgctgccttc

SEQ ID NO: 433282 - DNA, 13 bp, Homo sapiens
ccctgctgctcct

SEQ ID NO: 433283 - DNA, 16 bp, Homo sapiens
ccctgctgcttcctaa

SEQ ID NO: 433284 - DNA, 12 bp, Homo sapiens
ccctgctggacc

SEQ ID NO: 433285 - DNA, 13 bp, Homo sapiens
ccctgctggacca

SEQ ID NO: 433286 - DNA, 12 bp, Homo sapiens
ccctgcttctgc

SEQ ID NO: 433287 - DNA, 15 bp, Homo sapiens
ccctgcttctgctgc

SEQ ID NO: 433288 - DNA, 19 bp, Homo sapiens
ccctgcttctgctgccctg

SEQ ID NO: 433289 - DNA, 19 bp, Homo sapiens
ccctgcttggggcctggcg

SEQ ID NO: 433290 - DNA, 17 bp, Homo sapiens
ccctgctttgggctgcc

SEQ ID NO: 433291 - DNA, 19 bp, Homo sapiens
ccctgctttgggctgccct

SEQ ID NO: 433292 - DNA, 18 bp, Homo sapiens
ccctggaagccggcggcc

SEQ ID NO: 433293 - DNA, 18 bp, Homo sapiens
ccctggaattcagcaccc

SEQ ID NO: 433294 - DNA, 17 bp, Homo sapiens
ccctggaccagatgctg

SEQ ID NO: 433295 - DNA, 19 bp, Homo sapiens
ccctggaccagcctcctgt

SEQ ID NO: 433296 - DNA, 15 bp, Homo sapiens
ccctggagccagcag

SEQ ID NO: 433297 - DNA, 15 bp, Homo sapiens
ccctggagcccggca

SEQ ID NO: 433298 - DNA, 18 bp, Homo sapiens
ccctggagctgtccttca

SEQ ID NO: 433299 - DNA, 23 bp, Homo sapiens
ccctggatgggcattgggctgac

SEQ ID NO: 433300 - DNA, 21 bp, Homo sapiens
ccctggatgtcccctgtccca

SEQ ID NO: 433301 - DNA, 15 bp, Homo sapiens
ccctggcagagaaga

SEQ ID NO: 433302 - DNA, 13 bp, Homo sapiens
ccctggccagagg

SEQ ID NO: 433303 - DNA, 15 bp, Homo sapiens
ccctggccatctctg

SEQ ID NO: 433304 - DNA, 15 bp, Homo sapiens
ccctggcccatctca

SEQ ID NO: 433305 - DNA, 22 bp, Homo sapiens
ccctggcccatctcagcctcct

SEQ ID NO: 433306 - DNA, 14 bp, Homo sapiens
ccctggccccgccg

SEQ ID NO: 433307 - DNA, 13 bp, Homo sapiens
ccctggctcaggg

SEQ ID NO: 433308 - DNA, 18 bp, Homo sapiens
ccctggctcccaagggag

SEQ ID NO: 433309 - DNA, 13 bp, Homo sapiens
ccctggctcccat

SEQ ID NO: 433310 - DNA, 15 bp, Homo sapiens
ccctggctgtgagca

SEQ ID NO: 433311 - DNA, 20 bp, Homo sapiens
ccctggctgtgagcagcctc

SEQ ID NO: 433312 - DNA, 17 bp, Homo sapiens
ccctggcttttcactgc

SEQ ID NO: 433313 - DNA, 19 bp, Homo sapiens
ccctggcttttcactgctg

SEQ ID NO: 433314 - DNA, 11 bp, Homo sapiens
ccctgggcagg

SEQ ID NO: 433315 - DNA, 13 bp, Homo sapiens
ccctgggcaggcg

SEQ ID NO: 433316 - DNA, 20 bp, Homo sapiens
ccctgggccacccttcacgc

SEQ ID NO: 433317 - DNA, 16 bp, Homo sapiens
ccctgggcctgtctca

SEQ ID NO: 433318 - DNA, 20 bp, Homo sapiens
ccctgggctggactggaggt

SEQ ID NO: 433319 - DNA, 21 bp, Homo sapiens
ccctggggaagaggccttggg

SEQ ID NO: 433320 - DNA, 10 bp, Homo sapiens
ccctggggac

SEQ ID NO: 433321 - DNA, 17 bp, Homo sapiens
ccctggggaccaggagc

SEQ ID NO: 433322 - DNA, 14 bp, Homo sapiens
ccctggggactctg

SEQ ID NO: 433323 - DNA, 18 bp, Homo sapiens
ccctggggagtgagcttg

SEQ ID NO: 433324 - DNA, 18 bp, Homo sapiens
ccctggggcttctcctga

SEQ ID NO: 433325 - DNA, 19 bp, Homo sapiens
ccctggggggcacagccag

SEQ ID NO: 433326 - DNA, 21 bp, Homo sapiens
ccctggggggcacagccagaa

SEQ ID NO: 433327 - DNA, 18 bp, Homo sapiens
ccctggggtccccactcc

SEQ ID NO: 433328 - DNA, 14 bp, Homo sapiens
ccctggggtctctg

SEQ ID NO: 433329 - DNA, 20 bp, Homo sapiens
ccctggggtttccacacagg

SEQ ID NO: 433330 - DNA, 23 bp, Homo sapiens
ccctggggtttccacacaggccc

SEQ ID NO: 433331 - DNA, 15 bp, Homo sapiens
ccctgggtaactgtc

SEQ ID NO: 433332 - DNA, 14 bp, Homo sapiens
ccgccccgccccac

SEQ ID NO: 433333 - DNA, 15 bp, Homo sapiens
ccgccccgccccaga

SEQ ID NO: 433334 - DNA, 18 bp, Homo sapiens
ccgcccctcgctgctgct

SEQ ID NO: 433335 - DNA, 14 bp, Homo sapiens
ccgcccctggggaa

SEQ ID NO: 433336 - DNA, 13 bp, Homo sapiens
ccgcccgaccagg

SEQ ID NO: 433337 - DNA, 14 bp, Homo sapiens
ccgcccgcccaccc

SEQ ID NO: 433338 - DNA, 11 bp, Homo sapiens
ccgcccgccct

SEQ ID NO: 433339 - DNA, 12 bp, Homo sapiens
ccgccctctgcc

SEQ ID NO: 433340 - DNA, 13 bp, Homo sapiens
ccgccctctgccc

SEQ ID NO: 433341 - DNA, 11 bp, Homo sapiens
ccgccctgctg

SEQ ID NO: 433342 - DNA, 13 bp, Homo sapiens
ccgccctgggctc

SEQ ID NO: 433343 - DNA, 16 bp, Homo sapiens
ccgccctgggctctgg

SEQ ID NO: 433344 - DNA, 16 bp, Homo sapiens
ccgccctgggctggac

SEQ ID NO: 433345 - DNA, 15 bp, Homo sapiens
ccgccggcaggggcc

SEQ ID NO: 433346 - DNA, 21 bp, Homo sapiens
ccgccggttggccggctggcc

SEQ ID NO: 433347 - DNA, 17 bp, Homo sapiens
ccgccgtgccggcggca

SEQ ID NO: 433348 - DNA, 16 bp, Homo sapiens
ccgccgtgcctgcatt

SEQ ID NO: 433349 - DNA, 15 bp, Homo sapiens
ccgccgttttcatga

SEQ ID NO: 433350 - DNA, 14 bp, Homo sapiens
ccgcctccactcta

SEQ ID NO: 433351 - DNA, 21 bp, Homo sapiens
ccgcctccactctagttctag

SEQ ID NO: 433352 - DNA, 22 bp, Homo sapiens
ccgcctccactctagttctaga

SEQ ID NO: 433353 - DNA, 14 bp, Homo sapiens
ccgcctcccagcct

SEQ ID NO: 433354 - DNA, 14 bp, Homo sapiens
ccgcctcctccaga

SEQ ID NO: 433355 - DNA, 15 bp, Homo sapiens
ccgcctcgggccgcc

SEQ ID NO: 433356 - DNA, 16 bp, Homo sapiens
ccgcctcgggccgcct

SEQ ID NO: 433357 - DNA, 20 bp, Homo sapiens
ccgcctcgggccgcctcctc

SEQ ID NO: 433358 - DNA, 21 bp, Homo sapiens
ccgcctcgggccgcctcctcc

SEQ ID NO: 433359 - DNA, 20 bp, Homo sapiens
ccgcctgattggggcctcac

SEQ ID NO: 433360 - DNA, 14 bp, Homo sapiens
ccgcctgccgtgca

SEQ ID NO: 433361 - DNA, 18 bp, Homo sapiens
ccgcctgccgtgcatggc

SEQ ID NO: 433362 - DNA, 14 bp, Homo sapiens
ccgcctgcttcaca

SEQ ID NO: 433363 - DNA, 15 bp, Homo sapiens
ccgcctgcttcacac

SEQ ID NO: 433364 - DNA, 19 bp, Homo sapiens
ccgcctgcttcacacccct

SEQ ID NO: 433365 - DNA, 12 bp, Homo sapiens
ccgcctggcaga

SEQ ID NO: 433366 - DNA, 16 bp, Homo sapiens
ccgcctggcagaactg

SEQ ID NO: 433367 - DNA, 14 bp, Homo sapiens
ccgcctggcaggtg

SEQ ID NO: 433368 - DNA, 20 bp, Homo sapiens
ccgcctgtgcccttgctggg

SEQ ID NO: 433369 - DNA, 13 bp, Homo sapiens
ccgccttccctca

SEQ ID NO: 433370 - DNA, 23 bp, Homo sapiens
ccgccttccctcactcttcctca

SEQ ID NO: 433371 - DNA, 14 bp, Homo sapiens
ccgccttcctcctc

SEQ ID NO: 433372 - DNA, 22 bp, Homo sapiens
ccgccttccttgaccttcctct

SEQ ID NO: 433373 - DNA, 21 bp, Homo sapiens
ccgcggcggcttcgcgctgga

SEQ ID NO: 433374 - DNA, 18 bp, Homo sapiens
ccgcgggggacaggaaca

SEQ ID NO: 433375 - DNA, 21 bp, Homo sapiens
ccgcgggttctagacgcccct

SEQ ID NO: 433376 - DNA, 16 bp, Homo sapiens
ccgcggtgctctggcg

SEQ ID NO: 433377 - DNA, 13 bp, Homo sapiens
ccgcgtagagagc

SEQ ID NO: 433378 - DNA, 18 bp, Homo sapiens
ccgcgtgacggacatcca

SEQ ID NO: 433379 - DNA, 17 bp, Homo sapiens
ccgctagaggcctgagg

SEQ ID NO: 433380 - DNA, 18 bp, Homo sapiens
ccgctagaggcctgagga

SEQ ID NO: 433381 - DNA, 19 bp, Homo sapiens
ccgctagaggcctgaggat

SEQ ID NO: 433382 - DNA, 11 bp, Homo sapiens
ccgctcagccc

SEQ ID NO: 433383 - DNA, 12 bp, Homo sapiens
ccgctcagccct

SEQ ID NO: 433384 - DNA, 19 bp, Homo sapiens
ccgctcaggtagccaccac

SEQ ID NO: 433385 - DNA, 18 bp, Homo sapiens
ccgctcccaccagcccac

SEQ ID NO: 433386 - DNA, 13 bp, Homo sapiens
ccgctccccagcc

SEQ ID NO: 433387 - DNA, 14 bp, Homo sapiens
ccgctccccagccc

SEQ ID NO: 433388 - DNA, 16 bp, Homo sapiens
ccgctcgatgcctttg

SEQ ID NO: 433389 - DNA, 16 bp, Homo sapiens
ccgctctctcatgtgg

SEQ ID NO: 433390 - DNA, 22 bp, Homo sapiens
ccgctctgccatcagcccctgc

SEQ ID NO: 433391 - DNA, 18 bp, Homo sapiens
ccgctctggatcctgcac

SEQ ID NO: 433392 - DNA, 18 bp, Homo sapiens
ccgctgcaatgcctagac

SEQ ID NO: 433393 - DNA, 12 bp, Homo sapiens
ccgctgccacca

SEQ ID NO: 433394 - DNA, 20 bp, Homo sapiens
ccgctgccaccacgtctgcc

SEQ ID NO: 433395 - DNA, 15 bp, Homo sapiens
ccgctgccagcacag

SEQ ID NO: 433396 - DNA, 22 bp, Homo sapiens
ccgctgcctggcgggcagcccc

SEQ ID NO: 433397 - DNA, 20 bp, Homo sapiens
ccgctgctgtgctctgggga

SEQ ID NO: 433398 - DNA, 14 bp, Homo sapiens
ccgctggagcatga

SEQ ID NO: 433399 - DNA, 12 bp, Homo sapiens
ccgctggctggg

SEQ ID NO: 433400 - DNA, 21 bp, Homo sapiens
ccgctgggctgagcccctacc

SEQ ID NO: 433401 - DNA, 15 bp, Homo sapiens
ccgctgtcccagggg

SEQ ID NO: 433402 - DNA, 22 bp, Homo sapiens
ccgcttccctacccacagggcc

SEQ ID NO: 433403 - DNA, 23 bp, Homo sapiens
ccgcttccctacccacagggcct

SEQ ID NO: 433404 - DNA, 19 bp, Homo sapiens
ccggaatcctgtcctcagc

SEQ ID NO: 433405 - DNA, 22 bp, Homo sapiens
ccggaatcctgtcctcagcttc

SEQ ID NO: 433406 - DNA, 14 bp, Homo sapiens
ccggacgctggctc

SEQ ID NO: 433407 - DNA, 21 bp, Homo sapiens
ccggagaacatctgccttgct

SEQ ID NO: 433408 - DNA, 19 bp, Homo sapiens
ccggagattggacggcctg

SEQ ID NO: 433409 - DNA, 17 bp, Homo sapiens
ccggagcacagccctgg

SEQ ID NO: 433410 - DNA, 20 bp, Homo sapiens
ccggagcggctgaggacggg

SEQ ID NO: 433411 - DNA, 13 bp, Homo sapiens
ccggaggcagcag

SEQ ID NO: 433412 - DNA, 19 bp, Homo sapiens
ccggaggcgcccacctgcc

SEQ ID NO: 433413 - DNA, 22 bp, Homo sapiens
ccggaggcgcccacctgcccag

SEQ ID NO: 433414 - DNA, 14 bp, Homo sapiens
ccggaggggcctgg

SEQ ID NO: 433415 - DNA, 21 bp, Homo sapiens
ccggaggggcctggcagccgt

SEQ ID NO: 433416 - DNA, 12 bp, Homo sapiens
ccggatctccag

SEQ ID NO: 433417 - DNA, 13 bp, Homo sapiens
ccggatctccagg

SEQ ID NO: 433418 - DNA, 17 bp, Homo sapiens
ccggatctccaggccca

SEQ ID NO: 433419 - DNA, 18 bp, Homo sapiens
ccggatctccaggcccag

SEQ ID NO: 433420 - DNA, 21 bp, Homo sapiens
ccggatctccaggcccagcct

SEQ ID NO: 433421 - DNA, 13 bp, Homo sapiens
ccggatcttggag

SEQ ID NO: 433422 - DNA, 15 bp, Homo sapiens
ccggatcttggagac

SEQ ID NO: 433423 - DNA, 18 bp, Homo sapiens
ccggattccggccctggc

SEQ ID NO: 433424 - DNA, 20 bp, Homo sapiens
ccggattccggccctggctg

SEQ ID NO: 433425 - DNA, 16 bp, Homo sapiens
ccggcaacctgtaact

SEQ ID NO: 433426 - DNA, 17 bp, Homo sapiens
ccggcagaggcagggcc

SEQ ID NO: 433427 - DNA, 12 bp, Homo sapiens
ccggcagccccc

SEQ ID NO: 433428 - DNA, 13 bp, Homo sapiens
ccggcagcctggt

SEQ ID NO: 433429 - DNA, 12 bp, Homo sapiens
ccggcaggccct

SEQ ID NO: 433430 - DNA, 15 bp, Homo sapiens
ccggcaggccctgca

SEQ ID NO: 433431 - DNA, 15 bp, Homo sapiens
ccggcaggggcccct

SEQ ID NO: 433432 - DNA, 20 bp, Homo sapiens
ccggcaggggcccctcctct

SEQ ID NO: 433433 - DNA, 21 bp, Homo sapiens
ccggcaggggcccctcctctg

SEQ ID NO: 433434 - DNA, 17 bp, Homo sapiens
ccggccaaggacactga

SEQ ID NO: 433435 - DNA, 19 bp, Homo sapiens
ccggccaaggacactgatg

SEQ ID NO: 433436 - DNA, 18 bp, Homo sapiens
ccggcccacgcagagccc

SEQ ID NO: 433437 - DNA, 19 bp, Homo sapiens
ccggcccacgcagagcccc

SEQ ID NO: 433438 - DNA, 13 bp, Homo sapiens
ccggccccaggct

SEQ ID NO: 433439 - DNA, 14 bp, Homo sapiens
ccggccccaggctc

SEQ ID NO: 433440 - DNA, 15 bp, Homo sapiens
ccggccccaggctcc

SEQ ID NO: 433441 - DNA, 19 bp, Homo sapiens
ccggccccaggctcccctg

SEQ ID NO: 433442 - DNA, 21 bp, Homo sapiens
ccggccccaggctcccctggt

SEQ ID NO: 433443 - DNA, 17 bp, Homo sapiens
ccggcccccagagcgcc

SEQ ID NO: 433444 - DNA, 19 bp, Homo sapiens
ccggcccccgccctctgcc

SEQ ID NO: 433445 - DNA, 15 bp, Homo sapiens
ccggcccctaccagc

SEQ ID NO: 433446 - DNA, 13 bp, Homo sapiens
ccggccctggctg

SEQ ID NO: 433447 - DNA, 14 bp, Homo sapiens
ccggccctggctgg

SEQ ID NO: 433448 - DNA, 21 bp, Homo sapiens
ccggccgccccgccccagagc

SEQ ID NO: 433449 - DNA, 14 bp, Homo sapiens
ccggccggagaaca

SEQ ID NO: 433450 - DNA, 15 bp, Homo sapiens
ccggcctccactccc

SEQ ID NO: 433451 - DNA, 23 bp, Homo sapiens
ccggcctccactcccccacctga

SEQ ID NO: 433452 - DNA, 20 bp, Homo sapiens
ccggcctccaggctggggcc

SEQ ID NO: 433453 - DNA, 12 bp, Homo sapiens
ccggcctgcagc

SEQ ID NO: 433454 - DNA, 16 bp, Homo sapiens
ccggcctgcagcccag

SEQ ID NO: 433455 - DNA, 16 bp, Homo sapiens
ccggcctgctcccagc

SEQ ID NO: 433456 - DNA, 22 bp, Homo sapiens
ccggccttgtgacattcactca

SEQ ID NO: 433457 - DNA, 13 bp, Homo sapiens
ccggcgctgcagg

SEQ ID NO: 433458 - DNA, 20 bp, Homo sapiens
ccggcggcagccccacttca

SEQ ID NO: 433459 - DNA, 18 bp, Homo sapiens
ccggctgcatacccgggc

SEQ ID NO: 433460 - DNA, 12 bp, Homo sapiens
ccggctgcctgc

SEQ ID NO: 433461 - DNA, 22 bp, Homo sapiens
ccggctgcttttccctaagcca

SEQ ID NO: 433462 - DNA, 14 bp, Homo sapiens
ccggctgtggagca

SEQ ID NO: 433463 - DNA, 19 bp, Homo sapiens
ccgggaccacagctgctgg

SEQ ID NO: 433464 - DNA, 22 bp, Homo sapiens
cctccacaccagtggcctcgtg

SEQ ID NO: 433465 - DNA, 13 bp, Homo sapiens
cctccacacctcc

SEQ ID NO: 433466 - DNA, 15 bp, Homo sapiens
cctccacacctccac

SEQ ID NO: 433467 - DNA, 14 bp, Homo sapiens
cctccacagtgctg

SEQ ID NO: 433468 - DNA, 11 bp, Homo sapiens
cctccacccag

SEQ ID NO: 433469 - DNA, 20 bp, Homo sapiens
cctccacccccgccacggcc

SEQ ID NO: 433470 - DNA, 14 bp, Homo sapiens
cctccacccgtcct

SEQ ID NO: 433471 - DNA, 23 bp, Homo sapiens
cctccaccggtgcctcctctggg

SEQ ID NO: 433472 - DNA, 16 bp, Homo sapiens
cctccacctgggagat

SEQ ID NO: 433473 - DNA, 22 bp, Homo sapiens
cctccacctgggagatgctggg

SEQ ID NO: 433474 - DNA, 17 bp, Homo sapiens
cctccacgttcacccct

SEQ ID NO: 433475 - DNA, 15 bp, Homo sapiens
cctccactcactcca

SEQ ID NO: 433476 - DNA, 14 bp, Homo sapiens
cctccactccacct

SEQ ID NO: 433477 - DNA, 16 bp, Homo sapiens
cctccactccacctcc

SEQ ID NO: 433478 - DNA, 13 bp, Homo sapiens
cctccactcctcc

SEQ ID NO: 433479 - DNA, 15 bp, Homo sapiens
cctccactccttcct

SEQ ID NO: 433480 - DNA, 15 bp, Homo sapiens
cctccactgccctct

SEQ ID NO: 433481 - DNA, 17 bp, Homo sapiens
cctccagaagcctctgg

SEQ ID NO: 433482 - DNA, 20 bp, Homo sapiens
cctccagaagcctctggcta

SEQ ID NO: 433483 - DNA, 14 bp, Homo sapiens
cctccagaccacca

SEQ ID NO: 433484 - DNA, 18 bp, Homo sapiens
cctccagaccaccagccg

SEQ ID NO: 433485 - DNA, 13 bp, Homo sapiens
cctccagacccct

SEQ ID NO: 433486 - DNA, 14 bp, Homo sapiens
cctccagaccctgc

SEQ ID NO: 433487 - DNA, 21 bp, Homo sapiens
cctccagactcgagagggctg

SEQ ID NO: 433488 - DNA, 12 bp, Homo sapiens
cctccagagcca

SEQ ID NO: 433489 - DNA, 13 bp, Homo sapiens
cctccagagccag

SEQ ID NO: 433490 - DNA, 14 bp, Homo sapiens
cctccagagccagc

SEQ ID NO: 433491 - DNA, 20 bp, Homo sapiens
cctccagagccagcctggga

SEQ ID NO: 433492 - DNA, 21 bp, Homo sapiens
cctccagagccagcctgggac

SEQ ID NO: 433493 - DNA, 22 bp, Homo sapiens
cctccagcaatgcctgcctgaa

SEQ ID NO: 433494 - DNA, 21 bp, Homo sapiens
cctccagcacagactgttccc

SEQ ID NO: 433495 - DNA, 20 bp, Homo sapiens
cctccagccacttatttcca

SEQ ID NO: 433496 - DNA, 19 bp, Homo sapiens
cctccagcccacagtgctc

SEQ ID NO: 433497 - DNA, 12 bp, Homo sapiens
cctccagcctcc

SEQ ID NO: 433498 - DNA, 13 bp, Homo sapiens
cctccagcctccc

SEQ ID NO: 433499 - DNA, 15 bp, Homo sapiens
cctccagcctcccct

SEQ ID NO: 433500 - DNA, 16 bp, Homo sapiens
cctccagcctcccctc

SEQ ID NO: 433501 - DNA, 22 bp, Homo sapiens
cctccagcctcccctcccctgg

SEQ ID NO: 433502 - DNA, 18 bp, Homo sapiens
cctccagcctctcccggc

SEQ ID NO: 433503 - DNA, 15 bp, Homo sapiens
cctccagctctttcc

SEQ ID NO: 433504 - DNA, 17 bp, Homo sapiens
cctccagctctttcctc

SEQ ID NO: 433505 - DNA, 11 bp, Homo sapiens
cctccagctgt

SEQ ID NO: 433506 - DNA, 11 bp, Homo sapiens
cctccaggagg

SEQ ID NO: 433507 - DNA, 17 bp, Homo sapiens
cctccaggcatgctggc

SEQ ID NO: 433508 - DNA, 19 bp, Homo sapiens
cctccaggcatgctggcct

SEQ ID NO: 433509 - DNA, 20 bp, Homo sapiens
cctccaggcatgctggcctc

SEQ ID NO: 433510 - DNA, 20 bp, Homo sapiens
cctccagtacgtcccgctgc

SEQ ID NO: 433511 - DNA, 19 bp, Homo sapiens
cctccagtccagtttccca

SEQ ID NO: 433512 - DNA, 14 bp, Homo sapiens
cctccagtccccct

SEQ ID NO: 433513 - DNA, 16 bp, Homo sapiens
cctccagtgcttggct

SEQ ID NO: 433514 - DNA, 20 bp, Homo sapiens
cctccagtgttgcctcctcc

SEQ ID NO: 433515 - DNA, 21 bp, Homo sapiens
cctccagtgttgcctcctccc

SEQ ID NO: 433516 - DNA, 18 bp, Homo sapiens
cctccagttgtagcaggt

SEQ ID NO: 433517 - DNA, 19 bp, Homo sapiens
cctccatgattccaagggc

SEQ ID NO: 433518 - DNA, 22 bp, Homo sapiens
cctccatgctcctcacctgtct

SEQ ID NO: 433519 - DNA, 23 bp, Homo sapiens
cctccatgctcctcacctgtcta

SEQ ID NO: 433520 - DNA, 16 bp, Homo sapiens
cctccatgctgcctcc

SEQ ID NO: 433521 - DNA, 12 bp, Homo sapiens
cctccatggcag

SEQ ID NO: 433522 - DNA, 15 bp, Homo sapiens
cctccatggtgcctc

SEQ ID NO: 433523 - DNA, 21 bp, Homo sapiens
cctccatggtgcctctggagg

SEQ ID NO: 433524 - DNA, 19 bp, Homo sapiens
cctcccaaagtgctgggat

SEQ ID NO: 433525 - DNA, 23 bp, Homo sapiens
cctcccaaatatgcccctcccca

SEQ ID NO: 433526 - DNA, 21 bp, Homo sapiens
cctcccaacctcaatgccctg

SEQ ID NO: 433527 - DNA, 17 bp, Homo sapiens
cctcccaagctcagagc

SEQ ID NO: 433528 - DNA, 15 bp, Homo sapiens
cctcccaaggtcctc

SEQ ID NO: 433529 - DNA, 15 bp, Homo sapiens
cctcccacacttgct

SEQ ID NO: 433530 - DNA, 16 bp, Homo sapiens
cctcccacacttgctg

SEQ ID NO: 433531 - DNA, 12 bp, Homo sapiens
cctcccaccaca

SEQ ID NO: 433532 - DNA, 14 bp, Homo sapiens
cctcccaccacagc

SEQ ID NO: 433533 - DNA, 14 bp, Homo sapiens
cctcccacctccag

SEQ ID NO: 433534 - DNA, 19 bp, Homo sapiens
cctcccagacaggccctcc

SEQ ID NO: 433535 - DNA, 20 bp, Homo sapiens
cctcccagacaggccctccc

SEQ ID NO: 433536 - DNA, 22 bp, Homo sapiens
cctcccagacaggccctccctg

SEQ ID NO: 433537 - DNA, 13 bp, Homo sapiens
cctcccagctggt

SEQ ID NO: 433538 - DNA, 13 bp, Homo sapiens
cctcccagtcctc

SEQ ID NO: 433539 - DNA, 17 bp, Homo sapiens
cctcccatccagcgtct

SEQ ID NO: 433540 - DNA, 20 bp, Homo sapiens
cctcccatctccttccccca

SEQ ID NO: 433541 - DNA, 15 bp, Homo sapiens
cctcccatggcacct

SEQ ID NO: 433542 - DNA, 18 bp, Homo sapiens
cctcccatggccttccct

SEQ ID NO: 433543 - DNA, 15 bp, Homo sapiens
cctccccaaggaaga

SEQ ID NO: 433544 - DNA, 23 bp, Homo sapiens
cctccccacagtcctcacagcct

SEQ ID NO: 433545 - DNA, 17 bp, Homo sapiens
cctccccaccagtctca

SEQ ID NO: 433546 - DNA, 23 bp, Homo sapiens
cctccccacgtggcacctcctca

SEQ ID NO: 433547 - DNA, 16 bp, Homo sapiens
cctccccagcaggtgg

SEQ ID NO: 433548 - DNA, 20 bp, Homo sapiens
cctccccagcaggtggggag

SEQ ID NO: 433549 - DNA, 14 bp, Homo sapiens
cctccccagccagc

SEQ ID NO: 433550 - DNA, 22 bp, Homo sapiens
cctccccatggtgcagtgaaga

SEQ ID NO: 433551 - DNA, 22 bp, Homo sapiens
cctcccccaacccccaccccac

SEQ ID NO: 433552 - DNA, 17 bp, Homo sapiens
cctcccccagagccact

SEQ ID NO: 433553 - DNA, 16 bp, Homo sapiens
cctcccccagccagga

SEQ ID NO: 433554 - DNA, 18 bp, Homo sapiens
cctcccccaggctgcgcc

SEQ ID NO: 433555 - DNA, 23 bp, Homo sapiens
cctcccccaggctgcgcctgccc

SEQ ID NO: 433556 - DNA, 13 bp, Homo sapiens
cctcccccgcaga

SEQ ID NO: 433557 - DNA, 21 bp, Homo sapiens
cctccccgcagtgggaagtga

SEQ ID NO: 433558 - DNA, 14 bp, Homo sapiens
cctccccggcccta

SEQ ID NO: 433559 - DNA, 14 bp, Homo sapiens
cctcccctcccagt

SEQ ID NO: 433560 - DNA, 20 bp, Homo sapiens
cctcccctccttgcctcctg

SEQ ID NO: 433561 - DNA, 12 bp, Homo sapiens
cctcccctctcc

SEQ ID NO: 433562 - DNA, 13 bp, Homo sapiens
cctcccctcttcc

SEQ ID NO: 433563 - DNA, 14 bp, Homo sapiens
cctcccctgccatt

SEQ ID NO: 433564 - DNA, 14 bp, Homo sapiens
cctcccctgccctc

SEQ ID NO: 433565 - DNA, 20 bp, Homo sapiens
cctcccctgcggagctgcat

SEQ ID NO: 433566 - DNA, 15 bp, Homo sapiens
cctcccgcaccccga

SEQ ID NO: 433567 - DNA, 23 bp, Homo sapiens
cctcccgcatgctgcctgcctcc

SEQ ID NO: 433568 - DNA, 23 bp, Homo sapiens
cctcccgccgcctcgggccgcct

SEQ ID NO: 433569 - DNA, 15 bp, Homo sapiens
cctcccggcatggga

SEQ ID NO: 433570 - DNA, 17 bp, Homo sapiens
cctcccgggccctccct

SEQ ID NO: 433571 - DNA, 21 bp, Homo sapiens
cctcccgggccctcccttgga

SEQ ID NO: 433572 - DNA, 17 bp, Homo sapiens
cctccctacttccaaga

SEQ ID NO: 433573 - DNA, 18 bp, Homo sapiens
cctccctagtgacccgga

SEQ ID NO: 433574 - DNA, 20 bp, Homo sapiens
cctccctatatgcacccctg

SEQ ID NO: 433575 - DNA, 15 bp, Homo sapiens
cctccctcagcccct

SEQ ID NO: 433576 - DNA, 15 bp, Homo sapiens
cctccctccacacct

SEQ ID NO: 433577 - DNA, 17 bp, Homo sapiens
cctccctcccctgccct

SEQ ID NO: 433578 - DNA, 17 bp, Homo sapiens
cctccctcctgcaggct

SEQ ID NO: 433579 - DNA, 15 bp, Homo sapiens
cctccctcctggctc

SEQ ID NO: 433580 - DNA, 19 bp, Homo sapiens
cctccctcctggctcacag

SEQ ID NO: 433581 - DNA, 13 bp, Homo sapiens
cctccctctcttc

SEQ ID NO: 433582 - DNA, 13 bp, Homo sapiens
cctccctctgccc

SEQ ID NO: 433583 - DNA, 14 bp, Homo sapiens
cctccctctgctct

SEQ ID NO: 433584 - DNA, 15 bp, Homo sapiens
cctccctctgctctc

SEQ ID NO: 433585 - DNA, 12 bp, Homo sapiens
cctccctcttcc

SEQ ID NO: 433586 - DNA, 12 bp, Homo sapiens
cctccctgcagg

SEQ ID NO: 433587 - DNA, 13 bp, Homo sapiens
cctccctgcaggg

SEQ ID NO: 433588 - DNA, 14 bp, Homo sapiens
cctccctgcagggt

SEQ ID NO: 433589 - DNA, 13 bp, Homo sapiens
cctccctgcccag

SEQ ID NO: 433590 - DNA, 24 bp, Homo sapiens
cctccctgcccctcccttcaacca

SEQ ID NO: 433591 - DNA, 15 bp, Homo sapiens
cctccctgcctgctc

SEQ ID NO: 433592 - DNA, 13 bp, Homo sapiens
cctccctgctcag

SEQ ID NO: 433593 - DNA, 14 bp, Homo sapiens
cctccctgctcagc

SEQ ID NO: 433594 - DNA, 20 bp, Homo sapiens
cctccctggagcctccactg

SEQ ID NO: 433595 - DNA, 21 bp, Homo sapiens
cctctggaggcctctgggcct

SEQ ID NO: 433596 - DNA, 24 bp, Homo sapiens
cctctggctagaggccagccccac

SEQ ID NO: 433597 - DNA, 17 bp, Homo sapiens
cctctggctgcctggcc

SEQ ID NO: 433598 - DNA, 20 bp, Homo sapiens
cctctggctgcctggcccag

SEQ ID NO: 433599 - DNA, 16 bp, Homo sapiens
cctctgggccaggttg

SEQ ID NO: 433600 - DNA, 12 bp, Homo sapiens
cctctgggccct

SEQ ID NO: 433601 - DNA, 16 bp, Homo sapiens
cctctgggccctgcag

SEQ ID NO: 433602 - DNA, 19 bp, Homo sapiens
cctctgggccctgcaggag

SEQ ID NO: 433603 - DNA, 20 bp, Homo sapiens
cctctgggccctgcaggagg

SEQ ID NO: 433604 - DNA, 15 bp, Homo sapiens
cctctgggcctcctc

SEQ ID NO: 433605 - DNA, 20 bp, Homo sapiens
cctctggggaagggaaccag

SEQ ID NO: 433606 - DNA, 17 bp, Homo sapiens
cctctggggctctaggg

SEQ ID NO: 433607 - DNA, 12 bp, Homo sapiens
cctctggtcctt

SEQ ID NO: 433608 - DNA, 16 bp, Homo sapiens
cctctggttccactca

SEQ ID NO: 433609 - DNA, 17 bp, Homo sapiens
cctctgtagctccctcc

SEQ ID NO: 433610 - DNA, 21 bp, Homo sapiens
cctctgtcagtcatgcgtcca

SEQ ID NO: 433611 - DNA, 20 bp, Homo sapiens
cctctgtcatcactccctgg

SEQ ID NO: 433612 - DNA, 21 bp, Homo sapiens
cctctgtcatcactccctgga

SEQ ID NO: 433613 - DNA, 17 bp, Homo sapiens
cctctgtgcctaataaa

SEQ ID NO: 433614 - DNA, 16 bp, Homo sapiens
cctctgttcagtcgca

SEQ ID NO: 433615 - DNA, 21 bp, Homo sapiens
cctcttaaagctgcctgtagt

SEQ ID NO: 433616 - DNA, 15 bp, Homo sapiens
cctcttaagtgtgca

SEQ ID NO: 433617 - DNA, 23 bp, Homo sapiens
cctcttcaccccggcaggccctg

SEQ ID NO: 433618 - DNA, 22 bp, Homo sapiens
cctcttcaggggtcacctcctc

SEQ ID NO: 433619 - DNA, 15 bp, Homo sapiens
cctcttccacccatt

SEQ ID NO: 433620 - DNA, 13 bp, Homo sapiens
cctcttcccatga

SEQ ID NO: 433621 - DNA, 21 bp, Homo sapiens
cctcttcccatgactgcaccc

SEQ ID NO: 433622 - DNA, 14 bp, Homo sapiens
cctcttcccccttc

SEQ ID NO: 433623 - DNA, 13 bp, Homo sapiens
cctcttccctggt

SEQ ID NO: 433624 - DNA, 19 bp, Homo sapiens
cctcttccggagatgtagc

SEQ ID NO: 433625 - DNA, 20 bp, Homo sapiens
cctcttccggagatgtagca

SEQ ID NO: 433626 - DNA, 16 bp, Homo sapiens
cctcttcctccctcat

SEQ ID NO: 433627 - DNA, 22 bp, Homo sapiens
cctcttcctccctccctgcagg

SEQ ID NO: 433628 - DNA, 13 bp, Homo sapiens
cctcttccttctc

SEQ ID NO: 433629 - DNA, 14 bp, Homo sapiens
cctcttctcaagtg

SEQ ID NO: 433630 - DNA, 13 bp, Homo sapiens
cctcttctcagct

SEQ ID NO: 433631 - DNA, 16 bp, Homo sapiens
cctcttctcagctcca

SEQ ID NO: 433632 - DNA, 17 bp, Homo sapiens
cctcttctcagctccac

SEQ ID NO: 433633 - DNA, 18 bp, Homo sapiens
cctcttctcagctccact

SEQ ID NO: 433634 - DNA, 20 bp, Homo sapiens
cctcttctctgggcccagag

SEQ ID NO: 433635 - DNA, 23 bp, Homo sapiens
cctcttctgtattttttttttcc

SEQ ID NO: 433636 - DNA, 21 bp, Homo sapiens
cctcttcttgcggcaccgccc

SEQ ID NO: 433637 - DNA, 15 bp, Homo sapiens
cctcttgagcagtgg

SEQ ID NO: 433638 - DNA, 16 bp, Homo sapiens
cctcttgagcagtggc

SEQ ID NO: 433639 - DNA, 19 bp, Homo sapiens
cctcttgagctgaagtaat

SEQ ID NO: 433640 - DNA, 21 bp, Homo sapiens
cctcttgccccccaccccagc

SEQ ID NO: 433641 - DNA, 17 bp, Homo sapiens
cctcttgcctctctcag

SEQ ID NO: 433642 - DNA, 18 bp, Homo sapiens
cctcttgctcagagctag

SEQ ID NO: 433643 - DNA, 13 bp, Homo sapiens
cctcttgggagac

SEQ ID NO: 433644 - DNA, 13 bp, Homo sapiens
cctcttgtgctga

SEQ ID NO: 433645 - DNA, 14 bp, Homo sapiens
cctcttgtgctgag

SEQ ID NO: 433646 - DNA, 15 bp, Homo sapiens
cctctttactccctt

SEQ ID NO: 433647 - DNA, 23 bp, Homo sapiens
cctctttactcccttcctggcct

SEQ ID NO: 433648 - DNA, 21 bp, Homo sapiens
cctctttcagaaaacagaaaa

SEQ ID NO: 433649 - DNA, 16 bp, Homo sapiens
cctctttcccctcctt

SEQ ID NO: 433650 - DNA, 12 bp, Homo sapiens
cctctttcctct

SEQ ID NO: 433651 - DNA, 19 bp, Homo sapiens
cctctttcctgtgccagga

SEQ ID NO: 433652 - DNA, 23 bp, Homo sapiens
cctctttctctctgtgtggcaaa

SEQ ID NO: 433653 - DNA, 12 bp, Homo sapiens
cctcttttccta

SEQ ID NO: 433654 - DNA, 23 bp, Homo sapiens
cctctttttacttggaaataata

SEQ ID NO: 433655 - DNA, 21 bp, Homo sapiens
cctgaaaatgtttttctgcca

SEQ ID NO: 433656 - DNA, 18 bp, Homo sapiens
cctgaaacttacacacaa

SEQ ID NO: 433657 - DNA, 13 bp, Homo sapiens
cctgaaagcctgt

SEQ ID NO: 433658 - DNA, 19 bp, Homo sapiens
cctgaaagcctgtctcttt

SEQ ID NO: 433659 - DNA, 15 bp, Homo sapiens
cctgaaatgtttcca

SEQ ID NO: 433660 - DNA, 19 bp, Homo sapiens
cctgaaatgtttccaggca

SEQ ID NO: 433661 - DNA, 17 bp, Homo sapiens
cctgaacaagaaagagt

SEQ ID NO: 433662 - DNA, 20 bp, Homo sapiens
cctgaacattcttgctcaag

SEQ ID NO: 433663 - DNA, 20 bp, Homo sapiens
cctgaaccccatgggcttgg

SEQ ID NO: 433664 - DNA, 22 bp, Homo sapiens
cctgaagagcgctcctctgcct

SEQ ID NO: 433665 - DNA, 13 bp, Homo sapiens
cctgaagcctctg

SEQ ID NO: 433666 - DNA, 23 bp, Homo sapiens
cctgaagcctctgccctgcctcc

SEQ ID NO: 433667 - DNA, 20 bp, Homo sapiens
cctgaagggtgacatcccag

SEQ ID NO: 433668 - DNA, 22 bp, Homo sapiens
cctgaagggtgacatcccagga

SEQ ID NO: 433669 - DNA, 14 bp, Homo sapiens
cctgaatgcttctg

SEQ ID NO: 433670 - DNA, 18 bp, Homo sapiens
cctgacaaccactggtct

SEQ ID NO: 433671 - DNA, 19 bp, Homo sapiens
cctgacaaccactggtctg

SEQ ID NO: 433672 - DNA, 23 bp, Homo sapiens
cctgacaagtgaagttgtaaaca

SEQ ID NO: 433673 - DNA, 14 bp, Homo sapiens
cctgacaatggcag

SEQ ID NO: 433674 - DNA, 19 bp, Homo sapiens
cctgacacaggggacactg

SEQ ID NO: 433675 - DNA, 22 bp, Homo sapiens
cctgacacaggggacactgaac

SEQ ID NO: 433676 - DNA, 19 bp, Homo sapiens
cctgacactgagccccacc

SEQ ID NO: 433677 - DNA, 21 bp, Homo sapiens
cctgacagatgtcagccgagc

SEQ ID NO: 433678 - DNA, 16 bp, Homo sapiens
cctgacagcgacagaa

SEQ ID NO: 433679 - DNA, 17 bp, Homo sapiens
cctgacagcgacagaaa

SEQ ID NO: 433680 - DNA, 20 bp, Homo sapiens
cctgacagcgacagaaaacc

SEQ ID NO: 433681 - DNA, 21 bp, Homo sapiens
cctgaccaaaagtgagatggg

SEQ ID NO: 433682 - DNA, 15 bp, Homo sapiens
cctgaccccttgctc

SEQ ID NO: 433683 - DNA, 21 bp, Homo sapiens
cctgacccggcccctaccagc

SEQ ID NO: 433684 - DNA, 21 bp, Homo sapiens
cctgaccctcctccactccac

SEQ ID NO: 433685 - DNA, 13 bp, Homo sapiens
cctgaccctgcag

SEQ ID NO: 433686 - DNA, 12 bp, Homo sapiens
cctgacctctga

SEQ ID NO: 433687 - DNA, 13 bp, Homo sapiens
cctgacctgtcca

SEQ ID NO: 433688 - DNA, 17 bp, Homo sapiens
cctgaccttagcgttct

SEQ ID NO: 433689 - DNA, 20 bp, Homo sapiens
cctgaccttagcgttctgga

SEQ ID NO: 433690 - DNA, 24 bp, Homo sapiens
cctgaccttggctgactggggctg

SEQ ID NO: 433691 - DNA, 21 bp, Homo sapiens
cctgacgccctgcgttggagc

SEQ ID NO: 433692 - DNA, 21 bp, Homo sapiens
cctgactcgtctgactgtgtg

SEQ ID NO: 433693 - DNA, 13 bp, Homo sapiens
cctgactgggaag

SEQ ID NO: 433694 - DNA, 13 bp, Homo sapiens
cctgacttcccag

SEQ ID NO: 433695 - DNA, 16 bp, Homo sapiens
cctgacttcccagctg

SEQ ID NO: 433696 - DNA, 20 bp, Homo sapiens
cctgacttcccagctggcag

SEQ ID NO: 433697 - DNA, 14 bp, Homo sapiens
cctgacttgcttta

SEQ ID NO: 433698 - DNA, 14 bp, Homo sapiens
cctgacttttacag

SEQ ID NO: 433699 - DNA, 17 bp, Homo sapiens
cctgacttttacagctt

SEQ ID NO: 433700 - DNA, 21 bp, Homo sapiens
cctgacttttacagcttttct

SEQ ID NO: 433701 - DNA, 23 bp, Homo sapiens
cctgacttttacagcttttctct

SEQ ID NO: 433702 - DNA, 22 bp, Homo sapiens
cctgagaaacgtccatctctct

SEQ ID NO: 433703 - DNA, 22 bp, Homo sapiens
cctgagaccagttgggagcact

SEQ ID NO: 433704 - DNA, 23 bp, Homo sapiens
cctgagactccagaatctgctgt

SEQ ID NO: 433705 - DNA, 22 bp, Homo sapiens
cctgagactgtcggagaggctg

SEQ ID NO: 433706 - DNA, 16 bp, Homo sapiens
cctgagagctcacagt

SEQ ID NO: 433707 - DNA, 21 bp, Homo sapiens
cctgagatgtaggctccacct

SEQ ID NO: 433708 - DNA, 23 bp, Homo sapiens
cctgagattctgggaaaggtgct

SEQ ID NO: 433709 - DNA, 17 bp, Homo sapiens
cctgagccacagtgggg

SEQ ID NO: 433710 - DNA, 14 bp, Homo sapiens
cctgagcccaggag

SEQ ID NO: 433711 - DNA, 14 bp, Homo sapiens
cctgagccccctgc

SEQ ID NO: 433712 - DNA, 18 bp, Homo sapiens
cctgagcccgaatttctc

SEQ ID NO: 433713 - DNA, 12 bp, Homo sapiens
cctgagcctgcc

SEQ ID NO: 433714 - DNA, 14 bp, Homo sapiens
cctgagcctgtctc

SEQ ID NO: 433715 - DNA, 16 bp, Homo sapiens
cctgagcctgtctctc

SEQ ID NO: 433716 - DNA, 23 bp, Homo sapiens
cctgagcctgtgggtccccactc

SEQ ID NO: 433717 - DNA, 13 bp, Homo sapiens
cctgagctccacc

SEQ ID NO: 433718 - DNA, 15 bp, Homo sapiens
cctgagctccccacc

SEQ ID NO: 433719 - DNA, 20 bp, Homo sapiens
cctgagctttccggggagga

SEQ ID NO: 433720 - DNA, 21 bp, Homo sapiens
cctgagctttccggggaggag

SEQ ID NO: 433721 - DNA, 22 bp, Homo sapiens
cctgagctttggacacacacag

SEQ ID NO: 433722 - DNA, 23 bp, Homo sapiens
cctgagctttggacgcacacagc

SEQ ID NO: 433723 - DNA, 16 bp, Homo sapiens
cctgagctttggggac

SEQ ID NO: 433724 - DNA, 18 bp, Homo sapiens
cctgagctttggggacag

SEQ ID NO: 433725 - DNA, 13 bp, Homo sapiens
cctgaggatgagc

SEQ ID NO: 433726 - DNA, 20 bp, Homo sapiens
cctgaggatgagctggaagg

SEQ ID NO: 433727 - DNA, 12 bp, Homo sapiens
cctgaggcagga

SEQ ID NO: 433728 - DNA, 13 bp, Homo sapiens
cctgaggcaggag

SEQ ID NO: 433729 - DNA, 21 bp, Homo sapiens
cctgaggccaggacgtctggg

SEQ ID NO: 433730 - DNA, 15 bp, Homo sapiens
cctgagggaagccca

SEQ ID NO: 433731 - DNA, 17 bp, Homo sapiens
cctgagggaagcccacc

SEQ ID NO: 433732 - DNA, 18 bp, Homo sapiens
cctgagggaagcccaccc

SEQ ID NO: 433733 - DNA, 13 bp, Homo sapiens
cctgagggcccct

SEQ ID NO: 433734 - DNA, 16 bp, Homo sapiens
cctgagggcccctctg

SEQ ID NO: 433735 - DNA, 19 bp, Homo sapiens
cctgagggcccctctgccc

SEQ ID NO: 433736 - DNA, 20 bp, Homo sapiens
cctgagggctaattctggga

SEQ ID NO: 433737 - DNA, 19 bp, Homo sapiens
cctgaggggcatctgcccc

SEQ ID NO: 433738 - DNA, 20 bp, Homo sapiens
cctgaggtgaaagggagcta

SEQ ID NO: 433739 - DNA, 23 bp, Homo sapiens
cctgagtaccttctacaggcccg

SEQ ID NO: 433740 - DNA, 15 bp, Homo sapiens
cctgagtagctggat

SEQ ID NO: 433741 - DNA, 18 bp, Homo sapiens
cctgagtcagggcccaga

SEQ ID NO: 433742 - DNA, 20 bp, Homo sapiens
cctgagtcagggcccagagg

SEQ ID NO: 433743 - DNA, 14 bp, Homo sapiens
cctgagtcggcccc

SEQ ID NO: 433744 - DNA, 21 bp, Homo sapiens
cctgagtcggccccacatggg

SEQ ID NO: 433745 - DNA, 14 bp, Homo sapiens
cctgagtgggctgg

SEQ ID NO: 433746 - DNA, 22 bp, Homo sapiens
cctgagtggtgaggggccactg

SEQ ID NO: 433747 - DNA, 14 bp, Homo sapiens
cctgagtggtgcca

SEQ ID NO: 433748 - DNA, 16 bp, Homo sapiens
cctgagtggtgccaaa

SEQ ID NO: 433749 - DNA, 23 bp, Homo sapiens
cctgataaacattaaacactgta

SEQ ID NO: 433750 - DNA, 23 bp, Homo sapiens
cctgatactgggtacaagagcca

SEQ ID NO: 433751 - DNA, 19 bp, Homo sapiens
cctgatagtcacctgctgg

SEQ ID NO: 433752 - DNA, 22 bp, Homo sapiens
cctgatagtcacctgctggttg

SEQ ID NO: 433753 - DNA, 22 bp, Homo sapiens
cctgatcattacatggctgtgg

SEQ ID NO: 433754 - DNA, 15 bp, Homo sapiens
cctgatgctgccccg

SEQ ID NO: 433755 - DNA, 14 bp, Homo sapiens
cctgatggagagga

SEQ ID NO: 433756 - DNA, 15 bp, Homo sapiens
cctgatggagaggag

SEQ ID NO: 433757 - DNA, 17 bp, Homo sapiens
cctgatggccaagagca

SEQ ID NO: 433758 - DNA, 18 bp, Homo sapiens
cctgatggtacaggaaag

SEQ ID NO: 433759 - DNA, 16 bp, Homo sapiens
cctgatggtcagctcc

SEQ ID NO: 433760 - DNA, 14 bp, Homo sapiens
cctgattctccctg

SEQ ID NO: 433761 - DNA, 16 bp, Homo sapiens
cctgattctccctggt

SEQ ID NO: 433762 - DNA, 22 bp, Homo sapiens
cctgattggggcctcacccaga

SEQ ID NO: 433763 - DNA, 15 bp, Homo sapiens
cctgattttcaaaat

SEQ ID NO: 433764 - DNA, 21 bp, Homo sapiens
cctgcaaaattacctacccca

SEQ ID NO: 433765 - DNA, 19 bp, Homo sapiens
cctgcaacaccttgtttcc

SEQ ID NO: 433766 - DNA, 21 bp, Homo sapiens
cctgcaagagtgggctttcca

SEQ ID NO: 433767 - DNA, 17 bp, Homo sapiens
cctgcaagccccagggc

SEQ ID NO: 433768 - DNA, 18 bp, Homo sapiens
cctgcaagccccagggcc

SEQ ID NO: 433769 - DNA, 22 bp, Homo sapiens
cctgcaagccccagggcctggg

SEQ ID NO: 433770 - DNA, 23 bp, Homo sapiens
cctgcaagccccagggcctgggg

SEQ ID NO: 433771 - DNA, 19 bp, Homo sapiens
cctgcaaggcccacaggag

SEQ ID NO: 433772 - DNA, 21 bp, Homo sapiens
cctgcaaggcccacaggaggc

SEQ ID NO: 433773 - DNA, 21 bp, Homo sapiens
cctgcaagtccatagctgagc

SEQ ID NO: 433774 - DNA, 21 bp, Homo sapiens
cctgcaatctccagggctgcc

SEQ ID NO: 433775 - DNA, 23 bp, Homo sapiens
cctgcacaaagcccttccatgtc

SEQ ID NO: 433776 - DNA, 15 bp, Homo sapiens
cctgcacaagccagg

SEQ ID NO: 433777 - DNA, 16 bp, Homo sapiens
cctgcacaagccaggg

SEQ ID NO: 433778 - DNA, 17 bp, Homo sapiens
cctgcacaagccagggt

SEQ ID NO: 433779 - DNA, 17 bp, Homo sapiens
cctgcacacacctgcct

SEQ ID NO: 433780 - DNA, 17 bp, Homo sapiens
cctgcaccaggagacag

SEQ ID NO: 433781 - DNA, 23 bp, Homo sapiens
cctgcacccacccctgcccaggc

SEQ ID NO: 433782 - DNA, 13 bp, Homo sapiens
cctgcaccctctg

SEQ ID NO: 433783 - DNA, 21 bp, Homo sapiens
cctgcaccctggaaaggggag

SEQ ID NO: 433784 - DNA, 19 bp, Homo sapiens
cctgcacctgcgcctggct

SEQ ID NO: 433785 - DNA, 13 bp, Homo sapiens
cctgcactgtaaa

SEQ ID NO: 433786 - DNA, 15 bp, Homo sapiens
cctgcactgtaaaat

SEQ ID NO: 433787 - DNA, 16 bp, Homo sapiens
cctgcactgtaaaatg

SEQ ID NO: 433788 - DNA, 17 bp, Homo sapiens
cctgcacttcagacacc

SEQ ID NO: 433789 - DNA, 16 bp, Homo sapiens
cctgcagaggaccaca

SEQ ID NO: 433790 - DNA, 13 bp, Homo sapiens
cctgcagcccaga

SEQ ID NO: 433791 - DNA, 16 bp, Homo sapiens
cctgcagcccagaacg

SEQ ID NO: 433792 - DNA, 22 bp, Homo sapiens
cctgcagcccctcctcctcggg

SEQ ID NO: 433793 - DNA, 13 bp, Homo sapiens
cctgcagcctgga

SEQ ID NO: 433794 - DNA, 17 bp, Homo sapiens
cctgcagctttctggaa

SEQ ID NO: 433795 - DNA, 13 bp, Homo sapiens
cctgcaggaggcc

SEQ ID NO: 433796 - DNA, 17 bp, Homo sapiens
cctgcaggaggcctggg

SEQ ID NO: 433797 - DNA, 18 bp, Homo sapiens
cctgcaggaggcctggga

SEQ ID NO: 433798 - DNA, 19 bp, Homo sapiens
cctgcaggaggcctgggag

SEQ ID NO: 433799 - DNA, 22 bp, Homo sapiens
cctgcaggaggcctgggagggc

SEQ ID NO: 433800 - DNA, 13 bp, Homo sapiens
cctgcaggcccca

SEQ ID NO: 433801 - DNA, 17 bp, Homo sapiens
cctgcaggccccagcca

SEQ ID NO: 433802 - DNA, 19 bp, Homo sapiens
cctgcaggccccagccaag

SEQ ID NO: 433803 - DNA, 20 bp, Homo sapiens
cctgcaggcggtatccagag

SEQ ID NO: 433804 - DNA, 19 bp, Homo sapiens
cctgcaggctggctgttgg

SEQ ID NO: 433805 - DNA, 15 bp, Homo sapiens
cctgcagggccaagc

SEQ ID NO: 433806 - DNA, 14 bp, Homo sapiens
cctgcagggtaggg

SEQ ID NO: 433807 - DNA, 23 bp, Homo sapiens
cctgcagggtagggggcctgagt

SEQ ID NO: 433808 - DNA, 21 bp, Homo sapiens
cctgcagggtggtgctgggac

SEQ ID NO: 433809 - DNA, 20 bp, Homo sapiens
cctgcagtactttacctcct

SEQ ID NO: 433810 - DNA, 18 bp, Homo sapiens
cctgcagtagaaggtgcc

SEQ ID NO: 433811 - DNA, 12 bp, Homo sapiens
cctgcagtgttc

SEQ ID NO: 433812 - DNA, 19 bp, Homo sapiens
cctgcagtgttcgcttggc

SEQ ID NO: 433813 - DNA, 19 bp, Homo sapiens
cctgcatcagcctctggcc

SEQ ID NO: 433814 - DNA, 17 bp, Homo sapiens
cctgcatccctccaccc

SEQ ID NO: 433815 - DNA, 16 bp, Homo sapiens
cctgcatcccttggcc

SEQ ID NO: 433816 - DNA, 19 bp, Homo sapiens
cctgcatcccttggcccct

SEQ ID NO: 433817 - DNA, 15 bp, Homo sapiens
cctgcatgcaactaa

SEQ ID NO: 433818 - DNA, 12 bp, Homo sapiens
cctgcatgcaga

SEQ ID NO: 433819 - DNA, 15 bp, Homo sapiens
cctgcatgcagcaac

SEQ ID NO: 433820 - DNA, 19 bp, Homo sapiens
cctgccaactccatgacca

SEQ ID NO: 433821 - DNA, 18 bp, Homo sapiens
cctgccaactttccagac

SEQ ID NO: 433822 - DNA, 13 bp, Homo sapiens
cctgccaatgcca

SEQ ID NO: 433823 - DNA, 17 bp, Homo sapiens
cctgccaatgccacagc

SEQ ID NO: 433824 - DNA, 19 bp, Homo sapiens
cctgccaatgccacagcca

SEQ ID NO: 433825 - DNA, 14 bp, Homo sapiens
cctgccacctcctg

SEQ ID NO: 433826 - DNA, 17 bp, Homo sapiens
cctgccacctgtctgtc

SEQ ID NO: 433827 - DNA, 17 bp, Homo sapiens
cctgccactaggctggg

SEQ ID NO: 433828 - DNA, 15 bp, Homo sapiens
cctgccactctctgg

SEQ ID NO: 433829 - DNA, 19 bp, Homo sapiens
cctgccactctctgggact

SEQ ID NO: 433830 - DNA, 15 bp, Homo sapiens
cctgccagctgcctt

SEQ ID NO: 433831 - DNA, 17 bp, Homo sapiens
cctgccagctgccttcc

SEQ ID NO: 433832 - DNA, 19 bp, Homo sapiens
cctgccaggagcagcctcc

SEQ ID NO: 433833 - DNA, 13 bp, Homo sapiens
cctgccaggctgt

SEQ ID NO: 433834 - DNA, 22 bp, Homo sapiens
cctgccaggctgtcagcgcctc

SEQ ID NO: 433835 - DNA, 17 bp, Homo sapiens
cctgcccaatgctttgg

SEQ ID NO: 433836 - DNA, 22 bp, Homo sapiens
cctgcccaatgctttgggaggc

SEQ ID NO: 433837 - DNA, 18 bp, Homo sapiens
cctgcccagatcccagaa

SEQ ID NO: 433838 - DNA, 14 bp, Homo sapiens
cctgcccagatgcc

SEQ ID NO: 433839 - DNA, 13 bp, Homo sapiens
cctgcccaggccg

SEQ ID NO: 433840 - DNA, 15 bp, Homo sapiens
cctgcccaggccggc

SEQ ID NO: 433841 - DNA, 11 bp, Homo sapiens
cctgcccagtg

SEQ ID NO: 433842 - DNA, 12 bp, Homo sapiens
cctgcccagtgt

SEQ ID NO: 433843 - DNA, 18 bp, Homo sapiens
cctgcccagttagcccgg

SEQ ID NO: 433844 - DNA, 17 bp, Homo sapiens
cctgccccacacggact

SEQ ID NO: 433845 - DNA, 11 bp, Homo sapiens
cctgccccaga

SEQ ID NO: 433846 - DNA, 21 bp, Homo sapiens
cctgccccagagaagcctcag

SEQ ID NO: 433847 - DNA, 22 bp, Homo sapiens
cctgccccagagaagcctcagt

SEQ ID NO: 433848 - DNA, 23 bp, Homo sapiens
cctgccccagagaagcctcagtc

SEQ ID NO: 433849 - DNA, 17 bp, Homo sapiens
cctgccccagctgggct

SEQ ID NO: 433850 - DNA, 13 bp, Homo sapiens
cctgcccccatct

SEQ ID NO: 433851 - DNA, 19 bp, Homo sapiens
cctgcccccatctccccag

SEQ ID NO: 433852 - DNA, 20 bp, Homo sapiens
cctgcccccatctccccagg

SEQ ID NO: 433853 - DNA, 21 bp, Homo sapiens
cctgcccccatctccccaggc

SEQ ID NO: 433854 - DNA, 17 bp, Homo sapiens
cctggtcagcagagccg

SEQ ID NO: 433855 - DNA, 14 bp, Homo sapiens
cctggtccagattg

SEQ ID NO: 433856 - DNA, 22 bp, Homo sapiens
cctggtccagggaagctggccg

SEQ ID NO: 433857 - DNA, 14 bp, Homo sapiens
cctggtctggagcc

SEQ ID NO: 433858 - DNA, 20 bp, Homo sapiens
cctggtctggagcccctatc

SEQ ID NO: 433859 - DNA, 16 bp, Homo sapiens
cctggtcttgagatgt

SEQ ID NO: 433860 - DNA, 14 bp, Homo sapiens
cctggtgacaggca

SEQ ID NO: 433861 - DNA, 23 bp, Homo sapiens
cctggtgaggaagctccagtcct

SEQ ID NO: 433862 - DNA, 17 bp, Homo sapiens
cctggtgcactggcccc

SEQ ID NO: 433863 - DNA, 21 bp, Homo sapiens
cctggtgctgccacacttcag

SEQ ID NO: 433864 - DNA, 13 bp, Homo sapiens
cctggtgctgctg

SEQ ID NO: 433865 - DNA, 19 bp, Homo sapiens
cctggtggagaggcctccc

SEQ ID NO: 433866 - DNA, 19 bp, Homo sapiens
cctggtggcatggaagagg

SEQ ID NO: 433867 - DNA, 16 bp, Homo sapiens
cctggtggctggaggc

SEQ ID NO: 433868 - DNA, 17 bp, Homo sapiens
cctggtggctggaggca

SEQ ID NO: 433869 - DNA, 21 bp, Homo sapiens
cctggtggctggaggcattcc

SEQ ID NO: 433870 - DNA, 17 bp, Homo sapiens
cctggtggggctgagcc

SEQ ID NO: 433871 - DNA, 19 bp, Homo sapiens
cctggtggggctgagcctg

SEQ ID NO: 433872 - DNA, 12 bp, Homo sapiens
cctggttcaatt

SEQ ID NO: 433873 - DNA, 15 bp, Homo sapiens
cctggttcccccagg

SEQ ID NO: 433874 - DNA, 16 bp, Homo sapiens
cctggttcccccagga

SEQ ID NO: 433875 - DNA, 21 bp, Homo sapiens
cctggttcccccaggaccctg

SEQ ID NO: 433876 - DNA, 18 bp, Homo sapiens
cctggttccctctttcct

SEQ ID NO: 433877 - DNA, 20 bp, Homo sapiens
cctggttccctctttcctgt

SEQ ID NO: 433878 - DNA, 18 bp, Homo sapiens
cctggtttcactggccca

SEQ ID NO: 433879 - DNA, 21 bp, Homo sapiens
cctggttttaccccagctcca

SEQ ID NO: 433880 - DNA, 14 bp, Homo sapiens
cctgtaaaacttta

SEQ ID NO: 433881 - DNA, 18 bp, Homo sapiens
cctgtaaaactttatttt

SEQ ID NO: 433882 - DNA, 19 bp, Homo sapiens
cctgtaaacactcagctgt

SEQ ID NO: 433883 - DNA, 12 bp, Homo sapiens
cctgtaaattat

SEQ ID NO: 433884 - DNA, 13 bp, Homo sapiens
cctgtaaattatt

SEQ ID NO: 433885 - DNA, 15 bp, Homo sapiens
cctgtaaattatttt

SEQ ID NO: 433886 - DNA, 18 bp, Homo sapiens
cctgtaaattattttaaa

SEQ ID NO: 433887 - DNA, 21 bp, Homo sapiens
cctgtaatcccagcactttgg

SEQ ID NO: 433888 - DNA, 15 bp, Homo sapiens
cctgtaatcccagct

SEQ ID NO: 433889 - DNA, 12 bp, Homo sapiens
cctgtacactga

SEQ ID NO: 433890 - DNA, 13 bp, Homo sapiens
cctgtacccagct

SEQ ID NO: 433891 - DNA, 14 bp, Homo sapiens
cctgtacccagctc

SEQ ID NO: 433892 - DNA, 17 bp, Homo sapiens
cctgtacccagctcctt

SEQ ID NO: 433893 - DNA, 18 bp, Homo sapiens
cctgtacctctctctgct

SEQ ID NO: 433894 - DNA, 15 bp, Homo sapiens
cctgtactagctttt

SEQ ID NO: 433895 - DNA, 13 bp, Homo sapiens
cctgtagacctag

SEQ ID NO: 433896 - DNA, 19 bp, Homo sapiens
cctgtaggaaacagaaaag

SEQ ID NO: 433897 - DNA, 13 bp, Homo sapiens
cctgtagtcccag

SEQ ID NO: 433898 - DNA, 18 bp, Homo sapiens
cctgtagtcccagctaca

SEQ ID NO: 433899 - DNA, 16 bp, Homo sapiens
cctgtagtgcccctcc

SEQ ID NO: 433900 - DNA, 18 bp, Homo sapiens
cctgtagttaggaaataa

SEQ ID NO: 433901 - DNA, 19 bp, Homo sapiens
cctgtagttaggaaataaa

SEQ ID NO: 433902 - DNA, 23 bp, Homo sapiens
cctgtagttaggaaataaaacct

SEQ ID NO: 433903 - DNA, 16 bp, Homo sapiens
cctgtataaccccacc

SEQ ID NO: 433904 - DNA, 17 bp, Homo sapiens
cctgtataaccccacct

SEQ ID NO: 433905 - DNA, 10 bp, Homo sapiens
cctgtatgga

SEQ ID NO: 433906 - DNA, 19 bp, Homo sapiens
cctgtatggagctagagag

SEQ ID NO: 433907 - DNA, 20 bp, Homo sapiens
cctgtatttgagactaggat

SEQ ID NO: 433908 - DNA, 19 bp, Homo sapiens
cctgtcaagttaacaagga

SEQ ID NO: 433909 - DNA, 14 bp, Homo sapiens
cctgtcagagcttg

SEQ ID NO: 433910 - DNA, 13 bp, Homo sapiens
cctgtcagaggct

SEQ ID NO: 433911 - DNA, 19 bp, Homo sapiens
cctgtcagccaacattgcc

SEQ ID NO: 433912 - DNA, 14 bp, Homo sapiens
cctgtcagtgcagc

SEQ ID NO: 433913 - DNA, 17 bp, Homo sapiens
cctgtcatctgggccac

SEQ ID NO: 433914 - DNA, 23 bp, Homo sapiens
cctgtccactctcggggcccttg

SEQ ID NO: 433915 - DNA, 13 bp, Homo sapiens
cctgtccagagag

SEQ ID NO: 433916 - DNA, 16 bp, Homo sapiens
cctgtccagcctgggc

SEQ ID NO: 433917 - DNA, 20 bp, Homo sapiens
cctgtcccaccaactctgca

SEQ ID NO: 433918 - DNA, 14 bp, Homo sapiens
cctgtcccagaggt

SEQ ID NO: 433919 - DNA, 13 bp, Homo sapiens
cctgtcccattct

SEQ ID NO: 433920 - DNA, 18 bp, Homo sapiens
cctgtcccattctagatc

SEQ ID NO: 433921 - DNA, 23 bp, Homo sapiens
cctgtccccctcccctcccagtc

SEQ ID NO: 433922 - DNA, 18 bp, Homo sapiens
cctgtccccgccttccct

SEQ ID NO: 433923 - DNA, 22 bp, Homo sapiens
cctgtcccctccttccagcctg

SEQ ID NO: 433924 - DNA, 15 bp, Homo sapiens
cctgtccctctcagg

SEQ ID NO: 433925 - DNA, 16 bp, Homo sapiens
cctgtccctctcaggc

SEQ ID NO: 433926 - DNA, 22 bp, Homo sapiens
cctgtccctctcaggcatgcct

SEQ ID NO: 433927 - DNA, 14 bp, Homo sapiens
cctgtccctggcca

SEQ ID NO: 433928 - DNA, 15 bp, Homo sapiens
cctgtccctggccat

SEQ ID NO: 433929 - DNA, 23 bp, Homo sapiens
cctgtcccttctcttaatttaat

SEQ ID NO: 433930 - DNA, 12 bp, Homo sapiens
cctgtcctcacc

SEQ ID NO: 433931 - DNA, 15 bp, Homo sapiens
cctgtcctcagcttc

SEQ ID NO: 433932 - DNA, 13 bp, Homo sapiens
cctgtcctgatgg

SEQ ID NO: 433933 - DNA, 22 bp, Homo sapiens
cctgtcctgatggtcagctccc

SEQ ID NO: 433934 - DNA, 13 bp, Homo sapiens
cctgtcctgctca

SEQ ID NO: 433935 - DNA, 16 bp, Homo sapiens
cctgtcctggtacagc

SEQ ID NO: 433936 - DNA, 14 bp, Homo sapiens
cctgtcctggttcc

SEQ ID NO: 433937 - DNA, 15 bp, Homo sapiens
cctgtcgagacactt

SEQ ID NO: 433938 - DNA, 12 bp, Homo sapiens
cctgtcgcctgc

SEQ ID NO: 433939 - DNA, 22 bp, Homo sapiens
cctgtctaggtcagtacccacc

SEQ ID NO: 433940 - DNA, 17 bp, Homo sapiens
cctgtctaggtctcctc

SEQ ID NO: 433941 - DNA, 20 bp, Homo sapiens
cctgtctaggtctcctcagg

SEQ ID NO: 433942 - DNA, 14 bp, Homo sapiens
cctgtctcagcctc

SEQ ID NO: 433943 - DNA, 16 bp, Homo sapiens
cctgtctcatagcctc

SEQ ID NO: 433944 - DNA, 17 bp, Homo sapiens
cctgtctcatccccagg

SEQ ID NO: 433945 - DNA, 20 bp, Homo sapiens
cctgtctcatccccaggggt

SEQ ID NO: 433946 - DNA, 14 bp, Homo sapiens
cctgtctctcccta

SEQ ID NO: 433947 - DNA, 20 bp, Homo sapiens
cctgtctctccctaccctct

SEQ ID NO: 433948 - DNA, 18 bp, Homo sapiens
cctgtctctgttcagatg

SEQ ID NO: 433949 - DNA, 13 bp, Homo sapiens
cctgtctctttcc

SEQ ID NO: 433950 - DNA, 14 bp, Homo sapiens
cctgtctctttcca

SEQ ID NO: 433951 - DNA, 16 bp, Homo sapiens
cctgtctgcgccgctg

SEQ ID NO: 433952 - DNA, 23 bp, Homo sapiens
cctgtctggaagacgtggctctg

SEQ ID NO: 433953 - DNA, 18 bp, Homo sapiens
cctgtctggctcggaccc

SEQ ID NO: 433954 - DNA, 23 bp, Homo sapiens
cctgtctggctcggacccacccc

SEQ ID NO: 433955 - DNA, 18 bp, Homo sapiens
cctgtctgtctctccatc

SEQ ID NO: 433956 - DNA, 21 bp, Homo sapiens
cctgtctgtctctccatctgt

SEQ ID NO: 433957 - DNA, 21 bp, Homo sapiens
cctgtctgtctgtctgtccca

SEQ ID NO: 433958 - DNA, 16 bp, Homo sapiens
cctgtcttcagatcct

SEQ ID NO: 433959 - DNA, 21 bp, Homo sapiens
cctgtcttcagatcctgctgc

SEQ ID NO: 433960 - DNA, 22 bp, Homo sapiens
cctgtcttcagatcctgctgcc

SEQ ID NO: 433961 - DNA, 23 bp, Homo sapiens
cctgtcttcagatcctgctgccg

SEQ ID NO: 433962 - DNA, 14 bp, Homo sapiens
cctgtctttgctgt

SEQ ID NO: 433963 - DNA, 16 bp, Homo sapiens
cctgtgaccagcactg

SEQ ID NO: 433964 - DNA, 15 bp, Homo sapiens
cctgtgaccctctca

SEQ ID NO: 433965 - DNA, 18 bp, Homo sapiens
cctgtgaccctctcactt

SEQ ID NO: 433966 - DNA, 18 bp, Homo sapiens
cctgtgaccggggtcctg

SEQ ID NO: 433967 - DNA, 19 bp, Homo sapiens
cctgtgaccggggtcctga

SEQ ID NO: 433968 - DNA, 13 bp, Homo sapiens
cctgtgagcatcc

SEQ ID NO: 433969 - DNA, 20 bp, Homo sapiens
cctgtgagctccccaatcca

SEQ ID NO: 433970 - DNA, 15 bp, Homo sapiens
cctgtgatcgtgtgt

SEQ ID NO: 433971 - DNA, 20 bp, Homo sapiens
cctgtgatcgtgtgttgcca

SEQ ID NO: 433972 - DNA, 18 bp, Homo sapiens
cctgtgcagcagcccagc

SEQ ID NO: 433973 - DNA, 23 bp, Homo sapiens
cctgtgcagcagcccagcttcct

SEQ ID NO: 433974 - DNA, 13 bp, Homo sapiens
cctgtgccaacct

SEQ ID NO: 433975 - DNA, 12 bp, Homo sapiens
cctgtgccaata

SEQ ID NO: 433976 - DNA, 21 bp, Homo sapiens
cctgtgccacccaccagggcg

SEQ ID NO: 433977 - DNA, 21 bp, Homo sapiens
cctgtgccaggactctctttc

SEQ ID NO: 433978 - DNA, 17 bp, Homo sapiens
cctgtgccaggctgaat

SEQ ID NO: 433979 - DNA, 12 bp, Homo sapiens
cctgtgcccacc

SEQ ID NO: 433980 - DNA, 19 bp, Homo sapiens
cctgtgcccacccagggcc

SEQ ID NO: 433981 - DNA, 16 bp, Homo sapiens
cctgtgcccacccgtc

SEQ ID NO: 433982 - DNA, 20 bp, Homo sapiens
cctgtgcccatcatctctgc

SEQ ID NO: 433983 - DNA, 23 bp, Homo sapiens
cctgtgcccatcatctctgcctt

SEQ ID NO: 433984 - DNA, 16 bp, Homo sapiens
cctttccctggagtca

SEQ ID NO: 433985 - DNA, 17 bp, Homo sapiens
cctttcctcctttatca

SEQ ID NO: 433986 - DNA, 17 bp, Homo sapiens
cctttcctctctcctgt

SEQ ID NO: 433987 - DNA, 19 bp, Homo sapiens
cctttccttctcgtcttcc

SEQ ID NO: 433988 - DNA, 22 bp, Homo sapiens
cctttctagtcctattctattg

SEQ ID NO: 433989 - DNA, 15 bp, Homo sapiens
cctttctccagccag

SEQ ID NO: 433990 - DNA, 20 bp, Homo sapiens
cctttctccaggccctcaga

SEQ ID NO: 433991 - DNA, 17 bp, Homo sapiens
cctttctctgagagaga

SEQ ID NO: 433992 - DNA, 16 bp, Homo sapiens
cctttctttttcttct

SEQ ID NO: 433993 - DNA, 23 bp, Homo sapiens
cctttctttttcttcttccctcc

SEQ ID NO: 433994 - DNA, 16 bp, Homo sapiens
cctttcttttttttct

SEQ ID NO: 433995 - DNA, 14 bp, Homo sapiens
cctttgatcttcag

SEQ ID NO: 433996 - DNA, 19 bp, Homo sapiens
cctttgcactgagggccac

SEQ ID NO: 433997 - DNA, 18 bp, Homo sapiens
cctttgcagttggactct

SEQ ID NO: 433998 - DNA, 23 bp, Homo sapiens
cctttgcagttggactctcaggg

SEQ ID NO: 433999 - DNA, 16 bp, Homo sapiens
cctttgcgtggatcaa

SEQ ID NO: 434000 - DNA, 14 bp, Homo sapiens
cctttgctcttata

SEQ ID NO: 434001 - DNA, 23 bp, Homo sapiens
cctttgctgtgaggctgtcctgt

SEQ ID NO: 434002 - DNA, 19 bp, Homo sapiens
cctttgcttatgaatattt

SEQ ID NO: 434003 - DNA, 16 bp, Homo sapiens
cctttgcttgaaagaa

SEQ ID NO: 434004 - DNA, 21 bp, Homo sapiens
cctttggagaacgccagtctc

SEQ ID NO: 434005 - DNA, 15 bp, Homo sapiens
cctttggtgaataac

SEQ ID NO: 434006 - DNA, 12 bp, Homo sapiens
cctttgtaagac

SEQ ID NO: 434007 - DNA, 15 bp, Homo sapiens
cctttgtaagacaca

SEQ ID NO: 434008 - DNA, 21 bp, Homo sapiens
cctttgtaagacacacagcct

SEQ ID NO: 434009 - DNA, 15 bp, Homo sapiens
cctttgtaagttatt

SEQ ID NO: 434010 - DNA, 23 bp, Homo sapiens
cctttgtcatcattgtatatatg

SEQ ID NO: 434011 - DNA, 19 bp, Homo sapiens
cctttgtcttttttttcat

SEQ ID NO: 434012 - DNA, 22 bp, Homo sapiens
cctttgtggactttatttaatt

SEQ ID NO: 434013 - DNA, 12 bp, Homo sapiens
cctttgtgtaat

SEQ ID NO: 434014 - DNA, 15 bp, Homo sapiens
cctttgtgtaataaa

SEQ ID NO: 434015 - DNA, 15 bp, Homo sapiens
cctttgttaaattta

SEQ ID NO: 434016 - DNA, 17 bp, Homo sapiens
cctttgttgctgtctgg

SEQ ID NO: 434017 - DNA, 18 bp, Homo sapiens
cctttgtttccttgttgg

SEQ ID NO: 434018 - DNA, 14 bp, Homo sapiens
ccttttaaatggca

SEQ ID NO: 434019 - DNA, 11 bp, Homo sapiens
ccttttacttt

SEQ ID NO: 434020 - DNA, 22 bp, Homo sapiens
ccttttagtggtggtgtctcac

SEQ ID NO: 434021 - DNA, 15 bp, Homo sapiens
ccttttccttcagag

SEQ ID NO: 434022 - DNA, 11 bp, Homo sapiens
ccttttctaaa

SEQ ID NO: 434023 - DNA, 12 bp, Homo sapiens
ccttttctaaaa

SEQ ID NO: 434024 - DNA, 15 bp, Homo sapiens
ccttttctattcctt

SEQ ID NO: 434025 - DNA, 16 bp, Homo sapiens
ccttttctcattctgt

SEQ ID NO: 434026 - DNA, 13 bp, Homo sapiens
ccttttctggctc

SEQ ID NO: 434027 - DNA, 14 bp, Homo sapiens
ccttttctggctcc

SEQ ID NO: 434028 - DNA, 22 bp, Homo sapiens
ccttttctttttcccttgaact

SEQ ID NO: 434029 - DNA, 22 bp, Homo sapiens
ccttttgagggacaaatttaaa

SEQ ID NO: 434030 - DNA, 15 bp, Homo sapiens
ccttttgagtgcctt

SEQ ID NO: 434031 - DNA, 23 bp, Homo sapiens
ccttttgataaaatgttcctttt

SEQ ID NO: 434032 - DNA, 20 bp, Homo sapiens
ccttttggcccccgagctgg

SEQ ID NO: 434033 - DNA, 17 bp, Homo sapiens
ccttttggcctttgtaa

SEQ ID NO: 434034 - DNA, 19 bp, Homo sapiens
ccttttggcctttgtaaga

SEQ ID NO: 434035 - DNA, 18 bp, Homo sapiens
ccttttgtccccagggcc

SEQ ID NO: 434036 - DNA, 19 bp, Homo sapiens
ccttttgtccccagggccc

SEQ ID NO: 434037 - DNA, 21 bp, Homo sapiens
cctttttaaatgagacttgtt

SEQ ID NO: 434038 - DNA, 14 bp, Homo sapiens
cctttttactcccc

SEQ ID NO: 434039 - DNA, 17 bp, Homo sapiens
cctttttgtaaatactg

SEQ ID NO: 434040 - DNA, 18 bp, Homo sapiens
ccttttttaaaaaaaaga

SEQ ID NO: 434041 - DNA, 17 bp, Homo sapiens
ccttttttatcatttct

SEQ ID NO: 434042 - DNA, 21 bp, Homo sapiens
ccttttttatcatttctactg

SEQ ID NO: 434043 - DNA, 18 bp, Homo sapiens
ccttttttattgaataac

SEQ ID NO: 434044 - DNA, 21 bp, Homo sapiens
ccttttttctcttctgtccat

SEQ ID NO: 434045 - DNA, 13 bp, Homo sapiens
ccttttttcttcc

SEQ ID NO: 434046 - DNA, 22 bp, Homo sapiens
cctttttttaaaattcaccccc

SEQ ID NO: 434047 - DNA, 13 bp, Homo sapiens
cctttttttttga

SEQ ID NO: 434048 - DNA, 16 bp, Homo sapiens
cctttttttttgaaac

SEQ ID NO: 434049 - DNA, 15 bp, Homo sapiens
cgaaaacagatgaga

SEQ ID NO: 434050 - DNA, 16 bp, Homo sapiens
cgaaacacagaactca

SEQ ID NO: 434051 - DNA, 13 bp, Homo sapiens
cgaaatgttattt

SEQ ID NO: 434052 - DNA, 14 bp, Homo sapiens
cgaaatgttatttt

SEQ ID NO: 434053 - DNA, 22 bp, Homo sapiens
cgaaatgttattttttaattat

SEQ ID NO: 434054 - DNA, 14 bp, Homo sapiens
cgaacatcttcata

SEQ ID NO: 434055 - DNA, 19 bp, Homo sapiens
cgaacatcttcatataaac

SEQ ID NO: 434056 - DNA, 14 bp, Homo sapiens
cgaacatggcatgt

SEQ ID NO: 434057 - DNA, 12 bp, Homo sapiens
cgaaccaaggca

SEQ ID NO: 434058 - DNA, 17 bp, Homo sapiens
cgaaccaaggcagcctc

SEQ ID NO: 434059 - DNA, 20 bp, Homo sapiens
cgaaccaaggcagcctccag

SEQ ID NO: 434060 - DNA, 22 bp, Homo sapiens
cgaaccccccactccctgccac

SEQ ID NO: 434061 - DNA, 15 bp, Homo sapiens
cgaacgctcttagct

SEQ ID NO: 434062 - DNA, 18 bp, Homo sapiens
cgaagaagggtccttccc

SEQ ID NO: 434063 - DNA, 23 bp, Homo sapiens
cgaagagggaatggatggggaga

SEQ ID NO: 434064 - DNA, 22 bp, Homo sapiens
cgaagccatcacttctccccgc

SEQ ID NO: 434065 - DNA, 18 bp, Homo sapiens
cgaagctcagcccacccc

SEQ ID NO: 434066 - DNA, 12 bp, Homo sapiens
cgaagctgagcg

SEQ ID NO: 434067 - DNA, 22 bp, Homo sapiens
cgaagctgataaccgtccttca

SEQ ID NO: 434068 - DNA, 16 bp, Homo sapiens
cgaaggggccccgggg

SEQ ID NO: 434069 - DNA, 21 bp, Homo sapiens
cgaaggggccccggggctggc

SEQ ID NO: 434070 - DNA, 22 bp, Homo sapiens
cgaaggggccccggggctggca

SEQ ID NO: 434071 - DNA, 14 bp, Homo sapiens
cgaatcagactcat

SEQ ID NO: 434072 - DNA, 21 bp, Homo sapiens
cgaatcccctaaacaaaaaga

SEQ ID NO: 434073 - DNA, 24 bp, Homo sapiens
cgaatgcctgtcagtttcatggag

SEQ ID NO: 434074 - DNA, 20 bp, Homo sapiens
cgaatggagtccagacctgg

SEQ ID NO: 434075 - DNA, 21 bp, Homo sapiens
cgacaaaaacaagactgcctc

SEQ ID NO: 434076 - DNA, 23 bp, Homo sapiens
cgacaaaaacaagactgcctccc

SEQ ID NO: 434077 - DNA, 14 bp, Homo sapiens
cgacagcctggcac

SEQ ID NO: 434078 - DNA, 12 bp, Homo sapiens
cgacagtggctc

SEQ ID NO: 434079 - DNA, 15 bp, Homo sapiens
cgacagttctgaact

SEQ ID NO: 434080 - DNA, 14 bp, Homo sapiens
cgaccagaggtggg

SEQ ID NO: 434081 - DNA, 16 bp, Homo sapiens
cgaccccagagtgact

SEQ ID NO: 434082 - DNA, 19 bp, Homo sapiens
cgaccccagagtgactgac

SEQ ID NO: 434083 - DNA, 13 bp, Homo sapiens
cgaccccatctca

SEQ ID NO: 434084 - DNA, 20 bp, Homo sapiens
cgaccgaggctggagctggc

SEQ ID NO: 434085 - DNA, 15 bp, Homo sapiens
cgaccgcctgcttca

SEQ ID NO: 434086 - DNA, 15 bp, Homo sapiens
cgaccttcaccaagc

SEQ ID NO: 434087 - DNA, 11 bp, Homo sapiens
cgaccttggcc

SEQ ID NO: 434088 - DNA, 15 bp, Homo sapiens
cgacgccacagccca

SEQ ID NO: 434089 - DNA, 21 bp, Homo sapiens
cgactccagatatgaacaggg

SEQ ID NO: 434090 - DNA, 20 bp, Homo sapiens
cgactctatagactctagga

SEQ ID NO: 434091 - DNA, 15 bp, Homo sapiens
cgactggctgtgaga

SEQ ID NO: 434092 - DNA, 20 bp, Homo sapiens
cgacttgggacggaagtggc

SEQ ID NO: 434093 - DNA, 18 bp, Homo sapiens
cgactttgagctggaaag

SEQ ID NO: 434094 - DNA, 17 bp, Homo sapiens
cgagaccatcctggccc

SEQ ID NO: 434095 - DNA, 20 bp, Homo sapiens
cgagaccatcctggcccctc

SEQ ID NO: 434096 - DNA, 16 bp, Homo sapiens
cgagaccgcagaggga

SEQ ID NO: 434097 - DNA, 21 bp, Homo sapiens
cgagactcctcgggcaagggc

SEQ ID NO: 434098 - DNA, 19 bp, Homo sapiens
cgagagctcttagttttta

SEQ ID NO: 434099 - DNA, 12 bp, Homo sapiens
cgagagggctga

SEQ ID NO: 434100 - DNA, 18 bp, Homo sapiens
cgagagggctgagcccct

SEQ ID NO: 434101 - DNA, 20 bp, Homo sapiens
cgagagggctgagcccctcc

SEQ ID NO: 434102 - DNA, 21 bp, Homo sapiens
cgagagggctgagcccctcct

SEQ ID NO: 434103 - DNA, 18 bp, Homo sapiens
cgagatcggggtggcaga

SEQ ID NO: 434104 - DNA, 19 bp, Homo sapiens
cgagatcggggtggcagaa

SEQ ID NO: 434105 - DNA, 21 bp, Homo sapiens
cgagatgtgacccaccagtgc

SEQ ID NO: 434106 - DNA, 23 bp, Homo sapiens
cgagatttgccaggggcatccaa

SEQ ID NO: 434107 - DNA, 15 bp, Homo sapiens
cgagcaaagatcaaa

SEQ ID NO: 434108 - DNA, 20 bp, Homo sapiens
cgagcaaagtctaaagttta

SEQ ID NO: 434109 - DNA, 14 bp, Homo sapiens
cgagcaagccggca

SEQ ID NO: 434110 - DNA, 17 bp, Homo sapiens
cgagcactggccagaga

SEQ ID NO: 434111 - DNA, 20 bp, Homo sapiens
cgagcaggcttcttcccccc

SEQ ID NO: 434112 - DNA, 17 bp, Homo sapiens
cgagcagtcctgcctca

SEQ ID NO: 434113 - DNA, 14 bp, Homo sapiens
cgagcatcccccaa

SEQ ID NO: 434114 - DNA, 19 bp, Homo sapiens
cgcgtgcacgtggagagct

SEQ ID NO: 434115 - DNA, 12 bp, Homo sapiens
cgcgtgccccca

SEQ ID NO: 434116 - DNA, 13 bp, Homo sapiens
cgcgtgcccccag

SEQ ID NO: 434117 - DNA, 14 bp, Homo sapiens
cgcgtgcccccagc

SEQ ID NO: 434118 - DNA, 15 bp, Homo sapiens
cgcgtgcccccagcg

SEQ ID NO: 434119 - DNA, 17 bp, Homo sapiens
cgcgtgcccccagcgtg

SEQ ID NO: 434120 - DNA, 13 bp, Homo sapiens
cgcgtgccttccc

SEQ ID NO: 434121 - DNA, 14 bp, Homo sapiens
cgcgtgccttcccc

SEQ ID NO: 434122 - DNA, 16 bp, Homo sapiens
cgcgtgcgaccagagg

SEQ ID NO: 434123 - DNA, 22 bp, Homo sapiens
cgctaattcatacctccctcct

SEQ ID NO: 434124 - DNA, 22 bp, Homo sapiens
cgctagagcattctggggtggg

SEQ ID NO: 434125 - DNA, 13 bp, Homo sapiens
cgctagaggcctg

SEQ ID NO: 434126 - DNA, 15 bp, Homo sapiens
cgctagaggcctgag

SEQ ID NO: 434127 - DNA, 17 bp, Homo sapiens
cgctagaggcctgagga

SEQ ID NO: 434128 - DNA, 20 bp, Homo sapiens
cgctagtcaataaacctggg

SEQ ID NO: 434129 - DNA, 13 bp, Homo sapiens
cgctattcccagg

SEQ ID NO: 434130 - DNA, 14 bp, Homo sapiens
cgctattcccaggc

SEQ ID NO: 434131 - DNA, 17 bp, Homo sapiens
cgctattcccaggcagg

SEQ ID NO: 434132 - DNA, 13 bp, Homo sapiens
cgctcacctgcag

SEQ ID NO: 434133 - DNA, 15 bp, Homo sapiens
cgctcacctgcagcc

SEQ ID NO: 434134 - DNA, 22 bp, Homo sapiens
cgctcagcaatagggtgcagtt

SEQ ID NO: 434135 - DNA, 16 bp, Homo sapiens
cgctcaggacccaggc

SEQ ID NO: 434136 - DNA, 18 bp, Homo sapiens
cgctcaggacccaggccc

SEQ ID NO: 434137 - DNA, 22 bp, Homo sapiens
cgctcaggacccaggccctcca

SEQ ID NO: 434138 - DNA, 22 bp, Homo sapiens
cgctcatgggcccctctgactc

SEQ ID NO: 434139 - DNA, 13 bp, Homo sapiens
cgctcccacagct

SEQ ID NO: 434140 - DNA, 20 bp, Homo sapiens
cgctcccccgcagtccccag

SEQ ID NO: 434141 - DNA, 23 bp, Homo sapiens
cgctcccctctgccggtccccca

SEQ ID NO: 434142 - DNA, 16 bp, Homo sapiens
cgctcccctgagaggt

SEQ ID NO: 434143 - DNA, 17 bp, Homo sapiens
cgctcccctttcccatc

SEQ ID NO: 434144 - DNA, 14 bp, Homo sapiens
cgctccggcagagg

SEQ ID NO: 434145 - DNA, 15 bp, Homo sapiens
cgctccggcagaggc

SEQ ID NO: 434146 - DNA, 14 bp, Homo sapiens
cgctcctctgcagc

SEQ ID NO: 434147 - DNA, 18 bp, Homo sapiens
cgctcctctgcagcctga

SEQ ID NO: 434148 - DNA, 19 bp, Homo sapiens
cgctcctctgcagcctgag

SEQ ID NO: 434149 - DNA, 14 bp, Homo sapiens
cgctcctctgcctt

SEQ ID NO: 434150 - DNA, 20 bp, Homo sapiens
cgctcctctgttcagtcgca

SEQ ID NO: 434151 - DNA, 13 bp, Homo sapiens
cgctcctgccctc

SEQ ID NO: 434152 - DNA, 13 bp, Homo sapiens
cgctctcctaagt

SEQ ID NO: 434153 - DNA, 12 bp, Homo sapiens
cgctctgaggca

SEQ ID NO: 434154 - DNA, 18 bp, Homo sapiens
cgctctgccatcagcccc

SEQ ID NO: 434155 - DNA, 19 bp, Homo sapiens
cgctctgccatcagcccct

SEQ ID NO: 434156 - DNA, 13 bp, Homo sapiens
cgctctgcccctc

SEQ ID NO: 434157 - DNA, 16 bp, Homo sapiens
cgctctggatcctgca

SEQ ID NO: 434158 - DNA, 18 bp, Homo sapiens
cgctctggatcctgcact

SEQ ID NO: 434159 - DNA, 13 bp, Homo sapiens
cgctctggtgcag

SEQ ID NO: 434160 - DNA, 22 bp, Homo sapiens
cgctgcaggtacttcctcctga

SEQ ID NO: 434161 - DNA, 17 bp, Homo sapiens
cgctgccaccacgtctg

SEQ ID NO: 434162 - DNA, 12 bp, Homo sapiens
cgctgcccaggc

SEQ ID NO: 434163 - DNA, 13 bp, Homo sapiens
cgctgcccaggct

SEQ ID NO: 434164 - DNA, 20 bp, Homo sapiens
cgctgcccaggctctgctga

SEQ ID NO: 434165 - DNA, 18 bp, Homo sapiens
cgctgcctggcgggcagc

SEQ ID NO: 434166 - DNA, 21 bp, Homo sapiens
cgctgcctggcgggcagcccc

SEQ ID NO: 434167 - DNA, 23 bp, Homo sapiens
cgctgcctggcgggcagcccctg

SEQ ID NO: 434168 - DNA, 22 bp, Homo sapiens
cgctgcgcaaggcctcgctctt

SEQ ID NO: 434169 - DNA, 16 bp, Homo sapiens
cgctgctctagctggc

SEQ ID NO: 434170 - DNA, 19 bp, Homo sapiens
cgctgctctagctggcagg

SEQ ID NO: 434171 - DNA, 20 bp, Homo sapiens
cgctgctctagctggcagga

SEQ ID NO: 434172 - DNA, 14 bp, Homo sapiens
cgctgcttccagga

SEQ ID NO: 434173 - DNA, 14 bp, Homo sapiens
cgctgcttccaggt

SEQ ID NO: 434174 - DNA, 20 bp, Homo sapiens
cgctggctgggggcctcact

SEQ ID NO: 434175 - DNA, 13 bp, Homo sapiens
cgctgggacacag

SEQ ID NO: 434176 - DNA, 15 bp, Homo sapiens
cgctgggacacagac

SEQ ID NO: 434177 - DNA, 16 bp, Homo sapiens
cgctgggacacagacc

SEQ ID NO: 434178 - DNA, 20 bp, Homo sapiens
cgctgggagaaaagccagat

SEQ ID NO: 434179 - DNA, 12 bp, Homo sapiens
cgctgggagagc

SEQ ID NO: 434180 - DNA, 22 bp, Homo sapiens
cgctgggatttcttcgctgctc

SEQ ID NO: 434181 - DNA, 12 bp, Homo sapiens
cgctgggctcaa

SEQ ID NO: 434182 - DNA, 14 bp, Homo sapiens
cgctgtatgattta

SEQ ID NO: 434183 - DNA, 22 bp, Homo sapiens
cgctgtcagccattcctgttcc

SEQ ID NO: 434184 - DNA, 14 bp, Homo sapiens
cgctgtctccagac

SEQ ID NO: 434185 - DNA, 15 bp, Homo sapiens
cgctgtctccagacc

SEQ ID NO: 434186 - DNA, 22 bp, Homo sapiens
cgctgtctccagacccccaccc

SEQ ID NO: 434187 - DNA, 13 bp, Homo sapiens
cgctgtgctccag

SEQ ID NO: 434188 - DNA, 21 bp, Homo sapiens
cgctgtgctccagcagtgctg

SEQ ID NO: 434189 - DNA, 23 bp, Homo sapiens
cgctgtgctccagcagtgctggg

SEQ ID NO: 434190 - DNA, 13 bp, Homo sapiens
cgcttcacccctg

SEQ ID NO: 434191 - DNA, 22 bp, Homo sapiens
cgcttccctacccacagggcct

SEQ ID NO: 434192 - DNA, 12 bp, Homo sapiens
cgcttctctgtg

SEQ ID NO: 434193 - DNA, 12 bp, Homo sapiens
cgcttggctcca

SEQ ID NO: 434194 - DNA, 22 bp, Homo sapiens
cgctttcatgaccactgggcct

SEQ ID NO: 434195 - DNA, 22 bp, Homo sapiens
cgctttctagctgttgagctgt

SEQ ID NO: 434196 - DNA, 10 bp, Homo sapiens
cgctttctcc

SEQ ID NO: 434197 - DNA, 15 bp, Homo sapiens
cgctttctcctgtgc

SEQ ID NO: 434198 - DNA, 16 bp, Homo sapiens
cgcttttgttcttccc

SEQ ID NO: 434199 - DNA, 18 bp, Homo sapiens
cggaaaatgccaatctct

SEQ ID NO: 434200 - DNA, 16 bp, Homo sapiens
cggaacgttggacttt

SEQ ID NO: 434201 - DNA, 23 bp, Homo sapiens
cggaagcagtgccttccataatt

SEQ ID NO: 434202 - DNA, 21 bp, Homo sapiens
cggaagccgtctgactccaga

SEQ ID NO: 434203 - DNA, 22 bp, Homo sapiens
cggaagccgtctgactccagag

SEQ ID NO: 434204 - DNA, 12 bp, Homo sapiens
cggaagcctgtc

SEQ ID NO: 434205 - DNA, 14 bp, Homo sapiens
cggaagtggcctga

SEQ ID NO: 434206 - DNA, 20 bp, Homo sapiens
cggaagtggcctgagaagag

SEQ ID NO: 434207 - DNA, 13 bp, Homo sapiens
cggaatggtaacc

SEQ ID NO: 434208 - DNA, 17 bp, Homo sapiens
cggacccaccccaactc

SEQ ID NO: 434209 - DNA, 21 bp, Homo sapiens
cggacccaccccaactctccc

SEQ ID NO: 434210 - DNA, 22 bp, Homo sapiens
cggacccaccccaactctcccc

SEQ ID NO: 434211 - DNA, 17 bp, Homo sapiens
cggaccgcatcctccag

SEQ ID NO: 434212 - DNA, 17 bp, Homo sapiens
cggaccgcgtagagagc

SEQ ID NO: 434213 - DNA, 18 bp, Homo sapiens
cggaccgcgtagagagcc

SEQ ID NO: 434214 - DNA, 18 bp, Homo sapiens
cggaccggagcggctgag

SEQ ID NO: 434215 - DNA, 18 bp, Homo sapiens
cggacgggacagcggccc

SEQ ID NO: 434216 - DNA, 12 bp, Homo sapiens
cggacgggctgt

SEQ ID NO: 434217 - DNA, 19 bp, Homo sapiens
cggactccatggcccttcc

SEQ ID NO: 434218 - DNA, 17 bp, Homo sapiens
cggactcccgggccacg

SEQ ID NO: 434219 - DNA, 16 bp, Homo sapiens
cggactgcccccagaa

SEQ ID NO: 434220 - DNA, 19 bp, Homo sapiens
cggactgcccccagaaagc

SEQ ID NO: 434221 - DNA, 19 bp, Homo sapiens
cggagaacatctgccttgc

SEQ ID NO: 434222 - DNA, 22 bp, Homo sapiens
cggagaacatctgccttgctgc

SEQ ID NO: 434223 - DNA, 14 bp, Homo sapiens
cggagagaaaaaag

SEQ ID NO: 434224 - DNA, 17 bp, Homo sapiens
cggagaggctgtctggg

SEQ ID NO: 434225 - DNA, 21 bp, Homo sapiens
cggagaggctgtctggggcct

SEQ ID NO: 434226 - DNA, 14 bp, Homo sapiens
cggagcacagccct

SEQ ID NO: 434227 - DNA, 19 bp, Homo sapiens
cggagcacagccctgggag

SEQ ID NO: 434228 - DNA, 23 bp, Homo sapiens
cggagccaatgaacagctcctcc

SEQ ID NO: 434229 - DNA, 21 bp, Homo sapiens
cggagcctgtgttagtgtctg

SEQ ID NO: 434230 - DNA, 23 bp, Homo sapiens
cggagcctgtgttagtgtctgtc

SEQ ID NO: 434231 - DNA, 14 bp, Homo sapiens
cggagcggctgagg

SEQ ID NO: 434232 - DNA, 21 bp, Homo sapiens
cggagctaacactggccccta

SEQ ID NO: 434233 - DNA, 23 bp, Homo sapiens
cggaggacttgggggcagagcag

SEQ ID NO: 434234 - DNA, 13 bp, Homo sapiens
cggaggaggtgga

SEQ ID NO: 434235 - DNA, 12 bp, Homo sapiens
cggaggcaaaag

SEQ ID NO: 434236 - DNA, 19 bp, Homo sapiens
cggaggccacatgagtccc

SEQ ID NO: 434237 - DNA, 16 bp, Homo sapiens
cggaggccaggccctc

SEQ ID NO: 434238 - DNA, 22 bp, Homo sapiens
cggaggccaggccctcctgctg

SEQ ID NO: 434239 - DNA, 19 bp, Homo sapiens
cggaggcgcccacctgccc

SEQ ID NO: 434240 - DNA, 20 bp, Homo sapiens
cggaggcgcccacctgccca

SEQ ID NO: 434241 - DNA, 22 bp, Homo sapiens
cggaggcgcccacctgcccagt

SEQ ID NO: 434242 - DNA, 19 bp, Homo sapiens
cggaggcttgtcagagctg

SEQ ID NO: 434243 - DNA, 19 bp, Homo sapiens
cggagggaattgaggtctg

SEQ ID NO: 434244 - DNA, 20 bp, Homo sapiens
cgtatgtctgttaccatgtc

SEQ ID NO: 434245 - DNA, 23 bp, Homo sapiens
cgtcaccagaattagtcctcaca

SEQ ID NO: 434246 - DNA, 16 bp, Homo sapiens
cgtcaccatctcaggc

SEQ ID NO: 434247 - DNA, 21 bp, Homo sapiens
cgtcaccatctcaggccacct

SEQ ID NO: 434248 - DNA, 17 bp, Homo sapiens
cgtcagtatcaggcctg

SEQ ID NO: 434249 - DNA, 14 bp, Homo sapiens
cgtccacaggggca

SEQ ID NO: 434250 - DNA, 17 bp, Homo sapiens
cgtccacaggggcaggc

SEQ ID NO: 434251 - DNA, 19 bp, Homo sapiens
cgtccacaggggcaggcct

SEQ ID NO: 434252 - DNA, 14 bp, Homo sapiens
cgtccacccaggct

SEQ ID NO: 434253 - DNA, 15 bp, Homo sapiens
cgtccacccaggctg

SEQ ID NO: 434254 - DNA, 17 bp, Homo sapiens
cgtccacccaggctgca

SEQ ID NO: 434255 - DNA, 18 bp, Homo sapiens
cgtccacccgtttccaag

SEQ ID NO: 434256 - DNA, 20 bp, Homo sapiens
cgtccacccgtttccaagcc

SEQ ID NO: 434257 - DNA, 16 bp, Homo sapiens
cgtccacggctctagg

SEQ ID NO: 434258 - DNA, 22 bp, Homo sapiens
cgtccacggctctaggtggggc

SEQ ID NO: 434259 - DNA, 14 bp, Homo sapiens
cgtccactttccct

SEQ ID NO: 434260 - DNA, 18 bp, Homo sapiens
cgtccatctctctccctt

SEQ ID NO: 434261 - DNA, 14 bp, Homo sapiens
cgtccccagggtgc

SEQ ID NO: 434262 - DNA, 13 bp, Homo sapiens
cgtccccctgggg

SEQ ID NO: 434263 - DNA, 15 bp, Homo sapiens
cgtcccctccgccgt

SEQ ID NO: 434264 - DNA, 15 bp, Homo sapiens
cgtcccctgggccac

SEQ ID NO: 434265 - DNA, 19 bp, Homo sapiens
cgtcccgcgttcaagactt

SEQ ID NO: 434266 - DNA, 14 bp, Homo sapiens
cgtcccgctgctgt

SEQ ID NO: 434267 - DNA, 13 bp, Homo sapiens
cgtccctctgcct

SEQ ID NO: 434268 - DNA, 17 bp, Homo sapiens
cgtccctctgccttgca

SEQ ID NO: 434269 - DNA, 17 bp, Homo sapiens
cgtccctgacttcccag

SEQ ID NO: 434270 - DNA, 18 bp, Homo sapiens
cgtccctgacttcccagc

SEQ ID NO: 434271 - DNA, 20 bp, Homo sapiens
cgtccctgacttcccagctg

SEQ ID NO: 434272 - DNA, 22 bp, Homo sapiens
cgtccctgacttcccagctggc

SEQ ID NO: 434273 - DNA, 17 bp, Homo sapiens
cgtccctttccctgcat

SEQ ID NO: 434274 - DNA, 19 bp, Homo sapiens
cgtccctttccctgcatcc

SEQ ID NO: 434275 - DNA, 17 bp, Homo sapiens
cgtccgcccgcccaccc

SEQ ID NO: 434276 - DNA, 19 bp, Homo sapiens
cgtccgcccgcccaccccg

SEQ ID NO: 434277 - DNA, 20 bp, Homo sapiens
cgtccgcccgcccaccccgc

SEQ ID NO: 434278 - DNA, 15 bp, Homo sapiens
cgtccgcgcgccagc

SEQ ID NO: 434279 - DNA, 18 bp, Homo sapiens
cgtccggcctgcagccca

SEQ ID NO: 434280 - DNA, 16 bp, Homo sapiens
cgtccggggtggtgga

SEQ ID NO: 434281 - DNA, 22 bp, Homo sapiens
cgtcctccaccggtgcctcctc

SEQ ID NO: 434282 - DNA, 17 bp, Homo sapiens
cgtcctcccgggccctc

SEQ ID NO: 434283 - DNA, 19 bp, Homo sapiens
cgtcctgcacgccgtggag

SEQ ID NO: 434284 - DNA, 12 bp, Homo sapiens
cgtcctgcagag

SEQ ID NO: 434285 - DNA, 19 bp, Homo sapiens
cgtcctgcagaggaccaca

SEQ ID NO: 434286 - DNA, 14 bp, Homo sapiens
cgtcctggaatgaa

SEQ ID NO: 434287 - DNA, 16 bp, Homo sapiens
cgtcctgtcccagagg

SEQ ID NO: 434288 - DNA, 22 bp, Homo sapiens
cgtcctgtcccctccttccagc

SEQ ID NO: 434289 - DNA, 17 bp, Homo sapiens
cgtcggactgcccccag

SEQ ID NO: 434290 - DNA, 15 bp, Homo sapiens
cgtctacccagactc

SEQ ID NO: 434291 - DNA, 13 bp, Homo sapiens
cgtctctcaccta

SEQ ID NO: 434292 - DNA, 14 bp, Homo sapiens
cgtctgactccaga

SEQ ID NO: 434293 - DNA, 15 bp, Homo sapiens
cgtctgactccagag

SEQ ID NO: 434294 - DNA, 17 bp, Homo sapiens
cgtctgactccagagtc

SEQ ID NO: 434295 - DNA, 16 bp, Homo sapiens
cgtctgccaggcccat

SEQ ID NO: 434296 - DNA, 18 bp, Homo sapiens
cgtctgccaggcccatct

SEQ ID NO: 434297 - DNA, 10 bp, Homo sapiens
cgtctgcccc

SEQ ID NO: 434298 - DNA, 19 bp, Homo sapiens
cgtctgccccttgacccca

SEQ ID NO: 434299 - DNA, 16 bp, Homo sapiens
cgtctggcgagccctt

SEQ ID NO: 434300 - DNA, 21 bp, Homo sapiens
cgtctggcgagcccttagcct

SEQ ID NO: 434301 - DNA, 22 bp, Homo sapiens
cgtctggcgagcccttagcctt

SEQ ID NO: 434302 - DNA, 14 bp, Homo sapiens
cgtctggtgttctc

SEQ ID NO: 434303 - DNA, 20 bp, Homo sapiens
cgtcttagcaagaagtaaaa

SEQ ID NO: 434304 - DNA, 13 bp, Homo sapiens
cgtcttgtatttt

SEQ ID NO: 434305 - DNA, 15 bp, Homo sapiens
cgtcttgtattttct

SEQ ID NO: 434306 - DNA, 21 bp, Homo sapiens
cgtctttggttcctcatggct

SEQ ID NO: 434307 - DNA, 15 bp, Homo sapiens
cgtgaaacacaccag

SEQ ID NO: 434308 - DNA, 24 bp, Homo sapiens
cgtgaaacacaccaggctgtgggc

SEQ ID NO: 434309 - DNA, 17 bp, Homo sapiens
cgtgaagcagtgcctcg

SEQ ID NO: 434310 - DNA, 13 bp, Homo sapiens
cgtgaaggacctg

SEQ ID NO: 434311 - DNA, 20 bp, Homo sapiens
cgtgaccaattgccctgcca

SEQ ID NO: 434312 - DNA, 22 bp, Homo sapiens
cgtgaccggcccgccaccttgt

SEQ ID NO: 434313 - DNA, 16 bp, Homo sapiens
cgtgacttcagactct

SEQ ID NO: 434314 - DNA, 17 bp, Homo sapiens
cgtgacttcagactctc

SEQ ID NO: 434315 - DNA, 22 bp, Homo sapiens
cgtgacttcagactctctcctc

SEQ ID NO: 434316 - DNA, 17 bp, Homo sapiens
cgtgagagaatctgcct

SEQ ID NO: 434317 - DNA, 16 bp, Homo sapiens
cgtgagcgccccgccc

SEQ ID NO: 434318 - DNA, 19 bp, Homo sapiens
cgtgagtcctggcatggga

SEQ ID NO: 434319 - DNA, 21 bp, Homo sapiens
cgtgatccatccatctccagg

SEQ ID NO: 434320 - DNA, 21 bp, Homo sapiens
cgtgcaacgtgtaacttgtgc

SEQ ID NO: 434321 - DNA, 21 bp, Homo sapiens
cgtgcacgtggagagctggtg

SEQ ID NO: 434322 - DNA, 15 bp, Homo sapiens
cgtgcatttgtgagc

SEQ ID NO: 434323 - DNA, 23 bp, Homo sapiens
cgtgccacccgtaggcagcctct

SEQ ID NO: 434324 - DNA, 13 bp, Homo sapiens
cgtgccaggagca

SEQ ID NO: 434325 - DNA, 15 bp, Homo sapiens
cgtgccagtcctggg

SEQ ID NO: 434326 - DNA, 18 bp, Homo sapiens
cgtgccattgtactccag

SEQ ID NO: 434327 - DNA, 19 bp, Homo sapiens
cgtgccattgtactccagc

SEQ ID NO: 434328 - DNA, 24 bp, Homo sapiens
cgtgccattgtactccagcctggg

SEQ ID NO: 434329 - DNA, 18 bp, Homo sapiens
cgtgccattgtctttcct

SEQ ID NO: 434330 - DNA, 13 bp, Homo sapiens
cgtgcccccagcg

SEQ ID NO: 434331 - DNA, 20 bp, Homo sapiens
cgtgcccccctcctccagta

SEQ ID NO: 434332 - DNA, 17 bp, Homo sapiens
cgtgccccgcctccccg

SEQ ID NO: 434333 - DNA, 19 bp, Homo sapiens
cgtgcccggctaatttttt

SEQ ID NO: 434334 - DNA, 20 bp, Homo sapiens
cgtgccctgacccctgcacc

SEQ ID NO: 434335 - DNA, 21 bp, Homo sapiens
cgtgccggcggcagccccact

SEQ ID NO: 434336 - DNA, 22 bp, Homo sapiens
cgtgcctgcattcgcagcagct

SEQ ID NO: 434337 - DNA, 15 bp, Homo sapiens
cgtgccttcagctct

SEQ ID NO: 434338 - DNA, 16 bp, Homo sapiens
cgtgccttcagctcta

SEQ ID NO: 434339 - DNA, 13 bp, Homo sapiens
cgtgccttccccg

SEQ ID NO: 434340 - DNA, 16 bp, Homo sapiens
cgtgccttccccgtgc

SEQ ID NO: 434341 - DNA, 22 bp, Homo sapiens
cgtgccttccccgtgcggcccg

SEQ ID NO: 434342 - DNA, 16 bp, Homo sapiens
cgtgcgaccagaggtg

SEQ ID NO: 434343 - DNA, 22 bp, Homo sapiens
cgtgcgcagccgcgctctgccc

SEQ ID NO: 434344 - DNA, 13 bp, Homo sapiens
cgtgctggaggaa

SEQ ID NO: 434345 - DNA, 13 bp, Homo sapiens
cgtgctgggacag

SEQ ID NO: 434346 - DNA, 18 bp, Homo sapiens
cgtgcttcctcctgacag

SEQ ID NO: 434347 - DNA, 13 bp, Homo sapiens
cgtggacacctgc

SEQ ID NO: 434348 - DNA, 14 bp, Homo sapiens
cgtggacacctgcc

SEQ ID NO: 434349 - DNA, 15 bp, Homo sapiens
cgtggacacctgccc

SEQ ID NO: 434350 - DNA, 18 bp, Homo sapiens
cgtggacacctgccctgc

SEQ ID NO: 434351 - DNA, 19 bp, Homo sapiens
cgtggacacctgccctgcc

SEQ ID NO: 434352 - DNA, 13 bp, Homo sapiens
cgtggacctgcct

SEQ ID NO: 434353 - DNA, 15 bp, Homo sapiens
cgtggactctgtgct

SEQ ID NO: 434354 - DNA, 16 bp, Homo sapiens
cgtggagatagtgcca

SEQ ID NO: 434355 - DNA, 13 bp, Homo sapiens
cgtggagccacag

SEQ ID NO: 434356 - DNA, 15 bp, Homo sapiens
cgtggagccagggag

SEQ ID NO: 434357 - DNA, 12 bp, Homo sapiens
cgtggagctcgg

SEQ ID NO: 434358 - DNA, 18 bp, Homo sapiens
cgtggatcaagcttgtgt

SEQ ID NO: 434359 - DNA, 20 bp, Homo sapiens
cgtggcagataatcagcctc

SEQ ID NO: 434360 - DNA, 21 bp, Homo sapiens
cgtggcatttccgtggacagc

SEQ ID NO: 434361 - DNA, 17 bp, Homo sapiens
cgtggccccgccctcag

SEQ ID NO: 434362 - DNA, 19 bp, Homo sapiens
cgtggccccgccctcaggc

SEQ ID NO: 434363 - DNA, 23 bp, Homo sapiens
cgtggcctcttgagcagtggctg

SEQ ID NO: 434364 - DNA, 16 bp, Homo sapiens
cgtggcggggcagcag

SEQ ID NO: 434365 - DNA, 15 bp, Homo sapiens
cgtggctgtggcaca

SEQ ID NO: 434366 - DNA, 16 bp, Homo sapiens
cgtggctgtggcacag

SEQ ID NO: 434367 - DNA, 23 bp, Homo sapiens
cgtgggaactcgaacttgaagca

SEQ ID NO: 434368 - DNA, 19 bp, Homo sapiens
cgtgggaattttatctttt

SEQ ID NO: 434369 - DNA, 17 bp, Homo sapiens
cgtgggatccagagaga

SEQ ID NO: 434370 - DNA, 13 bp, Homo sapiens
cgtgggctctggc

SEQ ID NO: 434371 - DNA, 14 bp, Homo sapiens
cgtgggctctggct

SEQ ID NO: 434372 - DNA, 15 bp, Homo sapiens
cgtgggctctggctc

SEQ ID NO: 434373 - DNA, 16 bp, Homo sapiens
cgtgggctctggctcc

SEQ ID NO: 434374 - DNA, 14 bp, Homo sapiens
ctactattctgtta

SEQ ID NO: 434375 - DNA, 15 bp, Homo sapiens
ctactcacagtctct

SEQ ID NO: 434376 - DNA, 15 bp, Homo sapiens
ctactcatgccagat

SEQ ID NO: 434377 - DNA, 14 bp, Homo sapiens
ctactcatttttct

SEQ ID NO: 434378 - DNA, 12 bp, Homo sapiens
ctactccactga

SEQ ID NO: 434379 - DNA, 20 bp, Homo sapiens
ctactccactgacctggaag

SEQ ID NO: 434380 - DNA, 16 bp, Homo sapiens
ctactcgagttacaga

SEQ ID NO: 434381 - DNA, 18 bp, Homo sapiens
ctactctcttgccagcat

SEQ ID NO: 434382 - DNA, 18 bp, Homo sapiens
ctactctgtccaggccac

SEQ ID NO: 434383 - DNA, 12 bp, Homo sapiens
ctactctgtgta

SEQ ID NO: 434384 - DNA, 14 bp, Homo sapiens
ctactcttgtcatt

SEQ ID NO: 434385 - DNA, 21 bp, Homo sapiens
ctactggacttgaatggttaa

SEQ ID NO: 434386 - DNA, 13 bp, Homo sapiens
ctactgtacattt

SEQ ID NO: 434387 - DNA, 11 bp, Homo sapiens
ctactgtcagt

SEQ ID NO: 434388 - DNA, 15 bp, Homo sapiens
ctactgtctccttcc

SEQ ID NO: 434389 - DNA, 16 bp, Homo sapiens
ctactgtctccttccc

SEQ ID NO: 434390 - DNA, 17 bp, Homo sapiens
ctactgtctccttccca

SEQ ID NO: 434391 - DNA, 20 bp, Homo sapiens
ctactgtctccttcccactg

SEQ ID NO: 434392 - DNA, 13 bp, Homo sapiens
ctacttaaacaaa

SEQ ID NO: 434393 - DNA, 19 bp, Homo sapiens
ctacttaaacaaaaacttt

SEQ ID NO: 434394 - DNA, 23 bp, Homo sapiens
ctacttaaacaaaaactttccat

SEQ ID NO: 434395 - DNA, 22 bp, Homo sapiens
ctacttaattcctttctcatcc

SEQ ID NO: 434396 - DNA, 17 bp, Homo sapiens
ctacttagcatgtccct

SEQ ID NO: 434397 - DNA, 21 bp, Homo sapiens
ctacttaggaaatactcagca

SEQ ID NO: 434398 - DNA, 17 bp, Homo sapiens
ctacttccaagaaaaat

SEQ ID NO: 434399 - DNA, 14 bp, Homo sapiens
ctacttcctcctcc

SEQ ID NO: 434400 - DNA, 20 bp, Homo sapiens
ctacttcctgtgacttcagc

SEQ ID NO: 434401 - DNA, 20 bp, Homo sapiens
ctacttctggaagtcatctc

SEQ ID NO: 434402 - DNA, 23 bp, Homo sapiens
ctacttgatatttccttcaccac

SEQ ID NO: 434403 - DNA, 23 bp, Homo sapiens
ctacttggtggtttgcttgctct

SEQ ID NO: 434404 - DNA, 14 bp, Homo sapiens
ctacttgtttaaca

SEQ ID NO: 434405 - DNA, 14 bp, Homo sapiens
ctactttaaatcct

SEQ ID NO: 434406 - DNA, 14 bp, Homo sapiens
ctactttccaggct

SEQ ID NO: 434407 - DNA, 14 bp, Homo sapiens
ctactttgactaat

SEQ ID NO: 434408 - DNA, 21 bp, Homo sapiens
ctactttgtcccctcacctcc

SEQ ID NO: 434409 - DNA, 22 bp, Homo sapiens
ctacttttacttgttcatttct

SEQ ID NO: 434410 - DNA, 14 bp, Homo sapiens
ctactttttccttc

SEQ ID NO: 434411 - DNA, 23 bp, Homo sapiens
ctactttttccttcctgccctgt

SEQ ID NO: 434412 - DNA, 16 bp, Homo sapiens
ctagaaaagcttccta

SEQ ID NO: 434413 - DNA, 22 bp, Homo sapiens
ctagaaagaaaagaccctgaga

SEQ ID NO: 434414 - DNA, 18 bp, Homo sapiens
ctagaaagccatattcca

SEQ ID NO: 434415 - DNA, 21 bp, Homo sapiens
ctagaaagcccctcacctcag

SEQ ID NO: 434416 - DNA, 12 bp, Homo sapiens
ctagaagctgat

SEQ ID NO: 434417 - DNA, 13 bp, Homo sapiens
ctagaagggaagg

SEQ ID NO: 434418 - DNA, 14 bp, Homo sapiens
ctagaaggggcgag

SEQ ID NO: 434419 - DNA, 21 bp, Homo sapiens
ctagaagtatttttgtctctt

SEQ ID NO: 434420 - DNA, 21 bp, Homo sapiens
ctagaagtcttcatggtctct

SEQ ID NO: 434421 - DNA, 18 bp, Homo sapiens
ctagaatactttttaaaa

SEQ ID NO: 434422 - DNA, 21 bp, Homo sapiens
ctagaataggagaaaatgaaa

SEQ ID NO: 434423 - DNA, 22 bp, Homo sapiens
ctagaatggaaaactgcctgtt

SEQ ID NO: 434424 - DNA, 20 bp, Homo sapiens
ctagaattataagtcacaaa

SEQ ID NO: 434425 - DNA, 21 bp, Homo sapiens
ctagaatttatcacacttctg

SEQ ID NO: 434426 - DNA, 13 bp, Homo sapiens
ctagaatttattc

SEQ ID NO: 434427 - DNA, 19 bp, Homo sapiens
ctagacaaaggcccagaaa

SEQ ID NO: 434428 - DNA, 22 bp, Homo sapiens
ctagacaaaggcccagaaatca

SEQ ID NO: 434429 - DNA, 18 bp, Homo sapiens
ctagacaaggttgctgtt

SEQ ID NO: 434430 - DNA, 16 bp, Homo sapiens
ctagacactgaaggca

SEQ ID NO: 434431 - DNA, 22 bp, Homo sapiens
ctagacagtattgccacctctg

SEQ ID NO: 434432 - DNA, 15 bp, Homo sapiens
ctagaccctccccca

SEQ ID NO: 434433 - DNA, 18 bp, Homo sapiens
ctagaccctcccccacca

SEQ ID NO: 434434 - DNA, 17 bp, Homo sapiens
ctagacctccagctgtt

SEQ ID NO: 434435 - DNA, 18 bp, Homo sapiens
ctagacgcccctcccaag

SEQ ID NO: 434436 - DNA, 22 bp, Homo sapiens
ctagactactcaatattaaagg

SEQ ID NO: 434437 - DNA, 22 bp, Homo sapiens
ctagactaggagaccagaagtg

SEQ ID NO: 434438 - DNA, 20 bp, Homo sapiens
ctagactgcatcccgtacct

SEQ ID NO: 434439 - DNA, 19 bp, Homo sapiens
ctagactggagtgaggctt

SEQ ID NO: 434440 - DNA, 23 bp, Homo sapiens
ctagactggagtgaggcttccag

SEQ ID NO: 434441 - DNA, 24 bp, Homo sapiens
ctagactggagtgaggcttccagg

SEQ ID NO: 434442 - DNA, 15 bp, Homo sapiens
ctagacttccccatc

SEQ ID NO: 434443 - DNA, 16 bp, Homo sapiens
ctagacttccccatcc

SEQ ID NO: 434444 - DNA, 17 bp, Homo sapiens
ctagacttccccatccc

SEQ ID NO: 434445 - DNA, 21 bp, Homo sapiens
ctagacttccccatcccgaag

SEQ ID NO: 434446 - DNA, 16 bp, Homo sapiens
ctagacttgaaagttt

SEQ ID NO: 434447 - DNA, 19 bp, Homo sapiens
ctagagacgcaccttgctg

SEQ ID NO: 434448 - DNA, 20 bp, Homo sapiens
ctagagacgcaccttgctgc

SEQ ID NO: 434449 - DNA, 22 bp, Homo sapiens
ctagagaggggcctctggctgc

SEQ ID NO: 434450 - DNA, 13 bp, Homo sapiens
ctagagattctta

SEQ ID NO: 434451 - DNA, 21 bp, Homo sapiens
ctagagattcttagctcttgg

SEQ ID NO: 434452 - DNA, 14 bp, Homo sapiens
ctagagcagggatt

SEQ ID NO: 434453 - DNA, 16 bp, Homo sapiens
ctagagcatctgtccc

SEQ ID NO: 434454 - DNA, 20 bp, Homo sapiens
ctagagcatctgtcccactg

SEQ ID NO: 434455 - DNA, 17 bp, Homo sapiens
ctagagctccagttctt

SEQ ID NO: 434456 - DNA, 22 bp, Homo sapiens
ctagagcttcaagtctgtgcct

SEQ ID NO: 434457 - DNA, 18 bp, Homo sapiens
ctagaggccagccccacc

SEQ ID NO: 434458 - DNA, 20 bp, Homo sapiens
ctagaggccagccccaccca

SEQ ID NO: 434459 - DNA, 21 bp, Homo sapiens
ctagaggccagccccacccag

SEQ ID NO: 434460 - DNA, 11 bp, Homo sapiens
ctagaggcctc

SEQ ID NO: 434461 - DNA, 15 bp, Homo sapiens
ctagaggcctcagtt

SEQ ID NO: 434462 - DNA, 12 bp, Homo sapiens
ctagaggcctga

SEQ ID NO: 434463 - DNA, 13 bp, Homo sapiens
ctagaggcctgag

SEQ ID NO: 434464 - DNA, 15 bp, Homo sapiens
ctagaggcctgagga

SEQ ID NO: 434465 - DNA, 16 bp, Homo sapiens
ctagaggcctgaggat

SEQ ID NO: 434466 - DNA, 16 bp, Homo sapiens
ctagaggcgagccagg

SEQ ID NO: 434467 - DNA, 19 bp, Homo sapiens
ctagaggcgagccaggcaa

SEQ ID NO: 434468 - DNA, 16 bp, Homo sapiens
ctagagggttcctgta

SEQ ID NO: 434469 - DNA, 19 bp, Homo sapiens
ctagaggtgggcagctggg

SEQ ID NO: 434470 - DNA, 20 bp, Homo sapiens
ctagaggtgggcagctgggc

SEQ ID NO: 434471 - DNA, 22 bp, Homo sapiens
ctagaggtgggcagctgggccc

SEQ ID NO: 434472 - DNA, 15 bp, Homo sapiens
ctagagtcctcactc

SEQ ID NO: 434473 - DNA, 20 bp, Homo sapiens
ctagagtctgaacagctgta

SEQ ID NO: 434474 - DNA, 15 bp, Homo sapiens
ctagataaaaagatg

SEQ ID NO: 434475 - DNA, 15 bp, Homo sapiens
ctagatatgagaaat

SEQ ID NO: 434476 - DNA, 14 bp, Homo sapiens
ctagatcagagagc

SEQ ID NO: 434477 - DNA, 14 bp, Homo sapiens
ctagatcctgcacc

SEQ ID NO: 434478 - DNA, 20 bp, Homo sapiens
ctagatcctgcaccccagca

SEQ ID NO: 434479 - DNA, 21 bp, Homo sapiens
ctagatctcctatttttcaga

SEQ ID NO: 434480 - DNA, 20 bp, Homo sapiens
ctagatcttacatctgcagc

SEQ ID NO: 434481 - DNA, 23 bp, Homo sapiens
ctagatgagcccagccctgttct

SEQ ID NO: 434482 - DNA, 15 bp, Homo sapiens
ctagatggtgctgag

SEQ ID NO: 434483 - DNA, 16 bp, Homo sapiens
ctagatggtgctgaga

SEQ ID NO: 434484 - DNA, 17 bp, Homo sapiens
ctagatggtgctgagaa

SEQ ID NO: 434485 - DNA, 12 bp, Homo sapiens
ctagatggttcc

SEQ ID NO: 434486 - DNA, 15 bp, Homo sapiens
ctagatggttccctt

SEQ ID NO: 434487 - DNA, 13 bp, Homo sapiens
ctagatgtcttta

SEQ ID NO: 434488 - DNA, 20 bp, Homo sapiens
ctagatgtttaacaaatcta

SEQ ID NO: 434489 - DNA, 13 bp, Homo sapiens
ctagcaaaaggat

SEQ ID NO: 434490 - DNA, 21 bp, Homo sapiens
ctagcaaacagatgtttgttt

SEQ ID NO: 434491 - DNA, 18 bp, Homo sapiens
ctagcaagaagattctaa

SEQ ID NO: 434492 - DNA, 18 bp, Homo sapiens
ctagcaagacctgttggt

SEQ ID NO: 434493 - DNA, 19 bp, Homo sapiens
ctagcacaaggagtgcccg

SEQ ID NO: 434494 - DNA, 18 bp, Homo sapiens
ctagcacagctgtgagga

SEQ ID NO: 434495 - DNA, 16 bp, Homo sapiens
ctagcactcacatgct

SEQ ID NO: 434496 - DNA, 21 bp, Homo sapiens
ctagcactcacatgctggaca

SEQ ID NO: 434497 - DNA, 20 bp, Homo sapiens
ctagcactttgggaggctga

SEQ ID NO: 434498 - DNA, 15 bp, Homo sapiens
ctagcaggcaggaag

SEQ ID NO: 434499 - DNA, 19 bp, Homo sapiens
ctagcaggcaggaagtcct

SEQ ID NO: 434500 - DNA, 15 bp, Homo sapiens
ctagcatagtaaact

SEQ ID NO: 434501 - DNA, 12 bp, Homo sapiens
ctagccaaggct

SEQ ID NO: 434502 - DNA, 19 bp, Homo sapiens
ctagccagagcccttcact

SEQ ID NO: 434503 - DNA, 23 bp, Homo sapiens
ctagccagagcccttcactgcca

SEQ ID NO: 434504 - DNA, 16 bp, Homo sapiens
ctattccttctggcct

SEQ ID NO: 434505 - DNA, 19 bp, Homo sapiens
ctattctcaaagtttccta

SEQ ID NO: 434506 - DNA, 21 bp, Homo sapiens
ctattctcaaagtttcctaat

SEQ ID NO: 434507 - DNA, 15 bp, Homo sapiens
ctattctgagccttg

SEQ ID NO: 434508 - DNA, 18 bp, Homo sapiens
ctattctgccactcctga

SEQ ID NO: 434509 - DNA, 16 bp, Homo sapiens
ctattcttaagcactt

SEQ ID NO: 434510 - DNA, 16 bp, Homo sapiens
ctattcttgatgtaaa

SEQ ID NO: 434511 - DNA, 19 bp, Homo sapiens
ctattcttgatgtaaaatc

SEQ ID NO: 434512 - DNA, 22 bp, Homo sapiens
ctattcttgatgtaaaatcttg

SEQ ID NO: 434513 - DNA, 16 bp, Homo sapiens
ctattgacaagtcatt

SEQ ID NO: 434514 - DNA, 17 bp, Homo sapiens
ctattgacaagtcattt

SEQ ID NO: 434515 - DNA, 12 bp, Homo sapiens
ctattggacaga

SEQ ID NO: 434516 - DNA, 21 bp, Homo sapiens
ctattggccaacaatcctttc

SEQ ID NO: 434517 - DNA, 23 bp, Homo sapiens
ctattggccaacaatcctttctg

SEQ ID NO: 434518 - DNA, 23 bp, Homo sapiens
ctattgggttcattattggaatt

SEQ ID NO: 434519 - DNA, 15 bp, Homo sapiens
ctattgttgtgggct

SEQ ID NO: 434520 - DNA, 13 bp, Homo sapiens
ctatttaactgac

SEQ ID NO: 434521 - DNA, 11 bp, Homo sapiens
ctatttaagcc

SEQ ID NO: 434522 - DNA, 12 bp, Homo sapiens
ctatttaagccc

SEQ ID NO: 434523 - DNA, 20 bp, Homo sapiens
ctatttactggaaacctgtt

SEQ ID NO: 434524 - DNA, 21 bp, Homo sapiens
ctatttataaactagatctcc

SEQ ID NO: 434525 - DNA, 14 bp, Homo sapiens
ctatttatttactg

SEQ ID NO: 434526 - DNA, 18 bp, Homo sapiens
ctatttatttactgagct

SEQ ID NO: 434527 - DNA, 14 bp, Homo sapiens
ctatttccattcca

SEQ ID NO: 434528 - DNA, 17 bp, Homo sapiens
ctatttccattccagaa

SEQ ID NO: 434529 - DNA, 15 bp, Homo sapiens
ctatttcccaagctg

SEQ ID NO: 434530 - DNA, 18 bp, Homo sapiens
ctatttcggaaatacact

SEQ ID NO: 434531 - DNA, 21 bp, Homo sapiens
ctatttcggaaatacactaca

SEQ ID NO: 434532 - DNA, 12 bp, Homo sapiens
ctatttctatct

SEQ ID NO: 434533 - DNA, 17 bp, Homo sapiens
ctatttctatgtatgtg

SEQ ID NO: 434534 - DNA, 21 bp, Homo sapiens
ctatttctatgtatgtgccaa

SEQ ID NO: 434535 - DNA, 17 bp, Homo sapiens
ctatttctcccttcaat

SEQ ID NO: 434536 - DNA, 14 bp, Homo sapiens
ctatttctctcccc

SEQ ID NO: 434537 - DNA, 13 bp, Homo sapiens
ctatttgctttag

SEQ ID NO: 434538 - DNA, 10 bp, Homo sapiens
ctattttcag

SEQ ID NO: 434539 - DNA, 16 bp, Homo sapiens
ctatttttatttatat

SEQ ID NO: 434540 - DNA, 20 bp, Homo sapiens
ctatttttattttaaaataa

SEQ ID NO: 434541 - DNA, 22 bp, Homo sapiens
ctatttttgtttttgtcttttt

SEQ ID NO: 434542 - DNA, 20 bp, Homo sapiens
ctatttttttaactgaaaat

SEQ ID NO: 434543 - DNA, 23 bp, Homo sapiens
ctatttttttaactgaaaatgta

SEQ ID NO: 434544 - DNA, 18 bp, Homo sapiens
ctatttttttgttgctgt

SEQ ID NO: 434545 - DNA, 20 bp, Homo sapiens
ctcaaaaatacaaaataaaa

SEQ ID NO: 434546 - DNA, 13 bp, Homo sapiens
ctcaaaaatgatt

SEQ ID NO: 434547 - DNA, 21 bp, Homo sapiens
ctcaaaagcatttatcattct

SEQ ID NO: 434548 - DNA, 22 bp, Homo sapiens
ctcaaaagcatttatcattctt

SEQ ID NO: 434549 - DNA, 14 bp, Homo sapiens
ctcaaaaggaaacc

SEQ ID NO: 434550 - DNA, 22 bp, Homo sapiens
ctcaaaaggagaactgtgctct

SEQ ID NO: 434551 - DNA, 16 bp, Homo sapiens
ctcaaaagtctatttt

SEQ ID NO: 434552 - DNA, 23 bp, Homo sapiens
ctcaaaatattttttttaactgc

SEQ ID NO: 434553 - DNA, 11 bp, Homo sapiens
ctcaaaattat

SEQ ID NO: 434554 - DNA, 17 bp, Homo sapiens
ctcaaaccctgtttacg

SEQ ID NO: 434555 - DNA, 20 bp, Homo sapiens
ctcaaacctccaaaagccct

SEQ ID NO: 434556 - DNA, 20 bp, Homo sapiens
ctcaaacttttcccctgtcc

SEQ ID NO: 434557 - DNA, 15 bp, Homo sapiens
ctcaaagatctttcg

SEQ ID NO: 434558 - DNA, 19 bp, Homo sapiens
ctcaaagatgtactgagag

SEQ ID NO: 434559 - DNA, 24 bp, Homo sapiens
ctcaaagatgtactgagaggaggg

SEQ ID NO: 434560 - DNA, 19 bp, Homo sapiens
ctcaaagtttttacagtgt

SEQ ID NO: 434561 - DNA, 21 bp, Homo sapiens
ctcaaagtttttacagtgtat

SEQ ID NO: 434562 - DNA, 22 bp, Homo sapiens
ctcaaatctattcagacaagca

SEQ ID NO: 434563 - DNA, 14 bp, Homo sapiens
ctcaaatgtatatt

SEQ ID NO: 434564 - DNA, 22 bp, Homo sapiens
ctcaacaaagaagaaccatctt

SEQ ID NO: 434565 - DNA, 19 bp, Homo sapiens
ctcaacaaagcacagtgtt

SEQ ID NO: 434566 - DNA, 20 bp, Homo sapiens
ctcaacatgttactgaccag

SEQ ID NO: 434567 - DNA, 20 bp, Homo sapiens
ctcaaccaaattaaaaattt

SEQ ID NO: 434568 - DNA, 22 bp, Homo sapiens
ctcaacccccatttctatttat

SEQ ID NO: 434569 - DNA, 16 bp, Homo sapiens
ctcaacccccctccca

SEQ ID NO: 434570 - DNA, 17 bp, Homo sapiens
ctcaacccccctcccag

SEQ ID NO: 434571 - DNA, 22 bp, Homo sapiens
ctcaaccctccctcagcccctc

SEQ ID NO: 434572 - DNA, 13 bp, Homo sapiens
ctcaacctctcag

SEQ ID NO: 434573 - DNA, 14 bp, Homo sapiens
ctcaacctctcaga

SEQ ID NO: 434574 - DNA, 17 bp, Homo sapiens
ctcaacctgtaaattat

SEQ ID NO: 434575 - DNA, 19 bp, Homo sapiens
ctcaacctgtaaattattt

SEQ ID NO: 434576 - DNA, 21 bp, Homo sapiens
ctcaacctgtgatgaggggag

SEQ ID NO: 434577 - DNA, 13 bp, Homo sapiens
ctcaactgatgat

SEQ ID NO: 434578 - DNA, 17 bp, Homo sapiens
ctcaagaacaaacagaa

SEQ ID NO: 434579 - DNA, 19 bp, Homo sapiens
ctcaagaagacatggagac

SEQ ID NO: 434580 - DNA, 19 bp, Homo sapiens
ctcaagagggcactggtgg

SEQ ID NO: 434581 - DNA, 21 bp, Homo sapiens
ctcaagagggcactggtggcc

SEQ ID NO: 434582 - DNA, 14 bp, Homo sapiens
ctcaagattctact

SEQ ID NO: 434583 - DNA, 16 bp, Homo sapiens
ctcaagattctacttg

SEQ ID NO: 434584 - DNA, 17 bp, Homo sapiens
ctcaagcaatcctcctg

SEQ ID NO: 434585 - DNA, 14 bp, Homo sapiens
ctcaagcagtctac

SEQ ID NO: 434586 - DNA, 13 bp, Homo sapiens
ctcaagccaggag

SEQ ID NO: 434587 - DNA, 16 bp, Homo sapiens
ctcaagccaggagacc

SEQ ID NO: 434588 - DNA, 20 bp, Homo sapiens
ctcaaggacttgaaagcatc

SEQ ID NO: 434589 - DNA, 21 bp, Homo sapiens
ctcaagggctagcatccctga

SEQ ID NO: 434590 - DNA, 12 bp, Homo sapiens
ctcaagggcttt

SEQ ID NO: 434591 - DNA, 22 bp, Homo sapiens
ctcaagggtagggtctgcgtgt

SEQ ID NO: 434592 - DNA, 19 bp, Homo sapiens
ctcaaggtgggccttgcta

SEQ ID NO: 434593 - DNA, 22 bp, Homo sapiens
ctcaagtgtctcagtccacctg

SEQ ID NO: 434594 - DNA, 16 bp, Homo sapiens
ctcaataaatatttgt

SEQ ID NO: 434595 - DNA, 17 bp, Homo sapiens
ctcaatattcaataaag

SEQ ID NO: 434596 - DNA, 18 bp, Homo sapiens
ctcaatattcaataaagc

SEQ ID NO: 434597 - DNA, 16 bp, Homo sapiens
ctcaatattcctgaat

SEQ ID NO: 434598 - DNA, 14 bp, Homo sapiens
ctcaatcactgctc

SEQ ID NO: 434599 - DNA, 20 bp, Homo sapiens
ctcaatgaaaccttcctctt

SEQ ID NO: 434600 - DNA, 22 bp, Homo sapiens
ctcaatgcattgtcttgtggag

SEQ ID NO: 434601 - DNA, 17 bp, Homo sapiens
ctcaatgcttttctagc

SEQ ID NO: 434602 - DNA, 20 bp, Homo sapiens
ctcaatggaggtttgcaaag

SEQ ID NO: 434603 - DNA, 11 bp, Homo sapiens
ctcaatgtgaa

SEQ ID NO: 434604 - DNA, 22 bp, Homo sapiens
ctcaatgtgctgttgattcttt

SEQ ID NO: 434605 - DNA, 20 bp, Homo sapiens
ctcaatgtggaaaaaatatt

SEQ ID NO: 434606 - DNA, 15 bp, Homo sapiens
ctcaattttgtattt

SEQ ID NO: 434607 - DNA, 19 bp, Homo sapiens
ctcaattttgtatttaatg

SEQ ID NO: 434608 - DNA, 13 bp, Homo sapiens
ctcacaactcctt

SEQ ID NO: 434609 - DNA, 14 bp, Homo sapiens
ctcacaactccttc

SEQ ID NO: 434610 - DNA, 20 bp, Homo sapiens
ctcacaactgtttttgaaga

SEQ ID NO: 434611 - DNA, 17 bp, Homo sapiens
ctcacaagcctcttctg

SEQ ID NO: 434612 - DNA, 18 bp, Homo sapiens
ctcacacacacagctggg

SEQ ID NO: 434613 - DNA, 20 bp, Homo sapiens
ctcacacacacagctgggca

SEQ ID NO: 434614 - DNA, 10 bp, Homo sapiens
ctcacactcc

SEQ ID NO: 434615 - DNA, 16 bp, Homo sapiens
ctcacagagacacagg

SEQ ID NO: 434616 - DNA, 22 bp, Homo sapiens
ctcacagcacatgctggccagc

SEQ ID NO: 434617 - DNA, 10 bp, Homo sapiens
ctcacagcca

SEQ ID NO: 434618 - DNA, 16 bp, Homo sapiens
ctcacagccaccacct

SEQ ID NO: 434619 - DNA, 18 bp, Homo sapiens
ctcacagccaccacctgg

SEQ ID NO: 434620 - DNA, 22 bp, Homo sapiens
ctcacagcctaggaccagtttt

SEQ ID NO: 434621 - DNA, 14 bp, Homo sapiens
ctcacagcctctcc

SEQ ID NO: 434622 - DNA, 15 bp, Homo sapiens
ctcacagcctctccc

SEQ ID NO: 434623 - DNA, 15 bp, Homo sapiens
ctcacatgcccgctg

SEQ ID NO: 434624 - DNA, 16 bp, Homo sapiens
ctcacatgcccgctgt

SEQ ID NO: 434625 - DNA, 17 bp, Homo sapiens
ctcacattccctctcat

SEQ ID NO: 434626 - DNA, 17 bp, Homo sapiens
ctcacattgccttgagc

SEQ ID NO: 434627 - DNA, 13 bp, Homo sapiens
ctcaccaataact

SEQ ID NO: 434628 - DNA, 17 bp, Homo sapiens
ctcaccaataacttcag

SEQ ID NO: 434629 - DNA, 18 bp, Homo sapiens
ctcaccaataacttcaga

SEQ ID NO: 434630 - DNA, 14 bp, Homo sapiens
ctcaccacccactt

SEQ ID NO: 434631 - DNA, 15 bp, Homo sapiens
ctcaccagctcagcc

SEQ ID NO: 434632 - DNA, 12 bp, Homo sapiens
ctcaccagggtc

SEQ ID NO: 434633 - DNA, 22 bp, Homo sapiens
ctcaccagggtccgcaccagct

SEQ ID NO: 434634 - DNA, 14 bp, Homo sapiens
ctcattcagtatta

SEQ ID NO: 434635 - DNA, 15 bp, Homo sapiens
ctcattcagtattaa

SEQ ID NO: 434636 - DNA, 18 bp, Homo sapiens
ctcattccaacagtgagt

SEQ ID NO: 434637 - DNA, 18 bp, Homo sapiens
ctcattccaccttcccat

SEQ ID NO: 434638 - DNA, 21 bp, Homo sapiens
ctcattccaccttcccatgcc

SEQ ID NO: 434639 - DNA, 19 bp, Homo sapiens
ctcattgatcacagatgtg

SEQ ID NO: 434640 - DNA, 12 bp, Homo sapiens
ctcattgcattt

SEQ ID NO: 434641 - DNA, 13 bp, Homo sapiens
ctcattgccagtg

SEQ ID NO: 434642 - DNA, 20 bp, Homo sapiens
ctcattgccagtggtgtcca

SEQ ID NO: 434643 - DNA, 15 bp, Homo sapiens
ctcatttctgccagc

SEQ ID NO: 434644 - DNA, 17 bp, Homo sapiens
ctcatttgttcattaaa

SEQ ID NO: 434645 - DNA, 15 bp, Homo sapiens
ctcattttgtatgta

SEQ ID NO: 434646 - DNA, 18 bp, Homo sapiens
ctcattttgtatgtatgt

SEQ ID NO: 434647 - DNA, 20 bp, Homo sapiens
ctccaaaacacaagggagga

SEQ ID NO: 434648 - DNA, 22 bp, Homo sapiens
ctccaaaacacttatcctcctg

SEQ ID NO: 434649 - DNA, 18 bp, Homo sapiens
ctccaaagcctgggcaga

SEQ ID NO: 434650 - DNA, 17 bp, Homo sapiens
ctccaaaggcactgacc

SEQ ID NO: 434651 - DNA, 19 bp, Homo sapiens
ctccaaaggcactgaccct

SEQ ID NO: 434652 - DNA, 22 bp, Homo sapiens
ctccaaaggcactgaccctcgg

SEQ ID NO: 434653 - DNA, 17 bp, Homo sapiens
ctccaacgttaaaagac

SEQ ID NO: 434654 - DNA, 18 bp, Homo sapiens
ctccaagaagccctcctt

SEQ ID NO: 434655 - DNA, 20 bp, Homo sapiens
ctccaagaatacagaaaatg

SEQ ID NO: 434656 - DNA, 16 bp, Homo sapiens
ctccaagaatgttttg

SEQ ID NO: 434657 - DNA, 18 bp, Homo sapiens
ctccaagcctgcctccca

SEQ ID NO: 434658 - DNA, 14 bp, Homo sapiens
ctccaagctccatc

SEQ ID NO: 434659 - DNA, 19 bp, Homo sapiens
ctccaagctccatctccac

SEQ ID NO: 434660 - DNA, 14 bp, Homo sapiens
ctccaaggactcta

SEQ ID NO: 434661 - DNA, 16 bp, Homo sapiens
ctccaaggcaaatgtc

SEQ ID NO: 434662 - DNA, 18 bp, Homo sapiens
ctccaaggcaaatgtcca

SEQ ID NO: 434663 - DNA, 19 bp, Homo sapiens
ctccaaggcaaatgtccaa

SEQ ID NO: 434664 - DNA, 20 bp, Homo sapiens
ctccaaggcaaatgtccaag

SEQ ID NO: 434665 - DNA, 19 bp, Homo sapiens
ctccaagtctctctgtgaa

SEQ ID NO: 434666 - DNA, 15 bp, Homo sapiens
ctccaatcctttcca

SEQ ID NO: 434667 - DNA, 19 bp, Homo sapiens
ctccacacccatgactgcc

SEQ ID NO: 434668 - DNA, 17 bp, Homo sapiens
ctccacagaaaccctgt

SEQ ID NO: 434669 - DNA, 20 bp, Homo sapiens
ctccacagaagacacgtgtt

SEQ ID NO: 434670 - DNA, 21 bp, Homo sapiens
ctccacagaagacacgtgttt

SEQ ID NO: 434671 - DNA, 14 bp, Homo sapiens
ctccacatcccagc

SEQ ID NO: 434672 - DNA, 17 bp, Homo sapiens
ctccacatcccagcagc

SEQ ID NO: 434673 - DNA, 21 bp, Homo sapiens
ctccacatcccagcagcccaa

SEQ ID NO: 434674 - DNA, 13 bp, Homo sapiens
ctccaccacatcc

SEQ ID NO: 434675 - DNA, 16 bp, Homo sapiens
ctccacccactgtccg

SEQ ID NO: 434676 - DNA, 12 bp, Homo sapiens
ctccaccccact

SEQ ID NO: 434677 - DNA, 14 bp, Homo sapiens
ctccaccccactca

SEQ ID NO: 434678 - DNA, 15 bp, Homo sapiens
ctccaccccactcac

SEQ ID NO: 434679 - DNA, 18 bp, Homo sapiens
ctccaccccactcacaga

SEQ ID NO: 434680 - DNA, 13 bp, Homo sapiens
ctccacccccaag

SEQ ID NO: 434681 - DNA, 19 bp, Homo sapiens
ctccacccccaagaaacct

SEQ ID NO: 434682 - DNA, 18 bp, Homo sapiens
ctccacccccgccacggc

SEQ ID NO: 434683 - DNA, 15 bp, Homo sapiens
ctccaccccctcctg

SEQ ID NO: 434684 - DNA, 16 bp, Homo sapiens
ctccacccgtcctggg

SEQ ID NO: 434685 - DNA, 13 bp, Homo sapiens
ctccacccttggc

SEQ ID NO: 434686 - DNA, 16 bp, Homo sapiens
ctccacccttggcctg

SEQ ID NO: 434687 - DNA, 15 bp, Homo sapiens
ctccaccgagccagc

SEQ ID NO: 434688 - DNA, 21 bp, Homo sapiens
ctccacctcccccaaaccctg

SEQ ID NO: 434689 - DNA, 21 bp, Homo sapiens
ctccacctgggagatgctggg

SEQ ID NO: 434690 - DNA, 18 bp, Homo sapiens
ctccaccttccaggctta

SEQ ID NO: 434691 - DNA, 21 bp, Homo sapiens
ctccacgaagccttaagccat

SEQ ID NO: 434692 - DNA, 20 bp, Homo sapiens
ctccacgggggcctagtggc

SEQ ID NO: 434693 - DNA, 20 bp, Homo sapiens
ctccacggtgcgtggctgtg

SEQ ID NO: 434694 - DNA, 20 bp, Homo sapiens
ctccacgttcacccctccac

SEQ ID NO: 434695 - DNA, 17 bp, Homo sapiens
ctccactcagggctggc

SEQ ID NO: 434696 - DNA, 19 bp, Homo sapiens
ctccactcagggctggccc

SEQ ID NO: 434697 - DNA, 22 bp, Homo sapiens
ctccactcagggctggcccggg

SEQ ID NO: 434698 - DNA, 15 bp, Homo sapiens
ctccactccacctcc

SEQ ID NO: 434699 - DNA, 16 bp, Homo sapiens
ctccactcccccacct

SEQ ID NO: 434700 - DNA, 17 bp, Homo sapiens
ctccactcccctcatcc

SEQ ID NO: 434701 - DNA, 17 bp, Homo sapiens
ctccactcctcccaact

SEQ ID NO: 434702 - DNA, 14 bp, Homo sapiens
ctccactccttcct

SEQ ID NO: 434703 - DNA, 19 bp, Homo sapiens
ctccactccttcctgccac

SEQ ID NO: 434704 - DNA, 16 bp, Homo sapiens
ctccactctagttcta

SEQ ID NO: 434705 - DNA, 18 bp, Homo sapiens
ctccactctagttctaga

SEQ ID NO: 434706 - DNA, 13 bp, Homo sapiens
ctccactctcctt

SEQ ID NO: 434707 - DNA, 20 bp, Homo sapiens
ctccactctccttcgtgtct

SEQ ID NO: 434708 - DNA, 22 bp, Homo sapiens
ctccactctccttcgtgtctct

SEQ ID NO: 434709 - DNA, 14 bp, Homo sapiens
ctccactctgaagt

SEQ ID NO: 434710 - DNA, 13 bp, Homo sapiens
ctccactgccctc

SEQ ID NO: 434711 - DNA, 12 bp, Homo sapiens
ctccactggcct

SEQ ID NO: 434712 - DNA, 15 bp, Homo sapiens
ctccactgtgtccag

SEQ ID NO: 434713 - DNA, 17 bp, Homo sapiens
ctccacttctggtcccc

SEQ ID NO: 434714 - DNA, 20 bp, Homo sapiens
ctccacttctggtcccctgt

SEQ ID NO: 434715 - DNA, 22 bp, Homo sapiens
ctccacttctggtcccctgtgg

SEQ ID NO: 434716 - DNA, 14 bp, Homo sapiens
ctccagaagcctct

SEQ ID NO: 434717 - DNA, 14 bp, Homo sapiens
ctccagaatctgct

SEQ ID NO: 434718 - DNA, 13 bp, Homo sapiens
ctccagaatgtaa

SEQ ID NO: 434719 - DNA, 23 bp, Homo sapiens
ctccagaatgtaagaaaacaaaa

SEQ ID NO: 434720 - DNA, 15 bp, Homo sapiens
ctccagaatttccca

SEQ ID NO: 434721 - DNA, 22 bp, Homo sapiens
ctccagaatttcccaaagcagt

SEQ ID NO: 434722 - DNA, 13 bp, Homo sapiens
ctccagacattgt

SEQ ID NO: 434723 - DNA, 9 bp, Homo sapiens
ctccagacc

SEQ ID NO: 434724 - DNA, 16 bp, Homo sapiens
ctccagacccccaccc

SEQ ID NO: 434725 - DNA, 14 bp, Homo sapiens
ctccagacccccag

SEQ ID NO: 434726 - DNA, 15 bp, Homo sapiens
ctccagacccctacc

SEQ ID NO: 434727 - DNA, 20 bp, Homo sapiens
ctccagacccctaccctttc

SEQ ID NO: 434728 - DNA, 15 bp, Homo sapiens
ctccagacccctggc

SEQ ID NO: 434729 - DNA, 17 bp, Homo sapiens
ctccagacccctggctt

SEQ ID NO: 434730 - DNA, 18 bp, Homo sapiens
ctccagacccctggcttt

SEQ ID NO: 434731 - DNA, 16 bp, Homo sapiens
ctccagaccctgcctg

SEQ ID NO: 434732 - DNA, 19 bp, Homo sapiens
ctccagactcgagagggct

SEQ ID NO: 434733 - DNA, 23 bp, Homo sapiens
ctccagactcgagagggctgagc

SEQ ID NO: 434734 - DNA, 15 bp, Homo sapiens
ctccagagccagcct

SEQ ID NO: 434735 - DNA, 16 bp, Homo sapiens
ctccagagccagcctg

SEQ ID NO: 434736 - DNA, 20 bp, Homo sapiens
ctccagagccagcctgggac

SEQ ID NO: 434737 - DNA, 12 bp, Homo sapiens
ctccagagtctg

SEQ ID NO: 434738 - DNA, 18 bp, Homo sapiens
ctccagagtctgagcccc

SEQ ID NO: 434739 - DNA, 23 bp, Homo sapiens
ctccagagtctgagcccccggct

SEQ ID NO: 434740 - DNA, 14 bp, Homo sapiens
ctccagcacagact

SEQ ID NO: 434741 - DNA, 16 bp, Homo sapiens
ctccagcacagactgt

SEQ ID NO: 434742 - DNA, 20 bp, Homo sapiens
ctccagcacagactgttccc

SEQ ID NO: 434743 - DNA, 18 bp, Homo sapiens
ctccagcagtgctgggcc

SEQ ID NO: 434744 - DNA, 16 bp, Homo sapiens
ctccagcatccagcct

SEQ ID NO: 434745 - DNA, 21 bp, Homo sapiens
ctccagcatccagcctgtgtg

SEQ ID NO: 434746 - DNA, 21 bp, Homo sapiens
ctccagccaacccctgtggag

SEQ ID NO: 434747 - DNA, 24 bp, Homo sapiens
ctccagccagcaatgatgtccaga

SEQ ID NO: 434748 - DNA, 14 bp, Homo sapiens
ctccagcccacagt

SEQ ID NO: 434749 - DNA, 21 bp, Homo sapiens
ctccagcccgagtggtctcct

SEQ ID NO: 434750 - DNA, 12 bp, Homo sapiens
ctccagcctcag

SEQ ID NO: 434751 - DNA, 14 bp, Homo sapiens
ctccagcctcagct

SEQ ID NO: 434752 - DNA, 15 bp, Homo sapiens
ctccagcctcccctc

SEQ ID NO: 434753 - DNA, 21 bp, Homo sapiens
ctccagcctcccctcccctgg

SEQ ID NO: 434754 - DNA, 16 bp, Homo sapiens
ctccagcctctcccgg

SEQ ID NO: 434755 - DNA, 21 bp, Homo sapiens
ctccagctgtactagtgccat

SEQ ID NO: 434756 - DNA, 18 bp, Homo sapiens
ctccagcttcggagggcc

SEQ ID NO: 434757 - DNA, 22 bp, Homo sapiens
ctccagcttctggtactctcct

SEQ ID NO: 434758 - DNA, 23 bp, Homo sapiens
ctccagctttaagggttgtgagc

SEQ ID NO: 434759 - DNA, 20 bp, Homo sapiens
ctccaggacttgcttccaag

SEQ ID NO: 434760 - DNA, 13 bp, Homo sapiens
ctccaggagagga

SEQ ID NO: 434761 - DNA, 14 bp, Homo sapiens
ctccaggagaggag

SEQ ID NO: 434762 - DNA, 23 bp, Homo sapiens
ctccaggattgtccacaaatgtc

SEQ ID NO: 434763 - DNA, 22 bp, Homo sapiens
ctccaggccactctcagagact

SEQ ID NO: 434764 - DNA, 18 bp, Homo sapiens
ctccctggactctgtggg

SEQ ID NO: 434765 - DNA, 22 bp, Homo sapiens
ctccctggactctgtggggcca

SEQ ID NO: 434766 - DNA, 21 bp, Homo sapiens
ctccctggcctgttctgtttt

SEQ ID NO: 434767 - DNA, 12 bp, Homo sapiens
ctccctggctcc

SEQ ID NO: 434768 - DNA, 17 bp, Homo sapiens
ctccctggctgtgagca

SEQ ID NO: 434769 - DNA, 16 bp, Homo sapiens
ctccctgggcctgtct

SEQ ID NO: 434770 - DNA, 18 bp, Homo sapiens
ctccctgggcctgtctca

SEQ ID NO: 434771 - DNA, 23 bp, Homo sapiens
ctccctggttttaccccagctcc

SEQ ID NO: 434772 - DNA, 19 bp, Homo sapiens
ctccctgtcactcagctga

SEQ ID NO: 434773 - DNA, 20 bp, Homo sapiens
ctccctgtcactcagctgag

SEQ ID NO: 434774 - DNA, 13 bp, Homo sapiens
ctccctgtcccct

SEQ ID NO: 434775 - DNA, 17 bp, Homo sapiens
ctccctgtcccctcatg

SEQ ID NO: 434776 - DNA, 22 bp, Homo sapiens
ctccctgtcgcctgcggactcc

SEQ ID NO: 434777 - DNA, 16 bp, Homo sapiens
ctccctgtctccaggg

SEQ ID NO: 434778 - DNA, 22 bp, Homo sapiens
ctccctgtctccagggccccca

SEQ ID NO: 434779 - DNA, 12 bp, Homo sapiens
ctcccttcaacc

SEQ ID NO: 434780 - DNA, 14 bp, Homo sapiens
ctcccttcccagtg

SEQ ID NO: 434781 - DNA, 18 bp, Homo sapiens
ctcccttccgctgcgggc

SEQ ID NO: 434782 - DNA, 13 bp, Homo sapiens
ctcccttcctccg

SEQ ID NO: 434783 - DNA, 14 bp, Homo sapiens
ctcccttcctccgc

SEQ ID NO: 434784 - DNA, 20 bp, Homo sapiens
ctcccttcctccgctcccct

SEQ ID NO: 434785 - DNA, 17 bp, Homo sapiens
ctcccttcctctctcct

SEQ ID NO: 434786 - DNA, 16 bp, Homo sapiens
ctcccttcctggcctc

SEQ ID NO: 434787 - DNA, 17 bp, Homo sapiens
ctcccttcctggcctca

SEQ ID NO: 434788 - DNA, 18 bp, Homo sapiens
ctcccttcctggcctcac

SEQ ID NO: 434789 - DNA, 17 bp, Homo sapiens
ctcccttcgtgtgtgcg

SEQ ID NO: 434790 - DNA, 20 bp, Homo sapiens
ctcccttcgtgtgtgcgccc

SEQ ID NO: 434791 - DNA, 14 bp, Homo sapiens
ctcccttctttacc

SEQ ID NO: 434792 - DNA, 21 bp, Homo sapiens
ctcccttctttgcttcttttt

SEQ ID NO: 434793 - DNA, 16 bp, Homo sapiens
ctcccttggccacggc

SEQ ID NO: 434794 - DNA, 17 bp, Homo sapiens
ctcccttgggttctgat

SEQ ID NO: 434795 - DNA, 21 bp, Homo sapiens
ctcccttggttgttccttttt

SEQ ID NO: 434796 - DNA, 15 bp, Homo sapiens
ctccctttccctgag

SEQ ID NO: 434797 - DNA, 19 bp, Homo sapiens
ctccctttgtggactttat

SEQ ID NO: 434798 - DNA, 17 bp, Homo sapiens
ctccgaggctccccgcc

SEQ ID NO: 434799 - DNA, 17 bp, Homo sapiens
ctccgagggcggccagg

SEQ ID NO: 434800 - DNA, 19 bp, Homo sapiens
ctccgagggcggccaggga

SEQ ID NO: 434801 - DNA, 20 bp, Homo sapiens
ctccgatgcccgcccgggga

SEQ ID NO: 434802 - DNA, 14 bp, Homo sapiens
ctccgccattccaa

SEQ ID NO: 434803 - DNA, 17 bp, Homo sapiens
ctccgcccagcctctcc

SEQ ID NO: 434804 - DNA, 13 bp, Homo sapiens
ctccgcgggggac

SEQ ID NO: 434805 - DNA, 23 bp, Homo sapiens
ctccgctcccctttcccatcacc

SEQ ID NO: 434806 - DNA, 18 bp, Homo sapiens
ctccgctgtgtggatggg

SEQ ID NO: 434807 - DNA, 12 bp, Homo sapiens
ctccggcagagg

SEQ ID NO: 434808 - DNA, 15 bp, Homo sapiens
ctccggcagaggcag

SEQ ID NO: 434809 - DNA, 18 bp, Homo sapiens
ctccggcagaggcagggc

SEQ ID NO: 434810 - DNA, 23 bp, Homo sapiens
ctccggcagaggcagggccctgg

SEQ ID NO: 434811 - DNA, 12 bp, Homo sapiens
ctccggccctgc

SEQ ID NO: 434812 - DNA, 14 bp, Homo sapiens
ctccggccctgccc

SEQ ID NO: 434813 - DNA, 15 bp, Homo sapiens
ctccggcctcccctc

SEQ ID NO: 434814 - DNA, 14 bp, Homo sapiens
ctccgggagagggg

SEQ ID NO: 434815 - DNA, 12 bp, Homo sapiens
ctccgggcaggg

SEQ ID NO: 434816 - DNA, 18 bp, Homo sapiens
ctccggtgtgagcccacc

SEQ ID NO: 434817 - DNA, 15 bp, Homo sapiens
ctccgtccacccagg

SEQ ID NO: 434818 - DNA, 22 bp, Homo sapiens
ctccgtccactacgctcctgtc

SEQ ID NO: 434819 - DNA, 22 bp, Homo sapiens
ctccgtccagccgccattgcca

SEQ ID NO: 434820 - DNA, 15 bp, Homo sapiens
ctccgtccccagggt

SEQ ID NO: 434821 - DNA, 20 bp, Homo sapiens
ctccgtccccagggtgcagg

SEQ ID NO: 434822 - DNA, 14 bp, Homo sapiens
ctccgtcctggcag

SEQ ID NO: 434823 - DNA, 18 bp, Homo sapiens
ctccgtcctggcagggca

SEQ ID NO: 434824 - DNA, 16 bp, Homo sapiens
ctccgtggccccgccc

SEQ ID NO: 434825 - DNA, 20 bp, Homo sapiens
ctccgtgtggagcacgtgga

SEQ ID NO: 434826 - DNA, 14 bp, Homo sapiens
ctccgtgtgtctca

SEQ ID NO: 434827 - DNA, 22 bp, Homo sapiens
ctccgtgtgtctcatgccagca

SEQ ID NO: 434828 - DNA, 20 bp, Homo sapiens
ctccgttcccacctctgagg

SEQ ID NO: 434829 - DNA, 21 bp, Homo sapiens
ctccgtttatgggccttgctt

SEQ ID NO: 434830 - DNA, 20 bp, Homo sapiens
ctcctacaagatttagaaaa

SEQ ID NO: 434831 - DNA, 13 bp, Homo sapiens
ctcctacccctgt

SEQ ID NO: 434832 - DNA, 15 bp, Homo sapiens
ctcctacccctgtcc

SEQ ID NO: 434833 - DNA, 17 bp, Homo sapiens
ctcctaccctcccacca

SEQ ID NO: 434834 - DNA, 18 bp, Homo sapiens
ctcctaccctcccaccag

SEQ ID NO: 434835 - DNA, 22 bp, Homo sapiens
ctcctaccctcccaccagaacg

SEQ ID NO: 434836 - DNA, 14 bp, Homo sapiens
ctcctacctggtca

SEQ ID NO: 434837 - DNA, 15 bp, Homo sapiens
ctcctactctgtgta

SEQ ID NO: 434838 - DNA, 18 bp, Homo sapiens
ctcctactctgtgtaaat

SEQ ID NO: 434839 - DNA, 13 bp, Homo sapiens
ctcctagaggtgg

SEQ ID NO: 434840 - DNA, 20 bp, Homo sapiens
ctcctagaggtgggcagctg

SEQ ID NO: 434841 - DNA, 22 bp, Homo sapiens
ctcctagaggtgggcagctggg

SEQ ID NO: 434842 - DNA, 21 bp, Homo sapiens
ctcctagcacaaggagtgccc

SEQ ID NO: 434843 - DNA, 16 bp, Homo sapiens
ctcctaggagagccaa

SEQ ID NO: 434844 - DNA, 19 bp, Homo sapiens
ctcctaggagagccaacct

SEQ ID NO: 434845 - DNA, 20 bp, Homo sapiens
ctcctataatcccaatattt

SEQ ID NO: 434846 - DNA, 15 bp, Homo sapiens
ctcctatcttttatt

SEQ ID NO: 434847 - DNA, 15 bp, Homo sapiens
ctcctatgtggcagc

SEQ ID NO: 434848 - DNA, 18 bp, Homo sapiens
ctcctatgtggcagctgg

SEQ ID NO: 434849 - DNA, 14 bp, Homo sapiens
ctcctcaaccttga

SEQ ID NO: 434850 - DNA, 14 bp, Homo sapiens
ctcctcaactcacc

SEQ ID NO: 434851 - DNA, 18 bp, Homo sapiens
ctcctcacccccacccct

SEQ ID NO: 434852 - DNA, 14 bp, Homo sapiens
ctcctcacctctgg

SEQ ID NO: 434853 - DNA, 15 bp, Homo sapiens
ctcctcacctctgga

SEQ ID NO: 434854 - DNA, 16 bp, Homo sapiens
ctcctcacctctggac

SEQ ID NO: 434855 - DNA, 22 bp, Homo sapiens
ctcctcacctctggactggcta

SEQ ID NO: 434856 - DNA, 13 bp, Homo sapiens
ctcctcagggtgg

SEQ ID NO: 434857 - DNA, 21 bp, Homo sapiens
ctcctcagtctttgggggatt

SEQ ID NO: 434858 - DNA, 13 bp, Homo sapiens
ctcctccaaatgc

SEQ ID NO: 434859 - DNA, 18 bp, Homo sapiens
ctcctccaagaagccctc

SEQ ID NO: 434860 - DNA, 20 bp, Homo sapiens
ctcctccaagaagccctcct

SEQ ID NO: 434861 - DNA, 14 bp, Homo sapiens
ctcctccacagtgc

SEQ ID NO: 434862 - DNA, 15 bp, Homo sapiens
ctcctccacagtgct

SEQ ID NO: 434863 - DNA, 19 bp, Homo sapiens
ctcctccacagtgctgctt

SEQ ID NO: 434864 - DNA, 13 bp, Homo sapiens
ctcctccactcac

SEQ ID NO: 434865 - DNA, 16 bp, Homo sapiens
ctcctccactccacct

SEQ ID NO: 434866 - DNA, 21 bp, Homo sapiens
ctcctccagactcgagagggc

SEQ ID NO: 434867 - DNA, 13 bp, Homo sapiens
ctcctccagccca

SEQ ID NO: 434868 - DNA, 17 bp, Homo sapiens
ctcctccagcccaccca

SEQ ID NO: 434869 - DNA, 20 bp, Homo sapiens
ctcctccagttctgatgagg

SEQ ID NO: 434870 - DNA, 13 bp, Homo sapiens
ctcctcccaactc

SEQ ID NO: 434871 - DNA, 19 bp, Homo sapiens
ctcctcccaactctggcct

SEQ ID NO: 434872 - DNA, 22 bp, Homo sapiens
ctcctcccaggcgccccttccc

SEQ ID NO: 434873 - DNA, 23 bp, Homo sapiens
ctcctcccaggcgccccttcccc

SEQ ID NO: 434874 - DNA, 15 bp, Homo sapiens
ctcctcccatccagc

SEQ ID NO: 434875 - DNA, 22 bp, Homo sapiens
ctcctcccatctccttccccca

SEQ ID NO: 434876 - DNA, 14 bp, Homo sapiens
ctcctcccatggcc

SEQ ID NO: 434877 - DNA, 13 bp, Homo sapiens
ctcctcccctcct

SEQ ID NO: 434878 - DNA, 14 bp, Homo sapiens
ctcctcccggtgcc

SEQ ID NO: 434879 - DNA, 14 bp, Homo sapiens
ctcctcccttcccc

SEQ ID NO: 434880 - DNA, 19 bp, Homo sapiens
ctcctcccttccccactct

SEQ ID NO: 434881 - DNA, 12 bp, Homo sapiens
ctcctcctgttc

SEQ ID NO: 434882 - DNA, 21 bp, Homo sapiens
ctcctcgggcgcctgcgctcc

SEQ ID NO: 434883 - DNA, 20 bp, Homo sapiens
ctcctcggtggcatttgctg

SEQ ID NO: 434884 - DNA, 20 bp, Homo sapiens
ctcctcgtccggcctgcagc

SEQ ID NO: 434885 - DNA, 21 bp, Homo sapiens
ctcctctaacaggggctggtg

SEQ ID NO: 434886 - DNA, 14 bp, Homo sapiens
ctcctctatttctt

SEQ ID NO: 434887 - DNA, 12 bp, Homo sapiens
ctcctctccagc

SEQ ID NO: 434888 - DNA, 11 bp, Homo sapiens
ctcctctccca

SEQ ID NO: 434889 - DNA, 15 bp, Homo sapiens
ctcctctcccctcta

SEQ ID NO: 434890 - DNA, 15 bp, Homo sapiens
ctcctctctctccct

SEQ ID NO: 434891 - DNA, 16 bp, Homo sapiens
ctcctctctctccctc

SEQ ID NO: 434892 - DNA, 18 bp, Homo sapiens
ctcctctctctccctcca

SEQ ID NO: 434893 - DNA, 19 bp, Homo sapiens
ctcctctctctccctccac

SEQ ID NO: 434894 - DNA, 22 bp, Homo sapiens
ctcctctctctccctccactcc

SEQ ID NO: 434895 - DNA, 23 bp, Homo sapiens
ctctcttggactccctccccacc

SEQ ID NO: 434896 - DNA, 13 bp, Homo sapiens
ctctcttttcctg

SEQ ID NO: 434897 - DNA, 12 bp, Homo sapiens
ctctctttttct

SEQ ID NO: 434898 - DNA, 21 bp, Homo sapiens
ctctgaaaagcaattgccctg

SEQ ID NO: 434899 - DNA, 21 bp, Homo sapiens
ctctgaaaatatttttttcta

SEQ ID NO: 434900 - DNA, 17 bp, Homo sapiens
ctctgaaagctgcttct

SEQ ID NO: 434901 - DNA, 15 bp, Homo sapiens
ctctgaacttcagct

SEQ ID NO: 434902 - DNA, 18 bp, Homo sapiens
ctctgaagatgatcattt

SEQ ID NO: 434903 - DNA, 11 bp, Homo sapiens
ctctgaagcat

SEQ ID NO: 434904 - DNA, 13 bp, Homo sapiens
ctctgaagtccct

SEQ ID NO: 434905 - DNA, 16 bp, Homo sapiens
ctctgaagttggacag

SEQ ID NO: 434906 - DNA, 19 bp, Homo sapiens
ctctgaatattaagaaaca

SEQ ID NO: 434907 - DNA, 19 bp, Homo sapiens
ctctgaatctctcaaaatg

SEQ ID NO: 434908 - DNA, 18 bp, Homo sapiens
ctctgacagcagcctgtg

SEQ ID NO: 434909 - DNA, 22 bp, Homo sapiens
ctctgacataaacccatctgta

SEQ ID NO: 434910 - DNA, 21 bp, Homo sapiens
ctctgaccttcacagggacag

SEQ ID NO: 434911 - DNA, 18 bp, Homo sapiens
ctctgactcccaaagagc

SEQ ID NO: 434912 - DNA, 22 bp, Homo sapiens
ctctgactcccaaagagctgcc

SEQ ID NO: 434913 - DNA, 16 bp, Homo sapiens
ctctgactctgagtcc

SEQ ID NO: 434914 - DNA, 15 bp, Homo sapiens
ctctgagaagaggag

SEQ ID NO: 434915 - DNA, 18 bp, Homo sapiens
ctctgagaagaggagccc

SEQ ID NO: 434916 - DNA, 22 bp, Homo sapiens
ctctgagacggatggaaggaga

SEQ ID NO: 434917 - DNA, 23 bp, Homo sapiens
ctctgagacggatggaaggagag

SEQ ID NO: 434918 - DNA, 16 bp, Homo sapiens
ctctgagcaaatgtgg

SEQ ID NO: 434919 - DNA, 21 bp, Homo sapiens
ctctgagcagcctctgccagg

SEQ ID NO: 434920 - DNA, 12 bp, Homo sapiens
ctctgagcagtg

SEQ ID NO: 434921 - DNA, 23 bp, Homo sapiens
ctctgagccaccgcgagggcctg

SEQ ID NO: 434922 - DNA, 10 bp, Homo sapiens
ctctgagccc

SEQ ID NO: 434923 - DNA, 12 bp, Homo sapiens
ctctgagcccag

SEQ ID NO: 434924 - DNA, 11 bp, Homo sapiens
ctctgagcccc

SEQ ID NO: 434925 - DNA, 12 bp, Homo sapiens
ctctgagccccc

SEQ ID NO: 434926 - DNA, 14 bp, Homo sapiens
ctctgagccccctg

SEQ ID NO: 434927 - DNA, 22 bp, Homo sapiens
ctctgagcccctgggactgctg

SEQ ID NO: 434928 - DNA, 19 bp, Homo sapiens
ctctgatattccatgaatg

SEQ ID NO: 434929 - DNA, 16 bp, Homo sapiens
ctctgatcttgtgctc

SEQ ID NO: 434930 - DNA, 17 bp, Homo sapiens
ctctgatcttgtgctca

SEQ ID NO: 434931 - DNA, 21 bp, Homo sapiens
ctctgcaactgaatacttgaa

SEQ ID NO: 434932 - DNA, 14 bp, Homo sapiens
ctctgcacagatgg

SEQ ID NO: 434933 - DNA, 13 bp, Homo sapiens
ctctgcacctgtc

SEQ ID NO: 434934 - DNA, 16 bp, Homo sapiens
ctctgcactactgaca

SEQ ID NO: 434935 - DNA, 18 bp, Homo sapiens
ctctgcactactgacatg

SEQ ID NO: 434936 - DNA, 16 bp, Homo sapiens
ctctgcactatagcca

SEQ ID NO: 434937 - DNA, 16 bp, Homo sapiens
ctctgcactccatggc

SEQ ID NO: 434938 - DNA, 17 bp, Homo sapiens
ctctgcactccatggcc

SEQ ID NO: 434939 - DNA, 19 bp, Homo sapiens
ctctgcactccatggccac

SEQ ID NO: 434940 - DNA, 21 bp, Homo sapiens
ctctgcactccatggccaccc

SEQ ID NO: 434941 - DNA, 13 bp, Homo sapiens
ctctgcagcccac

SEQ ID NO: 434942 - DNA, 22 bp, Homo sapiens
ctctgcagcccacagaggacag

SEQ ID NO: 434943 - DNA, 15 bp, Homo sapiens
ctctgcagctgacct

SEQ ID NO: 434944 - DNA, 12 bp, Homo sapiens
ctctgcaggaca

SEQ ID NO: 434945 - DNA, 14 bp, Homo sapiens
ctctgcaggacaca

SEQ ID NO: 434946 - DNA, 19 bp, Homo sapiens
ctctgcaggacacagatct

SEQ ID NO: 434947 - DNA, 20 bp, Homo sapiens
ctctgcaggacacagatctg

SEQ ID NO: 434948 - DNA, 16 bp, Homo sapiens
ctctgcagggcagcct

SEQ ID NO: 434949 - DNA, 19 bp, Homo sapiens
ctctgcagggcagcctgtg

SEQ ID NO: 434950 - DNA, 13 bp, Homo sapiens
ctctgcagtgcct

SEQ ID NO: 434951 - DNA, 16 bp, Homo sapiens
ctctgcatagacaaag

SEQ ID NO: 434952 - DNA, 15 bp, Homo sapiens
ctctgcattctagta

SEQ ID NO: 434953 - DNA, 17 bp, Homo sapiens
ctctgccacactctgac

SEQ ID NO: 434954 - DNA, 14 bp, Homo sapiens
ctctgccacccact

SEQ ID NO: 434955 - DNA, 16 bp, Homo sapiens
ctctgccacccactca

SEQ ID NO: 434956 - DNA, 18 bp, Homo sapiens
ctctgccacccactcagg

SEQ ID NO: 434957 - DNA, 19 bp, Homo sapiens
ctctgccacccactcagga

SEQ ID NO: 434958 - DNA, 18 bp, Homo sapiens
ctctgccaccctacctgt

SEQ ID NO: 434959 - DNA, 22 bp, Homo sapiens
ctctgccaccctacctgttcag

SEQ ID NO: 434960 - DNA, 19 bp, Homo sapiens
ctctgccactgactgcagg

SEQ ID NO: 434961 - DNA, 14 bp, Homo sapiens
ctctgccagctcca

SEQ ID NO: 434962 - DNA, 14 bp, Homo sapiens
ctctgccaggcctg

SEQ ID NO: 434963 - DNA, 15 bp, Homo sapiens
ctctgccagggcagt

SEQ ID NO: 434964 - DNA, 22 bp, Homo sapiens
ctctgccagggcagtgctagtg

SEQ ID NO: 434965 - DNA, 15 bp, Homo sapiens
ctctgccagtgacag

SEQ ID NO: 434966 - DNA, 20 bp, Homo sapiens
ctctgccagtgacagacagg

SEQ ID NO: 434967 - DNA, 13 bp, Homo sapiens
ctctgccatcagc

SEQ ID NO: 434968 - DNA, 18 bp, Homo sapiens
ctctgccatcagcccctg

SEQ ID NO: 434969 - DNA, 22 bp, Homo sapiens
ctctgccatcagcccctgctgc

SEQ ID NO: 434970 - DNA, 16 bp, Homo sapiens
ctctgccatgtggcag

SEQ ID NO: 434971 - DNA, 17 bp, Homo sapiens
ctctgcccagagctggg

SEQ ID NO: 434972 - DNA, 15 bp, Homo sapiens
ctctgccccaagcag

SEQ ID NO: 434973 - DNA, 19 bp, Homo sapiens
ctctgccccaagcagccag

SEQ ID NO: 434974 - DNA, 21 bp, Homo sapiens
ctctgccccaagcagccagcc

SEQ ID NO: 434975 - DNA, 24 bp, Homo sapiens
ctctgccccaagcagccagccagt

SEQ ID NO: 434976 - DNA, 16 bp, Homo sapiens
ctctgccccaagcccc

SEQ ID NO: 434977 - DNA, 22 bp, Homo sapiens
ctctgccccaatcgggtccaga

SEQ ID NO: 434978 - DNA, 23 bp, Homo sapiens
ctctgcccccgcgggttctagac

SEQ ID NO: 434979 - DNA, 15 bp, Homo sapiens
ctctgccccctcccc

SEQ ID NO: 434980 - DNA, 16 bp, Homo sapiens
ctctgccccctccccc

SEQ ID NO: 434981 - DNA, 14 bp, Homo sapiens
ctctgccccttggg

SEQ ID NO: 434982 - DNA, 22 bp, Homo sapiens
ctctgccccttgggcatccacc

SEQ ID NO: 434983 - DNA, 13 bp, Homo sapiens
ctctgccctgcct

SEQ ID NO: 434984 - DNA, 16 bp, Homo sapiens
ctctgccctgcctccc

SEQ ID NO: 434985 - DNA, 23 bp, Homo sapiens
ctctgccctgcctccctttctgg

SEQ ID NO: 434986 - DNA, 18 bp, Homo sapiens
ctctgccggctctttcct

SEQ ID NO: 434987 - DNA, 20 bp, Homo sapiens
ctctgccggctctttccttg

SEQ ID NO: 434988 - DNA, 23 bp, Homo sapiens
ctctgccggctctttccttgctc

SEQ ID NO: 434989 - DNA, 16 bp, Homo sapiens
ctctgccggtccccca

SEQ ID NO: 434990 - DNA, 17 bp, Homo sapiens
ctctgcctccaggaggg

SEQ ID NO: 434991 - DNA, 13 bp, Homo sapiens
ctctgcctcccag

SEQ ID NO: 434992 - DNA, 15 bp, Homo sapiens
ctctgcctcccaggc

SEQ ID NO: 434993 - DNA, 14 bp, Homo sapiens
ctctgcctcctctt

SEQ ID NO: 434994 - DNA, 15 bp, Homo sapiens
ctctgcctcctcttc

SEQ ID NO: 434995 - DNA, 20 bp, Homo sapiens
ctctgccttgcacaaaaagc

SEQ ID NO: 434996 - DNA, 17 bp, Homo sapiens
ctctgctatgtctgtga

SEQ ID NO: 434997 - DNA, 23 bp, Homo sapiens
ctctgctcaatgaaaccttcctc

SEQ ID NO: 434998 - DNA, 16 bp, Homo sapiens
ctctgctccaccacat

SEQ ID NO: 434999 - DNA, 14 bp, Homo sapiens
ctctgctcctcacc

SEQ ID NO: 435000 - DNA, 18 bp, Homo sapiens
ctctgctcctcaccccca

SEQ ID NO: 435001 - DNA, 17 bp, Homo sapiens
ctctgctcctggagcct

SEQ ID NO: 435002 - DNA, 12 bp, Homo sapiens
ctctgctctagc

SEQ ID NO: 435003 - DNA, 15 bp, Homo sapiens
ctctgctctagccag

SEQ ID NO: 435004 - DNA, 16 bp, Homo sapiens
ctctgctgcccacggc

SEQ ID NO: 435005 - DNA, 17 bp, Homo sapiens
ctctgctgcccacggcc

SEQ ID NO: 435006 - DNA, 18 bp, Homo sapiens
ctctgctgcccacggcca

SEQ ID NO: 435007 - DNA, 19 bp, Homo sapiens
ctctgctgcccacggccac

SEQ ID NO: 435008 - DNA, 22 bp, Homo sapiens
ctctgctgcccacggccaccca

SEQ ID NO: 435009 - DNA, 22 bp, Homo sapiens
ctctgctgcctgcccgcacagc

SEQ ID NO: 435010 - DNA, 13 bp, Homo sapiens
ctctgctgctcat

SEQ ID NO: 435011 - DNA, 17 bp, Homo sapiens
ctctgctgcttctgggc

SEQ ID NO: 435012 - DNA, 20 bp, Homo sapiens
ctctgctgcttctgggcctg

SEQ ID NO: 435013 - DNA, 21 bp, Homo sapiens
ctctgctggccgggcacagct

SEQ ID NO: 435014 - DNA, 17 bp, Homo sapiens
ctctgctggtcttcaat

SEQ ID NO: 435015 - DNA, 18 bp, Homo sapiens
ctctgctggtcttcaatt

SEQ ID NO: 435016 - DNA, 23 bp, Homo sapiens
ctctgctgtacatatttgagact

SEQ ID NO: 435017 - DNA, 21 bp, Homo sapiens
ctctgctgtattgatatcact

SEQ ID NO: 435018 - DNA, 12 bp, Homo sapiens
ctctgctgtcct

SEQ ID NO: 435019 - DNA, 16 bp, Homo sapiens
ctctgctgtcctgcag

SEQ ID NO: 435020 - DNA, 21 bp, Homo sapiens
ctctgcttccatggcttcctg

SEQ ID NO: 435021 - DNA, 23 bp, Homo sapiens
ctctgcttccatggcttcctgag

SEQ ID NO: 435022 - DNA, 16 bp, Homo sapiens
ctctgcttcctcagcc

SEQ ID NO: 435023 - DNA, 18 bp, Homo sapiens
ctctgcttgagtcaggtt

SEQ ID NO: 435024 - DNA, 15 bp, Homo sapiens
ctctgcttggctgtc

SEQ ID NO: 435025 - DNA, 14 bp, Homo sapiens
ctgaacaattacct

SEQ ID NO: 435026 - DNA, 20 bp, Homo sapiens
ctgaacacttattgctttga

SEQ ID NO: 435027 - DNA, 20 bp, Homo sapiens
ctgaacacttttgttgtaaa

SEQ ID NO: 435028 - DNA, 14 bp, Homo sapiens
ctgaacagccaaat

SEQ ID NO: 435029 - DNA, 13 bp, Homo sapiens
ctgaacagctgta

SEQ ID NO: 435030 - DNA, 15 bp, Homo sapiens
ctgaaccaccctgga

SEQ ID NO: 435031 - DNA, 12 bp, Homo sapiens
ctgaaccattac

SEQ ID NO: 435032 - DNA, 19 bp, Homo sapiens
ctgaaccccccccccccgc

SEQ ID NO: 435033 - DNA, 16 bp, Homo sapiens
ctgaaccccctccaga

SEQ ID NO: 435034 - DNA, 16 bp, Homo sapiens
ctgaaccgcaaggagc

SEQ ID NO: 435035 - DNA, 22 bp, Homo sapiens
ctgaactaataaatctgttgcc

SEQ ID NO: 435036 - DNA, 21 bp, Homo sapiens
ctgaactccatacagcctcta

SEQ ID NO: 435037 - DNA, 12 bp, Homo sapiens
ctgaactctcaa

SEQ ID NO: 435038 - DNA, 18 bp, Homo sapiens
ctgaactgctgctggtca

SEQ ID NO: 435039 - DNA, 20 bp, Homo sapiens
ctgaactggccgctgggaga

SEQ ID NO: 435040 - DNA, 15 bp, Homo sapiens
ctgaactttggaagc

SEQ ID NO: 435041 - DNA, 21 bp, Homo sapiens
ctgaagagcgctcctctgcct

SEQ ID NO: 435042 - DNA, 19 bp, Homo sapiens
ctgaagaggaactgggcct

SEQ ID NO: 435043 - DNA, 12 bp, Homo sapiens
ctgaagatctca

SEQ ID NO: 435044 - DNA, 13 bp, Homo sapiens
ctgaagcaaatac

SEQ ID NO: 435045 - DNA, 14 bp, Homo sapiens
ctgaagcaacactg

SEQ ID NO: 435046 - DNA, 22 bp, Homo sapiens
ctgaagcagtgtcgccgtccct

SEQ ID NO: 435047 - DNA, 20 bp, Homo sapiens
ctgaagcatgtttcatgttt

SEQ ID NO: 435048 - DNA, 23 bp, Homo sapiens
ctgaagcatgtttcatgttttgt

SEQ ID NO: 435049 - DNA, 20 bp, Homo sapiens
ctgaagcctctgccctgcct

SEQ ID NO: 435050 - DNA, 18 bp, Homo sapiens
ctgaagcgaacatcttca

SEQ ID NO: 435051 - DNA, 20 bp, Homo sapiens
ctgaagcttattaatgctaa

SEQ ID NO: 435052 - DNA, 23 bp, Homo sapiens
ctgaagcttattaatgctaaggg

SEQ ID NO: 435053 - DNA, 18 bp, Homo sapiens
ctgaaggaatagccagag

SEQ ID NO: 435054 - DNA, 19 bp, Homo sapiens
ctgaaggaatagccagaga

SEQ ID NO: 435055 - DNA, 16 bp, Homo sapiens
ctgaaggagattttcc

SEQ ID NO: 435056 - DNA, 18 bp, Homo sapiens
ctgaaggctttcagggcc

SEQ ID NO: 435057 - DNA, 20 bp, Homo sapiens
ctgaaggctttcagggcctc

SEQ ID NO: 435058 - DNA, 16 bp, Homo sapiens
ctgaaggggcacacca

SEQ ID NO: 435059 - DNA, 20 bp, Homo sapiens
ctgaaggggcacaccactgc

SEQ ID NO: 435060 - DNA, 15 bp, Homo sapiens
ctgaagggtgacatc

SEQ ID NO: 435061 - DNA, 17 bp, Homo sapiens
ctgaagggtgacatccc

SEQ ID NO: 435062 - DNA, 18 bp, Homo sapiens
ctgaagggtgacatccca

SEQ ID NO: 435063 - DNA, 20 bp, Homo sapiens
ctgaagggtgacatcccagg

SEQ ID NO: 435064 - DNA, 15 bp, Homo sapiens
ctgaaggtgcccagg

SEQ ID NO: 435065 - DNA, 22 bp, Homo sapiens
ctgaagtacagtcccagcacat

SEQ ID NO: 435066 - DNA, 21 bp, Homo sapiens
ctgaagtcaaaccttaagata

SEQ ID NO: 435067 - DNA, 13 bp, Homo sapiens
ctgaagtcactgc

SEQ ID NO: 435068 - DNA, 22 bp, Homo sapiens
ctgaagtcactgcacagtgcat

SEQ ID NO: 435069 - DNA, 17 bp, Homo sapiens
ctgaagtcccttcctgt

SEQ ID NO: 435070 - DNA, 20 bp, Homo sapiens
ctgaagtctttgtacagaca

SEQ ID NO: 435071 - DNA, 17 bp, Homo sapiens
ctgaagtgaatacatgg

SEQ ID NO: 435072 - DNA, 18 bp, Homo sapiens
ctgaagtgaatacatggt

SEQ ID NO: 435073 - DNA, 23 bp, Homo sapiens
ctgaagtgatgatggatgagaaa

SEQ ID NO: 435074 - DNA, 17 bp, Homo sapiens
ctgaagttcagctgcat

SEQ ID NO: 435075 - DNA, 14 bp, Homo sapiens
ctgaagttggacag

SEQ ID NO: 435076 - DNA, 22 bp, Homo sapiens
ctgaagttggagtgagtgtggc

SEQ ID NO: 435077 - DNA, 16 bp, Homo sapiens
ctgaataacaacaatt

SEQ ID NO: 435078 - DNA, 15 bp, Homo sapiens
ctgaataatttctta

SEQ ID NO: 435079 - DNA, 16 bp, Homo sapiens
ctgaatagaaatggga

SEQ ID NO: 435080 - DNA, 12 bp, Homo sapiens
ctgaatattttt

SEQ ID NO: 435081 - DNA, 20 bp, Homo sapiens
ctgaatattttttatttcta

SEQ ID NO: 435082 - DNA, 13 bp, Homo sapiens
ctgaatctctcaa

SEQ ID NO: 435083 - DNA, 17 bp, Homo sapiens
ctgaatgcattcagggg

SEQ ID NO: 435084 - DNA, 22 bp, Homo sapiens
ctgaatgcattcaggggaagga

SEQ ID NO: 435085 - DNA, 21 bp, Homo sapiens
ctgaatggcggtttttatcca

SEQ ID NO: 435086 - DNA, 15 bp, Homo sapiens
ctgaatgtcattatt

SEQ ID NO: 435087 - DNA, 23 bp, Homo sapiens
ctgaatgtcattatttgataaca

SEQ ID NO: 435088 - DNA, 11 bp, Homo sapiens
ctgaatgttct

SEQ ID NO: 435089 - DNA, 16 bp, Homo sapiens
ctgaatgttctgacat

SEQ ID NO: 435090 - DNA, 17 bp, Homo sapiens
ctgaatgttctgacatt

SEQ ID NO: 435091 - DNA, 18 bp, Homo sapiens
ctgaatgttctgacatta

SEQ ID NO: 435092 - DNA, 20 bp, Homo sapiens
ctgaatgttctgacattaac

SEQ ID NO: 435093 - DNA, 15 bp, Homo sapiens
ctgaattaaataaat

SEQ ID NO: 435094 - DNA, 14 bp, Homo sapiens
ctgaattacagtga

SEQ ID NO: 435095 - DNA, 22 bp, Homo sapiens
ctgaattacagtgaaattttgg

SEQ ID NO: 435096 - DNA, 16 bp, Homo sapiens
ctgaattattctggat

SEQ ID NO: 435097 - DNA, 17 bp, Homo sapiens
ctgaattctatttgctg

SEQ ID NO: 435098 - DNA, 12 bp, Homo sapiens
ctgaatttaact

SEQ ID NO: 435099 - DNA, 15 bp, Homo sapiens
ctgaatttctttgat

SEQ ID NO: 435100 - DNA, 18 bp, Homo sapiens
ctgacaaaaagtttccat

SEQ ID NO: 435101 - DNA, 22 bp, Homo sapiens
ctgacaaagtcatgaagctcag

SEQ ID NO: 435102 - DNA, 14 bp, Homo sapiens
ctgacaaatatttt

SEQ ID NO: 435103 - DNA, 17 bp, Homo sapiens
ctgacaatggcagctag

SEQ ID NO: 435104 - DNA, 23 bp, Homo sapiens
ctgacaatggcagctagactgga

SEQ ID NO: 435105 - DNA, 19 bp, Homo sapiens
ctgacacataatttgaatg

SEQ ID NO: 435106 - DNA, 19 bp, Homo sapiens
ctgacacctaccatgctgc

SEQ ID NO: 435107 - DNA, 20 bp, Homo sapiens
ctgacacctaccatgctgct

SEQ ID NO: 435108 - DNA, 21 bp, Homo sapiens
ctgacacctaccatgctgctt

SEQ ID NO: 435109 - DNA, 14 bp, Homo sapiens
ctgacacgtccacc

SEQ ID NO: 435110 - DNA, 19 bp, Homo sapiens
ctgacactgcgaactctca

SEQ ID NO: 435111 - DNA, 21 bp, Homo sapiens
ctgacacttgtggtatagtat

SEQ ID NO: 435112 - DNA, 22 bp, Homo sapiens
ctgacagagcaggtctgcaggc

SEQ ID NO: 435113 - DNA, 14 bp, Homo sapiens
ctgacagcagcctg

SEQ ID NO: 435114 - DNA, 16 bp, Homo sapiens
ctgacagcagcctgtg

SEQ ID NO: 435115 - DNA, 13 bp, Homo sapiens
ctgacagcctccc

SEQ ID NO: 435116 - DNA, 14 bp, Homo sapiens
ctgacagcctccca

SEQ ID NO: 435117 - DNA, 21 bp, Homo sapiens
ctgacaggaagactggagact

SEQ ID NO: 435118 - DNA, 23 bp, Homo sapiens
ctgacataaacccatctgtaata

SEQ ID NO: 435119 - DNA, 20 bp, Homo sapiens
ctgacatgattccttcctgt

SEQ ID NO: 435120 - DNA, 15 bp, Homo sapiens
ctgacattaacagtt

SEQ ID NO: 435121 - DNA, 22 bp, Homo sapiens
ctgaccacggacgtttccatca

SEQ ID NO: 435122 - DNA, 23 bp, Homo sapiens
ctgaccacggacgtttccatcag

SEQ ID NO: 435123 - DNA, 17 bp, Homo sapiens
ctgaccagcctccatgc

SEQ ID NO: 435124 - DNA, 23 bp, Homo sapiens
ctgaccagcctccatgctgcctc

SEQ ID NO: 435125 - DNA, 23 bp, Homo sapiens
ctgaccatccactctaccctccc

SEQ ID NO: 435126 - DNA, 15 bp, Homo sapiens
ctgaccatcccatga

SEQ ID NO: 435127 - DNA, 21 bp, Homo sapiens
ctgacccaagtggggcctcct

SEQ ID NO: 435128 - DNA, 15 bp, Homo sapiens
ctgacccactgatct

SEQ ID NO: 435129 - DNA, 21 bp, Homo sapiens
ctgacccagccccttgagaaa

SEQ ID NO: 435130 - DNA, 11 bp, Homo sapiens
ctgacccagtc

SEQ ID NO: 435131 - DNA, 13 bp, Homo sapiens
ctgacccagtgag

SEQ ID NO: 435132 - DNA, 14 bp, Homo sapiens
ctgacccagtgaga

SEQ ID NO: 435133 - DNA, 15 bp, Homo sapiens
ctgaccccctcccct

SEQ ID NO: 435134 - DNA, 16 bp, Homo sapiens
ctgaccccctcccctg

SEQ ID NO: 435135 - DNA, 14 bp, Homo sapiens
ctgacccctgcacc

SEQ ID NO: 435136 - DNA, 20 bp, Homo sapiens
ctgaccctcctccactccac

SEQ ID NO: 435137 - DNA, 22 bp, Homo sapiens
ctgaccctcctccactccacct

SEQ ID NO: 435138 - DNA, 13 bp, Homo sapiens
ctgaccctgcaga

SEQ ID NO: 435139 - DNA, 17 bp, Homo sapiens
ctgaccctgcagagatg

SEQ ID NO: 435140 - DNA, 18 bp, Homo sapiens
ctgaccctgtgatgcctg

SEQ ID NO: 435141 - DNA, 17 bp, Homo sapiens
ctgacctcaggtgatcc

SEQ ID NO: 435142 - DNA, 18 bp, Homo sapiens
ctgacctcatgagtgtca

SEQ ID NO: 435143 - DNA, 17 bp, Homo sapiens
ctgacctctgaagagct

SEQ ID NO: 435144 - DNA, 15 bp, Homo sapiens
ctgacctgcccccgc

SEQ ID NO: 435145 - DNA, 24 bp, Homo sapiens
ctgacctgcccccgctctgccatc

SEQ ID NO: 435146 - DNA, 13 bp, Homo sapiens
ctgacctgcccct

SEQ ID NO: 435147 - DNA, 20 bp, Homo sapiens
ctgacctgctccgccaggaa

SEQ ID NO: 435148 - DNA, 15 bp, Homo sapiens
ctgaccttcacaggg

SEQ ID NO: 435149 - DNA, 22 bp, Homo sapiens
ctgaccttgaactcctgggctc

SEQ ID NO: 435150 - DNA, 20 bp, Homo sapiens
ctgaccttggaggaatgaca

SEQ ID NO: 435151 - DNA, 14 bp, Homo sapiens
ctgacgaggctggg

SEQ ID NO: 435152 - DNA, 17 bp, Homo sapiens
ctgacgaggctgggcca

SEQ ID NO: 435153 - DNA, 14 bp, Homo sapiens
ctgacgccctgcgt

SEQ ID NO: 435154 - DNA, 23 bp, Homo sapiens
ctgatgctccctcccctgccctg

SEQ ID NO: 435155 - DNA, 16 bp, Homo sapiens
ctgatgctgagattct

SEQ ID NO: 435156 - DNA, 11 bp, Homo sapiens
ctgatgctgcc

SEQ ID NO: 435157 - DNA, 20 bp, Homo sapiens
ctgatgcttaataaacgcag

SEQ ID NO: 435158 - DNA, 19 bp, Homo sapiens
ctgatgcttttgtctaatt

SEQ ID NO: 435159 - DNA, 22 bp, Homo sapiens
ctgatggaccgggtgggcctgg

SEQ ID NO: 435160 - DNA, 14 bp, Homo sapiens
ctgatggagaggag

SEQ ID NO: 435161 - DNA, 17 bp, Homo sapiens
ctgatggagaggagaac

SEQ ID NO: 435162 - DNA, 19 bp, Homo sapiens
ctgatggcttgacatgtgc

SEQ ID NO: 435163 - DNA, 14 bp, Homo sapiens
ctgatgggcactgg

SEQ ID NO: 435164 - DNA, 16 bp, Homo sapiens
ctgatggtacaggaaa

SEQ ID NO: 435165 - DNA, 15 bp, Homo sapiens
ctgatggtcagctcc

SEQ ID NO: 435166 - DNA, 19 bp, Homo sapiens
ctgatggtcagctcccttc

SEQ ID NO: 435167 - DNA, 14 bp, Homo sapiens
ctgatggtgagctg

SEQ ID NO: 435168 - DNA, 16 bp, Homo sapiens
ctgatggtgagctggg

SEQ ID NO: 435169 - DNA, 16 bp, Homo sapiens
ctgatggtgctcacga

SEQ ID NO: 435170 - DNA, 23 bp, Homo sapiens
ctgatggtgctcacgactcttcc

SEQ ID NO: 435171 - DNA, 15 bp, Homo sapiens
ctgatgtaggagctg

SEQ ID NO: 435172 - DNA, 12 bp, Homo sapiens
ctgatgtctcta

SEQ ID NO: 435173 - DNA, 17 bp, Homo sapiens
ctgatgttaggctgggc

SEQ ID NO: 435174 - DNA, 18 bp, Homo sapiens
ctgatgttaggctgggcc

SEQ ID NO: 435175 - DNA, 19 bp, Homo sapiens
ctgatgttaggctgggccc

SEQ ID NO: 435176 - DNA, 22 bp, Homo sapiens
ctgatgttaggctgggcccaga

SEQ ID NO: 435177 - DNA, 23 bp, Homo sapiens
ctgatgttaggctgggcccagag

SEQ ID NO: 435178 - DNA, 22 bp, Homo sapiens
ctgatgtttgggggttaccaaa

SEQ ID NO: 435179 - DNA, 17 bp, Homo sapiens
ctgattaaatttaatat

SEQ ID NO: 435180 - DNA, 14 bp, Homo sapiens
ctgattactgtcaa

SEQ ID NO: 435181 - DNA, 17 bp, Homo sapiens
ctgattactgtcaataa

SEQ ID NO: 435182 - DNA, 19 bp, Homo sapiens
ctgattactgtcaataaac

SEQ ID NO: 435183 - DNA, 13 bp, Homo sapiens
ctgattagaaatg

SEQ ID NO: 435184 - DNA, 23 bp, Homo sapiens
ctgattagaaatgaccaatatta

SEQ ID NO: 435185 - DNA, 18 bp, Homo sapiens
ctgattattgaatgttat

SEQ ID NO: 435186 - DNA, 15 bp, Homo sapiens
ctgattcccagagca

SEQ ID NO: 435187 - DNA, 13 bp, Homo sapiens
ctgattctatgcc

SEQ ID NO: 435188 - DNA, 19 bp, Homo sapiens
ctgattctatgcctgtatt

SEQ ID NO: 435189 - DNA, 20 bp, Homo sapiens
ctgattctatgcctgtattt

SEQ ID NO: 435190 - DNA, 23 bp, Homo sapiens
ctgattctatgcctgtatttcca

SEQ ID NO: 435191 - DNA, 12 bp, Homo sapiens
ctgattctccct

SEQ ID NO: 435192 - DNA, 17 bp, Homo sapiens
ctgattgctaagggaaa

SEQ ID NO: 435193 - DNA, 18 bp, Homo sapiens
ctgatttatttattttgg

SEQ ID NO: 435194 - DNA, 14 bp, Homo sapiens
ctgatttccaggcc

SEQ ID NO: 435195 - DNA, 16 bp, Homo sapiens
ctgatttccaggcccc

SEQ ID NO: 435196 - DNA, 18 bp, Homo sapiens
ctgatttccaggcccctg

SEQ ID NO: 435197 - DNA, 19 bp, Homo sapiens
ctgatttccaggcccctga

SEQ ID NO: 435198 - DNA, 13 bp, Homo sapiens
ctgatttcttgct

SEQ ID NO: 435199 - DNA, 15 bp, Homo sapiens
ctgatttgagtttcc

SEQ ID NO: 435200 - DNA, 16 bp, Homo sapiens
ctgatttgcaaatgca

SEQ ID NO: 435201 - DNA, 17 bp, Homo sapiens
ctgatttgcaaatgcac

SEQ ID NO: 435202 - DNA, 14 bp, Homo sapiens
ctgatttgctgttt

SEQ ID NO: 435203 - DNA, 15 bp, Homo sapiens
ctgattttaaatgca

SEQ ID NO: 435204 - DNA, 23 bp, Homo sapiens
ctgattttaaatgcaaattaaag

SEQ ID NO: 435205 - DNA, 13 bp, Homo sapiens
ctgattttaacaa

SEQ ID NO: 435206 - DNA, 16 bp, Homo sapiens
ctgatttttatctaga

SEQ ID NO: 435207 - DNA, 18 bp, Homo sapiens
ctgattttttactggctg

SEQ ID NO: 435208 - DNA, 22 bp, Homo sapiens
ctgcaaaaccggcaacctgtaa

SEQ ID NO: 435209 - DNA, 11 bp, Homo sapiens
ctgcaaaattt

SEQ ID NO: 435210 - DNA, 13 bp, Homo sapiens
ctgcaaaggactg

SEQ ID NO: 435211 - DNA, 22 bp, Homo sapiens
ctgcaaaggactgttttttcct

SEQ ID NO: 435212 - DNA, 19 bp, Homo sapiens
ctgcaaaggagggcctcag

SEQ ID NO: 435213 - DNA, 21 bp, Homo sapiens
ctgcaaaggagggcctcagag

SEQ ID NO: 435214 - DNA, 22 bp, Homo sapiens
ctgcaaaggagggcctcagaga

SEQ ID NO: 435215 - DNA, 19 bp, Homo sapiens
ctgcaaatagaaaacagga

SEQ ID NO: 435216 - DNA, 11 bp, Homo sapiens
ctgcaacatgg

SEQ ID NO: 435217 - DNA, 16 bp, Homo sapiens
ctgcaacctctgcctc

SEQ ID NO: 435218 - DNA, 17 bp, Homo sapiens
ctgcaacggcttagact

SEQ ID NO: 435219 - DNA, 16 bp, Homo sapiens
ctgcaactagccaagg

SEQ ID NO: 435220 - DNA, 21 bp, Homo sapiens
ctgcaactagccaaggctagt

SEQ ID NO: 435221 - DNA, 15 bp, Homo sapiens
ctgcaactcaaggac

SEQ ID NO: 435222 - DNA, 15 bp, Homo sapiens
ctgcaacttctgcct

SEQ ID NO: 435223 - DNA, 14 bp, Homo sapiens
ctgcaacttctgtc

SEQ ID NO: 435224 - DNA, 22 bp, Homo sapiens
ctgcaagagtgggctttccagg

SEQ ID NO: 435225 - DNA, 21 bp, Homo sapiens
ctgcaagccccagggcctggg

SEQ ID NO: 435226 - DNA, 16 bp, Homo sapiens
ctgcaaggcccacagg

SEQ ID NO: 435227 - DNA, 19 bp, Homo sapiens
ctgcaaggcccacaggagg

SEQ ID NO: 435228 - DNA, 20 bp, Homo sapiens
ctgcaaggcccacaggaggc

SEQ ID NO: 435229 - DNA, 18 bp, Homo sapiens
ctgcaataaggggagagt

SEQ ID NO: 435230 - DNA, 14 bp, Homo sapiens
ctgcaatagagact

SEQ ID NO: 435231 - DNA, 21 bp, Homo sapiens
ctgcaatagagactgtagatt

SEQ ID NO: 435232 - DNA, 16 bp, Homo sapiens
ctgcaatctccagggc

SEQ ID NO: 435233 - DNA, 22 bp, Homo sapiens
ctgcaatgcctagacttcccaa

SEQ ID NO: 435234 - DNA, 13 bp, Homo sapiens
ctgcaattcaact

SEQ ID NO: 435235 - DNA, 20 bp, Homo sapiens
ctgcaatttccattctttta

SEQ ID NO: 435236 - DNA, 21 bp, Homo sapiens
ctgcacaaagcccttccatgt

SEQ ID NO: 435237 - DNA, 15 bp, Homo sapiens
ctgcacaagccaggg

SEQ ID NO: 435238 - DNA, 18 bp, Homo sapiens
ctgcacaagccagggtgt

SEQ ID NO: 435239 - DNA, 17 bp, Homo sapiens
ctgcacacacagctcct

SEQ ID NO: 435240 - DNA, 20 bp, Homo sapiens
ctgcacacacctgcctgcag

SEQ ID NO: 435241 - DNA, 15 bp, Homo sapiens
ctgcacaccagttac

SEQ ID NO: 435242 - DNA, 23 bp, Homo sapiens
ctgcacagatggatttgcctgtg

SEQ ID NO: 435243 - DNA, 12 bp, Homo sapiens
ctgcacagccca

SEQ ID NO: 435244 - DNA, 22 bp, Homo sapiens
ctgcacagtgcatctcagccca

SEQ ID NO: 435245 - DNA, 12 bp, Homo sapiens
ctgcacagtgct

SEQ ID NO: 435246 - DNA, 12 bp, Homo sapiens
ctgcacattcct

SEQ ID NO: 435247 - DNA, 13 bp, Homo sapiens
ctgcacattcctg

SEQ ID NO: 435248 - DNA, 22 bp, Homo sapiens
ctgcaccaacctcactgccctc

SEQ ID NO: 435249 - DNA, 13 bp, Homo sapiens
ctgcaccagcagg

SEQ ID NO: 435250 - DNA, 23 bp, Homo sapiens
ctgcaccagcccttccctgcttt

SEQ ID NO: 435251 - DNA, 11 bp, Homo sapiens
ctgcaccagga

SEQ ID NO: 435252 - DNA, 13 bp, Homo sapiens
ctgcaccaggaga

SEQ ID NO: 435253 - DNA, 17 bp, Homo sapiens
ctgcaccaggagacaga

SEQ ID NO: 435254 - DNA, 17 bp, Homo sapiens
ctgcacccacccctgcc

SEQ ID NO: 435255 - DNA, 19 bp, Homo sapiens
ctgcacccacccctgccca

SEQ ID NO: 435256 - DNA, 13 bp, Homo sapiens
ctgcacccagctc

SEQ ID NO: 435257 - DNA, 20 bp, Homo sapiens
ctgcacccagctccaggggc

SEQ ID NO: 435258 - DNA, 13 bp, Homo sapiens
ctgcaccccagca

SEQ ID NO: 435259 - DNA, 21 bp, Homo sapiens
ctgcaccccagcattccagct

SEQ ID NO: 435260 - DNA, 14 bp, Homo sapiens
ctgcaccctctgct

SEQ ID NO: 435261 - DNA, 23 bp, Homo sapiens
ctgcaccctctgctatgtctgtg

SEQ ID NO: 435262 - DNA, 15 bp, Homo sapiens
ctgcaccctggaaag

SEQ ID NO: 435263 - DNA, 22 bp, Homo sapiens
ctgcaccctgtatggagctaga

SEQ ID NO: 435264 - DNA, 20 bp, Homo sapiens
ctgcaccgacgcctgccccc

SEQ ID NO: 435265 - DNA, 16 bp, Homo sapiens
ctgcacctcctaccct

SEQ ID NO: 435266 - DNA, 21 bp, Homo sapiens
ctgcacctcctaccctcccac

SEQ ID NO: 435267 - DNA, 24 bp, Homo sapiens
ctgcacctcctaccctcccaccag

SEQ ID NO: 435268 - DNA, 19 bp, Homo sapiens
ctgcacctgcgcctggctc

SEQ ID NO: 435269 - DNA, 20 bp, Homo sapiens
ctgcacctgtctcatagcct

SEQ ID NO: 435270 - DNA, 21 bp, Homo sapiens
ctgcacctgtctcatagcctc

SEQ ID NO: 435271 - DNA, 19 bp, Homo sapiens
ctgcactactcctctgcag

SEQ ID NO: 435272 - DNA, 14 bp, Homo sapiens
ctgcactcacaggc

SEQ ID NO: 435273 - DNA, 15 bp, Homo sapiens
ctgcactccagcctg

SEQ ID NO: 435274 - DNA, 11 bp, Homo sapiens
ctgcactccat

SEQ ID NO: 435275 - DNA, 16 bp, Homo sapiens
ctgcactccatggcca

SEQ ID NO: 435276 - DNA, 19 bp, Homo sapiens
ctgcactccatggccaccc

SEQ ID NO: 435277 - DNA, 13 bp, Homo sapiens
ctgcactgcagtg

SEQ ID NO: 435278 - DNA, 14 bp, Homo sapiens
ctgcactgtaaaat

SEQ ID NO: 435279 - DNA, 15 bp, Homo sapiens
ctgcactgtaaaatg

SEQ ID NO: 435280 - DNA, 18 bp, Homo sapiens
ctgcacttcatatctaga

SEQ ID NO: 435281 - DNA, 23 bp, Homo sapiens
ctgcactttagtgtattttctgt

SEQ ID NO: 435282 - DNA, 12 bp, Homo sapiens
ctgcagagactt

SEQ ID NO: 435283 - DNA, 20 bp, Homo sapiens
ctgcagagcaggaaacatga

SEQ ID NO: 435284 - DNA, 19 bp, Homo sapiens
ctgccctctccacacccat

SEQ ID NO: 435285 - DNA, 19 bp, Homo sapiens
ctgccctctgttcagtaac

SEQ ID NO: 435286 - DNA, 16 bp, Homo sapiens
ctgccctgccacctgt

SEQ ID NO: 435287 - DNA, 17 bp, Homo sapiens
ctgccctgccacctgtc

SEQ ID NO: 435288 - DNA, 11 bp, Homo sapiens
ctgccctgccc

SEQ ID NO: 435289 - DNA, 13 bp, Homo sapiens
ctgccctgcctcc

SEQ ID NO: 435290 - DNA, 15 bp, Homo sapiens
ctgccctgcctccct

SEQ ID NO: 435291 - DNA, 17 bp, Homo sapiens
ctgccctgcctgcccac

SEQ ID NO: 435292 - DNA, 18 bp, Homo sapiens
ctgccctgcctgcccact

SEQ ID NO: 435293 - DNA, 21 bp, Homo sapiens
ctgccctgctgccgcctccca

SEQ ID NO: 435294 - DNA, 14 bp, Homo sapiens
ctgccctggtccag

SEQ ID NO: 435295 - DNA, 20 bp, Homo sapiens
ctgccctggtccagggaagc

SEQ ID NO: 435296 - DNA, 14 bp, Homo sapiens
ctgccctggtgctg

SEQ ID NO: 435297 - DNA, 16 bp, Homo sapiens
ctgccctggtgctgcc

SEQ ID NO: 435298 - DNA, 21 bp, Homo sapiens
ctgccctggtgctgccacact

SEQ ID NO: 435299 - DNA, 14 bp, Homo sapiens
ctgccctgtccctg

SEQ ID NO: 435300 - DNA, 22 bp, Homo sapiens
ctgccgaccgaggctggagctg

SEQ ID NO: 435301 - DNA, 15 bp, Homo sapiens
ctgccgagggggctg

SEQ ID NO: 435302 - DNA, 22 bp, Homo sapiens
ctgccgagggggctgtcatgcg

SEQ ID NO: 435303 - DNA, 15 bp, Homo sapiens
ctgccgcccaaagag

SEQ ID NO: 435304 - DNA, 15 bp, Homo sapiens
ctgccgcctgtgccc

SEQ ID NO: 435305 - DNA, 21 bp, Homo sapiens
ctgccgcctgtgcccttgctg

SEQ ID NO: 435306 - DNA, 14 bp, Homo sapiens
ctgccggccttggc

SEQ ID NO: 435307 - DNA, 14 bp, Homo sapiens
ctgccgggttctag

SEQ ID NO: 435308 - DNA, 15 bp, Homo sapiens
ctgccggtcccccat

SEQ ID NO: 435309 - DNA, 18 bp, Homo sapiens
ctgccggtcccccatgcc

SEQ ID NO: 435310 - DNA, 18 bp, Homo sapiens
ctgccgtgagagcccaat

SEQ ID NO: 435311 - DNA, 23 bp, Homo sapiens
ctgccgtgagagcccaatcactg

SEQ ID NO: 435312 - DNA, 14 bp, Homo sapiens
ctgccgtgcatggc

SEQ ID NO: 435313 - DNA, 21 bp, Homo sapiens
ctgccgtgcatggctcctgtc

SEQ ID NO: 435314 - DNA, 22 bp, Homo sapiens
ctgccgtgggcctgtcgtgcca

SEQ ID NO: 435315 - DNA, 23 bp, Homo sapiens
ctgcctaccagtcgccctctgtg

SEQ ID NO: 435316 - DNA, 17 bp, Homo sapiens
ctgcctacggagggtgg

SEQ ID NO: 435317 - DNA, 17 bp, Homo sapiens
ctgcctagcactcacat

SEQ ID NO: 435318 - DNA, 19 bp, Homo sapiens
ctgcctagcactcacatgc

SEQ ID NO: 435319 - DNA, 20 bp, Homo sapiens
ctgcctaggagctggctggc

SEQ ID NO: 435320 - DNA, 16 bp, Homo sapiens
ctgcctaggagctggg

SEQ ID NO: 435321 - DNA, 22 bp, Homo sapiens
ctgcctagggttgcttgggcca

SEQ ID NO: 435322 - DNA, 23 bp, Homo sapiens
ctgcctagggttgcttgggccac

SEQ ID NO: 435323 - DNA, 12 bp, Homo sapiens
ctgcctcagcct

SEQ ID NO: 435324 - DNA, 13 bp, Homo sapiens
ctgcctcagcctt

SEQ ID NO: 435325 - DNA, 17 bp, Homo sapiens
ctgcctccaccgagcca

SEQ ID NO: 435326 - DNA, 19 bp, Homo sapiens
ctgcctccaccgagccagc

SEQ ID NO: 435327 - DNA, 15 bp, Homo sapiens
ctgcctccaggaggg

SEQ ID NO: 435328 - DNA, 16 bp, Homo sapiens
ctgcctccaggagggc

SEQ ID NO: 435329 - DNA, 21 bp, Homo sapiens
ctgcctcccaaggtcctctca

SEQ ID NO: 435330 - DNA, 23 bp, Homo sapiens
ctgcctcccaaggtcctctcagt

SEQ ID NO: 435331 - DNA, 15 bp, Homo sapiens
ctgcctccccaaccc

SEQ ID NO: 435332 - DNA, 23 bp, Homo sapiens
ctgcctccctctcttccgggagc

SEQ ID NO: 435333 - DNA, 21 bp, Homo sapiens
ctgcctccctggggaccagga

SEQ ID NO: 435334 - DNA, 22 bp, Homo sapiens
ctgcctccctggggaccaggag

SEQ ID NO: 435335 - DNA, 17 bp, Homo sapiens
ctgcctccctgtccacc

SEQ ID NO: 435336 - DNA, 15 bp, Homo sapiens
ctgcctccctttctg

SEQ ID NO: 435337 - DNA, 18 bp, Homo sapiens
ctgcctccggccctgccc

SEQ ID NO: 435338 - DNA, 14 bp, Homo sapiens
ctgcctcctcttca

SEQ ID NO: 435339 - DNA, 17 bp, Homo sapiens
ctgcctcggcctcccaa

SEQ ID NO: 435340 - DNA, 20 bp, Homo sapiens
ctgcctctaaggccaaggcc

SEQ ID NO: 435341 - DNA, 13 bp, Homo sapiens
ctgcctctgaaaa

SEQ ID NO: 435342 - DNA, 17 bp, Homo sapiens
ctgcctctgaaaatatt

SEQ ID NO: 435343 - DNA, 14 bp, Homo sapiens
ctgcctctgaactg

SEQ ID NO: 435344 - DNA, 22 bp, Homo sapiens
ctgcctctgaactgctgctggt

SEQ ID NO: 435345 - DNA, 19 bp, Homo sapiens
ctgcctctgacagcagcct

SEQ ID NO: 435346 - DNA, 20 bp, Homo sapiens
ctgcctctgacagcagcctg

SEQ ID NO: 435347 - DNA, 21 bp, Homo sapiens
ctgcctctgccacactctgac

SEQ ID NO: 435348 - DNA, 13 bp, Homo sapiens
ctgcctctgcctt

SEQ ID NO: 435349 - DNA, 15 bp, Homo sapiens
ctgcctctgccttag

SEQ ID NO: 435350 - DNA, 13 bp, Homo sapiens
ctgcctctgggag

SEQ ID NO: 435351 - DNA, 13 bp, Homo sapiens
ctgcctctgggtg

SEQ ID NO: 435352 - DNA, 21 bp, Homo sapiens
ctgcctctgggtgagtggctg

SEQ ID NO: 435353 - DNA, 16 bp, Homo sapiens
ctgcctgaaaaccatc

SEQ ID NO: 435354 - DNA, 16 bp, Homo sapiens
ctgcctgaaacagcca

SEQ ID NO: 435355 - DNA, 17 bp, Homo sapiens
ctgcctgaaacagccat

SEQ ID NO: 435356 - DNA, 18 bp, Homo sapiens
ctgcctgacactgagccc

SEQ ID NO: 435357 - DNA, 19 bp, Homo sapiens
ctgcctgacactgagcccc

SEQ ID NO: 435358 - DNA, 14 bp, Homo sapiens
ctgcctgagcccag

SEQ ID NO: 435359 - DNA, 12 bp, Homo sapiens
ctgcctgcccac

SEQ ID NO: 435360 - DNA, 13 bp, Homo sapiens
ctgcctgcccacc

SEQ ID NO: 435361 - DNA, 19 bp, Homo sapiens
ctgcctgcccacttagccg

SEQ ID NO: 435362 - DNA, 17 bp, Homo sapiens
ctgcctgccccacacgg

SEQ ID NO: 435363 - DNA, 20 bp, Homo sapiens
ctgcctgccccacacggact

SEQ ID NO: 435364 - DNA, 17 bp, Homo sapiens
ctgcctgcccgcacagc

SEQ ID NO: 435365 - DNA, 18 bp, Homo sapiens
ctgcctgcccgcacagca

SEQ ID NO: 435366 - DNA, 21 bp, Homo sapiens
ctgcctgcctccggccctgcc

SEQ ID NO: 435367 - DNA, 15 bp, Homo sapiens
ctgcctgcctgggaa

SEQ ID NO: 435368 - DNA, 12 bp, Homo sapiens
ctgcctgcctgt

SEQ ID NO: 435369 - DNA, 18 bp, Homo sapiens
ctgcctgcgaaacccagc

SEQ ID NO: 435370 - DNA, 22 bp, Homo sapiens
ctgcctgcgaaacccagcgttc

SEQ ID NO: 435371 - DNA, 15 bp, Homo sapiens
ctgcctggagaaagg

SEQ ID NO: 435372 - DNA, 23 bp, Homo sapiens
ctgcctggagaaaggatggcagc

SEQ ID NO: 435373 - DNA, 16 bp, Homo sapiens
ctgcctggccaggcag

SEQ ID NO: 435374 - DNA, 11 bp, Homo sapiens
ctgcctggccc

SEQ ID NO: 435375 - DNA, 12 bp, Homo sapiens
ctgcctggccca

SEQ ID NO: 435376 - DNA, 18 bp, Homo sapiens
ctgcctggcccagggagg

SEQ ID NO: 435377 - DNA, 14 bp, Homo sapiens
ctgcctggcctggc

SEQ ID NO: 435378 - DNA, 19 bp, Homo sapiens
ctgcctggcctggctcccc

SEQ ID NO: 435379 - DNA, 19 bp, Homo sapiens
ctgcctggcgggcagcccc

SEQ ID NO: 435380 - DNA, 21 bp, Homo sapiens
ctgcctggcgggcagcccctg

SEQ ID NO: 435381 - DNA, 23 bp, Homo sapiens
ctgcctggcgggcagcccctgct

SEQ ID NO: 435382 - DNA, 15 bp, Homo sapiens
ctgcctgggcctgtg

SEQ ID NO: 435383 - DNA, 16 bp, Homo sapiens
ctgcctgggcctgtgc

SEQ ID NO: 435384 - DNA, 19 bp, Homo sapiens
ctgcctgggcctgtgcagc

SEQ ID NO: 435385 - DNA, 20 bp, Homo sapiens
ctgcctgggcctgtgcagca

SEQ ID NO: 435386 - DNA, 23 bp, Homo sapiens
ctgcctgggcctgtgcagcagcc

SEQ ID NO: 435387 - DNA, 16 bp, Homo sapiens
ctgcctgtagttagga

SEQ ID NO: 435388 - DNA, 17 bp, Homo sapiens
ctgcctgtagttaggaa

SEQ ID NO: 435389 - DNA, 19 bp, Homo sapiens
ctgcctgtagttaggaaat

SEQ ID NO: 435390 - DNA, 21 bp, Homo sapiens
ctgcctgtagttaggaaataa

SEQ ID NO: 435391 - DNA, 22 bp, Homo sapiens
ctgcctgtagttaggaaataaa

SEQ ID NO: 435392 - DNA, 13 bp, Homo sapiens
ctgcctgtatttt

SEQ ID NO: 435393 - DNA, 22 bp, Homo sapiens
ctgcctgtattttcgggattct

SEQ ID NO: 435394 - DNA, 18 bp, Homo sapiens
ctgcctgtccctctcagg

SEQ ID NO: 435395 - DNA, 16 bp, Homo sapiens
ctgcctgtgagtgaca

SEQ ID NO: 435396 - DNA, 11 bp, Homo sapiens
ctgcctgtgtg

SEQ ID NO: 435397 - DNA, 19 bp, Homo sapiens
ctgcctgtgtttgtgtgga

SEQ ID NO: 435398 - DNA, 17 bp, Homo sapiens
ctgcctgttataactct

SEQ ID NO: 435399 - DNA, 20 bp, Homo sapiens
ctgcctgttataactctgca

SEQ ID NO: 435400 - DNA, 19 bp, Homo sapiens
ctgcctgttcccattcttg

SEQ ID NO: 435401 - DNA, 15 bp, Homo sapiens
ctgccttatcttgca

SEQ ID NO: 435402 - DNA, 13 bp, Homo sapiens
ctgccttcaggga

SEQ ID NO: 435403 - DNA, 21 bp, Homo sapiens
ctgccttcagtatcaaggctg

SEQ ID NO: 435404 - DNA, 24 bp, Homo sapiens
ctgccttcagtatcaaggctgcct

SEQ ID NO: 435405 - DNA, 18 bp, Homo sapiens
ctgccttcccatgaatct

SEQ ID NO: 435406 - DNA, 20 bp, Homo sapiens
ctgccttctcctctctgggc

SEQ ID NO: 435407 - DNA, 22 bp, Homo sapiens
ctgccttctcctctctgggcct

SEQ ID NO: 435408 - DNA, 12 bp, Homo sapiens
ctgccttctctt

SEQ ID NO: 435409 - DNA, 13 bp, Homo sapiens
ctgccttctcttc

SEQ ID NO: 435410 - DNA, 14 bp, Homo sapiens
ctgccttctcttct

SEQ ID NO: 435411 - DNA, 20 bp, Homo sapiens
ctgccttctgacggccctgc

SEQ ID NO: 435412 - DNA, 15 bp, Homo sapiens
ctgccttctgggcaa

SEQ ID NO: 435413 - DNA, 12 bp, Homo sapiens
ctgccttgctgc

SEQ ID NO: 435414 - DNA, 19 bp, Homo sapiens
ctggaaaatagtcctccaa

SEQ ID NO: 435415 - DNA, 18 bp, Homo sapiens
ctggaaagaggagaagga

SEQ ID NO: 435416 - DNA, 22 bp, Homo sapiens
ctggaaagcaggcaagcatgtt

SEQ ID NO: 435417 - DNA, 19 bp, Homo sapiens
ctggaaagcccgctagaag

SEQ ID NO: 435418 - DNA, 21 bp, Homo sapiens
ctggaaaggatgcttctgctc

SEQ ID NO: 435419 - DNA, 20 bp, Homo sapiens
ctggaaaggggggagctggg

SEQ ID NO: 435420 - DNA, 18 bp, Homo sapiens
ctggaaattcttatttcc

SEQ ID NO: 435421 - DNA, 19 bp, Homo sapiens
ctggaaattcttatttccc

SEQ ID NO: 435422 - DNA, 19 bp, Homo sapiens
ctggaaattcttccctggg

SEQ ID NO: 435423 - DNA, 20 bp, Homo sapiens
ctggaaccagggaggagagg

SEQ ID NO: 435424 - DNA, 23 bp, Homo sapiens
ctggaactctatctgggcctggg

SEQ ID NO: 435425 - DNA, 13 bp, Homo sapiens
ctggaagaacatc

SEQ ID NO: 435426 - DNA, 15 bp, Homo sapiens
ctggaagaacatcaa

SEQ ID NO: 435427 - DNA, 19 bp, Homo sapiens
ctggaagaacatcaagata

SEQ ID NO: 435428 - DNA, 15 bp, Homo sapiens
ctggaagagctgggt

SEQ ID NO: 435429 - DNA, 16 bp, Homo sapiens
ctggaagagctgggta

SEQ ID NO: 435430 - DNA, 18 bp, Homo sapiens
ctggaagccggcggccca

SEQ ID NO: 435431 - DNA, 16 bp, Homo sapiens
ctggaagcctgctgat

SEQ ID NO: 435432 - DNA, 14 bp, Homo sapiens
ctggaaggcagggc

SEQ ID NO: 435433 - DNA, 20 bp, Homo sapiens
ctggaaggcagggcagaggg

SEQ ID NO: 435434 - DNA, 12 bp, Homo sapiens
ctggaaggctgg

SEQ ID NO: 435435 - DNA, 23 bp, Homo sapiens
ctggaagtcatctcattccactg

SEQ ID NO: 435436 - DNA, 18 bp, Homo sapiens
ctggaatcccagctccgc

SEQ ID NO: 435437 - DNA, 22 bp, Homo sapiens
ctggaatgcattcactcagcat

SEQ ID NO: 435438 - DNA, 15 bp, Homo sapiens
ctggaatggagctgt

SEQ ID NO: 435439 - DNA, 19 bp, Homo sapiens
ctggaatggagctgtataa

SEQ ID NO: 435440 - DNA, 17 bp, Homo sapiens
ctggaatggggacctgg

SEQ ID NO: 435441 - DNA, 20 bp, Homo sapiens
ctggaatggggacctggggt

SEQ ID NO: 435442 - DNA, 22 bp, Homo sapiens
ctggaatggggacctggggtgg

SEQ ID NO: 435443 - DNA, 15 bp, Homo sapiens
ctggaattcagcacc

SEQ ID NO: 435444 - DNA, 18 bp, Homo sapiens
ctggaattcagcaccctg

SEQ ID NO: 435445 - DNA, 19 bp, Homo sapiens
ctggaattcagcaccctgg

SEQ ID NO: 435446 - DNA, 15 bp, Homo sapiens
ctggacaagaagctg

SEQ ID NO: 435447 - DNA, 17 bp, Homo sapiens
ctggacaagaagctgct

SEQ ID NO: 435448 - DNA, 18 bp, Homo sapiens
ctggacaagaagctgcta

SEQ ID NO: 435449 - DNA, 15 bp, Homo sapiens
ctggacaggtctggg

SEQ ID NO: 435450 - DNA, 18 bp, Homo sapiens
ctggacaggtctgggaga

SEQ ID NO: 435451 - DNA, 18 bp, Homo sapiens
ctggacatcctcttctgc

SEQ ID NO: 435452 - DNA, 20 bp, Homo sapiens
ctggaccaccagccccagca

SEQ ID NO: 435453 - DNA, 13 bp, Homo sapiens
ctggaccagatgc

SEQ ID NO: 435454 - DNA, 19 bp, Homo sapiens
ctggacctatgtcctaagg

SEQ ID NO: 435455 - DNA, 19 bp, Homo sapiens
ctggacctccccctcttgg

SEQ ID NO: 435456 - DNA, 15 bp, Homo sapiens
ctggacctgagtcgg

SEQ ID NO: 435457 - DNA, 15 bp, Homo sapiens
ctggacctgcctcct

SEQ ID NO: 435458 - DNA, 20 bp, Homo sapiens
ctggacctgcctcctgcctg

SEQ ID NO: 435459 - DNA, 21 bp, Homo sapiens
ctggacctgcctcctgcctgc

SEQ ID NO: 435460 - DNA, 17 bp, Homo sapiens
ctggactcctctgtcca

SEQ ID NO: 435461 - DNA, 18 bp, Homo sapiens
ctggactcctctgtccag

SEQ ID NO: 435462 - DNA, 22 bp, Homo sapiens
ctggactcctctgtccaggcac

SEQ ID NO: 435463 - DNA, 15 bp, Homo sapiens
ctggactggaggtgg

SEQ ID NO: 435464 - DNA, 18 bp, Homo sapiens
ctggactggaggtgggca

SEQ ID NO: 435465 - DNA, 15 bp, Homo sapiens
ctggactggcccttg

SEQ ID NO: 435466 - DNA, 17 bp, Homo sapiens
ctggactggcccttgcc

SEQ ID NO: 435467 - DNA, 15 bp, Homo sapiens
ctggactggctagag

SEQ ID NO: 435468 - DNA, 13 bp, Homo sapiens
ctggactggctgt

SEQ ID NO: 435469 - DNA, 22 bp, Homo sapiens
ctggactgtaggactatataaa

SEQ ID NO: 435470 - DNA, 18 bp, Homo sapiens
ctggactttcctgcaact

SEQ ID NO: 435471 - DNA, 14 bp, Homo sapiens
ctggagaaaatgga

SEQ ID NO: 435472 - DNA, 16 bp, Homo sapiens
ctggagaaaggatggc

SEQ ID NO: 435473 - DNA, 20 bp, Homo sapiens
ctggagaattgaaaaggact

SEQ ID NO: 435474 - DNA, 22 bp, Homo sapiens
ctggagaattgaaaaggactct

SEQ ID NO: 435475 - DNA, 21 bp, Homo sapiens
ctggagacaatgcagatgcca

SEQ ID NO: 435476 - DNA, 15 bp, Homo sapiens
ctggagaccaggact

SEQ ID NO: 435477 - DNA, 20 bp, Homo sapiens
ctggagaccccagagtaggg

SEQ ID NO: 435478 - DNA, 22 bp, Homo sapiens
ctggagaccgcttcacccctgc

SEQ ID NO: 435479 - DNA, 23 bp, Homo sapiens
ctggagaccgcttcacccctgca

SEQ ID NO: 435480 - DNA, 17 bp, Homo sapiens
ctggagacttcctctgg

SEQ ID NO: 435481 - DNA, 23 bp, Homo sapiens
ctggagagtctcactcccctcct

SEQ ID NO: 435482 - DNA, 23 bp, Homo sapiens
ctggagattgtgctctgcagcga

SEQ ID NO: 435483 - DNA, 17 bp, Homo sapiens
ctggagcatcccaggcg

SEQ ID NO: 435484 - DNA, 19 bp, Homo sapiens
ctggagcatgagctctgtg

SEQ ID NO: 435485 - DNA, 23 bp, Homo sapiens
ctggagccaatggtgagggctga

SEQ ID NO: 435486 - DNA, 18 bp, Homo sapiens
ctggagccacctgtccca

SEQ ID NO: 435487 - DNA, 14 bp, Homo sapiens
ctggagccagcagg

SEQ ID NO: 435488 - DNA, 12 bp, Homo sapiens
ctggagccccta

SEQ ID NO: 435489 - DNA, 22 bp, Homo sapiens
ctggagcccctatcctgcaccc

SEQ ID NO: 435490 - DNA, 23 bp, Homo sapiens
ctggagcccctatcctgcaccct

SEQ ID NO: 435491 - DNA, 19 bp, Homo sapiens
ctggagcccctgtgtggga

SEQ ID NO: 435492 - DNA, 20 bp, Homo sapiens
ctggagcccctgtgtgggag

SEQ ID NO: 435493 - DNA, 14 bp, Homo sapiens
ctggagcccggcag

SEQ ID NO: 435494 - DNA, 22 bp, Homo sapiens
ctggagcctgagtcagggccca

SEQ ID NO: 435495 - DNA, 22 bp, Homo sapiens
ctggagcgtttgctgtgccagg

SEQ ID NO: 435496 - DNA, 15 bp, Homo sapiens
ctggagctcctggga

SEQ ID NO: 435497 - DNA, 19 bp, Homo sapiens
ctggagctggcgtctgtct

SEQ ID NO: 435498 - DNA, 22 bp, Homo sapiens
ctggaggaacttgctgctgtgc

SEQ ID NO: 435499 - DNA, 15 bp, Homo sapiens
ctggaggatgaccag

SEQ ID NO: 435500 - DNA, 18 bp, Homo sapiens
ctggaggcattcccagag

SEQ ID NO: 435501 - DNA, 22 bp, Homo sapiens
ctggaggcattcccagaggtgg

SEQ ID NO: 435502 - DNA, 23 bp, Homo sapiens
ctggaggcattcccagaggtggg

SEQ ID NO: 435503 - DNA, 16 bp, Homo sapiens
ctggaggcctctgggc

SEQ ID NO: 435504 - DNA, 21 bp, Homo sapiens
ctggaggcctctgggcctcct

SEQ ID NO: 435505 - DNA, 16 bp, Homo sapiens
ctggaggggacgctgg

SEQ ID NO: 435506 - DNA, 22 bp, Homo sapiens
ctggaggggcatggccagcagc

SEQ ID NO: 435507 - DNA, 13 bp, Homo sapiens
ctggaggtgggca

SEQ ID NO: 435508 - DNA, 14 bp, Homo sapiens
ctggaggtgggcat

SEQ ID NO: 435509 - DNA, 15 bp, Homo sapiens
ctggaggtgggcatg

SEQ ID NO: 435510 - DNA, 21 bp, Homo sapiens
ctggaggtgggcatgccaccc

SEQ ID NO: 435511 - DNA, 24 bp, Homo sapiens
ctggaggtgggcatgccaccctca

SEQ ID NO: 435512 - DNA, 15 bp, Homo sapiens
ctggaggtggggttg

SEQ ID NO: 435513 - DNA, 22 bp, Homo sapiens
ctggaggtggggttgggattgg

SEQ ID NO: 435514 - DNA, 15 bp, Homo sapiens
ctggagtcagatgag

SEQ ID NO: 435515 - DNA, 18 bp, Homo sapiens
ctggagtcagatgagcaa

SEQ ID NO: 435516 - DNA, 19 bp, Homo sapiens
ctggagtctgaaggagagg

SEQ ID NO: 435517 - DNA, 20 bp, Homo sapiens
ctggagtgaggcttccaggc

SEQ ID NO: 435518 - DNA, 23 bp, Homo sapiens
ctggagtgaggcttccaggctct

SEQ ID NO: 435519 - DNA, 17 bp, Homo sapiens
ctggagtgcgctcttgg

SEQ ID NO: 435520 - DNA, 16 bp, Homo sapiens
ctggagtgctggctcc

SEQ ID NO: 435521 - DNA, 21 bp, Homo sapiens
ctggagtggaaggtctattgg

SEQ ID NO: 435522 - DNA, 22 bp, Homo sapiens
ctggagttacattaatgttaat

SEQ ID NO: 435523 - DNA, 16 bp, Homo sapiens
ctggagttctggttcc

SEQ ID NO: 435524 - DNA, 13 bp, Homo sapiens
ctggataaaatga

SEQ ID NO: 435525 - DNA, 21 bp, Homo sapiens
ctggataattttgcataaaat

SEQ ID NO: 435526 - DNA, 13 bp, Homo sapiens
ctggatattttca

SEQ ID NO: 435527 - DNA, 15 bp, Homo sapiens
ctggatattttcaaa

SEQ ID NO: 435528 - DNA, 16 bp, Homo sapiens
ctggatattttcaaat

SEQ ID NO: 435529 - DNA, 13 bp, Homo sapiens
ctggatcagggaa

SEQ ID NO: 435530 - DNA, 17 bp, Homo sapiens
ctggatcagggaatcca

SEQ ID NO: 435531 - DNA, 23 bp, Homo sapiens
ctggatcccctctgtctacaaat

SEQ ID NO: 435532 - DNA, 14 bp, Homo sapiens
ctggatcctgcact

SEQ ID NO: 435533 - DNA, 15 bp, Homo sapiens
ctggatctccccact

SEQ ID NO: 435534 - DNA, 23 bp, Homo sapiens
ctggatgaagattctcctgtgct

SEQ ID NO: 435535 - DNA, 22 bp, Homo sapiens
ctggatgcacagatgccatggc

SEQ ID NO: 435536 - DNA, 17 bp, Homo sapiens
ctggatgccaaggagcc

SEQ ID NO: 435537 - DNA, 20 bp, Homo sapiens
ctggatgccaaggagcccct

SEQ ID NO: 435538 - DNA, 20 bp, Homo sapiens
ctggatggatctgctccatg

SEQ ID NO: 435539 - DNA, 15 bp, Homo sapiens
ctggatgggcattgg

SEQ ID NO: 435540 - DNA, 17 bp, Homo sapiens
ctggatgggcattgggc

SEQ ID NO: 435541 - DNA, 20 bp, Homo sapiens
ctggatgggcattgggctga

SEQ ID NO: 435542 - DNA, 13 bp, Homo sapiens
ctgggagggccca

SEQ ID NO: 435543 - DNA, 20 bp, Homo sapiens
ctgggagggcccacttcagg

SEQ ID NO: 435544 - DNA, 20 bp, Homo sapiens
ctgggagggggcccttccag

SEQ ID NO: 435545 - DNA, 22 bp, Homo sapiens
ctgggaggggtgctgccttgta

SEQ ID NO: 435546 - DNA, 22 bp, Homo sapiens
ctgggaggggttttcgaagctc

SEQ ID NO: 435547 - DNA, 16 bp, Homo sapiens
ctgggagtcagagccc

SEQ ID NO: 435548 - DNA, 21 bp, Homo sapiens
ctgggagtcagagccctggct

SEQ ID NO: 435549 - DNA, 15 bp, Homo sapiens
ctgggagtgttctgt

SEQ ID NO: 435550 - DNA, 18 bp, Homo sapiens
ctgggagtgttctgtttc

SEQ ID NO: 435551 - DNA, 22 bp, Homo sapiens
ctgggatatatggaggattctt

SEQ ID NO: 435552 - DNA, 14 bp, Homo sapiens
ctgggatatttaac

SEQ ID NO: 435553 - DNA, 22 bp, Homo sapiens
ctgggatgacaggcgcctgcca

SEQ ID NO: 435554 - DNA, 19 bp, Homo sapiens
ctgggatgggaacactggt

SEQ ID NO: 435555 - DNA, 22 bp, Homo sapiens
ctgggattctactttaagcact

SEQ ID NO: 435556 - DNA, 19 bp, Homo sapiens
ctgggcaaagccacaaggc

SEQ ID NO: 435557 - DNA, 18 bp, Homo sapiens
ctgggcaacagagcaaga

SEQ ID NO: 435558 - DNA, 21 bp, Homo sapiens
ctgggcaaggtgagggatgcc

SEQ ID NO: 435559 - DNA, 23 bp, Homo sapiens
ctgggcaagtgaggcaagagaaa

SEQ ID NO: 435560 - DNA, 18 bp, Homo sapiens
ctgggcacccacctccac

SEQ ID NO: 435561 - DNA, 20 bp, Homo sapiens
ctgggcacccacctccaccc

SEQ ID NO: 435562 - DNA, 16 bp, Homo sapiens
ctgggcacctggggag

SEQ ID NO: 435563 - DNA, 19 bp, Homo sapiens
ctgggcacctggggagtgg

SEQ ID NO: 435564 - DNA, 20 bp, Homo sapiens
ctgggcacggctccgagggc

SEQ ID NO: 435565 - DNA, 15 bp, Homo sapiens
ctgggcactgggccg

SEQ ID NO: 435566 - DNA, 18 bp, Homo sapiens
ctgggcagaggggagagg

SEQ ID NO: 435567 - DNA, 21 bp, Homo sapiens
ctgggcagaggggagaggaag

SEQ ID NO: 435568 - DNA, 15 bp, Homo sapiens
ctgggcagccaggct

SEQ ID NO: 435569 - DNA, 14 bp, Homo sapiens
ctgggcagcccaga

SEQ ID NO: 435570 - DNA, 17 bp, Homo sapiens
ctgggcagcccagagag

SEQ ID NO: 435571 - DNA, 21 bp, Homo sapiens
ctgggcaggcggtccccatcc

SEQ ID NO: 435572 - DNA, 13 bp, Homo sapiens
ctgggcagggccg

SEQ ID NO: 435573 - DNA, 15 bp, Homo sapiens
ctgggcagggccgca

SEQ ID NO: 435574 - DNA, 22 bp, Homo sapiens
ctgggcagggccgcagggcgct

SEQ ID NO: 435575 - DNA, 21 bp, Homo sapiens
ctgggcaggtcctggggaggc

SEQ ID NO: 435576 - DNA, 12 bp, Homo sapiens
ctgggcagtgcc

SEQ ID NO: 435577 - DNA, 19 bp, Homo sapiens
ctgggcagtgcccaccatg

SEQ ID NO: 435578 - DNA, 22 bp, Homo sapiens
ctgggcagtgcccaccatgcac

SEQ ID NO: 435579 - DNA, 20 bp, Homo sapiens
ctgggcatactttctctcta

SEQ ID NO: 435580 - DNA, 20 bp, Homo sapiens
ctgggcatggtaccagccct

SEQ ID NO: 435581 - DNA, 19 bp, Homo sapiens
ctgggccaagccagggatg

SEQ ID NO: 435582 - DNA, 11 bp, Homo sapiens
ctgggccaccc

SEQ ID NO: 435583 - DNA, 13 bp, Homo sapiens
ctgggccaccctt

SEQ ID NO: 435584 - DNA, 23 bp, Homo sapiens
ctgggccacccttcacgctggct

SEQ ID NO: 435585 - DNA, 17 bp, Homo sapiens
ctgggccactggcatct

SEQ ID NO: 435586 - DNA, 18 bp, Homo sapiens
ctgggccactggcatctc

SEQ ID NO: 435587 - DNA, 13 bp, Homo sapiens
ctgggccagtggc

SEQ ID NO: 435588 - DNA, 17 bp, Homo sapiens
ctgggccagtggctggg

SEQ ID NO: 435589 - DNA, 15 bp, Homo sapiens
ctgggcccagaggca

SEQ ID NO: 435590 - DNA, 21 bp, Homo sapiens
ctgggcccagaggcacagccg

SEQ ID NO: 435591 - DNA, 13 bp, Homo sapiens
ctgggcccagccg

SEQ ID NO: 435592 - DNA, 18 bp, Homo sapiens
ctgggcccagccggggtg

SEQ ID NO: 435593 - DNA, 12 bp, Homo sapiens
ctgggcccaggc

SEQ ID NO: 435594 - DNA, 14 bp, Homo sapiens
ctgggcccaggcag

SEQ ID NO: 435595 - DNA, 21 bp, Homo sapiens
ctgggcccaggcagcacctgg

SEQ ID NO: 435596 - DNA, 14 bp, Homo sapiens
ctgggccccatgct

SEQ ID NO: 435597 - DNA, 18 bp, Homo sapiens
ctgggccccatgctctgc

SEQ ID NO: 435598 - DNA, 20 bp, Homo sapiens
ctgggccccatgctctgccc

SEQ ID NO: 435599 - DNA, 18 bp, Homo sapiens
ctgggccccattctccct

SEQ ID NO: 435600 - DNA, 19 bp, Homo sapiens
ctgggccccccagctcagg

SEQ ID NO: 435601 - DNA, 19 bp, Homo sapiens
ctgggcccctccctacctc

SEQ ID NO: 435602 - DNA, 14 bp, Homo sapiens
ctgggcccgggcag

SEQ ID NO: 435603 - DNA, 18 bp, Homo sapiens
ctgggcccgggcaggcca

SEQ ID NO: 435604 - DNA, 20 bp, Homo sapiens
ctgggccctaggcatactct

SEQ ID NO: 435605 - DNA, 14 bp, Homo sapiens
ctgggccctgcagg

SEQ ID NO: 435606 - DNA, 13 bp, Homo sapiens
ctgggccctgggt

SEQ ID NO: 435607 - DNA, 16 bp, Homo sapiens
ctgggccctgggtgag

SEQ ID NO: 435608 - DNA, 21 bp, Homo sapiens
ctgggccctggttcccccagg

SEQ ID NO: 435609 - DNA, 18 bp, Homo sapiens
ctgggccggcagcctggt

SEQ ID NO: 435610 - DNA, 22 bp, Homo sapiens
ctgggcctcccgtccgtccgcc

SEQ ID NO: 435611 - DNA, 15 bp, Homo sapiens
ctgggcctcccttgg

SEQ ID NO: 435612 - DNA, 16 bp, Homo sapiens
ctgggcctcctctaac

SEQ ID NO: 435613 - DNA, 12 bp, Homo sapiens
ctgggcctcctg

SEQ ID NO: 435614 - DNA, 15 bp, Homo sapiens
ctgggcctcctggga

SEQ ID NO: 435615 - DNA, 16 bp, Homo sapiens
ctgggcctcctgggaa

SEQ ID NO: 435616 - DNA, 13 bp, Homo sapiens
ctgggcctctgac

SEQ ID NO: 435617 - DNA, 14 bp, Homo sapiens
ctgggcctctgact

SEQ ID NO: 435618 - DNA, 23 bp, Homo sapiens
ctgggcctgatggagaggagaac

SEQ ID NO: 435619 - DNA, 21 bp, Homo sapiens
ctgggcctgcttttccaggat

SEQ ID NO: 435620 - DNA, 13 bp, Homo sapiens
ctgggcctgggct

SEQ ID NO: 435621 - DNA, 15 bp, Homo sapiens
ctgggcctgtctcag

SEQ ID NO: 435622 - DNA, 12 bp, Homo sapiens
ctgggcctgtgc

SEQ ID NO: 435623 - DNA, 14 bp, Homo sapiens
ctgggcctgtgcag

SEQ ID NO: 435624 - DNA, 19 bp, Homo sapiens
ctgggcctgtgcagcagcc

SEQ ID NO: 435625 - DNA, 20 bp, Homo sapiens
ctgggcctgtgcagcagccc

SEQ ID NO: 435626 - DNA, 22 bp, Homo sapiens
ctgggcctgtgcagcagcccag

SEQ ID NO: 435627 - DNA, 13 bp, Homo sapiens
ctgggccttctca

SEQ ID NO: 435628 - DNA, 13 bp, Homo sapiens
ctgggcctttcct

SEQ ID NO: 435629 - DNA, 14 bp, Homo sapiens
ctgggcctttcctg

SEQ ID NO: 435630 - DNA, 22 bp, Homo sapiens
ctgggcctttcctgtgccaacc

SEQ ID NO: 435631 - DNA, 23 bp, Homo sapiens
ctgggcgaatctacagaacaaag

SEQ ID NO: 435632 - DNA, 19 bp, Homo sapiens
ctgggctaatttgtatgtt

SEQ ID NO: 435633 - DNA, 20 bp, Homo sapiens
ctgggctaggggacatcaga

SEQ ID NO: 435634 - DNA, 13 bp, Homo sapiens
ctgggctcagggc

SEQ ID NO: 435635 - DNA, 14 bp, Homo sapiens
ctgggctcagggct

SEQ ID NO: 435636 - DNA, 18 bp, Homo sapiens
ctgggctcagggctggag

SEQ ID NO: 435637 - DNA, 20 bp, Homo sapiens
ctgggctcagggctggagtg

SEQ ID NO: 435638 - DNA, 13 bp, Homo sapiens
ctgggctctgcca

SEQ ID NO: 435639 - DNA, 14 bp, Homo sapiens
ctgggctctgccac

SEQ ID NO: 435640 - DNA, 19 bp, Homo sapiens
ctgggctctgtcttcctgg

SEQ ID NO: 435641 - DNA, 14 bp, Homo sapiens
ctgggctgagcccc

SEQ ID NO: 435642 - DNA, 19 bp, Homo sapiens
ctgggctgagcccctaccc

SEQ ID NO: 435643 - DNA, 17 bp, Homo sapiens
ctgggctgagcctactg

SEQ ID NO: 435644 - DNA, 20 bp, Homo sapiens
ctgggctgagcctactgtct

SEQ ID NO: 435645 - DNA, 23 bp, Homo sapiens
ctgggctgagcctactgtctcct

SEQ ID NO: 435646 - DNA, 17 bp, Homo sapiens
ctgggctgaggaggcag

SEQ ID NO: 435647 - DNA, 13 bp, Homo sapiens
ctgggctggactg

SEQ ID NO: 435648 - DNA, 14 bp, Homo sapiens
ctgggctggactgg

SEQ ID NO: 435649 - DNA, 17 bp, Homo sapiens
ctgggctggactggagg

SEQ ID NO: 435650 - DNA, 12 bp, Homo sapiens
ctgggctggcag

SEQ ID NO: 435651 - DNA, 14 bp, Homo sapiens
ctgggctggcagag

SEQ ID NO: 435652 - DNA, 13 bp, Homo sapiens
ctgggctgggaga

SEQ ID NO: 435653 - DNA, 14 bp, Homo sapiens
ctgggctgggagaa

SEQ ID NO: 435654 - DNA, 12 bp, Homo sapiens
ctgggctgtgtg

SEQ ID NO: 435655 - DNA, 11 bp, Homo sapiens
ctgggctttct

SEQ ID NO: 435656 - DNA, 16 bp, Homo sapiens
ctggggaagggaacca

SEQ ID NO: 435657 - DNA, 23 bp, Homo sapiens
ctggggaagggaaccagccctcc

SEQ ID NO: 435658 - DNA, 21 bp, Homo sapiens
ctggggactctgcttggctgt

SEQ ID NO: 435659 - DNA, 17 bp, Homo sapiens
ctggggagcagctgaga

SEQ ID NO: 435660 - DNA, 16 bp, Homo sapiens
ctggggaggacaaagg

SEQ ID NO: 435661 - DNA, 13 bp, Homo sapiens
ctggggaggctga

SEQ ID NO: 435662 - DNA, 16 bp, Homo sapiens
ctggggagggagagat

SEQ ID NO: 435663 - DNA, 14 bp, Homo sapiens
ctggggagtgagct

SEQ ID NO: 435664 - DNA, 17 bp, Homo sapiens
ctggggatttctgggat

SEQ ID NO: 435665 - DNA, 13 bp, Homo sapiens
ctggggcagaggg

SEQ ID NO: 435666 - DNA, 15 bp, Homo sapiens
ctggggcagaggggc

SEQ ID NO: 435667 - DNA, 15 bp, Homo sapiens
ctggggcagtcacct

SEQ ID NO: 435668 - DNA, 17 bp, Homo sapiens
ctggggcatgtgtgcct

SEQ ID NO: 435669 - DNA, 19 bp, Homo sapiens
ctggggcatgtgtgcctgt

SEQ ID NO: 435670 - DNA, 22 bp, Homo sapiens
ctggggcatgtgtgcctgtggc

SEQ ID NO: 435671 - DNA, 21 bp, Homo sapiens
ctggggccacaaatcaaagca

SEQ ID NO: 435672 - DNA, 22 bp, Homo sapiens
ctgtcctgatggtcagctccct

SEQ ID NO: 435673 - DNA, 15 bp, Homo sapiens
ctgtcctgctcacgt

SEQ ID NO: 435674 - DNA, 15 bp, Homo sapiens
ctgtcctggctgtgc

SEQ ID NO: 435675 - DNA, 16 bp, Homo sapiens
ctgtcctggctgtgca

SEQ ID NO: 435676 - DNA, 17 bp, Homo sapiens
ctgtcctggctgtgcac

SEQ ID NO: 435677 - DNA, 23 bp, Homo sapiens
ctgtcctgggcgccctggaagcc

SEQ ID NO: 435678 - DNA, 19 bp, Homo sapiens
ctgtcctggtacagcaggg

SEQ ID NO: 435679 - DNA, 18 bp, Homo sapiens
ctgtccttagactccttc

SEQ ID NO: 435680 - DNA, 14 bp, Homo sapiens
ctgtccttcagatg

SEQ ID NO: 435681 - DNA, 17 bp, Homo sapiens
ctgtccttcccacggcc

SEQ ID NO: 435682 - DNA, 16 bp, Homo sapiens
ctgtccttccttccat

SEQ ID NO: 435683 - DNA, 23 bp, Homo sapiens
ctgtccttctctcacctcctaaa

SEQ ID NO: 435684 - DNA, 15 bp, Homo sapiens
ctgtcctttctccag

SEQ ID NO: 435685 - DNA, 13 bp, Homo sapiens
ctgtcgagacact

SEQ ID NO: 435686 - DNA, 16 bp, Homo sapiens
ctgtcggagaggctgt

SEQ ID NO: 435687 - DNA, 16 bp, Homo sapiens
ctgtcgtgccagtcct

SEQ ID NO: 435688 - DNA, 17 bp, Homo sapiens
ctgtcgtgccagtcctg

SEQ ID NO: 435689 - DNA, 17 bp, Homo sapiens
ctgtcgtggtagcagat

SEQ ID NO: 435690 - DNA, 13 bp, Homo sapiens
ctgtctaaaaaac

SEQ ID NO: 435691 - DNA, 23 bp, Homo sapiens
ctgtctaacctacgaccccagag

SEQ ID NO: 435692 - DNA, 14 bp, Homo sapiens
ctgtctaccatctc

SEQ ID NO: 435693 - DNA, 15 bp, Homo sapiens
ctgtctaccatctcc

SEQ ID NO: 435694 - DNA, 19 bp, Homo sapiens
ctgtctagaatcctgcttt

SEQ ID NO: 435695 - DNA, 20 bp, Homo sapiens
ctgtctagaatcctgcttta

SEQ ID NO: 435696 - DNA, 21 bp, Homo sapiens
ctgtctagaatcctgctttac

SEQ ID NO: 435697 - DNA, 23 bp, Homo sapiens
ctgtctaggtcagtacccacctg

SEQ ID NO: 435698 - DNA, 17 bp, Homo sapiens
ctgtctaggtctcctca

SEQ ID NO: 435699 - DNA, 20 bp, Homo sapiens
ctgtctcaagagggcactgg

SEQ ID NO: 435700 - DNA, 23 bp, Homo sapiens
ctgtctcaagagggcactggtgg

SEQ ID NO: 435701 - DNA, 14 bp, Homo sapiens
ctgtctcatcccca

SEQ ID NO: 435702 - DNA, 14 bp, Homo sapiens
ctgtctcatttatt

SEQ ID NO: 435703 - DNA, 12 bp, Homo sapiens
ctgtctccagac

SEQ ID NO: 435704 - DNA, 22 bp, Homo sapiens
ctgtctccagacccccacccct

SEQ ID NO: 435705 - DNA, 17 bp, Homo sapiens
ctgtctccagggccccc

SEQ ID NO: 435706 - DNA, 18 bp, Homo sapiens
ctgtctccatgtttgatg

SEQ ID NO: 435707 - DNA, 16 bp, Homo sapiens
ctgtctcccctctgct

SEQ ID NO: 435708 - DNA, 19 bp, Homo sapiens
ctgtctcctacctctgctc

SEQ ID NO: 435709 - DNA, 16 bp, Homo sapiens
ctgtctcctctgtcag

SEQ ID NO: 435710 - DNA, 16 bp, Homo sapiens
ctgtctccttcccact

SEQ ID NO: 435711 - DNA, 22 bp, Homo sapiens
ctgtctccttcccactgtcctt

SEQ ID NO: 435712 - DNA, 20 bp, Homo sapiens
ctgtctctacaaaaaaaatc

SEQ ID NO: 435713 - DNA, 16 bp, Homo sapiens
ctgtctctccatctgt

SEQ ID NO: 435714 - DNA, 13 bp, Homo sapiens
ctgtctctctctc

SEQ ID NO: 435715 - DNA, 16 bp, Homo sapiens
ctgtctctctctcttt

SEQ ID NO: 435716 - DNA, 15 bp, Homo sapiens
ctgtctcttgaaaaa

SEQ ID NO: 435717 - DNA, 14 bp, Homo sapiens
ctgtctgagccctg

SEQ ID NO: 435718 - DNA, 21 bp, Homo sapiens
ctgtctgagccctgccctcac

SEQ ID NO: 435719 - DNA, 22 bp, Homo sapiens
ctgtctgagccctgccctcact

SEQ ID NO: 435720 - DNA, 13 bp, Homo sapiens
ctgtctgattcta

SEQ ID NO: 435721 - DNA, 14 bp, Homo sapiens
ctgtctgattctat

SEQ ID NO: 435722 - DNA, 16 bp, Homo sapiens
ctgtctgattctatgc

SEQ ID NO: 435723 - DNA, 18 bp, Homo sapiens
ctgtctgcgccgctgtgc

SEQ ID NO: 435724 - DNA, 14 bp, Homo sapiens
ctgtctggggcctt

SEQ ID NO: 435725 - DNA, 17 bp, Homo sapiens
ctgtctggttttaacaa

SEQ ID NO: 435726 - DNA, 18 bp, Homo sapiens
ctgtctggttttaacaat

SEQ ID NO: 435727 - DNA, 13 bp, Homo sapiens
ctgtctgtagtgt

SEQ ID NO: 435728 - DNA, 14 bp, Homo sapiens
ctgtctgtagtgtt

SEQ ID NO: 435729 - DNA, 13 bp, Homo sapiens
ctgtctgtcctac

SEQ ID NO: 435730 - DNA, 15 bp, Homo sapiens
ctgtcttcaaccctg

SEQ ID NO: 435731 - DNA, 18 bp, Homo sapiens
ctgtcttcaaccctgccc

SEQ ID NO: 435732 - DNA, 23 bp, Homo sapiens
ctgtcttcaaccctgccctgcac

SEQ ID NO: 435733 - DNA, 23 bp, Homo sapiens
ctgtcttcacagctctgtgttgc

SEQ ID NO: 435734 - DNA, 19 bp, Homo sapiens
ctgtcttcagatcctgctg

SEQ ID NO: 435735 - DNA, 20 bp, Homo sapiens
ctgtcttcagatcctgctgc

SEQ ID NO: 435736 - DNA, 21 bp, Homo sapiens
ctgtcttcagatcctgctgcc

SEQ ID NO: 435737 - DNA, 19 bp, Homo sapiens
ctgtcttcatagcagattt

SEQ ID NO: 435738 - DNA, 22 bp, Homo sapiens
ctgtcttcatagcagattttaa

SEQ ID NO: 435739 - DNA, 17 bp, Homo sapiens
ctgtcttcatccttagc

SEQ ID NO: 435740 - DNA, 17 bp, Homo sapiens
ctgtcttccaggcccag

SEQ ID NO: 435741 - DNA, 13 bp, Homo sapiens
ctgtcttctctcc

SEQ ID NO: 435742 - DNA, 22 bp, Homo sapiens
ctgtcttctctccacttctggt

SEQ ID NO: 435743 - DNA, 22 bp, Homo sapiens
ctgtcttctttctcctgtggtt

SEQ ID NO: 435744 - DNA, 16 bp, Homo sapiens
ctgtctttcagataca

SEQ ID NO: 435745 - DNA, 20 bp, Homo sapiens
ctgtctttcctagatggcag

SEQ ID NO: 435746 - DNA, 21 bp, Homo sapiens
ctgtcttttcaggtttgtcat

SEQ ID NO: 435747 - DNA, 18 bp, Homo sapiens
ctgtctttttccttcctg

SEQ ID NO: 435748 - DNA, 19 bp, Homo sapiens
ctgtctttttccttcctga

SEQ ID NO: 435749 - DNA, 20 bp, Homo sapiens
ctgtctttttccttcctgag

SEQ ID NO: 435750 - DNA, 21 bp, Homo sapiens
ctgtctttttccttcctgaga

SEQ ID NO: 435751 - DNA, 21 bp, Homo sapiens
ctgtgaaaattacacccatgc

SEQ ID NO: 435752 - DNA, 18 bp, Homo sapiens
ctgtgaaagtacatttgg

SEQ ID NO: 435753 - DNA, 14 bp, Homo sapiens
ctgtgaaagtatgt

SEQ ID NO: 435754 - DNA, 18 bp, Homo sapiens
ctgtgaaagtctcctgta

SEQ ID NO: 435755 - DNA, 14 bp, Homo sapiens
ctgtgaacttgggg

SEQ ID NO: 435756 - DNA, 17 bp, Homo sapiens
ctgtgaagcctttatct

SEQ ID NO: 435757 - DNA, 16 bp, Homo sapiens
ctgtgaataaagccac

SEQ ID NO: 435758 - DNA, 14 bp, Homo sapiens
ctgtgaatacaatt

SEQ ID NO: 435759 - DNA, 18 bp, Homo sapiens
ctgtgaatacaattaaag

SEQ ID NO: 435760 - DNA, 22 bp, Homo sapiens
ctgtgaatacaattaaaggtcc

SEQ ID NO: 435761 - DNA, 18 bp, Homo sapiens
ctgtgacacagctgagct

SEQ ID NO: 435762 - DNA, 14 bp, Homo sapiens
ctgtgaccatttat

SEQ ID NO: 435763 - DNA, 14 bp, Homo sapiens
ctgtgacctgtggg

SEQ ID NO: 435764 - DNA, 16 bp, Homo sapiens
ctgtgacctgtgggga

SEQ ID NO: 435765 - DNA, 15 bp, Homo sapiens
ctgtgactcctccct

SEQ ID NO: 435766 - DNA, 14 bp, Homo sapiens
ctgtgagaccccca

SEQ ID NO: 435767 - DNA, 22 bp, Homo sapiens
ctgtgagacgaggcaggggctc

SEQ ID NO: 435768 - DNA, 22 bp, Homo sapiens
ctgtgagagagttgctcctcag

SEQ ID NO: 435769 - DNA, 16 bp, Homo sapiens
ctgtgagataaatatc

SEQ ID NO: 435770 - DNA, 19 bp, Homo sapiens
ctgtgagataaatatcatt

SEQ ID NO: 435771 - DNA, 21 bp, Homo sapiens
ctgtgagataaatatcattat

SEQ ID NO: 435772 - DNA, 22 bp, Homo sapiens
ctgtgagataaatatcattata

SEQ ID NO: 435773 - DNA, 15 bp, Homo sapiens
ctgtgagcaaagtgc

SEQ ID NO: 435774 - DNA, 20 bp, Homo sapiens
ctgtgagcagcctccactgt

SEQ ID NO: 435775 - DNA, 23 bp, Homo sapiens
ctgtgagcatccttcccagcaga

SEQ ID NO: 435776 - DNA, 20 bp, Homo sapiens
ctgtgagcgagcctggcagg

SEQ ID NO: 435777 - DNA, 21 bp, Homo sapiens
ctgtgaggaatgctctgtgcc

SEQ ID NO: 435778 - DNA, 18 bp, Homo sapiens
ctgtgaggcggcagctgg

SEQ ID NO: 435779 - DNA, 19 bp, Homo sapiens
ctgtgaggcggcagctggg

SEQ ID NO: 435780 - DNA, 15 bp, Homo sapiens
ctgtgaggctgtcct

SEQ ID NO: 435781 - DNA, 17 bp, Homo sapiens
ctgtgagggagtgcaga

SEQ ID NO: 435782 - DNA, 22 bp, Homo sapiens
ctgtgaggtaactgggatcgca

SEQ ID NO: 435783 - DNA, 13 bp, Homo sapiens
ctgtgatcattta

SEQ ID NO: 435784 - DNA, 20 bp, Homo sapiens
ctgtgatcgtgtgttgccat

SEQ ID NO: 435785 - DNA, 17 bp, Homo sapiens
ctgtgatgatcctcata

SEQ ID NO: 435786 - DNA, 14 bp, Homo sapiens
ctgtgatgcatgag

SEQ ID NO: 435787 - DNA, 18 bp, Homo sapiens
ctgtgatgcatgagctcc

SEQ ID NO: 435788 - DNA, 17 bp, Homo sapiens
ctgtgatgccacacaga

SEQ ID NO: 435789 - DNA, 17 bp, Homo sapiens
ctgtgatgcctgacaca

SEQ ID NO: 435790 - DNA, 23 bp, Homo sapiens
ctgtgatgtcagtagtgcctgtg

SEQ ID NO: 435791 - DNA, 12 bp, Homo sapiens
ctgtgattaatt

SEQ ID NO: 435792 - DNA, 14 bp, Homo sapiens
ctgtgattaattat

SEQ ID NO: 435793 - DNA, 15 bp, Homo sapiens
ctgtgattaattatt

SEQ ID NO: 435794 - DNA, 19 bp, Homo sapiens
ctgtgattgccatttcttc

SEQ ID NO: 435795 - DNA, 22 bp, Homo sapiens
ctgtgatttatttggagtggag

SEQ ID NO: 435796 - DNA, 14 bp, Homo sapiens
ctgtgcaaacagtg

SEQ ID NO: 435797 - DNA, 22 bp, Homo sapiens
ctgtgcaaacagtgtaagctta

SEQ ID NO: 435798 - DNA, 18 bp, Homo sapiens
ctgtgcacattctccctt

SEQ ID NO: 435799 - DNA, 15 bp, Homo sapiens
ctgtgcagcagccca

SEQ ID NO: 435800 - DNA, 17 bp, Homo sapiens
ctgtgcagcagcccagc

SEQ ID NO: 435801 - DNA, 21 bp, Homo sapiens
ctgtttatggcctcagctgcc

SEQ ID NO: 435802 - DNA, 17 bp, Homo sapiens
ctgtttcaacacagacc

SEQ ID NO: 435803 - DNA, 13 bp, Homo sapiens
ctgtttccatggg

SEQ ID NO: 435804 - DNA, 16 bp, Homo sapiens
ctgtttcccttccctt

SEQ ID NO: 435805 - DNA, 11 bp, Homo sapiens
ctgtttctcat

SEQ ID NO: 435806 - DNA, 14 bp, Homo sapiens
ctgtttctctgctg

SEQ ID NO: 435807 - DNA, 13 bp, Homo sapiens
ctgtttgaatttt

SEQ ID NO: 435808 - DNA, 19 bp, Homo sapiens
ctgtttgctaagtgaggat

SEQ ID NO: 435809 - DNA, 17 bp, Homo sapiens
ctgttttagtgccaggc

SEQ ID NO: 435810 - DNA, 13 bp, Homo sapiens
ctgttttatgtca

SEQ ID NO: 435811 - DNA, 19 bp, Homo sapiens
ctgttttatgtcatactct

SEQ ID NO: 435812 - DNA, 21 bp, Homo sapiens
ctgttttattttaattcagtt

SEQ ID NO: 435813 - DNA, 15 bp, Homo sapiens
ctgtttttaagctgt

SEQ ID NO: 435814 - DNA, 17 bp, Homo sapiens
ctgtttttaagctgttt

SEQ ID NO: 435815 - DNA, 19 bp, Homo sapiens
ctgtttttaagctgtttcc

SEQ ID NO: 435816 - DNA, 13 bp, Homo sapiens
ctgtttttctcaa

SEQ ID NO: 435817 - DNA, 14 bp, Homo sapiens
ctgtttttctcaaa

SEQ ID NO: 435818 - DNA, 15 bp, Homo sapiens
ctgtttttctcaaat

SEQ ID NO: 435819 - DNA, 17 bp, Homo sapiens
ctgtttttctcaaataa

SEQ ID NO: 435820 - DNA, 14 bp, Homo sapiens
ctgtttttgaagaa

SEQ ID NO: 435821 - DNA, 19 bp, Homo sapiens
ctgttttttttttttgtat

SEQ ID NO: 435822 - DNA, 24 bp, Homo sapiens
ctgttttttttttttgtatttctt

SEQ ID NO: 435823 - DNA, 12 bp, Homo sapiens
cttaaaaagtta

SEQ ID NO: 435824 - DNA, 15 bp, Homo sapiens
cttaaaaatatgtga

SEQ ID NO: 435825 - DNA, 17 bp, Homo sapiens
cttaaaaatgtaaatat

SEQ ID NO: 435826 - DNA, 22 bp, Homo sapiens
cttaaaactaggcatttgtaaa

SEQ ID NO: 435827 - DNA, 21 bp, Homo sapiens
cttaaaataaacagttgtgaa

SEQ ID NO: 435828 - DNA, 16 bp, Homo sapiens
cttaaaataatgattt

SEQ ID NO: 435829 - DNA, 17 bp, Homo sapiens
cttaaaataatgattta

SEQ ID NO: 435830 - DNA, 18 bp, Homo sapiens
cttaaaatagaaataagt

SEQ ID NO: 435831 - DNA, 16 bp, Homo sapiens
cttaaaattagcatct

SEQ ID NO: 435832 - DNA, 15 bp, Homo sapiens
cttaaacaaaaactt

SEQ ID NO: 435833 - DNA, 13 bp, Homo sapiens
cttaaacaaagtg

SEQ ID NO: 435834 - DNA, 14 bp, Homo sapiens
cttaaactgtgtgg

SEQ ID NO: 435835 - DNA, 14 bp, Homo sapiens
cttaaactttgtca

SEQ ID NO: 435836 - DNA, 21 bp, Homo sapiens
cttaaagaaagtcgaattaat

SEQ ID NO: 435837 - DNA, 15 bp, Homo sapiens
cttaaagcaataagt

SEQ ID NO: 435838 - DNA, 23 bp, Homo sapiens
cttaaaggctgtggtagtactcc

SEQ ID NO: 435839 - DNA, 21 bp, Homo sapiens
cttaaataataaacagtggaa

SEQ ID NO: 435840 - DNA, 12 bp, Homo sapiens
cttaaataattt

SEQ ID NO: 435841 - DNA, 14 bp, Homo sapiens
cttaaatagcatct

SEQ ID NO: 435842 - DNA, 22 bp, Homo sapiens
cttaaatagcatctgctcttct

SEQ ID NO: 435843 - DNA, 14 bp, Homo sapiens
cttaaatatacaac

SEQ ID NO: 435844 - DNA, 16 bp, Homo sapiens
cttaaatggaattatt

SEQ ID NO: 435845 - DNA, 21 bp, Homo sapiens
cttaaattgcttttgttgtga

SEQ ID NO: 435846 - DNA, 13 bp, Homo sapiens
cttaaatttctaa

SEQ ID NO: 435847 - DNA, 22 bp, Homo sapiens
cttaacaaacgtaatttgttat

SEQ ID NO: 435848 - DNA, 16 bp, Homo sapiens
cttaacaacagcttct

SEQ ID NO: 435849 - DNA, 21 bp, Homo sapiens
cttaacaacagcttcttgctt

SEQ ID NO: 435850 - DNA, 22 bp, Homo sapiens
cttaacaacagcttcttgcttg

SEQ ID NO: 435851 - DNA, 13 bp, Homo sapiens
cttaacacttaca

SEQ ID NO: 435852 - DNA, 16 bp, Homo sapiens
cttaaccgcatcagaa

SEQ ID NO: 435853 - DNA, 11 bp, Homo sapiens
cttaactattc

SEQ ID NO: 435854 - DNA, 17 bp, Homo sapiens
cttaactgtgtgaagaa

SEQ ID NO: 435855 - DNA, 15 bp, Homo sapiens
cttaagaaagctata

SEQ ID NO: 435856 - DNA, 22 bp, Homo sapiens
cttaagaaagctatatatgaat

SEQ ID NO: 435857 - DNA, 17 bp, Homo sapiens
cttaagaacacaaagcg

SEQ ID NO: 435858 - DNA, 15 bp, Homo sapiens
cttaagacaaatggg

SEQ ID NO: 435859 - DNA, 17 bp, Homo sapiens
cttaagacaaatgggac

SEQ ID NO: 435860 - DNA, 20 bp, Homo sapiens
cttaagacaaatgggactga

SEQ ID NO: 435861 - DNA, 18 bp, Homo sapiens
cttaagagagagagcctt

SEQ ID NO: 435862 - DNA, 21 bp, Homo sapiens
cttaagattccattttggaaa

SEQ ID NO: 435863 - DNA, 13 bp, Homo sapiens
cttaagcactttg

SEQ ID NO: 435864 - DNA, 23 bp, Homo sapiens
cttaagcgaagtctttgccttct

SEQ ID NO: 435865 - DNA, 17 bp, Homo sapiens
cttaaggagaggagagc

SEQ ID NO: 435866 - DNA, 18 bp, Homo sapiens
cttaaggagaggagagca

SEQ ID NO: 435867 - DNA, 20 bp, Homo sapiens
cttaaggggggcagggagtg

SEQ ID NO: 435868 - DNA, 17 bp, Homo sapiens
cttaagtttagaaatta

SEQ ID NO: 435869 - DNA, 23 bp, Homo sapiens
cttaataaatttaagtttttccc

SEQ ID NO: 435870 - DNA, 17 bp, Homo sapiens
cttaatactgaatttct

SEQ ID NO: 435871 - DNA, 13 bp, Homo sapiens
cttaataggcttt

SEQ ID NO: 435872 - DNA, 17 bp, Homo sapiens
cttaatcatatcaactt

SEQ ID NO: 435873 - DNA, 17 bp, Homo sapiens
cttaatcggttgaccct

SEQ ID NO: 435874 - DNA, 16 bp, Homo sapiens
cttaatcttctctctt

SEQ ID NO: 435875 - DNA, 17 bp, Homo sapiens
cttaatctttattttat

SEQ ID NO: 435876 - DNA, 13 bp, Homo sapiens
cttaatctttgct

SEQ ID NO: 435877 - DNA, 19 bp, Homo sapiens
cttaatctttgctgaagaa

SEQ ID NO: 435878 - DNA, 23 bp, Homo sapiens
cttaatgacattcccctcccacc

SEQ ID NO: 435879 - DNA, 24 bp, Homo sapiens
cttaatgtcagtctacaggccttt

SEQ ID NO: 435880 - DNA, 20 bp, Homo sapiens
cttaatgttctgaataattt

SEQ ID NO: 435881 - DNA, 23 bp, Homo sapiens
cttaattctgttctgatattaat

SEQ ID NO: 435882 - DNA, 15 bp, Homo sapiens
cttaattcttacctc

SEQ ID NO: 435883 - DNA, 20 bp, Homo sapiens
cttaattcttacctcatttg

SEQ ID NO: 435884 - DNA, 23 bp, Homo sapiens
cttaattcttacctcatttgcat

SEQ ID NO: 435885 - DNA, 12 bp, Homo sapiens
cttaatttaagt

SEQ ID NO: 435886 - DNA, 17 bp, Homo sapiens
cttacaagccagctgga

SEQ ID NO: 435887 - DNA, 20 bp, Homo sapiens
cttacaagtaatgaatttta

SEQ ID NO: 435888 - DNA, 22 bp, Homo sapiens
cttacaagtaatgaattttatg

SEQ ID NO: 435889 - DNA, 17 bp, Homo sapiens
cttacaatgtgcactga

SEQ ID NO: 435890 - DNA, 19 bp, Homo sapiens
cttacaattccctgctgtc

SEQ ID NO: 435891 - DNA, 16 bp, Homo sapiens
cttacaattgcactgc

SEQ ID NO: 435892 - DNA, 13 bp, Homo sapiens
cttacacaatggt

SEQ ID NO: 435893 - DNA, 18 bp, Homo sapiens
cttacacttggagcccgt

SEQ ID NO: 435894 - DNA, 23 bp, Homo sapiens
cttacaggggggtcggaagcctg

SEQ ID NO: 435895 - DNA, 15 bp, Homo sapiens
cttacagtaggagtg

SEQ ID NO: 435896 - DNA, 23 bp, Homo sapiens
cttacagtaggagtgagaaattt

SEQ ID NO: 435897 - DNA, 21 bp, Homo sapiens
cttacagtattttctatgtaa

SEQ ID NO: 435898 - DNA, 14 bp, Homo sapiens
cttacatgcatttg

SEQ ID NO: 435899 - DNA, 21 bp, Homo sapiens
cttacattagcagtttgcttt

SEQ ID NO: 435900 - DNA, 22 bp, Homo sapiens
cttacattagcagtttgctttg

SEQ ID NO: 435901 - DNA, 14 bp, Homo sapiens
cttacattggcttt

SEQ ID NO: 435902 - DNA, 13 bp, Homo sapiens
cttacatttgtga

SEQ ID NO: 435903 - DNA, 18 bp, Homo sapiens
cttacatttgtgagattc

SEQ ID NO: 435904 - DNA, 20 bp, Homo sapiens
cttacatttgtgagattcct

SEQ ID NO: 435905 - DNA, 16 bp, Homo sapiens
cttaccaactttctgt

SEQ ID NO: 435906 - DNA, 19 bp, Homo sapiens
cttaccaactttctgtaaa

SEQ ID NO: 435907 - DNA, 23 bp, Homo sapiens
cttaccccgtccctttccctgca

SEQ ID NO: 435908 - DNA, 15 bp, Homo sapiens
cttaccctctctttc

SEQ ID NO: 435909 - DNA, 20 bp, Homo sapiens
cttacccttctgtgcccagc

SEQ ID NO: 435910 - DNA, 22 bp, Homo sapiens
cttaccctttcctcctttatca

SEQ ID NO: 435911 - DNA, 18 bp, Homo sapiens
cttacctcccacctttgg

SEQ ID NO: 435912 - DNA, 17 bp, Homo sapiens
cttacctgtacactgac

SEQ ID NO: 435913 - DNA, 12 bp, Homo sapiens
cttacgctctct

SEQ ID NO: 435914 - DNA, 14 bp, Homo sapiens
cttacgctctgctc

SEQ ID NO: 435915 - DNA, 21 bp, Homo sapiens
cttacgctctgctcaatgaaa

SEQ ID NO: 435916 - DNA, 14 bp, Homo sapiens
cttacggttttaaa

SEQ ID NO: 435917 - DNA, 21 bp, Homo sapiens
cttactaaacattttgttatt

SEQ ID NO: 435918 - DNA, 20 bp, Homo sapiens
cttactaaccaccatttccc

SEQ ID NO: 435919 - DNA, 21 bp, Homo sapiens
cttactacagaaagcaaatca

SEQ ID NO: 435920 - DNA, 15 bp, Homo sapiens
cttactactttaaat

SEQ ID NO: 435921 - DNA, 12 bp, Homo sapiens
cttactattccc

SEQ ID NO: 435922 - DNA, 13 bp, Homo sapiens
cttactattccca

SEQ ID NO: 435923 - DNA, 19 bp, Homo sapiens
cttactattcccactttca

SEQ ID NO: 435924 - DNA, 20 bp, Homo sapiens
cttactattcccactttcat

SEQ ID NO: 435925 - DNA, 19 bp, Homo sapiens
cttactctgagcccaggcc

SEQ ID NO: 435926 - DNA, 15 bp, Homo sapiens
cttactgattaactc

SEQ ID NO: 435927 - DNA, 11 bp, Homo sapiens
cttactgcttg

SEQ ID NO: 435928 - DNA, 19 bp, Homo sapiens
cttactgtcggtgtcccct

SEQ ID NO: 435929 - DNA, 13 bp, Homo sapiens
cttacttagagat

SEQ ID NO: 435930 - DNA, 22 bp, Homo sapiens
cttacttgccaagaaaatgaag

SEQ ID NO: 435931 - DNA, 18 bp, Homo sapiens
cttcagatcctgctgccg

SEQ ID NO: 435932 - DNA, 15 bp, Homo sapiens
cttcagattatttcc

SEQ ID NO: 435933 - DNA, 23 bp, Homo sapiens
cttcagcaaccctacagtatata

SEQ ID NO: 435934 - DNA, 15 bp, Homo sapiens
cttcagcaggggtgg

SEQ ID NO: 435935 - DNA, 16 bp, Homo sapiens
cttcagcaggggtggg

SEQ ID NO: 435936 - DNA, 14 bp, Homo sapiens
cttcagctgcctga

SEQ ID NO: 435937 - DNA, 18 bp, Homo sapiens
cttcagctgcctgaaaca

SEQ ID NO: 435938 - DNA, 12 bp, Homo sapiens
cttcagctggtg

SEQ ID NO: 435939 - DNA, 13 bp, Homo sapiens
cttcagctggtgg

SEQ ID NO: 435940 - DNA, 14 bp, Homo sapiens
cttcagctggtgga

SEQ ID NO: 435941 - DNA, 17 bp, Homo sapiens
cttcagctttggatgtg

SEQ ID NO: 435942 - DNA, 18 bp, Homo sapiens
cttcaggacccttctact

SEQ ID NO: 435943 - DNA, 19 bp, Homo sapiens
cttcaggacccttctactt

SEQ ID NO: 435944 - DNA, 12 bp, Homo sapiens
cttcaggcctcc

SEQ ID NO: 435945 - DNA, 14 bp, Homo sapiens
cttcaggctcttct

SEQ ID NO: 435946 - DNA, 16 bp, Homo sapiens
cttcaggctcttctcc

SEQ ID NO: 435947 - DNA, 22 bp, Homo sapiens
cttcaggctcttctcctttcac

SEQ ID NO: 435948 - DNA, 11 bp, Homo sapiens
cttcagggcca

SEQ ID NO: 435949 - DNA, 14 bp, Homo sapiens
cttcagggccagaa

SEQ ID NO: 435950 - DNA, 18 bp, Homo sapiens
cttcagggccagaaggag

SEQ ID NO: 435951 - DNA, 21 bp, Homo sapiens
cttcagggccagaaggagggc

SEQ ID NO: 435952 - DNA, 16 bp, Homo sapiens
cttcaggggtcacctc

SEQ ID NO: 435953 - DNA, 20 bp, Homo sapiens
cttcagggtatcccagaccc

SEQ ID NO: 435954 - DNA, 23 bp, Homo sapiens
cttcagggttctcctctcccctc

SEQ ID NO: 435955 - DNA, 16 bp, Homo sapiens
cttcaggttgttctgt

SEQ ID NO: 435956 - DNA, 20 bp, Homo sapiens
cttcagtatcaaggctgcct

SEQ ID NO: 435957 - DNA, 21 bp, Homo sapiens
cttcagtatcaaggctgcctg

SEQ ID NO: 435958 - DNA, 22 bp, Homo sapiens
cttcagtatcaaggctgcctgg

SEQ ID NO: 435959 - DNA, 19 bp, Homo sapiens
cttcagtcatggcattcgc

SEQ ID NO: 435960 - DNA, 14 bp, Homo sapiens
cttcagtctctgca

SEQ ID NO: 435961 - DNA, 14 bp, Homo sapiens
cttcagtcttggag

SEQ ID NO: 435962 - DNA, 15 bp, Homo sapiens
cttcagtgagcccct

SEQ ID NO: 435963 - DNA, 16 bp, Homo sapiens
cttcagtgagcccctc

SEQ ID NO: 435964 - DNA, 18 bp, Homo sapiens
cttcagtgagcccctccc

SEQ ID NO: 435965 - DNA, 21 bp, Homo sapiens
cttcagtgagcccctccccag

SEQ ID NO: 435966 - DNA, 14 bp, Homo sapiens
cttcagtgccaaaa

SEQ ID NO: 435967 - DNA, 16 bp, Homo sapiens
cttcataaaactcatg

SEQ ID NO: 435968 - DNA, 19 bp, Homo sapiens
cttcataacaattttagga

SEQ ID NO: 435969 - DNA, 23 bp, Homo sapiens
cttcatacaaaggacagtacaca

SEQ ID NO: 435970 - DNA, 21 bp, Homo sapiens
cttcatactttttttcacagt

SEQ ID NO: 435971 - DNA, 16 bp, Homo sapiens
cttcataggcagagcc

SEQ ID NO: 435972 - DNA, 13 bp, Homo sapiens
cttcatataaact

SEQ ID NO: 435973 - DNA, 15 bp, Homo sapiens
cttcatatctctccc

SEQ ID NO: 435974 - DNA, 16 bp, Homo sapiens
cttcatatctctccct

SEQ ID NO: 435975 - DNA, 17 bp, Homo sapiens
cttcatatctctccctt

SEQ ID NO: 435976 - DNA, 18 bp, Homo sapiens
cttcatccatagacacag

SEQ ID NO: 435977 - DNA, 17 bp, Homo sapiens
cttcatgaaaatcctac

SEQ ID NO: 435978 - DNA, 18 bp, Homo sapiens
cttcatgaaaatcctacc

SEQ ID NO: 435979 - DNA, 19 bp, Homo sapiens
cttcatgaaaatcctacca

SEQ ID NO: 435980 - DNA, 12 bp, Homo sapiens
cttcatgcaatg

SEQ ID NO: 435981 - DNA, 22 bp, Homo sapiens
cttcatgcaatgacatcttcaa

SEQ ID NO: 435982 - DNA, 15 bp, Homo sapiens
cttcatgcctttgta

SEQ ID NO: 435983 - DNA, 17 bp, Homo sapiens
cttcatgcctttgtaag

SEQ ID NO: 435984 - DNA, 19 bp, Homo sapiens
cttcatgcctttgtaagtt

SEQ ID NO: 435985 - DNA, 12 bp, Homo sapiens
cttcatggaggg

SEQ ID NO: 435986 - DNA, 17 bp, Homo sapiens
cttcatggtctcttcca

SEQ ID NO: 435987 - DNA, 20 bp, Homo sapiens
cttcatgtcaacttctggct

SEQ ID NO: 435988 - DNA, 17 bp, Homo sapiens
cttcattctaaaccaaa

SEQ ID NO: 435989 - DNA, 16 bp, Homo sapiens
cttcattctcactctg

SEQ ID NO: 435990 - DNA, 14 bp, Homo sapiens
cttcattctccgtt

SEQ ID NO: 435991 - DNA, 21 bp, Homo sapiens
cttcattcttgaaagctgtgg

SEQ ID NO: 435992 - DNA, 20 bp, Homo sapiens
cttcatttcctctgagctgt

SEQ ID NO: 435993 - DNA, 14 bp, Homo sapiens
cttcatttctgatg

SEQ ID NO: 435994 - DNA, 13 bp, Homo sapiens
cttcatttggaga

SEQ ID NO: 435995 - DNA, 13 bp, Homo sapiens
cttcatttgtgtc

SEQ ID NO: 435996 - DNA, 18 bp, Homo sapiens
cttcatttgtgtcaatgg

SEQ ID NO: 435997 - DNA, 13 bp, Homo sapiens
cttcatttttcct

SEQ ID NO: 435998 - DNA, 15 bp, Homo sapiens
cttccaaaaaattaa

SEQ ID NO: 435999 - DNA, 17 bp, Homo sapiens
cttccaaagaattctta

SEQ ID NO: 436000 - DNA, 18 bp, Homo sapiens
cttccaactgctgcccca

SEQ ID NO: 436001 - DNA, 19 bp, Homo sapiens
cttccaactgctgccccaa

SEQ ID NO: 436002 - DNA, 12 bp, Homo sapiens
cttccaagaaaa

SEQ ID NO: 436003 - DNA, 14 bp, Homo sapiens
cttccaagacctga

SEQ ID NO: 436004 - DNA, 22 bp, Homo sapiens
cttccaagcccttccctctgtt

SEQ ID NO: 436005 - DNA, 21 bp, Homo sapiens
cttccaaggagaccaagtcct

SEQ ID NO: 436006 - DNA, 15 bp, Homo sapiens
cttccaatgatgctt

SEQ ID NO: 436007 - DNA, 17 bp, Homo sapiens
cttccaatgatgcttac

SEQ ID NO: 436008 - DNA, 14 bp, Homo sapiens
cttccacagcaaat

SEQ ID NO: 436009 - DNA, 14 bp, Homo sapiens
cttccacccattcc

SEQ ID NO: 436010 - DNA, 21 bp, Homo sapiens
cttccacccattcccccatgt

SEQ ID NO: 436011 - DNA, 16 bp, Homo sapiens
cttccacctcacaact

SEQ ID NO: 436012 - DNA, 22 bp, Homo sapiens
cttccacctcacaactccttcc

SEQ ID NO: 436013 - DNA, 17 bp, Homo sapiens
cttccactaccctccct

SEQ ID NO: 436014 - DNA, 18 bp, Homo sapiens
cttccactgcctctgcct

SEQ ID NO: 436015 - DNA, 23 bp, Homo sapiens
cttccagaaagcaggagcagctg

SEQ ID NO: 436016 - DNA, 18 bp, Homo sapiens
cttccagaagatgccctc

SEQ ID NO: 436017 - DNA, 10 bp, Homo sapiens
cttccagatg

SEQ ID NO: 436018 - DNA, 18 bp, Homo sapiens
cttccagattgggggccc

SEQ ID NO: 436019 - DNA, 18 bp, Homo sapiens
cttccagcccagacatcc

SEQ ID NO: 436020 - DNA, 22 bp, Homo sapiens
cttccagcccagacccccagtg

SEQ ID NO: 436021 - DNA, 19 bp, Homo sapiens
cttccagcgggccctctgc

SEQ ID NO: 436022 - DNA, 20 bp, Homo sapiens
cttccagcgggccctctgcc

SEQ ID NO: 436023 - DNA, 22 bp, Homo sapiens
cttccaggaagcacaggccagg

SEQ ID NO: 436024 - DNA, 17 bp, Homo sapiens
cttccaggacccctggg

SEQ ID NO: 436025 - DNA, 14 bp, Homo sapiens
cttccaggccatca

SEQ ID NO: 436026 - DNA, 20 bp, Homo sapiens
cttccaggccatcagaggcc

SEQ ID NO: 436027 - DNA, 22 bp, Homo sapiens
cttccaggcgtagggccagggc

SEQ ID NO: 436028 - DNA, 12 bp, Homo sapiens
cttccaggctct

SEQ ID NO: 436029 - DNA, 14 bp, Homo sapiens
cttccaggctcttc

SEQ ID NO: 436030 - DNA, 15 bp, Homo sapiens
cttccaggctcttcc

SEQ ID NO: 436031 - DNA, 19 bp, Homo sapiens
cttccaggggtcaccttga

SEQ ID NO: 436032 - DNA, 22 bp, Homo sapiens
cttccagtggctggtttctgag

SEQ ID NO: 436033 - DNA, 16 bp, Homo sapiens
cttccatacagctcta

SEQ ID NO: 436034 - DNA, 15 bp, Homo sapiens
cttccatatgctctt

SEQ ID NO: 436035 - DNA, 18 bp, Homo sapiens
cttccatcagcagtgatt

SEQ ID NO: 436036 - DNA, 23 bp, Homo sapiens
cttccatcagcagtgattgaagt

SEQ ID NO: 436037 - DNA, 12 bp, Homo sapiens
cttccatcccta

SEQ ID NO: 436038 - DNA, 13 bp, Homo sapiens
cttccatggtggt

SEQ ID NO: 436039 - DNA, 21 bp, Homo sapiens
cttccatggtggtttcagaaa

SEQ ID NO: 436040 - DNA, 22 bp, Homo sapiens
cttccatggtggtttcagaaag

SEQ ID NO: 436041 - DNA, 16 bp, Homo sapiens
cttccatgtcgcctct

SEQ ID NO: 436042 - DNA, 18 bp, Homo sapiens
cttccatgtcgcctctgc

SEQ ID NO: 436043 - DNA, 19 bp, Homo sapiens
cttccatgtcgcctctgca

SEQ ID NO: 436044 - DNA, 15 bp, Homo sapiens
cttccattctttctt

SEQ ID NO: 436045 - DNA, 17 bp, Homo sapiens
cttccattctttcttcc

SEQ ID NO: 436046 - DNA, 17 bp, Homo sapiens
cttccattgctcccagt

SEQ ID NO: 436047 - DNA, 20 bp, Homo sapiens
cttccattgctcccagtgcc

SEQ ID NO: 436048 - DNA, 22 bp, Homo sapiens
cttcccaaactcccaggacctg

SEQ ID NO: 436049 - DNA, 18 bp, Homo sapiens
cttcccaactcactgtgc

SEQ ID NO: 436050 - DNA, 22 bp, Homo sapiens
cttcccaactcactgtgctcct

SEQ ID NO: 436051 - DNA, 17 bp, Homo sapiens
cttcccaacttccctgt

SEQ ID NO: 436052 - DNA, 21 bp, Homo sapiens
cttcccaacttccctgttctt

SEQ ID NO: 436053 - DNA, 17 bp, Homo sapiens
cttcccacctccctgcc

SEQ ID NO: 436054 - DNA, 19 bp, Homo sapiens
cttcccacctccctgccca

SEQ ID NO: 436055 - DNA, 21 bp, Homo sapiens
cttcccacggccactgcagtc

SEQ ID NO: 436056 - DNA, 15 bp, Homo sapiens
cttcccagctggcag

SEQ ID NO: 436057 - DNA, 16 bp, Homo sapiens
cttcccagctggcagc

SEQ ID NO: 436058 - DNA, 18 bp, Homo sapiens
cttcccagctggcagcgc

SEQ ID NO: 436059 - DNA, 17 bp, Homo sapiens
cttcccaggaccctggg

SEQ ID NO: 436060 - DNA, 13 bp, Homo sapiens
cttcccaggccag

SEQ ID NO: 436061 - DNA, 18 bp, Homo sapiens
cttctgtagtactcctta

SEQ ID NO: 436062 - DNA, 22 bp, Homo sapiens
cttctgtccccagccctgtcct

SEQ ID NO: 436063 - DNA, 15 bp, Homo sapiens
cttctgtctgtaaga

SEQ ID NO: 436064 - DNA, 17 bp, Homo sapiens
cttctgtgcccagctca

SEQ ID NO: 436065 - DNA, 16 bp, Homo sapiens
cttctgtgtctgtcac

SEQ ID NO: 436066 - DNA, 15 bp, Homo sapiens
cttctgtttttctca

SEQ ID NO: 436067 - DNA, 21 bp, Homo sapiens
cttctgtttttctcaaataaa

SEQ ID NO: 436068 - DNA, 21 bp, Homo sapiens
cttcttaaccccagtaagcca

SEQ ID NO: 436069 - DNA, 13 bp, Homo sapiens
cttcttacatgca

SEQ ID NO: 436070 - DNA, 14 bp, Homo sapiens
cttcttacatgcat

SEQ ID NO: 436071 - DNA, 15 bp, Homo sapiens
cttcttactgtattt

SEQ ID NO: 436072 - DNA, 16 bp, Homo sapiens
cttcttatacatttga

SEQ ID NO: 436073 - DNA, 13 bp, Homo sapiens
cttcttatggtat

SEQ ID NO: 436074 - DNA, 23 bp, Homo sapiens
cttcttattcatgctttctcctt

SEQ ID NO: 436075 - DNA, 23 bp, Homo sapiens
cttcttcacccagctaatctgta

SEQ ID NO: 436076 - DNA, 21 bp, Homo sapiens
cttcttcatccatagacacag

SEQ ID NO: 436077 - DNA, 17 bp, Homo sapiens
cttcttccccagggttc

SEQ ID NO: 436078 - DNA, 23 bp, Homo sapiens
cttcttccccagggttctgtatt

SEQ ID NO: 436079 - DNA, 21 bp, Homo sapiens
cttcttccctaatcagctccc

SEQ ID NO: 436080 - DNA, 14 bp, Homo sapiens
cttcttccctccct

SEQ ID NO: 436081 - DNA, 19 bp, Homo sapiens
cttcttcggaggtggcagc

SEQ ID NO: 436082 - DNA, 16 bp, Homo sapiens
cttcttctcggggaca

SEQ ID NO: 436083 - DNA, 15 bp, Homo sapiens
cttcttctgcgtttg

SEQ ID NO: 436084 - DNA, 13 bp, Homo sapiens
cttcttgccctga

SEQ ID NO: 436085 - DNA, 14 bp, Homo sapiens
cttcttgcggcacc

SEQ ID NO: 436086 - DNA, 20 bp, Homo sapiens
cttcttgcggcaccgcccac

SEQ ID NO: 436087 - DNA, 13 bp, Homo sapiens
cttcttgctcctg

SEQ ID NO: 436088 - DNA, 13 bp, Homo sapiens
cttcttgcttctc

SEQ ID NO: 436089 - DNA, 18 bp, Homo sapiens
cttcttgcttgtaaaaat

SEQ ID NO: 436090 - DNA, 19 bp, Homo sapiens
cttcttggcttctgggacc

SEQ ID NO: 436091 - DNA, 17 bp, Homo sapiens
cttcttgggccccagac

SEQ ID NO: 436092 - DNA, 23 bp, Homo sapiens
cttcttggtgcttacacatctca

SEQ ID NO: 436093 - DNA, 18 bp, Homo sapiens
cttcttgtgtcctgatga

SEQ ID NO: 436094 - DNA, 15 bp, Homo sapiens
cttcttgtgtttgaa

SEQ ID NO: 436095 - DNA, 16 bp, Homo sapiens
cttcttgtgtttgaaa

SEQ ID NO: 436096 - DNA, 13 bp, Homo sapiens
cttcttgttcccc

SEQ ID NO: 436097 - DNA, 14 bp, Homo sapiens
cttctttaccttca

SEQ ID NO: 436098 - DNA, 23 bp, Homo sapiens
cttctttactcggcgtgctcctt

SEQ ID NO: 436099 - DNA, 22 bp, Homo sapiens
cttctttataattctactttga

SEQ ID NO: 436100 - DNA, 21 bp, Homo sapiens
cttcttttgaccccttcctgt

SEQ ID NO: 436101 - DNA, 22 bp, Homo sapiens
cttcttttgaccccttcctgtc

SEQ ID NO: 436102 - DNA, 19 bp, Homo sapiens
cttgaaaaagtattgtttt

SEQ ID NO: 436103 - DNA, 22 bp, Homo sapiens
cttgaaaatgtggcttcttcaa

SEQ ID NO: 436104 - DNA, 14 bp, Homo sapiens
cttgaaacagcctg

SEQ ID NO: 436105 - DNA, 17 bp, Homo sapiens
cttgaaagaaaggggca

SEQ ID NO: 436106 - DNA, 16 bp, Homo sapiens
cttgaaagcatccatg

SEQ ID NO: 436107 - DNA, 17 bp, Homo sapiens
cttgaaagcatccatgt

SEQ ID NO: 436108 - DNA, 18 bp, Homo sapiens
cttgaaagcatccatgtg

SEQ ID NO: 436109 - DNA, 21 bp, Homo sapiens
cttgaactgttctggcctcag

SEQ ID NO: 436110 - DNA, 16 bp, Homo sapiens
cttgaagacttttctt

SEQ ID NO: 436111 - DNA, 12 bp, Homo sapiens
cttgaagatgta

SEQ ID NO: 436112 - DNA, 13 bp, Homo sapiens
cttgaagccaagt

SEQ ID NO: 436113 - DNA, 14 bp, Homo sapiens
cttgaagggcccag

SEQ ID NO: 436114 - DNA, 16 bp, Homo sapiens
cttgaagggcccagga

SEQ ID NO: 436115 - DNA, 20 bp, Homo sapiens
cttgaatatgggcggaagta

SEQ ID NO: 436116 - DNA, 21 bp, Homo sapiens
cttgaatggttaataaaactg

SEQ ID NO: 436117 - DNA, 21 bp, Homo sapiens
cttgaatgtacaaagatactt

SEQ ID NO: 436118 - DNA, 19 bp, Homo sapiens
cttgaatgtccccattcta

SEQ ID NO: 436119 - DNA, 15 bp, Homo sapiens
cttgaattaaaaaaa

SEQ ID NO: 436120 - DNA, 20 bp, Homo sapiens
cttgaattgcattttttaaa

SEQ ID NO: 436121 - DNA, 13 bp, Homo sapiens
cttgaatttctag

SEQ ID NO: 436122 - DNA, 20 bp, Homo sapiens
cttgacaaaacctaacttgc

SEQ ID NO: 436123 - DNA, 13 bp, Homo sapiens
cttgacatgtgca

SEQ ID NO: 436124 - DNA, 14 bp, Homo sapiens
cttgacattcaagg

SEQ ID NO: 436125 - DNA, 22 bp, Homo sapiens
cttgacattccttgtcaccagc

SEQ ID NO: 436126 - DNA, 23 bp, Homo sapiens
cttgacattccttgtcaccagca

SEQ ID NO: 436127 - DNA, 17 bp, Homo sapiens
cttgaccttcctctggg

SEQ ID NO: 436128 - DNA, 18 bp, Homo sapiens
cttgaccttcctctgggg

SEQ ID NO: 436129 - DNA, 22 bp, Homo sapiens
cttgacgcgtggtcacaggacg

SEQ ID NO: 436130 - DNA, 15 bp, Homo sapiens
cttgactcaggattt

SEQ ID NO: 436131 - DNA, 16 bp, Homo sapiens
cttgactcaggattta

SEQ ID NO: 436132 - DNA, 21 bp, Homo sapiens
cttgactcaggtggtgtcctt

SEQ ID NO: 436133 - DNA, 14 bp, Homo sapiens
cttgactctaaatg

SEQ ID NO: 436134 - DNA, 18 bp, Homo sapiens
cttgactgaagcgaacat

SEQ ID NO: 436135 - DNA, 15 bp, Homo sapiens
cttgacttctgccca

SEQ ID NO: 436136 - DNA, 16 bp, Homo sapiens
cttgacttctgcccaa

SEQ ID NO: 436137 - DNA, 13 bp, Homo sapiens
cttgagacagctt

SEQ ID NO: 436138 - DNA, 23 bp, Homo sapiens
cttgagaccaagccggtgcccac

SEQ ID NO: 436139 - DNA, 20 bp, Homo sapiens
cttgagagaaaaagtgcccc

SEQ ID NO: 436140 - DNA, 17 bp, Homo sapiens
cttgagagcgctggcct

SEQ ID NO: 436141 - DNA, 19 bp, Homo sapiens
cttgagagcgctggcctct

SEQ ID NO: 436142 - DNA, 13 bp, Homo sapiens
cttgagagctgct

SEQ ID NO: 436143 - DNA, 21 bp, Homo sapiens
cttgagaggggtgagacagtg

SEQ ID NO: 436144 - DNA, 20 bp, Homo sapiens
cttgagagtagatggtttga

SEQ ID NO: 436145 - DNA, 22 bp, Homo sapiens
cttgagatgtatgaaggctttt

SEQ ID NO: 436146 - DNA, 16 bp, Homo sapiens
cttgagcagtggctgg

SEQ ID NO: 436147 - DNA, 21 bp, Homo sapiens
cttgagcagtggctggtccag

SEQ ID NO: 436148 - DNA, 16 bp, Homo sapiens
cttgagcatgttactg

SEQ ID NO: 436149 - DNA, 22 bp, Homo sapiens
cttgagcatgttactgacagag

SEQ ID NO: 436150 - DNA, 16 bp, Homo sapiens
cttgagccagtaattg

SEQ ID NO: 436151 - DNA, 12 bp, Homo sapiens
cttgagcccagg

SEQ ID NO: 436152 - DNA, 15 bp, Homo sapiens
cttgagcccaggagt

SEQ ID NO: 436153 - DNA, 15 bp, Homo sapiens
cttgagcctccccca

SEQ ID NO: 436154 - DNA, 19 bp, Homo sapiens
cttgagcggagcccgatat

SEQ ID NO: 436155 - DNA, 21 bp, Homo sapiens
cttgagcggagcccgatattc

SEQ ID NO: 436156 - DNA, 19 bp, Homo sapiens
cttgagctcccctggagcc

SEQ ID NO: 436157 - DNA, 16 bp, Homo sapiens
cttgagctgagatgga

SEQ ID NO: 436158 - DNA, 21 bp, Homo sapiens
cttgagctgcctgctctgcag

SEQ ID NO: 436159 - DNA, 22 bp, Homo sapiens
cttgaggacctccacctgggag

SEQ ID NO: 436160 - DNA, 17 bp, Homo sapiens
cttgaggtcttttgaca

SEQ ID NO: 436161 - DNA, 22 bp, Homo sapiens
cttgaggtcttttgacatgtgg

SEQ ID NO: 436162 - DNA, 22 bp, Homo sapiens
cttgatgaaggtcatctttttc

SEQ ID NO: 436163 - DNA, 15 bp, Homo sapiens
cttgatggagaagga

SEQ ID NO: 436164 - DNA, 17 bp, Homo sapiens
cttgatggagaaggaaa

SEQ ID NO: 436165 - DNA, 20 bp, Homo sapiens
cttgatgtaaaatcttgtca

SEQ ID NO: 436166 - DNA, 21 bp, Homo sapiens
cttgatgtaaaatcttgtcat

SEQ ID NO: 436167 - DNA, 23 bp, Homo sapiens
cttgatgtgaagataatttgcat

SEQ ID NO: 436168 - DNA, 18 bp, Homo sapiens
cttgatgtgttatctctt

SEQ ID NO: 436169 - DNA, 14 bp, Homo sapiens
cttgatgttgctta

SEQ ID NO: 436170 - DNA, 23 bp, Homo sapiens
cttgatgttgcttagtcacttat

SEQ ID NO: 436171 - DNA, 21 bp, Homo sapiens
cttgattaagattttacaaaa

SEQ ID NO: 436172 - DNA, 22 bp, Homo sapiens
cttgattaagattttacaaaag

SEQ ID NO: 436173 - DNA, 14 bp, Homo sapiens
cttgattacataat

SEQ ID NO: 436174 - DNA, 19 bp, Homo sapiens
cttgattataccactgcac

SEQ ID NO: 436175 - DNA, 23 bp, Homo sapiens
cttgattataccactgcactcca

SEQ ID NO: 436176 - DNA, 22 bp, Homo sapiens
cttgattatgccttttaaaaat

SEQ ID NO: 436177 - DNA, 20 bp, Homo sapiens
cttgattctaaaggggacag

SEQ ID NO: 436178 - DNA, 19 bp, Homo sapiens
cttgattgatttttaaagt

SEQ ID NO: 436179 - DNA, 20 bp, Homo sapiens
cttgattgatttttaaagtt

SEQ ID NO: 436180 - DNA, 22 bp, Homo sapiens
cttgatttatcacacaaagcag

SEQ ID NO: 436181 - DNA, 21 bp, Homo sapiens
cttgattttcaagctttcaaa

SEQ ID NO: 436182 - DNA, 20 bp, Homo sapiens
cttgcaatgaaaagaaaatg

SEQ ID NO: 436183 - DNA, 18 bp, Homo sapiens
cttgcacaggccacttgc

SEQ ID NO: 436184 - DNA, 22 bp, Homo sapiens
cttgcaccccaaagctttcctg

SEQ ID NO: 436185 - DNA, 19 bp, Homo sapiens
cttgcacgcccatgtgtga

SEQ ID NO: 436186 - DNA, 16 bp, Homo sapiens
cttgcactattccaca

SEQ ID NO: 436187 - DNA, 18 bp, Homo sapiens
cttgcactattggacttt

SEQ ID NO: 436188 - DNA, 13 bp, Homo sapiens
cttgcactggggg

SEQ ID NO: 436189 - DNA, 17 bp, Homo sapiens
cttgcactgggggaaca

SEQ ID NO: 436190 - DNA, 15 bp, Homo sapiens
cttgttctgttttgt

SEQ ID NO: 436191 - DNA, 14 bp, Homo sapiens
cttgttcttttctg

SEQ ID NO: 436192 - DNA, 19 bp, Homo sapiens
cttgttcttttctggtagg

SEQ ID NO: 436193 - DNA, 22 bp, Homo sapiens
cttgttgatgggccttcagatt

SEQ ID NO: 436194 - DNA, 15 bp, Homo sapiens
cttgttggtcagagg

SEQ ID NO: 436195 - DNA, 18 bp, Homo sapiens
cttgttgtttttaagtcc

SEQ ID NO: 436196 - DNA, 21 bp, Homo sapiens
cttgttgtttttaagtcctgt

SEQ ID NO: 436197 - DNA, 20 bp, Homo sapiens
cttgtttaaggttcttgctg

SEQ ID NO: 436198 - DNA, 14 bp, Homo sapiens
cttgtttaattcta

SEQ ID NO: 436199 - DNA, 19 bp, Homo sapiens
cttgtttacagcactactc

SEQ ID NO: 436200 - DNA, 13 bp, Homo sapiens
cttgtttatgata

SEQ ID NO: 436201 - DNA, 12 bp, Homo sapiens
cttgtttcctgt

SEQ ID NO: 436202 - DNA, 14 bp, Homo sapiens
cttgtttcctgtgc

SEQ ID NO: 436203 - DNA, 16 bp, Homo sapiens
cttgtttctatactgt

SEQ ID NO: 436204 - DNA, 21 bp, Homo sapiens
cttgtttgcctttaggcagga

SEQ ID NO: 436205 - DNA, 18 bp, Homo sapiens
cttgttttcttgccaatg

SEQ ID NO: 436206 - DNA, 21 bp, Homo sapiens
cttgttttggactttgttaca

SEQ ID NO: 436207 - DNA, 13 bp, Homo sapiens
cttgttttggatg

SEQ ID NO: 436208 - DNA, 13 bp, Homo sapiens
cttgtttttgatg

SEQ ID NO: 436209 - DNA, 20 bp, Homo sapiens
cttgttttttttttccactt

SEQ ID NO: 436210 - DNA, 20 bp, Homo sapiens
ctttaaaaaaaaaagttaca

SEQ ID NO: 436211 - DNA, 17 bp, Homo sapiens
ctttaaactataggtaa

SEQ ID NO: 436212 - DNA, 14 bp, Homo sapiens
ctttaaagacttaa

SEQ ID NO: 436213 - DNA, 17 bp, Homo sapiens
ctttaaagacttaagat

SEQ ID NO: 436214 - DNA, 15 bp, Homo sapiens
ctttaaagacttgat

SEQ ID NO: 436215 - DNA, 17 bp, Homo sapiens
ctttaaagtacctgtag

SEQ ID NO: 436216 - DNA, 23 bp, Homo sapiens
ctttaaagtacctgtagtgagaa

SEQ ID NO: 436217 - DNA, 20 bp, Homo sapiens
ctttaaatactccctttttg

SEQ ID NO: 436218 - DNA, 16 bp, Homo sapiens
ctttaaatatcattct

SEQ ID NO: 436219 - DNA, 18 bp, Homo sapiens
ctttaaatcctaccaaag

SEQ ID NO: 436220 - DNA, 15 bp, Homo sapiens
ctttaaatctgtgat

SEQ ID NO: 436221 - DNA, 21 bp, Homo sapiens
ctttaaattatatgatatgca

SEQ ID NO: 436222 - DNA, 23 bp, Homo sapiens
ctttaaattatatgatatgcatg

SEQ ID NO: 436223 - DNA, 15 bp, Homo sapiens
ctttaaattgttcct

SEQ ID NO: 436224 - DNA, 17 bp, Homo sapiens
ctttaacaaaacaagaa

SEQ ID NO: 436225 - DNA, 20 bp, Homo sapiens
ctttaacaaaacaagaaaga

SEQ ID NO: 436226 - DNA, 22 bp, Homo sapiens
ctttaacaaaacaagaaagaaa

SEQ ID NO: 436227 - DNA, 16 bp, Homo sapiens
ctttaacagctttctc

SEQ ID NO: 436228 - DNA, 13 bp, Homo sapiens
ctttaacttagta

SEQ ID NO: 436229 - DNA, 16 bp, Homo sapiens
ctttaagaatagttct

SEQ ID NO: 436230 - DNA, 23 bp, Homo sapiens
ctttaagacatactccttccatc

SEQ ID NO: 436231 - DNA, 19 bp, Homo sapiens
ctttaagtcttacaggaag

SEQ ID NO: 436232 - DNA, 14 bp, Homo sapiens
ctttaatcaaaagt

SEQ ID NO: 436233 - DNA, 14 bp, Homo sapiens
ctttaatcttcagt

SEQ ID NO: 436234 - DNA, 21 bp, Homo sapiens
ctttaatcttcagttttatct

SEQ ID NO: 436235 - DNA, 12 bp, Homo sapiens
ctttaattgtat

SEQ ID NO: 436236 - DNA, 15 bp, Homo sapiens
ctttaattgttgctt

SEQ ID NO: 436237 - DNA, 13 bp, Homo sapiens
ctttacaaaatga

SEQ ID NO: 436238 - DNA, 22 bp, Homo sapiens
ctttacaaaatgaatgcattgg

SEQ ID NO: 436239 - DNA, 20 bp, Homo sapiens
ctttacaaactgaagataat

SEQ ID NO: 436240 - DNA, 16 bp, Homo sapiens
ctttacataattcaga

SEQ ID NO: 436241 - DNA, 19 bp, Homo sapiens
ctttacatgcaatttatta

SEQ ID NO: 436242 - DNA, 22 bp, Homo sapiens
ctttacattttcagtaccaaag

SEQ ID NO: 436243 - DNA, 14 bp, Homo sapiens
ctttaccttcattt

SEQ ID NO: 436244 - DNA, 16 bp, Homo sapiens
ctttaccttcatttca

SEQ ID NO: 436245 - DNA, 13 bp, Homo sapiens
ctttacgtatttt

SEQ ID NO: 436246 - DNA, 12 bp, Homo sapiens
ctttactccctt

SEQ ID NO: 436247 - DNA, 16 bp, Homo sapiens
ctttactcccttcctg

SEQ ID NO: 436248 - DNA, 17 bp, Homo sapiens
ctttactcccttcctgg

SEQ ID NO: 436249 - DNA, 18 bp, Homo sapiens
ctttactcccttcctggc

SEQ ID NO: 436250 - DNA, 19 bp, Homo sapiens
ctttagaagtgcatttctg

SEQ ID NO: 436251 - DNA, 22 bp, Homo sapiens
ctttagaatagttaaattggct

SEQ ID NO: 436252 - DNA, 14 bp, Homo sapiens
ctttaggcaggaag

SEQ ID NO: 436253 - DNA, 15 bp, Homo sapiens
ctttaggcaggaagt

SEQ ID NO: 436254 - DNA, 19 bp, Homo sapiens
ctttagggatctggggaag

SEQ ID NO: 436255 - DNA, 13 bp, Homo sapiens
ctttagtgtattt

SEQ ID NO: 436256 - DNA, 17 bp, Homo sapiens
ctttataagccaatgaa

SEQ ID NO: 436257 - DNA, 24 bp, Homo sapiens
ctttataagccaatgaagcaaaca

SEQ ID NO: 436258 - DNA, 16 bp, Homo sapiens
ctttataatttctacc

SEQ ID NO: 436259 - DNA, 21 bp, Homo sapiens
ctttataatttctacccatgt

SEQ ID NO: 436260 - DNA, 23 bp, Homo sapiens
ctttatacttaaacagctttttt

SEQ ID NO: 436261 - DNA, 19 bp, Homo sapiens
ctttatcacattatttgca

SEQ ID NO: 436262 - DNA, 14 bp, Homo sapiens
ctttatcagtgatg

SEQ ID NO: 436263 - DNA, 15 bp, Homo sapiens
ctttatcattgctaa

SEQ ID NO: 436264 - DNA, 23 bp, Homo sapiens
ctttatctatgggagattaaaac

SEQ ID NO: 436265 - DNA, 15 bp, Homo sapiens
ctttatctcctgctc

SEQ ID NO: 436266 - DNA, 16 bp, Homo sapiens
ctttatctctgaggct

SEQ ID NO: 436267 - DNA, 14 bp, Homo sapiens
ctttatcttgacat

SEQ ID NO: 436268 - DNA, 17 bp, Homo sapiens
ctttatgaaaaaaatat

SEQ ID NO: 436269 - DNA, 19 bp, Homo sapiens
ctttatgaaaaaaatatat

SEQ ID NO: 436270 - DNA, 21 bp, Homo sapiens
ctttatgaaaaaaatatattt

SEQ ID NO: 436271 - DNA, 22 bp, Homo sapiens
ctttatgaaaaaaatatatttt

SEQ ID NO: 436272 - DNA, 13 bp, Homo sapiens
ctttatgatttca

SEQ ID NO: 436273 - DNA, 15 bp, Homo sapiens
ctttatgctgaaaca

SEQ ID NO: 436274 - DNA, 13 bp, Homo sapiens
ctttatggtttct

SEQ ID NO: 436275 - DNA, 16 bp, Homo sapiens
ctttattaatgaactg

SEQ ID NO: 436276 - DNA, 22 bp, Homo sapiens
ctttattaatgaactgtgacag

SEQ ID NO: 436277 - DNA, 16 bp, Homo sapiens
ctttattaattcatta

SEQ ID NO: 436278 - DNA, 15 bp, Homo sapiens
ctttattctacatat

SEQ ID NO: 436279 - DNA, 14 bp, Homo sapiens
ctttattcttgctg

SEQ ID NO: 436280 - DNA, 19 bp, Homo sapiens
ctttattgattttctttct

SEQ ID NO: 436281 - DNA, 20 bp, Homo sapiens
ctttatttaatttcataaat

SEQ ID NO: 436282 - DNA, 21 bp, Homo sapiens
ctttatttaatttcataaatt

SEQ ID NO: 436283 - DNA, 19 bp, Homo sapiens
ctttatttattaaacttca

SEQ ID NO: 436284 - DNA, 21 bp, Homo sapiens
ctttatttattaaacttcagc

SEQ ID NO: 436285 - DNA, 13 bp, Homo sapiens
ctttatttctgtc

SEQ ID NO: 436286 - DNA, 14 bp, Homo sapiens
ctttatttctgtct

SEQ ID NO: 436287 - DNA, 13 bp, Homo sapiens
ctttattttctgg

SEQ ID NO: 436288 - DNA, 12 bp, Homo sapiens
ctttcaacttaa

SEQ ID NO: 436289 - DNA, 20 bp, Homo sapiens
ctttcaacttaaatcactga

SEQ ID NO: 436290 - DNA, 16 bp, Homo sapiens
ctttcaagacagccta

SEQ ID NO: 436291 - DNA, 14 bp, Homo sapiens
ctttcaagtgcctt

SEQ ID NO: 436292 - DNA, 21 bp, Homo sapiens
ctttcaatatttatttccaga

SEQ ID NO: 436293 - DNA, 14 bp, Homo sapiens
ctttcaatccacag

SEQ ID NO: 436294 - DNA, 19 bp, Homo sapiens
ctttcaatccacagtattg

SEQ ID NO: 436295 - DNA, 15 bp, Homo sapiens
ctttcacagcttctt

SEQ ID NO: 436296 - DNA, 12 bp, Homo sapiens
ctttcaccccca

SEQ ID NO: 436297 - DNA, 14 bp, Homo sapiens
ctttcacccttttc

SEQ ID NO: 436298 - DNA, 13 bp, Homo sapiens
ctttcactgaagt

SEQ ID NO: 436299 - DNA, 12 bp, Homo sapiens
ctttcactttga

SEQ ID NO: 436300 - DNA, 13 bp, Homo sapiens
ctttcagaaaaca

SEQ ID NO: 436301 - DNA, 19 bp, Homo sapiens
ctttcagaactgctaccat

SEQ ID NO: 436302 - DNA, 16 bp, Homo sapiens
ctttcagatgtcttct

SEQ ID NO: 436303 - DNA, 20 bp, Homo sapiens
ctttcagatgtcttctgcct

SEQ ID NO: 436304 - DNA, 22 bp, Homo sapiens
ctttcagatgtcttctgcctgt

SEQ ID NO: 436305 - DNA, 14 bp, Homo sapiens
ctttcagctgtgaa

SEQ ID NO: 436306 - DNA, 21 bp, Homo sapiens
ctttcaggaagggagaggagg

SEQ ID NO: 436307 - DNA, 17 bp, Homo sapiens
ctttcaggaagttgctg

SEQ ID NO: 436308 - DNA, 22 bp, Homo sapiens
ctttcaggaagttgctgagaaa

SEQ ID NO: 436309 - DNA, 15 bp, Homo sapiens
ctttcagggcctcca

SEQ ID NO: 436310 - DNA, 17 bp, Homo sapiens
ctttcagttattaaatg

SEQ ID NO: 436311 - DNA, 13 bp, Homo sapiens
ctttcatagttct

SEQ ID NO: 436312 - DNA, 14 bp, Homo sapiens
ctttcatcctgtgt

SEQ ID NO: 436313 - DNA, 16 bp, Homo sapiens
ctttcatcctgtgtcc

SEQ ID NO: 436314 - DNA, 13 bp, Homo sapiens
ctttcatgaccac

SEQ ID NO: 436315 - DNA, 23 bp, Homo sapiens
ctttcatgaccactgggcctgct

SEQ ID NO: 436316 - DNA, 17 bp, Homo sapiens
ctttcatttgaaagtgg

SEQ ID NO: 436317 - DNA, 20 bp, Homo sapiens
ctttccagaaggccacaggc

SEQ ID NO: 436318 - DNA, 23 bp, Homo sapiens
ctttccagaaggccacaggccac

SEQ ID NO: 436319 - DNA, 22 bp, Homo sapiens
ctttccagcctatatttcctct

SEQ ID NO: 436320 - DNA, 15 bp, Homo sapiens
ctttccaggaaggct

SEQ ID NO: 436321 - DNA, 21 bp, Homo sapiens
gaaactcacctgctggcccct

SEQ ID NO: 436322 - DNA, 22 bp, Homo sapiens
gaaactcacctgctggcccctc

SEQ ID NO: 436323 - DNA, 23 bp, Homo sapiens
gaaactcacctgctggcccctca

SEQ ID NO: 436324 - DNA, 13 bp, Homo sapiens
gaaactctttgga

SEQ ID NO: 436325 - DNA, 23 bp, Homo sapiens
gaaactgaaaactgtaaatacaa

SEQ ID NO: 436326 - DNA, 21 bp, Homo sapiens
gaaactgaaagtgttttactc

SEQ ID NO: 436327 - DNA, 16 bp, Homo sapiens
gaaactgacttgctgt

SEQ ID NO: 436328 - DNA, 16 bp, Homo sapiens
gaaactgaggcccaga

SEQ ID NO: 436329 - DNA, 19 bp, Homo sapiens
gaaactgaggcccagagag

SEQ ID NO: 436330 - DNA, 17 bp, Homo sapiens
gaaactgagtcctgttc

SEQ ID NO: 436331 - DNA, 21 bp, Homo sapiens
gaaactgttgccagagatgga

SEQ ID NO: 436332 - DNA, 15 bp, Homo sapiens
gaaactgttggttga

SEQ ID NO: 436333 - DNA, 15 bp, Homo sapiens
gaaacttacacacaa

SEQ ID NO: 436334 - DNA, 18 bp, Homo sapiens
gaaacttcccaacttccc

SEQ ID NO: 436335 - DNA, 22 bp, Homo sapiens
gaaacttcccaacttccctgtt

SEQ ID NO: 436336 - DNA, 18 bp, Homo sapiens
gaaactttgatctctgct

SEQ ID NO: 436337 - DNA, 11 bp, Homo sapiens
gaaacttttct

SEQ ID NO: 436338 - DNA, 21 bp, Homo sapiens
gaaagaaaagaccctgagact

SEQ ID NO: 436339 - DNA, 19 bp, Homo sapiens
gaaagaaaaggaatgcaag

SEQ ID NO: 436340 - DNA, 21 bp, Homo sapiens
gaaagaaaataccaaggaaca

SEQ ID NO: 436341 - DNA, 23 bp, Homo sapiens
gaaagaaacgtacttaactgtgt

SEQ ID NO: 436342 - DNA, 17 bp, Homo sapiens
gaaagaagaacagctgt

SEQ ID NO: 436343 - DNA, 20 bp, Homo sapiens
gaaagaagcactctgctggc

SEQ ID NO: 436344 - DNA, 21 bp, Homo sapiens
gaaagaattatttttgtgttt

SEQ ID NO: 436345 - DNA, 17 bp, Homo sapiens
gaaagacaaagaaggaa

SEQ ID NO: 436346 - DNA, 19 bp, Homo sapiens
gaaagacaaagaaggaaaa

SEQ ID NO: 436347 - DNA, 20 bp, Homo sapiens
gaaagacaaagaaggaaaag

SEQ ID NO: 436348 - DNA, 12 bp, Homo sapiens
gaaagacaggaa

SEQ ID NO: 436349 - DNA, 14 bp, Homo sapiens
gaaagacaggaaga

SEQ ID NO: 436350 - DNA, 12 bp, Homo sapiens
gaaagacagtaa

SEQ ID NO: 436351 - DNA, 22 bp, Homo sapiens
gaaagacctacattccctctcc

SEQ ID NO: 436352 - DNA, 13 bp, Homo sapiens
gaaagactgaaag

SEQ ID NO: 436353 - DNA, 23 bp, Homo sapiens
gaaagagataccaagatgccatc

SEQ ID NO: 436354 - DNA, 18 bp, Homo sapiens
gaaagagcattattcctg

SEQ ID NO: 436355 - DNA, 20 bp, Homo sapiens
gaaagagctgttttggatga

SEQ ID NO: 436356 - DNA, 11 bp, Homo sapiens
gaaagaggaga

SEQ ID NO: 436357 - DNA, 12 bp, Homo sapiens
gaaagatactaa

SEQ ID NO: 436358 - DNA, 14 bp, Homo sapiens
gaaagatcccaagt

SEQ ID NO: 436359 - DNA, 18 bp, Homo sapiens
gaaagatcccaagtcaaa

SEQ ID NO: 436360 - DNA, 13 bp, Homo sapiens
gaaagatttaatg

SEQ ID NO: 436361 - DNA, 23 bp, Homo sapiens
gaaagatttaatgttacagcatc

SEQ ID NO: 436362 - DNA, 14 bp, Homo sapiens
gaaagcaataaatg

SEQ ID NO: 436363 - DNA, 19 bp, Homo sapiens
gaaagcaccgcagcatgtg

SEQ ID NO: 436364 - DNA, 19 bp, Homo sapiens
gaaagcagaggctggcctc

SEQ ID NO: 436365 - DNA, 14 bp, Homo sapiens
gaaagcagcagcta

SEQ ID NO: 436366 - DNA, 18 bp, Homo sapiens
gaaagcatgtctctgctt

SEQ ID NO: 436367 - DNA, 21 bp, Homo sapiens
gaaagcatgtggcatgttcat

SEQ ID NO: 436368 - DNA, 14 bp, Homo sapiens
gaaagccacctctc

SEQ ID NO: 436369 - DNA, 15 bp, Homo sapiens
gaaagccacctctcc

SEQ ID NO: 436370 - DNA, 19 bp, Homo sapiens
gaaagccacctctccctca

SEQ ID NO: 436371 - DNA, 20 bp, Homo sapiens
gaaagccacctctccctcaa

SEQ ID NO: 436372 - DNA, 20 bp, Homo sapiens
gaaagccagtgactccagga

SEQ ID NO: 436373 - DNA, 14 bp, Homo sapiens
gaaagccatattcc

SEQ ID NO: 436374 - DNA, 15 bp, Homo sapiens
gaaagccatattcca

SEQ ID NO: 436375 - DNA, 15 bp, Homo sapiens
gaaagcccacctggg

SEQ ID NO: 436376 - DNA, 19 bp, Homo sapiens
gaaagcccctcacctcagg

SEQ ID NO: 436377 - DNA, 22 bp, Homo sapiens
gaaagcctcctgccccctgcca

SEQ ID NO: 436378 - DNA, 19 bp, Homo sapiens
gaaagcctgtctctttcca

SEQ ID NO: 436379 - DNA, 21 bp, Homo sapiens
gaaagcctgttcccctcactg

SEQ ID NO: 436380 - DNA, 24 bp, Homo sapiens
gaaagcctgttcccctcactggat

SEQ ID NO: 436381 - DNA, 15 bp, Homo sapiens
gaaagcgggcagccc

SEQ ID NO: 436382 - DNA, 17 bp, Homo sapiens
gaaagcgggcagccccg

SEQ ID NO: 436383 - DNA, 22 bp, Homo sapiens
gaaagctccacggtgcgtggct

SEQ ID NO: 436384 - DNA, 16 bp, Homo sapiens
gaaagctgtgaaattg

SEQ ID NO: 436385 - DNA, 21 bp, Homo sapiens
gaaagctgtgaaattgaagtc

SEQ ID NO: 436386 - DNA, 13 bp, Homo sapiens
gaaaggacccacc

SEQ ID NO: 436387 - DNA, 16 bp, Homo sapiens
gaaaggatatttaaga

SEQ ID NO: 436388 - DNA, 20 bp, Homo sapiens
gaaaggatatttaagaaaat

SEQ ID NO: 436389 - DNA, 21 bp, Homo sapiens
gaaaggatggagtgttttagt

SEQ ID NO: 436390 - DNA, 15 bp, Homo sapiens
gaaaggatggcagcc

SEQ ID NO: 436391 - DNA, 20 bp, Homo sapiens
gaaaggatggcagcctcagg

SEQ ID NO: 436392 - DNA, 21 bp, Homo sapiens
gaaaggatggcagcctcaggg

SEQ ID NO: 436393 - DNA, 19 bp, Homo sapiens
gaaaggattaagatacact

SEQ ID NO: 436394 - DNA, 16 bp, Homo sapiens
gaaaggcagaaacaca

SEQ ID NO: 436395 - DNA, 11 bp, Homo sapiens
gaaaggcatct

SEQ ID NO: 436396 - DNA, 23 bp, Homo sapiens
gaaaggcatctaagacattcacc

SEQ ID NO: 436397 - DNA, 21 bp, Homo sapiens
gaaagggagcccctcctctga

SEQ ID NO: 436398 - DNA, 17 bp, Homo sapiens
gaaagggcagcccctcc

SEQ ID NO: 436399 - DNA, 13 bp, Homo sapiens
gaaagggcagctt

SEQ ID NO: 436400 - DNA, 18 bp, Homo sapiens
gaaagggctatggcaagg

SEQ ID NO: 436401 - DNA, 18 bp, Homo sapiens
gaaaggggaaagaaaggg

SEQ ID NO: 436402 - DNA, 20 bp, Homo sapiens
gaaaggggcaggagctcaga

SEQ ID NO: 436403 - DNA, 20 bp, Homo sapiens
gaaagggtctgataaacaca

SEQ ID NO: 436404 - DNA, 18 bp, Homo sapiens
gaaagggtgtggcttgga

SEQ ID NO: 436405 - DNA, 16 bp, Homo sapiens
gaaaggtaatctgaaa

SEQ ID NO: 436406 - DNA, 12 bp, Homo sapiens
gaaaggtagccc

SEQ ID NO: 436407 - DNA, 13 bp, Homo sapiens
gaaaggtgctcaa

SEQ ID NO: 436408 - DNA, 21 bp, Homo sapiens
gaaagtcttgtgactagtgct

SEQ ID NO: 436409 - DNA, 17 bp, Homo sapiens
gaaagtgaataaaaatt

SEQ ID NO: 436410 - DNA, 17 bp, Homo sapiens
gaaagtgaatttgaatg

SEQ ID NO: 436411 - DNA, 16 bp, Homo sapiens
gaaagtgatttgtaat

SEQ ID NO: 436412 - DNA, 16 bp, Homo sapiens
gaaagtgggtcacctg

SEQ ID NO: 436413 - DNA, 11 bp, Homo sapiens
gaaagtttccc

SEQ ID NO: 436414 - DNA, 14 bp, Homo sapiens
gaaagttttccagt

SEQ ID NO: 436415 - DNA, 13 bp, Homo sapiens
gaaataaactagg

SEQ ID NO: 436416 - DNA, 23 bp, Homo sapiens
gaaataaactagggttttggcct

SEQ ID NO: 436417 - DNA, 15 bp, Homo sapiens
gaaataaatagctat

SEQ ID NO: 436418 - DNA, 15 bp, Homo sapiens
gaaataataaattaa

SEQ ID NO: 436419 - DNA, 23 bp, Homo sapiens
gaaataataaattaacattatat

SEQ ID NO: 436420 - DNA, 20 bp, Homo sapiens
gaaatacgccagaactgctt

SEQ ID NO: 436421 - DNA, 19 bp, Homo sapiens
gaaatagtaccttcaatac

SEQ ID NO: 436422 - DNA, 15 bp, Homo sapiens
gaaatagtctgtgtg

SEQ ID NO: 436423 - DNA, 21 bp, Homo sapiens
gaaatagtgttctttttaaaa

SEQ ID NO: 436424 - DNA, 16 bp, Homo sapiens
gaaatataaaaataat

SEQ ID NO: 436425 - DNA, 16 bp, Homo sapiens
gaaatataaactgtga

SEQ ID NO: 436426 - DNA, 22 bp, Homo sapiens
gaaatataaactgtgagataaa

SEQ ID NO: 436427 - DNA, 20 bp, Homo sapiens
gaaatatcataatgtaatga

SEQ ID NO: 436428 - DNA, 15 bp, Homo sapiens
gaaatattaaaagaa

SEQ ID NO: 436429 - DNA, 13 bp, Homo sapiens
gaaatatttattt

SEQ ID NO: 436430 - DNA, 13 bp, Homo sapiens
gaaatattttgat

SEQ ID NO: 436431 - DNA, 20 bp, Homo sapiens
gaaatattttgataataaat

SEQ ID NO: 436432 - DNA, 23 bp, Homo sapiens
gaaatattttgataataaattga

SEQ ID NO: 436433 - DNA, 15 bp, Homo sapiens
gaaatcacaggggcg

SEQ ID NO: 436434 - DNA, 17 bp, Homo sapiens
gaaatcatactttgcca

SEQ ID NO: 436435 - DNA, 15 bp, Homo sapiens
gaaatcattgtagaa

SEQ ID NO: 436436 - DNA, 12 bp, Homo sapiens
gaaatcattgtg

SEQ ID NO: 436437 - DNA, 20 bp, Homo sapiens
gaaatcgccttatgagaaca

SEQ ID NO: 436438 - DNA, 16 bp, Homo sapiens
gaaatctattttcagt

SEQ ID NO: 436439 - DNA, 12 bp, Homo sapiens
gaaatctcaccc

SEQ ID NO: 436440 - DNA, 19 bp, Homo sapiens
gaaatctcacttttctcca

SEQ ID NO: 436441 - DNA, 13 bp, Homo sapiens
gaaatgaataatt

SEQ ID NO: 436442 - DNA, 19 bp, Homo sapiens
gaaatgaataatttcccaa

SEQ ID NO: 436443 - DNA, 11 bp, Homo sapiens
gaaatgagctg

SEQ ID NO: 436444 - DNA, 14 bp, Homo sapiens
gaaatgataaagat

SEQ ID NO: 436445 - DNA, 21 bp, Homo sapiens
gaaatgcattttattctttaa

SEQ ID NO: 436446 - DNA, 19 bp, Homo sapiens
gaaatgccctcctaaatgt

SEQ ID NO: 436447 - DNA, 20 bp, Homo sapiens
gaaatgctattgttgtgggc

SEQ ID NO: 436448 - DNA, 14 bp, Homo sapiens
gaaatgctgcctgc

SEQ ID NO: 436449 - DNA, 20 bp, Homo sapiens
gaaatgtaccatcaaatgtt

SEQ ID NO: 436450 - DNA, 17 bp, Homo sapiens
gaaatgtggatgctctt

SEQ ID NO: 436451 - DNA, 20 bp, Homo sapiens
gaagatttgatgctggagag

SEQ ID NO: 436452 - DNA, 15 bp, Homo sapiens
gaagcaaacacacag

SEQ ID NO: 436453 - DNA, 16 bp, Homo sapiens
gaagcaaaggcaggag

SEQ ID NO: 436454 - DNA, 20 bp, Homo sapiens
gaagcaattatttaaagaaa

SEQ ID NO: 436455 - DNA, 15 bp, Homo sapiens
gaagcacaagaagtg

SEQ ID NO: 436456 - DNA, 13 bp, Homo sapiens
gaagcacaagttc

SEQ ID NO: 436457 - DNA, 16 bp, Homo sapiens
gaagcaccccatgcca

SEQ ID NO: 436458 - DNA, 21 bp, Homo sapiens
gaagcacctatgaaagcaaca

SEQ ID NO: 436459 - DNA, 19 bp, Homo sapiens
gaagcaggttgcttcaaga

SEQ ID NO: 436460 - DNA, 19 bp, Homo sapiens
gaagcagtgccttccataa

SEQ ID NO: 436461 - DNA, 19 bp, Homo sapiens
gaagcagtgtcgccgtccc

SEQ ID NO: 436462 - DNA, 14 bp, Homo sapiens
gaagcagttgtgtc

SEQ ID NO: 436463 - DNA, 18 bp, Homo sapiens
gaagcatgctttgctgct

SEQ ID NO: 436464 - DNA, 16 bp, Homo sapiens
gaagcatgtttcatgt

SEQ ID NO: 436465 - DNA, 19 bp, Homo sapiens
gaagcatgtttcatgtttt

SEQ ID NO: 436466 - DNA, 17 bp, Homo sapiens
gaagcattaacttctct

SEQ ID NO: 436467 - DNA, 20 bp, Homo sapiens
gaagcattaacttctctgga

SEQ ID NO: 436468 - DNA, 21 bp, Homo sapiens
gaagcattaacttctctggaa

SEQ ID NO: 436469 - DNA, 18 bp, Homo sapiens
gaagccacgtgctggaga

SEQ ID NO: 436470 - DNA, 19 bp, Homo sapiens
gaagccacgtgctggagag

SEQ ID NO: 436471 - DNA, 17 bp, Homo sapiens
gaagccatcaattttaa

SEQ ID NO: 436472 - DNA, 19 bp, Homo sapiens
gaagccatcacttctcccc

SEQ ID NO: 436473 - DNA, 19 bp, Homo sapiens
gaagcccacccgccccaga

SEQ ID NO: 436474 - DNA, 21 bp, Homo sapiens
gaagcccacccgccccagaga

SEQ ID NO: 436475 - DNA, 22 bp, Homo sapiens
gaagcccacccgccccagagac

SEQ ID NO: 436476 - DNA, 17 bp, Homo sapiens
gaagcccagtagccatt

SEQ ID NO: 436477 - DNA, 21 bp, Homo sapiens
gaagccccgctcaggtagcca

SEQ ID NO: 436478 - DNA, 19 bp, Homo sapiens
gaagccctaagtaaatcta

SEQ ID NO: 436479 - DNA, 16 bp, Homo sapiens
gaagccctccttgcca

SEQ ID NO: 436480 - DNA, 20 bp, Homo sapiens
gaagccgcctagtgcagaga

SEQ ID NO: 436481 - DNA, 23 bp, Homo sapiens
gaagccgcctagtgcagagaggt

SEQ ID NO: 436482 - DNA, 20 bp, Homo sapiens
gaagccggcggcccaagccc

SEQ ID NO: 436483 - DNA, 15 bp, Homo sapiens
gaagcctaaataaaa

SEQ ID NO: 436484 - DNA, 20 bp, Homo sapiens
gaagcctccaagcctgcctc

SEQ ID NO: 436485 - DNA, 22 bp, Homo sapiens
gaagcctccaagcctgcctccc

SEQ ID NO: 436486 - DNA, 21 bp, Homo sapiens
gaagcctctgccctgcctccc

SEQ ID NO: 436487 - DNA, 12 bp, Homo sapiens
gaagcctctggc

SEQ ID NO: 436488 - DNA, 10 bp, Homo sapiens
gaagcctgtc

SEQ ID NO: 436489 - DNA, 23 bp, Homo sapiens
gaagccttaagccataggcccag

SEQ ID NO: 436490 - DNA, 18 bp, Homo sapiens
gaagccttaccacgcagt

SEQ ID NO: 436491 - DNA, 14 bp, Homo sapiens
gaagcctttatcta

SEQ ID NO: 436492 - DNA, 14 bp, Homo sapiens
gaagcgaacatctt

SEQ ID NO: 436493 - DNA, 20 bp, Homo sapiens
gaagcgaacatcttcatata

SEQ ID NO: 436494 - DNA, 16 bp, Homo sapiens
gaagcgtcagcgggcg

SEQ ID NO: 436495 - DNA, 16 bp, Homo sapiens
gaagcgtctcccttgg

SEQ ID NO: 436496 - DNA, 12 bp, Homo sapiens
gaagctcagccc

SEQ ID NO: 436497 - DNA, 14 bp, Homo sapiens
gaagctcagcccac

SEQ ID NO: 436498 - DNA, 18 bp, Homo sapiens
gaagctcagcccaccccc

SEQ ID NO: 436499 - DNA, 19 bp, Homo sapiens
gaagctcagcccacccccc

SEQ ID NO: 436500 - DNA, 20 bp, Homo sapiens
gaagctccagtcctgctctc

SEQ ID NO: 436501 - DNA, 13 bp, Homo sapiens
gaagctcctggta

SEQ ID NO: 436502 - DNA, 18 bp, Homo sapiens
gaagctgaaccccctcca

SEQ ID NO: 436503 - DNA, 18 bp, Homo sapiens
gaagctgaggcgggagaa

SEQ ID NO: 436504 - DNA, 23 bp, Homo sapiens
gaagctggccgagggtcctggct

SEQ ID NO: 436505 - DNA, 19 bp, Homo sapiens
gaagctgggactcattcac

SEQ ID NO: 436506 - DNA, 13 bp, Homo sapiens
gaagctggggaca

SEQ ID NO: 436507 - DNA, 19 bp, Homo sapiens
gaagcttgagcctccccca

SEQ ID NO: 436508 - DNA, 20 bp, Homo sapiens
gaagctttctctgcttcagc

SEQ ID NO: 436509 - DNA, 15 bp, Homo sapiens
gaaggaaaaggctgg

SEQ ID NO: 436510 - DNA, 12 bp, Homo sapiens
gaaggaaataac

SEQ ID NO: 436511 - DNA, 13 bp, Homo sapiens
gaaggaagacttt

SEQ ID NO: 436512 - DNA, 17 bp, Homo sapiens
gaaggaatagccagaga

SEQ ID NO: 436513 - DNA, 14 bp, Homo sapiens
gaaggaattacatt

SEQ ID NO: 436514 - DNA, 20 bp, Homo sapiens
gaaggaccaacccatgccct

SEQ ID NO: 436515 - DNA, 15 bp, Homo sapiens
gaaggactgacgaga

SEQ ID NO: 436516 - DNA, 20 bp, Homo sapiens
gaaggactggattggccaaa

SEQ ID NO: 436517 - DNA, 17 bp, Homo sapiens
gaaggagaggagtgcgc

SEQ ID NO: 436518 - DNA, 13 bp, Homo sapiens
gaaggagaggctc

SEQ ID NO: 436519 - DNA, 21 bp, Homo sapiens
gaaggagcctgcggctgctgg

SEQ ID NO: 436520 - DNA, 22 bp, Homo sapiens
gaaggagcctgcggctgctggc

SEQ ID NO: 436521 - DNA, 23 bp, Homo sapiens
gaaggagcctgcggctgctggca

SEQ ID NO: 436522 - DNA, 13 bp, Homo sapiens
gaaggaggaaggg

SEQ ID NO: 436523 - DNA, 18 bp, Homo sapiens
gaaggaggaagggactgg

SEQ ID NO: 436524 - DNA, 19 bp, Homo sapiens
gaaggaggaagggactggt

SEQ ID NO: 436525 - DNA, 19 bp, Homo sapiens
gaaggaggagggcgcccat

SEQ ID NO: 436526 - DNA, 19 bp, Homo sapiens
gaaggagggagctgctcag

SEQ ID NO: 436527 - DNA, 13 bp, Homo sapiens
gaaggagggcaga

SEQ ID NO: 436528 - DNA, 14 bp, Homo sapiens
gaaggagggcagag

SEQ ID NO: 436529 - DNA, 20 bp, Homo sapiens
gaaggagggcagagccatgg

SEQ ID NO: 436530 - DNA, 19 bp, Homo sapiens
gaaggaggggaagctgcag

SEQ ID NO: 436531 - DNA, 14 bp, Homo sapiens
gaaggcaaatctcc

SEQ ID NO: 436532 - DNA, 15 bp, Homo sapiens
gaaggcaagctggca

SEQ ID NO: 436533 - DNA, 14 bp, Homo sapiens
gaaggcacccgccc

SEQ ID NO: 436534 - DNA, 13 bp, Homo sapiens
gaaggcagctgct

SEQ ID NO: 436535 - DNA, 14 bp, Homo sapiens
gaaggcagggcaga

SEQ ID NO: 436536 - DNA, 16 bp, Homo sapiens
gaaggccctgtgccct

SEQ ID NO: 436537 - DNA, 18 bp, Homo sapiens
gaaggcctcttgtgctca

SEQ ID NO: 436538 - DNA, 17 bp, Homo sapiens
gaaggcctgagggaagc

SEQ ID NO: 436539 - DNA, 19 bp, Homo sapiens
gaaggcctgagggaagccc

SEQ ID NO: 436540 - DNA, 14 bp, Homo sapiens
gaaggcctgccccc

SEQ ID NO: 436541 - DNA, 15 bp, Homo sapiens
gaaggcctgcccccc

SEQ ID NO: 436542 - DNA, 21 bp, Homo sapiens
gaaggcctgccccccttccca

SEQ ID NO: 436543 - DNA, 15 bp, Homo sapiens
gaaggcctggtcagc

SEQ ID NO: 436544 - DNA, 16 bp, Homo sapiens
gaaggcctggtcagca

SEQ ID NO: 436545 - DNA, 21 bp, Homo sapiens
gaaggcctggtcagcagagcc

SEQ ID NO: 436546 - DNA, 12 bp, Homo sapiens
gaaggcgaggag

SEQ ID NO: 436547 - DNA, 14 bp, Homo sapiens
gaaggcgaggagag

SEQ ID NO: 436548 - DNA, 16 bp, Homo sapiens
gaaggcgatgtggtga

SEQ ID NO: 436549 - DNA, 22 bp, Homo sapiens
gaaggcgatgtggtgaccccac

SEQ ID NO: 436550 - DNA, 18 bp, Homo sapiens
gaaggctggggctattta

SEQ ID NO: 436551 - DNA, 20 bp, Homo sapiens
gaagggaaagcgggcagccc

SEQ ID NO: 436552 - DNA, 23 bp, Homo sapiens
gaagggaattgctcagagaagga

SEQ ID NO: 436553 - DNA, 21 bp, Homo sapiens
gaagggaccgggagcctgcgt

SEQ ID NO: 436554 - DNA, 21 bp, Homo sapiens
gaagggactaggagcactgta

SEQ ID NO: 436555 - DNA, 13 bp, Homo sapiens
gaagggactggtc

SEQ ID NO: 436556 - DNA, 14 bp, Homo sapiens
gaagggactggtcc

SEQ ID NO: 436557 - DNA, 16 bp, Homo sapiens
gaagggactggtccag

SEQ ID NO: 436558 - DNA, 16 bp, Homo sapiens
gaagggagagccagct

SEQ ID NO: 436559 - DNA, 13 bp, Homo sapiens
gaagggagctgag

SEQ ID NO: 436560 - DNA, 14 bp, Homo sapiens
gaagggagctgagg

SEQ ID NO: 436561 - DNA, 22 bp, Homo sapiens
gaagggcaggaaggagagcctg

SEQ ID NO: 436562 - DNA, 15 bp, Homo sapiens
gaagggccagagcct

SEQ ID NO: 436563 - DNA, 18 bp, Homo sapiens
gaagggccagagcctggt

SEQ ID NO: 436564 - DNA, 16 bp, Homo sapiens
gaagggccagtcctgc

SEQ ID NO: 436565 - DNA, 19 bp, Homo sapiens
gaagggcgctgagggcagg

SEQ ID NO: 436566 - DNA, 22 bp, Homo sapiens
gaaggggcacaccactgccctg

SEQ ID NO: 436567 - DNA, 14 bp, Homo sapiens
gaaggggccccggg

SEQ ID NO: 436568 - DNA, 20 bp, Homo sapiens
gaaggggccccggggctggc

SEQ ID NO: 436569 - DNA, 12 bp, Homo sapiens
gaaggggctgga

SEQ ID NO: 436570 - DNA, 19 bp, Homo sapiens
gaaggggctggactggctg

SEQ ID NO: 436571 - DNA, 20 bp, Homo sapiens
gaaggggctggactggctgt

SEQ ID NO: 436572 - DNA, 16 bp, Homo sapiens
gaagggggatatgaat

SEQ ID NO: 436573 - DNA, 20 bp, Homo sapiens
gaagggggccatgaggcctc

SEQ ID NO: 436574 - DNA, 14 bp, Homo sapiens
gaaggggtgggagc

SEQ ID NO: 436575 - DNA, 14 bp, Homo sapiens
gaagggtccggctt

SEQ ID NO: 436576 - DNA, 15 bp, Homo sapiens
gaagggtgacatccc

SEQ ID NO: 436577 - DNA, 21 bp, Homo sapiens
gaagggtttgtggctgggggc

SEQ ID NO: 436578 - DNA, 18 bp, Homo sapiens
gaaggtaactaagaagtg

SEQ ID NO: 436579 - DNA, 16 bp, Homo sapiens
gaaggtatcacacact

SEQ ID NO: 436580 - DNA, 15 bp, Homo sapiens
gaaggtcggaggctt

SEQ ID NO: 436581 - DNA, 17 bp, Homo sapiens
gacaacctttgtgtaat

SEQ ID NO: 436582 - DNA, 19 bp, Homo sapiens
gacaacgaacatggcatgt

SEQ ID NO: 436583 - DNA, 16 bp, Homo sapiens
gacaactgaagagaca

SEQ ID NO: 436584 - DNA, 19 bp, Homo sapiens
gacaagaagcaaatttttt

SEQ ID NO: 436585 - DNA, 13 bp, Homo sapiens
gacaagaagctgc

SEQ ID NO: 436586 - DNA, 22 bp, Homo sapiens
gacaagccaacttgtaaataca

SEQ ID NO: 436587 - DNA, 17 bp, Homo sapiens
gacaagccccaggcagg

SEQ ID NO: 436588 - DNA, 17 bp, Homo sapiens
gacaaggccccagagac

SEQ ID NO: 436589 - DNA, 16 bp, Homo sapiens
gacaagggattctggg

SEQ ID NO: 436590 - DNA, 20 bp, Homo sapiens
gacaagggattctgggaagc

SEQ ID NO: 436591 - DNA, 14 bp, Homo sapiens
gacaaggtagccct

SEQ ID NO: 436592 - DNA, 23 bp, Homo sapiens
gacaaggtagccctggccagagg

SEQ ID NO: 436593 - DNA, 14 bp, Homo sapiens
gacaaggttgctgt

SEQ ID NO: 436594 - DNA, 19 bp, Homo sapiens
gacaagtacatcacccagt

SEQ ID NO: 436595 - DNA, 13 bp, Homo sapiens
gacaataaaacat

SEQ ID NO: 436596 - DNA, 17 bp, Homo sapiens
gacaatcaactctaata

SEQ ID NO: 436597 - DNA, 19 bp, Homo sapiens
gacaatcatgaaatatgca

SEQ ID NO: 436598 - DNA, 16 bp, Homo sapiens
gacaatgcagatgcca

SEQ ID NO: 436599 - DNA, 16 bp, Homo sapiens
gacaatggcaatagga

SEQ ID NO: 436600 - DNA, 21 bp, Homo sapiens
gacaattcctagataaaaaga

SEQ ID NO: 436601 - DNA, 23 bp, Homo sapiens
gacaattcctagataaaaagatg

SEQ ID NO: 436602 - DNA, 18 bp, Homo sapiens
gacaatttcaaaatgcat

SEQ ID NO: 436603 - DNA, 13 bp, Homo sapiens
gacaatttgcctt

SEQ ID NO: 436604 - DNA, 13 bp, Homo sapiens
gacacaaaaaaag

SEQ ID NO: 436605 - DNA, 14 bp, Homo sapiens
gacacaaaaaaatg

SEQ ID NO: 436606 - DNA, 16 bp, Homo sapiens
gacacaaccactaatt

SEQ ID NO: 436607 - DNA, 13 bp, Homo sapiens
gacacacacacgc

SEQ ID NO: 436608 - DNA, 14 bp, Homo sapiens
gacacacacacgca

SEQ ID NO: 436609 - DNA, 18 bp, Homo sapiens
gacacacacacgcacgca

SEQ ID NO: 436610 - DNA, 19 bp, Homo sapiens
gacacacacacgcacgcac

SEQ ID NO: 436611 - DNA, 21 bp, Homo sapiens
gacacacaggagtcctttctt

SEQ ID NO: 436612 - DNA, 20 bp, Homo sapiens
gacacaccccacaccccagc

SEQ ID NO: 436613 - DNA, 22 bp, Homo sapiens
gacacaccccacaccccagccc

SEQ ID NO: 436614 - DNA, 21 bp, Homo sapiens
gacacacggggcacccagccc

SEQ ID NO: 436615 - DNA, 16 bp, Homo sapiens
gacacactcaccattt

SEQ ID NO: 436616 - DNA, 10 bp, Homo sapiens
gacacactgt

SEQ ID NO: 436617 - DNA, 18 bp, Homo sapiens
gacacagatctggaggac

SEQ ID NO: 436618 - DNA, 22 bp, Homo sapiens
gacacagatggcacctgtggcc

SEQ ID NO: 436619 - DNA, 16 bp, Homo sapiens
gacacaggggacactg

SEQ ID NO: 436620 - DNA, 21 bp, Homo sapiens
gacacaggggacactgaacct

SEQ ID NO: 436621 - DNA, 20 bp, Homo sapiens
gacacagtgtgtgacgcaga

SEQ ID NO: 436622 - DNA, 15 bp, Homo sapiens
gacacagttttgtct

SEQ ID NO: 436623 - DNA, 13 bp, Homo sapiens
gacacataaaagt

SEQ ID NO: 436624 - DNA, 20 bp, Homo sapiens
gacacataaatctgtctgat

SEQ ID NO: 436625 - DNA, 17 bp, Homo sapiens
gacacatcccggcctct

SEQ ID NO: 436626 - DNA, 23 bp, Homo sapiens
gacaccagccctgctgcttccta

SEQ ID NO: 436627 - DNA, 16 bp, Homo sapiens
gacaccatcccctcct

SEQ ID NO: 436628 - DNA, 21 bp, Homo sapiens
gacaccccccgccccccacct

SEQ ID NO: 436629 - DNA, 16 bp, Homo sapiens
gacacctaccatgctg

SEQ ID NO: 436630 - DNA, 18 bp, Homo sapiens
gacacctaccatgctgct

SEQ ID NO: 436631 - DNA, 11 bp, Homo sapiens
gacacctcaga

SEQ ID NO: 436632 - DNA, 10 bp, Homo sapiens
gacacctgcc

SEQ ID NO: 436633 - DNA, 11 bp, Homo sapiens
gacacctgccc

SEQ ID NO: 436634 - DNA, 14 bp, Homo sapiens
gacacctgccctgc

SEQ ID NO: 436635 - DNA, 22 bp, Homo sapiens
gacacctgccctgccctgccac

SEQ ID NO: 436636 - DNA, 23 bp, Homo sapiens
gacacgctccctccccctgcccc

SEQ ID NO: 436637 - DNA, 19 bp, Homo sapiens
gacacggcctctggggaga

SEQ ID NO: 436638 - DNA, 22 bp, Homo sapiens
gacacggcctctggggagaccg

SEQ ID NO: 436639 - DNA, 15 bp, Homo sapiens
gacacgtccacccca

SEQ ID NO: 436640 - DNA, 21 bp, Homo sapiens
gacacgtgtggcgggcagtgg

SEQ ID NO: 436641 - DNA, 14 bp, Homo sapiens
gacactacaaacat

SEQ ID NO: 436642 - DNA, 14 bp, Homo sapiens
gacactacagagga

SEQ ID NO: 436643 - DNA, 12 bp, Homo sapiens
gacactgagccc

SEQ ID NO: 436644 - DNA, 22 bp, Homo sapiens
gacactgagccccacctctcca

SEQ ID NO: 436645 - DNA, 22 bp, Homo sapiens
gacactgatgggtcctgctgct

SEQ ID NO: 436646 - DNA, 16 bp, Homo sapiens
gacactgctgcaccag

SEQ ID NO: 436647 - DNA, 21 bp, Homo sapiens
gacactgctgcaccagagtga

SEQ ID NO: 436648 - DNA, 23 bp, Homo sapiens
gacactggctcatattcctgcag

SEQ ID NO: 436649 - DNA, 18 bp, Homo sapiens
gacactggtctcagagga

SEQ ID NO: 436650 - DNA, 17 bp, Homo sapiens
gacacttcagagagctg

SEQ ID NO: 436651 - DNA, 19 bp, Homo sapiens
gacacttgtggtatagtat

SEQ ID NO: 436652 - DNA, 19 bp, Homo sapiens
gacagaaccaacgggtctg

SEQ ID NO: 436653 - DNA, 13 bp, Homo sapiens
gacagaagcaggc

SEQ ID NO: 436654 - DNA, 20 bp, Homo sapiens
gacagaaggcaaagtttcca

SEQ ID NO: 436655 - DNA, 15 bp, Homo sapiens
gacagacacacacac

SEQ ID NO: 436656 - DNA, 14 bp, Homo sapiens
gacagacaggctct

SEQ ID NO: 436657 - DNA, 15 bp, Homo sapiens
gacagacaggctctt

SEQ ID NO: 436658 - DNA, 21 bp, Homo sapiens
gacagacaggctcttagcagc

SEQ ID NO: 436659 - DNA, 19 bp, Homo sapiens
gacagacggacgggacagc

SEQ ID NO: 436660 - DNA, 23 bp, Homo sapiens
gacagacggacgggacagcggcc

SEQ ID NO: 436661 - DNA, 15 bp, Homo sapiens
gacagacttgagaac

SEQ ID NO: 436662 - DNA, 18 bp, Homo sapiens
gacagagacgcaggaatg

SEQ ID NO: 436663 - DNA, 19 bp, Homo sapiens
gacagagaggacgtgggcg

SEQ ID NO: 436664 - DNA, 14 bp, Homo sapiens
gacagagggagaag

SEQ ID NO: 436665 - DNA, 17 bp, Homo sapiens
gacagagggagaaggga

SEQ ID NO: 436666 - DNA, 19 bp, Homo sapiens
gacagagggagaagggaga

SEQ ID NO: 436667 - DNA, 13 bp, Homo sapiens
gacagagtctggg

SEQ ID NO: 436668 - DNA, 12 bp, Homo sapiens
gacagagtggat

SEQ ID NO: 436669 - DNA, 13 bp, Homo sapiens
gacagagtggatc

SEQ ID NO: 436670 - DNA, 17 bp, Homo sapiens
gacagagtggatctgga

SEQ ID NO: 436671 - DNA, 18 bp, Homo sapiens
gacagatcaatggcgcag

SEQ ID NO: 436672 - DNA, 18 bp, Homo sapiens
gacagatgccccagagct

SEQ ID NO: 436673 - DNA, 19 bp, Homo sapiens
gacagatgccccagagctg

SEQ ID NO: 436674 - DNA, 23 bp, Homo sapiens
gacagatgttccatcctgtacaa

SEQ ID NO: 436675 - DNA, 19 bp, Homo sapiens
gacagcaacggggaggcca

SEQ ID NO: 436676 - DNA, 12 bp, Homo sapiens
gacagcagcctg

SEQ ID NO: 436677 - DNA, 16 bp, Homo sapiens
gacagcagcctgtgag

SEQ ID NO: 436678 - DNA, 20 bp, Homo sapiens
gacagcagtatcacaggcca

SEQ ID NO: 436679 - DNA, 18 bp, Homo sapiens
gacagcatggtgcatgcc

SEQ ID NO: 436680 - DNA, 14 bp, Homo sapiens
gacagccagagctg

SEQ ID NO: 436681 - DNA, 15 bp, Homo sapiens
gacagccagagctgg

SEQ ID NO: 436682 - DNA, 16 bp, Homo sapiens
gacagcctcccacccc

SEQ ID NO: 436683 - DNA, 11 bp, Homo sapiens
gacagcctggc

SEQ ID NO: 436684 - DNA, 16 bp, Homo sapiens
gacagcggcccggccc

SEQ ID NO: 436685 - DNA, 17 bp, Homo sapiens
gacagcggcccggccca

SEQ ID NO: 436686 - DNA, 21 bp, Homo sapiens
gacagcggcccggcccacgca

SEQ ID NO: 436687 - DNA, 14 bp, Homo sapiens
gacagcggggaagg

SEQ ID NO: 436688 - DNA, 21 bp, Homo sapiens
gacagcggggaaggtttttat

SEQ ID NO: 436689 - DNA, 23 bp, Homo sapiens
gacagcgggtaaaaagagaaggc

SEQ ID NO: 436690 - DNA, 20 bp, Homo sapiens
gacagctactaacctggaga

SEQ ID NO: 436691 - DNA, 16 bp, Homo sapiens
gacagctgcaggtgcc

SEQ ID NO: 436692 - DNA, 14 bp, Homo sapiens
gacagctgcttctg

SEQ ID NO: 436693 - DNA, 16 bp, Homo sapiens
gacagctttcctgggt

SEQ ID NO: 436694 - DNA, 17 bp, Homo sapiens
gacaggaagaccaaggc

SEQ ID NO: 436695 - DNA, 14 bp, Homo sapiens
gacaggaagactgg

SEQ ID NO: 436696 - DNA, 21 bp, Homo sapiens
gacaggagacctggcactgga

SEQ ID NO: 436697 - DNA, 17 bp, Homo sapiens
gacaggcagacacatgc

SEQ ID NO: 436698 - DNA, 19 bp, Homo sapiens
gacaggccatgtgagccac

SEQ ID NO: 436699 - DNA, 20 bp, Homo sapiens
gacaggccctccctgtctcc

SEQ ID NO: 436700 - DNA, 13 bp, Homo sapiens
gacaggctcttag

SEQ ID NO: 436701 - DNA, 19 bp, Homo sapiens
gacaggctcttagcagctt

SEQ ID NO: 436702 - DNA, 17 bp, Homo sapiens
gacagggaatagtggga

SEQ ID NO: 436703 - DNA, 14 bp, Homo sapiens
gacagggagctggg

SEQ ID NO: 436704 - DNA, 13 bp, Homo sapiens
gacagggagggaa

SEQ ID NO: 436705 - DNA, 14 bp, Homo sapiens
gacagggccagggt

SEQ ID NO: 436706 - DNA, 16 bp, Homo sapiens
gacagggccagggttg

SEQ ID NO: 436707 - DNA, 14 bp, Homo sapiens
gacagggtcctgct

SEQ ID NO: 436708 - DNA, 23 bp, Homo sapiens
gacagggtggggcttagaatggg

SEQ ID NO: 436709 - DNA, 17 bp, Homo sapiens
gacagggtttcaccatg

SEQ ID NO: 436710 - DNA, 19 bp, Homo sapiens
gacagggttttttcatttt

SEQ ID NO: 436711 - DNA, 18 bp, Homo sapiens
gactgtgactcattccca

SEQ ID NO: 436712 - DNA, 19 bp, Homo sapiens
gactgtgatgccacacaga

SEQ ID NO: 436713 - DNA, 17 bp, Homo sapiens
gactgtgatttatttgg

SEQ ID NO: 436714 - DNA, 19 bp, Homo sapiens
gactgtggcctcaggaggc

SEQ ID NO: 436715 - DNA, 14 bp, Homo sapiens
gactgtttggctta

SEQ ID NO: 436716 - DNA, 22 bp, Homo sapiens
gactgtttggcttataaacaca

SEQ ID NO: 436717 - DNA, 17 bp, Homo sapiens
gactgtttttgttttgt

SEQ ID NO: 436718 - DNA, 20 bp, Homo sapiens
gactgttttttcctgagctt

SEQ ID NO: 436719 - DNA, 19 bp, Homo sapiens
gacttaaaggacaggagga

SEQ ID NO: 436720 - DNA, 14 bp, Homo sapiens
gacttaacggctcc

SEQ ID NO: 436721 - DNA, 16 bp, Homo sapiens
gacttaacggctccag

SEQ ID NO: 436722 - DNA, 15 bp, Homo sapiens
gacttaagacaaatg

SEQ ID NO: 436723 - DNA, 14 bp, Homo sapiens
gacttaagattaaa

SEQ ID NO: 436724 - DNA, 15 bp, Homo sapiens
gacttaatctttgct

SEQ ID NO: 436725 - DNA, 14 bp, Homo sapiens
gacttaccaggaag

SEQ ID NO: 436726 - DNA, 16 bp, Homo sapiens
gacttagatctgagcc

SEQ ID NO: 436727 - DNA, 17 bp, Homo sapiens
gacttagtatattttct

SEQ ID NO: 436728 - DNA, 18 bp, Homo sapiens
gacttatatgcaggctgt

SEQ ID NO: 436729 - DNA, 20 bp, Homo sapiens
gacttattgattaagtatat

SEQ ID NO: 436730 - DNA, 18 bp, Homo sapiens
gacttatttcttcaaatc

SEQ ID NO: 436731 - DNA, 19 bp, Homo sapiens
gacttcagactctctcctc

SEQ ID NO: 436732 - DNA, 17 bp, Homo sapiens
gacttcagctgcctgaa

SEQ ID NO: 436733 - DNA, 18 bp, Homo sapiens
gacttcaggttgttctgt

SEQ ID NO: 436734 - DNA, 13 bp, Homo sapiens
gacttcatgttca

SEQ ID NO: 436735 - DNA, 13 bp, Homo sapiens
gacttcccagctg

SEQ ID NO: 436736 - DNA, 14 bp, Homo sapiens
gacttcccagctgg

SEQ ID NO: 436737 - DNA, 24 bp, Homo sapiens
gacttcccagctggcagcgcctcc

SEQ ID NO: 436738 - DNA, 17 bp, Homo sapiens
gacttccccatcccgaa

SEQ ID NO: 436739 - DNA, 18 bp, Homo sapiens
gacttcctggggccccgc

SEQ ID NO: 436740 - DNA, 22 bp, Homo sapiens
gacttcctggggccccgctggg

SEQ ID NO: 436741 - DNA, 22 bp, Homo sapiens
gacttcctggtgaggcccagcc

SEQ ID NO: 436742 - DNA, 14 bp, Homo sapiens
gacttccttgctct

SEQ ID NO: 436743 - DNA, 17 bp, Homo sapiens
gacttccttgctctccc

SEQ ID NO: 436744 - DNA, 18 bp, Homo sapiens
gacttcgctattcccagg

SEQ ID NO: 436745 - DNA, 19 bp, Homo sapiens
gacttcgctattcccaggc

SEQ ID NO: 436746 - DNA, 23 bp, Homo sapiens
gacttcgctattcccaggcaggg

SEQ ID NO: 436747 - DNA, 21 bp, Homo sapiens
gacttctaaatcataatcatc

SEQ ID NO: 436748 - DNA, 19 bp, Homo sapiens
gacttctaatatcattcac

SEQ ID NO: 436749 - DNA, 22 bp, Homo sapiens
gacttctgcccaaatcccctcc

SEQ ID NO: 436750 - DNA, 18 bp, Homo sapiens
gacttctgctaggtagag

SEQ ID NO: 436751 - DNA, 20 bp, Homo sapiens
gacttctggttgtatttcta

SEQ ID NO: 436752 - DNA, 21 bp, Homo sapiens
gacttcttcggaggtggcagc

SEQ ID NO: 436753 - DNA, 22 bp, Homo sapiens
gacttcttttgagttaggttaa

SEQ ID NO: 436754 - DNA, 13 bp, Homo sapiens
gacttgaaagcat

SEQ ID NO: 436755 - DNA, 14 bp, Homo sapiens
gacttgaaagcatc

SEQ ID NO: 436756 - DNA, 21 bp, Homo sapiens
gacttgaaagcatccatgtgt

SEQ ID NO: 436757 - DNA, 13 bp, Homo sapiens
gacttgaccccga

SEQ ID NO: 436758 - DNA, 16 bp, Homo sapiens
gacttgatgaataaac

SEQ ID NO: 436759 - DNA, 22 bp, Homo sapiens
gacttgccaacaccacagaaat

SEQ ID NO: 436760 - DNA, 19 bp, Homo sapiens
gacttgctgttttgttctg

SEQ ID NO: 436761 - DNA, 15 bp, Homo sapiens
gacttgcttcttgtg

SEQ ID NO: 436762 - DNA, 23 bp, Homo sapiens
gacttggataggagcttccagat

SEQ ID NO: 436763 - DNA, 19 bp, Homo sapiens
gacttggcaacagaagcag

SEQ ID NO: 436764 - DNA, 16 bp, Homo sapiens
gacttggcccaggaaa

SEQ ID NO: 436765 - DNA, 15 bp, Homo sapiens
gacttggcccctgcc

SEQ ID NO: 436766 - DNA, 16 bp, Homo sapiens
gacttggccgcttccc

SEQ ID NO: 436767 - DNA, 21 bp, Homo sapiens
gacttggccgcttccctaccc

SEQ ID NO: 436768 - DNA, 21 bp, Homo sapiens
gacttgtacagttgactggct

SEQ ID NO: 436769 - DNA, 23 bp, Homo sapiens
gacttgtacagttgactggcttt

SEQ ID NO: 436770 - DNA, 15 bp, Homo sapiens
gacttgtgcctcttg

SEQ ID NO: 436771 - DNA, 18 bp, Homo sapiens
gacttgtgtcccatgatc

SEQ ID NO: 436772 - DNA, 15 bp, Homo sapiens
gacttgtttcctgtg

SEQ ID NO: 436773 - DNA, 23 bp, Homo sapiens
gactttaaagtataaagtaaaat

SEQ ID NO: 436774 - DNA, 17 bp, Homo sapiens
gactttagaaataaatg

SEQ ID NO: 436775 - DNA, 12 bp, Homo sapiens
gactttatttaa

SEQ ID NO: 436776 - DNA, 15 bp, Homo sapiens
gactttatttaattt

SEQ ID NO: 436777 - DNA, 17 bp, Homo sapiens
gactttatttaatttca

SEQ ID NO: 436778 - DNA, 17 bp, Homo sapiens
gactttccaccccctcc

SEQ ID NO: 436779 - DNA, 18 bp, Homo sapiens
gactttcggagttggggg

SEQ ID NO: 436780 - DNA, 13 bp, Homo sapiens
gactttctgttgg

SEQ ID NO: 436781 - DNA, 22 bp, Homo sapiens
gactttgcccagggtcctgtgc

SEQ ID NO: 436782 - DNA, 15 bp, Homo sapiens
gacttttccaagccc

SEQ ID NO: 436783 - DNA, 23 bp, Homo sapiens
gacttttgaagaacaaaaggctt

SEQ ID NO: 436784 - DNA, 16 bp, Homo sapiens
gactttttagccagtg

SEQ ID NO: 436785 - DNA, 14 bp, Homo sapiens
gagaaaaaccaatg

SEQ ID NO: 436786 - DNA, 17 bp, Homo sapiens
gagaaaaagagagagca

SEQ ID NO: 436787 - DNA, 21 bp, Homo sapiens
gagaaaacacacgctcctctg

SEQ ID NO: 436788 - DNA, 12 bp, Homo sapiens
gagaaaagccag

SEQ ID NO: 436789 - DNA, 14 bp, Homo sapiens
gagaaaagccagat

SEQ ID NO: 436790 - DNA, 20 bp, Homo sapiens
gagaaacccctggggaccat

SEQ ID NO: 436791 - DNA, 17 bp, Homo sapiens
gagaaactgaaagtgtt

SEQ ID NO: 436792 - DNA, 12 bp, Homo sapiens
gagaaagaatga

SEQ ID NO: 436793 - DNA, 17 bp, Homo sapiens
gagaaagcccacctggg

SEQ ID NO: 436794 - DNA, 15 bp, Homo sapiens
gagaaaggattaaga

SEQ ID NO: 436795 - DNA, 17 bp, Homo sapiens
gagaaaggattaagata

SEQ ID NO: 436796 - DNA, 15 bp, Homo sapiens
gagaaatacagtgct

SEQ ID NO: 436797 - DNA, 18 bp, Homo sapiens
gagaaatacagtgcttta

SEQ ID NO: 436798 - DNA, 14 bp, Homo sapiens
gagaaatgagcttg

SEQ ID NO: 436799 - DNA, 15 bp, Homo sapiens
gagaaatgaggaaga

SEQ ID NO: 436800 - DNA, 17 bp, Homo sapiens
gagaaatgaggaagaat

SEQ ID NO: 436801 - DNA, 20 bp, Homo sapiens
gagaacaagtcacagctgca

SEQ ID NO: 436802 - DNA, 20 bp, Homo sapiens
gagaacatctgccttgctgc

SEQ ID NO: 436803 - DNA, 19 bp, Homo sapiens
gagaacatggtgtgtgtct

SEQ ID NO: 436804 - DNA, 19 bp, Homo sapiens
gagaaccactacatgcagc

SEQ ID NO: 436805 - DNA, 18 bp, Homo sapiens
gagaacctttccactccc

SEQ ID NO: 436806 - DNA, 16 bp, Homo sapiens
gagaacgccagtctcc

SEQ ID NO: 436807 - DNA, 18 bp, Homo sapiens
gagaacgccagtctccca

SEQ ID NO: 436808 - DNA, 19 bp, Homo sapiens
gagaactggttcttgcctt

SEQ ID NO: 436809 - DNA, 23 bp, Homo sapiens
gagaagaaggaagatcttgagag

SEQ ID NO: 436810 - DNA, 16 bp, Homo sapiens
gagaagactagcagct

SEQ ID NO: 436811 - DNA, 14 bp, Homo sapiens
gagaagagggcctg

SEQ ID NO: 436812 - DNA, 19 bp, Homo sapiens
gagaagagggcctgtggga

SEQ ID NO: 436813 - DNA, 18 bp, Homo sapiens
gagaagcatatagaggca

SEQ ID NO: 436814 - DNA, 19 bp, Homo sapiens
gagaagcatatagaggcaa

SEQ ID NO: 436815 - DNA, 21 bp, Homo sapiens
gagaagcctcagtccctccct

SEQ ID NO: 436816 - DNA, 18 bp, Homo sapiens
gagaaggagaggctctga

SEQ ID NO: 436817 - DNA, 15 bp, Homo sapiens
gagaaggagagggag

SEQ ID NO: 436818 - DNA, 20 bp, Homo sapiens
gagaaggcagagaaaacaca

SEQ ID NO: 436819 - DNA, 17 bp, Homo sapiens
gagaaggccctgtgccc

SEQ ID NO: 436820 - DNA, 14 bp, Homo sapiens
gagaaggcctgccc

SEQ ID NO: 436821 - DNA, 12 bp, Homo sapiens
gagaaggcctgg

SEQ ID NO: 436822 - DNA, 18 bp, Homo sapiens
gagaaggcctggtcagca

SEQ ID NO: 436823 - DNA, 15 bp, Homo sapiens
gagaaggcgaggaga

SEQ ID NO: 436824 - DNA, 15 bp, Homo sapiens
gagaagggcttttct

SEQ ID NO: 436825 - DNA, 18 bp, Homo sapiens
gagaagtaattcctctga

SEQ ID NO: 436826 - DNA, 21 bp, Homo sapiens
gagaagtatccaattatgtga

SEQ ID NO: 436827 - DNA, 22 bp, Homo sapiens
gagaagtatccaattatgtgac

SEQ ID NO: 436828 - DNA, 15 bp, Homo sapiens
gagaagtgcccctgc

SEQ ID NO: 436829 - DNA, 22 bp, Homo sapiens
gagaagtgcccctgctgcctcc

SEQ ID NO: 436830 - DNA, 23 bp, Homo sapiens
gagaagtgcccctgctgcctccc

SEQ ID NO: 436831 - DNA, 14 bp, Homo sapiens
gagaagtggcccct

SEQ ID NO: 436832 - DNA, 16 bp, Homo sapiens
gagaataaagacttca

SEQ ID NO: 436833 - DNA, 18 bp, Homo sapiens
gagaataagagaaagaaa

SEQ ID NO: 436834 - DNA, 15 bp, Homo sapiens
gagaataattgtgta

SEQ ID NO: 436835 - DNA, 16 bp, Homo sapiens
gagaataattgtgtac

SEQ ID NO: 436836 - DNA, 14 bp, Homo sapiens
gagaatagcagttt

SEQ ID NO: 436837 - DNA, 14 bp, Homo sapiens
gagaatatatacat

SEQ ID NO: 436838 - DNA, 20 bp, Homo sapiens
gagaatcccactttctatag

SEQ ID NO: 436839 - DNA, 18 bp, Homo sapiens
gagaatcgacctcactgt

SEQ ID NO: 436840 - DNA, 17 bp, Homo sapiens
gagaatctggctcctgt

SEQ ID NO: 436841 - DNA, 23 bp, Homo sapiens
gagcaggaggaggaaaggtagcc

SEQ ID NO: 436842 - DNA, 24 bp, Homo sapiens
gagcaggaggaggaaaggtagccc

SEQ ID NO: 436843 - DNA, 21 bp, Homo sapiens
gagcaggaggcccctggccca

SEQ ID NO: 436844 - DNA, 14 bp, Homo sapiens
gagcaggcaccagc

SEQ ID NO: 436845 - DNA, 20 bp, Homo sapiens
gagcaggctggcagctctcc

SEQ ID NO: 436846 - DNA, 20 bp, Homo sapiens
gagcagggattaacctctgc

SEQ ID NO: 436847 - DNA, 22 bp, Homo sapiens
gagcagggattaacctctgcac

SEQ ID NO: 436848 - DNA, 14 bp, Homo sapiens
gagcaggtctgcag

SEQ ID NO: 436849 - DNA, 16 bp, Homo sapiens
gagcaggtctgcaggc

SEQ ID NO: 436850 - DNA, 18 bp, Homo sapiens
gagcaggtctgcaggcca

SEQ ID NO: 436851 - DNA, 20 bp, Homo sapiens
gagcaggtctgcaggccacc

SEQ ID NO: 436852 - DNA, 15 bp, Homo sapiens
gagcagtctacttct

SEQ ID NO: 436853 - DNA, 19 bp, Homo sapiens
gagcagtctacttctgtgt

SEQ ID NO: 436854 - DNA, 11 bp, Homo sapiens
gagcagtgggg

SEQ ID NO: 436855 - DNA, 17 bp, Homo sapiens
gagcagttttccaggag

SEQ ID NO: 436856 - DNA, 21 bp, Homo sapiens
gagcatccggcatgagggctg

SEQ ID NO: 436857 - DNA, 14 bp, Homo sapiens
gagcatctgctctg

SEQ ID NO: 436858 - DNA, 21 bp, Homo sapiens
gagcatgaaactatgcaccta

SEQ ID NO: 436859 - DNA, 22 bp, Homo sapiens
gagcatgtactgagccttgtaa

SEQ ID NO: 436860 - DNA, 22 bp, Homo sapiens
gagcattctgcctgcctgggaa

SEQ ID NO: 436861 - DNA, 18 bp, Homo sapiens
gagcattctggggtgggg

SEQ ID NO: 436862 - DNA, 15 bp, Homo sapiens
gagcatttttaaggg

SEQ ID NO: 436863 - DNA, 14 bp, Homo sapiens
gagccaaagagaat

SEQ ID NO: 436864 - DNA, 20 bp, Homo sapiens
gagccaacagaagcttccat

SEQ ID NO: 436865 - DNA, 23 bp, Homo sapiens
gagccaacctcggcttgtgggct

SEQ ID NO: 436866 - DNA, 23 bp, Homo sapiens
gagccaactcactcttatgaaat

SEQ ID NO: 436867 - DNA, 13 bp, Homo sapiens
gagccaaggccta

SEQ ID NO: 436868 - DNA, 20 bp, Homo sapiens
gagccaatactgagtgcctg

SEQ ID NO: 436869 - DNA, 21 bp, Homo sapiens
gagccaatactgagtgcctgc

SEQ ID NO: 436870 - DNA, 22 bp, Homo sapiens
gagccaatggagtagacccctg

SEQ ID NO: 436871 - DNA, 14 bp, Homo sapiens
gagccaatggtgag

SEQ ID NO: 436872 - DNA, 19 bp, Homo sapiens
gagccaatggtgagggctg

SEQ ID NO: 436873 - DNA, 20 bp, Homo sapiens
gagccaatggtgagggctga

SEQ ID NO: 436874 - DNA, 14 bp, Homo sapiens
gagccacagtgggg

SEQ ID NO: 436875 - DNA, 22 bp, Homo sapiens
gagccacagtggggcccatggc

SEQ ID NO: 436876 - DNA, 23 bp, Homo sapiens
gagccacagtggggcccatggcc

SEQ ID NO: 436877 - DNA, 24 bp, Homo sapiens
gagccacagtggggcccatggccc

SEQ ID NO: 436878 - DNA, 14 bp, Homo sapiens
gagccaccgctgcc

SEQ ID NO: 436879 - DNA, 16 bp, Homo sapiens
gagccaccgctgccag

SEQ ID NO: 436880 - DNA, 15 bp, Homo sapiens
gagccacctgggctg

SEQ ID NO: 436881 - DNA, 20 bp, Homo sapiens
gagccacctgggctgggaga

SEQ ID NO: 436882 - DNA, 13 bp, Homo sapiens
gagccacctgtcc

SEQ ID NO: 436883 - DNA, 22 bp, Homo sapiens
gagccacggaccgcatcctcca

SEQ ID NO: 436884 - DNA, 23 bp, Homo sapiens
gagccacggaccgcatcctccag

SEQ ID NO: 436885 - DNA, 17 bp, Homo sapiens
gagccactacctttgtc

SEQ ID NO: 436886 - DNA, 23 bp, Homo sapiens
gagccactacctttgtccaggcc

SEQ ID NO: 436887 - DNA, 15 bp, Homo sapiens
gagccactcctgtcc

SEQ ID NO: 436888 - DNA, 16 bp, Homo sapiens
gagccacttctcccca

SEQ ID NO: 436889 - DNA, 16 bp, Homo sapiens
gagccagaattcacta

SEQ ID NO: 436890 - DNA, 19 bp, Homo sapiens
gagccagcagctgaagtct

SEQ ID NO: 436891 - DNA, 11 bp, Homo sapiens
gagccagcagg

SEQ ID NO: 436892 - DNA, 18 bp, Homo sapiens
gagccagcagggctgtga

SEQ ID NO: 436893 - DNA, 13 bp, Homo sapiens
gagccagcctggg

SEQ ID NO: 436894 - DNA, 13 bp, Homo sapiens
gagccaggagcct

SEQ ID NO: 436895 - DNA, 21 bp, Homo sapiens
gagccaggcctgggtctgtgt

SEQ ID NO: 436896 - DNA, 12 bp, Homo sapiens
gagccagggctg

SEQ ID NO: 436897 - DNA, 13 bp, Homo sapiens
gagccagggctgt

SEQ ID NO: 436898 - DNA, 17 bp, Homo sapiens
gagccagggctgtcctt

SEQ ID NO: 436899 - DNA, 11 bp, Homo sapiens
gagccagggta

SEQ ID NO: 436900 - DNA, 23 bp, Homo sapiens
gagccagggtagagcaaaggaga

SEQ ID NO: 436901 - DNA, 23 bp, Homo sapiens
gagccagtggaacagcgggagac

SEQ ID NO: 436902 - DNA, 22 bp, Homo sapiens
gagccatgatgtggagtggggc

SEQ ID NO: 436903 - DNA, 13 bp, Homo sapiens
gagccatgggcct

SEQ ID NO: 436904 - DNA, 15 bp, Homo sapiens
gagccatgggcctgg

SEQ ID NO: 436905 - DNA, 16 bp, Homo sapiens
gagccatgggcctggg

SEQ ID NO: 436906 - DNA, 17 bp, Homo sapiens
gagccatgggcctgggc

SEQ ID NO: 436907 - DNA, 18 bp, Homo sapiens
gagccatgggcctgggcc

SEQ ID NO: 436908 - DNA, 22 bp, Homo sapiens
gagccatgggcctgggcctgct

SEQ ID NO: 436909 - DNA, 17 bp, Homo sapiens
gagccattcccttggaa

SEQ ID NO: 436910 - DNA, 16 bp, Homo sapiens
gagcccacaaagcctt

SEQ ID NO: 436911 - DNA, 18 bp, Homo sapiens
gagcccacggctaagagg

SEQ ID NO: 436912 - DNA, 21 bp, Homo sapiens
gagcccacggctaagaggctg

SEQ ID NO: 436913 - DNA, 17 bp, Homo sapiens
gagcccagccctgttct

SEQ ID NO: 436914 - DNA, 20 bp, Homo sapiens
gagcccagccctgttctggg

SEQ ID NO: 436915 - DNA, 14 bp, Homo sapiens
gagcccagctacat

SEQ ID NO: 436916 - DNA, 18 bp, Homo sapiens
gagcccagctacattcct

SEQ ID NO: 436917 - DNA, 20 bp, Homo sapiens
gagcccagctacattcctca

SEQ ID NO: 436918 - DNA, 21 bp, Homo sapiens
gagcccagctacattcctcag

SEQ ID NO: 436919 - DNA, 13 bp, Homo sapiens
gagcccaggaagt

SEQ ID NO: 436920 - DNA, 15 bp, Homo sapiens
gagcccaggcctggc

SEQ ID NO: 436921 - DNA, 23 bp, Homo sapiens
gagccccagaaccccaactccca

SEQ ID NO: 436922 - DNA, 15 bp, Homo sapiens
gagccccagccagcc

SEQ ID NO: 436923 - DNA, 14 bp, Homo sapiens
gagccccagctgac

SEQ ID NO: 436924 - DNA, 12 bp, Homo sapiens
gagccccagggt

SEQ ID NO: 436925 - DNA, 14 bp, Homo sapiens
gagccccagggtct

SEQ ID NO: 436926 - DNA, 24 bp, Homo sapiens
gagccccagggtcttccctacctc

SEQ ID NO: 436927 - DNA, 14 bp, Homo sapiens
gagcccccaccagc

SEQ ID NO: 436928 - DNA, 18 bp, Homo sapiens
gagcccccacctgcctga

SEQ ID NO: 436929 - DNA, 13 bp, Homo sapiens
gagccccccacaa

SEQ ID NO: 436930 - DNA, 22 bp, Homo sapiens
gagcccccgccccgccccacat

SEQ ID NO: 436931 - DNA, 22 bp, Homo sapiens
gagccccctgcacccacccctg

SEQ ID NO: 436932 - DNA, 14 bp, Homo sapiens
gagccccctgtcct

SEQ ID NO: 436933 - DNA, 16 bp, Homo sapiens
gagccccctgtccttc

SEQ ID NO: 436934 - DNA, 16 bp, Homo sapiens
gagccccctgtgccca

SEQ ID NO: 436935 - DNA, 20 bp, Homo sapiens
gagcccctaccccacaccag

SEQ ID NO: 436936 - DNA, 14 bp, Homo sapiens
gagcccctcctctc

SEQ ID NO: 436937 - DNA, 17 bp, Homo sapiens
gagcccctcctctcctc

SEQ ID NO: 436938 - DNA, 12 bp, Homo sapiens
gagcccctcctg

SEQ ID NO: 436939 - DNA, 19 bp, Homo sapiens
gagcccctgtgtgggaggg

SEQ ID NO: 436940 - DNA, 18 bp, Homo sapiens
gagcccgaatttctcact

SEQ ID NO: 436941 - DNA, 18 bp, Homo sapiens
gagcccgatattctccct

SEQ ID NO: 436942 - DNA, 17 bp, Homo sapiens
gagcccgcacccccacc

SEQ ID NO: 436943 - DNA, 19 bp, Homo sapiens
gagcccgcacccccaccct

SEQ ID NO: 436944 - DNA, 23 bp, Homo sapiens
gagcccgcacccccaccctttgg

SEQ ID NO: 436945 - DNA, 18 bp, Homo sapiens
gagcccgcccacctgggc

SEQ ID NO: 436946 - DNA, 19 bp, Homo sapiens
gagcccgcttttgttcttc

SEQ ID NO: 436947 - DNA, 21 bp, Homo sapiens
gagcccggcagtgcaccccct

SEQ ID NO: 436948 - DNA, 21 bp, Homo sapiens
gagcccggggcagagctcaga

SEQ ID NO: 436949 - DNA, 21 bp, Homo sapiens
gagcccgtgcagtacaggcaa

SEQ ID NO: 436950 - DNA, 16 bp, Homo sapiens
gagccctacttccagg

SEQ ID NO: 436951 - DNA, 15 bp, Homo sapiens
gagccctccctcttc

SEQ ID NO: 436952 - DNA, 22 bp, Homo sapiens
gagccctccctcttcccagcac

SEQ ID NO: 436953 - DNA, 11 bp, Homo sapiens
gagccctcctt

SEQ ID NO: 436954 - DNA, 23 bp, Homo sapiens
gagccctccttcttgccctgagc

SEQ ID NO: 436955 - DNA, 22 bp, Homo sapiens
gagccctctgctgctttccaac

SEQ ID NO: 436956 - DNA, 24 bp, Homo sapiens
gagccctgccctcactccactccc

SEQ ID NO: 436957 - DNA, 13 bp, Homo sapiens
gagccctggctgg

SEQ ID NO: 436958 - DNA, 17 bp, Homo sapiens
gagccctggctgggttc

SEQ ID NO: 436959 - DNA, 14 bp, Homo sapiens
gagcccttagcctt

SEQ ID NO: 436960 - DNA, 20 bp, Homo sapiens
gagcccttagccttgctgta

SEQ ID NO: 436961 - DNA, 12 bp, Homo sapiens
gagcccttcact

SEQ ID NO: 436962 - DNA, 20 bp, Homo sapiens
gagcccttcactgccatgat

SEQ ID NO: 436963 - DNA, 13 bp, Homo sapiens
gagcccttgcaca

SEQ ID NO: 436964 - DNA, 16 bp, Homo sapiens
gagccgagctctcctg

SEQ ID NO: 436965 - DNA, 18 bp, Homo sapiens
gagccgccccgtgtcccc

SEQ ID NO: 436966 - DNA, 22 bp, Homo sapiens
gagccgccccgtgtccccccag

SEQ ID NO: 436967 - DNA, 22 bp, Homo sapiens
gagccggactttcggagttggg

SEQ ID NO: 436968 - DNA, 15 bp, Homo sapiens
gagccgggccccgga

SEQ ID NO: 436969 - DNA, 20 bp, Homo sapiens
gagccgggcctggggctcct

SEQ ID NO: 436970 - DNA, 21 bp, Homo sapiens
gaggcgtgggatccagagaga

SEQ ID NO: 436971 - DNA, 17 bp, Homo sapiens
gaggcgttctcctgctt

SEQ ID NO: 436972 - DNA, 23 bp, Homo sapiens
gaggctaagatgagatttgccag

SEQ ID NO: 436973 - DNA, 21 bp, Homo sapiens
gaggctccccgcctccactct

SEQ ID NO: 436974 - DNA, 22 bp, Homo sapiens
gaggctccccgcctccactcta

SEQ ID NO: 436975 - DNA, 12 bp, Homo sapiens
gaggctcctgga

SEQ ID NO: 436976 - DNA, 11 bp, Homo sapiens
gaggctctgaa

SEQ ID NO: 436977 - DNA, 14 bp, Homo sapiens
gaggctgaggcctg

SEQ ID NO: 436978 - DNA, 19 bp, Homo sapiens
gaggctgaggcctggactt

SEQ ID NO: 436979 - DNA, 18 bp, Homo sapiens
gaggctgcctctgggtga

SEQ ID NO: 436980 - DNA, 13 bp, Homo sapiens
gaggctggcaggt

SEQ ID NO: 436981 - DNA, 15 bp, Homo sapiens
gaggctggcctcaga

SEQ ID NO: 436982 - DNA, 12 bp, Homo sapiens
gaggctgtcctg

SEQ ID NO: 436983 - DNA, 22 bp, Homo sapiens
gaggcttagagagaggaggcag

SEQ ID NO: 436984 - DNA, 14 bp, Homo sapiens
gaggcttccaggct

SEQ ID NO: 436985 - DNA, 15 bp, Homo sapiens
gaggcttccaggctc

SEQ ID NO: 436986 - DNA, 22 bp, Homo sapiens
gaggcttcctactataaaatgt

SEQ ID NO: 436987 - DNA, 14 bp, Homo sapiens
gaggcttctccttc

SEQ ID NO: 436988 - DNA, 18 bp, Homo sapiens
gaggcttgggcccagtag

SEQ ID NO: 436989 - DNA, 21 bp, Homo sapiens
gaggcttgggcccagtagccc

SEQ ID NO: 436990 - DNA, 20 bp, Homo sapiens
gaggcttttcccaccagctc

SEQ ID NO: 436991 - DNA, 23 bp, Homo sapiens
gaggcttttcccaccagctccca

SEQ ID NO: 436992 - DNA, 19 bp, Homo sapiens
gagggaatgttccctgcac

SEQ ID NO: 436993 - DNA, 21 bp, Homo sapiens
gagggaatgttccctgcaccc

SEQ ID NO: 436994 - DNA, 18 bp, Homo sapiens
gagggaattgaggtctgc

SEQ ID NO: 436995 - DNA, 19 bp, Homo sapiens
gagggacatgctcacctct

SEQ ID NO: 436996 - DNA, 17 bp, Homo sapiens
gagggaccaactgggcc

SEQ ID NO: 436997 - DNA, 18 bp, Homo sapiens
gagggaccaactgggccc

SEQ ID NO: 436998 - DNA, 19 bp, Homo sapiens
gagggaccaactgggccca

SEQ ID NO: 436999 - DNA, 16 bp, Homo sapiens
gagggaccagctgggg

SEQ ID NO: 437000 - DNA, 22 bp, Homo sapiens
gagggaccaggtgtctagaggc

SEQ ID NO: 437001 - DNA, 23 bp, Homo sapiens
gagggaccaggtgtctagaggca

SEQ ID NO: 437002 - DNA, 13 bp, Homo sapiens
gagggaccttgga

SEQ ID NO: 437003 - DNA, 14 bp, Homo sapiens
gagggaccttggag

SEQ ID NO: 437004 - DNA, 18 bp, Homo sapiens
gagggactgcctctgcca

SEQ ID NO: 437005 - DNA, 14 bp, Homo sapiens
gagggagaagcatg

SEQ ID NO: 437006 - DNA, 19 bp, Homo sapiens
gagggagaaggagaggctc

SEQ ID NO: 437007 - DNA, 17 bp, Homo sapiens
gagggagccttgtgaga

SEQ ID NO: 437008 - DNA, 12 bp, Homo sapiens
gagggagctgct

SEQ ID NO: 437009 - DNA, 15 bp, Homo sapiens
gagggaggtgtttaa

SEQ ID NO: 437010 - DNA, 18 bp, Homo sapiens
gagggaggtgtttaaaga

SEQ ID NO: 437011 - DNA, 16 bp, Homo sapiens
gagggagtgcagaaca

SEQ ID NO: 437012 - DNA, 16 bp, Homo sapiens
gagggataagcaaaag

SEQ ID NO: 437013 - DNA, 17 bp, Homo sapiens
gagggatagagacgcag

SEQ ID NO: 437014 - DNA, 22 bp, Homo sapiens
gagggatgaggtgctgggaggg

SEQ ID NO: 437015 - DNA, 15 bp, Homo sapiens
gagggatgcaggtgg

SEQ ID NO: 437016 - DNA, 14 bp, Homo sapiens
gagggatgcagtgc

SEQ ID NO: 437017 - DNA, 23 bp, Homo sapiens
gagggatgcagtgcctttcccca

SEQ ID NO: 437018 - DNA, 18 bp, Homo sapiens
gagggattgaacacaggc

SEQ ID NO: 437019 - DNA, 21 bp, Homo sapiens
gagggcactctctgccagctc

SEQ ID NO: 437020 - DNA, 12 bp, Homo sapiens
gagggcactggt

SEQ ID NO: 437021 - DNA, 21 bp, Homo sapiens
gagggcagagccatgggcctg

SEQ ID NO: 437022 - DNA, 18 bp, Homo sapiens
gagggccaagacttggca

SEQ ID NO: 437023 - DNA, 23 bp, Homo sapiens
gagggcccagctgtagccatggc

SEQ ID NO: 437024 - DNA, 11 bp, Homo sapiens
gagggcccctc

SEQ ID NO: 437025 - DNA, 17 bp, Homo sapiens
gagggcccctctgccca

SEQ ID NO: 437026 - DNA, 20 bp, Homo sapiens
gagggcccctgcgtgggggc

SEQ ID NO: 437027 - DNA, 15 bp, Homo sapiens
gagggccctacctga

SEQ ID NO: 437028 - DNA, 16 bp, Homo sapiens
gagggcctggtcacca

SEQ ID NO: 437029 - DNA, 18 bp, Homo sapiens
gagggcgcatgtgtgtat

SEQ ID NO: 437030 - DNA, 13 bp, Homo sapiens
gagggcggccagg

SEQ ID NO: 437031 - DNA, 21 bp, Homo sapiens
gagggcggcccctctgttctg

SEQ ID NO: 437032 - DNA, 19 bp, Homo sapiens
gagggctaattctgggaag

SEQ ID NO: 437033 - DNA, 14 bp, Homo sapiens
gagggctgagaggg

SEQ ID NO: 437034 - DNA, 22 bp, Homo sapiens
gagggctgagagggctgtggct

SEQ ID NO: 437035 - DNA, 15 bp, Homo sapiens
gagggctgagcccct

SEQ ID NO: 437036 - DNA, 18 bp, Homo sapiens
gagggctgagcccctcct

SEQ ID NO: 437037 - DNA, 13 bp, Homo sapiens
gagggctgcctga

SEQ ID NO: 437038 - DNA, 14 bp, Homo sapiens
gagggctgtggctg

SEQ ID NO: 437039 - DNA, 16 bp, Homo sapiens
gagggcttggggctgc

SEQ ID NO: 437040 - DNA, 19 bp, Homo sapiens
gaggggacaaaacccacct

SEQ ID NO: 437041 - DNA, 21 bp, Homo sapiens
gaggggacgctggtagagatg

SEQ ID NO: 437042 - DNA, 19 bp, Homo sapiens
gaggggactgcatgcaagc

SEQ ID NO: 437043 - DNA, 15 bp, Homo sapiens
gaggggagaggaagc

SEQ ID NO: 437044 - DNA, 13 bp, Homo sapiens
gaggggaggcaga

SEQ ID NO: 437045 - DNA, 20 bp, Homo sapiens
gaggggcaacgaagaaaaaa

SEQ ID NO: 437046 - DNA, 17 bp, Homo sapiens
gaggggcatctgcccct

SEQ ID NO: 437047 - DNA, 22 bp, Homo sapiens
gaggggcatctgcccctccccc

SEQ ID NO: 437048 - DNA, 12 bp, Homo sapiens
gaggggccactg

SEQ ID NO: 437049 - DNA, 15 bp, Homo sapiens
gaggggcctagggag

SEQ ID NO: 437050 - DNA, 17 bp, Homo sapiens
gaggggcctagggagcc

SEQ ID NO: 437051 - DNA, 14 bp, Homo sapiens
gaggggcctctgaa

SEQ ID NO: 437052 - DNA, 21 bp, Homo sapiens
gaggggcctctggctgcctgg

SEQ ID NO: 437053 - DNA, 17 bp, Homo sapiens
gaggggcttccctctgc

SEQ ID NO: 437054 - DNA, 21 bp, Homo sapiens
gaggggcttccctctgctcca

SEQ ID NO: 437055 - DNA, 17 bp, Homo sapiens
gaggggcttggagcaga

SEQ ID NO: 437056 - DNA, 14 bp, Homo sapiens
gagggggagggggt

SEQ ID NO: 437057 - DNA, 22 bp, Homo sapiens
gagggggccacctccccaggcc

SEQ ID NO: 437058 - DNA, 19 bp, Homo sapiens
gagggggctatttctctcc

SEQ ID NO: 437059 - DNA, 14 bp, Homo sapiens
gagggggctctcca

SEQ ID NO: 437060 - DNA, 14 bp, Homo sapiens
gagggggctgtcat

SEQ ID NO: 437061 - DNA, 23 bp, Homo sapiens
gagggggtcatttcagagccctc

SEQ ID NO: 437062 - DNA, 19 bp, Homo sapiens
gagggggttacaaactgca

SEQ ID NO: 437063 - DNA, 14 bp, Homo sapiens
gaggggtaaatata

SEQ ID NO: 437064 - DNA, 18 bp, Homo sapiens
gaggggtaaatatatgtt

SEQ ID NO: 437065 - DNA, 20 bp, Homo sapiens
gaggggtaaatatatgtttt

SEQ ID NO: 437066 - DNA, 16 bp, Homo sapiens
gaggggtcagcagggg

SEQ ID NO: 437067 - DNA, 15 bp, Homo sapiens
gaggggtcagctctg

SEQ ID NO: 437068 - DNA, 14 bp, Homo sapiens
gaggggtctgcctc

SEQ ID NO: 437069 - DNA, 14 bp, Homo sapiens
gaggggtgctctgc

SEQ ID NO: 437070 - DNA, 16 bp, Homo sapiens
gagggtaataaactta

SEQ ID NO: 437071 - DNA, 23 bp, Homo sapiens
gagggtcattttcctttctgtat

SEQ ID NO: 437072 - DNA, 13 bp, Homo sapiens
gagggtccctaat

SEQ ID NO: 437073 - DNA, 21 bp, Homo sapiens
gagggtgccatccacatttta

SEQ ID NO: 437074 - DNA, 23 bp, Homo sapiens
gagggtggaggaaggtgctgagc

SEQ ID NO: 437075 - DNA, 22 bp, Homo sapiens
gagggtggcacttcgtggatga

SEQ ID NO: 437076 - DNA, 13 bp, Homo sapiens
gagggtggcaggt

SEQ ID NO: 437077 - DNA, 22 bp, Homo sapiens
gagggtggttcctgttctcagc

SEQ ID NO: 437078 - DNA, 20 bp, Homo sapiens
gagggtgtccgctgctgctt

SEQ ID NO: 437079 - DNA, 17 bp, Homo sapiens
gagggttccaggctgtg

SEQ ID NO: 437080 - DNA, 13 bp, Homo sapiens
gaggtaaaagagc

SEQ ID NO: 437081 - DNA, 17 bp, Homo sapiens
gaggtacccaaggtcac

SEQ ID NO: 437082 - DNA, 20 bp, Homo sapiens
gaggtagaccaggatttcta

SEQ ID NO: 437083 - DNA, 21 bp, Homo sapiens
gaggtagaccaggatttctaa

SEQ ID NO: 437084 - DNA, 17 bp, Homo sapiens
gaggtatcctgtgtgtc

SEQ ID NO: 437085 - DNA, 16 bp, Homo sapiens
gaggtcaagcccagga

SEQ ID NO: 437086 - DNA, 19 bp, Homo sapiens
gaggtcaaggctgcagtga

SEQ ID NO: 437087 - DNA, 16 bp, Homo sapiens
gaggtcaagtaagaag

SEQ ID NO: 437088 - DNA, 23 bp, Homo sapiens
gaggtctgctcggccgtcttcac

SEQ ID NO: 437089 - DNA, 22 bp, Homo sapiens
gaggtcttttgacatgtggaaa

SEQ ID NO: 437090 - DNA, 23 bp, Homo sapiens
gaggtgaactgtttccacattca

SEQ ID NO: 437091 - DNA, 15 bp, Homo sapiens
gaggtgagaccacct

SEQ ID NO: 437092 - DNA, 14 bp, Homo sapiens
gaggtgatagcatt

SEQ ID NO: 437093 - DNA, 12 bp, Homo sapiens
gaggtgggcagc

SEQ ID NO: 437094 - DNA, 17 bp, Homo sapiens
gaggtgggcagctgggc

SEQ ID NO: 437095 - DNA, 18 bp, Homo sapiens
gaggtgggcagctgggcc

SEQ ID NO: 437096 - DNA, 19 bp, Homo sapiens
gaggtgggcagctgggccc

SEQ ID NO: 437097 - DNA, 20 bp, Homo sapiens
gaggtggggaagagagcctg

SEQ ID NO: 437098 - DNA, 15 bp, Homo sapiens
gaggtgggggatgct

SEQ ID NO: 437099 - DNA, 15 bp, Homo sapiens
gaggtggggttggga

SEQ ID NO: 437100 - DNA, 17 bp, Homo sapiens
gatgcaccaagtacagc

SEQ ID NO: 437101 - DNA, 16 bp, Homo sapiens
gatgcacggtttctgt

SEQ ID NO: 437102 - DNA, 19 bp, Homo sapiens
gatgcacggtttctgttct

SEQ ID NO: 437103 - DNA, 21 bp, Homo sapiens
gatgcacggtttctgttctgc

SEQ ID NO: 437104 - DNA, 20 bp, Homo sapiens
gatgcactcgcactgcaaat

SEQ ID NO: 437105 - DNA, 13 bp, Homo sapiens
gatgcactggcct

SEQ ID NO: 437106 - DNA, 15 bp, Homo sapiens
gatgcactggcctgt

SEQ ID NO: 437107 - DNA, 23 bp, Homo sapiens
gatgcagaaatgtggatgctctt

SEQ ID NO: 437108 - DNA, 14 bp, Homo sapiens
gatgcagccgcctt

SEQ ID NO: 437109 - DNA, 20 bp, Homo sapiens
gatgcagccgccttccttga

SEQ ID NO: 437110 - DNA, 22 bp, Homo sapiens
gatgcagccgccttccttgacc

SEQ ID NO: 437111 - DNA, 19 bp, Homo sapiens
gatgccaaaaaagatgcca

SEQ ID NO: 437112 - DNA, 20 bp, Homo sapiens
gatgccaacagacactacat

SEQ ID NO: 437113 - DNA, 22 bp, Homo sapiens
gatgccaaggaggtcccaggaa

SEQ ID NO: 437114 - DNA, 22 bp, Homo sapiens
gatgccacgctttgctgctacc

SEQ ID NO: 437115 - DNA, 12 bp, Homo sapiens
gatgccagctgt

SEQ ID NO: 437116 - DNA, 18 bp, Homo sapiens
gatgccatctgtgggcac

SEQ ID NO: 437117 - DNA, 14 bp, Homo sapiens
gatgccatttgtct

SEQ ID NO: 437118 - DNA, 20 bp, Homo sapiens
gatgccatttgtcttttgta

SEQ ID NO: 437119 - DNA, 14 bp, Homo sapiens
gatgcccacccctg

SEQ ID NO: 437120 - DNA, 17 bp, Homo sapiens
gatgcccactgaggaat

SEQ ID NO: 437121 - DNA, 12 bp, Homo sapiens
gatgccccagag

SEQ ID NO: 437122 - DNA, 17 bp, Homo sapiens
gatgccccttccccaag

SEQ ID NO: 437123 - DNA, 15 bp, Homo sapiens
gatgcctaccgggtt

SEQ ID NO: 437124 - DNA, 17 bp, Homo sapiens
gatgcgcctgatcacca

SEQ ID NO: 437125 - DNA, 14 bp, Homo sapiens
gatgctcactgctt

SEQ ID NO: 437126 - DNA, 23 bp, Homo sapiens
gatgctcattcatattcctgcct

SEQ ID NO: 437127 - DNA, 16 bp, Homo sapiens
gatgctccagccaacc

SEQ ID NO: 437128 - DNA, 17 bp, Homo sapiens
gatgctccagccaaccc

SEQ ID NO: 437129 - DNA, 22 bp, Homo sapiens
gatgctccagccaacccctgtg

SEQ ID NO: 437130 - DNA, 23 bp, Homo sapiens
gatgctccagccaacccctgtgg

SEQ ID NO: 437131 - DNA, 15 bp, Homo sapiens
gatgctccctcccct

SEQ ID NO: 437132 - DNA, 20 bp, Homo sapiens
gatgctccctcccctgccct

SEQ ID NO: 437133 - DNA, 12 bp, Homo sapiens
gatgctgaggag

SEQ ID NO: 437134 - DNA, 22 bp, Homo sapiens
gatgctggcctgcgcctgcacc

SEQ ID NO: 437135 - DNA, 23 bp, Homo sapiens
gatgctggtcaagccccctttga

SEQ ID NO: 437136 - DNA, 13 bp, Homo sapiens
gatgcttaataaa

SEQ ID NO: 437137 - DNA, 20 bp, Homo sapiens
gatgcttgtaacaagaaaac

SEQ ID NO: 437138 - DNA, 22 bp, Homo sapiens
gatggaaaaaccacccccaaat

SEQ ID NO: 437139 - DNA, 14 bp, Homo sapiens
gatggaaggagaga

SEQ ID NO: 437140 - DNA, 21 bp, Homo sapiens
gatggaagttgcagtgagctg

SEQ ID NO: 437141 - DNA, 20 bp, Homo sapiens
gatggacagttcacaccctg

SEQ ID NO: 437142 - DNA, 16 bp, Homo sapiens
gatggacccctccctt

SEQ ID NO: 437143 - DNA, 15 bp, Homo sapiens
gatggaccgggtggg

SEQ ID NO: 437144 - DNA, 23 bp, Homo sapiens
gatggaccgggtgggcctggcct

SEQ ID NO: 437145 - DNA, 12 bp, Homo sapiens
gatggagaagga

SEQ ID NO: 437146 - DNA, 22 bp, Homo sapiens
gatggagactggtcctgtgtgc

SEQ ID NO: 437147 - DNA, 12 bp, Homo sapiens
gatggaggagga

SEQ ID NO: 437148 - DNA, 17 bp, Homo sapiens
gatggaggttctcagag

SEQ ID NO: 437149 - DNA, 19 bp, Homo sapiens
gatggattctcagatattt

SEQ ID NO: 437150 - DNA, 14 bp, Homo sapiens
gatggatttgacac

SEQ ID NO: 437151 - DNA, 18 bp, Homo sapiens
gatggatttgacacactc

SEQ ID NO: 437152 - DNA, 14 bp, Homo sapiens
gatggatttgcctg

SEQ ID NO: 437153 - DNA, 15 bp, Homo sapiens
gatggcacctgtggc

SEQ ID NO: 437154 - DNA, 21 bp, Homo sapiens
gatggcgcacccggcagcccc

SEQ ID NO: 437155 - DNA, 20 bp, Homo sapiens
gatggcgtgtcccctgcctg

SEQ ID NO: 437156 - DNA, 22 bp, Homo sapiens
gatggcgtgtcccctgcctgtg

SEQ ID NO: 437157 - DNA, 20 bp, Homo sapiens
gatggctgtgaaaattacac

SEQ ID NO: 437158 - DNA, 13 bp, Homo sapiens
gatggctgtgcct

SEQ ID NO: 437159 - DNA, 22 bp, Homo sapiens
gatggcttccgtgagacacaag

SEQ ID NO: 437160 - DNA, 18 bp, Homo sapiens
gatggcttgacatgtgca

SEQ ID NO: 437161 - DNA, 15 bp, Homo sapiens
gatgggagtgagaca

SEQ ID NO: 437162 - DNA, 15 bp, Homo sapiens
gatgggagtgggcac

SEQ ID NO: 437163 - DNA, 18 bp, Homo sapiens
gatgggagtgggcacctc

SEQ ID NO: 437164 - DNA, 13 bp, Homo sapiens
gatgggcacaggc

SEQ ID NO: 437165 - DNA, 18 bp, Homo sapiens
gatgggcacaggctgccc

SEQ ID NO: 437166 - DNA, 22 bp, Homo sapiens
gatgggcatggggtgggcctct

SEQ ID NO: 437167 - DNA, 18 bp, Homo sapiens
gatgggccacccaccagg

SEQ ID NO: 437168 - DNA, 21 bp, Homo sapiens
gatgggccacccaccagggct

SEQ ID NO: 437169 - DNA, 14 bp, Homo sapiens
gatggggacaaaga

SEQ ID NO: 437170 - DNA, 21 bp, Homo sapiens
gatggggagatcggggccaga

SEQ ID NO: 437171 - DNA, 18 bp, Homo sapiens
gatggggagcagctgggc

SEQ ID NO: 437172 - DNA, 13 bp, Homo sapiens
gatggggccacag

SEQ ID NO: 437173 - DNA, 15 bp, Homo sapiens
gatggggccacagcc

SEQ ID NO: 437174 - DNA, 13 bp, Homo sapiens
gatggggcctctg

SEQ ID NO: 437175 - DNA, 22 bp, Homo sapiens
gatgggtattaaacttgtcaga

SEQ ID NO: 437176 - DNA, 11 bp, Homo sapiens
gatgggtgggc

SEQ ID NO: 437177 - DNA, 21 bp, Homo sapiens
gatgggttttgttaggggtgg

SEQ ID NO: 437178 - DNA, 22 bp, Homo sapiens
gatgggttttgttaggggtggg

SEQ ID NO: 437179 - DNA, 23 bp, Homo sapiens
gatgggttttgttaggggtgggg

SEQ ID NO: 437180 - DNA, 19 bp, Homo sapiens
gatggtcccaggaagcagg

SEQ ID NO: 437181 - DNA, 15 bp, Homo sapiens
gatggtctcacagag

SEQ ID NO: 437182 - DNA, 17 bp, Homo sapiens
gatggtcttgatctcct

SEQ ID NO: 437183 - DNA, 13 bp, Homo sapiens
gatggtgagctgg

SEQ ID NO: 437184 - DNA, 13 bp, Homo sapiens
gatggttcccctg

SEQ ID NO: 437185 - DNA, 18 bp, Homo sapiens
gatggttcccctgttcac

SEQ ID NO: 437186 - DNA, 21 bp, Homo sapiens
gatggttcccctgttcactct

SEQ ID NO: 437187 - DNA, 15 bp, Homo sapiens
gatgtaaccaagctg

SEQ ID NO: 437188 - DNA, 17 bp, Homo sapiens
gatgtaatgacagagag

SEQ ID NO: 437189 - DNA, 19 bp, Homo sapiens
gatgtacagtctgtcatga

SEQ ID NO: 437190 - DNA, 19 bp, Homo sapiens
gatgtaccatgaaacaaag

SEQ ID NO: 437191 - DNA, 19 bp, Homo sapiens
gatgtaccatgttaaagag

SEQ ID NO: 437192 - DNA, 12 bp, Homo sapiens
gatgtagaactt

SEQ ID NO: 437193 - DNA, 16 bp, Homo sapiens
gatgtagatacagatc

SEQ ID NO: 437194 - DNA, 14 bp, Homo sapiens
gatgtatcatgatt

SEQ ID NO: 437195 - DNA, 17 bp, Homo sapiens
gatgtatgttggttttt

SEQ ID NO: 437196 - DNA, 16 bp, Homo sapiens
gatgtattcagagcca

SEQ ID NO: 437197 - DNA, 13 bp, Homo sapiens
gatgtattggaac

SEQ ID NO: 437198 - DNA, 22 bp, Homo sapiens
gatgtcaaccttgtgtgagtgt

SEQ ID NO: 437199 - DNA, 14 bp, Homo sapiens
gatgtccaacaagg

SEQ ID NO: 437200 - DNA, 12 bp, Homo sapiens
gatgtccagaag

SEQ ID NO: 437201 - DNA, 14 bp, Homo sapiens
gatgtcctgtaaac

SEQ ID NO: 437202 - DNA, 21 bp, Homo sapiens
gatgtctaaaagattctttaa

SEQ ID NO: 437203 - DNA, 14 bp, Homo sapiens
gatgtctccagatt

SEQ ID NO: 437204 - DNA, 16 bp, Homo sapiens
gatgtctcttgtagaa

SEQ ID NO: 437205 - DNA, 15 bp, Homo sapiens
gatgtctgcaaagga

SEQ ID NO: 437206 - DNA, 20 bp, Homo sapiens
gatgtcttcgtacagttctt

SEQ ID NO: 437207 - DNA, 13 bp, Homo sapiens
gatgtcttctgcc

SEQ ID NO: 437208 - DNA, 22 bp, Homo sapiens
gatgtcttgagagcgctggcct

SEQ ID NO: 437209 - DNA, 18 bp, Homo sapiens
gatgtcttgagatgtatt

SEQ ID NO: 437210 - DNA, 15 bp, Homo sapiens
gatgtgaagataatt

SEQ ID NO: 437211 - DNA, 15 bp, Homo sapiens
gatgtgacccaccag

SEQ ID NO: 437212 - DNA, 16 bp, Homo sapiens
gatgtgatggaacaca

SEQ ID NO: 437213 - DNA, 19 bp, Homo sapiens
gatgtgatggaacacacac

SEQ ID NO: 437214 - DNA, 14 bp, Homo sapiens
gatgtgcccagagt

SEQ ID NO: 437215 - DNA, 15 bp, Homo sapiens
gatgtgcccagagta

SEQ ID NO: 437216 - DNA, 14 bp, Homo sapiens
gatgtgcctgtaat

SEQ ID NO: 437217 - DNA, 22 bp, Homo sapiens
gatgtggacttgtatgctgccc

SEQ ID NO: 437218 - DNA, 17 bp, Homo sapiens
gatgtggagtggggcag

SEQ ID NO: 437219 - DNA, 19 bp, Homo sapiens
gatgtggatggaggtgatg

SEQ ID NO: 437220 - DNA, 17 bp, Homo sapiens
gatgtggcaaagtgctg

SEQ ID NO: 437221 - DNA, 22 bp, Homo sapiens
gatgtggtgcctgaggtctgta

SEQ ID NO: 437222 - DNA, 13 bp, Homo sapiens
gatgtgtgcccag

SEQ ID NO: 437223 - DNA, 15 bp, Homo sapiens
gatgtgtggggcatg

SEQ ID NO: 437224 - DNA, 12 bp, Homo sapiens
gatgtgttgtga

SEQ ID NO: 437225 - DNA, 20 bp, Homo sapiens
gatgttaaacgtcacagcag

SEQ ID NO: 437226 - DNA, 16 bp, Homo sapiens
gatgttaggctgggcc

SEQ ID NO: 437227 - DNA, 22 bp, Homo sapiens
gatgttcagcactgtcccttgc

SEQ ID NO: 437228 - DNA, 21 bp, Homo sapiens
gatgttctttcacccttttct

SEQ ID NO: 437229 - DNA, 15 bp, Homo sapiens
gatgtttccagctgc

SEQ ID NO: 437230 - DNA, 22 bp, Homo sapiens
gcaagggtcctacggagggacc

SEQ ID NO: 437231 - DNA, 23 bp, Homo sapiens
gcaagggtgcttgtggtcacact

SEQ ID NO: 437232 - DNA, 23 bp, Homo sapiens
gcaaggtctccttactctgagcc

SEQ ID NO: 437233 - DNA, 16 bp, Homo sapiens
gcaaggtgataggaaa

SEQ ID NO: 437234 - DNA, 18 bp, Homo sapiens
gcaaggtgggggagcctg

SEQ ID NO: 437235 - DNA, 19 bp, Homo sapiens
gcaaggtgggggagcctgg

SEQ ID NO: 437236 - DNA, 21 bp, Homo sapiens
gcaaggtgggggagcctggag

SEQ ID NO: 437237 - DNA, 23 bp, Homo sapiens
gcaaggtgggggagcctggagcc

SEQ ID NO: 437238 - DNA, 18 bp, Homo sapiens
gcaagtagctttccacat

SEQ ID NO: 437239 - DNA, 14 bp, Homo sapiens
gcaagtatgtgagt

SEQ ID NO: 437240 - DNA, 23 bp, Homo sapiens
gcaagtatgttttagcatgtgtt

SEQ ID NO: 437241 - DNA, 21 bp, Homo sapiens
gcaagtgagcaaacctgcccc

SEQ ID NO: 437242 - DNA, 14 bp, Homo sapiens
gcaagtgaggcaag

SEQ ID NO: 437243 - DNA, 13 bp, Homo sapiens
gcaagtgtgtgca

SEQ ID NO: 437244 - DNA, 23 bp, Homo sapiens
gcaagtgtgtgcacatgtgtgcg

SEQ ID NO: 437245 - DNA, 16 bp, Homo sapiens
gcaagtttttggtaat

SEQ ID NO: 437246 - DNA, 15 bp, Homo sapiens
gcaataaatggctcg

SEQ ID NO: 437247 - DNA, 15 bp, Homo sapiens
gcaatagagactgta

SEQ ID NO: 437248 - DNA, 20 bp, Homo sapiens
gcaatatgaggggactgcat

SEQ ID NO: 437249 - DNA, 22 bp, Homo sapiens
gcaatatttatagggcttttat

SEQ ID NO: 437250 - DNA, 19 bp, Homo sapiens
gcaatccgagccagctctg

SEQ ID NO: 437251 - DNA, 21 bp, Homo sapiens
gcaatgggactggagtcagat

SEQ ID NO: 437252 - DNA, 22 bp, Homo sapiens
gcaatgtatcccttctcacagc

SEQ ID NO: 437253 - DNA, 21 bp, Homo sapiens
gcaatgtcacaacctctctga

SEQ ID NO: 437254 - DNA, 21 bp, Homo sapiens
gcaatgtcttaaataaaacta

SEQ ID NO: 437255 - DNA, 22 bp, Homo sapiens
gcaatgtcttaaataaaactat

SEQ ID NO: 437256 - DNA, 14 bp, Homo sapiens
gcaatgttttcctt

SEQ ID NO: 437257 - DNA, 13 bp, Homo sapiens
gcaattaactctg

SEQ ID NO: 437258 - DNA, 13 bp, Homo sapiens
gcaattattttgg

SEQ ID NO: 437259 - DNA, 18 bp, Homo sapiens
gcaattgcacaaatacaa

SEQ ID NO: 437260 - DNA, 14 bp, Homo sapiens
gcaattgccctgta

SEQ ID NO: 437261 - DNA, 16 bp, Homo sapiens
gcaatttatacaatat

SEQ ID NO: 437262 - DNA, 19 bp, Homo sapiens
gcaatttatacaatatcat

SEQ ID NO: 437263 - DNA, 17 bp, Homo sapiens
gcaatttattaaaatga

SEQ ID NO: 437264 - DNA, 20 bp, Homo sapiens
gcaatttgtttaaagaataa

SEQ ID NO: 437265 - DNA, 22 bp, Homo sapiens
gcaattttctaagcaatttctt

SEQ ID NO: 437266 - DNA, 15 bp, Homo sapiens
gcaatttttttatac

SEQ ID NO: 437267 - DNA, 19 bp, Homo sapiens
gcacaaaccctggggactc

SEQ ID NO: 437268 - DNA, 22 bp, Homo sapiens
gcacaaactttagggtaaaaat

SEQ ID NO: 437269 - DNA, 15 bp, Homo sapiens
gcacaactgctgttt

SEQ ID NO: 437270 - DNA, 23 bp, Homo sapiens
gcacaactgctgtttagtgaaca

SEQ ID NO: 437271 - DNA, 12 bp, Homo sapiens
gcacaagccagg

SEQ ID NO: 437272 - DNA, 13 bp, Homo sapiens
gcacaagctcaga

SEQ ID NO: 437273 - DNA, 14 bp, Homo sapiens
gcacaagctcagaa

SEQ ID NO: 437274 - DNA, 22 bp, Homo sapiens
gcacaagctcagaatagatctg

SEQ ID NO: 437275 - DNA, 18 bp, Homo sapiens
gcacacaaacacctccta

SEQ ID NO: 437276 - DNA, 10 bp, Homo sapiens
gcacacacac

SEQ ID NO: 437277 - DNA, 12 bp, Homo sapiens
gcacacacacaa

SEQ ID NO: 437278 - DNA, 12 bp, Homo sapiens
gcacacacacac

SEQ ID NO: 437279 - DNA, 16 bp, Homo sapiens
gcacacacacacacag

SEQ ID NO: 437280 - DNA, 17 bp, Homo sapiens
gcacacacacacacagg

SEQ ID NO: 437281 - DNA, 15 bp, Homo sapiens
gcacacacagctcct

SEQ ID NO: 437282 - DNA, 21 bp, Homo sapiens
gcacacagcttttagtaccca

SEQ ID NO: 437283 - DNA, 18 bp, Homo sapiens
gcacaccaaattgctgag

SEQ ID NO: 437284 - DNA, 21 bp, Homo sapiens
gcacaccaaattgctgagatg

SEQ ID NO: 437285 - DNA, 14 bp, Homo sapiens
gcacaccactgccc

SEQ ID NO: 437286 - DNA, 21 bp, Homo sapiens
gcacaccactgccctgcctgc

SEQ ID NO: 437287 - DNA, 17 bp, Homo sapiens
gcacaccctcactctgc

SEQ ID NO: 437288 - DNA, 20 bp, Homo sapiens
gcacaccctcactctgccag

SEQ ID NO: 437289 - DNA, 21 bp, Homo sapiens
gcacaccctcactctgccagg

SEQ ID NO: 437290 - DNA, 22 bp, Homo sapiens
gcacactacagagcagctcccc

SEQ ID NO: 437291 - DNA, 17 bp, Homo sapiens
gcacactgctaaattta

SEQ ID NO: 437292 - DNA, 18 bp, Homo sapiens
gcacagacgtccctccac

SEQ ID NO: 437293 - DNA, 18 bp, Homo sapiens
gcacagactgttccctcc

SEQ ID NO: 437294 - DNA, 18 bp, Homo sapiens
gcacagacttcacacagc

SEQ ID NO: 437295 - DNA, 22 bp, Homo sapiens
gcacagacttctggaaggctgg

SEQ ID NO: 437296 - DNA, 15 bp, Homo sapiens
gcacagagagggggc

SEQ ID NO: 437297 - DNA, 18 bp, Homo sapiens
gcacagagcgtccttccc

SEQ ID NO: 437298 - DNA, 19 bp, Homo sapiens
gcacagagcgtccttcccc

SEQ ID NO: 437299 - DNA, 18 bp, Homo sapiens
gcacagagtcgatgctca

SEQ ID NO: 437300 - DNA, 18 bp, Homo sapiens
gcacagatggatttgcct

SEQ ID NO: 437301 - DNA, 19 bp, Homo sapiens
gcacagatggatttgcctg

SEQ ID NO: 437302 - DNA, 22 bp, Homo sapiens
gcacagatggatttgcctgtgc

SEQ ID NO: 437303 - DNA, 20 bp, Homo sapiens
gcacagattaaacttcacct

SEQ ID NO: 437304 - DNA, 17 bp, Homo sapiens
gcacagcagcctgcttc

SEQ ID NO: 437305 - DNA, 11 bp, Homo sapiens
gcacagccaga

SEQ ID NO: 437306 - DNA, 18 bp, Homo sapiens
gcacagcccaaccaggag

SEQ ID NO: 437307 - DNA, 23 bp, Homo sapiens
gcacagcccaaccaggaggggtc

SEQ ID NO: 437308 - DNA, 12 bp, Homo sapiens
gcacagccctgg

SEQ ID NO: 437309 - DNA, 13 bp, Homo sapiens
gcacagccctggg

SEQ ID NO: 437310 - DNA, 20 bp, Homo sapiens
gcacagcctcacccctgcag

SEQ ID NO: 437311 - DNA, 12 bp, Homo sapiens
gcacagctgtgg

SEQ ID NO: 437312 - DNA, 17 bp, Homo sapiens
gcacaggccacttgctc

SEQ ID NO: 437313 - DNA, 12 bp, Homo sapiens
gcacagggtctg

SEQ ID NO: 437314 - DNA, 15 bp, Homo sapiens
gcacagtccctcctg

SEQ ID NO: 437315 - DNA, 13 bp, Homo sapiens
gcacagtgcatct

SEQ ID NO: 437316 - DNA, 22 bp, Homo sapiens
gcacagtttgctatttgcttta

SEQ ID NO: 437317 - DNA, 16 bp, Homo sapiens
gcacatatacatctag

SEQ ID NO: 437318 - DNA, 13 bp, Homo sapiens
gcacatatatttt

SEQ ID NO: 437319 - DNA, 13 bp, Homo sapiens
gcacatctgcatt

SEQ ID NO: 437320 - DNA, 22 bp, Homo sapiens
gcacatgccgcgggcggccagg

SEQ ID NO: 437321 - DNA, 13 bp, Homo sapiens
gcacatgctggcc

SEQ ID NO: 437322 - DNA, 18 bp, Homo sapiens
gcacatgctggccagcct

SEQ ID NO: 437323 - DNA, 23 bp, Homo sapiens
gcacatgctggccagcctggggc

SEQ ID NO: 437324 - DNA, 15 bp, Homo sapiens
gcacatgtgttcaga

SEQ ID NO: 437325 - DNA, 16 bp, Homo sapiens
gcacattcctggcccc

SEQ ID NO: 437326 - DNA, 17 bp, Homo sapiens
gcacattcctggccccg

SEQ ID NO: 437327 - DNA, 19 bp, Homo sapiens
gcaccaaagatgcagccgc

SEQ ID NO: 437328 - DNA, 23 bp, Homo sapiens
gcaccaaagatgcagccgccttc

SEQ ID NO: 437329 - DNA, 18 bp, Homo sapiens
gcaccaagtacagccttc

SEQ ID NO: 437330 - DNA, 18 bp, Homo sapiens
gcaccactgtgtatttaa

SEQ ID NO: 437331 - DNA, 18 bp, Homo sapiens
gcaccagcccttccctgc

SEQ ID NO: 437332 - DNA, 20 bp, Homo sapiens
gcaccagcccttccctgctt

SEQ ID NO: 437333 - DNA, 12 bp, Homo sapiens
gcaccagcctga

SEQ ID NO: 437334 - DNA, 18 bp, Homo sapiens
gcaccagcctgagccaca

SEQ ID NO: 437335 - DNA, 19 bp, Homo sapiens
gcaccagcctgagccacag

SEQ ID NO: 437336 - DNA, 15 bp, Homo sapiens
gcaccagctctgtgg

SEQ ID NO: 437337 - DNA, 16 bp, Homo sapiens
gcaccagctctgtggc

SEQ ID NO: 437338 - DNA, 22 bp, Homo sapiens
gcaccagctctgtggcctgtgt

SEQ ID NO: 437339 - DNA, 23 bp, Homo sapiens
gcaccagctctgtggcctgtgtc

SEQ ID NO: 437340 - DNA, 11 bp, Homo sapiens
gcaccagctgc

SEQ ID NO: 437341 - DNA, 20 bp, Homo sapiens
gcaccagctgctctgcccct

SEQ ID NO: 437342 - DNA, 21 bp, Homo sapiens
gcaccagctgctctgcccctt

SEQ ID NO: 437343 - DNA, 13 bp, Homo sapiens
gcaccagggaaga

SEQ ID NO: 437344 - DNA, 14 bp, Homo sapiens
gcaccatctctcct

SEQ ID NO: 437345 - DNA, 23 bp, Homo sapiens
gcaccattcaggaacctggacca

SEQ ID NO: 437346 - DNA, 12 bp, Homo sapiens
gcacccacccct

SEQ ID NO: 437347 - DNA, 14 bp, Homo sapiens
gcacccactcacca

SEQ ID NO: 437348 - DNA, 14 bp, Homo sapiens
gcacccactctgct

SEQ ID NO: 437349 - DNA, 16 bp, Homo sapiens
gcacccagctccaggg

SEQ ID NO: 437350 - DNA, 20 bp, Homo sapiens
gcaccccaaagctttcctgc

SEQ ID NO: 437351 - DNA, 15 bp, Homo sapiens
gcaccccactgggag

SEQ ID NO: 437352 - DNA, 14 bp, Homo sapiens
gcaccccagcattc

SEQ ID NO: 437353 - DNA, 14 bp, Homo sapiens
gcaccccagctacc

SEQ ID NO: 437354 - DNA, 19 bp, Homo sapiens
gcaccccagctaccccttc

SEQ ID NO: 437355 - DNA, 12 bp, Homo sapiens
gcacccccaccc

SEQ ID NO: 437356 - DNA, 18 bp, Homo sapiens
gcacccccacccacctcc

SEQ ID NO: 437357 - DNA, 21 bp, Homo sapiens
gcacccccacccacctccacc

SEQ ID NO: 437358 - DNA, 13 bp, Homo sapiens
gcacccccaccct

SEQ ID NO: 437359 - DNA, 17 bp, Homo sapiens
gcacccccagcctcccc

SEQ ID NO: 437360 - DNA, 19 bp, Homo sapiens
gcaggctctgggctcaggg

SEQ ID NO: 437361 - DNA, 20 bp, Homo sapiens
gcaggctctgggctcagggc

SEQ ID NO: 437362 - DNA, 21 bp, Homo sapiens
gcaggctctgggctcagggct

SEQ ID NO: 437363 - DNA, 20 bp, Homo sapiens
gcaggctggaggtaaggcct

SEQ ID NO: 437364 - DNA, 19 bp, Homo sapiens
gcaggctggcaccgccttc

SEQ ID NO: 437365 - DNA, 18 bp, Homo sapiens
gcaggctggcagctctcc

SEQ ID NO: 437366 - DNA, 16 bp, Homo sapiens
gcagggaagagggcag

SEQ ID NO: 437367 - DNA, 17 bp, Homo sapiens
gcagggaagagggcagt

SEQ ID NO: 437368 - DNA, 21 bp, Homo sapiens
gcagggaaggggaggcagccg

SEQ ID NO: 437369 - DNA, 22 bp, Homo sapiens
gcagggaattttcattggatgc

SEQ ID NO: 437370 - DNA, 14 bp, Homo sapiens
gcagggacaccccc

SEQ ID NO: 437371 - DNA, 19 bp, Homo sapiens
gcagggacacgggcagcct

SEQ ID NO: 437372 - DNA, 13 bp, Homo sapiens
gcagggagaccag

SEQ ID NO: 437373 - DNA, 16 bp, Homo sapiens
gcagggagaccctggg

SEQ ID NO: 437374 - DNA, 18 bp, Homo sapiens
gcagggagcaactctcca

SEQ ID NO: 437375 - DNA, 22 bp, Homo sapiens
gcagggagggaaacccggggaa

SEQ ID NO: 437376 - DNA, 20 bp, Homo sapiens
gcagggaggggaggcagatg

SEQ ID NO: 437377 - DNA, 22 bp, Homo sapiens
gcagggagtgtctgcagtcctg

SEQ ID NO: 437378 - DNA, 22 bp, Homo sapiens
gcagggattaacctctgcacta

SEQ ID NO: 437379 - DNA, 14 bp, Homo sapiens
gcagggcagaggga

SEQ ID NO: 437380 - DNA, 14 bp, Homo sapiens
gcagggcagcctgt

SEQ ID NO: 437381 - DNA, 15 bp, Homo sapiens
gcagggcagcctgtg

SEQ ID NO: 437382 - DNA, 19 bp, Homo sapiens
gcagggcagcctgtgggag

SEQ ID NO: 437383 - DNA, 23 bp, Homo sapiens
gcagggcagcctgtgggagaagg

SEQ ID NO: 437384 - DNA, 14 bp, Homo sapiens
gcagggcatctcct

SEQ ID NO: 437385 - DNA, 19 bp, Homo sapiens
gcagggcatctcctgtgca

SEQ ID NO: 437386 - DNA, 14 bp, Homo sapiens
gcagggcccatctg

SEQ ID NO: 437387 - DNA, 16 bp, Homo sapiens
gcagggccctcagagg

SEQ ID NO: 437388 - DNA, 17 bp, Homo sapiens
gcagggccctggggtct

SEQ ID NO: 437389 - DNA, 22 bp, Homo sapiens
gcagggccctggggtctctgag

SEQ ID NO: 437390 - DNA, 17 bp, Homo sapiens
gcagggccgcagggcgc

SEQ ID NO: 437391 - DNA, 22 bp, Homo sapiens
gcagggccgcccgggcccagag

SEQ ID NO: 437392 - DNA, 23 bp, Homo sapiens
gcagggccgctcgatgcctttgc

SEQ ID NO: 437393 - DNA, 15 bp, Homo sapiens
gcagggcctggcctg

SEQ ID NO: 437394 - DNA, 14 bp, Homo sapiens
gcagggcgctccgg

SEQ ID NO: 437395 - DNA, 20 bp, Homo sapiens
gcagggcgctccggcagagg

SEQ ID NO: 437396 - DNA, 16 bp, Homo sapiens
gcagggcgggccagga

SEQ ID NO: 437397 - DNA, 18 bp, Homo sapiens
gcagggcgggccaggaga

SEQ ID NO: 437398 - DNA, 22 bp, Homo sapiens
gcaggggagggtagagcggaga

SEQ ID NO: 437399 - DNA, 12 bp, Homo sapiens
gcaggggagtct

SEQ ID NO: 437400 - DNA, 15 bp, Homo sapiens
gcaggggagtctgct

SEQ ID NO: 437401 - DNA, 20 bp, Homo sapiens
gcaggggcagaaggaggaag

SEQ ID NO: 437402 - DNA, 12 bp, Homo sapiens
gcaggggcccct

SEQ ID NO: 437403 - DNA, 13 bp, Homo sapiens
gcaggggcccctc

SEQ ID NO: 437404 - DNA, 18 bp, Homo sapiens
gcaggggcccctcctctg

SEQ ID NO: 437405 - DNA, 19 bp, Homo sapiens
gcaggggcccctcctctgt

SEQ ID NO: 437406 - DNA, 16 bp, Homo sapiens
gcaggggctgggcaga

SEQ ID NO: 437407 - DNA, 13 bp, Homo sapiens
gcaggggggttgg

SEQ ID NO: 437408 - DNA, 23 bp, Homo sapiens
gcaggggggttgggttccagaca

SEQ ID NO: 437409 - DNA, 14 bp, Homo sapiens
gcaggggtgggagg

SEQ ID NO: 437410 - DNA, 18 bp, Homo sapiens
gcaggggtgggaggctcc

SEQ ID NO: 437411 - DNA, 13 bp, Homo sapiens
gcagggtcttgct

SEQ ID NO: 437412 - DNA, 13 bp, Homo sapiens
gcagggttctaga

SEQ ID NO: 437413 - DNA, 24 bp, Homo sapiens
gcaggtacttcctcctgatggcca

SEQ ID NO: 437414 - DNA, 22 bp, Homo sapiens
gcaggtagatcgcttgagccca

SEQ ID NO: 437415 - DNA, 21 bp, Homo sapiens
gcaggtcactgaaacttcaag

SEQ ID NO: 437416 - DNA, 15 bp, Homo sapiens
gcaggtgaggaaaca

SEQ ID NO: 437417 - DNA, 15 bp, Homo sapiens
gcaggtgctgccttg

SEQ ID NO: 437418 - DNA, 22 bp, Homo sapiens
gcaggtggccacagcaggactg

SEQ ID NO: 437419 - DNA, 20 bp, Homo sapiens
gcaggtgtggtggctcatgg

SEQ ID NO: 437420 - DNA, 21 bp, Homo sapiens
gcaggtgtggtggctcatggc

SEQ ID NO: 437421 - DNA, 20 bp, Homo sapiens
gcaggtgttgggacctgctg

SEQ ID NO: 437422 - DNA, 14 bp, Homo sapiens
gcaggttaccttgg

SEQ ID NO: 437423 - DNA, 19 bp, Homo sapiens
gcaggttctctcctgtgag

SEQ ID NO: 437424 - DNA, 16 bp, Homo sapiens
gcaggttgatcagtga

SEQ ID NO: 437425 - DNA, 19 bp, Homo sapiens
gcaggttgatcagtgagct

SEQ ID NO: 437426 - DNA, 19 bp, Homo sapiens
gcaggttggaccccagaga

SEQ ID NO: 437427 - DNA, 18 bp, Homo sapiens
gcagtacctgggaaagga

SEQ ID NO: 437428 - DNA, 14 bp, Homo sapiens
gcagtacttgctca

SEQ ID NO: 437429 - DNA, 15 bp, Homo sapiens
gcagtacttgctcaa

SEQ ID NO: 437430 - DNA, 21 bp, Homo sapiens
gcagtacttgctcaataaagg

SEQ ID NO: 437431 - DNA, 19 bp, Homo sapiens
gcagtagaaataatatgca

SEQ ID NO: 437432 - DNA, 20 bp, Homo sapiens
gcagtagaaataatatgcat

SEQ ID NO: 437433 - DNA, 23 bp, Homo sapiens
gcagtagaaggtgccgtgagcag

SEQ ID NO: 437434 - DNA, 15 bp, Homo sapiens
gcagtagatgtgctt

SEQ ID NO: 437435 - DNA, 18 bp, Homo sapiens
gcagtagatgtgcttctg

SEQ ID NO: 437436 - DNA, 18 bp, Homo sapiens
gcagtatgaatgatgttt

SEQ ID NO: 437437 - DNA, 17 bp, Homo sapiens
gcagtatgatggcagga

SEQ ID NO: 437438 - DNA, 20 bp, Homo sapiens
gcagtatgatggcaggagaa

SEQ ID NO: 437439 - DNA, 17 bp, Homo sapiens
gcagtcacactgctggg

SEQ ID NO: 437440 - DNA, 17 bp, Homo sapiens
gcagtcacccctgtctg

SEQ ID NO: 437441 - DNA, 14 bp, Homo sapiens
gcagtcatctactt

SEQ ID NO: 437442 - DNA, 22 bp, Homo sapiens
gcagtccagagcttcagggctg

SEQ ID NO: 437443 - DNA, 22 bp, Homo sapiens
gcagtccccagcccttctgcct

SEQ ID NO: 437444 - DNA, 23 bp, Homo sapiens
gcagtccccagcccttctgcctt

SEQ ID NO: 437445 - DNA, 17 bp, Homo sapiens
gcagtcctgcctcagcc

SEQ ID NO: 437446 - DNA, 16 bp, Homo sapiens
gcagtctacccacctc

SEQ ID NO: 437447 - DNA, 15 bp, Homo sapiens
gcagtctctcttacc

SEQ ID NO: 437448 - DNA, 14 bp, Homo sapiens
gcagtctgaaccct

SEQ ID NO: 437449 - DNA, 19 bp, Homo sapiens
gcagtctgaacccttgtgc

SEQ ID NO: 437450 - DNA, 14 bp, Homo sapiens
gcagtctggagggg

SEQ ID NO: 437451 - DNA, 15 bp, Homo sapiens
gcagtctggaggggc

SEQ ID NO: 437452 - DNA, 14 bp, Homo sapiens
gcagtcttgctctg

SEQ ID NO: 437453 - DNA, 16 bp, Homo sapiens
gcagtgaaaaatatgt

SEQ ID NO: 437454 - DNA, 18 bp, Homo sapiens
gcagtgacgtgagtgggg

SEQ ID NO: 437455 - DNA, 15 bp, Homo sapiens
gcagtgactggcagg

SEQ ID NO: 437456 - DNA, 16 bp, Homo sapiens
gcagtgactggcaggt

SEQ ID NO: 437457 - DNA, 18 bp, Homo sapiens
gcagtgactggcaggtgc

SEQ ID NO: 437458 - DNA, 14 bp, Homo sapiens
gcagtgagcggaga

SEQ ID NO: 437459 - DNA, 21 bp, Homo sapiens
gcagtgatggcgcgggaggca

SEQ ID NO: 437460 - DNA, 15 bp, Homo sapiens
gcagtgattctctct

SEQ ID NO: 437461 - DNA, 20 bp, Homo sapiens
gcagtgattgaagtatctgt

SEQ ID NO: 437462 - DNA, 16 bp, Homo sapiens
gcagtgcatgctgtcc

SEQ ID NO: 437463 - DNA, 16 bp, Homo sapiens
gcagtgcccagtgatg

SEQ ID NO: 437464 - DNA, 21 bp, Homo sapiens
gcagtgcccagtgatggcatt

SEQ ID NO: 437465 - DNA, 15 bp, Homo sapiens
gcagtgccttccata

SEQ ID NO: 437466 - DNA, 22 bp, Homo sapiens
gcagtgccttccataattatga

SEQ ID NO: 437467 - DNA, 15 bp, Homo sapiens
gcagtgcctttcccc

SEQ ID NO: 437468 - DNA, 17 bp, Homo sapiens
gcagtgcctttccccat

SEQ ID NO: 437469 - DNA, 12 bp, Homo sapiens
gcagtgctgggc

SEQ ID NO: 437470 - DNA, 17 bp, Homo sapiens
gcagtgctgggcccagc

SEQ ID NO: 437471 - DNA, 14 bp, Homo sapiens
gcagtggagaggga

SEQ ID NO: 437472 - DNA, 24 bp, Homo sapiens
gcagtggagaggggacttggatag

SEQ ID NO: 437473 - DNA, 14 bp, Homo sapiens
gcagtggcagcaac

SEQ ID NO: 437474 - DNA, 14 bp, Homo sapiens
gcagtggccaggca

SEQ ID NO: 437475 - DNA, 15 bp, Homo sapiens
gcagtggccaggcag

SEQ ID NO: 437476 - DNA, 18 bp, Homo sapiens
gcagtggccaggcaggga

SEQ ID NO: 437477 - DNA, 14 bp, Homo sapiens
gcagtggctggtcc

SEQ ID NO: 437478 - DNA, 15 bp, Homo sapiens
gcagtggctggtcca

SEQ ID NO: 437479 - DNA, 18 bp, Homo sapiens
gcagtggctggtccaggg

SEQ ID NO: 437480 - DNA, 21 bp, Homo sapiens
gcagtgggacagggcatggcc

SEQ ID NO: 437481 - DNA, 12 bp, Homo sapiens
gcagtggggagc

SEQ ID NO: 437482 - DNA, 15 bp, Homo sapiens
gcagtggggctgggg

SEQ ID NO: 437483 - DNA, 18 bp, Homo sapiens
gcagtgtagcccacactt

SEQ ID NO: 437484 - DNA, 22 bp, Homo sapiens
gcagtgtcctgtgctttctgca

SEQ ID NO: 437485 - DNA, 17 bp, Homo sapiens
gcagtgtcgccgtccct

SEQ ID NO: 437486 - DNA, 18 bp, Homo sapiens
gcagtgtcgccgtccctc

SEQ ID NO: 437487 - DNA, 19 bp, Homo sapiens
gcagtgtcgccgtccctct

SEQ ID NO: 437488 - DNA, 21 bp, Homo sapiens
gcagtgtcgccgtccctctgc

SEQ ID NO: 437489 - DNA, 20 bp, Homo sapiens
gcagtgtcttccataatgta

SEQ ID NO: 437490 - DNA, 15 bp, Homo sapiens
gccactccctgccaa

SEQ ID NO: 437491 - DNA, 13 bp, Homo sapiens
gccactcctgtcc

SEQ ID NO: 437492 - DNA, 18 bp, Homo sapiens
gccactcctgtcccgcct

SEQ ID NO: 437493 - DNA, 18 bp, Homo sapiens
gccactcgcagtcgcagg

SEQ ID NO: 437494 - DNA, 13 bp, Homo sapiens
gccactctgttcc

SEQ ID NO: 437495 - DNA, 22 bp, Homo sapiens
gccactgaatattatcatttct

SEQ ID NO: 437496 - DNA, 19 bp, Homo sapiens
gccactgcactccagcctg

SEQ ID NO: 437497 - DNA, 16 bp, Homo sapiens
gccactgccaggcacc

SEQ ID NO: 437498 - DNA, 17 bp, Homo sapiens
gccactgccaggcacct

SEQ ID NO: 437499 - DNA, 16 bp, Homo sapiens
gccactgcccgagctg

SEQ ID NO: 437500 - DNA, 17 bp, Homo sapiens
gccactgcccgagctgg

SEQ ID NO: 437501 - DNA, 19 bp, Homo sapiens
gccactgcccgagctggtg

SEQ ID NO: 437502 - DNA, 21 bp, Homo sapiens
gccactgccctctccacaccc

SEQ ID NO: 437503 - DNA, 13 bp, Homo sapiens
gccactgcctctt

SEQ ID NO: 437504 - DNA, 17 bp, Homo sapiens
gccactggcatctctgg

SEQ ID NO: 437505 - DNA, 21 bp, Homo sapiens
gccactggcatctctggagtg

SEQ ID NO: 437506 - DNA, 19 bp, Homo sapiens
gccactgggccccattctc

SEQ ID NO: 437507 - DNA, 23 bp, Homo sapiens
gccactgggccccattctccctc

SEQ ID NO: 437508 - DNA, 20 bp, Homo sapiens
gccactgggtctcactcctg

SEQ ID NO: 437509 - DNA, 13 bp, Homo sapiens
gccactgtggcca

SEQ ID NO: 437510 - DNA, 16 bp, Homo sapiens
gccacttatttccatg

SEQ ID NO: 437511 - DNA, 21 bp, Homo sapiens
gccacttgatgacccccaacc

SEQ ID NO: 437512 - DNA, 16 bp, Homo sapiens
gccacttgcactgtgc

SEQ ID NO: 437513 - DNA, 18 bp, Homo sapiens
gccacttgcactgtgctt

SEQ ID NO: 437514 - DNA, 14 bp, Homo sapiens
gccacttgctcaga

SEQ ID NO: 437515 - DNA, 15 bp, Homo sapiens
gccacttgctcagac

SEQ ID NO: 437516 - DNA, 18 bp, Homo sapiens
gccactttgcagacctgg

SEQ ID NO: 437517 - DNA, 20 bp, Homo sapiens
gccactttgcagacctggga

SEQ ID NO: 437518 - DNA, 23 bp, Homo sapiens
gccactttgcagacctgggactt

SEQ ID NO: 437519 - DNA, 20 bp, Homo sapiens
gccagaaccccgagccctac

SEQ ID NO: 437520 - DNA, 19 bp, Homo sapiens
gccagaaggagggcagagc

SEQ ID NO: 437521 - DNA, 20 bp, Homo sapiens
gccagaaggagggcagagcc

SEQ ID NO: 437522 - DNA, 23 bp, Homo sapiens
gccagaaggagggcagagccatg

SEQ ID NO: 437523 - DNA, 15 bp, Homo sapiens
gccagaccagagctc

SEQ ID NO: 437524 - DNA, 23 bp, Homo sapiens
gccagacggcacccacccagcac

SEQ ID NO: 437525 - DNA, 21 bp, Homo sapiens
gccagactggctgcacagccc

SEQ ID NO: 437526 - DNA, 17 bp, Homo sapiens
gccagagaggagcacct

SEQ ID NO: 437527 - DNA, 14 bp, Homo sapiens
gccagagagggccc

SEQ ID NO: 437528 - DNA, 17 bp, Homo sapiens
gccagagagggcccagc

SEQ ID NO: 437529 - DNA, 11 bp, Homo sapiens
gccagagcacc

SEQ ID NO: 437530 - DNA, 15 bp, Homo sapiens
gccagagcacctcag

SEQ ID NO: 437531 - DNA, 17 bp, Homo sapiens
gccagagcacctcagga

SEQ ID NO: 437532 - DNA, 20 bp, Homo sapiens
gccagagcccttcactgcca

SEQ ID NO: 437533 - DNA, 13 bp, Homo sapiens
gccagagctccca

SEQ ID NO: 437534 - DNA, 15 bp, Homo sapiens
gccagagctcccagg

SEQ ID NO: 437535 - DNA, 20 bp, Homo sapiens
gccagagctcccaggacgca

SEQ ID NO: 437536 - DNA, 14 bp, Homo sapiens
gccagagctggaag

SEQ ID NO: 437537 - DNA, 18 bp, Homo sapiens
gccagagctggaaggcag

SEQ ID NO: 437538 - DNA, 21 bp, Homo sapiens
gccagagctggaaggcagggc

SEQ ID NO: 437539 - DNA, 22 bp, Homo sapiens
gccagagctggaaggcagggca

SEQ ID NO: 437540 - DNA, 20 bp, Homo sapiens
gccagaggcagaaccctggt

SEQ ID NO: 437541 - DNA, 23 bp, Homo sapiens
gccagaggcagaaccctggtgag

SEQ ID NO: 437542 - DNA, 22 bp, Homo sapiens
gccagagtggcctggccaggag

SEQ ID NO: 437543 - DNA, 23 bp, Homo sapiens
gccagagtggcctggccaggagc

SEQ ID NO: 437544 - DNA, 13 bp, Homo sapiens
gccagatctgtta

SEQ ID NO: 437545 - DNA, 16 bp, Homo sapiens
gccagatgacagggag

SEQ ID NO: 437546 - DNA, 17 bp, Homo sapiens
gccagatgacagggagc

SEQ ID NO: 437547 - DNA, 18 bp, Homo sapiens
gccagatggggcctctgt

SEQ ID NO: 437548 - DNA, 17 bp, Homo sapiens
gccagcaaaccaggact

SEQ ID NO: 437549 - DNA, 18 bp, Homo sapiens
gccagcaaaccaggactc

SEQ ID NO: 437550 - DNA, 16 bp, Homo sapiens
gccagcaaggcaggtt

SEQ ID NO: 437551 - DNA, 21 bp, Homo sapiens
gccagcaatgatgtccagaag

SEQ ID NO: 437552 - DNA, 24 bp, Homo sapiens
gccagcacaggggccccagatctg

SEQ ID NO: 437553 - DNA, 12 bp, Homo sapiens
gccagcagcaga

SEQ ID NO: 437554 - DNA, 15 bp, Homo sapiens
gccagcagctgaagt

SEQ ID NO: 437555 - DNA, 21 bp, Homo sapiens
gccagcagctgaagtctcttt

SEQ ID NO: 437556 - DNA, 13 bp, Homo sapiens
gccagcagggcgg

SEQ ID NO: 437557 - DNA, 20 bp, Homo sapiens
gccagcagggcgggccagga

SEQ ID NO: 437558 - DNA, 12 bp, Homo sapiens
gccagcagggct

SEQ ID NO: 437559 - DNA, 23 bp, Homo sapiens
gccagcaggttctctcctgtgag

SEQ ID NO: 437560 - DNA, 21 bp, Homo sapiens
gccagcattttcacattttgc

SEQ ID NO: 437561 - DNA, 22 bp, Homo sapiens
gccagccaccctaactgagctg

SEQ ID NO: 437562 - DNA, 19 bp, Homo sapiens
gccagccagtcttgcctag

SEQ ID NO: 437563 - DNA, 14 bp, Homo sapiens
gccagccagtggcc

SEQ ID NO: 437564 - DNA, 10 bp, Homo sapiens
gccagcccaa

SEQ ID NO: 437565 - DNA, 11 bp, Homo sapiens
gccagcccaaa

SEQ ID NO: 437566 - DNA, 20 bp, Homo sapiens
gccagcccaaagctggagcc

SEQ ID NO: 437567 - DNA, 13 bp, Homo sapiens
gccagcccaggat

SEQ ID NO: 437568 - DNA, 18 bp, Homo sapiens
gccagccccacccaggag

SEQ ID NO: 437569 - DNA, 19 bp, Homo sapiens
gccagccccacccaggagg

SEQ ID NO: 437570 - DNA, 21 bp, Homo sapiens
gccagcccctcccaccacagc

SEQ ID NO: 437571 - DNA, 15 bp, Homo sapiens
gccagccctaggcta

SEQ ID NO: 437572 - DNA, 16 bp, Homo sapiens
gccagccctaggctac

SEQ ID NO: 437573 - DNA, 10 bp, Homo sapiens
gccagccctt

SEQ ID NO: 437574 - DNA, 14 bp, Homo sapiens
gccagcccttccca

SEQ ID NO: 437575 - DNA, 21 bp, Homo sapiens
gccagcccttcccaggccagc

SEQ ID NO: 437576 - DNA, 21 bp, Homo sapiens
gccagcccttccctggccccg

SEQ ID NO: 437577 - DNA, 12 bp, Homo sapiens
gccagcctcagt

SEQ ID NO: 437578 - DNA, 19 bp, Homo sapiens
gccagcctcagtgccactt

SEQ ID NO: 437579 - DNA, 23 bp, Homo sapiens
gccagcctcagtgccacttgaca

SEQ ID NO: 437580 - DNA, 12 bp, Homo sapiens
gccagcctggga

SEQ ID NO: 437581 - DNA, 15 bp, Homo sapiens
gccagcctggggcct

SEQ ID NO: 437582 - DNA, 19 bp, Homo sapiens
gccagcctggggcctggca

SEQ ID NO: 437583 - DNA, 15 bp, Homo sapiens
gccagccttggagga

SEQ ID NO: 437584 - DNA, 23 bp, Homo sapiens
gccagcgaggcgaggctgcctct

SEQ ID NO: 437585 - DNA, 19 bp, Homo sapiens
gccagcgtgaaggacctgg

SEQ ID NO: 437586 - DNA, 14 bp, Homo sapiens
gccagcgtggcgca

SEQ ID NO: 437587 - DNA, 14 bp, Homo sapiens
gccagctccacagg

SEQ ID NO: 437588 - DNA, 15 bp, Homo sapiens
gccagctccacaggg

SEQ ID NO: 437589 - DNA, 19 bp, Homo sapiens
gccagctgcagctgggctg

SEQ ID NO: 437590 - DNA, 18 bp, Homo sapiens
gccagctgcccacaagcc

SEQ ID NO: 437591 - DNA, 14 bp, Homo sapiens
gccagctgcccctc

SEQ ID NO: 437592 - DNA, 14 bp, Homo sapiens
gccagctgccttcc

SEQ ID NO: 437593 - DNA, 22 bp, Homo sapiens
gccagctgccttcctcatcccc

SEQ ID NO: 437594 - DNA, 17 bp, Homo sapiens
gccagctgtactgagtt

SEQ ID NO: 437595 - DNA, 20 bp, Homo sapiens
gccagctgtggttttctttt

SEQ ID NO: 437596 - DNA, 20 bp, Homo sapiens
gccagcttcgtgctggagga

SEQ ID NO: 437597 - DNA, 21 bp, Homo sapiens
gccagcttcgtgctggaggaa

SEQ ID NO: 437598 - DNA, 18 bp, Homo sapiens
gccagcttgttatttata

SEQ ID NO: 437599 - DNA, 15 bp, Homo sapiens
gccaggacagctgca

SEQ ID NO: 437600 - DNA, 12 bp, Homo sapiens
gccaggactctc

SEQ ID NO: 437601 - DNA, 14 bp, Homo sapiens
gccaggactgtgac

SEQ ID NO: 437602 - DNA, 17 bp, Homo sapiens
gccaggagaccctgtct

SEQ ID NO: 437603 - DNA, 22 bp, Homo sapiens
gccaggagcaatgggactggag

SEQ ID NO: 437604 - DNA, 23 bp, Homo sapiens
gccaggagcaatgggactggagt

SEQ ID NO: 437605 - DNA, 17 bp, Homo sapiens
gccaggagcagcctcca

SEQ ID NO: 437606 - DNA, 20 bp, Homo sapiens
gccaggagctcttcaggcct

SEQ ID NO: 437607 - DNA, 17 bp, Homo sapiens
gccaggaggcggcagct

SEQ ID NO: 437608 - DNA, 20 bp, Homo sapiens
gccaggaggcggcagctctt

SEQ ID NO: 437609 - DNA, 22 bp, Homo sapiens
gccaggaggctggcagtacaga

SEQ ID NO: 437610 - DNA, 18 bp, Homo sapiens
gccaggaggggctgtcca

SEQ ID NO: 437611 - DNA, 20 bp, Homo sapiens
gccaggaggttggtgactga

SEQ ID NO: 437612 - DNA, 15 bp, Homo sapiens
gccaggagtctgtgc

SEQ ID NO: 437613 - DNA, 17 bp, Homo sapiens
gccaggagtctgtgctc

SEQ ID NO: 437614 - DNA, 19 bp, Homo sapiens
gccaggcaacttcagtcct

SEQ ID NO: 437615 - DNA, 18 bp, Homo sapiens
gccaggcacctggcctgc

SEQ ID NO: 437616 - DNA, 19 bp, Homo sapiens
gccaggcacctggcctgct

SEQ ID NO: 437617 - DNA, 17 bp, Homo sapiens
gccaggcacggaggctc

SEQ ID NO: 437618 - DNA, 23 bp, Homo sapiens
gccaggcagatctgtgccccatg

SEQ ID NO: 437619 - DNA, 22 bp, Homo sapiens
gcccatcacagggttgggccca

SEQ ID NO: 437620 - DNA, 17 bp, Homo sapiens
gcccatcactcggctgt

SEQ ID NO: 437621 - DNA, 23 bp, Homo sapiens
gcccatcatacgcatggtcctgg

SEQ ID NO: 437622 - DNA, 20 bp, Homo sapiens
gcccatcatctctgcctttg

SEQ ID NO: 437623 - DNA, 17 bp, Homo sapiens
gcccatctcaggtgcca

SEQ ID NO: 437624 - DNA, 20 bp, Homo sapiens
gcccatctcaggtgccactc

SEQ ID NO: 437625 - DNA, 17 bp, Homo sapiens
gcccatctgccgcctgg

SEQ ID NO: 437626 - DNA, 19 bp, Homo sapiens
gcccatgcccacctgccca

SEQ ID NO: 437627 - DNA, 19 bp, Homo sapiens
gcccatggccccagctggc

SEQ ID NO: 437628 - DNA, 17 bp, Homo sapiens
gcccatgggcagaagat

SEQ ID NO: 437629 - DNA, 14 bp, Homo sapiens
gcccatgtgtgagt

SEQ ID NO: 437630 - DNA, 15 bp, Homo sapiens
gcccatgtgtgagtg

SEQ ID NO: 437631 - DNA, 20 bp, Homo sapiens
gcccatgtgtgagtgtgtgc

SEQ ID NO: 437632 - DNA, 13 bp, Homo sapiens
gcccattcccacc

SEQ ID NO: 437633 - DNA, 16 bp, Homo sapiens
gccccaaaaccacagc

SEQ ID NO: 437634 - DNA, 16 bp, Homo sapiens
gccccaaaagccttac

SEQ ID NO: 437635 - DNA, 19 bp, Homo sapiens
gccccaaacaaatatgcaa

SEQ ID NO: 437636 - DNA, 16 bp, Homo sapiens
gccccaaagcccagcc

SEQ ID NO: 437637 - DNA, 19 bp, Homo sapiens
gccccaagataggggcaca

SEQ ID NO: 437638 - DNA, 19 bp, Homo sapiens
gccccaagcagccagccag

SEQ ID NO: 437639 - DNA, 21 bp, Homo sapiens
gccccaagcagccagccagtc

SEQ ID NO: 437640 - DNA, 19 bp, Homo sapiens
gccccaatatggtggccct

SEQ ID NO: 437641 - DNA, 20 bp, Homo sapiens
gccccaatatggtggccctg

SEQ ID NO: 437642 - DNA, 21 bp, Homo sapiens
gccccaatcgggtccagagac

SEQ ID NO: 437643 - DNA, 17 bp, Homo sapiens
gccccacacaggcctgg

SEQ ID NO: 437644 - DNA, 19 bp, Homo sapiens
gccccacacaggcctggcc

SEQ ID NO: 437645 - DNA, 21 bp, Homo sapiens
gccccacacggactcccgggc

SEQ ID NO: 437646 - DNA, 11 bp, Homo sapiens
gccccacagct

SEQ ID NO: 437647 - DNA, 15 bp, Homo sapiens
gccccacagctacct

SEQ ID NO: 437648 - DNA, 16 bp, Homo sapiens
gccccacaggccacac

SEQ ID NO: 437649 - DNA, 15 bp, Homo sapiens
gccccacccacccct

SEQ ID NO: 437650 - DNA, 18 bp, Homo sapiens
gccccacccacccctcct

SEQ ID NO: 437651 - DNA, 19 bp, Homo sapiens
gccccacccaccctctggt

SEQ ID NO: 437652 - DNA, 11 bp, Homo sapiens
gccccacccag

SEQ ID NO: 437653 - DNA, 15 bp, Homo sapiens
gccccacccctccat

SEQ ID NO: 437654 - DNA, 20 bp, Homo sapiens
gccccacctacttgtgactg

SEQ ID NO: 437655 - DNA, 13 bp, Homo sapiens
gccccacctgagc

SEQ ID NO: 437656 - DNA, 14 bp, Homo sapiens
gccccacctgccac

SEQ ID NO: 437657 - DNA, 16 bp, Homo sapiens
gccccacgtggagctc

SEQ ID NO: 437658 - DNA, 17 bp, Homo sapiens
gccccacttcaccccca

SEQ ID NO: 437659 - DNA, 19 bp, Homo sapiens
gccccagaaatgccgctgt

SEQ ID NO: 437660 - DNA, 24 bp, Homo sapiens
gccccagaaatgccgctgtgtccc

SEQ ID NO: 437661 - DNA, 22 bp, Homo sapiens
gccccagaaccccaactcccag

SEQ ID NO: 437662 - DNA, 18 bp, Homo sapiens
gccccagaccccagggca

SEQ ID NO: 437663 - DNA, 11 bp, Homo sapiens
gccccagagaa

SEQ ID NO: 437664 - DNA, 18 bp, Homo sapiens
gccccagagaagcctcag

SEQ ID NO: 437665 - DNA, 12 bp, Homo sapiens
gccccagagact

SEQ ID NO: 437666 - DNA, 14 bp, Homo sapiens
gccccagagactgc

SEQ ID NO: 437667 - DNA, 16 bp, Homo sapiens
gccccagagactgccc

SEQ ID NO: 437668 - DNA, 22 bp, Homo sapiens
gccccagagactgcccaccctg

SEQ ID NO: 437669 - DNA, 15 bp, Homo sapiens
gccccagagctccga

SEQ ID NO: 437670 - DNA, 21 bp, Homo sapiens
gccccagagctccgatgcccg

SEQ ID NO: 437671 - DNA, 17 bp, Homo sapiens
gccccagataccagccc

SEQ ID NO: 437672 - DNA, 19 bp, Homo sapiens
gccccagatcaccagcccg

SEQ ID NO: 437673 - DNA, 20 bp, Homo sapiens
gccccagatcaccagcccgg

SEQ ID NO: 437674 - DNA, 18 bp, Homo sapiens
gccccagatctgcctggg

SEQ ID NO: 437675 - DNA, 21 bp, Homo sapiens
gccccagatctgcctgggcct

SEQ ID NO: 437676 - DNA, 13 bp, Homo sapiens
gccccagccaagt

SEQ ID NO: 437677 - DNA, 20 bp, Homo sapiens
gccccagccaagtgccttcc

SEQ ID NO: 437678 - DNA, 16 bp, Homo sapiens
gccccagccagccctt

SEQ ID NO: 437679 - DNA, 11 bp, Homo sapiens
gccccagcccc

SEQ ID NO: 437680 - DNA, 23 bp, Homo sapiens
gccccagccccttctcccagcac

SEQ ID NO: 437681 - DNA, 20 bp, Homo sapiens
gccccagcgagtctggagac

SEQ ID NO: 437682 - DNA, 11 bp, Homo sapiens
gccccagctga

SEQ ID NO: 437683 - DNA, 19 bp, Homo sapiens
gccccagctgactgtggcc

SEQ ID NO: 437684 - DNA, 15 bp, Homo sapiens
gccccagctgggctg

SEQ ID NO: 437685 - DNA, 19 bp, Homo sapiens
gccccaggcaggctgtgcg

SEQ ID NO: 437686 - DNA, 15 bp, Homo sapiens
gccccaggcctgaaa

SEQ ID NO: 437687 - DNA, 19 bp, Homo sapiens
gccccaggcggaggggctt

SEQ ID NO: 437688 - DNA, 16 bp, Homo sapiens
gccccaggctcccctg

SEQ ID NO: 437689 - DNA, 16 bp, Homo sapiens
gccccagggccctgct

SEQ ID NO: 437690 - DNA, 17 bp, Homo sapiens
gccccagggccctgctc

SEQ ID NO: 437691 - DNA, 18 bp, Homo sapiens
gccccagggccctgctca

SEQ ID NO: 437692 - DNA, 20 bp, Homo sapiens
gccccagggccctgctcagg

SEQ ID NO: 437693 - DNA, 12 bp, Homo sapiens
gccccagggcct

SEQ ID NO: 437694 - DNA, 14 bp, Homo sapiens
gccccagggcctgg

SEQ ID NO: 437695 - DNA, 20 bp, Homo sapiens
gccccagggtcttccctacc

SEQ ID NO: 437696 - DNA, 21 bp, Homo sapiens
gccccagggtgagcagggccc

SEQ ID NO: 437697 - DNA, 13 bp, Homo sapiens
gccccaggtgcca

SEQ ID NO: 437698 - DNA, 14 bp, Homo sapiens
gccccaggtgccac

SEQ ID NO: 437699 - DNA, 22 bp, Homo sapiens
gccccaggtgccaccaataaaa

SEQ ID NO: 437700 - DNA, 11 bp, Homo sapiens
gccccagtcct

SEQ ID NO: 437701 - DNA, 21 bp, Homo sapiens
gccccagtcctggttcagtgg

SEQ ID NO: 437702 - DNA, 16 bp, Homo sapiens
gccccatagaaaacaa

SEQ ID NO: 437703 - DNA, 18 bp, Homo sapiens
gccccatccagcatgtgt

SEQ ID NO: 437704 - DNA, 19 bp, Homo sapiens
gccccatccagcatgtgtg

SEQ ID NO: 437705 - DNA, 18 bp, Homo sapiens
gccccatcccaaaccctt

SEQ ID NO: 437706 - DNA, 15 bp, Homo sapiens
gccccatccctgctt

SEQ ID NO: 437707 - DNA, 11 bp, Homo sapiens
gccccatcctt

SEQ ID NO: 437708 - DNA, 15 bp, Homo sapiens
gccccatccttcccg

SEQ ID NO: 437709 - DNA, 24 bp, Homo sapiens
gccccatccttcccgcagcaccag

SEQ ID NO: 437710 - DNA, 16 bp, Homo sapiens
gccccatgcctgtcca

SEQ ID NO: 437711 - DNA, 15 bp, Homo sapiens
gccccatgctctgcc

SEQ ID NO: 437712 - DNA, 16 bp, Homo sapiens
gccccatgctctgccc

SEQ ID NO: 437713 - DNA, 21 bp, Homo sapiens
gccccattcagaactctcaga

SEQ ID NO: 437714 - DNA, 22 bp, Homo sapiens
gccccattcagaactctcagac

SEQ ID NO: 437715 - DNA, 20 bp, Homo sapiens
gccccattctccctccatgg

SEQ ID NO: 437716 - DNA, 17 bp, Homo sapiens
gcccccaaattgccttc

SEQ ID NO: 437717 - DNA, 21 bp, Homo sapiens
gcccccaaattgccttcagcc

SEQ ID NO: 437718 - DNA, 20 bp, Homo sapiens
gcccccaaccccgcggtgct

SEQ ID NO: 437719 - DNA, 23 bp, Homo sapiens
gcccccaaccccgcggtgctctg

SEQ ID NO: 437720 - DNA, 20 bp, Homo sapiens
gcccccaactccgcccagcc

SEQ ID NO: 437721 - DNA, 16 bp, Homo sapiens
gcccccaccagcagca

SEQ ID NO: 437722 - DNA, 13 bp, Homo sapiens
gcccccaccccta

SEQ ID NO: 437723 - DNA, 11 bp, Homo sapiens
gcccccagaaa

SEQ ID NO: 437724 - DNA, 18 bp, Homo sapiens
gcccccagaaagcctcct

SEQ ID NO: 437725 - DNA, 21 bp, Homo sapiens
gcccccagaaagcctcctgcc

SEQ ID NO: 437726 - DNA, 14 bp, Homo sapiens
gcccccagacccca

SEQ ID NO: 437727 - DNA, 17 bp, Homo sapiens
gcccccagaccccatcc

SEQ ID NO: 437728 - DNA, 18 bp, Homo sapiens
gcccccagagcgcccctc

SEQ ID NO: 437729 - DNA, 21 bp, Homo sapiens
gcccccatccctcggacccac

SEQ ID NO: 437730 - DNA, 15 bp, Homo sapiens
gcccccatctcccca

SEQ ID NO: 437731 - DNA, 17 bp, Homo sapiens
gcccccatctccccagg

SEQ ID NO: 437732 - DNA, 19 bp, Homo sapiens
gcccccatctccccaggcc

SEQ ID NO: 437733 - DNA, 23 bp, Homo sapiens
gccccccacctttgggatcagcc

SEQ ID NO: 437734 - DNA, 13 bp, Homo sapiens
gccccccagagcc

SEQ ID NO: 437735 - DNA, 15 bp, Homo sapiens
gccccccagagccag

SEQ ID NO: 437736 - DNA, 20 bp, Homo sapiens
gccccccagagccagggctg

SEQ ID NO: 437737 - DNA, 24 bp, Homo sapiens
gccccccagagccagggctgtcct

SEQ ID NO: 437738 - DNA, 20 bp, Homo sapiens
gccccccctcttttggcctt

SEQ ID NO: 437739 - DNA, 21 bp, Homo sapiens
gccccccctcttttggccttg

SEQ ID NO: 437740 - DNA, 22 bp, Homo sapiens
gccccccctcttttggccttgt

SEQ ID NO: 437741 - DNA, 12 bp, Homo sapiens
gcccccctccag

SEQ ID NO: 437742 - DNA, 11 bp, Homo sapiens
gcccccctcct

SEQ ID NO: 437743 - DNA, 18 bp, Homo sapiens
gccccccttcccacccct

SEQ ID NO: 437744 - DNA, 14 bp, Homo sapiens
gcccccgagctggg

SEQ ID NO: 437745 - DNA, 16 bp, Homo sapiens
gcccccgccccgcccc

SEQ ID NO: 437746 - DNA, 16 bp, Homo sapiens
gcccccgccctcgctc

SEQ ID NO: 437747 - DNA, 19 bp, Homo sapiens
gcccccgccctcgctccgg

SEQ ID NO: 437748 - DNA, 14 bp, Homo sapiens
gcccccgccctctg

SEQ ID NO: 437749 - DNA, 13 bp, Homo sapiens
gccgcctcctcca

SEQ ID NO: 437750 - DNA, 14 bp, Homo sapiens
gccgcctgtgccct

SEQ ID NO: 437751 - DNA, 13 bp, Homo sapiens
gccgcgctctgcc

SEQ ID NO: 437752 - DNA, 15 bp, Homo sapiens
gccgcgctctgcccc

SEQ ID NO: 437753 - DNA, 19 bp, Homo sapiens
gccgcgggcggccaggcaa

SEQ ID NO: 437754 - DNA, 21 bp, Homo sapiens
gccgcggtaggtaagggccgc

SEQ ID NO: 437755 - DNA, 19 bp, Homo sapiens
gccgctagaggcctgagga

SEQ ID NO: 437756 - DNA, 18 bp, Homo sapiens
gccgctagatgggcatgg

SEQ ID NO: 437757 - DNA, 23 bp, Homo sapiens
gccgctagatgggcatggggtgg

SEQ ID NO: 437758 - DNA, 13 bp, Homo sapiens
gccgctaggagag

SEQ ID NO: 437759 - DNA, 17 bp, Homo sapiens
gccgctaggagagactg

SEQ ID NO: 437760 - DNA, 22 bp, Homo sapiens
gccgctaggagagactgaaagc

SEQ ID NO: 437761 - DNA, 12 bp, Homo sapiens
gccgctggaggc

SEQ ID NO: 437762 - DNA, 20 bp, Homo sapiens
gccgctgggagaaaagccag

SEQ ID NO: 437763 - DNA, 22 bp, Homo sapiens
gccgctgggagaaaagccagat

SEQ ID NO: 437764 - DNA, 13 bp, Homo sapiens
gccgctgggagag

SEQ ID NO: 437765 - DNA, 16 bp, Homo sapiens
gccgctgtgtccccgc

SEQ ID NO: 437766 - DNA, 13 bp, Homo sapiens
gccggagcctttg

SEQ ID NO: 437767 - DNA, 14 bp, Homo sapiens
gccggatcttggag

SEQ ID NO: 437768 - DNA, 13 bp, Homo sapiens
gccggcaggggcc

SEQ ID NO: 437769 - DNA, 16 bp, Homo sapiens
gccggcaggggcccct

SEQ ID NO: 437770 - DNA, 15 bp, Homo sapiens
gccggccagctcccc

SEQ ID NO: 437771 - DNA, 18 bp, Homo sapiens
gccggccttggccttggg

SEQ ID NO: 437772 - DNA, 19 bp, Homo sapiens
gccggcggcagccccactt

SEQ ID NO: 437773 - DNA, 17 bp, Homo sapiens
gccggcggcccaagccc

SEQ ID NO: 437774 - DNA, 16 bp, Homo sapiens
gccggctggccggtcc

SEQ ID NO: 437775 - DNA, 17 bp, Homo sapiens
gccgggccctctgtagc

SEQ ID NO: 437776 - DNA, 18 bp, Homo sapiens
gccgggccctctgtagct

SEQ ID NO: 437777 - DNA, 12 bp, Homo sapiens
gccgggctgctg

SEQ ID NO: 437778 - DNA, 14 bp, Homo sapiens
gccgggctgctgct

SEQ ID NO: 437779 - DNA, 20 bp, Homo sapiens
gccgggctggcttctccctg

SEQ ID NO: 437780 - DNA, 19 bp, Homo sapiens
gccggggctggccctgccc

SEQ ID NO: 437781 - DNA, 21 bp, Homo sapiens
gccgggggtgggggcctgctg

SEQ ID NO: 437782 - DNA, 22 bp, Homo sapiens
gccggggtggagcatgggcctg

SEQ ID NO: 437783 - DNA, 23 bp, Homo sapiens
gccggggtggggtgcctgagccc

SEQ ID NO: 437784 - DNA, 16 bp, Homo sapiens
gccgggtgctcagggc

SEQ ID NO: 437785 - DNA, 22 bp, Homo sapiens
gccggtcccccatgccaccacc

SEQ ID NO: 437786 - DNA, 20 bp, Homo sapiens
gccggttggccggctggccg

SEQ ID NO: 437787 - DNA, 19 bp, Homo sapiens
gccgtagggagtacctgct

SEQ ID NO: 437788 - DNA, 12 bp, Homo sapiens
gccgtcacgctt

SEQ ID NO: 437789 - DNA, 21 bp, Homo sapiens
gccgtccatggcaccagcccc

SEQ ID NO: 437790 - DNA, 22 bp, Homo sapiens
gccgtccatggcaccagccccc

SEQ ID NO: 437791 - DNA, 23 bp, Homo sapiens
gccgtccatggcaccagccccct

SEQ ID NO: 437792 - DNA, 19 bp, Homo sapiens
gccgtccctgacttcccag

SEQ ID NO: 437793 - DNA, 21 bp, Homo sapiens
gccgtcctcccgggccctccc

SEQ ID NO: 437794 - DNA, 18 bp, Homo sapiens
gccgtcctggactctgtg

SEQ ID NO: 437795 - DNA, 14 bp, Homo sapiens
gccgtctcctccct

SEQ ID NO: 437796 - DNA, 16 bp, Homo sapiens
gccgtctgactccaga

SEQ ID NO: 437797 - DNA, 21 bp, Homo sapiens
gccgtcttcactcgcccccgg

SEQ ID NO: 437798 - DNA, 22 bp, Homo sapiens
gccgtcttcactcgcccccggg

SEQ ID NO: 437799 - DNA, 19 bp, Homo sapiens
gccgtctttggttcctcat

SEQ ID NO: 437800 - DNA, 12 bp, Homo sapiens
gccgtgagcagg

SEQ ID NO: 437801 - DNA, 17 bp, Homo sapiens
gccgtgatgctcaggct

SEQ ID NO: 437802 - DNA, 22 bp, Homo sapiens
gccgtgcatggctcctgtctgg

SEQ ID NO: 437803 - DNA, 15 bp, Homo sapiens
gccgtgcccgcccac

SEQ ID NO: 437804 - DNA, 21 bp, Homo sapiens
gccgtgcccgcccacctctgc

SEQ ID NO: 437805 - DNA, 23 bp, Homo sapiens
gccgtggattgcacgtggcctct

SEQ ID NO: 437806 - DNA, 15 bp, Homo sapiens
gccgtggctgcggca

SEQ ID NO: 437807 - DNA, 11 bp, Homo sapiens
gccgtggcttc

SEQ ID NO: 437808 - DNA, 12 bp, Homo sapiens
gccgtggcttcc

SEQ ID NO: 437809 - DNA, 21 bp, Homo sapiens
gccgtggcttcccgctcagcc

SEQ ID NO: 437810 - DNA, 15 bp, Homo sapiens
gccgttccccttggc

SEQ ID NO: 437811 - DNA, 20 bp, Homo sapiens
gccgttgccaagaactgaaa

SEQ ID NO: 437812 - DNA, 22 bp, Homo sapiens
gccgtttgaatatattttatct

SEQ ID NO: 437813 - DNA, 18 bp, Homo sapiens
gcctaactactagttttt

SEQ ID NO: 437814 - DNA, 17 bp, Homo sapiens
gcctaagaaaaaggaaa

SEQ ID NO: 437815 - DNA, 15 bp, Homo sapiens
gcctaaggctgctgt

SEQ ID NO: 437816 - DNA, 11 bp, Homo sapiens
gcctaataaag

SEQ ID NO: 437817 - DNA, 13 bp, Homo sapiens
gcctaatttacaa

SEQ ID NO: 437818 - DNA, 14 bp, Homo sapiens
gcctacagatgaac

SEQ ID NO: 437819 - DNA, 21 bp, Homo sapiens
gcctaccagtcgccctctgtg

SEQ ID NO: 437820 - DNA, 23 bp, Homo sapiens
gcctaccagtcgccctctgtgcc

SEQ ID NO: 437821 - DNA, 19 bp, Homo sapiens
gcctaccgggttctcctga

SEQ ID NO: 437822 - DNA, 19 bp, Homo sapiens
gcctactctttgttttctt

SEQ ID NO: 437823 - DNA, 13 bp, Homo sapiens
gcctactgtctcc

SEQ ID NO: 437824 - DNA, 14 bp, Homo sapiens
gcctaggagctggc

SEQ ID NO: 437825 - DNA, 15 bp, Homo sapiens
gcctaggagctggct

SEQ ID NO: 437826 - DNA, 16 bp, Homo sapiens
gcctaggagctggctg

SEQ ID NO: 437827 - DNA, 19 bp, Homo sapiens
gcctaggagctggctggca

SEQ ID NO: 437828 - DNA, 11 bp, Homo sapiens
gcctagggagc

SEQ ID NO: 437829 - DNA, 20 bp, Homo sapiens
gcctagggagccgcaccttg

SEQ ID NO: 437830 - DNA, 20 bp, Homo sapiens
gcctagtaggagctgagctt

SEQ ID NO: 437831 - DNA, 19 bp, Homo sapiens
gcctagtcagccacatggg

SEQ ID NO: 437832 - DNA, 23 bp, Homo sapiens
gcctagtggcttcagcccctggg

SEQ ID NO: 437833 - DNA, 19 bp, Homo sapiens
gcctagtggggaggggcct

SEQ ID NO: 437834 - DNA, 21 bp, Homo sapiens
gcctagttcatccaatcctca

SEQ ID NO: 437835 - DNA, 18 bp, Homo sapiens
gcctatatttcctcttct

SEQ ID NO: 437836 - DNA, 14 bp, Homo sapiens
gcctatccatcctg

SEQ ID NO: 437837 - DNA, 15 bp, Homo sapiens
gcctatccatcctgc

SEQ ID NO: 437838 - DNA, 17 bp, Homo sapiens
gcctatgccacctgcag

SEQ ID NO: 437839 - DNA, 19 bp, Homo sapiens
gcctatgccacctgcagcg

SEQ ID NO: 437840 - DNA, 20 bp, Homo sapiens
gcctatggaaagggtgtggc

SEQ ID NO: 437841 - DNA, 22 bp, Homo sapiens
gcctatggaaagggtgtggctt

SEQ ID NO: 437842 - DNA, 19 bp, Homo sapiens
gcctatgggggctctcgga

SEQ ID NO: 437843 - DNA, 15 bp, Homo sapiens
gcctattatattaaa

SEQ ID NO: 437844 - DNA, 20 bp, Homo sapiens
gcctattatattaaaatatg

SEQ ID NO: 437845 - DNA, 13 bp, Homo sapiens
gcctatttaagcc

SEQ ID NO: 437846 - DNA, 13 bp, Homo sapiens
gcctatttactgg

SEQ ID NO: 437847 - DNA, 18 bp, Homo sapiens
gcctcaaccctccctcag

SEQ ID NO: 437848 - DNA, 14 bp, Homo sapiens
gcctcaagccatct

SEQ ID NO: 437849 - DNA, 21 bp, Homo sapiens
gcctcaagccatcttcccgcc

SEQ ID NO: 437850 - DNA, 22 bp, Homo sapiens
gcctcaatggggaattttttga

SEQ ID NO: 437851 - DNA, 23 bp, Homo sapiens
gcctcaatggggaattttttgat

SEQ ID NO: 437852 - DNA, 17 bp, Homo sapiens
gcctcacatctcccttc

SEQ ID NO: 437853 - DNA, 12 bp, Homo sapiens
gcctcaccctgc

SEQ ID NO: 437854 - DNA, 13 bp, Homo sapiens
gcctcaccctgct

SEQ ID NO: 437855 - DNA, 13 bp, Homo sapiens
gcctcacctggct

SEQ ID NO: 437856 - DNA, 16 bp, Homo sapiens
gcctcacctggcttcc

SEQ ID NO: 437857 - DNA, 15 bp, Homo sapiens
gcctcacctttccca

SEQ ID NO: 437858 - DNA, 21 bp, Homo sapiens
gcctcacctttcccacagtct

SEQ ID NO: 437859 - DNA, 18 bp, Homo sapiens
gcctcacttgaatgtgtc

SEQ ID NO: 437860 - DNA, 20 bp, Homo sapiens
gcctcacttgaatgtgtcac

SEQ ID NO: 437861 - DNA, 16 bp, Homo sapiens
gcctcagactcataca

SEQ ID NO: 437862 - DNA, 12 bp, Homo sapiens
gcctcagagaca

SEQ ID NO: 437863 - DNA, 19 bp, Homo sapiens
gcctcagccagctgcccac

SEQ ID NO: 437864 - DNA, 15 bp, Homo sapiens
gcctcagccattcac

SEQ ID NO: 437865 - DNA, 17 bp, Homo sapiens
gcctcagccattcactg

SEQ ID NO: 437866 - DNA, 14 bp, Homo sapiens
gcctcagctgcctc

SEQ ID NO: 437867 - DNA, 15 bp, Homo sapiens
gcctcaggcctccca

SEQ ID NO: 437868 - DNA, 14 bp, Homo sapiens
gcctcagtgccact

SEQ ID NO: 437869 - DNA, 15 bp, Homo sapiens
gcctcagtgccactt

SEQ ID NO: 437870 - DNA, 11 bp, Homo sapiens
gcctcagtgga

SEQ ID NO: 437871 - DNA, 20 bp, Homo sapiens
gcctcagtttctccatcagc

SEQ ID NO: 437872 - DNA, 22 bp, Homo sapiens
gcctcagtttctccatcagctt

SEQ ID NO: 437873 - DNA, 16 bp, Homo sapiens
gcctcatcctcccaag

SEQ ID NO: 437874 - DNA, 13 bp, Homo sapiens
gcctcatgccaca

SEQ ID NO: 437875 - DNA, 19 bp, Homo sapiens
gcctcatgctctctataga

SEQ ID NO: 437876 - DNA, 13 bp, Homo sapiens
gcctccaagcctg

SEQ ID NO: 437877 - DNA, 20 bp, Homo sapiens
gcctccaagcctgcctccca

SEQ ID NO: 437878 - DNA, 17 bp, Homo sapiens
gcctccaccgagccagc

SEQ ID NO: 437879 - DNA, 20 bp, Homo sapiens
gccttcctctgcagctgacc

SEQ ID NO: 437880 - DNA, 19 bp, Homo sapiens
gccttcctgccctacagag

SEQ ID NO: 437881 - DNA, 18 bp, Homo sapiens
gccttcgatacaccgggc

SEQ ID NO: 437882 - DNA, 14 bp, Homo sapiens
gccttcgtgccccc

SEQ ID NO: 437883 - DNA, 17 bp, Homo sapiens
gccttctacctgcagga

SEQ ID NO: 437884 - DNA, 20 bp, Homo sapiens
gccttctacctgcaggactc

SEQ ID NO: 437885 - DNA, 13 bp, Homo sapiens
gccttctcccctc

SEQ ID NO: 437886 - DNA, 14 bp, Homo sapiens
gccttctcccctcc

SEQ ID NO: 437887 - DNA, 21 bp, Homo sapiens
gccttctctattgggcacagc

SEQ ID NO: 437888 - DNA, 18 bp, Homo sapiens
gccttctcttctatcctg

SEQ ID NO: 437889 - DNA, 21 bp, Homo sapiens
gccttctgaactccatacagc

SEQ ID NO: 437890 - DNA, 19 bp, Homo sapiens
gccttctgacggccctgca

SEQ ID NO: 437891 - DNA, 15 bp, Homo sapiens
gccttcttcacccag

SEQ ID NO: 437892 - DNA, 17 bp, Homo sapiens
gccttcttcacccagct

SEQ ID NO: 437893 - DNA, 14 bp, Homo sapiens
gccttgacaagtac

SEQ ID NO: 437894 - DNA, 16 bp, Homo sapiens
gccttgacaagtacat

SEQ ID NO: 437895 - DNA, 23 bp, Homo sapiens
gccttgagacccccaagcttcca

SEQ ID NO: 437896 - DNA, 14 bp, Homo sapiens
gccttgatggagaa

SEQ ID NO: 437897 - DNA, 18 bp, Homo sapiens
gccttgatggagaaggaa

SEQ ID NO: 437898 - DNA, 16 bp, Homo sapiens
gccttgatgttgtgtt

SEQ ID NO: 437899 - DNA, 18 bp, Homo sapiens
gccttgattataccactg

SEQ ID NO: 437900 - DNA, 22 bp, Homo sapiens
gccttgctgatggcttgacatg

SEQ ID NO: 437901 - DNA, 15 bp, Homo sapiens
gccttgctgccaagt

SEQ ID NO: 437902 - DNA, 13 bp, Homo sapiens
gccttgctgtaga

SEQ ID NO: 437903 - DNA, 15 bp, Homo sapiens
gccttgctgtagaga

SEQ ID NO: 437904 - DNA, 15 bp, Homo sapiens
gccttggccttgggg

SEQ ID NO: 437905 - DNA, 15 bp, Homo sapiens
gccttgggcctttca

SEQ ID NO: 437906 - DNA, 14 bp, Homo sapiens
gccttgggctgctc

SEQ ID NO: 437907 - DNA, 16 bp, Homo sapiens
gccttgggctgctcct

SEQ ID NO: 437908 - DNA, 18 bp, Homo sapiens
gccttggggaatttcctc

SEQ ID NO: 437909 - DNA, 18 bp, Homo sapiens
gccttggggccagactgg

SEQ ID NO: 437910 - DNA, 14 bp, Homo sapiens
gccttgggggtctg

SEQ ID NO: 437911 - DNA, 22 bp, Homo sapiens
gccttgggggtctgctctgtgc

SEQ ID NO: 437912 - DNA, 18 bp, Homo sapiens
gccttgggttccaaccag

SEQ ID NO: 437913 - DNA, 18 bp, Homo sapiens
gccttggttcctccagca

SEQ ID NO: 437914 - DNA, 22 bp, Homo sapiens
gccttgtccctctcactcccca

SEQ ID NO: 437915 - DNA, 17 bp, Homo sapiens
gccttgtctcttcctct

SEQ ID NO: 437916 - DNA, 13 bp, Homo sapiens
gccttgtgccctg

SEQ ID NO: 437917 - DNA, 14 bp, Homo sapiens
gccttgtgccctgc

SEQ ID NO: 437918 - DNA, 17 bp, Homo sapiens
gccttgtgccctgcccc

SEQ ID NO: 437919 - DNA, 19 bp, Homo sapiens
gccttgtgtgctggcttcc

SEQ ID NO: 437920 - DNA, 21 bp, Homo sapiens
gccttgttgatgggccttcag

SEQ ID NO: 437921 - DNA, 16 bp, Homo sapiens
gccttgttgtattcct

SEQ ID NO: 437922 - DNA, 22 bp, Homo sapiens
gcctttaccctcctctatttct

SEQ ID NO: 437923 - DNA, 14 bp, Homo sapiens
gcctttaggcagga

SEQ ID NO: 437924 - DNA, 20 bp, Homo sapiens
gcctttcaggaagggagagg

SEQ ID NO: 437925 - DNA, 19 bp, Homo sapiens
gcctttcataccagtcagt

SEQ ID NO: 437926 - DNA, 15 bp, Homo sapiens
gcctttcctgtgcca

SEQ ID NO: 437927 - DNA, 14 bp, Homo sapiens
gcctttctcccccg

SEQ ID NO: 437928 - DNA, 14 bp, Homo sapiens
gcctttctgcagtt

SEQ ID NO: 437929 - DNA, 19 bp, Homo sapiens
gcctttctgcagtttttca

SEQ ID NO: 437930 - DNA, 11 bp, Homo sapiens
gcctttctgta

SEQ ID NO: 437931 - DNA, 21 bp, Homo sapiens
gcctttctgtatcaagcccct

SEQ ID NO: 437932 - DNA, 18 bp, Homo sapiens
gcctttgagcccacaaag

SEQ ID NO: 437933 - DNA, 12 bp, Homo sapiens
gcctttgaggtt

SEQ ID NO: 437934 - DNA, 22 bp, Homo sapiens
gcctttgagtgtgggactccag

SEQ ID NO: 437935 - DNA, 22 bp, Homo sapiens
gcctttgagtttcctcaggctg

SEQ ID NO: 437936 - DNA, 21 bp, Homo sapiens
gcctttgctgtttagcttcct

SEQ ID NO: 437937 - DNA, 18 bp, Homo sapiens
gcctttggcaattcttct

SEQ ID NO: 437938 - DNA, 10 bp, Homo sapiens
gcctttggga

SEQ ID NO: 437939 - DNA, 14 bp, Homo sapiens
gcctttgggatttg

SEQ ID NO: 437940 - DNA, 21 bp, Homo sapiens
gcctttgtaagacacacagcc

SEQ ID NO: 437941 - DNA, 11 bp, Homo sapiens
gcctttgtagg

SEQ ID NO: 437942 - DNA, 18 bp, Homo sapiens
gccttttaaattcttttc

SEQ ID NO: 437943 - DNA, 14 bp, Homo sapiens
gccttttatagcta

SEQ ID NO: 437944 - DNA, 14 bp, Homo sapiens
gccttttgtttaaa

SEQ ID NO: 437945 - DNA, 12 bp, Homo sapiens
gcctttttcctt

SEQ ID NO: 437946 - DNA, 23 bp, Homo sapiens
gcctttttttaaaattcaccccc

SEQ ID NO: 437947 - DNA, 16 bp, Homo sapiens
gcgaactctcaggact

SEQ ID NO: 437948 - DNA, 15 bp, Homo sapiens
gcgaccagaggtggg

SEQ ID NO: 437949 - DNA, 17 bp, Homo sapiens
gcgacggagagaaaaaa

SEQ ID NO: 437950 - DNA, 21 bp, Homo sapiens
gcgactctatagactctagga

SEQ ID NO: 437951 - DNA, 20 bp, Homo sapiens
gcgactgtcatgtggcttgg

SEQ ID NO: 437952 - DNA, 14 bp, Homo sapiens
gcgagactccgtct

SEQ ID NO: 437953 - DNA, 18 bp, Homo sapiens
gcgagcacagtattattt

SEQ ID NO: 437954 - DNA, 13 bp, Homo sapiens
gcgagcacccacg

SEQ ID NO: 437955 - DNA, 12 bp, Homo sapiens
gcgagccaggca

SEQ ID NO: 437956 - DNA, 13 bp, Homo sapiens
gcgagccaggcaa

SEQ ID NO: 437957 - DNA, 12 bp, Homo sapiens
gcgagcccttag

SEQ ID NO: 437958 - DNA, 13 bp, Homo sapiens
gcgagctgctctg

SEQ ID NO: 437959 - DNA, 15 bp, Homo sapiens
gcgagctgctctgct

SEQ ID NO: 437960 - DNA, 13 bp, Homo sapiens
gcgaggcagagga

SEQ ID NO: 437961 - DNA, 14 bp, Homo sapiens
gcgaggcagaggac

SEQ ID NO: 437962 - DNA, 18 bp, Homo sapiens
gcgaggcgggggagcctg

SEQ ID NO: 437963 - DNA, 21 bp, Homo sapiens
gcgaggcgggggagcctggag

SEQ ID NO: 437964 - DNA, 21 bp, Homo sapiens
gcgaggcgggggatcctggag

SEQ ID NO: 437965 - DNA, 22 bp, Homo sapiens
gcgaggcgggggatcctggagc

SEQ ID NO: 437966 - DNA, 13 bp, Homo sapiens
gcgaggctgcctc

SEQ ID NO: 437967 - DNA, 19 bp, Homo sapiens
gcgaggctttaagcgaggc

SEQ ID NO: 437968 - DNA, 11 bp, Homo sapiens
gcgagggaggg

SEQ ID NO: 437969 - DNA, 12 bp, Homo sapiens
gcgagggagggg

SEQ ID NO: 437970 - DNA, 16 bp, Homo sapiens
gcgagggaggggaggt

SEQ ID NO: 437971 - DNA, 19 bp, Homo sapiens
gcgagggaggggaggtggc

SEQ ID NO: 437972 - DNA, 19 bp, Homo sapiens
gcgagtaccccagccactc

SEQ ID NO: 437973 - DNA, 14 bp, Homo sapiens
gcgagtggtcaagg

SEQ ID NO: 437974 - DNA, 17 bp, Homo sapiens
gcgatcatggctcactg

SEQ ID NO: 437975 - DNA, 20 bp, Homo sapiens
gcgatcatggctcactgcag

SEQ ID NO: 437976 - DNA, 22 bp, Homo sapiens
gcgatcatggctcactgcagcc

SEQ ID NO: 437977 - DNA, 16 bp, Homo sapiens
gcgatccacctgtctc

SEQ ID NO: 437978 - DNA, 23 bp, Homo sapiens
gcgatgtttcaggaggctggagg

SEQ ID NO: 437979 - DNA, 16 bp, Homo sapiens
gcgattcccattgaaa

SEQ ID NO: 437980 - DNA, 19 bp, Homo sapiens
gcgcaaaactgcctgaaag

SEQ ID NO: 437981 - DNA, 12 bp, Homo sapiens
gcgcaaacttta

SEQ ID NO: 437982 - DNA, 21 bp, Homo sapiens
gcgcacccggcagccccccag

SEQ ID NO: 437983 - DNA, 17 bp, Homo sapiens
gcgcaccgcccaacccc

SEQ ID NO: 437984 - DNA, 22 bp, Homo sapiens
gcgcaccgcccaacccccacct

SEQ ID NO: 437985 - DNA, 23 bp, Homo sapiens
gcgcaccgcccaacccccacctc

SEQ ID NO: 437986 - DNA, 13 bp, Homo sapiens
gcgcagcccctgg

SEQ ID NO: 437987 - DNA, 16 bp, Homo sapiens
gcgcagccgcgctctg

SEQ ID NO: 437988 - DNA, 11 bp, Homo sapiens
gcgcaggccct

SEQ ID NO: 437989 - DNA, 17 bp, Homo sapiens
gcgcaggccctggtgga

SEQ ID NO: 437990 - DNA, 22 bp, Homo sapiens
gcgcatagtgtgctcggacaca

SEQ ID NO: 437991 - DNA, 12 bp, Homo sapiens
gcgcatgtgtgt

SEQ ID NO: 437992 - DNA, 20 bp, Homo sapiens
gcgccagtacattccaactt

SEQ ID NO: 437993 - DNA, 19 bp, Homo sapiens
gcgcccattcgtctgtccc

SEQ ID NO: 437994 - DNA, 13 bp, Homo sapiens
gcgcccccagtgt

SEQ ID NO: 437995 - DNA, 12 bp, Homo sapiens
gcgccccgcccc

SEQ ID NO: 437996 - DNA, 14 bp, Homo sapiens
gcgccccgccccca

SEQ ID NO: 437997 - DNA, 13 bp, Homo sapiens
gcgccccttcccc

SEQ ID NO: 437998 - DNA, 13 bp, Homo sapiens
gcgcccgctgggc

SEQ ID NO: 437999 - DNA, 14 bp, Homo sapiens
gcgcccgctgggct

SEQ ID NO: 438000 - DNA, 16 bp, Homo sapiens
gcgcccgctgggctga

SEQ ID NO: 438001 - DNA, 16 bp, Homo sapiens
gcgccctccctccctc

SEQ ID NO: 438002 - DNA, 18 bp, Homo sapiens
gcgccctccctccctcca

SEQ ID NO: 438003 - DNA, 18 bp, Homo sapiens
gcgcctgcgctcctctgc

SEQ ID NO: 438004 - DNA, 20 bp, Homo sapiens
gcgcctgcgctcctctgcag

SEQ ID NO: 438005 - DNA, 21 bp, Homo sapiens
gcgcctgcgctcctctgcagc

SEQ ID NO: 438006 - DNA, 22 bp, Homo sapiens
gcgcctgtgctgaggactccct

SEQ ID NO: 438007 - DNA, 18 bp, Homo sapiens
gcgccttctacctgcagg

SEQ ID NO: 438008 - DNA, 20 bp, Homo sapiens
gcgccttctacctgcaggac

SEQ ID NO: 438009 - DNA, 20 bp, Homo sapiens
gcgcgccctcccttggcgtg

SEQ ID NO: 438010 - DNA, 14 bp, Homo sapiens
gctcccaggacgca

SEQ ID NO: 438011 - DNA, 22 bp, Homo sapiens
gctcccagggccatgaactttg

SEQ ID NO: 438012 - DNA, 12 bp, Homo sapiens
gctcccagtgcc

SEQ ID NO: 438013 - DNA, 15 bp, Homo sapiens
gctcccattcctccc

SEQ ID NO: 438014 - DNA, 22 bp, Homo sapiens
gctccccacccgcctcccgcct

SEQ ID NO: 438015 - DNA, 23 bp, Homo sapiens
gctccccacgagtcacctgcaag

SEQ ID NO: 438016 - DNA, 24 bp, Homo sapiens
gctccccacgagtcacctgcaagc

SEQ ID NO: 438017 - DNA, 14 bp, Homo sapiens
gctccccagcccag

SEQ ID NO: 438018 - DNA, 14 bp, Homo sapiens
gctccccaggagct

SEQ ID NO: 438019 - DNA, 22 bp, Homo sapiens
gctccccatggctcctcaccac

SEQ ID NO: 438020 - DNA, 16 bp, Homo sapiens
gctcccccatcctccc

SEQ ID NO: 438021 - DNA, 17 bp, Homo sapiens
gctcccccatcctcccc

SEQ ID NO: 438022 - DNA, 18 bp, Homo sapiens
gctcccccatcctcccct

SEQ ID NO: 438023 - DNA, 20 bp, Homo sapiens
gctcccccatcctccccttc

SEQ ID NO: 438024 - DNA, 16 bp, Homo sapiens
gctcccccgcagtccc

SEQ ID NO: 438025 - DNA, 22 bp, Homo sapiens
gctcccctttcccatcacccct

SEQ ID NO: 438026 - DNA, 20 bp, Homo sapiens
gctcccgagctactctcttg

SEQ ID NO: 438027 - DNA, 14 bp, Homo sapiens
gctccctagactgc

SEQ ID NO: 438028 - DNA, 21 bp, Homo sapiens
gctccctagactgcatcccgt

SEQ ID NO: 438029 - DNA, 13 bp, Homo sapiens
gctccctcccgca

SEQ ID NO: 438030 - DNA, 15 bp, Homo sapiens
gctccctcctcagtc

SEQ ID NO: 438031 - DNA, 16 bp, Homo sapiens
gctccctcctcccatc

SEQ ID NO: 438032 - DNA, 15 bp, Homo sapiens
gctcccttctctgta

SEQ ID NO: 438033 - DNA, 17 bp, Homo sapiens
gctccgcctctgctggc

SEQ ID NO: 438034 - DNA, 13 bp, Homo sapiens
gctccgcctggca

SEQ ID NO: 438035 - DNA, 14 bp, Homo sapiens
gctccgcctggcac

SEQ ID NO: 438036 - DNA, 16 bp, Homo sapiens
gctccgctgcttactg

SEQ ID NO: 438037 - DNA, 13 bp, Homo sapiens
gctccgctgtgtg

SEQ ID NO: 438038 - DNA, 16 bp, Homo sapiens
gctccggcagaggcag

SEQ ID NO: 438039 - DNA, 17 bp, Homo sapiens
gctccggcagaggcagg

SEQ ID NO: 438040 - DNA, 21 bp, Homo sapiens
gctccggcagaggcagggccc

SEQ ID NO: 438041 - DNA, 22 bp, Homo sapiens
gctccggcagaggcagggccct

SEQ ID NO: 438042 - DNA, 14 bp, Homo sapiens
gctccgggtgcgtg

SEQ ID NO: 438043 - DNA, 22 bp, Homo sapiens
gctccgggtgcgtgaccggccc

SEQ ID NO: 438044 - DNA, 19 bp, Homo sapiens
gctccggtgcggtgcactg

SEQ ID NO: 438045 - DNA, 16 bp, Homo sapiens
gctccgtgtgtctcat

SEQ ID NO: 438046 - DNA, 22 bp, Homo sapiens
gctcctcacccccacccctgta

SEQ ID NO: 438047 - DNA, 14 bp, Homo sapiens
gctcctcactgccc

SEQ ID NO: 438048 - DNA, 14 bp, Homo sapiens
gctcctccccgatc

SEQ ID NO: 438049 - DNA, 20 bp, Homo sapiens
gctcctccccgatccccgac

SEQ ID NO: 438050 - DNA, 15 bp, Homo sapiens
gctcctcccctcttg

SEQ ID NO: 438051 - DNA, 19 bp, Homo sapiens
gctcctcctctctggactt

SEQ ID NO: 438052 - DNA, 18 bp, Homo sapiens
gctcctcctgccctgtcc

SEQ ID NO: 438053 - DNA, 23 bp, Homo sapiens
gctcctcggccagagctcccagg

SEQ ID NO: 438054 - DNA, 18 bp, Homo sapiens
gctcctctccttgggctc

SEQ ID NO: 438055 - DNA, 20 bp, Homo sapiens
gctcctctccttgggctcct

SEQ ID NO: 438056 - DNA, 21 bp, Homo sapiens
gctcctctccttgggctcctg

SEQ ID NO: 438057 - DNA, 17 bp, Homo sapiens
gctcctctgcagcctga

SEQ ID NO: 438058 - DNA, 20 bp, Homo sapiens
gctcctctgccttggacacc

SEQ ID NO: 438059 - DNA, 12 bp, Homo sapiens
gctcctctgggc

SEQ ID NO: 438060 - DNA, 15 bp, Homo sapiens
gctcctctgttcagt

SEQ ID NO: 438061 - DNA, 22 bp, Homo sapiens
gctcctcttaccgtagcctccg

SEQ ID NO: 438062 - DNA, 23 bp, Homo sapiens
gctcctcttaccgtagcctccgt

SEQ ID NO: 438063 - DNA, 18 bp, Homo sapiens
gctcctctttcccctcct

SEQ ID NO: 438064 - DNA, 23 bp, Homo sapiens
gctcctgaggggcatctgcccct

SEQ ID NO: 438065 - DNA, 11 bp, Homo sapiens
gctcctggagc

SEQ ID NO: 438066 - DNA, 15 bp, Homo sapiens
gctcctggagccagc

SEQ ID NO: 438067 - DNA, 19 bp, Homo sapiens
gctcctggagccagccacc

SEQ ID NO: 438068 - DNA, 16 bp, Homo sapiens
gctcctggctgccagg

SEQ ID NO: 438069 - DNA, 23 bp, Homo sapiens
gctcctgggggttctttcttcct

SEQ ID NO: 438070 - DNA, 22 bp, Homo sapiens
gctcctggtatgggtttctccc

SEQ ID NO: 438071 - DNA, 13 bp, Homo sapiens
gctcctgtctcca

SEQ ID NO: 438072 - DNA, 19 bp, Homo sapiens
gctccttcagcagctagag

SEQ ID NO: 438073 - DNA, 17 bp, Homo sapiens
gctccttcatgcttttc

SEQ ID NO: 438074 - DNA, 23 bp, Homo sapiens
gctccttgaagacatatcatgtg

SEQ ID NO: 438075 - DNA, 17 bp, Homo sapiens
gctccttggagcaggca

SEQ ID NO: 438076 - DNA, 16 bp, Homo sapiens
gctccttgttcctaga

SEQ ID NO: 438077 - DNA, 12 bp, Homo sapiens
gctcctttccca

SEQ ID NO: 438078 - DNA, 15 bp, Homo sapiens
gctcctttcccacag

SEQ ID NO: 438079 - DNA, 17 bp, Homo sapiens
gctcctttctccagcca

SEQ ID NO: 438080 - DNA, 15 bp, Homo sapiens
gctccttttctcttt

SEQ ID NO: 438081 - DNA, 12 bp, Homo sapiens
gctccttttctg

SEQ ID NO: 438082 - DNA, 23 bp, Homo sapiens
gctccttttctggtgttacacat

SEQ ID NO: 438083 - DNA, 17 bp, Homo sapiens
gctccttttctgtgaag

SEQ ID NO: 438084 - DNA, 21 bp, Homo sapiens
gctcgagcagtcctgcctcag

SEQ ID NO: 438085 - DNA, 14 bp, Homo sapiens
gctcgatgcctttg

SEQ ID NO: 438086 - DNA, 13 bp, Homo sapiens
gctcgccccaccc

SEQ ID NO: 438087 - DNA, 17 bp, Homo sapiens
gctcgccccacccaggg

SEQ ID NO: 438088 - DNA, 18 bp, Homo sapiens
gctcgccccacccagggc

SEQ ID NO: 438089 - DNA, 15 bp, Homo sapiens
gctcggacccacccc

SEQ ID NO: 438090 - DNA, 16 bp, Homo sapiens
gctcggacccacccca

SEQ ID NO: 438091 - DNA, 17 bp, Homo sapiens
gctcgggaaggcctgag

SEQ ID NO: 438092 - DNA, 18 bp, Homo sapiens
gctcgggaaggcctgagg

SEQ ID NO: 438093 - DNA, 15 bp, Homo sapiens
gctcgtggccttccc

SEQ ID NO: 438094 - DNA, 16 bp, Homo sapiens
gctcgtgggctctggc

SEQ ID NO: 438095 - DNA, 18 bp, Homo sapiens
gctcgtgggctctggctc

SEQ ID NO: 438096 - DNA, 19 bp, Homo sapiens
gctcgtgggctctggctcc

SEQ ID NO: 438097 - DNA, 17 bp, Homo sapiens
gctcgtgtatcctgggg

SEQ ID NO: 438098 - DNA, 18 bp, Homo sapiens
gctcgtttttcagcaccc

SEQ ID NO: 438099 - DNA, 17 bp, Homo sapiens
gctctaatagagtcaca

SEQ ID NO: 438100 - DNA, 17 bp, Homo sapiens
gctctacacaacatgta

SEQ ID NO: 438101 - DNA, 18 bp, Homo sapiens
gctctacacaacatgtat

SEQ ID NO: 438102 - DNA, 22 bp, Homo sapiens
gctctacagctaatcagcattc

SEQ ID NO: 438103 - DNA, 13 bp, Homo sapiens
gctctacccatga

SEQ ID NO: 438104 - DNA, 19 bp, Homo sapiens
gctctagccaggagtctgt

SEQ ID NO: 438105 - DNA, 22 bp, Homo sapiens
gctctagccaggagtctgtgct

SEQ ID NO: 438106 - DNA, 13 bp, Homo sapiens
gctctagctggca

SEQ ID NO: 438107 - DNA, 14 bp, Homo sapiens
gctctagctggcag

SEQ ID NO: 438108 - DNA, 15 bp, Homo sapiens
gctctagctggcagg

SEQ ID NO: 438109 - DNA, 21 bp, Homo sapiens
gctctagggttgctggagcct

SEQ ID NO: 438110 - DNA, 23 bp, Homo sapiens
gctctagggttgctggagcctga

SEQ ID NO: 438111 - DNA, 24 bp, Homo sapiens
gctctagggttgctggagcctgag

SEQ ID NO: 438112 - DNA, 18 bp, Homo sapiens
gctctatctctcaaaact

SEQ ID NO: 438113 - DNA, 18 bp, Homo sapiens
gctctatttcggaaatac

SEQ ID NO: 438114 - DNA, 23 bp, Homo sapiens
gctctcaatatataataaatggg

SEQ ID NO: 438115 - DNA, 18 bp, Homo sapiens
gctctcacccccatccct

SEQ ID NO: 438116 - DNA, 14 bp, Homo sapiens
gctctcactggcca

SEQ ID NO: 438117 - DNA, 22 bp, Homo sapiens
gctctccaaaccactttttgca

SEQ ID NO: 438118 - DNA, 16 bp, Homo sapiens
gctctccaaaggggct

SEQ ID NO: 438119 - DNA, 21 bp, Homo sapiens
gctctccaaaggggctgctgg

SEQ ID NO: 438120 - DNA, 22 bp, Homo sapiens
gctctccaaaggggctgctggg

SEQ ID NO: 438121 - DNA, 21 bp, Homo sapiens
gctctccacccccaccactct

SEQ ID NO: 438122 - DNA, 22 bp, Homo sapiens
gctctccatcataggctgacac

SEQ ID NO: 438123 - DNA, 18 bp, Homo sapiens
gctctcccctctcgcccc

SEQ ID NO: 438124 - DNA, 13 bp, Homo sapiens
gctctcccctgcg

SEQ ID NO: 438125 - DNA, 17 bp, Homo sapiens
gctctcccctgcgcagg

SEQ ID NO: 438126 - DNA, 21 bp, Homo sapiens
gctctcccctgcgcaggccct

SEQ ID NO: 438127 - DNA, 23 bp, Homo sapiens
gctctccctctctgcacctgtct

SEQ ID NO: 438128 - DNA, 14 bp, Homo sapiens
gctctccctcttct

SEQ ID NO: 438129 - DNA, 21 bp, Homo sapiens
gctctccctcttctcaagtgc

SEQ ID NO: 438130 - DNA, 24 bp, Homo sapiens
gctctccctcttctcaagtgcctt

SEQ ID NO: 438131 - DNA, 14 bp, Homo sapiens
gctctcctgacttt

SEQ ID NO: 438132 - DNA, 16 bp, Homo sapiens
gctctcctgactttta

SEQ ID NO: 438133 - DNA, 15 bp, Homo sapiens
gctctcctgggccag

SEQ ID NO: 438134 - DNA, 20 bp, Homo sapiens
gctctcctgggccagggtct

SEQ ID NO: 438135 - DNA, 20 bp, Homo sapiens
gctctccttgccctgggcca

SEQ ID NO: 438136 - DNA, 21 bp, Homo sapiens
gctctccttgccctgggccag

SEQ ID NO: 438137 - DNA, 19 bp, Homo sapiens
gctctcgtccctctgctcc

SEQ ID NO: 438138 - DNA, 21 bp, Homo sapiens
gctctcgtccctctgctccgt

SEQ ID NO: 438139 - DNA, 20 bp, Homo sapiens
gctgctcccctccctcctct

SEQ ID NO: 438140 - DNA, 14 bp, Homo sapiens
gctgctcctcgcag

SEQ ID NO: 438141 - DNA, 15 bp, Homo sapiens
gctgctcctctttcc

SEQ ID NO: 438142 - DNA, 19 bp, Homo sapiens
gctgctcctctttcccctc

SEQ ID NO: 438143 - DNA, 16 bp, Homo sapiens
gctgctcgggaaggcc

SEQ ID NO: 438144 - DNA, 20 bp, Homo sapiens
gctgctcgggaaggcctgag

SEQ ID NO: 438145 - DNA, 15 bp, Homo sapiens
gctgctctagctggc

SEQ ID NO: 438146 - DNA, 22 bp, Homo sapiens
gctgctctagctggcaggacac

SEQ ID NO: 438147 - DNA, 23 bp, Homo sapiens
gctgctctattgtagcatttctt

SEQ ID NO: 438148 - DNA, 12 bp, Homo sapiens
gctgctctgccc

SEQ ID NO: 438149 - DNA, 15 bp, Homo sapiens
gctgctctgcccaga

SEQ ID NO: 438150 - DNA, 16 bp, Homo sapiens
gctgctctgcccagag

SEQ ID NO: 438151 - DNA, 13 bp, Homo sapiens
gctgctctgcccc

SEQ ID NO: 438152 - DNA, 22 bp, Homo sapiens
gctgctctgccccttgggcatc

SEQ ID NO: 438153 - DNA, 18 bp, Homo sapiens
gctgctcttagtgcccgc

SEQ ID NO: 438154 - DNA, 17 bp, Homo sapiens
gctgctcttgcatctgg

SEQ ID NO: 438155 - DNA, 21 bp, Homo sapiens
gctgctcttgcatctgggcca

SEQ ID NO: 438156 - DNA, 23 bp, Homo sapiens
gctgctgacgtttgacaccaggg

SEQ ID NO: 438157 - DNA, 15 bp, Homo sapiens
gctgctgcaccaacc

SEQ ID NO: 438158 - DNA, 22 bp, Homo sapiens
gctgctgccaccaaatctgtct

SEQ ID NO: 438159 - DNA, 18 bp, Homo sapiens
gctgctgcctccctgggg

SEQ ID NO: 438160 - DNA, 16 bp, Homo sapiens
gctgctgcctgcctgg

SEQ ID NO: 438161 - DNA, 15 bp, Homo sapiens
gctgctgctgcgccc

SEQ ID NO: 438162 - DNA, 12 bp, Homo sapiens
gctgctgctgct

SEQ ID NO: 438163 - DNA, 21 bp, Homo sapiens
gctgctggacagtatcactgt

SEQ ID NO: 438164 - DNA, 14 bp, Homo sapiens
gctgctggaggaaa

SEQ ID NO: 438165 - DNA, 13 bp, Homo sapiens
gctgctggccagg

SEQ ID NO: 438166 - DNA, 22 bp, Homo sapiens
gctgctggggcatgtgtgcctg

SEQ ID NO: 438167 - DNA, 23 bp, Homo sapiens
gctgctggggcatgtgtgcctgt

SEQ ID NO: 438168 - DNA, 13 bp, Homo sapiens
gctgctggttttg

SEQ ID NO: 438169 - DNA, 20 bp, Homo sapiens
gctgctggttttggtttcca

SEQ ID NO: 438170 - DNA, 18 bp, Homo sapiens
gctgctgtaactgctgag

SEQ ID NO: 438171 - DNA, 21 bp, Homo sapiens
gctgctgtaactgctgagcca

SEQ ID NO: 438172 - DNA, 12 bp, Homo sapiens
gctgctgtgaat

SEQ ID NO: 438173 - DNA, 14 bp, Homo sapiens
gctgctgtgaattt

SEQ ID NO: 438174 - DNA, 14 bp, Homo sapiens
gctgctgtgcctgc

SEQ ID NO: 438175 - DNA, 21 bp, Homo sapiens
gctgcttccctctgcctgtcc

SEQ ID NO: 438176 - DNA, 23 bp, Homo sapiens
gctgcttccctctgcctgtccct

SEQ ID NO: 438177 - DNA, 14 bp, Homo sapiens
gctgcttcctaact

SEQ ID NO: 438178 - DNA, 15 bp, Homo sapiens
gctgcttctccacct

SEQ ID NO: 438179 - DNA, 11 bp, Homo sapiens
gctgcttctgt

SEQ ID NO: 438180 - DNA, 21 bp, Homo sapiens
gctgcttcttaaccccagtaa

SEQ ID NO: 438181 - DNA, 21 bp, Homo sapiens
gctgcttgaaacttcagccct

SEQ ID NO: 438182 - DNA, 16 bp, Homo sapiens
gctgcttgtgcctccc

SEQ ID NO: 438183 - DNA, 17 bp, Homo sapiens
gctgcttgtgcctccct

SEQ ID NO: 438184 - DNA, 18 bp, Homo sapiens
gctgcttgtgcctccctt

SEQ ID NO: 438185 - DNA, 23 bp, Homo sapiens
gctgcttgtgcctcccttcccag

SEQ ID NO: 438186 - DNA, 19 bp, Homo sapiens
gctgctttccaacacacaa

SEQ ID NO: 438187 - DNA, 13 bp, Homo sapiens
gctgctttccttc

SEQ ID NO: 438188 - DNA, 15 bp, Homo sapiens
gctggaaagaggaga

SEQ ID NO: 438189 - DNA, 17 bp, Homo sapiens
gctggaaagaggagaag

SEQ ID NO: 438190 - DNA, 21 bp, Homo sapiens
gctggaaattcttatttcccc

SEQ ID NO: 438191 - DNA, 16 bp, Homo sapiens
gctggaacactgtact

SEQ ID NO: 438192 - DNA, 17 bp, Homo sapiens
gctggaaggcagggcag

SEQ ID NO: 438193 - DNA, 20 bp, Homo sapiens
gctggaatccagaaggaagc

SEQ ID NO: 438194 - DNA, 20 bp, Homo sapiens
gctggaatggggacctgggg

SEQ ID NO: 438195 - DNA, 18 bp, Homo sapiens
gctggacaagaagctgct

SEQ ID NO: 438196 - DNA, 14 bp, Homo sapiens
gctggacaggtctg

SEQ ID NO: 438197 - DNA, 15 bp, Homo sapiens
gctggacaggtctgg

SEQ ID NO: 438198 - DNA, 21 bp, Homo sapiens
gctggacttttgcagcttcct

SEQ ID NO: 438199 - DNA, 19 bp, Homo sapiens
gctggagacttcctctggt

SEQ ID NO: 438200 - DNA, 13 bp, Homo sapiens
gctggagaggtta

SEQ ID NO: 438201 - DNA, 13 bp, Homo sapiens
gctggagagtaga

SEQ ID NO: 438202 - DNA, 22 bp, Homo sapiens
gctggagccaatggtgagggct

SEQ ID NO: 438203 - DNA, 23 bp, Homo sapiens
gctggagcctgagtcagggccca

SEQ ID NO: 438204 - DNA, 12 bp, Homo sapiens
gctggagctggc

SEQ ID NO: 438205 - DNA, 22 bp, Homo sapiens
gctggagctggcgtctgtcttc

SEQ ID NO: 438206 - DNA, 20 bp, Homo sapiens
gctggaggcagactcgaggg

SEQ ID NO: 438207 - DNA, 19 bp, Homo sapiens
gctggagtcctgttctcag

SEQ ID NO: 438208 - DNA, 17 bp, Homo sapiens
gctggagtgctgcttgt

SEQ ID NO: 438209 - DNA, 16 bp, Homo sapiens
gctggcaagcagggaa

SEQ ID NO: 438210 - DNA, 21 bp, Homo sapiens
gctggcaaggtgggttccagg

SEQ ID NO: 438211 - DNA, 12 bp, Homo sapiens
gctggcacagac

SEQ ID NO: 438212 - DNA, 16 bp, Homo sapiens
gctggcagaggggaca

SEQ ID NO: 438213 - DNA, 18 bp, Homo sapiens
gctggcagctctccagtc

SEQ ID NO: 438214 - DNA, 21 bp, Homo sapiens
gctggcaggagacactggtct

SEQ ID NO: 438215 - DNA, 20 bp, Homo sapiens
gctggcaggagggtggcact

SEQ ID NO: 438216 - DNA, 12 bp, Homo sapiens
gctggcaggtgt

SEQ ID NO: 438217 - DNA, 13 bp, Homo sapiens
gctggccaaagtc

SEQ ID NO: 438218 - DNA, 21 bp, Homo sapiens
gctggccagcaaggcaggttg

SEQ ID NO: 438219 - DNA, 10 bp, Homo sapiens
gctggcccca

SEQ ID NO: 438220 - DNA, 14 bp, Homo sapiens
gctggcccctcacc

SEQ ID NO: 438221 - DNA, 23 bp, Homo sapiens
gctggcccctcacctgggcacct

SEQ ID NO: 438222 - DNA, 13 bp, Homo sapiens
gctggcccgggga

SEQ ID NO: 438223 - DNA, 17 bp, Homo sapiens
gctggccctgccctccc

SEQ ID NO: 438224 - DNA, 18 bp, Homo sapiens
gctggccgggcacagctg

SEQ ID NO: 438225 - DNA, 19 bp, Homo sapiens
gctggccgggcacagctgt

SEQ ID NO: 438226 - DNA, 21 bp, Homo sapiens
gctggccgggcacagctgtgg

SEQ ID NO: 438227 - DNA, 20 bp, Homo sapiens
gctggccgggttggaggcct

SEQ ID NO: 438228 - DNA, 22 bp, Homo sapiens
gctggccggtccaccccgtccc

SEQ ID NO: 438229 - DNA, 23 bp, Homo sapiens
gctggcctcaaacagccacgagg

SEQ ID NO: 438230 - DNA, 20 bp, Homo sapiens
gctggcctcccaataaagct

SEQ ID NO: 438231 - DNA, 22 bp, Homo sapiens
gctggcctcccaataaagctgg

SEQ ID NO: 438232 - DNA, 22 bp, Homo sapiens
gctggcctgcgcctgcacctgc

SEQ ID NO: 438233 - DNA, 12 bp, Homo sapiens
gctggccttcct

SEQ ID NO: 438234 - DNA, 15 bp, Homo sapiens
gctggccttcctgcc

SEQ ID NO: 438235 - DNA, 20 bp, Homo sapiens
gctggcggaacctggctgcg

SEQ ID NO: 438236 - DNA, 18 bp, Homo sapiens
gctggctccacgccctgg

SEQ ID NO: 438237 - DNA, 17 bp, Homo sapiens
gctggctgaaaatcact

SEQ ID NO: 438238 - DNA, 18 bp, Homo sapiens
gctggctgaaaatcacta

SEQ ID NO: 438239 - DNA, 16 bp, Homo sapiens
gctggctgaggcttgg

SEQ ID NO: 438240 - DNA, 21 bp, Homo sapiens
gctggctgagtggaatgcagg

SEQ ID NO: 438241 - DNA, 11 bp, Homo sapiens
gctggctgcct

SEQ ID NO: 438242 - DNA, 14 bp, Homo sapiens
gctggctggcaggt

SEQ ID NO: 438243 - DNA, 22 bp, Homo sapiens
gctggctgttggcccctctgct

SEQ ID NO: 438244 - DNA, 16 bp, Homo sapiens
gctggcttccgctgtc

SEQ ID NO: 438245 - DNA, 21 bp, Homo sapiens
gctggcttctccctggactct

SEQ ID NO: 438246 - DNA, 15 bp, Homo sapiens
gctgggacacagacc

SEQ ID NO: 438247 - DNA, 12 bp, Homo sapiens
gctgggacccct

SEQ ID NO: 438248 - DNA, 22 bp, Homo sapiens
gctgggacccctcccaacctca

SEQ ID NO: 438249 - DNA, 17 bp, Homo sapiens
gctgggagaaaagccag

SEQ ID NO: 438250 - DNA, 13 bp, Homo sapiens
gctgggagagcca

SEQ ID NO: 438251 - DNA, 16 bp, Homo sapiens
gctgggagagccaagg

SEQ ID NO: 438252 - DNA, 16 bp, Homo sapiens
gctgggagcctcgccc

SEQ ID NO: 438253 - DNA, 21 bp, Homo sapiens
gctgggagggatagagggggg

SEQ ID NO: 438254 - DNA, 22 bp, Homo sapiens
gctgggagggggcccttccaga

SEQ ID NO: 438255 - DNA, 18 bp, Homo sapiens
gctgggattacaggtgtg

SEQ ID NO: 438256 - DNA, 22 bp, Homo sapiens
gctgggatttcttcgctgctct

SEQ ID NO: 438257 - DNA, 24 bp, Homo sapiens
gctgggatttcttcgctgctctag

SEQ ID NO: 438258 - DNA, 20 bp, Homo sapiens
gctgggcacggctccgaggg

SEQ ID NO: 438259 - DNA, 13 bp, Homo sapiens
gctgggcagaggg

SEQ ID NO: 438260 - DNA, 19 bp, Homo sapiens
gctgggcagaggggagagg

SEQ ID NO: 438261 - DNA, 13 bp, Homo sapiens
gctgggcagggcc

SEQ ID NO: 438262 - DNA, 15 bp, Homo sapiens
gctgggcagggccgc

SEQ ID NO: 438263 - DNA, 22 bp, Homo sapiens
gctgggcaggtcctggggaggc

SEQ ID NO: 438264 - DNA, 23 bp, Homo sapiens
gctgggcaggtcctggggaggct

SEQ ID NO: 438265 - DNA, 22 bp, Homo sapiens
gctgggcatggtaccagccctg

SEQ ID NO: 438266 - DNA, 16 bp, Homo sapiens
gctgggcccagaggca

SEQ ID NO: 438267 - DNA, 14 bp, Homo sapiens
gctgggccccatgc

SEQ ID NO: 438268 - DNA, 20 bp, Homo sapiens
gcttcttgtgtttgaaacac

SEQ ID NO: 438269 - DNA, 22 bp, Homo sapiens
gcttctttactactgcaagttc

SEQ ID NO: 438270 - DNA, 15 bp, Homo sapiens
gcttcttttgaactg

SEQ ID NO: 438271 - DNA, 16 bp, Homo sapiens
gcttgacaggacagca

SEQ ID NO: 438272 - DNA, 18 bp, Homo sapiens
gcttgaccgtactctcac

SEQ ID NO: 438273 - DNA, 20 bp, Homo sapiens
gcttgaccgtactctcacat

SEQ ID NO: 438274 - DNA, 16 bp, Homo sapiens
gcttgactcaggattt

SEQ ID NO: 438275 - DNA, 14 bp, Homo sapiens
gcttgagcccagga

SEQ ID NO: 438276 - DNA, 16 bp, Homo sapiens
gcttgagcctccccca

SEQ ID NO: 438277 - DNA, 20 bp, Homo sapiens
gcttgagcctcccccaaagc

SEQ ID NO: 438278 - DNA, 17 bp, Homo sapiens
gcttgagctcccctgga

SEQ ID NO: 438279 - DNA, 21 bp, Homo sapiens
gcttgattctaaaggggacag

SEQ ID NO: 438280 - DNA, 23 bp, Homo sapiens
gcttgcaagtatgttttagcatg

SEQ ID NO: 438281 - DNA, 21 bp, Homo sapiens
gcttgcactttgtgagtattc

SEQ ID NO: 438282 - DNA, 23 bp, Homo sapiens
gcttgcatttctttatttctgtc

SEQ ID NO: 438283 - DNA, 13 bp, Homo sapiens
gcttgcccagggt

SEQ ID NO: 438284 - DNA, 18 bp, Homo sapiens
gcttgcccgctcccacag

SEQ ID NO: 438285 - DNA, 20 bp, Homo sapiens
gcttgccgagcctaatgaaa

SEQ ID NO: 438286 - DNA, 18 bp, Homo sapiens
gcttgccgggcctgggcc

SEQ ID NO: 438287 - DNA, 15 bp, Homo sapiens
gcttgcgtgctggga

SEQ ID NO: 438288 - DNA, 18 bp, Homo sapiens
gcttgcgtgctgggacag

SEQ ID NO: 438289 - DNA, 22 bp, Homo sapiens
gcttgcgttagaatgaggagga

SEQ ID NO: 438290 - DNA, 14 bp, Homo sapiens
gcttgctcattttt

SEQ ID NO: 438291 - DNA, 15 bp, Homo sapiens
gcttgctccagggtc

SEQ ID NO: 438292 - DNA, 14 bp, Homo sapiens
gcttgctgttccca

SEQ ID NO: 438293 - DNA, 12 bp, Homo sapiens
gcttgcttgccg

SEQ ID NO: 438294 - DNA, 23 bp, Homo sapiens
gcttggacctcgtgctttaagtg

SEQ ID NO: 438295 - DNA, 16 bp, Homo sapiens
gcttggacttcctggg

SEQ ID NO: 438296 - DNA, 22 bp, Homo sapiens
gcttggacttcctggggccccg

SEQ ID NO: 438297 - DNA, 13 bp, Homo sapiens
gcttggcagccga

SEQ ID NO: 438298 - DNA, 19 bp, Homo sapiens
gcttggcgtggagcaggcg

SEQ ID NO: 438299 - DNA, 13 bp, Homo sapiens
gcttggctgagcc

SEQ ID NO: 438300 - DNA, 19 bp, Homo sapiens
gcttggctgagccccctct

SEQ ID NO: 438301 - DNA, 13 bp, Homo sapiens
gcttggctgcccc

SEQ ID NO: 438302 - DNA, 16 bp, Homo sapiens
gcttggctgtcccctc

SEQ ID NO: 438303 - DNA, 20 bp, Homo sapiens
gcttgggaggaagcccagta

SEQ ID NO: 438304 - DNA, 15 bp, Homo sapiens
gcttgggcccagctg

SEQ ID NO: 438305 - DNA, 19 bp, Homo sapiens
gcttgggcccagctgggct

SEQ ID NO: 438306 - DNA, 20 bp, Homo sapiens
gcttgggcccagctgggctc

SEQ ID NO: 438307 - DNA, 20 bp, Homo sapiens
gcttgggcccagtagcccca

SEQ ID NO: 438308 - DNA, 23 bp, Homo sapiens
gcttgggcttccatttgtgtgtg

SEQ ID NO: 438309 - DNA, 11 bp, Homo sapiens
gcttggggcta

SEQ ID NO: 438310 - DNA, 16 bp, Homo sapiens
gcttggggctatttgt

SEQ ID NO: 438311 - DNA, 23 bp, Homo sapiens
gcttggggctgcacctcctaccc

SEQ ID NO: 438312 - DNA, 20 bp, Homo sapiens
gcttggggtgtggggtgggg

SEQ ID NO: 438313 - DNA, 21 bp, Homo sapiens
gcttggtccctatgggcttcc

SEQ ID NO: 438314 - DNA, 19 bp, Homo sapiens
gcttggtgcggtaggtgct

SEQ ID NO: 438315 - DNA, 21 bp, Homo sapiens
gcttggtgcggtaggtgctgg

SEQ ID NO: 438316 - DNA, 18 bp, Homo sapiens
gcttggtggggctcgtgg

SEQ ID NO: 438317 - DNA, 20 bp, Homo sapiens
gcttggtggggctcgtggcc

SEQ ID NO: 438318 - DNA, 22 bp, Homo sapiens
gcttggttcctgcccccgccct

SEQ ID NO: 438319 - DNA, 17 bp, Homo sapiens
gcttgtaacaagaaaac

SEQ ID NO: 438320 - DNA, 18 bp, Homo sapiens
gcttgtaacaagaaaaca

SEQ ID NO: 438321 - DNA, 18 bp, Homo sapiens
gcttgtacatattggaaa

SEQ ID NO: 438322 - DNA, 17 bp, Homo sapiens
gcttgtactaagccagg

SEQ ID NO: 438323 - DNA, 22 bp, Homo sapiens
gcttgtactaagccaggaggct

SEQ ID NO: 438324 - DNA, 21 bp, Homo sapiens
gcttgtattatcagtgaatat

SEQ ID NO: 438325 - DNA, 15 bp, Homo sapiens
gcttgtcagagctgg

SEQ ID NO: 438326 - DNA, 19 bp, Homo sapiens
gcttgtctttaaagttact

SEQ ID NO: 438327 - DNA, 16 bp, Homo sapiens
gcttgtgatctgggaa

SEQ ID NO: 438328 - DNA, 20 bp, Homo sapiens
gcttgtgatttccatttctg

SEQ ID NO: 438329 - DNA, 18 bp, Homo sapiens
gcttgtgcctcccttccc

SEQ ID NO: 438330 - DNA, 19 bp, Homo sapiens
gcttgtgcctcccttccca

SEQ ID NO: 438331 - DNA, 21 bp, Homo sapiens
gcttgtggccccttttacttt

SEQ ID NO: 438332 - DNA, 18 bp, Homo sapiens
gcttgttccctctccctg

SEQ ID NO: 438333 - DNA, 22 bp, Homo sapiens
gcttgttcttcctcttacctgt

SEQ ID NO: 438334 - DNA, 11 bp, Homo sapiens
gcttgtttcta

SEQ ID NO: 438335 - DNA, 13 bp, Homo sapiens
gcttgtttctata

SEQ ID NO: 438336 - DNA, 22 bp, Homo sapiens
gcttgtttctatactgtttgta

SEQ ID NO: 438337 - DNA, 16 bp, Homo sapiens
gcttgttttggacttt

SEQ ID NO: 438338 - DNA, 17 bp, Homo sapiens
gctttaacaaaacaaga

SEQ ID NO: 438339 - DNA, 17 bp, Homo sapiens
gctttaagctccagctt

SEQ ID NO: 438340 - DNA, 16 bp, Homo sapiens
gctttaattgtgaatt

SEQ ID NO: 438341 - DNA, 22 bp, Homo sapiens
gctttacattttcagtaccaaa

SEQ ID NO: 438342 - DNA, 23 bp, Homo sapiens
gctttacctttattaatgaactg

SEQ ID NO: 438343 - DNA, 21 bp, Homo sapiens
gctttactctgaatttccagt

SEQ ID NO: 438344 - DNA, 18 bp, Homo sapiens
gctttagagacagggact

SEQ ID NO: 438345 - DNA, 19 bp, Homo sapiens
gctttataatttctaccca

SEQ ID NO: 438346 - DNA, 17 bp, Homo sapiens
gctttataccccatttg

SEQ ID NO: 438347 - DNA, 19 bp, Homo sapiens
gctttatgcaggattctct

SEQ ID NO: 438348 - DNA, 14 bp, Homo sapiens
gctttatgctgaaa

SEQ ID NO: 438349 - DNA, 21 bp, Homo sapiens
gctttatttgttttttttgtt

SEQ ID NO: 438350 - DNA, 13 bp, Homo sapiens
gctttatttttta

SEQ ID NO: 438351 - DNA, 16 bp, Homo sapiens
gctttcaacttaaatc

SEQ ID NO: 438352 - DNA, 19 bp, Homo sapiens
gctttcaacttaaatcact

SEQ ID NO: 438353 - DNA, 11 bp, Homo sapiens
gctttcaagtg

SEQ ID NO: 438354 - DNA, 14 bp, Homo sapiens
gctttcacaaatat

SEQ ID NO: 438355 - DNA, 18 bp, Homo sapiens
gctttcagggcctccagc

SEQ ID NO: 438356 - DNA, 14 bp, Homo sapiens
gctttcatcctgtg

SEQ ID NO: 438357 - DNA, 16 bp, Homo sapiens
gctttcatcctgtgtc

SEQ ID NO: 438358 - DNA, 17 bp, Homo sapiens
gctttcatcctgtgtcc

SEQ ID NO: 438359 - DNA, 20 bp, Homo sapiens
gctttcatcctgtgtcccct

SEQ ID NO: 438360 - DNA, 19 bp, Homo sapiens
gctttccagaaggccacag

SEQ ID NO: 438361 - DNA, 18 bp, Homo sapiens
gctttccagggtctttac

SEQ ID NO: 438362 - DNA, 20 bp, Homo sapiens
gctttcccccaggcgcctgc

SEQ ID NO: 438363 - DNA, 14 bp, Homo sapiens
gctttccctggctc

SEQ ID NO: 438364 - DNA, 17 bp, Homo sapiens
gctttcccttccagttc

SEQ ID NO: 438365 - DNA, 18 bp, Homo sapiens
gctttccggggaggagcc

SEQ ID NO: 438366 - DNA, 12 bp, Homo sapiens
gctttcctgccc

SEQ ID NO: 438367 - DNA, 23 bp, Homo sapiens
gctttccttcggaatccagtgct

SEQ ID NO: 438368 - DNA, 14 bp, Homo sapiens
gctttctaattaaa

SEQ ID NO: 438369 - DNA, 14 bp, Homo sapiens
gctttctactcatt

SEQ ID NO: 438370 - DNA, 21 bp, Homo sapiens
gctttctccggggtctgtgct

SEQ ID NO: 438371 - DNA, 16 bp, Homo sapiens
gctttctctttcagta

SEQ ID NO: 438372 - DNA, 17 bp, Homo sapiens
gctttgacatgaaaaga

SEQ ID NO: 438373 - DNA, 14 bp, Homo sapiens
gctttgatcccttc

SEQ ID NO: 438374 - DNA, 17 bp, Homo sapiens
gctttgatcccttctta

SEQ ID NO: 438375 - DNA, 20 bp, Homo sapiens
gctttgattccatctccttg

SEQ ID NO: 438376 - DNA, 22 bp, Homo sapiens
gctttgcaccgtggtcagaggg

SEQ ID NO: 438377 - DNA, 14 bp, Homo sapiens
gctttgcaggctct

SEQ ID NO: 438378 - DNA, 18 bp, Homo sapiens
gctttgcaggctctgggc

SEQ ID NO: 438379 - DNA, 19 bp, Homo sapiens
gctttgcaggctctgggct

SEQ ID NO: 438380 - DNA, 12 bp, Homo sapiens
gctttgcagtga

SEQ ID NO: 438381 - DNA, 21 bp, Homo sapiens
gctttgccatgggcctgctgc

SEQ ID NO: 438382 - DNA, 20 bp, Homo sapiens
gctttgcctggttttgtctt

SEQ ID NO: 438383 - DNA, 13 bp, Homo sapiens
gctttgccttcca

SEQ ID NO: 438384 - DNA, 15 bp, Homo sapiens
gctttgctgctatga

SEQ ID NO: 438385 - DNA, 14 bp, Homo sapiens
gctttggctgactg

SEQ ID NO: 438386 - DNA, 19 bp, Homo sapiens
gctttgggaggccaaggca

SEQ ID NO: 438387 - DNA, 21 bp, Homo sapiens
gctttgggaggccaaggcagg

SEQ ID NO: 438388 - DNA, 17 bp, Homo sapiens
gctttgtaaactccaca

SEQ ID NO: 438389 - DNA, 17 bp, Homo sapiens
gctttgtccatgatgtc

SEQ ID NO: 438390 - DNA, 19 bp, Homo sapiens
gctttgtcccacagcttgg

SEQ ID NO: 438391 - DNA, 15 bp, Homo sapiens
gctttgtgtgattga

SEQ ID NO: 438392 - DNA, 17 bp, Homo sapiens
gctttgttaccttaaaa

SEQ ID NO: 438393 - DNA, 20 bp, Homo sapiens
gctttgtttgtttgttttct

SEQ ID NO: 438394 - DNA, 15 bp, Homo sapiens
gcttttaagaaacac

SEQ ID NO: 438395 - DNA, 13 bp, Homo sapiens
gcttttaataaaa

SEQ ID NO: 438396 - DNA, 17 bp, Homo sapiens
gcttttacggtgatatt

SEQ ID NO: 438397 - DNA, 14 bp, Homo sapiens
ggagaagggacagc

SEQ ID NO: 438398 - DNA, 15 bp, Homo sapiens
ggagaagggacagcg

SEQ ID NO: 438399 - DNA, 16 bp, Homo sapiens
ggagaagggagaacag

SEQ ID NO: 438400 - DNA, 12 bp, Homo sapiens
ggagaagggctt

SEQ ID NO: 438401 - DNA, 15 bp, Homo sapiens
ggagaagtggcccct

SEQ ID NO: 438402 - DNA, 15 bp, Homo sapiens
ggagaataaatttgg

SEQ ID NO: 438403 - DNA, 12 bp, Homo sapiens
ggagaatatgat

SEQ ID NO: 438404 - DNA, 16 bp, Homo sapiens
ggagaatctgagggca

SEQ ID NO: 438405 - DNA, 22 bp, Homo sapiens
ggagacaatgcagatgccagag

SEQ ID NO: 438406 - DNA, 23 bp, Homo sapiens
ggagacaatgcagatgccagagc

SEQ ID NO: 438407 - DNA, 19 bp, Homo sapiens
ggagacacagatggcacct

SEQ ID NO: 438408 - DNA, 23 bp, Homo sapiens
ggagacacagatggcacctgtgg

SEQ ID NO: 438409 - DNA, 17 bp, Homo sapiens
ggagacagtaacatttc

SEQ ID NO: 438410 - DNA, 17 bp, Homo sapiens
ggagacagtcaggaagc

SEQ ID NO: 438411 - DNA, 19 bp, Homo sapiens
ggagaccaagtcctggcta

SEQ ID NO: 438412 - DNA, 18 bp, Homo sapiens
ggagaccagaagtgaatg

SEQ ID NO: 438413 - DNA, 15 bp, Homo sapiens
ggagaccaggactct

SEQ ID NO: 438414 - DNA, 23 bp, Homo sapiens
ggagaccaggactctgccttcca

SEQ ID NO: 438415 - DNA, 19 bp, Homo sapiens
ggagaccctgggagagtga

SEQ ID NO: 438416 - DNA, 14 bp, Homo sapiens
ggagaccctgtctt

SEQ ID NO: 438417 - DNA, 22 bp, Homo sapiens
ggagaccgagtgtggagctgct

SEQ ID NO: 438418 - DNA, 15 bp, Homo sapiens
ggagaccgcttcacc

SEQ ID NO: 438419 - DNA, 19 bp, Homo sapiens
ggagaccgcttcacccctg

SEQ ID NO: 438420 - DNA, 13 bp, Homo sapiens
ggagacctgtgct

SEQ ID NO: 438421 - DNA, 15 bp, Homo sapiens
ggagacctgtgctag

SEQ ID NO: 438422 - DNA, 19 bp, Homo sapiens
ggagactagattgcctttg

SEQ ID NO: 438423 - DNA, 17 bp, Homo sapiens
ggagactcctgccctgt

SEQ ID NO: 438424 - DNA, 23 bp, Homo sapiens
ggagactgataacttggggaggc

SEQ ID NO: 438425 - DNA, 13 bp, Homo sapiens
ggagagaaaaaag

SEQ ID NO: 438426 - DNA, 12 bp, Homo sapiens
ggagagaaaaca

SEQ ID NO: 438427 - DNA, 21 bp, Homo sapiens
ggagagaaggggaggagggcg

SEQ ID NO: 438428 - DNA, 18 bp, Homo sapiens
ggagagaccagcctttct

SEQ ID NO: 438429 - DNA, 15 bp, Homo sapiens
ggagagactgaaagc

SEQ ID NO: 438430 - DNA, 18 bp, Homo sapiens
ggagagactgaaagcagc

SEQ ID NO: 438431 - DNA, 19 bp, Homo sapiens
ggagagactgaaagcagca

SEQ ID NO: 438432 - DNA, 21 bp, Homo sapiens
ggagagactgaaagcagcagc

SEQ ID NO: 438433 - DNA, 14 bp, Homo sapiens
ggagagactggcca

SEQ ID NO: 438434 - DNA, 16 bp, Homo sapiens
ggagagactggccaga

SEQ ID NO: 438435 - DNA, 14 bp, Homo sapiens
ggagagactgtgag

SEQ ID NO: 438436 - DNA, 14 bp, Homo sapiens
ggagagagagagag

SEQ ID NO: 438437 - DNA, 15 bp, Homo sapiens
ggagagagagagaga

SEQ ID NO: 438438 - DNA, 19 bp, Homo sapiens
ggagagagtgagagagagt

SEQ ID NO: 438439 - DNA, 10 bp, Homo sapiens
ggagagcagc

SEQ ID NO: 438440 - DNA, 11 bp, Homo sapiens
ggagagcagct

SEQ ID NO: 438441 - DNA, 14 bp, Homo sapiens
ggagagcagctggc

SEQ ID NO: 438442 - DNA, 12 bp, Homo sapiens
ggagagcaggct

SEQ ID NO: 438443 - DNA, 16 bp, Homo sapiens
ggagagcaggctggca

SEQ ID NO: 438444 - DNA, 23 bp, Homo sapiens
ggagagcaggctggcagctctcc

SEQ ID NO: 438445 - DNA, 19 bp, Homo sapiens
ggagagcatcaccaccaca

SEQ ID NO: 438446 - DNA, 17 bp, Homo sapiens
ggagagccaacctcggc

SEQ ID NO: 438447 - DNA, 21 bp, Homo sapiens
ggagagcccccaccagcagca

SEQ ID NO: 438448 - DNA, 14 bp, Homo sapiens
ggagagcggaggag

SEQ ID NO: 438449 - DNA, 17 bp, Homo sapiens
ggagagcggaggaggaa

SEQ ID NO: 438450 - DNA, 15 bp, Homo sapiens
ggagagctggtgccc

SEQ ID NO: 438451 - DNA, 18 bp, Homo sapiens
ggagagctggtgcccgga

SEQ ID NO: 438452 - DNA, 17 bp, Homo sapiens
ggagaggaaaagccagt

SEQ ID NO: 438453 - DNA, 16 bp, Homo sapiens
ggagaggaactccttg

SEQ ID NO: 438454 - DNA, 11 bp, Homo sapiens
ggagaggaagc

SEQ ID NO: 438455 - DNA, 13 bp, Homo sapiens
ggagaggaagcac

SEQ ID NO: 438456 - DNA, 20 bp, Homo sapiens
ggagaggaagccacgtgctg

SEQ ID NO: 438457 - DNA, 12 bp, Homo sapiens
ggagaggagagc

SEQ ID NO: 438458 - DNA, 14 bp, Homo sapiens
ggagaggagagcat

SEQ ID NO: 438459 - DNA, 14 bp, Homo sapiens
ggagaggagtgcgc

SEQ ID NO: 438460 - DNA, 19 bp, Homo sapiens
ggagagggaaatacaagga

SEQ ID NO: 438461 - DNA, 23 bp, Homo sapiens
ggagagggaaatacaaggagggc

SEQ ID NO: 438462 - DNA, 22 bp, Homo sapiens
ggagagggacagcccactgaga

SEQ ID NO: 438463 - DNA, 16 bp, Homo sapiens
ggagagggagcaagcc

SEQ ID NO: 438464 - DNA, 17 bp, Homo sapiens
ggagagggagcaagcct

SEQ ID NO: 438465 - DNA, 22 bp, Homo sapiens
ggagagggggtaatggaggcca

SEQ ID NO: 438466 - DNA, 20 bp, Homo sapiens
ggagagtacccccctgagag

SEQ ID NO: 438467 - DNA, 21 bp, Homo sapiens
ggagagtcccagagcaggagg

SEQ ID NO: 438468 - DNA, 22 bp, Homo sapiens
ggagagtcccagagcaggaggc

SEQ ID NO: 438469 - DNA, 12 bp, Homo sapiens
ggagagtgaggt

SEQ ID NO: 438470 - DNA, 21 bp, Homo sapiens
ggagagtgaggtcatcccggg

SEQ ID NO: 438471 - DNA, 18 bp, Homo sapiens
ggagagtggttgttgcca

SEQ ID NO: 438472 - DNA, 21 bp, Homo sapiens
ggagagttctttgctgcccct

SEQ ID NO: 438473 - DNA, 23 bp, Homo sapiens
ggagataccagagactctgaaac

SEQ ID NO: 438474 - DNA, 23 bp, Homo sapiens
ggagatagtgccaggtggctcag

SEQ ID NO: 438475 - DNA, 14 bp, Homo sapiens
ggagatccgccctg

SEQ ID NO: 438476 - DNA, 16 bp, Homo sapiens
ggagatccgccctggg

SEQ ID NO: 438477 - DNA, 22 bp, Homo sapiens
ggagatccgccctgggctctgg

SEQ ID NO: 438478 - DNA, 18 bp, Homo sapiens
ggagatcggggccagagg

SEQ ID NO: 438479 - DNA, 13 bp, Homo sapiens
ggagatgaaaacc

SEQ ID NO: 438480 - DNA, 19 bp, Homo sapiens
ggagatgtaatgacagaga

SEQ ID NO: 438481 - DNA, 21 bp, Homo sapiens
ggagatgtaatgacagagagt

SEQ ID NO: 438482 - DNA, 22 bp, Homo sapiens
ggagatgtaatgacagagagtt

SEQ ID NO: 438483 - DNA, 12 bp, Homo sapiens
ggagattgcttt

SEQ ID NO: 438484 - DNA, 16 bp, Homo sapiens
ggagattttaggtgtt

SEQ ID NO: 438485 - DNA, 11 bp, Homo sapiens
ggagcaaaaca

SEQ ID NO: 438486 - DNA, 19 bp, Homo sapiens
ggagcaaaaggcagctcac

SEQ ID NO: 438487 - DNA, 15 bp, Homo sapiens
ggagcaagacagaga

SEQ ID NO: 438488 - DNA, 16 bp, Homo sapiens
ggagcacagccctggg

SEQ ID NO: 438489 - DNA, 14 bp, Homo sapiens
ggagcacccccagc

SEQ ID NO: 438490 - DNA, 15 bp, Homo sapiens
ggagcacccccagcc

SEQ ID NO: 438491 - DNA, 16 bp, Homo sapiens
ggagcacccccagcct

SEQ ID NO: 438492 - DNA, 17 bp, Homo sapiens
ggagcacccccagcctc

SEQ ID NO: 438493 - DNA, 18 bp, Homo sapiens
ggagcacttgcgtcctgc

SEQ ID NO: 438494 - DNA, 19 bp, Homo sapiens
ggagcacttgcgtcctgca

SEQ ID NO: 438495 - DNA, 14 bp, Homo sapiens
ggagcagagaaggc

SEQ ID NO: 438496 - DNA, 15 bp, Homo sapiens
ggagcagcctccaag

SEQ ID NO: 438497 - DNA, 14 bp, Homo sapiens
ggagcagctgagat

SEQ ID NO: 438498 - DNA, 11 bp, Homo sapiens
ggagcagctgt

SEQ ID NO: 438499 - DNA, 14 bp, Homo sapiens
ggagcagctgtgct

SEQ ID NO: 438500 - DNA, 15 bp, Homo sapiens
ggagcagctgtgctg

SEQ ID NO: 438501 - DNA, 21 bp, Homo sapiens
ggagcaggcggtggggagaga

SEQ ID NO: 438502 - DNA, 23 bp, Homo sapiens
ggagcaggcggtggggagagatg

SEQ ID NO: 438503 - DNA, 18 bp, Homo sapiens
ggagcagtgtcttccata

SEQ ID NO: 438504 - DNA, 15 bp, Homo sapiens
ggagcatcccaggcg

SEQ ID NO: 438505 - DNA, 16 bp, Homo sapiens
ggagcatgggcctggc

SEQ ID NO: 438506 - DNA, 16 bp, Homo sapiens
ggagcattctgcctgc

SEQ ID NO: 438507 - DNA, 22 bp, Homo sapiens
ggagcattctgcctgcctggga

SEQ ID NO: 438508 - DNA, 23 bp, Homo sapiens
ggagcattctgcctgcctgggaa

SEQ ID NO: 438509 - DNA, 15 bp, Homo sapiens
ggagcattttgtgtc

SEQ ID NO: 438510 - DNA, 16 bp, Homo sapiens
ggagcattttgtgtct

SEQ ID NO: 438511 - DNA, 16 bp, Homo sapiens
ggagccaatgaacagc

SEQ ID NO: 438512 - DNA, 16 bp, Homo sapiens
ggagccacctgggctg

SEQ ID NO: 438513 - DNA, 11 bp, Homo sapiens
ggagccactcc

SEQ ID NO: 438514 - DNA, 18 bp, Homo sapiens
ggagccactcctgtcccg

SEQ ID NO: 438515 - DNA, 12 bp, Homo sapiens
ggagccagcagg

SEQ ID NO: 438516 - DNA, 14 bp, Homo sapiens
ggagccagcagggc

SEQ ID NO: 438517 - DNA, 12 bp, Homo sapiens
ggagccagctct

SEQ ID NO: 438518 - DNA, 10 bp, Homo sapiens
ggagccaggt

SEQ ID NO: 438519 - DNA, 16 bp, Homo sapiens
ggagccaggtgtcctg

SEQ ID NO: 438520 - DNA, 14 bp, Homo sapiens
ggagccatgctctt

SEQ ID NO: 438521 - DNA, 23 bp, Homo sapiens
ggagccatgtctacaaaagcaaa

SEQ ID NO: 438522 - DNA, 22 bp, Homo sapiens
ggagcccaggcctggcctcggg

SEQ ID NO: 438523 - DNA, 16 bp, Homo sapiens
ggagccccagccagcc

SEQ ID NO: 438524 - DNA, 22 bp, Homo sapiens
ggagcccccagatagagctggg

SEQ ID NO: 438525 - DNA, 23 bp, Homo sapiens
ggagcccctcctctgagcagcct

SEQ ID NO: 438526 - DNA, 13 bp, Homo sapiens
ggagcccctgtgt

SEQ ID NO: 438527 - DNA, 20 bp, Homo sapiens
ggagcccctgtgtgggaggg

SEQ ID NO: 438528 - DNA, 21 bp, Homo sapiens
ggcagaggttgtggtgagccg

SEQ ID NO: 438529 - DNA, 22 bp, Homo sapiens
ggcagagtgccccacctgccac

SEQ ID NO: 438530 - DNA, 17 bp, Homo sapiens
ggcagatctgtgcccca

SEQ ID NO: 438531 - DNA, 21 bp, Homo sapiens
ggcagattttacaaaagatgt

SEQ ID NO: 438532 - DNA, 13 bp, Homo sapiens
ggcagcaaaggaa

SEQ ID NO: 438533 - DNA, 12 bp, Homo sapiens
ggcagcaggagc

SEQ ID NO: 438534 - DNA, 15 bp, Homo sapiens
ggcagccaggctgcc

SEQ ID NO: 438535 - DNA, 22 bp, Homo sapiens
ggcagccagggagcccggggca

SEQ ID NO: 438536 - DNA, 12 bp, Homo sapiens
ggcagcccagag

SEQ ID NO: 438537 - DNA, 18 bp, Homo sapiens
ggcagcccctgctggacc

SEQ ID NO: 438538 - DNA, 13 bp, Homo sapiens
ggcagccgagctc

SEQ ID NO: 438539 - DNA, 17 bp, Homo sapiens
ggcagccgctaggagag

SEQ ID NO: 438540 - DNA, 24 bp, Homo sapiens
ggcagcctccagagccagcctggg

SEQ ID NO: 438541 - DNA, 12 bp, Homo sapiens
ggcagcctgccg

SEQ ID NO: 438542 - DNA, 22 bp, Homo sapiens
ggcagcctgccgccgtctctgt

SEQ ID NO: 438543 - DNA, 19 bp, Homo sapiens
ggcagcctggctcccagga

SEQ ID NO: 438544 - DNA, 22 bp, Homo sapiens
ggcagcctggctcccaggacac

SEQ ID NO: 438545 - DNA, 18 bp, Homo sapiens
ggcagcctgtgggagaag

SEQ ID NO: 438546 - DNA, 14 bp, Homo sapiens
ggcagcgctcctgg

SEQ ID NO: 438547 - DNA, 14 bp, Homo sapiens
ggcagctcacccct

SEQ ID NO: 438548 - DNA, 17 bp, Homo sapiens
ggcagctcacccctggg

SEQ ID NO: 438549 - DNA, 21 bp, Homo sapiens
ggcagctcacccctgggcagg

SEQ ID NO: 438550 - DNA, 22 bp, Homo sapiens
ggcagctcacccctgggcaggc

SEQ ID NO: 438551 - DNA, 14 bp, Homo sapiens
ggcagctcctctcc

SEQ ID NO: 438552 - DNA, 18 bp, Homo sapiens
ggcagctcctctccttgg

SEQ ID NO: 438553 - DNA, 22 bp, Homo sapiens
ggcagctcctctccttgggctc

SEQ ID NO: 438554 - DNA, 11 bp, Homo sapiens
ggcagctctcc

SEQ ID NO: 438555 - DNA, 14 bp, Homo sapiens
ggcagctctccagt

SEQ ID NO: 438556 - DNA, 24 bp, Homo sapiens
ggcagctcttctgggcagagcctg

SEQ ID NO: 438557 - DNA, 20 bp, Homo sapiens
ggcagctgaaaagtaaattg

SEQ ID NO: 438558 - DNA, 23 bp, Homo sapiens
ggcagctgaggacacaccccaca

SEQ ID NO: 438559 - DNA, 13 bp, Homo sapiens
ggcagctgctctt

SEQ ID NO: 438560 - DNA, 23 bp, Homo sapiens
ggcagctgctcttagtgcccgcc

SEQ ID NO: 438561 - DNA, 16 bp, Homo sapiens
ggcagctggatgagac

SEQ ID NO: 438562 - DNA, 13 bp, Homo sapiens
ggcagctgggccc

SEQ ID NO: 438563 - DNA, 20 bp, Homo sapiens
ggcagctgggccccacctac

SEQ ID NO: 438564 - DNA, 21 bp, Homo sapiens
ggcagctgggccccacctact

SEQ ID NO: 438565 - DNA, 19 bp, Homo sapiens
ggcagctggggagcagctg

SEQ ID NO: 438566 - DNA, 20 bp, Homo sapiens
ggcagctggggggctgtcct

SEQ ID NO: 438567 - DNA, 21 bp, Homo sapiens
ggcagctggggggctgtcctg

SEQ ID NO: 438568 - DNA, 23 bp, Homo sapiens
ggcaggaaggagagcctgctgca

SEQ ID NO: 438569 - DNA, 16 bp, Homo sapiens
ggcaggaagtcaggag

SEQ ID NO: 438570 - DNA, 18 bp, Homo sapiens
ggcaggaagtcaggagcc

SEQ ID NO: 438571 - DNA, 23 bp, Homo sapiens
ggcaggaagtcaggagccagcag

SEQ ID NO: 438572 - DNA, 19 bp, Homo sapiens
ggcaggaatcaaggagcct

SEQ ID NO: 438573 - DNA, 12 bp, Homo sapiens
ggcaggacacat

SEQ ID NO: 438574 - DNA, 16 bp, Homo sapiens
ggcaggacacatcccg

SEQ ID NO: 438575 - DNA, 20 bp, Homo sapiens
ggcaggacgagactcctcgg

SEQ ID NO: 438576 - DNA, 18 bp, Homo sapiens
ggcaggagagagccttgg

SEQ ID NO: 438577 - DNA, 13 bp, Homo sapiens
ggcaggagctcag

SEQ ID NO: 438578 - DNA, 18 bp, Homo sapiens
ggcaggaggccattccag

SEQ ID NO: 438579 - DNA, 16 bp, Homo sapiens
ggcaggagggtggcac

SEQ ID NO: 438580 - DNA, 15 bp, Homo sapiens
ggcaggccagctgtg

SEQ ID NO: 438581 - DNA, 11 bp, Homo sapiens
ggcaggccctg

SEQ ID NO: 438582 - DNA, 12 bp, Homo sapiens
ggcaggccctgc

SEQ ID NO: 438583 - DNA, 12 bp, Homo sapiens
ggcaggcctggg

SEQ ID NO: 438584 - DNA, 15 bp, Homo sapiens
ggcaggcctttccta

SEQ ID NO: 438585 - DNA, 15 bp, Homo sapiens
ggcagggagggaaac

SEQ ID NO: 438586 - DNA, 15 bp, Homo sapiens
ggcagggaggtcagg

SEQ ID NO: 438587 - DNA, 13 bp, Homo sapiens
ggcagggcagagg

SEQ ID NO: 438588 - DNA, 14 bp, Homo sapiens
ggcagggcagaggg

SEQ ID NO: 438589 - DNA, 15 bp, Homo sapiens
ggcagggcagaggga

SEQ ID NO: 438590 - DNA, 15 bp, Homo sapiens
ggcagggcatctcct

SEQ ID NO: 438591 - DNA, 19 bp, Homo sapiens
ggcagggcccatctgccgc

SEQ ID NO: 438592 - DNA, 23 bp, Homo sapiens
ggcagggccctggggtctctgag

SEQ ID NO: 438593 - DNA, 13 bp, Homo sapiens
ggcagggcctggc

SEQ ID NO: 438594 - DNA, 14 bp, Homo sapiens
ggcagggcctggcc

SEQ ID NO: 438595 - DNA, 21 bp, Homo sapiens
ggcagggctcccacagagaca

SEQ ID NO: 438596 - DNA, 14 bp, Homo sapiens
ggcagggctctgat

SEQ ID NO: 438597 - DNA, 14 bp, Homo sapiens
ggcaggggagccag

SEQ ID NO: 438598 - DNA, 20 bp, Homo sapiens
ggcaggggcccctcctctgt

SEQ ID NO: 438599 - DNA, 11 bp, Homo sapiens
ggcaggggctc

SEQ ID NO: 438600 - DNA, 14 bp, Homo sapiens
ggcaggggctgggc

SEQ ID NO: 438601 - DNA, 18 bp, Homo sapiens
ggcagggttctagaaggg

SEQ ID NO: 438602 - DNA, 24 bp, Homo sapiens
ggcaggtagatcgcttgagcccag

SEQ ID NO: 438603 - DNA, 18 bp, Homo sapiens
ggcaggtcccgagccccc

SEQ ID NO: 438604 - DNA, 19 bp, Homo sapiens
ggcaggtcccgagccccct

SEQ ID NO: 438605 - DNA, 18 bp, Homo sapiens
ggcaggtcctggggaggc

SEQ ID NO: 438606 - DNA, 20 bp, Homo sapiens
ggcaggtcctggggaggctg

SEQ ID NO: 438607 - DNA, 13 bp, Homo sapiens
ggcaggtgcagat

SEQ ID NO: 438608 - DNA, 19 bp, Homo sapiens
ggcaggtgcagatgggctg

SEQ ID NO: 438609 - DNA, 23 bp, Homo sapiens
ggcaggtgccccgtggtacattc

SEQ ID NO: 438610 - DNA, 16 bp, Homo sapiens
ggcaggtgggagcttg

SEQ ID NO: 438611 - DNA, 17 bp, Homo sapiens
ggcaggtgttgggacct

SEQ ID NO: 438612 - DNA, 23 bp, Homo sapiens
ggcaggtgttgggacctgctgct

SEQ ID NO: 438613 - DNA, 19 bp, Homo sapiens
ggcaggttgatcagtgagc

SEQ ID NO: 438614 - DNA, 20 bp, Homo sapiens
ggcaggttggatgggagtgg

SEQ ID NO: 438615 - DNA, 13 bp, Homo sapiens
ggcagtacctggg

SEQ ID NO: 438616 - DNA, 21 bp, Homo sapiens
ggcagtagaaggtcggaggct

SEQ ID NO: 438617 - DNA, 16 bp, Homo sapiens
ggcagtagcagctgtg

SEQ ID NO: 438618 - DNA, 13 bp, Homo sapiens
ggcagtatggcgg

SEQ ID NO: 438619 - DNA, 21 bp, Homo sapiens
ggcagtatggcggaggccatg

SEQ ID NO: 438620 - DNA, 23 bp, Homo sapiens
ggcagtatggcggaggccatggg

SEQ ID NO: 438621 - DNA, 15 bp, Homo sapiens
ggcagtctgaaccct

SEQ ID NO: 438622 - DNA, 16 bp, Homo sapiens
ggcagtctggaggggc

SEQ ID NO: 438623 - DNA, 18 bp, Homo sapiens
ggcagtgacgtgagtggg

SEQ ID NO: 438624 - DNA, 18 bp, Homo sapiens
ggcagtgactggcaggtg

SEQ ID NO: 438625 - DNA, 16 bp, Homo sapiens
ggcagtgcacccccta

SEQ ID NO: 438626 - DNA, 14 bp, Homo sapiens
ggcagtgcccacca

SEQ ID NO: 438627 - DNA, 11 bp, Homo sapiens
ggcagtggaga

SEQ ID NO: 438628 - DNA, 23 bp, Homo sapiens
ggcagtggcttggagcagaggtg

SEQ ID NO: 438629 - DNA, 13 bp, Homo sapiens
ggcagtgggagac

SEQ ID NO: 438630 - DNA, 18 bp, Homo sapiens
ggcagtggggctgggggt

SEQ ID NO: 438631 - DNA, 21 bp, Homo sapiens
ggcagttctcactcctaggag

SEQ ID NO: 438632 - DNA, 14 bp, Homo sapiens
ggcagttggccaga

SEQ ID NO: 438633 - DNA, 16 bp, Homo sapiens
ggcatactctccagga

SEQ ID NO: 438634 - DNA, 18 bp, Homo sapiens
ggcatactctccaggatt

SEQ ID NO: 438635 - DNA, 17 bp, Homo sapiens
ggcataggcctgggtgc

SEQ ID NO: 438636 - DNA, 22 bp, Homo sapiens
ggcatataattttcacttctgt

SEQ ID NO: 438637 - DNA, 13 bp, Homo sapiens
ggcatcaaagatg

SEQ ID NO: 438638 - DNA, 18 bp, Homo sapiens
ggcatcaaagatgagaag

SEQ ID NO: 438639 - DNA, 19 bp, Homo sapiens
ggcatcagctttccctggc

SEQ ID NO: 438640 - DNA, 14 bp, Homo sapiens
ggcatcaggcactg

SEQ ID NO: 438641 - DNA, 15 bp, Homo sapiens
ggcatcaggcactgg

SEQ ID NO: 438642 - DNA, 15 bp, Homo sapiens
ggcatccacccagtg

SEQ ID NO: 438643 - DNA, 20 bp, Homo sapiens
ggcatccacccagtgctgcc

SEQ ID NO: 438644 - DNA, 15 bp, Homo sapiens
ggcatccacttcaca

SEQ ID NO: 438645 - DNA, 18 bp, Homo sapiens
ggcatccagtatcttgaa

SEQ ID NO: 438646 - DNA, 21 bp, Homo sapiens
ggcatcccagtggcctcaacc

SEQ ID NO: 438647 - DNA, 18 bp, Homo sapiens
ggcatccccagccccctg

SEQ ID NO: 438648 - DNA, 21 bp, Homo sapiens
ggcatccccagccccctggcc

SEQ ID NO: 438649 - DNA, 19 bp, Homo sapiens
ggcatccttctgccttttt

SEQ ID NO: 438650 - DNA, 18 bp, Homo sapiens
ggcatccttgaggacctc

SEQ ID NO: 438651 - DNA, 12 bp, Homo sapiens
ggcatctccagg

SEQ ID NO: 438652 - DNA, 12 bp, Homo sapiens
ggcatctcctct

SEQ ID NO: 438653 - DNA, 23 bp, Homo sapiens
ggcatctctccccatatataaat

SEQ ID NO: 438654 - DNA, 15 bp, Homo sapiens
ggcatctctggagtg

SEQ ID NO: 438655 - DNA, 16 bp, Homo sapiens
ggcatctctggagtgt

SEQ ID NO: 438656 - DNA, 20 bp, Homo sapiens
ggcatctctgggctgagcct

SEQ ID NO: 438657 - DNA, 21 bp, Homo sapiens
ggcatctctgggctgagccta

SEQ ID NO: 438658 - DNA, 16 bp, Homo sapiens
ggcccctcctctgtgc

SEQ ID NO: 438659 - DNA, 23 bp, Homo sapiens
ggcccctcctctgtgctccctcg

SEQ ID NO: 438660 - DNA, 23 bp, Homo sapiens
ggcccctccttctcccctccaga

SEQ ID NO: 438661 - DNA, 24 bp, Homo sapiens
ggcccctctgactcccaaagagct

SEQ ID NO: 438662 - DNA, 17 bp, Homo sapiens
ggcccctctgcccagct

SEQ ID NO: 438663 - DNA, 12 bp, Homo sapiens
ggcccctctgct

SEQ ID NO: 438664 - DNA, 15 bp, Homo sapiens
ggcccctctgctgtc

SEQ ID NO: 438665 - DNA, 16 bp, Homo sapiens
ggcccctgaggactgg

SEQ ID NO: 438666 - DNA, 19 bp, Homo sapiens
ggcccctgaggactggaga

SEQ ID NO: 438667 - DNA, 12 bp, Homo sapiens
ggcccctggcac

SEQ ID NO: 438668 - DNA, 13 bp, Homo sapiens
ggcccctggccca

SEQ ID NO: 438669 - DNA, 13 bp, Homo sapiens
ggcccctggtggc

SEQ ID NO: 438670 - DNA, 16 bp, Homo sapiens
ggcccgacagcctggc

SEQ ID NO: 438671 - DNA, 21 bp, Homo sapiens
ggcccgagatgtgacccacca

SEQ ID NO: 438672 - DNA, 21 bp, Homo sapiens
ggcccgagcgcgtgccttccc

SEQ ID NO: 438673 - DNA, 14 bp, Homo sapiens
ggcccgcagtggct

SEQ ID NO: 438674 - DNA, 12 bp, Homo sapiens
ggcccgcccctc

SEQ ID NO: 438675 - DNA, 14 bp, Homo sapiens
ggcccgcccctcgc

SEQ ID NO: 438676 - DNA, 22 bp, Homo sapiens
ggcccgctcaacctctcagatc

SEQ ID NO: 438677 - DNA, 16 bp, Homo sapiens
ggcccggcccacgcag

SEQ ID NO: 438678 - DNA, 22 bp, Homo sapiens
ggcccggcccacgcagagcccc

SEQ ID NO: 438679 - DNA, 13 bp, Homo sapiens
ggcccgggcaggc

SEQ ID NO: 438680 - DNA, 14 bp, Homo sapiens
ggcccgggcaggcc

SEQ ID NO: 438681 - DNA, 17 bp, Homo sapiens
ggcccgggcccctggca

SEQ ID NO: 438682 - DNA, 14 bp, Homo sapiens
ggcccgtgcgcagc

SEQ ID NO: 438683 - DNA, 17 bp, Homo sapiens
ggcccgtgcgcagccgc

SEQ ID NO: 438684 - DNA, 11 bp, Homo sapiens
ggccctaggca

SEQ ID NO: 438685 - DNA, 23 bp, Homo sapiens
ggccctaggcatactctccagga

SEQ ID NO: 438686 - DNA, 14 bp, Homo sapiens
ggccctccatgggc

SEQ ID NO: 438687 - DNA, 13 bp, Homo sapiens
ggccctcccttgg

SEQ ID NO: 438688 - DNA, 22 bp, Homo sapiens
ggccctctgccgaccgcctgct

SEQ ID NO: 438689 - DNA, 23 bp, Homo sapiens
ggccctctgccgaccgcctgctt

SEQ ID NO: 438690 - DNA, 17 bp, Homo sapiens
ggccctgcaagggcgtg

SEQ ID NO: 438691 - DNA, 23 bp, Homo sapiens
ggccctgcagtgttcgcttggct

SEQ ID NO: 438692 - DNA, 10 bp, Homo sapiens
ggccctgccc

SEQ ID NO: 438693 - DNA, 11 bp, Homo sapiens
ggccctgccca

SEQ ID NO: 438694 - DNA, 20 bp, Homo sapiens
ggccctgccccacacaggcc

SEQ ID NO: 438695 - DNA, 17 bp, Homo sapiens
ggccctgccctccccca

SEQ ID NO: 438696 - DNA, 23 bp, Homo sapiens
ggccctgccctcccccacggccg

SEQ ID NO: 438697 - DNA, 13 bp, Homo sapiens
ggccctggctggg

SEQ ID NO: 438698 - DNA, 12 bp, Homo sapiens
ggccctggggaa

SEQ ID NO: 438699 - DNA, 12 bp, Homo sapiens
ggccctggggtc

SEQ ID NO: 438700 - DNA, 13 bp, Homo sapiens
ggccctggggtcc

SEQ ID NO: 438701 - DNA, 12 bp, Homo sapiens
ggccctggtgga

SEQ ID NO: 438702 - DNA, 15 bp, Homo sapiens
ggcccttcctctcca

SEQ ID NO: 438703 - DNA, 20 bp, Homo sapiens
ggcccttcctggactggccc

SEQ ID NO: 438704 - DNA, 14 bp, Homo sapiens
ggcccttgtcctgc

SEQ ID NO: 438705 - DNA, 17 bp, Homo sapiens
ggcccttttctggctcc

SEQ ID NO: 438706 - DNA, 19 bp, Homo sapiens
ggccgaatcccctccctgt

SEQ ID NO: 438707 - DNA, 13 bp, Homo sapiens
ggccgaggacttt

SEQ ID NO: 438708 - DNA, 15 bp, Homo sapiens
ggccgagtccaggag

SEQ ID NO: 438709 - DNA, 17 bp, Homo sapiens
ggccgagtccaggagcc

SEQ ID NO: 438710 - DNA, 21 bp, Homo sapiens
ggccgagtccaggagccccag

SEQ ID NO: 438711 - DNA, 22 bp, Homo sapiens
ggccgcacctaaagcagccagc

SEQ ID NO: 438712 - DNA, 19 bp, Homo sapiens
ggccgcatggcccctccag

SEQ ID NO: 438713 - DNA, 13 bp, Homo sapiens
ggccgcccacctg

SEQ ID NO: 438714 - DNA, 18 bp, Homo sapiens
ggccgcccagacaccaca

SEQ ID NO: 438715 - DNA, 14 bp, Homo sapiens
ggccgcctcctcca

SEQ ID NO: 438716 - DNA, 18 bp, Homo sapiens
ggccgcctcctccagact

SEQ ID NO: 438717 - DNA, 14 bp, Homo sapiens
ggccgcctggcagg

SEQ ID NO: 438718 - DNA, 18 bp, Homo sapiens
ggccgcctggcaggtgga

SEQ ID NO: 438719 - DNA, 13 bp, Homo sapiens
ggccgctagaggc

SEQ ID NO: 438720 - DNA, 15 bp, Homo sapiens
ggccgctagaggcct

SEQ ID NO: 438721 - DNA, 18 bp, Homo sapiens
ggccgctagaggcctgag

SEQ ID NO: 438722 - DNA, 21 bp, Homo sapiens
ggccgctcttcccccatgtgc

SEQ ID NO: 438723 - DNA, 15 bp, Homo sapiens
ggccggcagcctggt

SEQ ID NO: 438724 - DNA, 13 bp, Homo sapiens
ggccggccagctc

SEQ ID NO: 438725 - DNA, 14 bp, Homo sapiens
ggccggccagctcc

SEQ ID NO: 438726 - DNA, 14 bp, Homo sapiens
ggccggccccaggc

SEQ ID NO: 438727 - DNA, 12 bp, Homo sapiens
ggccgggcacag

SEQ ID NO: 438728 - DNA, 15 bp, Homo sapiens
ggccgggcacagctg

SEQ ID NO: 438729 - DNA, 16 bp, Homo sapiens
ggccgggctgctgctg

SEQ ID NO: 438730 - DNA, 14 bp, Homo sapiens
ggccgggctggctt

SEQ ID NO: 438731 - DNA, 23 bp, Homo sapiens
ggccgtcacgctttcatgaccac

SEQ ID NO: 438732 - DNA, 23 bp, Homo sapiens
ggccgtccctgacttcccagctg

SEQ ID NO: 438733 - DNA, 15 bp, Homo sapiens
ggccgtcctcccggg

SEQ ID NO: 438734 - DNA, 21 bp, Homo sapiens
ggccgtcctcccgggccctcc

SEQ ID NO: 438735 - DNA, 13 bp, Homo sapiens
ggccgtggctgcc

SEQ ID NO: 438736 - DNA, 18 bp, Homo sapiens
ggccgttccccttggctt

SEQ ID NO: 438737 - DNA, 15 bp, Homo sapiens
ggcctaatttacaag

SEQ ID NO: 438738 - DNA, 15 bp, Homo sapiens
ggcctagtcagatgg

SEQ ID NO: 438739 - DNA, 20 bp, Homo sapiens
ggcctagtggcttcagcccc

SEQ ID NO: 438740 - DNA, 21 bp, Homo sapiens
ggcctagtggggaggggcctg

SEQ ID NO: 438741 - DNA, 17 bp, Homo sapiens
ggcctatgccacctgca

SEQ ID NO: 438742 - DNA, 18 bp, Homo sapiens
ggcctcaaccctccctca

SEQ ID NO: 438743 - DNA, 22 bp, Homo sapiens
ggcctcaaccctccctcagccc

SEQ ID NO: 438744 - DNA, 13 bp, Homo sapiens
ggcctcacccaga

SEQ ID NO: 438745 - DNA, 15 bp, Homo sapiens
ggcctcaccctgctt

SEQ ID NO: 438746 - DNA, 23 bp, Homo sapiens
ggcctcaccctgcttggggcctg

SEQ ID NO: 438747 - DNA, 13 bp, Homo sapiens
ggcctcacctggc

SEQ ID NO: 438748 - DNA, 19 bp, Homo sapiens
ggcctcacctggcttccca

SEQ ID NO: 438749 - DNA, 20 bp, Homo sapiens
ggcctcacctggcttcccag

SEQ ID NO: 438750 - DNA, 21 bp, Homo sapiens
ggcctcacctggcttcccagg

SEQ ID NO: 438751 - DNA, 15 bp, Homo sapiens
ggcctcactccagga

SEQ ID NO: 438752 - DNA, 14 bp, Homo sapiens
ggcctcactggctg

SEQ ID NO: 438753 - DNA, 20 bp, Homo sapiens
ggcctcagtggactttccac

SEQ ID NO: 438754 - DNA, 22 bp, Homo sapiens
ggcctcagtggactttccaccc

SEQ ID NO: 438755 - DNA, 19 bp, Homo sapiens
ggcctcagtttctccatca

SEQ ID NO: 438756 - DNA, 21 bp, Homo sapiens
ggcctcagtttctccatcagc

SEQ ID NO: 438757 - DNA, 21 bp, Homo sapiens
ggcctcatccctcggaagccg

SEQ ID NO: 438758 - DNA, 14 bp, Homo sapiens
ggcctcatcctcct

SEQ ID NO: 438759 - DNA, 15 bp, Homo sapiens
ggcctcatcctcctg

SEQ ID NO: 438760 - DNA, 14 bp, Homo sapiens
ggcctccagcctct

SEQ ID NO: 438761 - DNA, 14 bp, Homo sapiens
ggcctccaggctgg

SEQ ID NO: 438762 - DNA, 18 bp, Homo sapiens
ggcctccaggctggggcc

SEQ ID NO: 438763 - DNA, 13 bp, Homo sapiens
ggcctcccaaagt

SEQ ID NO: 438764 - DNA, 20 bp, Homo sapiens
ggcctcccaataaagctgga

SEQ ID NO: 438765 - DNA, 13 bp, Homo sapiens
ggcctcccaccag

SEQ ID NO: 438766 - DNA, 19 bp, Homo sapiens
ggcctcccagccacccgga

SEQ ID NO: 438767 - DNA, 14 bp, Homo sapiens
ggcctcccccagcc

SEQ ID NO: 438768 - DNA, 18 bp, Homo sapiens
ggcctcccccagccagga

SEQ ID NO: 438769 - DNA, 14 bp, Homo sapiens
ggcctcccctgctg

SEQ ID NO: 438770 - DNA, 15 bp, Homo sapiens
ggcctcccctgctga

SEQ ID NO: 438771 - DNA, 18 bp, Homo sapiens
ggcctccgaggctccccg

SEQ ID NO: 438772 - DNA, 21 bp, Homo sapiens
ggcctcctcttcaccccggca

SEQ ID NO: 438773 - DNA, 14 bp, Homo sapiens
ggcctcctgggaag

SEQ ID NO: 438774 - DNA, 20 bp, Homo sapiens
ggcctccttgtccaggtctc

SEQ ID NO: 438775 - DNA, 14 bp, Homo sapiens
ggcctcggcagaac

SEQ ID NO: 438776 - DNA, 22 bp, Homo sapiens
ggcctcggcagaactctctgtc

SEQ ID NO: 438777 - DNA, 22 bp, Homo sapiens
ggcctctgaaatttcccacacc

SEQ ID NO: 438778 - DNA, 17 bp, Homo sapiens
ggcctctgactctgagt

SEQ ID NO: 438779 - DNA, 15 bp, Homo sapiens
ggcctctgcctccag

SEQ ID NO: 438780 - DNA, 13 bp, Homo sapiens
ggcctctggctgc

SEQ ID NO: 438781 - DNA, 14 bp, Homo sapiens
ggcctctggctgcc

SEQ ID NO: 438782 - DNA, 17 bp, Homo sapiens
ggcctctggctgcctgg

SEQ ID NO: 438783 - DNA, 21 bp, Homo sapiens
ggcctctggctgcctggccca

SEQ ID NO: 438784 - DNA, 19 bp, Homo sapiens
ggcctctggtgttcctggc

SEQ ID NO: 438785 - DNA, 15 bp, Homo sapiens
ggcctcttccaccca

SEQ ID NO: 438786 - DNA, 16 bp, Homo sapiens
ggcctcttccacccat

SEQ ID NO: 438787 - DNA, 18 bp, Homo sapiens
ggcctcttgagcagtggc

SEQ ID NO: 438788 - DNA, 16 bp, Homo sapiens
ggcctcttgtgctcac

SEQ ID NO: 438789 - DNA, 21 bp, Homo sapiens
ggctgcaaaaccggcaacctg

SEQ ID NO: 438790 - DNA, 17 bp, Homo sapiens
ggctgcaagctgcaggg

SEQ ID NO: 438791 - DNA, 13 bp, Homo sapiens
ggctgcacagccc

SEQ ID NO: 438792 - DNA, 15 bp, Homo sapiens
ggctgcacagcccaa

SEQ ID NO: 438793 - DNA, 19 bp, Homo sapiens
ggctgcacagcccaaccag

SEQ ID NO: 438794 - DNA, 13 bp, Homo sapiens
ggctgcactgcag

SEQ ID NO: 438795 - DNA, 18 bp, Homo sapiens
ggctgcagcaggcagagg

SEQ ID NO: 438796 - DNA, 18 bp, Homo sapiens
ggctgcatcctcagcccc

SEQ ID NO: 438797 - DNA, 20 bp, Homo sapiens
ggctgcatgcgggcttcctc

SEQ ID NO: 438798 - DNA, 17 bp, Homo sapiens
ggctgccaaggccagag

SEQ ID NO: 438799 - DNA, 11 bp, Homo sapiens
ggctgccaggc

SEQ ID NO: 438800 - DNA, 17 bp, Homo sapiens
ggctgcccacacacccc

SEQ ID NO: 438801 - DNA, 19 bp, Homo sapiens
ggctgcccacacaccccaa

SEQ ID NO: 438802 - DNA, 17 bp, Homo sapiens
ggctgccccacaggcca

SEQ ID NO: 438803 - DNA, 13 bp, Homo sapiens
ggctgccctggtg

SEQ ID NO: 438804 - DNA, 14 bp, Homo sapiens
ggctgccctggtgc

SEQ ID NO: 438805 - DNA, 20 bp, Homo sapiens
ggctgccgtgcacggggcca

SEQ ID NO: 438806 - DNA, 17 bp, Homo sapiens
ggctgcctctgggtgag

SEQ ID NO: 438807 - DNA, 10 bp, Homo sapiens
ggctgcctgc

SEQ ID NO: 438808 - DNA, 12 bp, Homo sapiens
ggctgcctgccg

SEQ ID NO: 438809 - DNA, 16 bp, Homo sapiens
ggctgcctgccgccca

SEQ ID NO: 438810 - DNA, 11 bp, Homo sapiens
ggctgcctgga

SEQ ID NO: 438811 - DNA, 14 bp, Homo sapiens
ggctgcctggagaa

SEQ ID NO: 438812 - DNA, 16 bp, Homo sapiens
ggctgcctggagaaag

SEQ ID NO: 438813 - DNA, 15 bp, Homo sapiens
ggctgcctggcccag

SEQ ID NO: 438814 - DNA, 21 bp, Homo sapiens
ggctgcctggcccagggagga

SEQ ID NO: 438815 - DNA, 23 bp, Homo sapiens
ggctgcctggcccagggaggaat

SEQ ID NO: 438816 - DNA, 16 bp, Homo sapiens
ggctgccttagaacct

SEQ ID NO: 438817 - DNA, 16 bp, Homo sapiens
ggctgcgaactgtgca

SEQ ID NO: 438818 - DNA, 17 bp, Homo sapiens
ggctgcgaactgtgcag

SEQ ID NO: 438819 - DNA, 19 bp, Homo sapiens
ggctgcgaactgtgcagtt

SEQ ID NO: 438820 - DNA, 19 bp, Homo sapiens
ggctgcgcctgcccgcccg

SEQ ID NO: 438821 - DNA, 23 bp, Homo sapiens
ggctgctgaaaaccatctggcct

SEQ ID NO: 438822 - DNA, 15 bp, Homo sapiens
ggctgctgacgtttg

SEQ ID NO: 438823 - DNA, 19 bp, Homo sapiens
ggctgctgctgatgtagga

SEQ ID NO: 438824 - DNA, 13 bp, Homo sapiens
ggctgctggagga

SEQ ID NO: 438825 - DNA, 13 bp, Homo sapiens
ggctgctggcaca

SEQ ID NO: 438826 - DNA, 21 bp, Homo sapiens
ggctgctggggcatgtgtgcc

SEQ ID NO: 438827 - DNA, 23 bp, Homo sapiens
ggctgctggggcatgtgtgcctg

SEQ ID NO: 438828 - DNA, 16 bp, Homo sapiens
ggctgcttctccacct

SEQ ID NO: 438829 - DNA, 14 bp, Homo sapiens
ggctggaaagagga

SEQ ID NO: 438830 - DNA, 16 bp, Homo sapiens
ggctggaaagaggaga

SEQ ID NO: 438831 - DNA, 18 bp, Homo sapiens
ggctggaaagaggagaag

SEQ ID NO: 438832 - DNA, 16 bp, Homo sapiens
ggctggagtgcgctct

SEQ ID NO: 438833 - DNA, 15 bp, Homo sapiens
ggctggatgaaattt

SEQ ID NO: 438834 - DNA, 14 bp, Homo sapiens
ggctggcaagcagg

SEQ ID NO: 438835 - DNA, 14 bp, Homo sapiens
ggctggcaggtatg

SEQ ID NO: 438836 - DNA, 20 bp, Homo sapiens
ggctggcccggggagtcccc

SEQ ID NO: 438837 - DNA, 18 bp, Homo sapiens
ggctggccctgccctccc

SEQ ID NO: 438838 - DNA, 15 bp, Homo sapiens
ggctggcctcagact

SEQ ID NO: 438839 - DNA, 10 bp, Homo sapiens
ggctggctga

SEQ ID NO: 438840 - DNA, 22 bp, Homo sapiens
ggctgggagcctcgcccctcca

SEQ ID NO: 438841 - DNA, 15 bp, Homo sapiens
ggctgggagctctgc

SEQ ID NO: 438842 - DNA, 19 bp, Homo sapiens
ggctgggcagggccgcagg

SEQ ID NO: 438843 - DNA, 12 bp, Homo sapiens
ggctgggcaggt

SEQ ID NO: 438844 - DNA, 23 bp, Homo sapiens
ggctgggcaggtcctggggaggc

SEQ ID NO: 438845 - DNA, 13 bp, Homo sapiens
ggctgggcccaga

SEQ ID NO: 438846 - DNA, 16 bp, Homo sapiens
ggctgggcccagaggc

SEQ ID NO: 438847 - DNA, 18 bp, Homo sapiens
ggctgggccctctgtcca

SEQ ID NO: 438848 - DNA, 13 bp, Homo sapiens
ggctggggcagag

SEQ ID NO: 438849 - DNA, 16 bp, Homo sapiens
ggctggggcagagggg

SEQ ID NO: 438850 - DNA, 14 bp, Homo sapiens
ggctggggcctggc

SEQ ID NO: 438851 - DNA, 16 bp, Homo sapiens
ggctgggggcaggagg

SEQ ID NO: 438852 - DNA, 14 bp, Homo sapiens
ggctggggtgagag

SEQ ID NO: 438853 - DNA, 19 bp, Homo sapiens
ggctgggtcgcccctcctc

SEQ ID NO: 438854 - DNA, 14 bp, Homo sapiens
ggctgggtgcccac

SEQ ID NO: 438855 - DNA, 17 bp, Homo sapiens
ggctgggtgggcccaga

SEQ ID NO: 438856 - DNA, 19 bp, Homo sapiens
ggctgggtgggcccagaac

SEQ ID NO: 438857 - DNA, 20 bp, Homo sapiens
ggctgggtgtttcagtttga

SEQ ID NO: 438858 - DNA, 22 bp, Homo sapiens
ggctgggtttgggcagtggaga

SEQ ID NO: 438859 - DNA, 14 bp, Homo sapiens
ggctggtattctct

SEQ ID NO: 438860 - DNA, 23 bp, Homo sapiens
ggctggtccagggctagtgactt

SEQ ID NO: 438861 - DNA, 15 bp, Homo sapiens
ggctggtgccagcct

SEQ ID NO: 438862 - DNA, 15 bp, Homo sapiens
ggctggtgccccaca

SEQ ID NO: 438863 - DNA, 16 bp, Homo sapiens
ggctggtgtggctgct

SEQ ID NO: 438864 - DNA, 14 bp, Homo sapiens
ggctgtaaaaacac

SEQ ID NO: 438865 - DNA, 21 bp, Homo sapiens
ggctgtaagcattctgagctg

SEQ ID NO: 438866 - DNA, 16 bp, Homo sapiens
ggctgtacacaccctc

SEQ ID NO: 438867 - DNA, 16 bp, Homo sapiens
ggctgtattttctttt

SEQ ID NO: 438868 - DNA, 13 bp, Homo sapiens
ggctgtcccctcc

SEQ ID NO: 438869 - DNA, 21 bp, Homo sapiens
ggctgtcctcttaagacacta

SEQ ID NO: 438870 - DNA, 22 bp, Homo sapiens
ggctgtcctttccagtggcctg

SEQ ID NO: 438871 - DNA, 20 bp, Homo sapiens
ggctgtctgcctgtattttc

SEQ ID NO: 438872 - DNA, 13 bp, Homo sapiens
ggctgtctggggc

SEQ ID NO: 438873 - DNA, 23 bp, Homo sapiens
ggctgtgaaaattacacccatgc

SEQ ID NO: 438874 - DNA, 23 bp, Homo sapiens
ggctgtgagacgaggcaggggct

SEQ ID NO: 438875 - DNA, 11 bp, Homo sapiens
ggctgtgagca

SEQ ID NO: 438876 - DNA, 22 bp, Homo sapiens
ggctgtgcacattctcccttga

SEQ ID NO: 438877 - DNA, 13 bp, Homo sapiens
ggctgtggcacag

SEQ ID NO: 438878 - DNA, 14 bp, Homo sapiens
ggctgtggcacaga

SEQ ID NO: 438879 - DNA, 16 bp, Homo sapiens
ggctgtggcccctcct

SEQ ID NO: 438880 - DNA, 17 bp, Homo sapiens
ggctgtggcccctcctt

SEQ ID NO: 438881 - DNA, 21 bp, Homo sapiens
ggctgtggcccctccttctcc

SEQ ID NO: 438882 - DNA, 14 bp, Homo sapiens
ggctgtgggtgggg

SEQ ID NO: 438883 - DNA, 12 bp, Homo sapiens
ggctgtggttcc

SEQ ID NO: 438884 - DNA, 18 bp, Homo sapiens
ggctgtgtatttctgtag

SEQ ID NO: 438885 - DNA, 21 bp, Homo sapiens
ggctgtgttgactgctgctcc

SEQ ID NO: 438886 - DNA, 13 bp, Homo sapiens
ggctgttatctgt

SEQ ID NO: 438887 - DNA, 15 bp, Homo sapiens
ggctgttggctgggg

SEQ ID NO: 438888 - DNA, 21 bp, Homo sapiens
ggctgttttagtgccaggctg

SEQ ID NO: 438889 - DNA, 14 bp, Homo sapiens
ggcttaaacatttt

SEQ ID NO: 438890 - DNA, 14 bp, Homo sapiens
ggcttaatgtttat

SEQ ID NO: 438891 - DNA, 16 bp, Homo sapiens
ggcttaatgtttattc

SEQ ID NO: 438892 - DNA, 17 bp, Homo sapiens
ggcttacacgtggagga

SEQ ID NO: 438893 - DNA, 14 bp, Homo sapiens
ggcttagagagagg

SEQ ID NO: 438894 - DNA, 19 bp, Homo sapiens
ggcttccagcgggccctct

SEQ ID NO: 438895 - DNA, 12 bp, Homo sapiens
ggcttccaggct

SEQ ID NO: 438896 - DNA, 13 bp, Homo sapiens
ggcttccaggctc

SEQ ID NO: 438897 - DNA, 17 bp, Homo sapiens
ggcttccaggctcttcc

SEQ ID NO: 438898 - DNA, 14 bp, Homo sapiens
ggcttccatggtgg

SEQ ID NO: 438899 - DNA, 22 bp, Homo sapiens
ggcttccatttgtgtgtgtgca

SEQ ID NO: 438900 - DNA, 13 bp, Homo sapiens
ggcttcccaggac

SEQ ID NO: 438901 - DNA, 14 bp, Homo sapiens
ggcttcccaggacc

SEQ ID NO: 438902 - DNA, 15 bp, Homo sapiens
ggcttcccgctcagc

SEQ ID NO: 438903 - DNA, 16 bp, Homo sapiens
ggcttcccgctcagcc

SEQ ID NO: 438904 - DNA, 21 bp, Homo sapiens
ggcttccgctgtcacccagca

SEQ ID NO: 438905 - DNA, 20 bp, Homo sapiens
ggcttcctccgtccacccag

SEQ ID NO: 438906 - DNA, 17 bp, Homo sapiens
ggcttcctgagaaagcc

SEQ ID NO: 438907 - DNA, 23 bp, Homo sapiens
ggcttcctgagaaagcccacctg

SEQ ID NO: 438908 - DNA, 22 bp, Homo sapiens
ggcttcgcgctggaatccagaa

SEQ ID NO: 438909 - DNA, 18 bp, Homo sapiens
ggcttctatgatcagaac

SEQ ID NO: 438910 - DNA, 17 bp, Homo sapiens
ggcttctccctggactc

SEQ ID NO: 438911 - DNA, 12 bp, Homo sapiens
ggcttctccttc

SEQ ID NO: 438912 - DNA, 21 bp, Homo sapiens
ggcttctccttctccttccca

SEQ ID NO: 438913 - DNA, 21 bp, Homo sapiens
ggcttctgcggtgaggcaggg

SEQ ID NO: 438914 - DNA, 18 bp, Homo sapiens
ggcttctgcttgtcatcc

SEQ ID NO: 438915 - DNA, 15 bp, Homo sapiens
ggcttctgggacctg

SEQ ID NO: 438916 - DNA, 14 bp, Homo sapiens
ggcttgacatgtgc

SEQ ID NO: 438917 - DNA, 17 bp, Homo sapiens
ggcttgactcaggattt

SEQ ID NO: 438918 - DNA, 23 bp, Homo sapiens
ggcttgcaagtatgttttagcat

SEQ ID NO: 438919 - DNA, 15 bp, Homo sapiens
ggcttgctccagggt

SEQ ID NO: 438920 - DNA, 14 bp, Homo sapiens
gggcagggccgcag

SEQ ID NO: 438921 - DNA, 15 bp, Homo sapiens
gggcagggccgcagg

SEQ ID NO: 438922 - DNA, 23 bp, Homo sapiens
gggcagggccgcccgggcccaga

SEQ ID NO: 438923 - DNA, 16 bp, Homo sapiens
gggcaggggagccagg

SEQ ID NO: 438924 - DNA, 21 bp, Homo sapiens
gggcaggtggccacagcagga

SEQ ID NO: 438925 - DNA, 17 bp, Homo sapiens
gggcaggtgggagcttg

SEQ ID NO: 438926 - DNA, 17 bp, Homo sapiens
gggcagtgactggcagg

SEQ ID NO: 438927 - DNA, 11 bp, Homo sapiens
gggcagtgccc

SEQ ID NO: 438928 - DNA, 19 bp, Homo sapiens
gggcagtgctagtgagctg

SEQ ID NO: 438929 - DNA, 21 bp, Homo sapiens
gggcagtgggacccatagatc

SEQ ID NO: 438930 - DNA, 24 bp, Homo sapiens
gggcagttctcactcctaggagag

SEQ ID NO: 438931 - DNA, 21 bp, Homo sapiens
gggcatcagctttccctggct

SEQ ID NO: 438932 - DNA, 12 bp, Homo sapiens
gggcatcaggca

SEQ ID NO: 438933 - DNA, 21 bp, Homo sapiens
gggcatcaggcactggtggca

SEQ ID NO: 438934 - DNA, 19 bp, Homo sapiens
gggcatccacccagtgctg

SEQ ID NO: 438935 - DNA, 21 bp, Homo sapiens
gggcatctgagtccagctccc

SEQ ID NO: 438936 - DNA, 14 bp, Homo sapiens
gggcatctgcccct

SEQ ID NO: 438937 - DNA, 17 bp, Homo sapiens
gggcatctgcccctccc

SEQ ID NO: 438938 - DNA, 14 bp, Homo sapiens
gggcatgccaccct

SEQ ID NO: 438939 - DNA, 16 bp, Homo sapiens
gggcatgggggaggct

SEQ ID NO: 438940 - DNA, 22 bp, Homo sapiens
gggcatgggggaggctctgaag

SEQ ID NO: 438941 - DNA, 20 bp, Homo sapiens
gggcatggggtgggcctctg

SEQ ID NO: 438942 - DNA, 21 bp, Homo sapiens
gggcatggggtgggcctctgg

SEQ ID NO: 438943 - DNA, 18 bp, Homo sapiens
gggcatggtaccagccct

SEQ ID NO: 438944 - DNA, 20 bp, Homo sapiens
gggcatggtagctcaagcct

SEQ ID NO: 438945 - DNA, 22 bp, Homo sapiens
gggcatggttccttccctggga

SEQ ID NO: 438946 - DNA, 19 bp, Homo sapiens
gggcatgtattagccagtc

SEQ ID NO: 438947 - DNA, 19 bp, Homo sapiens
gggcatgtattggcctgga

SEQ ID NO: 438948 - DNA, 20 bp, Homo sapiens
gggcatgtattggcctggag

SEQ ID NO: 438949 - DNA, 23 bp, Homo sapiens
gggcatgtttgtctgtgtgctgt

SEQ ID NO: 438950 - DNA, 17 bp, Homo sapiens
gggccaagacttggcaa

SEQ ID NO: 438951 - DNA, 22 bp, Homo sapiens
gggccaagccagggttccagac

SEQ ID NO: 438952 - DNA, 23 bp, Homo sapiens
gggccaagccagggttccagaca

SEQ ID NO: 438953 - DNA, 13 bp, Homo sapiens
gggccaaggactg

SEQ ID NO: 438954 - DNA, 15 bp, Homo sapiens
gggccaaggtcctgc

SEQ ID NO: 438955 - DNA, 14 bp, Homo sapiens
gggccacagccaga

SEQ ID NO: 438956 - DNA, 19 bp, Homo sapiens
gggccaccagctccactgg

SEQ ID NO: 438957 - DNA, 23 bp, Homo sapiens
gggccaccagctccactggcctg

SEQ ID NO: 438958 - DNA, 23 bp, Homo sapiens
gggccacccttcacgctggcttc

SEQ ID NO: 438959 - DNA, 16 bp, Homo sapiens
gggccacctccccagg

SEQ ID NO: 438960 - DNA, 15 bp, Homo sapiens
gggccacgccccagc

SEQ ID NO: 438961 - DNA, 18 bp, Homo sapiens
gggccacgccccagcccg

SEQ ID NO: 438962 - DNA, 19 bp, Homo sapiens
gggccactgccctctccac

SEQ ID NO: 438963 - DNA, 13 bp, Homo sapiens
gggccactggcat

SEQ ID NO: 438964 - DNA, 21 bp, Homo sapiens
gggccactggcatctctggag

SEQ ID NO: 438965 - DNA, 21 bp, Homo sapiens
gggccagaaggagggcagagc

SEQ ID NO: 438966 - DNA, 14 bp, Homo sapiens
gggccagagcctgg

SEQ ID NO: 438967 - DNA, 13 bp, Homo sapiens
gggccagcccctc

SEQ ID NO: 438968 - DNA, 17 bp, Homo sapiens
gggccagcccctcccac

SEQ ID NO: 438969 - DNA, 13 bp, Homo sapiens
gggccagggttgc

SEQ ID NO: 438970 - DNA, 16 bp, Homo sapiens
gggccagtagagagtg

SEQ ID NO: 438971 - DNA, 20 bp, Homo sapiens
gggccagtctgggctgccgg

SEQ ID NO: 438972 - DNA, 19 bp, Homo sapiens
gggccatgagctccagacc

SEQ ID NO: 438973 - DNA, 18 bp, Homo sapiens
gggcccaagacagatgcc

SEQ ID NO: 438974 - DNA, 19 bp, Homo sapiens
gggcccaagcatgccccac

SEQ ID NO: 438975 - DNA, 20 bp, Homo sapiens
gggcccacagacagatccca

SEQ ID NO: 438976 - DNA, 14 bp, Homo sapiens
gggcccagaggagc

SEQ ID NO: 438977 - DNA, 11 bp, Homo sapiens
gggcccagccg

SEQ ID NO: 438978 - DNA, 19 bp, Homo sapiens
gggcccagccggggtgggg

SEQ ID NO: 438979 - DNA, 12 bp, Homo sapiens
gggcccagctgt

SEQ ID NO: 438980 - DNA, 20 bp, Homo sapiens
gggcccaggagagcccccac

SEQ ID NO: 438981 - DNA, 22 bp, Homo sapiens
gggcccaggagagcccccacca

SEQ ID NO: 438982 - DNA, 22 bp, Homo sapiens
gggcccataatagttagccctc

SEQ ID NO: 438983 - DNA, 15 bp, Homo sapiens
gggcccatggcccca

SEQ ID NO: 438984 - DNA, 19 bp, Homo sapiens
gggcccatggccccagctg

SEQ ID NO: 438985 - DNA, 16 bp, Homo sapiens
gggccccaaagcccag

SEQ ID NO: 438986 - DNA, 18 bp, Homo sapiens
gggccccaaagcccagcc

SEQ ID NO: 438987 - DNA, 13 bp, Homo sapiens
gggccccacctac

SEQ ID NO: 438988 - DNA, 16 bp, Homo sapiens
gggccccagaccccag

SEQ ID NO: 438989 - DNA, 21 bp, Homo sapiens
gggccccagaccccagggcag

SEQ ID NO: 438990 - DNA, 15 bp, Homo sapiens
gggccccagccgtgg

SEQ ID NO: 438991 - DNA, 12 bp, Homo sapiens
gggccccatgct

SEQ ID NO: 438992 - DNA, 16 bp, Homo sapiens
gggccccatgctctgc

SEQ ID NO: 438993 - DNA, 18 bp, Homo sapiens
gggccccatgctctgccc

SEQ ID NO: 438994 - DNA, 23 bp, Homo sapiens
gggccccctctcttaccccgtcc

SEQ ID NO: 438995 - DNA, 16 bp, Homo sapiens
gggcccctcagagccc

SEQ ID NO: 438996 - DNA, 16 bp, Homo sapiens
gggcccctccctctgc

SEQ ID NO: 438997 - DNA, 17 bp, Homo sapiens
gggcccctcctctgtgc

SEQ ID NO: 438998 - DNA, 19 bp, Homo sapiens
gggcccctcctctgtgctc

SEQ ID NO: 438999 - DNA, 15 bp, Homo sapiens
gggcccctctgccca

SEQ ID NO: 439000 - DNA, 22 bp, Homo sapiens
gggcccctctgcccagcttggg

SEQ ID NO: 439001 - DNA, 18 bp, Homo sapiens
gggcccctttttactccc

SEQ ID NO: 439002 - DNA, 13 bp, Homo sapiens
gggcccgagcgcg

SEQ ID NO: 439003 - DNA, 16 bp, Homo sapiens
gggcccgcctggcaga

SEQ ID NO: 439004 - DNA, 20 bp, Homo sapiens
gggcccgcctggcagaactg

SEQ ID NO: 439005 - DNA, 21 bp, Homo sapiens
gggcccgctcaacctctcaga

SEQ ID NO: 439006 - DNA, 21 bp, Homo sapiens
gggccctcagaggaaaggcag

SEQ ID NO: 439007 - DNA, 12 bp, Homo sapiens
gggccctctgag

SEQ ID NO: 439008 - DNA, 14 bp, Homo sapiens
gggccctctgccga

SEQ ID NO: 439009 - DNA, 18 bp, Homo sapiens
gggccctgcacctgtgca

SEQ ID NO: 439010 - DNA, 19 bp, Homo sapiens
gggccctgcacctgtgcag

SEQ ID NO: 439011 - DNA, 16 bp, Homo sapiens
gggccctgctcaggcc

SEQ ID NO: 439012 - DNA, 18 bp, Homo sapiens
gggccctgctcaggcctc

SEQ ID NO: 439013 - DNA, 22 bp, Homo sapiens
gggccctggggtccccactccc

SEQ ID NO: 439014 - DNA, 15 bp, Homo sapiens
gggcccttggggcct

SEQ ID NO: 439015 - DNA, 16 bp, Homo sapiens
gggcccttggggcctg

SEQ ID NO: 439016 - DNA, 18 bp, Homo sapiens
gggccgaatcccctccct

SEQ ID NO: 439017 - DNA, 14 bp, Homo sapiens
gggccgaggccgct

SEQ ID NO: 439018 - DNA, 20 bp, Homo sapiens
gggccgcccgggcccagagg

SEQ ID NO: 439019 - DNA, 17 bp, Homo sapiens
gggccgcctcctccaga

SEQ ID NO: 439020 - DNA, 16 bp, Homo sapiens
gggccggccccaggct

SEQ ID NO: 439021 - DNA, 17 bp, Homo sapiens
gggccggccccaggctc

SEQ ID NO: 439022 - DNA, 17 bp, Homo sapiens
gggcctactagagtctg

SEQ ID NO: 439023 - DNA, 22 bp, Homo sapiens
gggcctagtggcttcagcccct

SEQ ID NO: 439024 - DNA, 15 bp, Homo sapiens
gggcctcagagacag

SEQ ID NO: 439025 - DNA, 16 bp, Homo sapiens
gggcctcccaccagag

SEQ ID NO: 439026 - DNA, 17 bp, Homo sapiens
gggcctcccttgggctg

SEQ ID NO: 439027 - DNA, 18 bp, Homo sapiens
gggcctccttcccatgcc

SEQ ID NO: 439028 - DNA, 16 bp, Homo sapiens
gggcctcgctttccca

SEQ ID NO: 439029 - DNA, 19 bp, Homo sapiens
gggcctctgcctccaggag

SEQ ID NO: 439030 - DNA, 18 bp, Homo sapiens
gggcctctggctgcctgg

SEQ ID NO: 439031 - DNA, 23 bp, Homo sapiens
gggcctctggtttggggcgaggc

SEQ ID NO: 439032 - DNA, 23 bp, Homo sapiens
gggcctcttgcggtcccttctta

SEQ ID NO: 439033 - DNA, 21 bp, Homo sapiens
gggcctgacttttacagcttt

SEQ ID NO: 439034 - DNA, 16 bp, Homo sapiens
gggcctgcaggcccca

SEQ ID NO: 439035 - DNA, 17 bp, Homo sapiens
gggcctgcaggccccag

SEQ ID NO: 439036 - DNA, 19 bp, Homo sapiens
gggcctgcaggccccagcc

SEQ ID NO: 439037 - DNA, 20 bp, Homo sapiens
gggcctgcaggccccagcca

SEQ ID NO: 439038 - DNA, 22 bp, Homo sapiens
gggcctgcaggccccagccaag

SEQ ID NO: 439039 - DNA, 15 bp, Homo sapiens
gggcctgcccaatgc

SEQ ID NO: 439040 - DNA, 11 bp, Homo sapiens
gggcctgctgc

SEQ ID NO: 439041 - DNA, 12 bp, Homo sapiens
gggcctgctgcg

SEQ ID NO: 439042 - DNA, 20 bp, Homo sapiens
gggcctgctgcgtcagacca

SEQ ID NO: 439043 - DNA, 12 bp, Homo sapiens
gggcctggactg

SEQ ID NO: 439044 - DNA, 10 bp, Homo sapiens
gggcctggca

SEQ ID NO: 439045 - DNA, 22 bp, Homo sapiens
gggcctggcagccgtgccttca

SEQ ID NO: 439046 - DNA, 13 bp, Homo sapiens
gggcctggcaggg

SEQ ID NO: 439047 - DNA, 12 bp, Homo sapiens
gggcctggcctg

SEQ ID NO: 439048 - DNA, 13 bp, Homo sapiens
gggcctggcctga

SEQ ID NO: 439049 - DNA, 19 bp, Homo sapiens
gggcctggcctgagctggg

SEQ ID NO: 439050 - DNA, 23 bp, Homo sapiens
ggggtttgggcccctcagagccc

SEQ ID NO: 439051 - DNA, 23 bp, Homo sapiens
ggggttttcgaagctcagcccac

SEQ ID NO: 439052 - DNA, 12 bp, Homo sapiens
gggtaaatatac

SEQ ID NO: 439053 - DNA, 21 bp, Homo sapiens
gggtaataaacttagaataaa

SEQ ID NO: 439054 - DNA, 22 bp, Homo sapiens
gggtaatcagcattattcttca

SEQ ID NO: 439055 - DNA, 20 bp, Homo sapiens
gggtaatggaggccaagcct

SEQ ID NO: 439056 - DNA, 14 bp, Homo sapiens
gggtactagaagct

SEQ ID NO: 439057 - DNA, 19 bp, Homo sapiens
gggtactcttgatgtgaag

SEQ ID NO: 439058 - DNA, 22 bp, Homo sapiens
gggtagaagcaaaggcaggagg

SEQ ID NO: 439059 - DNA, 16 bp, Homo sapiens
gggtagacttggagct

SEQ ID NO: 439060 - DNA, 19 bp, Homo sapiens
gggtagcttctgacctcag

SEQ ID NO: 439061 - DNA, 21 bp, Homo sapiens
gggtagcttctgacctcagca

SEQ ID NO: 439062 - DNA, 16 bp, Homo sapiens
gggtatatctgggctg

SEQ ID NO: 439063 - DNA, 20 bp, Homo sapiens
gggtatatttttgtttgttt

SEQ ID NO: 439064 - DNA, 23 bp, Homo sapiens
gggtatatttttgtttgttttgt

SEQ ID NO: 439065 - DNA, 10 bp, Homo sapiens
gggtatcctg

SEQ ID NO: 439066 - DNA, 12 bp, Homo sapiens
gggtatgtgttg

SEQ ID NO: 439067 - DNA, 18 bp, Homo sapiens
gggtatgtgttgccaaag

SEQ ID NO: 439068 - DNA, 23 bp, Homo sapiens
gggtattgttaatattaatttat

SEQ ID NO: 439069 - DNA, 13 bp, Homo sapiens
gggtcaagttatt

SEQ ID NO: 439070 - DNA, 14 bp, Homo sapiens
gggtcaccctgtga

SEQ ID NO: 439071 - DNA, 15 bp, Homo sapiens
gggtcaccctgtgac

SEQ ID NO: 439072 - DNA, 16 bp, Homo sapiens
gggtcaccttcctggg

SEQ ID NO: 439073 - DNA, 17 bp, Homo sapiens
gggtcaccttcctgggc

SEQ ID NO: 439074 - DNA, 20 bp, Homo sapiens
gggtcagcaggggggttggg

SEQ ID NO: 439075 - DNA, 18 bp, Homo sapiens
gggtcagggaccaaggac

SEQ ID NO: 439076 - DNA, 12 bp, Homo sapiens
gggtcagtgtgc

SEQ ID NO: 439077 - DNA, 16 bp, Homo sapiens
gggtcatcccagcacc

SEQ ID NO: 439078 - DNA, 23 bp, Homo sapiens
gggtcatcccagcacctgccagg

SEQ ID NO: 439079 - DNA, 19 bp, Homo sapiens
gggtccaggaaggcagctg

SEQ ID NO: 439080 - DNA, 20 bp, Homo sapiens
gggtccaggaaggcagctgc

SEQ ID NO: 439081 - DNA, 22 bp, Homo sapiens
gggtcccagctaaagaggtggg

SEQ ID NO: 439082 - DNA, 12 bp, Homo sapiens
gggtcccaggat

SEQ ID NO: 439083 - DNA, 15 bp, Homo sapiens
gggtccccactccct

SEQ ID NO: 439084 - DNA, 12 bp, Homo sapiens
gggtccccggac

SEQ ID NO: 439085 - DNA, 15 bp, Homo sapiens
gggtcccttccccct

SEQ ID NO: 439086 - DNA, 17 bp, Homo sapiens
gggtccgcaccagctgc

SEQ ID NO: 439087 - DNA, 19 bp, Homo sapiens
gggtccgcaccagctgctc

SEQ ID NO: 439088 - DNA, 23 bp, Homo sapiens
gggtccgcaccagctgctctgcc

SEQ ID NO: 439089 - DNA, 18 bp, Homo sapiens
gggtcctggctcctgagg

SEQ ID NO: 439090 - DNA, 15 bp, Homo sapiens
gggtcggaagcctgt

SEQ ID NO: 439091 - DNA, 16 bp, Homo sapiens
gggtcggccctgccca

SEQ ID NO: 439092 - DNA, 17 bp, Homo sapiens
gggtctcacttatacca

SEQ ID NO: 439093 - DNA, 13 bp, Homo sapiens
gggtctctgagca

SEQ ID NO: 439094 - DNA, 14 bp, Homo sapiens
gggtctctgagcag

SEQ ID NO: 439095 - DNA, 23 bp, Homo sapiens
gggtctgaaggaatagccagaga

SEQ ID NO: 439096 - DNA, 21 bp, Homo sapiens
gggtctgctctgtgcctggga

SEQ ID NO: 439097 - DNA, 16 bp, Homo sapiens
gggtctgggaggcagg

SEQ ID NO: 439098 - DNA, 18 bp, Homo sapiens
gggtctgggaggcaggtc

SEQ ID NO: 439099 - DNA, 15 bp, Homo sapiens
gggtctgtgctgtgc

SEQ ID NO: 439100 - DNA, 18 bp, Homo sapiens
gggtctgtgctgtgcctg

SEQ ID NO: 439101 - DNA, 22 bp, Homo sapiens
gggtctgtgctgtgcctgctag

SEQ ID NO: 439102 - DNA, 15 bp, Homo sapiens
gggtctgtgtctctt

SEQ ID NO: 439103 - DNA, 21 bp, Homo sapiens
gggtcttgggctactggcagc

SEQ ID NO: 439104 - DNA, 22 bp, Homo sapiens
gggtgaagcaagttcactacag

SEQ ID NO: 439105 - DNA, 14 bp, Homo sapiens
gggtgaagctgggg

SEQ ID NO: 439106 - DNA, 13 bp, Homo sapiens
gggtgaagggaga

SEQ ID NO: 439107 - DNA, 23 bp, Homo sapiens
gggtgacatcccaggaggggcct

SEQ ID NO: 439108 - DNA, 17 bp, Homo sapiens
gggtgagaacaaccaaa

SEQ ID NO: 439109 - DNA, 13 bp, Homo sapiens
gggtgagtggctg

SEQ ID NO: 439110 - DNA, 15 bp, Homo sapiens
gggtgcagctgagaa

SEQ ID NO: 439111 - DNA, 15 bp, Homo sapiens
gggtgcaggcgcgca

SEQ ID NO: 439112 - DNA, 22 bp, Homo sapiens
gggtgcaggcgcgcaccgccca

SEQ ID NO: 439113 - DNA, 21 bp, Homo sapiens
gggtgccaaccacctctggcc

SEQ ID NO: 439114 - DNA, 18 bp, Homo sapiens
gggtgccctccactgccc

SEQ ID NO: 439115 - DNA, 15 bp, Homo sapiens
gggtgcctgagcccg

SEQ ID NO: 439116 - DNA, 18 bp, Homo sapiens
gggtgcgctcacctgcag

SEQ ID NO: 439117 - DNA, 23 bp, Homo sapiens
gggtgcgtgaccggcccgccacc

SEQ ID NO: 439118 - DNA, 18 bp, Homo sapiens
gggtgctccctcctcagt

SEQ ID NO: 439119 - DNA, 21 bp, Homo sapiens
gggtgctgcttccctctgcct

SEQ ID NO: 439120 - DNA, 19 bp, Homo sapiens
gggtgctggctgcccagac

SEQ ID NO: 439121 - DNA, 20 bp, Homo sapiens
gggtggacgagggagtgtct

SEQ ID NO: 439122 - DNA, 15 bp, Homo sapiens
gggtggatcacctgt

SEQ ID NO: 439123 - DNA, 18 bp, Homo sapiens
gggtggcacctcctgaga

SEQ ID NO: 439124 - DNA, 13 bp, Homo sapiens
gggtggcagaaat

SEQ ID NO: 439125 - DNA, 17 bp, Homo sapiens
gggtgggcccagaactg

SEQ ID NO: 439126 - DNA, 21 bp, Homo sapiens
gggtgggcccagaactgcccc

SEQ ID NO: 439127 - DNA, 15 bp, Homo sapiens
gggtgggcctggcct

SEQ ID NO: 439128 - DNA, 19 bp, Homo sapiens
gggtgggcctggcctgagc

SEQ ID NO: 439129 - DNA, 23 bp, Homo sapiens
gggtgggcctggcctgagctggg

SEQ ID NO: 439130 - DNA, 14 bp, Homo sapiens
gggtggggaggcag

SEQ ID NO: 439131 - DNA, 15 bp, Homo sapiens
gggtggggcgggagg

SEQ ID NO: 439132 - DNA, 16 bp, Homo sapiens
gggtgggggcctgctg

SEQ ID NO: 439133 - DNA, 17 bp, Homo sapiens
gggtggtaactgccagc

SEQ ID NO: 439134 - DNA, 14 bp, Homo sapiens
gggtggtggacagg

SEQ ID NO: 439135 - DNA, 17 bp, Homo sapiens
gggtgtcacagaggcag

SEQ ID NO: 439136 - DNA, 16 bp, Homo sapiens
gggtgtgccctggctc

SEQ ID NO: 439137 - DNA, 18 bp, Homo sapiens
gggtgtgggtcagggagg

SEQ ID NO: 439138 - DNA, 14 bp, Homo sapiens
gggttaaagaaagg

SEQ ID NO: 439139 - DNA, 13 bp, Homo sapiens
gggttccagacag

SEQ ID NO: 439140 - DNA, 16 bp, Homo sapiens
gggttccagacagagt

SEQ ID NO: 439141 - DNA, 20 bp, Homo sapiens
gggttccagacagagtggat

SEQ ID NO: 439142 - DNA, 18 bp, Homo sapiens
gggttccctttccttcca

SEQ ID NO: 439143 - DNA, 21 bp, Homo sapiens
gggttccctttccttccatcc

SEQ ID NO: 439144 - DNA, 18 bp, Homo sapiens
gggttcgtggaaagggtg

SEQ ID NO: 439145 - DNA, 11 bp, Homo sapiens
gggttctagac

SEQ ID NO: 439146 - DNA, 11 bp, Homo sapiens
gggttctgtat

SEQ ID NO: 439147 - DNA, 16 bp, Homo sapiens
gggttctttcttcctc

SEQ ID NO: 439148 - DNA, 12 bp, Homo sapiens
gggttgaaaatt

SEQ ID NO: 439149 - DNA, 23 bp, Homo sapiens
gggttgaaaattcaaaaagtgtt

SEQ ID NO: 439150 - DNA, 22 bp, Homo sapiens
gggttgaaggcagtctgaaccc

SEQ ID NO: 439151 - DNA, 16 bp, Homo sapiens
gggttgccagtcctgc

SEQ ID NO: 439152 - DNA, 20 bp, Homo sapiens
gggttgcgtcctgacggcgc

SEQ ID NO: 439153 - DNA, 14 bp, Homo sapiens
gggttggctgggta

SEQ ID NO: 439154 - DNA, 16 bp, Homo sapiens
gggttgggttccagac

SEQ ID NO: 439155 - DNA, 18 bp, Homo sapiens
gggttgggttccagacag

SEQ ID NO: 439156 - DNA, 20 bp, Homo sapiens
gggtttcaccatgttggcca

SEQ ID NO: 439157 - DNA, 15 bp, Homo sapiens
gggtttctgccctgc

SEQ ID NO: 439158 - DNA, 22 bp, Homo sapiens
gggtttggcgggccaaggactg

SEQ ID NO: 439159 - DNA, 20 bp, Homo sapiens
gggtttgggcccctcagagc

SEQ ID NO: 439160 - DNA, 17 bp, Homo sapiens
gggttttccgcccacag

SEQ ID NO: 439161 - DNA, 12 bp, Homo sapiens
gggttttggcct

SEQ ID NO: 439162 - DNA, 14 bp, Homo sapiens
gggttttggcctgc

SEQ ID NO: 439163 - DNA, 18 bp, Homo sapiens
gggttttgttaggggtgg

SEQ ID NO: 439164 - DNA, 13 bp, Homo sapiens
ggtaaaatacttc

SEQ ID NO: 439165 - DNA, 13 bp, Homo sapiens
ggtaaatgatgtg

SEQ ID NO: 439166 - DNA, 12 bp, Homo sapiens
ggtaacactgat

SEQ ID NO: 439167 - DNA, 16 bp, Homo sapiens
ggtaacatcatcaggc

SEQ ID NO: 439168 - DNA, 14 bp, Homo sapiens
ggtaacctgtggtg

SEQ ID NO: 439169 - DNA, 17 bp, Homo sapiens
ggtaacttgctgtgaaa

SEQ ID NO: 439170 - DNA, 13 bp, Homo sapiens
ggtaaggaggaga

SEQ ID NO: 439171 - DNA, 16 bp, Homo sapiens
ggtaaggaggagaaaa

SEQ ID NO: 439172 - DNA, 18 bp, Homo sapiens
ggtaaggaggagaaaata

SEQ ID NO: 439173 - DNA, 16 bp, Homo sapiens
ggtaatactataaata

SEQ ID NO: 439174 - DNA, 13 bp, Homo sapiens
ggtaatctgaaac

SEQ ID NO: 439175 - DNA, 14 bp, Homo sapiens
ggtaatctgaaaca

SEQ ID NO: 439176 - DNA, 21 bp, Homo sapiens
ggtaatggaggccaagcctgc

SEQ ID NO: 439177 - DNA, 17 bp, Homo sapiens
ggtaattattttgagtg

SEQ ID NO: 439178 - DNA, 13 bp, Homo sapiens
ggtacaagagcca

SEQ ID NO: 439179 - DNA, 11 bp, Homo sapiens
ggtacagcagg

SEQ ID NO: 439180 - DNA, 13 bp, Homo sapiens
ggtacagcagggt

SEQ ID NO: 439181 - DNA, 20 bp, Homo sapiens
ggtgctctggctggagagga

SEQ ID NO: 439182 - DNA, 12 bp, Homo sapiens
ggtgctgagctt

SEQ ID NO: 439183 - DNA, 21 bp, Homo sapiens
ggtgctgcttccctctgcctg

SEQ ID NO: 439184 - DNA, 19 bp, Homo sapiens
ggtgctgctttggctgact

SEQ ID NO: 439185 - DNA, 24 bp, Homo sapiens
ggtgctgggactgagccagtccca

SEQ ID NO: 439186 - DNA, 22 bp, Homo sapiens
ggtgctgttgtcattgctttac

SEQ ID NO: 439187 - DNA, 17 bp, Homo sapiens
ggtgcttacacatctca

SEQ ID NO: 439188 - DNA, 19 bp, Homo sapiens
ggtgcttattctcaaagca

SEQ ID NO: 439189 - DNA, 15 bp, Homo sapiens
ggtgcttccctttca

SEQ ID NO: 439190 - DNA, 20 bp, Homo sapiens
ggtggaagaggttctcagca

SEQ ID NO: 439191 - DNA, 20 bp, Homo sapiens
ggtggacatttcggaagtgg

SEQ ID NO: 439192 - DNA, 19 bp, Homo sapiens
ggtggagaatctgagggca

SEQ ID NO: 439193 - DNA, 22 bp, Homo sapiens
ggtggaggaaggtgctgagctt

SEQ ID NO: 439194 - DNA, 15 bp, Homo sapiens
ggtggatggtgactt

SEQ ID NO: 439195 - DNA, 13 bp, Homo sapiens
ggtggcaataaat

SEQ ID NO: 439196 - DNA, 20 bp, Homo sapiens
ggtggcacctcctgagaagg

SEQ ID NO: 439197 - DNA, 16 bp, Homo sapiens
ggtggcatttgctgaa

SEQ ID NO: 439198 - DNA, 22 bp, Homo sapiens
ggtggccactccagacccctgg

SEQ ID NO: 439199 - DNA, 23 bp, Homo sapiens
ggtggccactccagacccctggc

SEQ ID NO: 439200 - DNA, 13 bp, Homo sapiens
ggtggccccagct

SEQ ID NO: 439201 - DNA, 14 bp, Homo sapiens
ggtggcccctgcct

SEQ ID NO: 439202 - DNA, 19 bp, Homo sapiens
ggtggcccgacagcctggc

SEQ ID NO: 439203 - DNA, 20 bp, Homo sapiens
ggtggcccgacagcctggca

SEQ ID NO: 439204 - DNA, 15 bp, Homo sapiens
ggtggccctggggaa

SEQ ID NO: 439205 - DNA, 19 bp, Homo sapiens
ggtggcctaaggctgctgt

SEQ ID NO: 439206 - DNA, 21 bp, Homo sapiens
ggtggcgactctatagactct

SEQ ID NO: 439207 - DNA, 22 bp, Homo sapiens
ggtggcgctttctcctgtgccc

SEQ ID NO: 439208 - DNA, 18 bp, Homo sapiens
ggtggcgtctgcctagga

SEQ ID NO: 439209 - DNA, 13 bp, Homo sapiens
ggtggctctgaga

SEQ ID NO: 439210 - DNA, 14 bp, Homo sapiens
ggtggctggaggca

SEQ ID NO: 439211 - DNA, 24 bp, Homo sapiens
ggtgggaggcccctggtggcatgg

SEQ ID NO: 439212 - DNA, 12 bp, Homo sapiens
ggtgggcagctg

SEQ ID NO: 439213 - DNA, 18 bp, Homo sapiens
ggtgggcatgccaccctc

SEQ ID NO: 439214 - DNA, 22 bp, Homo sapiens
ggtgggcccagaactgccccca

SEQ ID NO: 439215 - DNA, 15 bp, Homo sapiens
ggtgggcctggcctg

SEQ ID NO: 439216 - DNA, 17 bp, Homo sapiens
ggtgggcctggcctgag

SEQ ID NO: 439217 - DNA, 18 bp, Homo sapiens
ggtgggcctggcctgagc

SEQ ID NO: 439218 - DNA, 19 bp, Homo sapiens
ggtgggcctggcctgagct

SEQ ID NO: 439219 - DNA, 13 bp, Homo sapiens
ggtgggctccaga

SEQ ID NO: 439220 - DNA, 14 bp, Homo sapiens
ggtgggctccagag

SEQ ID NO: 439221 - DNA, 12 bp, Homo sapiens
ggtggggcggga

SEQ ID NO: 439222 - DNA, 22 bp, Homo sapiens
ggtggggctgtacacaccctcc

SEQ ID NO: 439223 - DNA, 17 bp, Homo sapiens
ggtgggggagcctggag

SEQ ID NO: 439224 - DNA, 13 bp, Homo sapiens
ggtgggggcctgc

SEQ ID NO: 439225 - DNA, 15 bp, Homo sapiens
ggtggggtgaagctg

SEQ ID NO: 439226 - DNA, 16 bp, Homo sapiens
ggtggggtgcctgagc

SEQ ID NO: 439227 - DNA, 16 bp, Homo sapiens
ggtggggtgcttgctg

SEQ ID NO: 439228 - DNA, 20 bp, Homo sapiens
ggtgggtcaactccaaggca

SEQ ID NO: 439229 - DNA, 16 bp, Homo sapiens
ggtggtaactgccagc

SEQ ID NO: 439230 - DNA, 16 bp, Homo sapiens
ggtggtagctctgagc

SEQ ID NO: 439231 - DNA, 23 bp, Homo sapiens
ggtggtattggccgatgagctgg

SEQ ID NO: 439232 - DNA, 18 bp, Homo sapiens
ggtggtctgaatgttctg

SEQ ID NO: 439233 - DNA, 14 bp, Homo sapiens
ggtggtcttggaga

SEQ ID NO: 439234 - DNA, 17 bp, Homo sapiens
ggtggtcttggagagga

SEQ ID NO: 439235 - DNA, 18 bp, Homo sapiens
ggtggtcttggagaggag

SEQ ID NO: 439236 - DNA, 22 bp, Homo sapiens
ggtggtcttggagaggaggtgt

SEQ ID NO: 439237 - DNA, 23 bp, Homo sapiens
ggtggtgcagccccaggaccaag

SEQ ID NO: 439238 - DNA, 12 bp, Homo sapiens
ggtggtggacag

SEQ ID NO: 439239 - DNA, 14 bp, Homo sapiens
ggtggttggaggcc

SEQ ID NO: 439240 - DNA, 17 bp, Homo sapiens
ggtggttggaggcctgg

SEQ ID NO: 439241 - DNA, 15 bp, Homo sapiens
ggtggtttgccatgt

SEQ ID NO: 439242 - DNA, 23 bp, Homo sapiens
ggtgtatttattttcctccccag

SEQ ID NO: 439243 - DNA, 19 bp, Homo sapiens
ggtgtcacagaggcagtgg

SEQ ID NO: 439244 - DNA, 15 bp, Homo sapiens
ggtgtcatctgagga

SEQ ID NO: 439245 - DNA, 15 bp, Homo sapiens
ggtgtccccaacgtc

SEQ ID NO: 439246 - DNA, 16 bp, Homo sapiens
ggtgtccccagcccac

SEQ ID NO: 439247 - DNA, 15 bp, Homo sapiens
ggtgtcgtcctgcag

SEQ ID NO: 439248 - DNA, 18 bp, Homo sapiens
ggtgtctcctaccctctt

SEQ ID NO: 439249 - DNA, 21 bp, Homo sapiens
ggtgtctgatgtgtgcccaga

SEQ ID NO: 439250 - DNA, 11 bp, Homo sapiens
ggtgtgccctg

SEQ ID NO: 439251 - DNA, 15 bp, Homo sapiens
ggtgtgccctggctc

SEQ ID NO: 439252 - DNA, 17 bp, Homo sapiens
ggtgtgccctggctccc

SEQ ID NO: 439253 - DNA, 12 bp, Homo sapiens
ggtgtggaagag

SEQ ID NO: 439254 - DNA, 23 bp, Homo sapiens
ggtgtggccctgcaagggcgtgg

SEQ ID NO: 439255 - DNA, 19 bp, Homo sapiens
ggtgtggctgctcccagcc

SEQ ID NO: 439256 - DNA, 17 bp, Homo sapiens
ggtgtgggtcagggagg

SEQ ID NO: 439257 - DNA, 15 bp, Homo sapiens
ggtgtggtggctcat

SEQ ID NO: 439258 - DNA, 15 bp, Homo sapiens
ggtgtgtgtctctga

SEQ ID NO: 439259 - DNA, 16 bp, Homo sapiens
ggtgtgttcgtggagc

SEQ ID NO: 439260 - DNA, 18 bp, Homo sapiens
ggtgtgtttcaggacagc

SEQ ID NO: 439261 - DNA, 22 bp, Homo sapiens
ggtgttgccaaatatgtcctgg

SEQ ID NO: 439262 - DNA, 15 bp, Homo sapiens
ggtgttgtatgcctt

SEQ ID NO: 439263 - DNA, 17 bp, Homo sapiens
ggtgttgtatgccttta

SEQ ID NO: 439264 - DNA, 13 bp, Homo sapiens
ggttaaaactgtc

SEQ ID NO: 439265 - DNA, 19 bp, Homo sapiens
ggttaaaatataaattaag

SEQ ID NO: 439266 - DNA, 13 bp, Homo sapiens
ggttaagccatat

SEQ ID NO: 439267 - DNA, 12 bp, Homo sapiens
ggttaaggggat

SEQ ID NO: 439268 - DNA, 18 bp, Homo sapiens
ggttaaggggatctaaaa

SEQ ID NO: 439269 - DNA, 19 bp, Homo sapiens
ggttaaggggatctaaaag

SEQ ID NO: 439270 - DNA, 22 bp, Homo sapiens
ggttaccaaaaatatccctttt

SEQ ID NO: 439271 - DNA, 22 bp, Homo sapiens
ggttagctcagccccagcccag

SEQ ID NO: 439272 - DNA, 14 bp, Homo sapiens
ggttatctgcctgg

SEQ ID NO: 439273 - DNA, 21 bp, Homo sapiens
ggttatctgcctggcctggct

SEQ ID NO: 439274 - DNA, 14 bp, Homo sapiens
ggttatgatggaaa

SEQ ID NO: 439275 - DNA, 13 bp, Homo sapiens
ggttcaccttgcc

SEQ ID NO: 439276 - DNA, 17 bp, Homo sapiens
ggttcacgccattctcc

SEQ ID NO: 439277 - DNA, 19 bp, Homo sapiens
ggttcacgtcactgccaga

SEQ ID NO: 439278 - DNA, 22 bp, Homo sapiens
ggttcacgtcactgccagagct

SEQ ID NO: 439279 - DNA, 18 bp, Homo sapiens
ggttcagagactggcagc

SEQ ID NO: 439280 - DNA, 19 bp, Homo sapiens
ggttcagagactggcagcc

SEQ ID NO: 439281 - DNA, 22 bp, Homo sapiens
ggttcagagactggcagccagg

SEQ ID NO: 439282 - DNA, 19 bp, Homo sapiens
ggttcaggtcagggctatg

SEQ ID NO: 439283 - DNA, 15 bp, Homo sapiens
ggttcatcagtgtta

SEQ ID NO: 439284 - DNA, 16 bp, Homo sapiens
ggttcattattggaat

SEQ ID NO: 439285 - DNA, 18 bp, Homo sapiens
ggttccagacagagtgga

SEQ ID NO: 439286 - DNA, 19 bp, Homo sapiens
ggttccagacagagtggat

SEQ ID NO: 439287 - DNA, 23 bp, Homo sapiens
ggttccagacagggtggggctta

SEQ ID NO: 439288 - DNA, 14 bp, Homo sapiens
ggttccagcttccc

SEQ ID NO: 439289 - DNA, 17 bp, Homo sapiens
ggttccatccaccacct

SEQ ID NO: 439290 - DNA, 16 bp, Homo sapiens
ggttccatgcctgagg

SEQ ID NO: 439291 - DNA, 14 bp, Homo sapiens
ggttcccaataaaa

SEQ ID NO: 439292 - DNA, 15 bp, Homo sapiens
ggttcccccagccct

SEQ ID NO: 439293 - DNA, 21 bp, Homo sapiens
ggttccctgcctaggagctgg

SEQ ID NO: 439294 - DNA, 19 bp, Homo sapiens
ggttccttcctatgcccag

SEQ ID NO: 439295 - DNA, 16 bp, Homo sapiens
ggttctagaaggggcg

SEQ ID NO: 439296 - DNA, 22 bp, Homo sapiens
ggttctattttactttgtactt

SEQ ID NO: 439297 - DNA, 15 bp, Homo sapiens
ggttctcagcaagtg

SEQ ID NO: 439298 - DNA, 18 bp, Homo sapiens
ggttctcagcaagtgtac

SEQ ID NO: 439299 - DNA, 18 bp, Homo sapiens
ggttctcaggtgttgcca

SEQ ID NO: 439300 - DNA, 12 bp, Homo sapiens
ggttctccatcc

SEQ ID NO: 439301 - DNA, 13 bp, Homo sapiens
ggttctccatccc

SEQ ID NO: 439302 - DNA, 17 bp, Homo sapiens
ggttctcctctcccctc

SEQ ID NO: 439303 - DNA, 12 bp, Homo sapiens
ggttctgggtgg

SEQ ID NO: 439304 - DNA, 20 bp, Homo sapiens
ggttctggttagctcagccc

SEQ ID NO: 439305 - DNA, 12 bp, Homo sapiens
ggttctgtaaaa

SEQ ID NO: 439306 - DNA, 12 bp, Homo sapiens
ggttctgtctgt

SEQ ID NO: 439307 - DNA, 16 bp, Homo sapiens
ggttcttagtgtcact

SEQ ID NO: 439308 - DNA, 18 bp, Homo sapiens
ggttcttagttctcactg

SEQ ID NO: 439309 - DNA, 18 bp, Homo sapiens
ggttctttcttcctctgc

SEQ ID NO: 439310 - DNA, 15 bp, Homo sapiens
ggttctttgttttaa

SEQ ID NO: 439311 - DNA, 17 bp, Homo sapiens
gtagacctagggaggac

SEQ ID NO: 439312 - DNA, 18 bp, Homo sapiens
gtagacctgattttcaaa

SEQ ID NO: 439313 - DNA, 20 bp, Homo sapiens
gtagactggccatgcaagtg

SEQ ID NO: 439314 - DNA, 13 bp, Homo sapiens
gtagactgtgaca

SEQ ID NO: 439315 - DNA, 15 bp, Homo sapiens
gtagacttggagctg

SEQ ID NO: 439316 - DNA, 16 bp, Homo sapiens
gtagagatggaggagg

SEQ ID NO: 439317 - DNA, 17 bp, Homo sapiens
gtagagatggaggagga

SEQ ID NO: 439318 - DNA, 23 bp, Homo sapiens
gtagagccctgtatcaacccaga

SEQ ID NO: 439319 - DNA, 15 bp, Homo sapiens
gtagaggagcctgga

SEQ ID NO: 439320 - DNA, 22 bp, Homo sapiens
gtagaggcatttgtcttagaga

SEQ ID NO: 439321 - DNA, 14 bp, Homo sapiens
gtagaggttttgtt

SEQ ID NO: 439322 - DNA, 21 bp, Homo sapiens
gtagagtagggtagaaggaaa

SEQ ID NO: 439323 - DNA, 15 bp, Homo sapiens
gtagagtcatctcca

SEQ ID NO: 439324 - DNA, 22 bp, Homo sapiens
gtagatacagatccgcatgtgt

SEQ ID NO: 439325 - DNA, 16 bp, Homo sapiens
gtagatattgttttct

SEQ ID NO: 439326 - DNA, 18 bp, Homo sapiens
gtagatcgcttgagccca

SEQ ID NO: 439327 - DNA, 14 bp, Homo sapiens
gtagatgagaaaac

SEQ ID NO: 439328 - DNA, 14 bp, Homo sapiens
gtagatgtagcatt

SEQ ID NO: 439329 - DNA, 15 bp, Homo sapiens
gtagatgtagcattg

SEQ ID NO: 439330 - DNA, 21 bp, Homo sapiens
gtagatgtgcatttttgtgaa

SEQ ID NO: 439331 - DNA, 20 bp, Homo sapiens
gtagattgatctaaggcatg

SEQ ID NO: 439332 - DNA, 14 bp, Homo sapiens
gtagcatataaatg

SEQ ID NO: 439333 - DNA, 20 bp, Homo sapiens
gtagcatgaccttttggcct

SEQ ID NO: 439334 - DNA, 15 bp, Homo sapiens
gtagcatggactctg

SEQ ID NO: 439335 - DNA, 20 bp, Homo sapiens
gtagcattgttccacacatt

SEQ ID NO: 439336 - DNA, 21 bp, Homo sapiens
gtagccaccaccggggcactg

SEQ ID NO: 439337 - DNA, 16 bp, Homo sapiens
gtagccactctctgcc

SEQ ID NO: 439338 - DNA, 18 bp, Homo sapiens
gtagccactctctgccca

SEQ ID NO: 439339 - DNA, 22 bp, Homo sapiens
gtagccactggcatagccctcc

SEQ ID NO: 439340 - DNA, 20 bp, Homo sapiens
gtagccatggctcaggcaag

SEQ ID NO: 439341 - DNA, 19 bp, Homo sapiens
gtagcctccgtttatgggc

SEQ ID NO: 439342 - DNA, 22 bp, Homo sapiens
gtagcctccgtttatgggcctt

SEQ ID NO: 439343 - DNA, 21 bp, Homo sapiens
gtagcggaaaagttgtcttaa

SEQ ID NO: 439344 - DNA, 15 bp, Homo sapiens
gtagcgtcctgagga

SEQ ID NO: 439345 - DNA, 16 bp, Homo sapiens
gtagcgtcctgaggaa

SEQ ID NO: 439346 - DNA, 16 bp, Homo sapiens
gtagctacggttccct

SEQ ID NO: 439347 - DNA, 17 bp, Homo sapiens
gtagctagtttaaaatt

SEQ ID NO: 439348 - DNA, 12 bp, Homo sapiens
gtagctattttt

SEQ ID NO: 439349 - DNA, 15 bp, Homo sapiens
gtagctccctcctcc

SEQ ID NO: 439350 - DNA, 11 bp, Homo sapiens
gtagctctagg

SEQ ID NO: 439351 - DNA, 22 bp, Homo sapiens
gtagctctaggagggctggcaa

SEQ ID NO: 439352 - DNA, 10 bp, Homo sapiens
gtagctgcga

SEQ ID NO: 439353 - DNA, 17 bp, Homo sapiens
gtagctggattacaggc

SEQ ID NO: 439354 - DNA, 18 bp, Homo sapiens
gtagctgggattacaggt

SEQ ID NO: 439355 - DNA, 13 bp, Homo sapiens
gtagcttatattt

SEQ ID NO: 439356 - DNA, 15 bp, Homo sapiens
gtaggaccaatgttg

SEQ ID NO: 439357 - DNA, 14 bp, Homo sapiens
gtaggactgtatag

SEQ ID NO: 439358 - DNA, 13 bp, Homo sapiens
gtaggcattcttt

SEQ ID NO: 439359 - DNA, 19 bp, Homo sapiens
gtaggcccttgtcctgcca

SEQ ID NO: 439360 - DNA, 16 bp, Homo sapiens
gtaggctaaaaacatt

SEQ ID NO: 439361 - DNA, 12 bp, Homo sapiens
gtagggctgact

SEQ ID NO: 439362 - DNA, 17 bp, Homo sapiens
gtaggtctgcacacata

SEQ ID NO: 439363 - DNA, 13 bp, Homo sapiens
gtaggtgctggcc

SEQ ID NO: 439364 - DNA, 15 bp, Homo sapiens
gtaggttgaggacag

SEQ ID NO: 439365 - DNA, 16 bp, Homo sapiens
gtaggttgaggacagg

SEQ ID NO: 439366 - DNA, 15 bp, Homo sapiens
gtaggttgtctaaaa

SEQ ID NO: 439367 - DNA, 19 bp, Homo sapiens
gtaggttgtgatgatagca

SEQ ID NO: 439368 - DNA, 19 bp, Homo sapiens
gtagtaaaattagaaaaaa

SEQ ID NO: 439369 - DNA, 23 bp, Homo sapiens
gtagtaaaattagaaaaaaacaa

SEQ ID NO: 439370 - DNA, 15 bp, Homo sapiens
gtagtaacacataaa

SEQ ID NO: 439371 - DNA, 21 bp, Homo sapiens
gtagtactcctgcaaaatttt

SEQ ID NO: 439372 - DNA, 20 bp, Homo sapiens
gtagtactccttaagaacac

SEQ ID NO: 439373 - DNA, 18 bp, Homo sapiens
gtagtagaatctcagcac

SEQ ID NO: 439374 - DNA, 20 bp, Homo sapiens
gtagtagtcaaggtgctcaa

SEQ ID NO: 439375 - DNA, 17 bp, Homo sapiens
gtagtagttgatgacca

SEQ ID NO: 439376 - DNA, 19 bp, Homo sapiens
gtagtagttgatgaccaat

SEQ ID NO: 439377 - DNA, 16 bp, Homo sapiens
gtagtgcccctcccat

SEQ ID NO: 439378 - DNA, 14 bp, Homo sapiens
gtagtggaagagca

SEQ ID NO: 439379 - DNA, 11 bp, Homo sapiens
gtagttaggaa

SEQ ID NO: 439380 - DNA, 13 bp, Homo sapiens
gtagttaggaaat

SEQ ID NO: 439381 - DNA, 15 bp, Homo sapiens
gtagttcctgctaca

SEQ ID NO: 439382 - DNA, 16 bp, Homo sapiens
gtagttctgtgcctcc

SEQ ID NO: 439383 - DNA, 17 bp, Homo sapiens
gtagttctgtgcctccc

SEQ ID NO: 439384 - DNA, 19 bp, Homo sapiens
gtagtttatggcagaaggg

SEQ ID NO: 439385 - DNA, 16 bp, Homo sapiens
gtagttttctttttta

SEQ ID NO: 439386 - DNA, 17 bp, Homo sapiens
gtagtttttcttcaaca

SEQ ID NO: 439387 - DNA, 17 bp, Homo sapiens
gtagtttttgctgaagg

SEQ ID NO: 439388 - DNA, 16 bp, Homo sapiens
gtataaaaaataagta

SEQ ID NO: 439389 - DNA, 23 bp, Homo sapiens
gtataaaaataaaaaagatccca

SEQ ID NO: 439390 - DNA, 15 bp, Homo sapiens
gtataaaactttcct

SEQ ID NO: 439391 - DNA, 18 bp, Homo sapiens
gtataaaactttcctcgc

SEQ ID NO: 439392 - DNA, 18 bp, Homo sapiens
gtataaaatgcaaaataa

SEQ ID NO: 439393 - DNA, 15 bp, Homo sapiens
gtataaacaagccta

SEQ ID NO: 439394 - DNA, 16 bp, Homo sapiens
gtataaactgatggat

SEQ ID NO: 439395 - DNA, 14 bp, Homo sapiens
gtataaataataaa

SEQ ID NO: 439396 - DNA, 20 bp, Homo sapiens
gtataacaagccaaacattc

SEQ ID NO: 439397 - DNA, 19 bp, Homo sapiens
gtataactgtgcagagact

SEQ ID NO: 439398 - DNA, 17 bp, Homo sapiens
gtataccacctgtacat

SEQ ID NO: 439399 - DNA, 14 bp, Homo sapiens
gtatacccactgca

SEQ ID NO: 439400 - DNA, 23 bp, Homo sapiens
gtatacccactgcatcctactcc

SEQ ID NO: 439401 - DNA, 23 bp, Homo sapiens
gtatactgtgtgggatacttagt

SEQ ID NO: 439402 - DNA, 19 bp, Homo sapiens
gtatagaaaaagcacagct

SEQ ID NO: 439403 - DNA, 20 bp, Homo sapiens
gtatagaaaaagcacagctc

SEQ ID NO: 439404 - DNA, 14 bp, Homo sapiens
gtatagatgcaaga

SEQ ID NO: 439405 - DNA, 16 bp, Homo sapiens
gtatagatgcaagata

SEQ ID NO: 439406 - DNA, 16 bp, Homo sapiens
gtatagcaacctattt

SEQ ID NO: 439407 - DNA, 15 bp, Homo sapiens
gtataggccatctgt

SEQ ID NO: 439408 - DNA, 22 bp, Homo sapiens
gtataggccatctgtaaatatc

SEQ ID NO: 439409 - DNA, 13 bp, Homo sapiens
gtatagtgtaaaa

SEQ ID NO: 439410 - DNA, 15 bp, Homo sapiens
gtatataaatggtga

SEQ ID NO: 439411 - DNA, 13 bp, Homo sapiens
gtatataagctgt

SEQ ID NO: 439412 - DNA, 12 bp, Homo sapiens
gtatataagctt

SEQ ID NO: 439413 - DNA, 21 bp, Homo sapiens
gtatataatttttttatgttt

SEQ ID NO: 439414 - DNA, 11 bp, Homo sapiens
gtatatacatt

SEQ ID NO: 439415 - DNA, 22 bp, Homo sapiens
gtatatatctgcttcagtggag

SEQ ID NO: 439416 - DNA, 13 bp, Homo sapiens
gtatatatgtgtg

SEQ ID NO: 439417 - DNA, 18 bp, Homo sapiens
gtatatctggacaagcca

SEQ ID NO: 439418 - DNA, 14 bp, Homo sapiens
gtatatctgggctg

SEQ ID NO: 439419 - DNA, 21 bp, Homo sapiens
gtatatctgggctggccagtt

SEQ ID NO: 439420 - DNA, 15 bp, Homo sapiens
gtatatctttgcact

SEQ ID NO: 439421 - DNA, 19 bp, Homo sapiens
gtatatctttgcactgaag

SEQ ID NO: 439422 - DNA, 16 bp, Homo sapiens
gtatatgttgggtgca

SEQ ID NO: 439423 - DNA, 13 bp, Homo sapiens
gtatatgttgtaa

SEQ ID NO: 439424 - DNA, 22 bp, Homo sapiens
gtatattactgatttacaagac

SEQ ID NO: 439425 - DNA, 19 bp, Homo sapiens
gtatatttatataattatg

SEQ ID NO: 439426 - DNA, 22 bp, Homo sapiens
gtatatttcattgaatacttta

SEQ ID NO: 439427 - DNA, 17 bp, Homo sapiens
gtatatttttgtttgtt

SEQ ID NO: 439428 - DNA, 22 bp, Homo sapiens
gtatatttttgtttgttttgtg

SEQ ID NO: 439429 - DNA, 20 bp, Homo sapiens
gtatcaaacagctcaggctg

SEQ ID NO: 439430 - DNA, 18 bp, Homo sapiens
gtatcaaactcgtctgat

SEQ ID NO: 439431 - DNA, 14 bp, Homo sapiens
gtatcaaaggcaga

SEQ ID NO: 439432 - DNA, 17 bp, Homo sapiens
gtatcaaaggcagaaag

SEQ ID NO: 439433 - DNA, 13 bp, Homo sapiens
gtatcaaatctgt

SEQ ID NO: 439434 - DNA, 16 bp, Homo sapiens
gtatcaccctcagctg

SEQ ID NO: 439435 - DNA, 17 bp, Homo sapiens
gtatcaccctcagctgg

SEQ ID NO: 439436 - DNA, 15 bp, Homo sapiens
gtatcacctttccca

SEQ ID NO: 439437 - DNA, 17 bp, Homo sapiens
gtatcactgtctttcct

SEQ ID NO: 439438 - DNA, 21 bp, Homo sapiens
gtatcaggaaatatatatgtg

SEQ ID NO: 439439 - DNA, 18 bp, Homo sapiens
gtatcaggcctgccagac

SEQ ID NO: 439440 - DNA, 13 bp, Homo sapiens
gtatcatctccat

SEQ ID NO: 439441 - DNA, 19 bp, Homo sapiens
gtatccaaccaacttggtt

SEQ ID NO: 439442 - DNA, 13 bp, Homo sapiens
gtcagtctgagtc

SEQ ID NO: 439443 - DNA, 21 bp, Homo sapiens
gtcagtgaagcccaggaggac

SEQ ID NO: 439444 - DNA, 23 bp, Homo sapiens
gtcagtgaggcccagggagaggc

SEQ ID NO: 439445 - DNA, 15 bp, Homo sapiens
gtcagtgtgactgat

SEQ ID NO: 439446 - DNA, 19 bp, Homo sapiens
gtcagtgtgcaaagaaaag

SEQ ID NO: 439447 - DNA, 19 bp, Homo sapiens
gtcagtgtgccaccctctg

SEQ ID NO: 439448 - DNA, 15 bp, Homo sapiens
gtcagtgtggagagg

SEQ ID NO: 439449 - DNA, 19 bp, Homo sapiens
gtcagtgtggagaggggtg

SEQ ID NO: 439450 - DNA, 17 bp, Homo sapiens
gtcagttcccggagcac

SEQ ID NO: 439451 - DNA, 17 bp, Homo sapiens
gtcagttggagaaaatg

SEQ ID NO: 439452 - DNA, 20 bp, Homo sapiens
gtcatactatctactctcct

SEQ ID NO: 439453 - DNA, 21 bp, Homo sapiens
gtcatataagattcatattta

SEQ ID NO: 439454 - DNA, 19 bp, Homo sapiens
gtcatcactccctggatgt

SEQ ID NO: 439455 - DNA, 23 bp, Homo sapiens
gtcatcagtattgtgtaaaggaa

SEQ ID NO: 439456 - DNA, 17 bp, Homo sapiens
gtcatcatctttttgtg

SEQ ID NO: 439457 - DNA, 19 bp, Homo sapiens
gtcatccacacaacaccag

SEQ ID NO: 439458 - DNA, 22 bp, Homo sapiens
gtcatccacacaacaccaggac

SEQ ID NO: 439459 - DNA, 23 bp, Homo sapiens
gtcatccacacaacaccaggact

SEQ ID NO: 439460 - DNA, 13 bp, Homo sapiens
gtcatcccagcac

SEQ ID NO: 439461 - DNA, 16 bp, Homo sapiens
gtcatcccggggccat

SEQ ID NO: 439462 - DNA, 18 bp, Homo sapiens
gtcatcccggggccatgg

SEQ ID NO: 439463 - DNA, 19 bp, Homo sapiens
gtcatcccggggccatgga

SEQ ID NO: 439464 - DNA, 22 bp, Homo sapiens
gtcatcccggggccatggaagc

SEQ ID NO: 439465 - DNA, 23 bp, Homo sapiens
gtcatgaagctcagtttggctgt

SEQ ID NO: 439466 - DNA, 16 bp, Homo sapiens
gtcatgacatttctca

SEQ ID NO: 439467 - DNA, 17 bp, Homo sapiens
gtcatgacatttctcaa

SEQ ID NO: 439468 - DNA, 15 bp, Homo sapiens
gtcatgatggagact

SEQ ID NO: 439469 - DNA, 16 bp, Homo sapiens
gtcatgattaatgtgt

SEQ ID NO: 439470 - DNA, 21 bp, Homo sapiens
gtcatgcattgtaatcatcat

SEQ ID NO: 439471 - DNA, 19 bp, Homo sapiens
gtcatggctcaaggattca

SEQ ID NO: 439472 - DNA, 15 bp, Homo sapiens
gtcatggcttaatgt

SEQ ID NO: 439473 - DNA, 19 bp, Homo sapiens
gtcatgggaacgcagcctc

SEQ ID NO: 439474 - DNA, 23 bp, Homo sapiens
gtcatgggaacgcagcctccagt

SEQ ID NO: 439475 - DNA, 21 bp, Homo sapiens
gtcatggtttcttggagggcc

SEQ ID NO: 439476 - DNA, 15 bp, Homo sapiens
gtcatgtaccatcaa

SEQ ID NO: 439477 - DNA, 17 bp, Homo sapiens
gtcatgtaccatcaata

SEQ ID NO: 439478 - DNA, 17 bp, Homo sapiens
gtcatgtgtatgagaag

SEQ ID NO: 439479 - DNA, 20 bp, Homo sapiens
gtcatgtgtcagctgtagaa

SEQ ID NO: 439480 - DNA, 19 bp, Homo sapiens
gtcattaaaatggaagtgg

SEQ ID NO: 439481 - DNA, 18 bp, Homo sapiens
gtcattgtaacctcgtgt

SEQ ID NO: 439482 - DNA, 22 bp, Homo sapiens
gtcatttgctaatgaattttaa

SEQ ID NO: 439483 - DNA, 17 bp, Homo sapiens
gtcattttcctttctgt

SEQ ID NO: 439484 - DNA, 19 bp, Homo sapiens
gtccaaaggagtgcatggc

SEQ ID NO: 439485 - DNA, 22 bp, Homo sapiens
gtccaaatgtcctccagaagcc

SEQ ID NO: 439486 - DNA, 16 bp, Homo sapiens
gtccaaattctttatt

SEQ ID NO: 439487 - DNA, 15 bp, Homo sapiens
gtccaacctgcctgt

SEQ ID NO: 439488 - DNA, 18 bp, Homo sapiens
gtccaagcatcagcaaga

SEQ ID NO: 439489 - DNA, 15 bp, Homo sapiens
gtccaagtgtgtgtg

SEQ ID NO: 439490 - DNA, 15 bp, Homo sapiens
gtccaagtgtttctt

SEQ ID NO: 439491 - DNA, 15 bp, Homo sapiens
gtccaatttaaggaa

SEQ ID NO: 439492 - DNA, 17 bp, Homo sapiens
gtccacaaatgtcctca

SEQ ID NO: 439493 - DNA, 18 bp, Homo sapiens
gtccacaaatgtcctcag

SEQ ID NO: 439494 - DNA, 15 bp, Homo sapiens
gtccacaggggcagg

SEQ ID NO: 439495 - DNA, 15 bp, Homo sapiens
gtccacattctgctg

SEQ ID NO: 439496 - DNA, 13 bp, Homo sapiens
gtccacccaggct

SEQ ID NO: 439497 - DNA, 19 bp, Homo sapiens
gtccacccaggctgcactg

SEQ ID NO: 439498 - DNA, 21 bp, Homo sapiens
gtccacccaggctgcactgca

SEQ ID NO: 439499 - DNA, 19 bp, Homo sapiens
gtccacccccattgtgaat

SEQ ID NO: 439500 - DNA, 17 bp, Homo sapiens
gtccaccccgtcccggc

SEQ ID NO: 439501 - DNA, 15 bp, Homo sapiens
gtccacctgcctatc

SEQ ID NO: 439502 - DNA, 13 bp, Homo sapiens
gtccacctgtgct

SEQ ID NO: 439503 - DNA, 18 bp, Homo sapiens
gtccacctgtgctgctgc

SEQ ID NO: 439504 - DNA, 20 bp, Homo sapiens
gtccactacgctcctgtctc

SEQ ID NO: 439505 - DNA, 17 bp, Homo sapiens
gtccactccctgctcca

SEQ ID NO: 439506 - DNA, 20 bp, Homo sapiens
gtccactccctgctccacga

SEQ ID NO: 439507 - DNA, 20 bp, Homo sapiens
gtccactctcggggcccttg

SEQ ID NO: 439508 - DNA, 12 bp, Homo sapiens
gtccactgtcac

SEQ ID NO: 439509 - DNA, 20 bp, Homo sapiens
gtccactgtcactgtttctc

SEQ ID NO: 439510 - DNA, 18 bp, Homo sapiens
gtccactttcctctctct

SEQ ID NO: 439511 - DNA, 22 bp, Homo sapiens
gtccagaaaatagggtggacag

SEQ ID NO: 439512 - DNA, 17 bp, Homo sapiens
gtccagaacaaaagata

SEQ ID NO: 439513 - DNA, 21 bp, Homo sapiens
gtccagaagaatattcaggac

SEQ ID NO: 439514 - DNA, 16 bp, Homo sapiens
gtccagacctgggccc

SEQ ID NO: 439515 - DNA, 22 bp, Homo sapiens
gtccagagcttcagggctgggc

SEQ ID NO: 439516 - DNA, 14 bp, Homo sapiens
gtccagcagctgcg

SEQ ID NO: 439517 - DNA, 20 bp, Homo sapiens
gtccagcagctgcgggtctg

SEQ ID NO: 439518 - DNA, 11 bp, Homo sapiens
gtccagcctgg

SEQ ID NO: 439519 - DNA, 13 bp, Homo sapiens
gtccagcctgggc

SEQ ID NO: 439520 - DNA, 12 bp, Homo sapiens
gtccagctctcc

SEQ ID NO: 439521 - DNA, 13 bp, Homo sapiens
gtccagctctccc

SEQ ID NO: 439522 - DNA, 14 bp, Homo sapiens
gtccaggaaggcag

SEQ ID NO: 439523 - DNA, 21 bp, Homo sapiens
gtccaggaaggcagctgctct

SEQ ID NO: 439524 - DNA, 14 bp, Homo sapiens
gtccaggagcccca

SEQ ID NO: 439525 - DNA, 20 bp, Homo sapiens
gtccaggagccccagccagc

SEQ ID NO: 439526 - DNA, 22 bp, Homo sapiens
gtccaggccactgtggccagag

SEQ ID NO: 439527 - DNA, 13 bp, Homo sapiens
gtccagggaagct

SEQ ID NO: 439528 - DNA, 18 bp, Homo sapiens
gtccagggctagtgactt

SEQ ID NO: 439529 - DNA, 18 bp, Homo sapiens
gtccaggtcgggctcagc

SEQ ID NO: 439530 - DNA, 22 bp, Homo sapiens
gtccaggtcgggctcagctctg

SEQ ID NO: 439531 - DNA, 21 bp, Homo sapiens
gtccaggtctcactgctttgc

SEQ ID NO: 439532 - DNA, 20 bp, Homo sapiens
gtccaggtgagtgtgagggc

SEQ ID NO: 439533 - DNA, 20 bp, Homo sapiens
gtccagtgcaaccacacacc

SEQ ID NO: 439534 - DNA, 18 bp, Homo sapiens
gtccagttcaggaatttt

SEQ ID NO: 439535 - DNA, 16 bp, Homo sapiens
gtccatatcagacctc

SEQ ID NO: 439536 - DNA, 13 bp, Homo sapiens
gtccatccccagt

SEQ ID NO: 439537 - DNA, 13 bp, Homo sapiens
gtccatctgtctg

SEQ ID NO: 439538 - DNA, 19 bp, Homo sapiens
gtccatgcctacagataat

SEQ ID NO: 439539 - DNA, 12 bp, Homo sapiens
gtccatggcacc

SEQ ID NO: 439540 - DNA, 14 bp, Homo sapiens
gtccatggcaccag

SEQ ID NO: 439541 - DNA, 16 bp, Homo sapiens
gtccatggcaccagcc

SEQ ID NO: 439542 - DNA, 19 bp, Homo sapiens
gtccatggcaccagccccc

SEQ ID NO: 439543 - DNA, 19 bp, Homo sapiens
gtccatttcatgtgatcta

SEQ ID NO: 439544 - DNA, 15 bp, Homo sapiens
gtcccaaggagctga

SEQ ID NO: 439545 - DNA, 16 bp, Homo sapiens
gtcccacaaaatattt

SEQ ID NO: 439546 - DNA, 11 bp, Homo sapiens
gtcccacagct

SEQ ID NO: 439547 - DNA, 15 bp, Homo sapiens
gtcccacagcttggg

SEQ ID NO: 439548 - DNA, 16 bp, Homo sapiens
gtcccaccaactctgc

SEQ ID NO: 439549 - DNA, 20 bp, Homo sapiens
gtcccaccaactctgcactc

SEQ ID NO: 439550 - DNA, 19 bp, Homo sapiens
gtcccaccggttgcttctg

SEQ ID NO: 439551 - DNA, 22 bp, Homo sapiens
gtcccaccggttgcttctggga

SEQ ID NO: 439552 - DNA, 20 bp, Homo sapiens
gtcccacgtctggccaggca

SEQ ID NO: 439553 - DNA, 13 bp, Homo sapiens
gtcccactgggac

SEQ ID NO: 439554 - DNA, 14 bp, Homo sapiens
gtcccactgggaca

SEQ ID NO: 439555 - DNA, 13 bp, Homo sapiens
gtcccagaatgga

SEQ ID NO: 439556 - DNA, 23 bp, Homo sapiens
gtcccagaggttatctgcctggc

SEQ ID NO: 439557 - DNA, 18 bp, Homo sapiens
gtcccagccaccccgggc

SEQ ID NO: 439558 - DNA, 22 bp, Homo sapiens
gtcccagctacttgggagcctg

SEQ ID NO: 439559 - DNA, 18 bp, Homo sapiens
gtcccaggaagcagggag

SEQ ID NO: 439560 - DNA, 11 bp, Homo sapiens
gtcccaggccg

SEQ ID NO: 439561 - DNA, 18 bp, Homo sapiens
gtcccaggccgcatggcc

SEQ ID NO: 439562 - DNA, 21 bp, Homo sapiens
gtcccaggggtctccctgagc

SEQ ID NO: 439563 - DNA, 19 bp, Homo sapiens
gtcccagtattctcagagc

SEQ ID NO: 439564 - DNA, 18 bp, Homo sapiens
gtcccagtgggaggcgcg

SEQ ID NO: 439565 - DNA, 15 bp, Homo sapiens
gtcccatcggaagtt

SEQ ID NO: 439566 - DNA, 13 bp, Homo sapiens
gtcccattctaga

SEQ ID NO: 439567 - DNA, 18 bp, Homo sapiens
gtcccattctagatcctg

SEQ ID NO: 439568 - DNA, 23 bp, Homo sapiens
gtcccattctccactcactgcat

SEQ ID NO: 439569 - DNA, 20 bp, Homo sapiens
gtccccaacgtcccctccgc

SEQ ID NO: 439570 - DNA, 14 bp, Homo sapiens
gtccccactcaccc

SEQ ID NO: 439571 - DNA, 15 bp, Homo sapiens
gtccccactcacccc

SEQ ID NO: 439572 - DNA, 15 bp, Homo sapiens
gtctggtgggtggag

SEQ ID NO: 439573 - DNA, 21 bp, Homo sapiens
gtctggttttaacaatttcct

SEQ ID NO: 439574 - DNA, 19 bp, Homo sapiens
gtctgtaaggactcagtgt

SEQ ID NO: 439575 - DNA, 20 bp, Homo sapiens
gtctgtattcatacagcact

SEQ ID NO: 439576 - DNA, 21 bp, Homo sapiens
gtctgtattcatacagcacta

SEQ ID NO: 439577 - DNA, 22 bp, Homo sapiens
gtctgtccatctgtctgtccta

SEQ ID NO: 439578 - DNA, 19 bp, Homo sapiens
gtctgtcccagttaactgt

SEQ ID NO: 439579 - DNA, 18 bp, Homo sapiens
gtctgtcctacccgcccg

SEQ ID NO: 439580 - DNA, 15 bp, Homo sapiens
gtctgtcttcacagc

SEQ ID NO: 439581 - DNA, 17 bp, Homo sapiens
gtctgtgaataaagcca

SEQ ID NO: 439582 - DNA, 18 bp, Homo sapiens
gtctgtgaataaagccac

SEQ ID NO: 439583 - DNA, 15 bp, Homo sapiens
gtctgtgctgtgcct

SEQ ID NO: 439584 - DNA, 15 bp, Homo sapiens
gtctgtggacactgt

SEQ ID NO: 439585 - DNA, 21 bp, Homo sapiens
gtctgtgtgtagccaggaagc

SEQ ID NO: 439586 - DNA, 14 bp, Homo sapiens
gtctgtgttttaat

SEQ ID NO: 439587 - DNA, 15 bp, Homo sapiens
gtctgttaccatgtc

SEQ ID NO: 439588 - DNA, 20 bp, Homo sapiens
gtctgttaccatgtcactgt

SEQ ID NO: 439589 - DNA, 12 bp, Homo sapiens
gtctgttctcac

SEQ ID NO: 439590 - DNA, 20 bp, Homo sapiens
gtctgtttcaatgacctgta

SEQ ID NO: 439591 - DNA, 18 bp, Homo sapiens
gtctgtttccttctcttt

SEQ ID NO: 439592 - DNA, 22 bp, Homo sapiens
gtctgtttccttctctttctcc

SEQ ID NO: 439593 - DNA, 19 bp, Homo sapiens
gtctgttttagttggaatg

SEQ ID NO: 439594 - DNA, 22 bp, Homo sapiens
gtcttaaataaaactatttaaa

SEQ ID NO: 439595 - DNA, 23 bp, Homo sapiens
gtcttaaataaaactatttaaaa

SEQ ID NO: 439596 - DNA, 13 bp, Homo sapiens
gtcttaattttct

SEQ ID NO: 439597 - DNA, 16 bp, Homo sapiens
gtcttacattggcttt

SEQ ID NO: 439598 - DNA, 13 bp, Homo sapiens
gtcttagctttac

SEQ ID NO: 439599 - DNA, 14 bp, Homo sapiens
gtcttagctttaca

SEQ ID NO: 439600 - DNA, 15 bp, Homo sapiens
gtcttagctttacat

SEQ ID NO: 439601 - DNA, 17 bp, Homo sapiens
gtcttagctttacattt

SEQ ID NO: 439602 - DNA, 14 bp, Homo sapiens
gtcttatttcctca

SEQ ID NO: 439603 - DNA, 14 bp, Homo sapiens
gtcttcaatctctg

SEQ ID NO: 439604 - DNA, 18 bp, Homo sapiens
gtcttcaatctctgttct

SEQ ID NO: 439605 - DNA, 18 bp, Homo sapiens
gtcttcagatcctgctgc

SEQ ID NO: 439606 - DNA, 19 bp, Homo sapiens
gtcttcagatcctgctgcc

SEQ ID NO: 439607 - DNA, 21 bp, Homo sapiens
gtcttcatccttagcaacagc

SEQ ID NO: 439608 - DNA, 13 bp, Homo sapiens
gtcttccagagcc

SEQ ID NO: 439609 - DNA, 18 bp, Homo sapiens
gtcttccaggcccagtcc

SEQ ID NO: 439610 - DNA, 15 bp, Homo sapiens
gtcttccctacctca

SEQ ID NO: 439611 - DNA, 18 bp, Homo sapiens
gtcttccctagggctggg

SEQ ID NO: 439612 - DNA, 20 bp, Homo sapiens
gtcttccctagggctgggtg

SEQ ID NO: 439613 - DNA, 18 bp, Homo sapiens
gtcttcctgaaatgcagt

SEQ ID NO: 439614 - DNA, 21 bp, Homo sapiens
gtcttcctggtcataggctca

SEQ ID NO: 439615 - DNA, 13 bp, Homo sapiens
gtcttcgtacagt

SEQ ID NO: 439616 - DNA, 14 bp, Homo sapiens
gtcttcgtacagtt

SEQ ID NO: 439617 - DNA, 15 bp, Homo sapiens
gtcttctaatttcaa

SEQ ID NO: 439618 - DNA, 16 bp, Homo sapiens
gtcttctcatagcatt

SEQ ID NO: 439619 - DNA, 19 bp, Homo sapiens
gtcttctcatagcattaac

SEQ ID NO: 439620 - DNA, 12 bp, Homo sapiens
gtcttctccctg

SEQ ID NO: 439621 - DNA, 23 bp, Homo sapiens
gtcttctccctgtcccctcatgg

SEQ ID NO: 439622 - DNA, 14 bp, Homo sapiens
gtcttctgcctgtt

SEQ ID NO: 439623 - DNA, 17 bp, Homo sapiens
gtcttctgcctgttata

SEQ ID NO: 439624 - DNA, 19 bp, Homo sapiens
gtcttcttgtgtcctgatg

SEQ ID NO: 439625 - DNA, 16 bp, Homo sapiens
gtcttgagaaaacaga

SEQ ID NO: 439626 - DNA, 21 bp, Homo sapiens
gtcttgagagcgctggcctct

SEQ ID NO: 439627 - DNA, 15 bp, Homo sapiens
gtcttgatctcctga

SEQ ID NO: 439628 - DNA, 14 bp, Homo sapiens
gtcttggagaggag

SEQ ID NO: 439629 - DNA, 18 bp, Homo sapiens
gtcttggcacaatctcac

SEQ ID NO: 439630 - DNA, 15 bp, Homo sapiens
gtcttggtgcctttt

SEQ ID NO: 439631 - DNA, 16 bp, Homo sapiens
gtcttggttagagaag

SEQ ID NO: 439632 - DNA, 12 bp, Homo sapiens
gtcttgtatttt

SEQ ID NO: 439633 - DNA, 13 bp, Homo sapiens
gtcttgtattttc

SEQ ID NO: 439634 - DNA, 14 bp, Homo sapiens
gtcttgtcatcttt

SEQ ID NO: 439635 - DNA, 14 bp, Homo sapiens
gtctttaactgtca

SEQ ID NO: 439636 - DNA, 18 bp, Homo sapiens
gtctttattcttattact

SEQ ID NO: 439637 - DNA, 12 bp, Homo sapiens
gtctttcctaga

SEQ ID NO: 439638 - DNA, 20 bp, Homo sapiens
gtctttcctcccttctttgc

SEQ ID NO: 439639 - DNA, 18 bp, Homo sapiens
gtctttctaatgtagcta

SEQ ID NO: 439640 - DNA, 17 bp, Homo sapiens
gtctttctttgctgctg

SEQ ID NO: 439641 - DNA, 19 bp, Homo sapiens
gtctttctttgctgctgtg

SEQ ID NO: 439642 - DNA, 21 bp, Homo sapiens
gtctttctttgctgctgtgga

SEQ ID NO: 439643 - DNA, 16 bp, Homo sapiens
gtctttgaaatatgca

SEQ ID NO: 439644 - DNA, 20 bp, Homo sapiens
gtctttgaaatatgcatgta

SEQ ID NO: 439645 - DNA, 13 bp, Homo sapiens
gtctttgccttct

SEQ ID NO: 439646 - DNA, 19 bp, Homo sapiens
gtctttgctgtttatatat

SEQ ID NO: 439647 - DNA, 20 bp, Homo sapiens
gtctttggttcctcatggct

SEQ ID NO: 439648 - DNA, 18 bp, Homo sapiens
gtctttgtaatgcttgta

SEQ ID NO: 439649 - DNA, 16 bp, Homo sapiens
gtctttgtgtgctgtg

SEQ ID NO: 439650 - DNA, 19 bp, Homo sapiens
gtctttgttaagactgctg

SEQ ID NO: 439651 - DNA, 17 bp, Homo sapiens
gtcttttcccctcattg

SEQ ID NO: 439652 - DNA, 15 bp, Homo sapiens
gtctttttccttcct

SEQ ID NO: 439653 - DNA, 18 bp, Homo sapiens
gtctttttccttcctgag

SEQ ID NO: 439654 - DNA, 21 bp, Homo sapiens
gtgaaaaagcctaagaaaaag

SEQ ID NO: 439655 - DNA, 16 bp, Homo sapiens
gtgaaaagtaaaacag

SEQ ID NO: 439656 - DNA, 17 bp, Homo sapiens
gtgaaaattttattgaa

SEQ ID NO: 439657 - DNA, 18 bp, Homo sapiens
gtgaaacacacacacatt

SEQ ID NO: 439658 - DNA, 16 bp, Homo sapiens
gtgaaacacaccaggc

SEQ ID NO: 439659 - DNA, 23 bp, Homo sapiens
gtgaaacacaccaggctgtgggc

SEQ ID NO: 439660 - DNA, 20 bp, Homo sapiens
gtgaaaccccatctctacta

SEQ ID NO: 439661 - DNA, 19 bp, Homo sapiens
gtgaaagatgcaagcacct

SEQ ID NO: 439662 - DNA, 12 bp, Homo sapiens
gtgaaagggcta

SEQ ID NO: 439663 - DNA, 18 bp, Homo sapiens
gtgaaagtgtaaaataga

SEQ ID NO: 439664 - DNA, 17 bp, Homo sapiens
gtgaaattaaattctta

SEQ ID NO: 439665 - DNA, 11 bp, Homo sapiens
gtgaaattatg

SEQ ID NO: 439666 - DNA, 13 bp, Homo sapiens
gtgaaatttgtta

SEQ ID NO: 439667 - DNA, 12 bp, Homo sapiens
gtgaacagccaa

SEQ ID NO: 439668 - DNA, 12 bp, Homo sapiens
gtgaacatttct

SEQ ID NO: 439669 - DNA, 12 bp, Homo sapiens
gtgaacctggag

SEQ ID NO: 439670 - DNA, 16 bp, Homo sapiens
gtgaacgatttagaaa

SEQ ID NO: 439671 - DNA, 17 bp, Homo sapiens
gtgaactagggaagctc

SEQ ID NO: 439672 - DNA, 21 bp, Homo sapiens
gtgaacttacacttggagccc

SEQ ID NO: 439673 - DNA, 21 bp, Homo sapiens
gtgaagaatttatctgtgaat

SEQ ID NO: 439674 - DNA, 14 bp, Homo sapiens
gtgaagataatttg

SEQ ID NO: 439675 - DNA, 17 bp, Homo sapiens
gtgaagataatttgcat

SEQ ID NO: 439676 - DNA, 23 bp, Homo sapiens
gtgaagcagccttactattcata

SEQ ID NO: 439677 - DNA, 22 bp, Homo sapiens
gtgaagcagtgcctcgaggcac

SEQ ID NO: 439678 - DNA, 15 bp, Homo sapiens
gtgaagcctttatct

SEQ ID NO: 439679 - DNA, 22 bp, Homo sapiens
gtgaagcctttatctatgggag

SEQ ID NO: 439680 - DNA, 22 bp, Homo sapiens
gtgaagctgaaccccctccaga

SEQ ID NO: 439681 - DNA, 17 bp, Homo sapiens
gtgaaggtgacagcagt

SEQ ID NO: 439682 - DNA, 21 bp, Homo sapiens
gtgaagtccttcagtgagccc

SEQ ID NO: 439683 - DNA, 17 bp, Homo sapiens
gtgaagtgtggctggtg

SEQ ID NO: 439684 - DNA, 18 bp, Homo sapiens
gtgaagtgtggctggtgt

SEQ ID NO: 439685 - DNA, 22 bp, Homo sapiens
gtgaagtgtggctggtgtcccc

SEQ ID NO: 439686 - DNA, 14 bp, Homo sapiens
gtgaagtttacatt

SEQ ID NO: 439687 - DNA, 13 bp, Homo sapiens
gtgaataaaggat

SEQ ID NO: 439688 - DNA, 13 bp, Homo sapiens
gtgaatacatggt

SEQ ID NO: 439689 - DNA, 22 bp, Homo sapiens
gtgaatatttccatatggattt

SEQ ID NO: 439690 - DNA, 14 bp, Homo sapiens
gtgaatcagagcac

SEQ ID NO: 439691 - DNA, 22 bp, Homo sapiens
gtgaatgaaagtcttgtgacta

SEQ ID NO: 439692 - DNA, 20 bp, Homo sapiens
gtgaatgagtaaataaactc

SEQ ID NO: 439693 - DNA, 12 bp, Homo sapiens
gtgaattaaaaa

SEQ ID NO: 439694 - DNA, 18 bp, Homo sapiens
gtgaattctgtgaagaat

SEQ ID NO: 439695 - DNA, 19 bp, Homo sapiens
gtgaattgaagtcatcata

SEQ ID NO: 439696 - DNA, 16 bp, Homo sapiens
gtgaattgataataaa

SEQ ID NO: 439697 - DNA, 13 bp, Homo sapiens
gtgaatttgaatg

SEQ ID NO: 439698 - DNA, 16 bp, Homo sapiens
gtgaatttgaatgaaa

SEQ ID NO: 439699 - DNA, 17 bp, Homo sapiens
gtgaattttaaaatgta

SEQ ID NO: 439700 - DNA, 19 bp, Homo sapiens
gtgacaacctttgtgtaat

SEQ ID NO: 439701 - DNA, 17 bp, Homo sapiens
gtgacaaggccccagag

SEQ ID NO: 439702 - DNA, 20 bp, Homo sapiens
gtgacacagctgagctggcc

SEQ ID NO: 439703 - DNA, 15 bp, Homo sapiens
gtggagaggagagaa

SEQ ID NO: 439704 - DNA, 12 bp, Homo sapiens
gtggagagggaa

SEQ ID NO: 439705 - DNA, 22 bp, Homo sapiens
gtggagagggacagcccactga

SEQ ID NO: 439706 - DNA, 22 bp, Homo sapiens
gtggagagggatgaggtgctgg

SEQ ID NO: 439707 - DNA, 20 bp, Homo sapiens
gtggagaggggtgcacccac

SEQ ID NO: 439708 - DNA, 21 bp, Homo sapiens
gtggagatagtgccaggtggc

SEQ ID NO: 439709 - DNA, 21 bp, Homo sapiens
gtggagcaaaaggcagctcac

SEQ ID NO: 439710 - DNA, 16 bp, Homo sapiens
gtggagcatgggcctg

SEQ ID NO: 439711 - DNA, 19 bp, Homo sapiens
gtggaggaaatgttggaac

SEQ ID NO: 439712 - DNA, 20 bp, Homo sapiens
gtggaggaaggtgctgagct

SEQ ID NO: 439713 - DNA, 16 bp, Homo sapiens
gtggaggcctgatgct

SEQ ID NO: 439714 - DNA, 17 bp, Homo sapiens
gtggaggcctgatgctg

SEQ ID NO: 439715 - DNA, 20 bp, Homo sapiens
gtggaggcctgatgctgccc

SEQ ID NO: 439716 - DNA, 18 bp, Homo sapiens
gtggaggttgagtgagcc

SEQ ID NO: 439717 - DNA, 19 bp, Homo sapiens
gtggagttggcattgcatt

SEQ ID NO: 439718 - DNA, 20 bp, Homo sapiens
gtggagtttgacattgtatg

SEQ ID NO: 439719 - DNA, 13 bp, Homo sapiens
gtggataaaacat

SEQ ID NO: 439720 - DNA, 14 bp, Homo sapiens
gtggatagatgccc

SEQ ID NO: 439721 - DNA, 21 bp, Homo sapiens
gtggatagatgccctgctaga

SEQ ID NO: 439722 - DNA, 15 bp, Homo sapiens
gtggatctgggcaca

SEQ ID NO: 439723 - DNA, 19 bp, Homo sapiens
gtggattgcacgtggcctc

SEQ ID NO: 439724 - DNA, 14 bp, Homo sapiens
gtggattgctcatc

SEQ ID NO: 439725 - DNA, 14 bp, Homo sapiens
gtggattggctttg

SEQ ID NO: 439726 - DNA, 16 bp, Homo sapiens
gtggcaaagtgctgta

SEQ ID NO: 439727 - DNA, 20 bp, Homo sapiens
gtggcaaagtgctgtaccct

SEQ ID NO: 439728 - DNA, 13 bp, Homo sapiens
gtggcaactgtgg

SEQ ID NO: 439729 - DNA, 12 bp, Homo sapiens
gtggcacctcct

SEQ ID NO: 439730 - DNA, 15 bp, Homo sapiens
gtggcacctcctgag

SEQ ID NO: 439731 - DNA, 18 bp, Homo sapiens
gtggcacgatctcagctc

SEQ ID NO: 439732 - DNA, 16 bp, Homo sapiens
gtggcacgcacctgta

SEQ ID NO: 439733 - DNA, 19 bp, Homo sapiens
gtggcagaaaagaggagac

SEQ ID NO: 439734 - DNA, 20 bp, Homo sapiens
gtggcagataatcagcctct

SEQ ID NO: 439735 - DNA, 21 bp, Homo sapiens
gtggcagataatcagcctctt

SEQ ID NO: 439736 - DNA, 18 bp, Homo sapiens
gtggcagattttacaaaa

SEQ ID NO: 439737 - DNA, 15 bp, Homo sapiens
gtggcagcaaaggaa

SEQ ID NO: 439738 - DNA, 14 bp, Homo sapiens
gtggcagccatgcc

SEQ ID NO: 439739 - DNA, 15 bp, Homo sapiens
gtggcagccatgcct

SEQ ID NO: 439740 - DNA, 18 bp, Homo sapiens
gtggcagtggccaggcag

SEQ ID NO: 439741 - DNA, 14 bp, Homo sapiens
gtggcatggaagag

SEQ ID NO: 439742 - DNA, 17 bp, Homo sapiens
gtggccaacgtggacct

SEQ ID NO: 439743 - DNA, 20 bp, Homo sapiens
gtggccaagggctccagggc

SEQ ID NO: 439744 - DNA, 21 bp, Homo sapiens
gtggccactccagacccctgg

SEQ ID NO: 439745 - DNA, 21 bp, Homo sapiens
gtggccagaccagagctctgg

SEQ ID NO: 439746 - DNA, 18 bp, Homo sapiens
gtggccagagctggaagg

SEQ ID NO: 439747 - DNA, 22 bp, Homo sapiens
gtggccaggcctgccagcccct

SEQ ID NO: 439748 - DNA, 15 bp, Homo sapiens
gtggccccaggtgcc

SEQ ID NO: 439749 - DNA, 16 bp, Homo sapiens
gtggccccaggtgcca

SEQ ID NO: 439750 - DNA, 18 bp, Homo sapiens
gtggccccatccagcatg

SEQ ID NO: 439751 - DNA, 17 bp, Homo sapiens
gtggcccctccttctcc

SEQ ID NO: 439752 - DNA, 16 bp, Homo sapiens
gtggccccttttactt

SEQ ID NO: 439753 - DNA, 16 bp, Homo sapiens
gtggcccgacagcctg

SEQ ID NO: 439754 - DNA, 17 bp, Homo sapiens
gtggcccgacagcctgg

SEQ ID NO: 439755 - DNA, 19 bp, Homo sapiens
gtggcccgacagcctggca

SEQ ID NO: 439756 - DNA, 16 bp, Homo sapiens
gtggccctgcaagggc

SEQ ID NO: 439757 - DNA, 11 bp, Homo sapiens
gtggcccttgc

SEQ ID NO: 439758 - DNA, 16 bp, Homo sapiens
gtggccgcctggcagg

SEQ ID NO: 439759 - DNA, 21 bp, Homo sapiens
gtggccgggggtgggggcctg

SEQ ID NO: 439760 - DNA, 11 bp, Homo sapiens
gtggcctcaga

SEQ ID NO: 439761 - DNA, 13 bp, Homo sapiens
gtggcctcagaat

SEQ ID NO: 439762 - DNA, 12 bp, Homo sapiens
gtggcctctcag

SEQ ID NO: 439763 - DNA, 17 bp, Homo sapiens
gtggcctcttgagcagt

SEQ ID NO: 439764 - DNA, 21 bp, Homo sapiens
gtggcctcttgagcagtggct

SEQ ID NO: 439765 - DNA, 13 bp, Homo sapiens
gtggcctggccag

SEQ ID NO: 439766 - DNA, 16 bp, Homo sapiens
gtggcctggccaggag

SEQ ID NO: 439767 - DNA, 15 bp, Homo sapiens
gtggcctgtgtccag

SEQ ID NO: 439768 - DNA, 21 bp, Homo sapiens
gtggcctgtgtccagcagctg

SEQ ID NO: 439769 - DNA, 13 bp, Homo sapiens
gtggcctgtttct

SEQ ID NO: 439770 - DNA, 23 bp, Homo sapiens
gtggccttgcccgccagcctcag

SEQ ID NO: 439771 - DNA, 14 bp, Homo sapiens
gtggcgctttctcc

SEQ ID NO: 439772 - DNA, 15 bp, Homo sapiens
gtggcggggcagcag

SEQ ID NO: 439773 - DNA, 17 bp, Homo sapiens
gtggctcagtgccacct

SEQ ID NO: 439774 - DNA, 22 bp, Homo sapiens
gtggctcatggcgtaatgggcc

SEQ ID NO: 439775 - DNA, 23 bp, Homo sapiens
gtggctcccctctatttagcatg

SEQ ID NO: 439776 - DNA, 16 bp, Homo sapiens
gtggctggggctggca

SEQ ID NO: 439777 - DNA, 16 bp, Homo sapiens
gtggctgggggcagga

SEQ ID NO: 439778 - DNA, 12 bp, Homo sapiens
gtggctgggtgg

SEQ ID NO: 439779 - DNA, 16 bp, Homo sapiens
gtggctgggtggtcag

SEQ ID NO: 439780 - DNA, 19 bp, Homo sapiens
gtggctggtggtcatgaat

SEQ ID NO: 439781 - DNA, 13 bp, Homo sapiens
gtggctggtgtcc

SEQ ID NO: 439782 - DNA, 18 bp, Homo sapiens
gtggctggtgtccccttc

SEQ ID NO: 439783 - DNA, 20 bp, Homo sapiens
gtggctggtgtccccttccc

SEQ ID NO: 439784 - DNA, 21 bp, Homo sapiens
gtggctggtgtccccttcccc

SEQ ID NO: 439785 - DNA, 15 bp, Homo sapiens
gtggctgtggcacag

SEQ ID NO: 439786 - DNA, 20 bp, Homo sapiens
gtggcttactacatgtggga

SEQ ID NO: 439787 - DNA, 13 bp, Homo sapiens
gtggcttcagccc

SEQ ID NO: 439788 - DNA, 19 bp, Homo sapiens
gtggcttggagcagaggtg

SEQ ID NO: 439789 - DNA, 12 bp, Homo sapiens
gtgggaacattc

SEQ ID NO: 439790 - DNA, 13 bp, Homo sapiens
gtgggaagagctg

SEQ ID NO: 439791 - DNA, 14 bp, Homo sapiens
gtgggaagagctgg

SEQ ID NO: 439792 - DNA, 17 bp, Homo sapiens
gtgggaagagctgggtt

SEQ ID NO: 439793 - DNA, 18 bp, Homo sapiens
gtgggaagagctgggttt

SEQ ID NO: 439794 - DNA, 18 bp, Homo sapiens
gtgggaattttatctttt

SEQ ID NO: 439795 - DNA, 15 bp, Homo sapiens
gtgggacagagtctg

SEQ ID NO: 439796 - DNA, 15 bp, Homo sapiens
gtgggacgtggtcag

SEQ ID NO: 439797 - DNA, 21 bp, Homo sapiens
gtgggactggcccacccctct

SEQ ID NO: 439798 - DNA, 18 bp, Homo sapiens
gtgggagaagtggcccct

SEQ ID NO: 439799 - DNA, 12 bp, Homo sapiens
gtgggagaggaa

SEQ ID NO: 439800 - DNA, 13 bp, Homo sapiens
gtgggagaggcag

SEQ ID NO: 439801 - DNA, 19 bp, Homo sapiens
gtgggagcagcggtttggg

SEQ ID NO: 439802 - DNA, 22 bp, Homo sapiens
gtgggagccaatactgagtgcc

SEQ ID NO: 439803 - DNA, 13 bp, Homo sapiens
gtgggagcccagc

SEQ ID NO: 439804 - DNA, 19 bp, Homo sapiens
gtgggagcccagcacactg

SEQ ID NO: 439805 - DNA, 19 bp, Homo sapiens
gtgggaggagagggcagag

SEQ ID NO: 439806 - DNA, 14 bp, Homo sapiens
gtgggaggcccctg

SEQ ID NO: 439807 - DNA, 18 bp, Homo sapiens
gtgggaggcccctggtgg

SEQ ID NO: 439808 - DNA, 15 bp, Homo sapiens
gtgggaggcgtgccc

SEQ ID NO: 439809 - DNA, 15 bp, Homo sapiens
gtgggaggctcccag

SEQ ID NO: 439810 - DNA, 16 bp, Homo sapiens
gtgggaggctcccaga

SEQ ID NO: 439811 - DNA, 22 bp, Homo sapiens
gtgggagggggcgttggattta

SEQ ID NO: 439812 - DNA, 21 bp, Homo sapiens
gtgggaggggtgttccaaaga

SEQ ID NO: 439813 - DNA, 21 bp, Homo sapiens
gtgggagtccactttcctctc

SEQ ID NO: 439814 - DNA, 18 bp, Homo sapiens
gtgggagtgggagaggaa

SEQ ID NO: 439815 - DNA, 15 bp, Homo sapiens
gtgggatccagagag

SEQ ID NO: 439816 - DNA, 18 bp, Homo sapiens
gtgggatccagagagaag

SEQ ID NO: 439817 - DNA, 14 bp, Homo sapiens
gtgggatcctccct

SEQ ID NO: 439818 - DNA, 24 bp, Homo sapiens
gtgggatgttcagcactgtccctt

SEQ ID NO: 439819 - DNA, 22 bp, Homo sapiens
gtgggattatgggtcacaggaa

SEQ ID NO: 439820 - DNA, 21 bp, Homo sapiens
gtgggcacgctgtgggcaggt

SEQ ID NO: 439821 - DNA, 23 bp, Homo sapiens
gtgggcacgctgtgggcaggtgg

SEQ ID NO: 439822 - DNA, 14 bp, Homo sapiens
gtgggcagctgagg

SEQ ID NO: 439823 - DNA, 12 bp, Homo sapiens
gtgggcagctgg

SEQ ID NO: 439824 - DNA, 14 bp, Homo sapiens
gtgggcagctgggc

SEQ ID NO: 439825 - DNA, 13 bp, Homo sapiens
gtgggcaggaaaa

SEQ ID NO: 439826 - DNA, 19 bp, Homo sapiens
gtgggccagcccctcccac

SEQ ID NO: 439827 - DNA, 16 bp, Homo sapiens
gtgggccggccccagg

SEQ ID NO: 439828 - DNA, 22 bp, Homo sapiens
gtgggccggccccaggctcccc

SEQ ID NO: 439829 - DNA, 19 bp, Homo sapiens
gtgggcctcaaggacttga

SEQ ID NO: 439830 - DNA, 15 bp, Homo sapiens
gtgggcctggcctga

SEQ ID NO: 439831 - DNA, 16 bp, Homo sapiens
gtgggcctggcctgag

SEQ ID NO: 439832 - DNA, 17 bp, Homo sapiens
gtgggcctggcctgagc

SEQ ID NO: 439833 - DNA, 20 bp, Homo sapiens
gtgggcctggcctgagctgg

SEQ ID NO: 439834 - DNA, 12 bp, Homo sapiens
gtgttgtctcta

SEQ ID NO: 439835 - DNA, 20 bp, Homo sapiens
gtgttgtgatagctaacatt

SEQ ID NO: 439836 - DNA, 17 bp, Homo sapiens
gtgtttaaataaagacc

SEQ ID NO: 439837 - DNA, 16 bp, Homo sapiens
gtgtttaaataaagta

SEQ ID NO: 439838 - DNA, 23 bp, Homo sapiens
gtgtttaacggcactgtggcctt

SEQ ID NO: 439839 - DNA, 13 bp, Homo sapiens
gtgtttattgtca

SEQ ID NO: 439840 - DNA, 13 bp, Homo sapiens
gtgtttatttata

SEQ ID NO: 439841 - DNA, 19 bp, Homo sapiens
gtgtttcaggacagctgct

SEQ ID NO: 439842 - DNA, 12 bp, Homo sapiens
gtgtttctgttc

SEQ ID NO: 439843 - DNA, 15 bp, Homo sapiens
gtgtttgagtttctg

SEQ ID NO: 439844 - DNA, 19 bp, Homo sapiens
gtgtttgcttaaacaaagt

SEQ ID NO: 439845 - DNA, 14 bp, Homo sapiens
gtgtttgtcaaaaa

SEQ ID NO: 439846 - DNA, 16 bp, Homo sapiens
gtgttttaaagagaat

SEQ ID NO: 439847 - DNA, 13 bp, Homo sapiens
gtgttttcataat

SEQ ID NO: 439848 - DNA, 14 bp, Homo sapiens
gtgttttcataata

SEQ ID NO: 439849 - DNA, 16 bp, Homo sapiens
gtgttttcataataaa

SEQ ID NO: 439850 - DNA, 17 bp, Homo sapiens
gtgttttgtctgagcct

SEQ ID NO: 439851 - DNA, 21 bp, Homo sapiens
gtgttttgtgaggtgaatgtc

SEQ ID NO: 439852 - DNA, 21 bp, Homo sapiens
gtgttttttttcctttgccgt

SEQ ID NO: 439853 - DNA, 13 bp, Homo sapiens
gttaaaaaccatt

SEQ ID NO: 439854 - DNA, 14 bp, Homo sapiens
gttaaaagcatttt

SEQ ID NO: 439855 - DNA, 15 bp, Homo sapiens
gttaaaattccatcc

SEQ ID NO: 439856 - DNA, 16 bp, Homo sapiens
gttaaacgtcacagca

SEQ ID NO: 439857 - DNA, 21 bp, Homo sapiens
gttaaagaggcgtcttgtatt

SEQ ID NO: 439858 - DNA, 15 bp, Homo sapiens
gttaaatatttttgt

SEQ ID NO: 439859 - DNA, 15 bp, Homo sapiens
gttaaatgaaattgt

SEQ ID NO: 439860 - DNA, 18 bp, Homo sapiens
gttaaatgaaattgtaaa

SEQ ID NO: 439861 - DNA, 20 bp, Homo sapiens
gttaaatgaaattgtaaaac

SEQ ID NO: 439862 - DNA, 15 bp, Homo sapiens
gttaacaacttgaat

SEQ ID NO: 439863 - DNA, 15 bp, Homo sapiens
gttaacactgtaata

SEQ ID NO: 439864 - DNA, 16 bp, Homo sapiens
gttaacactgtaatat

SEQ ID NO: 439865 - DNA, 17 bp, Homo sapiens
gttaacatctgaagtgt

SEQ ID NO: 439866 - DNA, 18 bp, Homo sapiens
gttaacattgaccaagaa

SEQ ID NO: 439867 - DNA, 23 bp, Homo sapiens
gttaacattgaccaagaactgca

SEQ ID NO: 439868 - DNA, 12 bp, Homo sapiens
gttaacctacct

SEQ ID NO: 439869 - DNA, 15 bp, Homo sapiens
gttaactctcccagg

SEQ ID NO: 439870 - DNA, 13 bp, Homo sapiens
gttaagacaacag

SEQ ID NO: 439871 - DNA, 12 bp, Homo sapiens
gttaagagaaat

SEQ ID NO: 439872 - DNA, 18 bp, Homo sapiens
gttaagagaaatgagctt

SEQ ID NO: 439873 - DNA, 18 bp, Homo sapiens
gttaagcagcctttctgt

SEQ ID NO: 439874 - DNA, 15 bp, Homo sapiens
gttaaggggatctaa

SEQ ID NO: 439875 - DNA, 20 bp, Homo sapiens
gttaaggggatctaaaagga

SEQ ID NO: 439876 - DNA, 22 bp, Homo sapiens
gttaagtctaaatatttcctta

SEQ ID NO: 439877 - DNA, 11 bp, Homo sapiens
gttaagtgaca

SEQ ID NO: 439878 - DNA, 17 bp, Homo sapiens
gttaagtgtcatttctt

SEQ ID NO: 439879 - DNA, 14 bp, Homo sapiens
gttaataaaggttt

SEQ ID NO: 439880 - DNA, 20 bp, Homo sapiens
gttaatcacttaacctgctt

SEQ ID NO: 439881 - DNA, 16 bp, Homo sapiens
gttaatcatcttctct

SEQ ID NO: 439882 - DNA, 19 bp, Homo sapiens
gttaatcatcttctctttt

SEQ ID NO: 439883 - DNA, 20 bp, Homo sapiens
gttaatgaaggtgtgctaca

SEQ ID NO: 439884 - DNA, 22 bp, Homo sapiens
gttaatgatggttgatgggttc

SEQ ID NO: 439885 - DNA, 22 bp, Homo sapiens
gttaatggctagtactgtattg

SEQ ID NO: 439886 - DNA, 18 bp, Homo sapiens
gttaattcagcactgatt

SEQ ID NO: 439887 - DNA, 20 bp, Homo sapiens
gttaattgattaaactgtat

SEQ ID NO: 439888 - DNA, 21 bp, Homo sapiens
gttaattgattaaactgtatg

SEQ ID NO: 439889 - DNA, 19 bp, Homo sapiens
gttaattggttaatcactt

SEQ ID NO: 439890 - DNA, 16 bp, Homo sapiens
gttacaaactgcaata

SEQ ID NO: 439891 - DNA, 13 bp, Homo sapiens
gttacaagtatac

SEQ ID NO: 439892 - DNA, 15 bp, Homo sapiens
gttacagtgcagaca

SEQ ID NO: 439893 - DNA, 13 bp, Homo sapiens
gttacattaatgt

SEQ ID NO: 439894 - DNA, 17 bp, Homo sapiens
gttaccaaaaatatccc

SEQ ID NO: 439895 - DNA, 18 bp, Homo sapiens
gttaccatgtcactgtgg

SEQ ID NO: 439896 - DNA, 13 bp, Homo sapiens
gttacccacccta

SEQ ID NO: 439897 - DNA, 15 bp, Homo sapiens
gttacccaggctgga

SEQ ID NO: 439898 - DNA, 23 bp, Homo sapiens
gttacgcacacgtacttaaatga

SEQ ID NO: 439899 - DNA, 22 bp, Homo sapiens
gttactaagatgaaattgccaa

SEQ ID NO: 439900 - DNA, 16 bp, Homo sapiens
gttactatcctggctt

SEQ ID NO: 439901 - DNA, 14 bp, Homo sapiens
gttactctggttct

SEQ ID NO: 439902 - DNA, 21 bp, Homo sapiens
gttactgaaggtgatggaggt

SEQ ID NO: 439903 - DNA, 19 bp, Homo sapiens
gttactgatcatgcattgt

SEQ ID NO: 439904 - DNA, 19 bp, Homo sapiens
gttactgtgccatgtgttt

SEQ ID NO: 439905 - DNA, 18 bp, Homo sapiens
gttactgttaaccattta

SEQ ID NO: 439906 - DNA, 14 bp, Homo sapiens
gttactgttcatgg

SEQ ID NO: 439907 - DNA, 20 bp, Homo sapiens
gttacttaaacatcattgga

SEQ ID NO: 439908 - DNA, 12 bp, Homo sapiens
gttacttccttc

SEQ ID NO: 439909 - DNA, 19 bp, Homo sapiens
gttacttgtctgaggcctc

SEQ ID NO: 439910 - DNA, 20 bp, Homo sapiens
gttactttctttcagatgtt

SEQ ID NO: 439911 - DNA, 14 bp, Homo sapiens
gttagaatgaggag

SEQ ID NO: 439912 - DNA, 18 bp, Homo sapiens
gttagaattgatttccaa

SEQ ID NO: 439913 - DNA, 18 bp, Homo sapiens
gttagagaggtagcgagc

SEQ ID NO: 439914 - DNA, 18 bp, Homo sapiens
gttagagatgcctccctg

SEQ ID NO: 439915 - DNA, 22 bp, Homo sapiens
gttagagtccaacgtggggcag

SEQ ID NO: 439916 - DNA, 20 bp, Homo sapiens
gttagcctggtgacaggcag

SEQ ID NO: 439917 - DNA, 21 bp, Homo sapiens
gttagcctggtgacaggcaga

SEQ ID NO: 439918 - DNA, 20 bp, Homo sapiens
gttagctggacatgctttgg

SEQ ID NO: 439919 - DNA, 19 bp, Homo sapiens
gttagctttttaaaacatt

SEQ ID NO: 439920 - DNA, 17 bp, Homo sapiens
gttaggaaataaaacct

SEQ ID NO: 439921 - DNA, 23 bp, Homo sapiens
gttaggatttaacagtcatttaa

SEQ ID NO: 439922 - DNA, 14 bp, Homo sapiens
gttaggccacgctc

SEQ ID NO: 439923 - DNA, 13 bp, Homo sapiens
gttaggctgggcc

SEQ ID NO: 439924 - DNA, 16 bp, Homo sapiens
gttaggggtgggggag

SEQ ID NO: 439925 - DNA, 18 bp, Homo sapiens
gttaggtagagggagttg

SEQ ID NO: 439926 - DNA, 22 bp, Homo sapiens
gttaggtcctcacttgggggaa

SEQ ID NO: 439927 - DNA, 21 bp, Homo sapiens
gttagtagacactaattctgt

SEQ ID NO: 439928 - DNA, 21 bp, Homo sapiens
gttagtagcatgttgagccag

SEQ ID NO: 439929 - DNA, 16 bp, Homo sapiens
gttagtatctaacatg

SEQ ID NO: 439930 - DNA, 17 bp, Homo sapiens
gttagtatctaacatgt

SEQ ID NO: 439931 - DNA, 16 bp, Homo sapiens
gttagtgatttgctat

SEQ ID NO: 439932 - DNA, 13 bp, Homo sapiens
gttagtgggaaga

SEQ ID NO: 439933 - DNA, 23 bp, Homo sapiens
gttagttattttaggagacagtc

SEQ ID NO: 439934 - DNA, 13 bp, Homo sapiens
gttatacttcaaa

SEQ ID NO: 439935 - DNA, 17 bp, Homo sapiens
gttataggtcactcctg

SEQ ID NO: 439936 - DNA, 14 bp, Homo sapiens
gttatatcaacaga

SEQ ID NO: 439937 - DNA, 15 bp, Homo sapiens
gttatatcatcaata

SEQ ID NO: 439938 - DNA, 18 bp, Homo sapiens
gttatatcatcaatactt

SEQ ID NO: 439939 - DNA, 21 bp, Homo sapiens
gttatatgacttcttgttcat

SEQ ID NO: 439940 - DNA, 12 bp, Homo sapiens
gttatattcatt

SEQ ID NO: 439941 - DNA, 23 bp, Homo sapiens
gttatcaaacttcagctgtactt

SEQ ID NO: 439942 - DNA, 22 bp, Homo sapiens
gttatccaactattaagatatc

SEQ ID NO: 439943 - DNA, 13 bp, Homo sapiens
gttatcctgctag

SEQ ID NO: 439944 - DNA, 16 bp, Homo sapiens
gttatcctgtgctaca

SEQ ID NO: 439945 - DNA, 18 bp, Homo sapiens
gttatgagaaaaaaacag

SEQ ID NO: 439946 - DNA, 17 bp, Homo sapiens
gttatgataaaaggaag

SEQ ID NO: 439947 - DNA, 17 bp, Homo sapiens
gttatggggagagggca

SEQ ID NO: 439948 - DNA, 19 bp, Homo sapiens
gttatgtgtatgtgccatt

SEQ ID NO: 439949 - DNA, 21 bp, Homo sapiens
gttattaatccacaaatatgc

SEQ ID NO: 439950 - DNA, 14 bp, Homo sapiens
gttattattggctt

SEQ ID NO: 439951 - DNA, 21 bp, Homo sapiens
gttattcaataactattgctg

SEQ ID NO: 439952 - DNA, 22 bp, Homo sapiens
gttattcactctcccagaggct

SEQ ID NO: 439953 - DNA, 14 bp, Homo sapiens
gttattgaaaaaaa

SEQ ID NO: 439954 - DNA, 21 bp, Homo sapiens
gttattgggcaagtgattgaa

SEQ ID NO: 439955 - DNA, 13 bp, Homo sapiens
gttattgttttca

SEQ ID NO: 439956 - DNA, 14 bp, Homo sapiens
gttatttactttta

SEQ ID NO: 439957 - DNA, 17 bp, Homo sapiens
gttatttcctgctttct

SEQ ID NO: 439958 - DNA, 14 bp, Homo sapiens
gttatttcttgttt

SEQ ID NO: 439959 - DNA, 19 bp, Homo sapiens
gttatttgttattttcagt

SEQ ID NO: 439960 - DNA, 21 bp, Homo sapiens
gttattttaatacctttaaat

SEQ ID NO: 439961 - DNA, 15 bp, Homo sapiens
gttattttcagcatg

SEQ ID NO: 439962 - DNA, 14 bp, Homo sapiens
gttattttcagtat

SEQ ID NO: 439963 - DNA, 15 bp, Homo sapiens
gttattttcagtatt

SEQ ID NO: 439964 - DNA, 22 bp, Homo sapiens
gtttctgattcactattagaga

SEQ ID NO: 439965 - DNA, 16 bp, Homo sapiens
gtttctgcagaggcag

SEQ ID NO: 439966 - DNA, 22 bp, Homo sapiens
gtttctgcagcccttgggcagt

SEQ ID NO: 439967 - DNA, 23 bp, Homo sapiens
gtttctgtaattggcttttgaat

SEQ ID NO: 439968 - DNA, 11 bp, Homo sapiens
gtttcttccaa

SEQ ID NO: 439969 - DNA, 21 bp, Homo sapiens
gtttcttctaaagaggaagcc

SEQ ID NO: 439970 - DNA, 22 bp, Homo sapiens
gtttcttgaagtccagtgtttc

SEQ ID NO: 439971 - DNA, 11 bp, Homo sapiens
gtttgaaacac

SEQ ID NO: 439972 - DNA, 18 bp, Homo sapiens
gtttgaaacactcgtgtg

SEQ ID NO: 439973 - DNA, 14 bp, Homo sapiens
gtttgaaatctttt

SEQ ID NO: 439974 - DNA, 19 bp, Homo sapiens
gtttgaagaaccgcatttt

SEQ ID NO: 439975 - DNA, 20 bp, Homo sapiens
gtttgacgaagaaacaaaaa

SEQ ID NO: 439976 - DNA, 22 bp, Homo sapiens
gtttgagcgcagagtaaaataa

SEQ ID NO: 439977 - DNA, 12 bp, Homo sapiens
gtttgatagtgc

SEQ ID NO: 439978 - DNA, 21 bp, Homo sapiens
gtttgatagtgcttcttgtaa

SEQ ID NO: 439979 - DNA, 23 bp, Homo sapiens
gtttgatatgggctttctctttg

SEQ ID NO: 439980 - DNA, 19 bp, Homo sapiens
gtttgatgtgtatgtgttt

SEQ ID NO: 439981 - DNA, 21 bp, Homo sapiens
gtttgcagaagggggtctctt

SEQ ID NO: 439982 - DNA, 16 bp, Homo sapiens
gtttgccttaattctt

SEQ ID NO: 439983 - DNA, 18 bp, Homo sapiens
gtttgcctttaggcagga

SEQ ID NO: 439984 - DNA, 17 bp, Homo sapiens
gtttgctgcttttgatg

SEQ ID NO: 439985 - DNA, 13 bp, Homo sapiens
gtttgctgtgcca

SEQ ID NO: 439986 - DNA, 16 bp, Homo sapiens
gtttgctgtgccagga

SEQ ID NO: 439987 - DNA, 18 bp, Homo sapiens
gtttgctgtttcccctgc

SEQ ID NO: 439988 - DNA, 13 bp, Homo sapiens
gtttgcttaaaca

SEQ ID NO: 439989 - DNA, 17 bp, Homo sapiens
gtttgcttaaacaaagt

SEQ ID NO: 439990 - DNA, 21 bp, Homo sapiens
gtttgcttaaacaaagtgact

SEQ ID NO: 439991 - DNA, 18 bp, Homo sapiens
gtttgcttattgttccaa

SEQ ID NO: 439992 - DNA, 19 bp, Homo sapiens
gtttgcttcaactgtctcc

SEQ ID NO: 439993 - DNA, 19 bp, Homo sapiens
gtttggaaataaactgtgc

SEQ ID NO: 439994 - DNA, 20 bp, Homo sapiens
gtttggatgggagtgagaca

SEQ ID NO: 439995 - DNA, 17 bp, Homo sapiens
gtttggcaatagtttgc

SEQ ID NO: 439996 - DNA, 21 bp, Homo sapiens
gtttggcgggccaaggactgc

SEQ ID NO: 439997 - DNA, 17 bp, Homo sapiens
gtttggctgaaattatg

SEQ ID NO: 439998 - DNA, 11 bp, Homo sapiens
gtttggctgta

SEQ ID NO: 439999 - DNA, 18 bp, Homo sapiens
gtttggcttataaacaca

SEQ ID NO: 440000 - DNA, 22 bp, Homo sapiens
gtttgggaatggtgcccttgga

SEQ ID NO: 440001 - DNA, 16 bp, Homo sapiens
gtttgggcagtggaga

SEQ ID NO: 440002 - DNA, 16 bp, Homo sapiens
gtttggggcgaggcag

SEQ ID NO: 440003 - DNA, 21 bp, Homo sapiens
gtttgggggttaccaaaaata

SEQ ID NO: 440004 - DNA, 23 bp, Homo sapiens
gtttggtctgggacttccttgct

SEQ ID NO: 440005 - DNA, 15 bp, Homo sapiens
gtttggtgtctgatg

SEQ ID NO: 440006 - DNA, 16 bp, Homo sapiens
gtttgtataacttctt

SEQ ID NO: 440007 - DNA, 20 bp, Homo sapiens
gtttgtcatcagatggaaat

SEQ ID NO: 440008 - DNA, 20 bp, Homo sapiens
gtttgtccctcctgccatgt

SEQ ID NO: 440009 - DNA, 22 bp, Homo sapiens
gtttgtcctgatgcttttgtct

SEQ ID NO: 440010 - DNA, 17 bp, Homo sapiens
gtttgtcctttaactat

SEQ ID NO: 440011 - DNA, 15 bp, Homo sapiens
gtttgtgagccttgc

SEQ ID NO: 440012 - DNA, 20 bp, Homo sapiens
gtttgtgagccttgctgcca

SEQ ID NO: 440013 - DNA, 16 bp, Homo sapiens
gtttgtgctgcagaca

SEQ ID NO: 440014 - DNA, 15 bp, Homo sapiens
gtttgtggcctcaga

SEQ ID NO: 440015 - DNA, 16 bp, Homo sapiens
gtttgtggcctcagaa

SEQ ID NO: 440016 - DNA, 19 bp, Homo sapiens
gtttgttatcagtacaatt

SEQ ID NO: 440017 - DNA, 23 bp, Homo sapiens
gtttgttgcacagtccctcctgt

SEQ ID NO: 440018 - DNA, 24 bp, Homo sapiens
gttttaaaataaaaattctgaatg

SEQ ID NO: 440019 - DNA, 22 bp, Homo sapiens
gttttaaaataagttaaaggca

SEQ ID NO: 440020 - DNA, 23 bp, Homo sapiens
gttttaaagggagccatgctctt

SEQ ID NO: 440021 - DNA, 22 bp, Homo sapiens
gttttaacaatttcctttatat

SEQ ID NO: 440022 - DNA, 19 bp, Homo sapiens
gttttaaggaagaaaaatc

SEQ ID NO: 440023 - DNA, 23 bp, Homo sapiens
gttttaattccaatatgatgact

SEQ ID NO: 440024 - DNA, 23 bp, Homo sapiens
gttttacaataaaatcttgaaaa

SEQ ID NO: 440025 - DNA, 18 bp, Homo sapiens
gttttacaatggctgggt

SEQ ID NO: 440026 - DNA, 22 bp, Homo sapiens
gttttacattacaaatttctgt

SEQ ID NO: 440027 - DNA, 21 bp, Homo sapiens
gttttactacccaaatctaaa

SEQ ID NO: 440028 - DNA, 14 bp, Homo sapiens
gttttactgctttt

SEQ ID NO: 440029 - DNA, 13 bp, Homo sapiens
gttttagaaaaca

SEQ ID NO: 440030 - DNA, 15 bp, Homo sapiens
gttttagttaaattt

SEQ ID NO: 440031 - DNA, 16 bp, Homo sapiens
gttttagtttcaaaat

SEQ ID NO: 440032 - DNA, 14 bp, Homo sapiens
gttttatcatgaca

SEQ ID NO: 440033 - DNA, 22 bp, Homo sapiens
gttttatcatgacatgttatat

SEQ ID NO: 440034 - DNA, 13 bp, Homo sapiens
gttttatgtttct

SEQ ID NO: 440035 - DNA, 22 bp, Homo sapiens
gttttattgtccttcagagctc

SEQ ID NO: 440036 - DNA, 21 bp, Homo sapiens
gttttattttttattgttttc

SEQ ID NO: 440037 - DNA, 17 bp, Homo sapiens
gttttcaaattggactt

SEQ ID NO: 440038 - DNA, 20 bp, Homo sapiens
gttttcaatgttttcttttc

SEQ ID NO: 440039 - DNA, 19 bp, Homo sapiens
gttttcagaacctcttccc

SEQ ID NO: 440040 - DNA, 21 bp, Homo sapiens
gttttcagaacctcttcccca

SEQ ID NO: 440041 - DNA, 14 bp, Homo sapiens
gttttcataataaa

SEQ ID NO: 440042 - DNA, 15 bp, Homo sapiens
gttttcatcctggcc

SEQ ID NO: 440043 - DNA, 17 bp, Homo sapiens
gttttcatcctggcctc

SEQ ID NO: 440044 - DNA, 21 bp, Homo sapiens
gttttcatggtgaaaatgtac

SEQ ID NO: 440045 - DNA, 18 bp, Homo sapiens
gttttccatgaaaacgtt

SEQ ID NO: 440046 - DNA, 20 bp, Homo sapiens
gttttccccaattatcctcc

SEQ ID NO: 440047 - DNA, 22 bp, Homo sapiens
gttttcccgagcaaagtctaaa

SEQ ID NO: 440048 - DNA, 23 bp, Homo sapiens
gttttcccgagcaaagtctaaag

SEQ ID NO: 440049 - DNA, 17 bp, Homo sapiens
gttttcctaaatgcagt

SEQ ID NO: 440050 - DNA, 21 bp, Homo sapiens
gttttcctagtatacccactg

SEQ ID NO: 440051 - DNA, 18 bp, Homo sapiens
gttttcgaagctcagccc

SEQ ID NO: 440052 - DNA, 20 bp, Homo sapiens
gttttcgaagctcagcccac

SEQ ID NO: 440053 - DNA, 23 bp, Homo sapiens
gttttctcaacaaatggaatgcc

SEQ ID NO: 440054 - DNA, 20 bp, Homo sapiens
gttttctcagaacagctgaa

SEQ ID NO: 440055 - DNA, 16 bp, Homo sapiens
gttttctgtaaataac

SEQ ID NO: 440056 - DNA, 19 bp, Homo sapiens
gttttctttgctgtgccaa

SEQ ID NO: 440057 - DNA, 11 bp, Homo sapiens
gttttcttttc

SEQ ID NO: 440058 - DNA, 15 bp, Homo sapiens
gttttcttttctgtg

SEQ ID NO: 440059 - DNA, 21 bp, Homo sapiens
gttttgatgaaattcttgaag

SEQ ID NO: 440060 - DNA, 17 bp, Homo sapiens
gttttgatgagaaaaaa

SEQ ID NO: 440061 - DNA, 23 bp, Homo sapiens
gttttgattaatgtttcttaaat

SEQ ID NO: 440062 - DNA, 22 bp, Homo sapiens
gttttgcaagggaatgaatcca

SEQ ID NO: 440063 - DNA, 13 bp, Homo sapiens
gttttgcactttt

SEQ ID NO: 440064 - DNA, 16 bp, Homo sapiens
gttttgcatgtctgca

SEQ ID NO: 440065 - DNA, 21 bp, Homo sapiens
gttttgccccatgataaaata

SEQ ID NO: 440066 - DNA, 22 bp, Homo sapiens
gttttgccccatgataaaataa

SEQ ID NO: 440067 - DNA, 11 bp, Homo sapiens
gttttgctttt

SEQ ID NO: 440068 - DNA, 22 bp, Homo sapiens
gttttgcttttatccactggca

SEQ ID NO: 440069 - DNA, 14 bp, Homo sapiens
gttttgtgtgtata

SEQ ID NO: 440070 - DNA, 14 bp, Homo sapiens
gttttgttttttag

SEQ ID NO: 440071 - DNA, 16 bp, Homo sapiens
gttttgtttttttcct

SEQ ID NO: 440072 - DNA, 17 bp, Homo sapiens
gtttttaaaaaggcctt

SEQ ID NO: 440073 - DNA, 15 bp, Homo sapiens
gtttttaaaagtttc

SEQ ID NO: 440074 - DNA, 15 bp, Homo sapiens
gtttttaaatatatt

SEQ ID NO: 440075 - DNA, 15 bp, Homo sapiens
gtttttaagtcctgt

SEQ ID NO: 440076 - DNA, 17 bp, Homo sapiens
gtttttaataaagacag

SEQ ID NO: 440077 - DNA, 14 bp, Homo sapiens
gtttttatattact

SEQ ID NO: 440078 - DNA, 13 bp, Homo sapiens
gtttttattacaa

SEQ ID NO: 440079 - DNA, 16 bp, Homo sapiens
gtttttccatgtgttt

SEQ ID NO: 440080 - DNA, 18 bp, Homo sapiens
gtttttctgttccctgct

SEQ ID NO: 440081 - DNA, 22 bp, Homo sapiens
gtttttcttggggtactcttga

SEQ ID NO: 440082 - DNA, 19 bp, Homo sapiens
gtttttgggtgcaagaggg

SEQ ID NO: 440083 - DNA, 22 bp, Homo sapiens
gtttttgttgagtctctgaaca

SEQ ID NO: 440084 - DNA, 12 bp, Homo sapiens
gtttttgttttg

SEQ ID NO: 440085 - DNA, 22 bp, Homo sapiens
gttttttaaggtgagttctcac

SEQ ID NO: 440086 - DNA, 16 bp, Homo sapiens
gttttttgccactgca

SEQ ID NO: 440087 - DNA, 13 bp, Homo sapiens
gtttttttccttt

SEQ ID NO: 440088 - DNA, 14 bp, Homo sapiens
gtttttttctaata

SEQ ID NO: 440089 - DNA, 18 bp, Homo sapiens
gttttttttaaataaaag

SEQ ID NO: 440090 - DNA, 20 bp, Homo sapiens
gttttttttaaataaaagca

SEQ ID NO: 440091 - DNA, 19 bp, Homo sapiens
gtttttttttcctgtcctt

SEQ ID NO: 440092 - DNA, 15 bp, Homo sapiens
tactccccttgagct

SEQ ID NO: 440093 - DNA, 16 bp, Homo sapiens
tactccccttgagctg

SEQ ID NO: 440094 - DNA, 13 bp, Homo sapiens
tactcccttcctg

SEQ ID NO: 440095 - DNA, 12 bp, Homo sapiens
tactcctcccag

SEQ ID NO: 440096 - DNA, 13 bp, Homo sapiens
tactcctctgcag

SEQ ID NO: 440097 - DNA, 14 bp, Homo sapiens
tactcctctgcagt

SEQ ID NO: 440098 - DNA, 16 bp, Homo sapiens
tactcctctgcagtgc

SEQ ID NO: 440099 - DNA, 14 bp, Homo sapiens
tactcctgcaaaat

SEQ ID NO: 440100 - DNA, 16 bp, Homo sapiens
tactcctgcaaaattt

SEQ ID NO: 440101 - DNA, 22 bp, Homo sapiens
tactcctgcaaaattttatagc

SEQ ID NO: 440102 - DNA, 22 bp, Homo sapiens
tactcgagttacagacaaagcg

SEQ ID NO: 440103 - DNA, 18 bp, Homo sapiens
tactctagcctgggccag

SEQ ID NO: 440104 - DNA, 12 bp, Homo sapiens
tactctccagga

SEQ ID NO: 440105 - DNA, 16 bp, Homo sapiens
tactctcctcatctct

SEQ ID NO: 440106 - DNA, 20 bp, Homo sapiens
tactctcctcggccccctcc

SEQ ID NO: 440107 - DNA, 14 bp, Homo sapiens
tactctctgctcta

SEQ ID NO: 440108 - DNA, 14 bp, Homo sapiens
tactctgaaaagca

SEQ ID NO: 440109 - DNA, 21 bp, Homo sapiens
tactctgacataaacccatct

SEQ ID NO: 440110 - DNA, 14 bp, Homo sapiens
tactctgagcccag

SEQ ID NO: 440111 - DNA, 18 bp, Homo sapiens
tactctgagcccaggccg

SEQ ID NO: 440112 - DNA, 17 bp, Homo sapiens
tactctggttctttgtt

SEQ ID NO: 440113 - DNA, 11 bp, Homo sapiens
tactctgtcca

SEQ ID NO: 440114 - DNA, 13 bp, Homo sapiens
tactctgtccagg

SEQ ID NO: 440115 - DNA, 16 bp, Homo sapiens
tactctgtccaggcca

SEQ ID NO: 440116 - DNA, 12 bp, Homo sapiens
tactctgtctcc

SEQ ID NO: 440117 - DNA, 13 bp, Homo sapiens
tactctgttgcct

SEQ ID NO: 440118 - DNA, 15 bp, Homo sapiens
tactctgttgcctcc

SEQ ID NO: 440119 - DNA, 17 bp, Homo sapiens
tactctgttgcctcctc

SEQ ID NO: 440120 - DNA, 20 bp, Homo sapiens
tactctgttgcctcctctct

SEQ ID NO: 440121 - DNA, 15 bp, Homo sapiens
tactcttaaatatac

SEQ ID NO: 440122 - DNA, 21 bp, Homo sapiens
tactcttaggaagagaaacca

SEQ ID NO: 440123 - DNA, 16 bp, Homo sapiens
tactcttgaattcctg

SEQ ID NO: 440124 - DNA, 19 bp, Homo sapiens
tactctttgtctttttaag

SEQ ID NO: 440125 - DNA, 18 bp, Homo sapiens
tactctttttctaaagtg

SEQ ID NO: 440126 - DNA, 20 bp, Homo sapiens
tactctttttctaaagtgtt

SEQ ID NO: 440127 - DNA, 22 bp, Homo sapiens
tactgaaacatttgacacataa

SEQ ID NO: 440128 - DNA, 21 bp, Homo sapiens
tactgacaactgtttaattga

SEQ ID NO: 440129 - DNA, 13 bp, Homo sapiens
tactgacatgtgg

SEQ ID NO: 440130 - DNA, 23 bp, Homo sapiens
tactgagccttgtaattctaaat

SEQ ID NO: 440131 - DNA, 18 bp, Homo sapiens
tactgagcttctctgtga

SEQ ID NO: 440132 - DNA, 17 bp, Homo sapiens
tactgagtgcctgcagc

SEQ ID NO: 440133 - DNA, 17 bp, Homo sapiens
tactgatcatgcattgt

SEQ ID NO: 440134 - DNA, 18 bp, Homo sapiens
tactgatcatgcattgtt

SEQ ID NO: 440135 - DNA, 13 bp, Homo sapiens
tactgatttttgt

SEQ ID NO: 440136 - DNA, 17 bp, Homo sapiens
tactgcaaaaagtacat

SEQ ID NO: 440137 - DNA, 18 bp, Homo sapiens
tactgcaaaaagtacata

SEQ ID NO: 440138 - DNA, 23 bp, Homo sapiens
tactgcccaatatgcagttctgc

SEQ ID NO: 440139 - DNA, 19 bp, Homo sapiens
tactgcccaggcctgcctg

SEQ ID NO: 440140 - DNA, 22 bp, Homo sapiens
tactgcccaggcctgcctgttc

SEQ ID NO: 440141 - DNA, 19 bp, Homo sapiens
tactgcccggggcagctgc

SEQ ID NO: 440142 - DNA, 21 bp, Homo sapiens
tactgcctaggagttaatgat

SEQ ID NO: 440143 - DNA, 17 bp, Homo sapiens
tactgccttcagtatca

SEQ ID NO: 440144 - DNA, 23 bp, Homo sapiens
tactgccttcagtatcaaggctg

SEQ ID NO: 440145 - DNA, 15 bp, Homo sapiens
tactgctgtcattgt

SEQ ID NO: 440146 - DNA, 23 bp, Homo sapiens
tactgctgtcattgtccatgcct

SEQ ID NO: 440147 - DNA, 22 bp, Homo sapiens
tactgcttgaccgtactctcac

SEQ ID NO: 440148 - DNA, 22 bp, Homo sapiens
tactgcttggatccatacaaaa

SEQ ID NO: 440149 - DNA, 17 bp, Homo sapiens
tactggaagttttgcat

SEQ ID NO: 440150 - DNA, 11 bp, Homo sapiens
tactgggaagc

SEQ ID NO: 440151 - DNA, 19 bp, Homo sapiens
tactggtgcagtcattatg

SEQ ID NO: 440152 - DNA, 13 bp, Homo sapiens
tactggtttgtat

SEQ ID NO: 440153 - DNA, 14 bp, Homo sapiens
tactgtaaagaatt

SEQ ID NO: 440154 - DNA, 18 bp, Homo sapiens
tactgtaaggaaatgtta

SEQ ID NO: 440155 - DNA, 13 bp, Homo sapiens
tactgtcaataaa

SEQ ID NO: 440156 - DNA, 19 bp, Homo sapiens
tactgtcagtgtcctcagg

SEQ ID NO: 440157 - DNA, 15 bp, Homo sapiens
tactgtctccttccc

SEQ ID NO: 440158 - DNA, 17 bp, Homo sapiens
tactgtctccttcccac

SEQ ID NO: 440159 - DNA, 16 bp, Homo sapiens
tactgtctggttttaa

SEQ ID NO: 440160 - DNA, 17 bp, Homo sapiens
tactgtctgtaagagaa

SEQ ID NO: 440161 - DNA, 14 bp, Homo sapiens
tactgtcttgtctc

SEQ ID NO: 440162 - DNA, 19 bp, Homo sapiens
tactgtcttgtctcacttt

SEQ ID NO: 440163 - DNA, 16 bp, Homo sapiens
tactgtctttattctt

SEQ ID NO: 440164 - DNA, 11 bp, Homo sapiens
tactgtggagg

SEQ ID NO: 440165 - DNA, 21 bp, Homo sapiens
tactgtgtcatggtgatgcaa

SEQ ID NO: 440166 - DNA, 23 bp, Homo sapiens
tactgtgtcatggtgatgcaagt

SEQ ID NO: 440167 - DNA, 13 bp, Homo sapiens
tactgtgttcctg

SEQ ID NO: 440168 - DNA, 15 bp, Homo sapiens
tactgttaaccattt

SEQ ID NO: 440169 - DNA, 10 bp, Homo sapiens
tactgttctt

SEQ ID NO: 440170 - DNA, 15 bp, Homo sapiens
tactgtttgtaatat

SEQ ID NO: 440171 - DNA, 15 bp, Homo sapiens
tacttaaacatcatt

SEQ ID NO: 440172 - DNA, 17 bp, Homo sapiens
tacttaaatgaaagcat

SEQ ID NO: 440173 - DNA, 18 bp, Homo sapiens
tacttaaatgaaagcatg

SEQ ID NO: 440174 - DNA, 14 bp, Homo sapiens
tacttaactgtgtg

SEQ ID NO: 440175 - DNA, 20 bp, Homo sapiens
tacttaactgtgtgaagaaa

SEQ ID NO: 440176 - DNA, 14 bp, Homo sapiens
tacttacggtttta

SEQ ID NO: 440177 - DNA, 15 bp, Homo sapiens
tacttagtggtatgt

SEQ ID NO: 440178 - DNA, 19 bp, Homo sapiens
tacttagtggtatgtctct

SEQ ID NO: 440179 - DNA, 14 bp, Homo sapiens
tacttatgcacatt

SEQ ID NO: 440180 - DNA, 17 bp, Homo sapiens
tacttatttataacatt

SEQ ID NO: 440181 - DNA, 20 bp, Homo sapiens
tacttatttataacattgta

SEQ ID NO: 440182 - DNA, 21 bp, Homo sapiens
tacttcaagttaaagtgaata

SEQ ID NO: 440183 - DNA, 23 bp, Homo sapiens
tacttcaagttaaagtgaataac

SEQ ID NO: 440184 - DNA, 17 bp, Homo sapiens
tacttcataagatattc

SEQ ID NO: 440185 - DNA, 18 bp, Homo sapiens
tacttcatagctccttgg

SEQ ID NO: 440186 - DNA, 23 bp, Homo sapiens
tacttccataggacatactgcat

SEQ ID NO: 440187 - DNA, 14 bp, Homo sapiens
tacttccctcaggc

SEQ ID NO: 440188 - DNA, 24 bp, Homo sapiens
tacttcctcctcctcctcctgttc

SEQ ID NO: 440189 - DNA, 13 bp, Homo sapiens
tacttcctcctga

SEQ ID NO: 440190 - DNA, 18 bp, Homo sapiens
tacttcgtcttctaattt

SEQ ID NO: 440191 - DNA, 15 bp, Homo sapiens
tacttctgtgtctgt

SEQ ID NO: 440192 - DNA, 16 bp, Homo sapiens
tacttctgtgtctgtc

SEQ ID NO: 440193 - DNA, 14 bp, Homo sapiens
tacttcttatacat

SEQ ID NO: 440194 - DNA, 16 bp, Homo sapiens
tacttcttatacattt

SEQ ID NO: 440195 - DNA, 14 bp, Homo sapiens
tacttctttttcat

SEQ ID NO: 440196 - DNA, 16 bp, Homo sapiens
tacttgatatttcctt

SEQ ID NO: 440197 - DNA, 18 bp, Homo sapiens
tacttgatcattctcagt

SEQ ID NO: 440198 - DNA, 15 bp, Homo sapiens
tacttgctcaataaa

SEQ ID NO: 440199 - DNA, 15 bp, Homo sapiens
tacttggaaataata

SEQ ID NO: 440200 - DNA, 16 bp, Homo sapiens
tacttggaaataataa

SEQ ID NO: 440201 - DNA, 21 bp, Homo sapiens
tacttggaaatattaaaagaa

SEQ ID NO: 440202 - DNA, 17 bp, Homo sapiens
tacttgggaagctgagg

SEQ ID NO: 440203 - DNA, 16 bp, Homo sapiens
tacttgggagcctgag

SEQ ID NO: 440204 - DNA, 14 bp, Homo sapiens
tacttgtctgaggc

SEQ ID NO: 440205 - DNA, 15 bp, Homo sapiens
tacttgtctgaggcc

SEQ ID NO: 440206 - DNA, 20 bp, Homo sapiens
tacttgtgtttgcttaaaca

SEQ ID NO: 440207 - DNA, 13 bp, Homo sapiens
tactttaaatcct

SEQ ID NO: 440208 - DNA, 14 bp, Homo sapiens
tactttaacttcca

SEQ ID NO: 440209 - DNA, 19 bp, Homo sapiens
tactttattaatatgagtt

SEQ ID NO: 440210 - DNA, 20 bp, Homo sapiens
tactttgatttacagtgcct

SEQ ID NO: 440211 - DNA, 15 bp, Homo sapiens
tactttgtgcaatat

SEQ ID NO: 440212 - DNA, 14 bp, Homo sapiens
tactttgtttttcc

SEQ ID NO: 440213 - DNA, 15 bp, Homo sapiens
tactttgtttttcca

SEQ ID NO: 440214 - DNA, 16 bp, Homo sapiens
tactttgtttttccat

SEQ ID NO: 440215 - DNA, 17 bp, Homo sapiens
tactttgtttttccatg

SEQ ID NO: 440216 - DNA, 18 bp, Homo sapiens
tacttttaccactattta

SEQ ID NO: 440217 - DNA, 21 bp, Homo sapiens
tacttttatttgcaacattta

SEQ ID NO: 440218 - DNA, 14 bp, Homo sapiens
tacttttgataata

SEQ ID NO: 440219 - DNA, 14 bp, Homo sapiens
tacttttgtaaata

SEQ ID NO: 440220 - DNA, 15 bp, Homo sapiens
tacttttgtaaatat

SEQ ID NO: 440221 - DNA, 13 bp, Homo sapiens
tacttttgtttca

SEQ ID NO: 440222 - DNA, 13 bp, Homo sapiens
tactttttaaaca

SEQ ID NO: 440223 - DNA, 16 bp, Homo sapiens
taggtgtcatttccat

SEQ ID NO: 440224 - DNA, 14 bp, Homo sapiens
taggtgtccccaac

SEQ ID NO: 440225 - DNA, 13 bp, Homo sapiens
taggtgtttggga

SEQ ID NO: 440226 - DNA, 20 bp, Homo sapiens
taggttgccaataatacact

SEQ ID NO: 440227 - DNA, 23 bp, Homo sapiens
taggttggagatgacagaaatat

SEQ ID NO: 440228 - DNA, 20 bp, Homo sapiens
taggttgtttttaaaaccac

SEQ ID NO: 440229 - DNA, 21 bp, Homo sapiens
taggtttaactcagatcacta

SEQ ID NO: 440230 - DNA, 21 bp, Homo sapiens
taggtttagaatcaagtctgt

SEQ ID NO: 440231 - DNA, 15 bp, Homo sapiens
tagtaaaattagaaa

SEQ ID NO: 440232 - DNA, 20 bp, Homo sapiens
tagtaacacataaagtaaat

SEQ ID NO: 440233 - DNA, 14 bp, Homo sapiens
tagtaattgttaca

SEQ ID NO: 440234 - DNA, 16 bp, Homo sapiens
tagtaccaatcatttt

SEQ ID NO: 440235 - DNA, 16 bp, Homo sapiens
tagtacctttgctctt

SEQ ID NO: 440236 - DNA, 14 bp, Homo sapiens
tagtactattacta

SEQ ID NO: 440237 - DNA, 22 bp, Homo sapiens
tagtactattatggaattactc

SEQ ID NO: 440238 - DNA, 21 bp, Homo sapiens
tagtactcctgcaaaatttta

SEQ ID NO: 440239 - DNA, 19 bp, Homo sapiens
tagtactccttaagaacac

SEQ ID NO: 440240 - DNA, 17 bp, Homo sapiens
tagtagaatctcagcac

SEQ ID NO: 440241 - DNA, 22 bp, Homo sapiens
tagtagaatctcagcactttgt

SEQ ID NO: 440242 - DNA, 12 bp, Homo sapiens
tagtagagacag

SEQ ID NO: 440243 - DNA, 20 bp, Homo sapiens
tagtagagatttcatagcta

SEQ ID NO: 440244 - DNA, 16 bp, Homo sapiens
tagtagagcaaagact

SEQ ID NO: 440245 - DNA, 23 bp, Homo sapiens
tagtagagcaacccattaatctt

SEQ ID NO: 440246 - DNA, 22 bp, Homo sapiens
tagtagcagagtcattgttaca

SEQ ID NO: 440247 - DNA, 14 bp, Homo sapiens
tagtagcatgttga

SEQ ID NO: 440248 - DNA, 11 bp, Homo sapiens
tagtagcattt

SEQ ID NO: 440249 - DNA, 17 bp, Homo sapiens
tagtagccctttctgtg

SEQ ID NO: 440250 - DNA, 14 bp, Homo sapiens
tagtagctgataaa

SEQ ID NO: 440251 - DNA, 18 bp, Homo sapiens
tagtagctgataaagaaa

SEQ ID NO: 440252 - DNA, 16 bp, Homo sapiens
tagtaggagctgagct

SEQ ID NO: 440253 - DNA, 17 bp, Homo sapiens
tagtaggctaaaaacat

SEQ ID NO: 440254 - DNA, 18 bp, Homo sapiens
tagtaggctaaaaacatt

SEQ ID NO: 440255 - DNA, 21 bp, Homo sapiens
tagtagtaaaattagaaaaaa

SEQ ID NO: 440256 - DNA, 16 bp, Homo sapiens
tagtatatctggacaa

SEQ ID NO: 440257 - DNA, 12 bp, Homo sapiens
tagtatatttat

SEQ ID NO: 440258 - DNA, 14 bp, Homo sapiens
tagtatctaacatg

SEQ ID NO: 440259 - DNA, 15 bp, Homo sapiens
tagtcaactgctgtt

SEQ ID NO: 440260 - DNA, 18 bp, Homo sapiens
tagtcaactgctgtttta

SEQ ID NO: 440261 - DNA, 13 bp, Homo sapiens
tagtcacctgctg

SEQ ID NO: 440262 - DNA, 17 bp, Homo sapiens
tagtcacttatttcata

SEQ ID NO: 440263 - DNA, 20 bp, Homo sapiens
tagtcatatgtgaagacaga

SEQ ID NO: 440264 - DNA, 14 bp, Homo sapiens
tagtccctgtgttc

SEQ ID NO: 440265 - DNA, 16 bp, Homo sapiens
tagtcccttcccctcc

SEQ ID NO: 440266 - DNA, 20 bp, Homo sapiens
tagtcccttcccctccctgg

SEQ ID NO: 440267 - DNA, 14 bp, Homo sapiens
tagtcctcacagcc

SEQ ID NO: 440268 - DNA, 15 bp, Homo sapiens
tagtcctccaaaaca

SEQ ID NO: 440269 - DNA, 20 bp, Homo sapiens
tagtctcctttgcactgagg

SEQ ID NO: 440270 - DNA, 18 bp, Homo sapiens
tagtctctgggtttacaa

SEQ ID NO: 440271 - DNA, 12 bp, Homo sapiens
tagtctggtttc

SEQ ID NO: 440272 - DNA, 12 bp, Homo sapiens
tagtcttctcat

SEQ ID NO: 440273 - DNA, 20 bp, Homo sapiens
tagtgacccggaggccacat

SEQ ID NO: 440274 - DNA, 23 bp, Homo sapiens
tagtgagtgtggcttagtaatag

SEQ ID NO: 440275 - DNA, 14 bp, Homo sapiens
tagtgatgaaatta

SEQ ID NO: 440276 - DNA, 21 bp, Homo sapiens
tagtgatgaaattataagtag

SEQ ID NO: 440277 - DNA, 13 bp, Homo sapiens
tagtgatggttcc

SEQ ID NO: 440278 - DNA, 14 bp, Homo sapiens
tagtgatggttccc

SEQ ID NO: 440279 - DNA, 18 bp, Homo sapiens
tagtgcagagaggttgtg

SEQ ID NO: 440280 - DNA, 15 bp, Homo sapiens
tagtgcagctgattt

SEQ ID NO: 440281 - DNA, 19 bp, Homo sapiens
tagtgcagtcaccctgtgg

SEQ ID NO: 440282 - DNA, 14 bp, Homo sapiens
tagtgcctaaaatt

SEQ ID NO: 440283 - DNA, 18 bp, Homo sapiens
tagtgcctaaaattgtat

SEQ ID NO: 440284 - DNA, 21 bp, Homo sapiens
tagtgcctcagcgctgcccac

SEQ ID NO: 440285 - DNA, 22 bp, Homo sapiens
tagtgcctcagcgctgcccaca

SEQ ID NO: 440286 - DNA, 22 bp, Homo sapiens
tagtgcctgagagtatttaggc

SEQ ID NO: 440287 - DNA, 11 bp, Homo sapiens
tagtgcctttt

SEQ ID NO: 440288 - DNA, 14 bp, Homo sapiens
tagtgctgaagctt

SEQ ID NO: 440289 - DNA, 15 bp, Homo sapiens
tagtgctgaagctta

SEQ ID NO: 440290 - DNA, 22 bp, Homo sapiens
tagtgctgaagcttattaatgc

SEQ ID NO: 440291 - DNA, 11 bp, Homo sapiens
tagtgctggta

SEQ ID NO: 440292 - DNA, 14 bp, Homo sapiens
tagtgcttcttgta

SEQ ID NO: 440293 - DNA, 15 bp, Homo sapiens
tagtggaaagattgt

SEQ ID NO: 440294 - DNA, 19 bp, Homo sapiens
tagtggaaagattgtgtct

SEQ ID NO: 440295 - DNA, 16 bp, Homo sapiens
tagtggaagagcagcc

SEQ ID NO: 440296 - DNA, 14 bp, Homo sapiens
tagtggcttcaaaa

SEQ ID NO: 440297 - DNA, 21 bp, Homo sapiens
tagtggcttcttttgaactgt

SEQ ID NO: 440298 - DNA, 15 bp, Homo sapiens
tagtgggaagagctg

SEQ ID NO: 440299 - DNA, 16 bp, Homo sapiens
tagtgggagcccagca

SEQ ID NO: 440300 - DNA, 23 bp, Homo sapiens
tagtgggagcccagcacactgct

SEQ ID NO: 440301 - DNA, 20 bp, Homo sapiens
tagtgggccctctctctggg

SEQ ID NO: 440302 - DNA, 17 bp, Homo sapiens
tagtggtggctctgaga

SEQ ID NO: 440303 - DNA, 21 bp, Homo sapiens
tagtgtcacttttttcctgtc

SEQ ID NO: 440304 - DNA, 23 bp, Homo sapiens
tagtgtcacttttttcctgtcaa

SEQ ID NO: 440305 - DNA, 15 bp, Homo sapiens
tagtgtcccttacct

SEQ ID NO: 440306 - DNA, 18 bp, Homo sapiens
tagtgtctgtccatctgt

SEQ ID NO: 440307 - DNA, 18 bp, Homo sapiens
tagtgtggttttctgttt

SEQ ID NO: 440308 - DNA, 19 bp, Homo sapiens
tagtgtttctgcagaggca

SEQ ID NO: 440309 - DNA, 19 bp, Homo sapiens
tagttaaatttctggacct

SEQ ID NO: 440310 - DNA, 19 bp, Homo sapiens
tagttaacctagaagtatt

SEQ ID NO: 440311 - DNA, 13 bp, Homo sapiens
tagttaagtcgct

SEQ ID NO: 440312 - DNA, 21 bp, Homo sapiens
tagttaagtcgctgaacaatt

SEQ ID NO: 440313 - DNA, 18 bp, Homo sapiens
tagttagcaggaaatagt

SEQ ID NO: 440314 - DNA, 16 bp, Homo sapiens
tagttaggaaataaaa

SEQ ID NO: 440315 - DNA, 22 bp, Homo sapiens
tagttaggaaataaaacctttc

SEQ ID NO: 440316 - DNA, 15 bp, Homo sapiens
tagttaggatagcat

SEQ ID NO: 440317 - DNA, 15 bp, Homo sapiens
tagttatagtttcag

SEQ ID NO: 440318 - DNA, 16 bp, Homo sapiens
tagttatgtgagaaag

SEQ ID NO: 440319 - DNA, 21 bp, Homo sapiens
tagttcaggatttggtttttc

SEQ ID NO: 440320 - DNA, 14 bp, Homo sapiens
tagttcatccaatc

SEQ ID NO: 440321 - DNA, 16 bp, Homo sapiens
tagttccattcttggt

SEQ ID NO: 440322 - DNA, 15 bp, Homo sapiens
tagttccctcagtgt

SEQ ID NO: 440323 - DNA, 12 bp, Homo sapiens
tagttcctgcta

SEQ ID NO: 440324 - DNA, 16 bp, Homo sapiens
tagttcctgtggccag

SEQ ID NO: 440325 - DNA, 12 bp, Homo sapiens
tagttctagatg

SEQ ID NO: 440326 - DNA, 14 bp, Homo sapiens
tagttctatttcta

SEQ ID NO: 440327 - DNA, 23 bp, Homo sapiens
tagttctatttctatctgcaaat

SEQ ID NO: 440328 - DNA, 15 bp, Homo sapiens
tagttctgtgcctcc

SEQ ID NO: 440329 - DNA, 16 bp, Homo sapiens
tagttctttgttcctg

SEQ ID NO: 440330 - DNA, 15 bp, Homo sapiens
tagttgaaaaatcta

SEQ ID NO: 440331 - DNA, 20 bp, Homo sapiens
tagttgagtcttcacattta

SEQ ID NO: 440332 - DNA, 22 bp, Homo sapiens
tagttgagtcttcacatttaga

SEQ ID NO: 440333 - DNA, 17 bp, Homo sapiens
tagttgcagaaacattt

SEQ ID NO: 440334 - DNA, 19 bp, Homo sapiens
tagttgcagaaacattttg

SEQ ID NO: 440335 - DNA, 17 bp, Homo sapiens
tagttgcgttacaccct

SEQ ID NO: 440336 - DNA, 15 bp, Homo sapiens
tagttgctccgcctc

SEQ ID NO: 440337 - DNA, 20 bp, Homo sapiens
tagttgggtctgaaaggaaa

SEQ ID NO: 440338 - DNA, 13 bp, Homo sapiens
tagttgtctttct

SEQ ID NO: 440339 - DNA, 16 bp, Homo sapiens
tagtttaaaacacatt

SEQ ID NO: 440340 - DNA, 20 bp, Homo sapiens
tagtttaaaattattaaaaa

SEQ ID NO: 440341 - DNA, 19 bp, Homo sapiens
tagtttacagaaaaatctt

SEQ ID NO: 440342 - DNA, 21 bp, Homo sapiens
tagtttatacagttttaaaga

SEQ ID NO: 440343 - DNA, 18 bp, Homo sapiens
tagtttattggaagtgtt

SEQ ID NO: 440344 - DNA, 17 bp, Homo sapiens
tagtttcagaagtactg

SEQ ID NO: 440345 - DNA, 17 bp, Homo sapiens
tagtttcagtaaataat

SEQ ID NO: 440346 - DNA, 17 bp, Homo sapiens
tagtttgtacatgcatt

SEQ ID NO: 440347 - DNA, 16 bp, Homo sapiens
tagttttaaactcatt

SEQ ID NO: 440348 - DNA, 13 bp, Homo sapiens
tagttttacatta

SEQ ID NO: 440349 - DNA, 16 bp, Homo sapiens
tagttttgttccaaca

SEQ ID NO: 440350 - DNA, 19 bp, Homo sapiens
tagtttttaaaaaggcctt

SEQ ID NO: 440351 - DNA, 18 bp, Homo sapiens
tagttttttttgtaaact

SEQ ID NO: 440352 - DNA, 21 bp, Homo sapiens
tagttttttttgtaaactgta

SEQ ID NO: 440353 - DNA, 12 bp, Homo sapiens
tatcaaatcatt

SEQ ID NO: 440354 - DNA, 14 bp, Homo sapiens
tatcaaatcattca

SEQ ID NO: 440355 - DNA, 15 bp, Homo sapiens
tatcaaatcattcaa

SEQ ID NO: 440356 - DNA, 20 bp, Homo sapiens
tatcaaatcattcaaaactt

SEQ ID NO: 440357 - DNA, 21 bp, Homo sapiens
tatcaaatcattcaaaacttt

SEQ ID NO: 440358 - DNA, 14 bp, Homo sapiens
tatcaacaacaagt

SEQ ID NO: 440359 - DNA, 16 bp, Homo sapiens
tatcaacccagaaaca

SEQ ID NO: 440360 - DNA, 12 bp, Homo sapiens
tatcaactttag

SEQ ID NO: 440361 - DNA, 22 bp, Homo sapiens
tatcaagaagtcagagaaaaca

SEQ ID NO: 440362 - DNA, 14 bp, Homo sapiens
tatcaagcagagac

SEQ ID NO: 440363 - DNA, 22 bp, Homo sapiens
tatcaagcagagacctttgttg

SEQ ID NO: 440364 - DNA, 12 bp, Homo sapiens
tatcaagctaat

SEQ ID NO: 440365 - DNA, 15 bp, Homo sapiens
tatcaagctaataaa

SEQ ID NO: 440366 - DNA, 20 bp, Homo sapiens
tatcaagtcaatcatttctc

SEQ ID NO: 440367 - DNA, 19 bp, Homo sapiens
tatcaagtcccgaggcagc

SEQ ID NO: 440368 - DNA, 15 bp, Homo sapiens
tatcaagtggcatgt

SEQ ID NO: 440369 - DNA, 14 bp, Homo sapiens
tatcaataaagcac

SEQ ID NO: 440370 - DNA, 23 bp, Homo sapiens
tatcacaaccaccgttacaagta

SEQ ID NO: 440371 - DNA, 18 bp, Homo sapiens
tatcacaatgtactatat

SEQ ID NO: 440372 - DNA, 16 bp, Homo sapiens
tatcacacaaagcaga

SEQ ID NO: 440373 - DNA, 17 bp, Homo sapiens
tatcacacttctgtgag

SEQ ID NO: 440374 - DNA, 13 bp, Homo sapiens
tatcacaggccag

SEQ ID NO: 440375 - DNA, 16 bp, Homo sapiens
tatcacctcccctcct

SEQ ID NO: 440376 - DNA, 13 bp, Homo sapiens
tatcactttgtat

SEQ ID NO: 440377 - DNA, 14 bp, Homo sapiens
tatcagaagaccac

SEQ ID NO: 440378 - DNA, 23 bp, Homo sapiens
tatcagaagaccacaaaaattga

SEQ ID NO: 440379 - DNA, 16 bp, Homo sapiens
tatcagtacaattctt

SEQ ID NO: 440380 - DNA, 17 bp, Homo sapiens
tatcagtacaattcttt

SEQ ID NO: 440381 - DNA, 14 bp, Homo sapiens
tatcagtgaatata

SEQ ID NO: 440382 - DNA, 17 bp, Homo sapiens
tatcagtgacagagttc

SEQ ID NO: 440383 - DNA, 16 bp, Homo sapiens
tatcataatgtaatga

SEQ ID NO: 440384 - DNA, 15 bp, Homo sapiens
tatcatcccaacagc

SEQ ID NO: 440385 - DNA, 13 bp, Homo sapiens
tatcatgacatgt

SEQ ID NO: 440386 - DNA, 18 bp, Homo sapiens
tatcatgcccctgtactc

SEQ ID NO: 440387 - DNA, 17 bp, Homo sapiens
tatcattatagcatgta

SEQ ID NO: 440388 - DNA, 14 bp, Homo sapiens
tatcattcagcaac

SEQ ID NO: 440389 - DNA, 18 bp, Homo sapiens
tatcattctttgtatctt

SEQ ID NO: 440390 - DNA, 17 bp, Homo sapiens
tatcatttcataaaaat

SEQ ID NO: 440391 - DNA, 12 bp, Homo sapiens
tatcattttatt

SEQ ID NO: 440392 - DNA, 15 bp, Homo sapiens
tatcattttattcac

SEQ ID NO: 440393 - DNA, 18 bp, Homo sapiens
tatcattttcctgggagt

SEQ ID NO: 440394 - DNA, 17 bp, Homo sapiens
tatccaaagactgtact

SEQ ID NO: 440395 - DNA, 18 bp, Homo sapiens
tatccaaagactgtactg

SEQ ID NO: 440396 - DNA, 19 bp, Homo sapiens
tatccaaagactgtactgg

SEQ ID NO: 440397 - DNA, 18 bp, Homo sapiens
tatccaattatgtgacaa

SEQ ID NO: 440398 - DNA, 19 bp, Homo sapiens
tatccaattatgtgacaac

SEQ ID NO: 440399 - DNA, 11 bp, Homo sapiens
tatccaggagt

SEQ ID NO: 440400 - DNA, 17 bp, Homo sapiens
tatccatgggggcaggg

SEQ ID NO: 440401 - DNA, 19 bp, Homo sapiens
tatccatgggggcagggca

SEQ ID NO: 440402 - DNA, 22 bp, Homo sapiens
tatccatgtactgtagtttttc

SEQ ID NO: 440403 - DNA, 14 bp, Homo sapiens
tatccattctttct

SEQ ID NO: 440404 - DNA, 14 bp, Homo sapiens
tatccatttaaact

SEQ ID NO: 440405 - DNA, 21 bp, Homo sapiens
tatccatttaaactaaccttt

SEQ ID NO: 440406 - DNA, 11 bp, Homo sapiens
tatcccacctc

SEQ ID NO: 440407 - DNA, 12 bp, Homo sapiens
tatcccacctcc

SEQ ID NO: 440408 - DNA, 23 bp, Homo sapiens
tatcccacctccagcccacagtg

SEQ ID NO: 440409 - DNA, 21 bp, Homo sapiens
tatcccacggaaaatgccaat

SEQ ID NO: 440410 - DNA, 21 bp, Homo sapiens
tatcccagagaacaatcacta

SEQ ID NO: 440411 - DNA, 14 bp, Homo sapiens
tatcccttcctttt

SEQ ID NO: 440412 - DNA, 12 bp, Homo sapiens
tatcccttctca

SEQ ID NO: 440413 - DNA, 15 bp, Homo sapiens
tatcccttctcagaa

SEQ ID NO: 440414 - DNA, 15 bp, Homo sapiens
tatccctttctcttc

SEQ ID NO: 440415 - DNA, 18 bp, Homo sapiens
tatcctacatacttcttt

SEQ ID NO: 440416 - DNA, 13 bp, Homo sapiens
tatcctgaataac

SEQ ID NO: 440417 - DNA, 14 bp, Homo sapiens
tatcctgcaccctc

SEQ ID NO: 440418 - DNA, 20 bp, Homo sapiens
tatcctgcaccctctgctat

SEQ ID NO: 440419 - DNA, 10 bp, Homo sapiens
tatcctgccc

SEQ ID NO: 440420 - DNA, 19 bp, Homo sapiens
tatcctgctagctgtagaa

SEQ ID NO: 440421 - DNA, 22 bp, Homo sapiens
tatcctgcttctgatatgcagt

SEQ ID NO: 440422 - DNA, 17 bp, Homo sapiens
tatcctggctttgccca

SEQ ID NO: 440423 - DNA, 19 bp, Homo sapiens
tatcctggctttgcccaac

SEQ ID NO: 440424 - DNA, 10 bp, Homo sapiens
tatcctgggg

SEQ ID NO: 440425 - DNA, 22 bp, Homo sapiens
tatcctggggctcccttcatct

SEQ ID NO: 440426 - DNA, 16 bp, Homo sapiens
tatcctggtgtctagt

SEQ ID NO: 440427 - DNA, 17 bp, Homo sapiens
tatcctggtgtctagtt

SEQ ID NO: 440428 - DNA, 15 bp, Homo sapiens
tatcctgtgtgtctt

SEQ ID NO: 440429 - DNA, 20 bp, Homo sapiens
tatcctgttaacactgtaat

SEQ ID NO: 440430 - DNA, 21 bp, Homo sapiens
tatcctgttaacactgtaata

SEQ ID NO: 440431 - DNA, 18 bp, Homo sapiens
tatcctgttaggggaaaa

SEQ ID NO: 440432 - DNA, 17 bp, Homo sapiens
tatccttggagagcagc

SEQ ID NO: 440433 - DNA, 20 bp, Homo sapiens
tatcgcaccactgtgtattt

SEQ ID NO: 440434 - DNA, 14 bp, Homo sapiens
tatcggaagcagtg

SEQ ID NO: 440435 - DNA, 17 bp, Homo sapiens
tatcgggagcagtgtct

SEQ ID NO: 440436 - DNA, 15 bp, Homo sapiens
tatctaaaaaataac

SEQ ID NO: 440437 - DNA, 18 bp, Homo sapiens
tatctaaaaaataactgt

SEQ ID NO: 440438 - DNA, 16 bp, Homo sapiens
tatctagatttctaga

SEQ ID NO: 440439 - DNA, 16 bp, Homo sapiens
tatctagcaagaagat

SEQ ID NO: 440440 - DNA, 23 bp, Homo sapiens
tatctagtgcagctgattttaac

SEQ ID NO: 440441 - DNA, 21 bp, Homo sapiens
tatctatatagtacctttgct

SEQ ID NO: 440442 - DNA, 18 bp, Homo sapiens
tatctatttatctgtctg

SEQ ID NO: 440443 - DNA, 19 bp, Homo sapiens
tatctatttgtatatatac

SEQ ID NO: 440444 - DNA, 15 bp, Homo sapiens
tatctccctgcttca

SEQ ID NO: 440445 - DNA, 23 bp, Homo sapiens
tatctccttcagaagtttgcttc

SEQ ID NO: 440446 - DNA, 20 bp, Homo sapiens
tatctctaatgaaattgtga

SEQ ID NO: 440447 - DNA, 19 bp, Homo sapiens
tatctctagtccctgtgtt

SEQ ID NO: 440448 - DNA, 18 bp, Homo sapiens
tatctctcccttctttac

SEQ ID NO: 440449 - DNA, 14 bp, Homo sapiens
tatctctgaggcta

SEQ ID NO: 440450 - DNA, 18 bp, Homo sapiens
tatctctttctctctttc

SEQ ID NO: 440451 - DNA, 21 bp, Homo sapiens
tatctgaaggagattttcctt

SEQ ID NO: 440452 - DNA, 20 bp, Homo sapiens
tatctgcaaatagtttcaaa

SEQ ID NO: 440453 - DNA, 21 bp, Homo sapiens
tatctgcaaatagtttcaaat

SEQ ID NO: 440454 - DNA, 11 bp, Homo sapiens
tatctgcattt

SEQ ID NO: 440455 - DNA, 18 bp, Homo sapiens
tatctgcatttataaatg

SEQ ID NO: 440456 - DNA, 20 bp, Homo sapiens
tatctgcatttataaatgtg

SEQ ID NO: 440457 - DNA, 11 bp, Homo sapiens
tatctgcctgg

SEQ ID NO: 440458 - DNA, 16 bp, Homo sapiens
tatctgcctggcctgg

SEQ ID NO: 440459 - DNA, 19 bp, Homo sapiens
tatctgcctggcctggctc

SEQ ID NO: 440460 - DNA, 21 bp, Homo sapiens
tatctgctgcctctgaaaata

SEQ ID NO: 440461 - DNA, 18 bp, Homo sapiens
tatctggacaagccaact

SEQ ID NO: 440462 - DNA, 18 bp, Homo sapiens
tatctgggaactgtgcct

SEQ ID NO: 440463 - DNA, 15 bp, Homo sapiens
tatctggtatctgca

SEQ ID NO: 440464 - DNA, 18 bp, Homo sapiens
tatctgtaaatttaactg

SEQ ID NO: 440465 - DNA, 21 bp, Homo sapiens
tatctgtaaatttaactgcat

SEQ ID NO: 440466 - DNA, 14 bp, Homo sapiens
tatctgtctgagcc

SEQ ID NO: 440467 - DNA, 22 bp, Homo sapiens
tatctgtctgagccctgccctc

SEQ ID NO: 440468 - DNA, 21 bp, Homo sapiens
tatctgtctttatgatttcat

SEQ ID NO: 440469 - DNA, 14 bp, Homo sapiens
tatctgtgatggat

SEQ ID NO: 440470 - DNA, 19 bp, Homo sapiens
tatctgtgcgtgaaacaca

SEQ ID NO: 440471 - DNA, 23 bp, Homo sapiens
tatctgtggattcagcttctgtt

SEQ ID NO: 440472 - DNA, 14 bp, Homo sapiens
tatctgttcacttt

SEQ ID NO: 440473 - DNA, 17 bp, Homo sapiens
tatctgtttgcttctaa

SEQ ID NO: 440474 - DNA, 20 bp, Homo sapiens
tatcttaaagaaacagcttt

SEQ ID NO: 440475 - DNA, 20 bp, Homo sapiens
tatcttacctgtaaagtcta

SEQ ID NO: 440476 - DNA, 15 bp, Homo sapiens
tatcttatctagcaa

SEQ ID NO: 440477 - DNA, 17 bp, Homo sapiens
tatcttcaaactttcac

SEQ ID NO: 440478 - DNA, 15 bp, Homo sapiens
tatcttcgttcttgt

SEQ ID NO: 440479 - DNA, 17 bp, Homo sapiens
tatcttctgctctttct

SEQ ID NO: 440480 - DNA, 12 bp, Homo sapiens
tatcttctggtg

SEQ ID NO: 440481 - DNA, 14 bp, Homo sapiens
tatcttctggtgca

SEQ ID NO: 440482 - DNA, 12 bp, Homo sapiens
tatcttctgttt

SEQ ID NO: 440483 - DNA, 13 bp, Homo sapiens
tatcttctgtttt

SEQ ID NO: 440484 - DNA, 18 bp, Homo sapiens
tattcaagaaagatatct

SEQ ID NO: 440485 - DNA, 20 bp, Homo sapiens
tattcaagaaagatatctat

SEQ ID NO: 440486 - DNA, 17 bp, Homo sapiens
tattcaagcaaacatca

SEQ ID NO: 440487 - DNA, 18 bp, Homo sapiens
tattcaagcaaacatcaa

SEQ ID NO: 440488 - DNA, 16 bp, Homo sapiens
tattcaagttattgta

SEQ ID NO: 440489 - DNA, 15 bp, Homo sapiens
tattcaattcctctg

SEQ ID NO: 440490 - DNA, 16 bp, Homo sapiens
tattcaattcctctgg

SEQ ID NO: 440491 - DNA, 17 bp, Homo sapiens
tattcaattcctctggg

SEQ ID NO: 440492 - DNA, 18 bp, Homo sapiens
tattcaattcctctggga

SEQ ID NO: 440493 - DNA, 18 bp, Homo sapiens
tattcaccatgtaaaaca

SEQ ID NO: 440494 - DNA, 23 bp, Homo sapiens
tattcacgtgcagcagcaacaca

SEQ ID NO: 440495 - DNA, 21 bp, Homo sapiens
tattcactgaagttctcctga

SEQ ID NO: 440496 - DNA, 21 bp, Homo sapiens
tattcacttgtgtttgtatat

SEQ ID NO: 440497 - DNA, 18 bp, Homo sapiens
tattcagacaagcaacag

SEQ ID NO: 440498 - DNA, 14 bp, Homo sapiens
tattcagcttcatt

SEQ ID NO: 440499 - DNA, 16 bp, Homo sapiens
tattcagcttcatttg

SEQ ID NO: 440500 - DNA, 17 bp, Homo sapiens
tattcagcttcatttgt

SEQ ID NO: 440501 - DNA, 19 bp, Homo sapiens
tattcagcttcatttgtgt

SEQ ID NO: 440502 - DNA, 19 bp, Homo sapiens
tattcaggaccccatctgc

SEQ ID NO: 440503 - DNA, 14 bp, Homo sapiens
tattcatacagcac

SEQ ID NO: 440504 - DNA, 14 bp, Homo sapiens
tattcatagctgta

SEQ ID NO: 440505 - DNA, 17 bp, Homo sapiens
tattcatcaaactcttt

SEQ ID NO: 440506 - DNA, 18 bp, Homo sapiens
tattcatctattttctca

SEQ ID NO: 440507 - DNA, 22 bp, Homo sapiens
tattcattctgtgatcatttat

SEQ ID NO: 440508 - DNA, 19 bp, Homo sapiens
tattccaccttaaattaaa

SEQ ID NO: 440509 - DNA, 20 bp, Homo sapiens
tattccaccttaaattaaac

SEQ ID NO: 440510 - DNA, 22 bp, Homo sapiens
tattccagaccaaaataataca

SEQ ID NO: 440511 - DNA, 21 bp, Homo sapiens
tattcccactttcattcaatc

SEQ ID NO: 440512 - DNA, 20 bp, Homo sapiens
tattcccctatctctagaat

SEQ ID NO: 440513 - DNA, 19 bp, Homo sapiens
tattcccgttttacagata

SEQ ID NO: 440514 - DNA, 22 bp, Homo sapiens
tattccctgaattgtttgatat

SEQ ID NO: 440515 - DNA, 21 bp, Homo sapiens
tattccctggaattcaccctc

SEQ ID NO: 440516 - DNA, 18 bp, Homo sapiens
tattccctgttaaaattt

SEQ ID NO: 440517 - DNA, 20 bp, Homo sapiens
tattccctttgacttcagct

SEQ ID NO: 440518 - DNA, 19 bp, Homo sapiens
tattcctgcatttgtgaaa

SEQ ID NO: 440519 - DNA, 16 bp, Homo sapiens
tattccttctggcctt

SEQ ID NO: 440520 - DNA, 19 bp, Homo sapiens
tattccttctggcctttcc

SEQ ID NO: 440521 - DNA, 20 bp, Homo sapiens
tattctagtcaactgctgtt

SEQ ID NO: 440522 - DNA, 14 bp, Homo sapiens
tattctatatgaat

SEQ ID NO: 440523 - DNA, 17 bp, Homo sapiens
tattctatatgaattta

SEQ ID NO: 440524 - DNA, 13 bp, Homo sapiens
tattctattaact

SEQ ID NO: 440525 - DNA, 16 bp, Homo sapiens
tattctcaaagcagga

SEQ ID NO: 440526 - DNA, 12 bp, Homo sapiens
tattctcagagc

SEQ ID NO: 440527 - DNA, 17 bp, Homo sapiens
tattctcagagcatgtg

SEQ ID NO: 440528 - DNA, 18 bp, Homo sapiens
tattctcagagcatgtgt

SEQ ID NO: 440529 - DNA, 16 bp, Homo sapiens
tattctcattatttca

SEQ ID NO: 440530 - DNA, 19 bp, Homo sapiens
tattctcattatttcatca

SEQ ID NO: 440531 - DNA, 15 bp, Homo sapiens
tattctcctccctgt

SEQ ID NO: 440532 - DNA, 16 bp, Homo sapiens
tattctcctccctgtt

SEQ ID NO: 440533 - DNA, 15 bp, Homo sapiens
tattctctctatgca

SEQ ID NO: 440534 - DNA, 15 bp, Homo sapiens
tattctctgcaattt

SEQ ID NO: 440535 - DNA, 17 bp, Homo sapiens
tattctctgcaatttgt

SEQ ID NO: 440536 - DNA, 17 bp, Homo sapiens
tattctctgtccagggc

SEQ ID NO: 440537 - DNA, 19 bp, Homo sapiens
tattctctgtccagggctt

SEQ ID NO: 440538 - DNA, 11 bp, Homo sapiens
tattctgagcc

SEQ ID NO: 440539 - DNA, 18 bp, Homo sapiens
tattctgataatgtattg

SEQ ID NO: 440540 - DNA, 17 bp, Homo sapiens
tattctgcaacagcctg

SEQ ID NO: 440541 - DNA, 15 bp, Homo sapiens
tattctgtaaaccta

SEQ ID NO: 440542 - DNA, 15 bp, Homo sapiens
tattctgttaaaatc

SEQ ID NO: 440543 - DNA, 15 bp, Homo sapiens
tattcttaagcactt

SEQ ID NO: 440544 - DNA, 22 bp, Homo sapiens
tattcttccttgagctaagcag

SEQ ID NO: 440545 - DNA, 16 bp, Homo sapiens
tattcttgctttcaca

SEQ ID NO: 440546 - DNA, 19 bp, Homo sapiens
tattctttccatgcagtta

SEQ ID NO: 440547 - DNA, 20 bp, Homo sapiens
tattcttttccagaaagaaa

SEQ ID NO: 440548 - DNA, 13 bp, Homo sapiens
tattgaaaaaaat

SEQ ID NO: 440549 - DNA, 14 bp, Homo sapiens
tattgaaaacttca

SEQ ID NO: 440550 - DNA, 16 bp, Homo sapiens
tattgaaaacttcaaa

SEQ ID NO: 440551 - DNA, 16 bp, Homo sapiens
tattgaagatacacaa

SEQ ID NO: 440552 - DNA, 21 bp, Homo sapiens
tattgaattattttgttactg

SEQ ID NO: 440553 - DNA, 14 bp, Homo sapiens
tattgagacaaaaa

SEQ ID NO: 440554 - DNA, 15 bp, Homo sapiens
tattgagacaaaaat

SEQ ID NO: 440555 - DNA, 18 bp, Homo sapiens
tattgagcgtgattctgt

SEQ ID NO: 440556 - DNA, 23 bp, Homo sapiens
tattgatgaaaagatttaagcac

SEQ ID NO: 440557 - DNA, 21 bp, Homo sapiens
tattgattcctcacatcttta

SEQ ID NO: 440558 - DNA, 17 bp, Homo sapiens
tattgcaaataagactc

SEQ ID NO: 440559 - DNA, 18 bp, Homo sapiens
tattgccaggaatgtttc

SEQ ID NO: 440560 - DNA, 20 bp, Homo sapiens
tattgccagtatataagctg

SEQ ID NO: 440561 - DNA, 22 bp, Homo sapiens
tattgccagtatataagctgtt

SEQ ID NO: 440562 - DNA, 19 bp, Homo sapiens
tattgctgtaaataaaaat

SEQ ID NO: 440563 - DNA, 20 bp, Homo sapiens
tattgctgtaaataaaaata

SEQ ID NO: 440564 - DNA, 22 bp, Homo sapiens
tattgctgtaaataaaaatagc

SEQ ID NO: 440565 - DNA, 22 bp, Homo sapiens
tattgcttggactacctataaa

SEQ ID NO: 440566 - DNA, 21 bp, Homo sapiens
tattggaattaacctggtgct

SEQ ID NO: 440567 - DNA, 23 bp, Homo sapiens
tattggaattaacctggtgctgg

SEQ ID NO: 440568 - DNA, 16 bp, Homo sapiens
tattggacagacacag

SEQ ID NO: 440569 - DNA, 14 bp, Homo sapiens
tattggcctggagg

SEQ ID NO: 440570 - DNA, 23 bp, Homo sapiens
tattgggagtaggagttgctcct

SEQ ID NO: 440571 - DNA, 14 bp, Homo sapiens
tattggtgtgaatg

SEQ ID NO: 440572 - DNA, 20 bp, Homo sapiens
tattggttttaaaaaagcat

SEQ ID NO: 440573 - DNA, 17 bp, Homo sapiens
tattgtaaacatgtgtt

SEQ ID NO: 440574 - DNA, 18 bp, Homo sapiens
tattgtaaacatgtgttt

SEQ ID NO: 440575 - DNA, 21 bp, Homo sapiens
tattgtaaactttttcaatgg

SEQ ID NO: 440576 - DNA, 20 bp, Homo sapiens
tattgtagataacactatgg

SEQ ID NO: 440577 - DNA, 16 bp, Homo sapiens
tattgtagcatttctt

SEQ ID NO: 440578 - DNA, 14 bp, Homo sapiens
tattgtatgtacct

SEQ ID NO: 440579 - DNA, 15 bp, Homo sapiens
tattgtattatttgg

SEQ ID NO: 440580 - DNA, 17 bp, Homo sapiens
tattgtattatttggag

SEQ ID NO: 440581 - DNA, 17 bp, Homo sapiens
tattgtcaaagtggtga

SEQ ID NO: 440582 - DNA, 19 bp, Homo sapiens
tattgtcctcaccttcaaa

SEQ ID NO: 440583 - DNA, 17 bp, Homo sapiens
tattgtccttcagagct

SEQ ID NO: 440584 - DNA, 18 bp, Homo sapiens
tattgtccttcagagctc

SEQ ID NO: 440585 - DNA, 14 bp, Homo sapiens
tattgtgaaatttg

SEQ ID NO: 440586 - DNA, 17 bp, Homo sapiens
tattgtgaaatttgtta

SEQ ID NO: 440587 - DNA, 12 bp, Homo sapiens
tattgtgtgaag

SEQ ID NO: 440588 - DNA, 14 bp, Homo sapiens
tattgtgttgtgaa

SEQ ID NO: 440589 - DNA, 13 bp, Homo sapiens
tattgttaatatt

SEQ ID NO: 440590 - DNA, 20 bp, Homo sapiens
tattgttccaagacattgtc

SEQ ID NO: 440591 - DNA, 17 bp, Homo sapiens
tattgttcccagtgaca

SEQ ID NO: 440592 - DNA, 18 bp, Homo sapiens
tattgttcccctaagtgg

SEQ ID NO: 440593 - DNA, 20 bp, Homo sapiens
tattgttcttgtaaaactgt

SEQ ID NO: 440594 - DNA, 22 bp, Homo sapiens
tattgttttctgtaaataacct

SEQ ID NO: 440595 - DNA, 23 bp, Homo sapiens
tattgtttttggatggcttaagc

SEQ ID NO: 440596 - DNA, 22 bp, Homo sapiens
tatttaaaaaaaaacattcaaa

SEQ ID NO: 440597 - DNA, 17 bp, Homo sapiens
tatttaaaaatgcatga

SEQ ID NO: 440598 - DNA, 19 bp, Homo sapiens
tatttaaaaatgcatgata

SEQ ID NO: 440599 - DNA, 18 bp, Homo sapiens
tatttaaaagacaaacac

SEQ ID NO: 440600 - DNA, 20 bp, Homo sapiens
tatttaaactattcagagga

SEQ ID NO: 440601 - DNA, 21 bp, Homo sapiens
tatttaaacttataaatcata

SEQ ID NO: 440602 - DNA, 13 bp, Homo sapiens
tatttaaagaaag

SEQ ID NO: 440603 - DNA, 19 bp, Homo sapiens
tatttaaagaaagtgaaaa

SEQ ID NO: 440604 - DNA, 13 bp, Homo sapiens
tatttaaagcaca

SEQ ID NO: 440605 - DNA, 18 bp, Homo sapiens
tatttaaatgttctaaca

SEQ ID NO: 440606 - DNA, 13 bp, Homo sapiens
tatttaactgact

SEQ ID NO: 440607 - DNA, 21 bp, Homo sapiens
tatttaactgccttgtgtaca

SEQ ID NO: 440608 - DNA, 19 bp, Homo sapiens
tatttaacttctagttgct

SEQ ID NO: 440609 - DNA, 13 bp, Homo sapiens
tatttaagaaaat

SEQ ID NO: 440610 - DNA, 17 bp, Homo sapiens
tatttaagataattata

SEQ ID NO: 440611 - DNA, 18 bp, Homo sapiens
tatttaagcaacatcttt

SEQ ID NO: 440612 - DNA, 16 bp, Homo sapiens
tatttaatgatttttg

SEQ ID NO: 440613 - DNA, 12 bp, Homo sapiens
tcacagccagcc

SEQ ID NO: 440614 - DNA, 14 bp, Homo sapiens
tcacagccagccca

SEQ ID NO: 440615 - DNA, 17 bp, Homo sapiens
tcacagccagcccagct

SEQ ID NO: 440616 - DNA, 19 bp, Homo sapiens
tcacagcctaggaccagtt

SEQ ID NO: 440617 - DNA, 14 bp, Homo sapiens
tcacagcctccagg

SEQ ID NO: 440618 - DNA, 15 bp, Homo sapiens
tcacagcctccaggg

SEQ ID NO: 440619 - DNA, 18 bp, Homo sapiens
tcacagcctccagggccc

SEQ ID NO: 440620 - DNA, 16 bp, Homo sapiens
tcacagcctctccctt

SEQ ID NO: 440621 - DNA, 18 bp, Homo sapiens
tcacagctgcagctgggc

SEQ ID NO: 440622 - DNA, 22 bp, Homo sapiens
tcacagctgcagctgggcccca

SEQ ID NO: 440623 - DNA, 14 bp, Homo sapiens
tcacagcttcttta

SEQ ID NO: 440624 - DNA, 20 bp, Homo sapiens
tcacagcttctttactactg

SEQ ID NO: 440625 - DNA, 17 bp, Homo sapiens
tcacagctttcccaggt

SEQ ID NO: 440626 - DNA, 23 bp, Homo sapiens
tcacaggccagatgttgttcctg

SEQ ID NO: 440627 - DNA, 17 bp, Homo sapiens
tcacaggggcggggcag

SEQ ID NO: 440628 - DNA, 18 bp, Homo sapiens
tcacagggtgttggaaga

SEQ ID NO: 440629 - DNA, 16 bp, Homo sapiens
tcacagggttgggccc

SEQ ID NO: 440630 - DNA, 17 bp, Homo sapiens
tcacagggttgggccca

SEQ ID NO: 440631 - DNA, 18 bp, Homo sapiens
tcacagtacttcccaaca

SEQ ID NO: 440632 - DNA, 19 bp, Homo sapiens
tcacagtcacatgcttgat

SEQ ID NO: 440633 - DNA, 23 bp, Homo sapiens
tcacagtctctttaatcttcagt

SEQ ID NO: 440634 - DNA, 15 bp, Homo sapiens
tcacagttctctcct

SEQ ID NO: 440635 - DNA, 16 bp, Homo sapiens
tcacagttctctcctt

SEQ ID NO: 440636 - DNA, 19 bp, Homo sapiens
tcacataacagagtagttt

SEQ ID NO: 440637 - DNA, 20 bp, Homo sapiens
tcacatatcaagtcccgagg

SEQ ID NO: 440638 - DNA, 17 bp, Homo sapiens
tcacatatgtcttacta

SEQ ID NO: 440639 - DNA, 23 bp, Homo sapiens
tcacatgagctatttccattcca

SEQ ID NO: 440640 - DNA, 19 bp, Homo sapiens
tcacatggggcctggccca

SEQ ID NO: 440641 - DNA, 19 bp, Homo sapiens
tcacatgtcctattactga

SEQ ID NO: 440642 - DNA, 19 bp, Homo sapiens
tcacatgtggcaaaatatg

SEQ ID NO: 440643 - DNA, 19 bp, Homo sapiens
tcacattccctctcatcca

SEQ ID NO: 440644 - DNA, 18 bp, Homo sapiens
tcaccaaagtattaatgt

SEQ ID NO: 440645 - DNA, 16 bp, Homo sapiens
tcaccaacaacagtca

SEQ ID NO: 440646 - DNA, 20 bp, Homo sapiens
tcaccaacaacagtcagcca

SEQ ID NO: 440647 - DNA, 12 bp, Homo sapiens
tcaccaataact

SEQ ID NO: 440648 - DNA, 18 bp, Homo sapiens
tcaccaataacttcagag

SEQ ID NO: 440649 - DNA, 19 bp, Homo sapiens
tcaccaataacttcagaga

SEQ ID NO: 440650 - DNA, 22 bp, Homo sapiens
tcaccaataacttcagagaagt

SEQ ID NO: 440651 - DNA, 20 bp, Homo sapiens
tcaccacaattagagcttga

SEQ ID NO: 440652 - DNA, 19 bp, Homo sapiens
tcaccacatcttgtctttt

SEQ ID NO: 440653 - DNA, 21 bp, Homo sapiens
tcaccacatcttgtcttttcc

SEQ ID NO: 440654 - DNA, 15 bp, Homo sapiens
tcaccacatctttta

SEQ ID NO: 440655 - DNA, 17 bp, Homo sapiens
tcaccaccacacccctg

SEQ ID NO: 440656 - DNA, 18 bp, Homo sapiens
tcaccaccacacccctgc

SEQ ID NO: 440657 - DNA, 22 bp, Homo sapiens
tcaccaccacacccctgccggc

SEQ ID NO: 440658 - DNA, 12 bp, Homo sapiens
tcaccaccccct

SEQ ID NO: 440659 - DNA, 11 bp, Homo sapiens
tcaccaccctg

SEQ ID NO: 440660 - DNA, 12 bp, Homo sapiens
tcaccaccctgg

SEQ ID NO: 440661 - DNA, 18 bp, Homo sapiens
tcaccacctcatgtcatt

SEQ ID NO: 440662 - DNA, 18 bp, Homo sapiens
tcaccagaattgtgcaaa

SEQ ID NO: 440663 - DNA, 15 bp, Homo sapiens
tcaccagcaacatct

SEQ ID NO: 440664 - DNA, 22 bp, Homo sapiens
tcaccagctcagccccggccac

SEQ ID NO: 440665 - DNA, 12 bp, Homo sapiens
tcaccaggaaga

SEQ ID NO: 440666 - DNA, 23 bp, Homo sapiens
tcaccagtctgtctactgtggtg

SEQ ID NO: 440667 - DNA, 16 bp, Homo sapiens
tcaccatctcaggcca

SEQ ID NO: 440668 - DNA, 17 bp, Homo sapiens
tcaccatctcaggccac

SEQ ID NO: 440669 - DNA, 20 bp, Homo sapiens
tcaccatctttctaatcttt

SEQ ID NO: 440670 - DNA, 19 bp, Homo sapiens
tcaccatgtaaaacaaaaa

SEQ ID NO: 440671 - DNA, 23 bp, Homo sapiens
tcaccatgtaaaacaaaaaacaa

SEQ ID NO: 440672 - DNA, 15 bp, Homo sapiens
tcaccatttaatcat

SEQ ID NO: 440673 - DNA, 17 bp, Homo sapiens
tcacccagctaatctgt

SEQ ID NO: 440674 - DNA, 21 bp, Homo sapiens
tcacccagctaatctgtaggg

SEQ ID NO: 440675 - DNA, 14 bp, Homo sapiens
tcacccattgtctc

SEQ ID NO: 440676 - DNA, 12 bp, Homo sapiens
tcaccccatccc

SEQ ID NO: 440677 - DNA, 12 bp, Homo sapiens
tcacccccaact

SEQ ID NO: 440678 - DNA, 22 bp, Homo sapiens
tcacccccaacttcaccacccc

SEQ ID NO: 440679 - DNA, 17 bp, Homo sapiens
tcacccccacccctgta

SEQ ID NO: 440680 - DNA, 14 bp, Homo sapiens
tcacccccatccac

SEQ ID NO: 440681 - DNA, 15 bp, Homo sapiens
tcacccccatccaca

SEQ ID NO: 440682 - DNA, 19 bp, Homo sapiens
tcacccccatccacagttg

SEQ ID NO: 440683 - DNA, 15 bp, Homo sapiens
tcaccccctttgctg

SEQ ID NO: 440684 - DNA, 16 bp, Homo sapiens
tcaccccggcaggccc

SEQ ID NO: 440685 - DNA, 18 bp, Homo sapiens
tcaccccggcaggccctg

SEQ ID NO: 440686 - DNA, 13 bp, Homo sapiens
tcacccctgggca

SEQ ID NO: 440687 - DNA, 16 bp, Homo sapiens
tcacccctgggcaggc

SEQ ID NO: 440688 - DNA, 12 bp, Homo sapiens
tcacccctgtct

SEQ ID NO: 440689 - DNA, 13 bp, Homo sapiens
tcacccctgtctg

SEQ ID NO: 440690 - DNA, 12 bp, Homo sapiens
tcaccccttccc

SEQ ID NO: 440691 - DNA, 14 bp, Homo sapiens
tcaccccttcccca

SEQ ID NO: 440692 - DNA, 15 bp, Homo sapiens
tcaccccttccccat

SEQ ID NO: 440693 - DNA, 14 bp, Homo sapiens
tcaccccttccttt

SEQ ID NO: 440694 - DNA, 15 bp, Homo sapiens
tcacccgctgcccag

SEQ ID NO: 440695 - DNA, 18 bp, Homo sapiens
tcacccgctgcccagccc

SEQ ID NO: 440696 - DNA, 19 bp, Homo sapiens
tcacccgctgcccagccct

SEQ ID NO: 440697 - DNA, 20 bp, Homo sapiens
tcacccgctgcccagccctc

SEQ ID NO: 440698 - DNA, 13 bp, Homo sapiens
tcaccctcagctg

SEQ ID NO: 440699 - DNA, 12 bp, Homo sapiens
tcaccctgcaga

SEQ ID NO: 440700 - DNA, 13 bp, Homo sapiens
tcaccctgcagag

SEQ ID NO: 440701 - DNA, 15 bp, Homo sapiens
tcaccctgcagagct

SEQ ID NO: 440702 - DNA, 23 bp, Homo sapiens
tcaccctgcagagctatggtgag

SEQ ID NO: 440703 - DNA, 13 bp, Homo sapiens
tcaccctgcctta

SEQ ID NO: 440704 - DNA, 13 bp, Homo sapiens
tcaccctgtcaag

SEQ ID NO: 440705 - DNA, 14 bp, Homo sapiens
tcacccttatttat

SEQ ID NO: 440706 - DNA, 14 bp, Homo sapiens
tcacccttctgggc

SEQ ID NO: 440707 - DNA, 16 bp, Homo sapiens
tcacccttggtagagt

SEQ ID NO: 440708 - DNA, 15 bp, Homo sapiens
tcaccctttgctgtg

SEQ ID NO: 440709 - DNA, 14 bp, Homo sapiens
tcaccgccatgcaa

SEQ ID NO: 440710 - DNA, 16 bp, Homo sapiens
tcaccgctcaccctcc

SEQ ID NO: 440711 - DNA, 14 bp, Homo sapiens
tcacctaatgttta

SEQ ID NO: 440712 - DNA, 22 bp, Homo sapiens
tcacctaatgtttatgagccag

SEQ ID NO: 440713 - DNA, 15 bp, Homo sapiens
tcacctacttcctcc

SEQ ID NO: 440714 - DNA, 19 bp, Homo sapiens
tcacctacttcctcctcct

SEQ ID NO: 440715 - DNA, 15 bp, Homo sapiens
tcacctactttgtaa

SEQ ID NO: 440716 - DNA, 16 bp, Homo sapiens
tcacctatctggaaaa

SEQ ID NO: 440717 - DNA, 19 bp, Homo sapiens
tcacctcaggaccccagag

SEQ ID NO: 440718 - DNA, 23 bp, Homo sapiens
tcacctccccatcatccacgcca

SEQ ID NO: 440719 - DNA, 14 bp, Homo sapiens
tcacctcccctcct

SEQ ID NO: 440720 - DNA, 15 bp, Homo sapiens
tcacctcctccaaga

SEQ ID NO: 440721 - DNA, 17 bp, Homo sapiens
tcacctcctccactcac

SEQ ID NO: 440722 - DNA, 17 bp, Homo sapiens
tcacctctatccaaaga

SEQ ID NO: 440723 - DNA, 19 bp, Homo sapiens
tcacctctggactggctag

SEQ ID NO: 440724 - DNA, 23 bp, Homo sapiens
tcacctcttatgcacacctccca

SEQ ID NO: 440725 - DNA, 22 bp, Homo sapiens
tcacctgagcccggatgcttct

SEQ ID NO: 440726 - DNA, 15 bp, Homo sapiens
tcacctgcaagcccc

SEQ ID NO: 440727 - DNA, 17 bp, Homo sapiens
tcacctgcaagccccag

SEQ ID NO: 440728 - DNA, 19 bp, Homo sapiens
tcacctgcaagccccaggg

SEQ ID NO: 440729 - DNA, 22 bp, Homo sapiens
tcacctgcaagccccagggcct

SEQ ID NO: 440730 - DNA, 23 bp, Homo sapiens
tcacctgcaagccccagggcctg

SEQ ID NO: 440731 - DNA, 23 bp, Homo sapiens
tcacctgcccagatcccagaagg

SEQ ID NO: 440732 - DNA, 20 bp, Homo sapiens
tcacctgctggcccctcacc

SEQ ID NO: 440733 - DNA, 13 bp, Homo sapiens
tcacctggcttcc

SEQ ID NO: 440734 - DNA, 17 bp, Homo sapiens
tcacctggcttcccagg

SEQ ID NO: 440735 - DNA, 18 bp, Homo sapiens
tcacctggcttcccagga

SEQ ID NO: 440736 - DNA, 19 bp, Homo sapiens
tcacctggcttcccaggac

SEQ ID NO: 440737 - DNA, 21 bp, Homo sapiens
tcacctggcttcccaggaccc

SEQ ID NO: 440738 - DNA, 20 bp, Homo sapiens
tcacctgggcacctggggag

SEQ ID NO: 440739 - DNA, 18 bp, Homo sapiens
tcacctgtaaaactttat

SEQ ID NO: 440740 - DNA, 22 bp, Homo sapiens
tcacctgtaagatgaagataag

SEQ ID NO: 440741 - DNA, 13 bp, Homo sapiens
tcacctgtcatca

SEQ ID NO: 440742 - DNA, 14 bp, Homo sapiens
tcacctgtgacaaa

SEQ ID NO: 440743 - DNA, 17 bp, Homo sapiens
tcacctgtgacaaagga

SEQ ID NO: 440744 - DNA, 13 bp, Homo sapiens
tcagccctgaaaa

SEQ ID NO: 440745 - DNA, 13 bp, Homo sapiens
tcagcccttgccc

SEQ ID NO: 440746 - DNA, 19 bp, Homo sapiens
tcagccgagccgggcctgg

SEQ ID NO: 440747 - DNA, 19 bp, Homo sapiens
tcagcctcccaaagtgttg

SEQ ID NO: 440748 - DNA, 22 bp, Homo sapiens
tcagcctcctgagcctgtgggt

SEQ ID NO: 440749 - DNA, 20 bp, Homo sapiens
tcagcctcctgagtagctgg

SEQ ID NO: 440750 - DNA, 13 bp, Homo sapiens
tcagcctcctgtg

SEQ ID NO: 440751 - DNA, 16 bp, Homo sapiens
tcagcctcctgtgtag

SEQ ID NO: 440752 - DNA, 21 bp, Homo sapiens
tcagcctctcaaatagctggg

SEQ ID NO: 440753 - DNA, 12 bp, Homo sapiens
tcagcctcttaa

SEQ ID NO: 440754 - DNA, 21 bp, Homo sapiens
tcagcctcttaaagctgcctg

SEQ ID NO: 440755 - DNA, 15 bp, Homo sapiens
tcagcctgagtctcc

SEQ ID NO: 440756 - DNA, 16 bp, Homo sapiens
tcagcctgagtctcct

SEQ ID NO: 440757 - DNA, 13 bp, Homo sapiens
tcagcctgcttct

SEQ ID NO: 440758 - DNA, 16 bp, Homo sapiens
tcagccttacatttgt

SEQ ID NO: 440759 - DNA, 18 bp, Homo sapiens
tcagccttacatttgtga

SEQ ID NO: 440760 - DNA, 14 bp, Homo sapiens
tcagcgctccctgt

SEQ ID NO: 440761 - DNA, 21 bp, Homo sapiens
tcagcgctgcccacaccaccg

SEQ ID NO: 440762 - DNA, 19 bp, Homo sapiens
tcagcgggcgctgctggga

SEQ ID NO: 440763 - DNA, 19 bp, Homo sapiens
tcagctactgatttttgtg

SEQ ID NO: 440764 - DNA, 21 bp, Homo sapiens
tcagctagttaataattcttt

SEQ ID NO: 440765 - DNA, 18 bp, Homo sapiens
tcagctattggtaatata

SEQ ID NO: 440766 - DNA, 20 bp, Homo sapiens
tcagctcccttcccctgcct

SEQ ID NO: 440767 - DNA, 22 bp, Homo sapiens
tcagctcccttcccctgcctgg

SEQ ID NO: 440768 - DNA, 16 bp, Homo sapiens
tcagctctggctcaca

SEQ ID NO: 440769 - DNA, 17 bp, Homo sapiens
tcagctctggctcacag

SEQ ID NO: 440770 - DNA, 16 bp, Homo sapiens
tcagctctgggagagg

SEQ ID NO: 440771 - DNA, 17 bp, Homo sapiens
tcagctctgggagagga

SEQ ID NO: 440772 - DNA, 13 bp, Homo sapiens
tcagctgaacaca

SEQ ID NO: 440773 - DNA, 15 bp, Homo sapiens
tcagctgcacattcc

SEQ ID NO: 440774 - DNA, 16 bp, Homo sapiens
tcagctgcacattcct

SEQ ID NO: 440775 - DNA, 22 bp, Homo sapiens
tcagctgcacattcctggcccc

SEQ ID NO: 440776 - DNA, 16 bp, Homo sapiens
tcagctgccaagcact

SEQ ID NO: 440777 - DNA, 21 bp, Homo sapiens
tcagctgcccccgctcatggg

SEQ ID NO: 440778 - DNA, 14 bp, Homo sapiens
tcagctgcctcact

SEQ ID NO: 440779 - DNA, 15 bp, Homo sapiens
tcagctgcctgaaac

SEQ ID NO: 440780 - DNA, 16 bp, Homo sapiens
tcagctgcctgaaaca

SEQ ID NO: 440781 - DNA, 23 bp, Homo sapiens
tcagctgcctgaaacagccatgt

SEQ ID NO: 440782 - DNA, 15 bp, Homo sapiens
tcagctgctttgtta

SEQ ID NO: 440783 - DNA, 15 bp, Homo sapiens
tcagctggcagagtt

SEQ ID NO: 440784 - DNA, 19 bp, Homo sapiens
tcagctggtggatggtgac

SEQ ID NO: 440785 - DNA, 23 bp, Homo sapiens
tcagctgtaagaagagactggga

SEQ ID NO: 440786 - DNA, 21 bp, Homo sapiens
tcagctgtgaacatggactct

SEQ ID NO: 440787 - DNA, 17 bp, Homo sapiens
tcagcttaaaataaaca

SEQ ID NO: 440788 - DNA, 21 bp, Homo sapiens
tcagcttaatttaagtttgta

SEQ ID NO: 440789 - DNA, 16 bp, Homo sapiens
tcagcttatgggatcc

SEQ ID NO: 440790 - DNA, 18 bp, Homo sapiens
tcagcttcatttgtgtca

SEQ ID NO: 440791 - DNA, 16 bp, Homo sapiens
tcagcttcccaacaat

SEQ ID NO: 440792 - DNA, 17 bp, Homo sapiens
tcagcttcccaacaata

SEQ ID NO: 440793 - DNA, 22 bp, Homo sapiens
tcagcttctaattttgtgctct

SEQ ID NO: 440794 - DNA, 23 bp, Homo sapiens
tcagcttctaattttgtgctctt

SEQ ID NO: 440795 - DNA, 14 bp, Homo sapiens
tcagcttcttaata

SEQ ID NO: 440796 - DNA, 14 bp, Homo sapiens
tcagcttgtttcta

SEQ ID NO: 440797 - DNA, 19 bp, Homo sapiens
tcagctttcagagccagtg

SEQ ID NO: 440798 - DNA, 14 bp, Homo sapiens
tcagctttccctgg

SEQ ID NO: 440799 - DNA, 18 bp, Homo sapiens
tcagctttccctggctca

SEQ ID NO: 440800 - DNA, 21 bp, Homo sapiens
tcagctttccctggctcaggg

SEQ ID NO: 440801 - DNA, 12 bp, Homo sapiens
tcagctttgact

SEQ ID NO: 440802 - DNA, 16 bp, Homo sapiens
tcagcttttaataaaa

SEQ ID NO: 440803 - DNA, 18 bp, Homo sapiens
tcagcttttgttgtttat

SEQ ID NO: 440804 - DNA, 19 bp, Homo sapiens
tcaggaaatatatatgtgt

SEQ ID NO: 440805 - DNA, 21 bp, Homo sapiens
tcaggaaatatatatgtgtgt

SEQ ID NO: 440806 - DNA, 18 bp, Homo sapiens
tcaggaacagctatggga

SEQ ID NO: 440807 - DNA, 18 bp, Homo sapiens
tcaggaacagtggctggg

SEQ ID NO: 440808 - DNA, 21 bp, Homo sapiens
tcaggaacagtggctgggtgg

SEQ ID NO: 440809 - DNA, 22 bp, Homo sapiens
tcaggaacctggaccaaagctg

SEQ ID NO: 440810 - DNA, 17 bp, Homo sapiens
tcaggaactatgggagc

SEQ ID NO: 440811 - DNA, 22 bp, Homo sapiens
tcaggaaggtatcacacacttt

SEQ ID NO: 440812 - DNA, 17 bp, Homo sapiens
tcaggaagttgctgaga

SEQ ID NO: 440813 - DNA, 13 bp, Homo sapiens
tcaggacagctgc

SEQ ID NO: 440814 - DNA, 17 bp, Homo sapiens
tcaggacagctgcttct

SEQ ID NO: 440815 - DNA, 12 bp, Homo sapiens
tcaggacccagg

SEQ ID NO: 440816 - DNA, 13 bp, Homo sapiens
tcaggacccaggc

SEQ ID NO: 440817 - DNA, 14 bp, Homo sapiens
tcaggacccaggcc

SEQ ID NO: 440818 - DNA, 14 bp, Homo sapiens
tcaggaccccagag

SEQ ID NO: 440819 - DNA, 14 bp, Homo sapiens
tcaggaccccatct

SEQ ID NO: 440820 - DNA, 18 bp, Homo sapiens
tcaggaccccatctgctg

SEQ ID NO: 440821 - DNA, 23 bp, Homo sapiens
tcaggaccccatctgctgagctc

SEQ ID NO: 440822 - DNA, 14 bp, Homo sapiens
tcaggacccttcta

SEQ ID NO: 440823 - DNA, 23 bp, Homo sapiens
tcaggagaatgtgcagtgtcttg

SEQ ID NO: 440824 - DNA, 19 bp, Homo sapiens
tcaggagagagcttcctgt

SEQ ID NO: 440825 - DNA, 23 bp, Homo sapiens
tcaggagagtaaaaattcatata

SEQ ID NO: 440826 - DNA, 13 bp, Homo sapiens
tcaggagccagca

SEQ ID NO: 440827 - DNA, 15 bp, Homo sapiens
tcaggagccagcagg

SEQ ID NO: 440828 - DNA, 13 bp, Homo sapiens
tcaggaggcaggg

SEQ ID NO: 440829 - DNA, 21 bp, Homo sapiens
tcaggaggctggaggaagggg

SEQ ID NO: 440830 - DNA, 15 bp, Homo sapiens
tcaggaggtgcctga

SEQ ID NO: 440831 - DNA, 17 bp, Homo sapiens
tcaggatgaacccagga

SEQ ID NO: 440832 - DNA, 23 bp, Homo sapiens
tcaggattgaggatgaactcagg

SEQ ID NO: 440833 - DNA, 20 bp, Homo sapiens
tcaggcaagcccctcagccc

SEQ ID NO: 440834 - DNA, 21 bp, Homo sapiens
tcaggcaagcccctcagccct

SEQ ID NO: 440835 - DNA, 22 bp, Homo sapiens
tcaggcaagcccctcagccctt

SEQ ID NO: 440836 - DNA, 13 bp, Homo sapiens
tcaggcaaggcag

SEQ ID NO: 440837 - DNA, 20 bp, Homo sapiens
tcaggcaaggcagctcccag

SEQ ID NO: 440838 - DNA, 16 bp, Homo sapiens
tcaggcacatcattgg

SEQ ID NO: 440839 - DNA, 17 bp, Homo sapiens
tcaggcacatcattgga

SEQ ID NO: 440840 - DNA, 15 bp, Homo sapiens
tcaggcacatgtgtt

SEQ ID NO: 440841 - DNA, 15 bp, Homo sapiens
tcaggcactggtggc

SEQ ID NO: 440842 - DNA, 19 bp, Homo sapiens
tcaggcagaggatgttctg

SEQ ID NO: 440843 - DNA, 23 bp, Homo sapiens
tcaggcagaggatgttctggacc

SEQ ID NO: 440844 - DNA, 19 bp, Homo sapiens
tcaggcagtaggcattctt

SEQ ID NO: 440845 - DNA, 20 bp, Homo sapiens
tcaggcagtaggcattcttt

SEQ ID NO: 440846 - DNA, 15 bp, Homo sapiens
tcaggcataggcctg

SEQ ID NO: 440847 - DNA, 16 bp, Homo sapiens
tcaggcatgcctgtgt

SEQ ID NO: 440848 - DNA, 17 bp, Homo sapiens
tcaggcatgcctgtgtg

SEQ ID NO: 440849 - DNA, 22 bp, Homo sapiens
tcaggcatgcgaatgagctggg

SEQ ID NO: 440850 - DNA, 21 bp, Homo sapiens
tcaggccacctgcccccttct

SEQ ID NO: 440851 - DNA, 14 bp, Homo sapiens
tcaggccacggcag

SEQ ID NO: 440852 - DNA, 16 bp, Homo sapiens
tcaggccacggcagcc

SEQ ID NO: 440853 - DNA, 17 bp, Homo sapiens
tcaggccacggcagcct

SEQ ID NO: 440854 - DNA, 15 bp, Homo sapiens
tcaggccatggctcc

SEQ ID NO: 440855 - DNA, 11 bp, Homo sapiens
tcaggccctgg

SEQ ID NO: 440856 - DNA, 23 bp, Homo sapiens
tcaggcctgccaatgccacagcc

SEQ ID NO: 440857 - DNA, 21 bp, Homo sapiens
tcaggcgatccacctgtctca

SEQ ID NO: 440858 - DNA, 14 bp, Homo sapiens
tcaggcgcagccct

SEQ ID NO: 440859 - DNA, 15 bp, Homo sapiens
tcaggcgcagcccta

SEQ ID NO: 440860 - DNA, 22 bp, Homo sapiens
tcaggcgcagccctagtgggag

SEQ ID NO: 440861 - DNA, 12 bp, Homo sapiens
tcaggctctgaa

SEQ ID NO: 440862 - DNA, 16 bp, Homo sapiens
tcaggctcttctcctt

SEQ ID NO: 440863 - DNA, 16 bp, Homo sapiens
tcaggctgctggagga

SEQ ID NO: 440864 - DNA, 16 bp, Homo sapiens
tcaggcttgaaatgca

SEQ ID NO: 440865 - DNA, 18 bp, Homo sapiens
tcaggcttgaaatgcatt

SEQ ID NO: 440866 - DNA, 14 bp, Homo sapiens
tcagggacagcagc

SEQ ID NO: 440867 - DNA, 15 bp, Homo sapiens
tcagggaccaaggac

SEQ ID NO: 440868 - DNA, 20 bp, Homo sapiens
tcagggaccaaggacccctc

SEQ ID NO: 440869 - DNA, 18 bp, Homo sapiens
tcagggagacaggcaggg

SEQ ID NO: 440870 - DNA, 14 bp, Homo sapiens
tcagggagccctgg

SEQ ID NO: 440871 - DNA, 15 bp, Homo sapiens
tcagggagccctggg

SEQ ID NO: 440872 - DNA, 15 bp, Homo sapiens
tcagggaggtcattt

SEQ ID NO: 440873 - DNA, 14 bp, Homo sapiens
tcagggcagggctc

SEQ ID NO: 440874 - DNA, 18 bp, Homo sapiens
tcattaaatggtgatttc

SEQ ID NO: 440875 - DNA, 18 bp, Homo sapiens
tcattaaccaaagaaagt

SEQ ID NO: 440876 - DNA, 16 bp, Homo sapiens
tcattaataggaaaga

SEQ ID NO: 440877 - DNA, 17 bp, Homo sapiens
tcattaccactcgtaaa

SEQ ID NO: 440878 - DNA, 21 bp, Homo sapiens
tcattacttgattaagatttt

SEQ ID NO: 440879 - DNA, 16 bp, Homo sapiens
tcattacttttgaagt

SEQ ID NO: 440880 - DNA, 15 bp, Homo sapiens
tcattatagcatgta

SEQ ID NO: 440881 - DNA, 13 bp, Homo sapiens
tcattatgtagaa

SEQ ID NO: 440882 - DNA, 17 bp, Homo sapiens
tcattattggaattaac

SEQ ID NO: 440883 - DNA, 18 bp, Homo sapiens
tcattattggaattaacc

SEQ ID NO: 440884 - DNA, 22 bp, Homo sapiens
tcattatttgataacattttgt

SEQ ID NO: 440885 - DNA, 15 bp, Homo sapiens
tcattattttgtggt

SEQ ID NO: 440886 - DNA, 13 bp, Homo sapiens
tcattcaaaactt

SEQ ID NO: 440887 - DNA, 17 bp, Homo sapiens
tcattcaaaactttcag

SEQ ID NO: 440888 - DNA, 23 bp, Homo sapiens
tcattcaactctccaatgttcta

SEQ ID NO: 440889 - DNA, 21 bp, Homo sapiens
tcattcaatcaacctgcactt

SEQ ID NO: 440890 - DNA, 14 bp, Homo sapiens
tcattcacatttca

SEQ ID NO: 440891 - DNA, 16 bp, Homo sapiens
tcattcactagctttg

SEQ ID NO: 440892 - DNA, 21 bp, Homo sapiens
tcattcatatcctccgccctt

SEQ ID NO: 440893 - DNA, 14 bp, Homo sapiens
tcattcattttgtg

SEQ ID NO: 440894 - DNA, 12 bp, Homo sapiens
tcattccaaata

SEQ ID NO: 440895 - DNA, 23 bp, Homo sapiens
tcattccaccttcccatgccctg

SEQ ID NO: 440896 - DNA, 20 bp, Homo sapiens
tcattccatgtgcccagtta

SEQ ID NO: 440897 - DNA, 14 bp, Homo sapiens
tcattcccactgca

SEQ ID NO: 440898 - DNA, 15 bp, Homo sapiens
tcattcccactgcac

SEQ ID NO: 440899 - DNA, 14 bp, Homo sapiens
tcattccgttagga

SEQ ID NO: 440900 - DNA, 16 bp, Homo sapiens
tcattcctgaaagaaa

SEQ ID NO: 440901 - DNA, 21 bp, Homo sapiens
tcattcctgaaagaaacagtt

SEQ ID NO: 440902 - DNA, 19 bp, Homo sapiens
tcattctaaaccaaaacag

SEQ ID NO: 440903 - DNA, 21 bp, Homo sapiens
tcattctagcaccttgttctt

SEQ ID NO: 440904 - DNA, 20 bp, Homo sapiens
tcattcttgccctttgagaa

SEQ ID NO: 440905 - DNA, 22 bp, Homo sapiens
tcattgcaggccagtggacaga

SEQ ID NO: 440906 - DNA, 16 bp, Homo sapiens
tcattgcatttattgc

SEQ ID NO: 440907 - DNA, 12 bp, Homo sapiens
tcattgccttcc

SEQ ID NO: 440908 - DNA, 22 bp, Homo sapiens
tcattgctacacttacaagtaa

SEQ ID NO: 440909 - DNA, 16 bp, Homo sapiens
tcattgcttatgacat

SEQ ID NO: 440910 - DNA, 12 bp, Homo sapiens
tcattgctttac

SEQ ID NO: 440911 - DNA, 18 bp, Homo sapiens
tcattggaatacaggaag

SEQ ID NO: 440912 - DNA, 13 bp, Homo sapiens
tcattggatgcag

SEQ ID NO: 440913 - DNA, 22 bp, Homo sapiens
tcattgggccatgtttaagtgt

SEQ ID NO: 440914 - DNA, 20 bp, Homo sapiens
tcattgtaatgttactgatc

SEQ ID NO: 440915 - DNA, 13 bp, Homo sapiens
tcattgtggctat

SEQ ID NO: 440916 - DNA, 18 bp, Homo sapiens
tcattgtggctatctgca

SEQ ID NO: 440917 - DNA, 15 bp, Homo sapiens
tcattgttaaagtaa

SEQ ID NO: 440918 - DNA, 22 bp, Homo sapiens
tcattgttacaggtgtactatg

SEQ ID NO: 440919 - DNA, 14 bp, Homo sapiens
tcatttaaaatgat

SEQ ID NO: 440920 - DNA, 15 bp, Homo sapiens
tcatttaaaatgatt

SEQ ID NO: 440921 - DNA, 12 bp, Homo sapiens
tcatttaagatt

SEQ ID NO: 440922 - DNA, 19 bp, Homo sapiens
tcatttatttttagccatt

SEQ ID NO: 440923 - DNA, 14 bp, Homo sapiens
tcatttcatcctgt

SEQ ID NO: 440924 - DNA, 19 bp, Homo sapiens
tcatttcattgtatgatgt

SEQ ID NO: 440925 - DNA, 19 bp, Homo sapiens
tcatttccaactcaggtta

SEQ ID NO: 440926 - DNA, 15 bp, Homo sapiens
tcatttccagcaaaa

SEQ ID NO: 440927 - DNA, 24 bp, Homo sapiens
tcatttcctctgagctgttatctt

SEQ ID NO: 440928 - DNA, 14 bp, Homo sapiens
tcatttctactgaa

SEQ ID NO: 440929 - DNA, 17 bp, Homo sapiens
tcatttctcactgtgta

SEQ ID NO: 440930 - DNA, 24 bp, Homo sapiens
tcatttctcactgtgtacataatg

SEQ ID NO: 440931 - DNA, 18 bp, Homo sapiens
tcatttctcatggatttg

SEQ ID NO: 440932 - DNA, 14 bp, Homo sapiens
tcatttctgccagc

SEQ ID NO: 440933 - DNA, 13 bp, Homo sapiens
tcatttcttgggc

SEQ ID NO: 440934 - DNA, 22 bp, Homo sapiens
tcatttctttcaagacagccta

SEQ ID NO: 440935 - DNA, 12 bp, Homo sapiens
tcatttgcatat

SEQ ID NO: 440936 - DNA, 19 bp, Homo sapiens
tcatttgcccttaaggaca

SEQ ID NO: 440937 - DNA, 21 bp, Homo sapiens
tcatttgcccttaaggacaaa

SEQ ID NO: 440938 - DNA, 13 bp, Homo sapiens
tcatttgtgtcaa

SEQ ID NO: 440939 - DNA, 15 bp, Homo sapiens
tcatttgtgtcaatg

SEQ ID NO: 440940 - DNA, 16 bp, Homo sapiens
tcatttgtgtgctcat

SEQ ID NO: 440941 - DNA, 12 bp, Homo sapiens
tcatttgttcat

SEQ ID NO: 440942 - DNA, 14 bp, Homo sapiens
tcattttaattatt

SEQ ID NO: 440943 - DNA, 16 bp, Homo sapiens
tcattttagtgactgt

SEQ ID NO: 440944 - DNA, 22 bp, Homo sapiens
tcattttatatatgaaaactaa

SEQ ID NO: 440945 - DNA, 14 bp, Homo sapiens
tcattttattcaca

SEQ ID NO: 440946 - DNA, 13 bp, Homo sapiens
tcattttcacctc

SEQ ID NO: 440947 - DNA, 16 bp, Homo sapiens
tcattttcctgggagt

SEQ ID NO: 440948 - DNA, 11 bp, Homo sapiens
tcattttctct

SEQ ID NO: 440949 - DNA, 13 bp, Homo sapiens
tcattttctctcc

SEQ ID NO: 440950 - DNA, 14 bp, Homo sapiens
tcattttgtatgta

SEQ ID NO: 440951 - DNA, 18 bp, Homo sapiens
tcattttgtatgtatgtg

SEQ ID NO: 440952 - DNA, 22 bp, Homo sapiens
tcattttgtatgtatgtgtagt

SEQ ID NO: 440953 - DNA, 22 bp, Homo sapiens
tcatttttgtgggggctagaaa

SEQ ID NO: 440954 - DNA, 19 bp, Homo sapiens
tccaaaaagattttcagaa

SEQ ID NO: 440955 - DNA, 13 bp, Homo sapiens
tccaaaaattatt

SEQ ID NO: 440956 - DNA, 14 bp, Homo sapiens
tccaaaaattatta

SEQ ID NO: 440957 - DNA, 12 bp, Homo sapiens
tccaaaacacaa

SEQ ID NO: 440958 - DNA, 19 bp, Homo sapiens
tccaaaataattttaagaa

SEQ ID NO: 440959 - DNA, 13 bp, Homo sapiens
tccaaaatcattc

SEQ ID NO: 440960 - DNA, 20 bp, Homo sapiens
tccaaaattccatccctaag

SEQ ID NO: 440961 - DNA, 12 bp, Homo sapiens
tccaaactcctg

SEQ ID NO: 440962 - DNA, 13 bp, Homo sapiens
tccaaactcctgc

SEQ ID NO: 440963 - DNA, 13 bp, Homo sapiens
tccaaagactgta

SEQ ID NO: 440964 - DNA, 22 bp, Homo sapiens
tccaaagactgtactggccagt

SEQ ID NO: 440965 - DNA, 17 bp, Homo sapiens
tccaaagagtcatcatg

SEQ ID NO: 440966 - DNA, 19 bp, Homo sapiens
tccaaagcacattgaaaga

SEQ ID NO: 440967 - DNA, 22 bp, Homo sapiens
tccaaagcctgggcagaaatgt

SEQ ID NO: 440968 - DNA, 13 bp, Homo sapiens
tccaaaggaggct

SEQ ID NO: 440969 - DNA, 19 bp, Homo sapiens
tccaaaggggctgctgggg

SEQ ID NO: 440970 - DNA, 16 bp, Homo sapiens
tccaaaggtttcaact

SEQ ID NO: 440971 - DNA, 19 bp, Homo sapiens
tccaaagtcagatctggtc

SEQ ID NO: 440972 - DNA, 21 bp, Homo sapiens
tccaaataaaacttgagccca

SEQ ID NO: 440973 - DNA, 19 bp, Homo sapiens
tccaaatgattttcatcaa

SEQ ID NO: 440974 - DNA, 21 bp, Homo sapiens
tccaaatgattttcatcaatt

SEQ ID NO: 440975 - DNA, 22 bp, Homo sapiens
tccaaatgattttcatcaattt

SEQ ID NO: 440976 - DNA, 13 bp, Homo sapiens
tccaaatgcattc

SEQ ID NO: 440977 - DNA, 23 bp, Homo sapiens
tccaaatgctgtgcaaacagtgt

SEQ ID NO: 440978 - DNA, 20 bp, Homo sapiens
tccaaatgtcctccagaagc

SEQ ID NO: 440979 - DNA, 16 bp, Homo sapiens
tccaaattctttattc

SEQ ID NO: 440980 - DNA, 16 bp, Homo sapiens
tccaaatttaatgtag

SEQ ID NO: 440981 - DNA, 19 bp, Homo sapiens
tccaacaactccaggaaaa

SEQ ID NO: 440982 - DNA, 18 bp, Homo sapiens
tccaacaccacagacaca

SEQ ID NO: 440983 - DNA, 19 bp, Homo sapiens
tccaacaccacagacacac

SEQ ID NO: 440984 - DNA, 21 bp, Homo sapiens
tccaacaccacagacacacac

SEQ ID NO: 440985 - DNA, 15 bp, Homo sapiens
tccaaccccggggca

SEQ ID NO: 440986 - DNA, 15 bp, Homo sapiens
tccaacccctttgct

SEQ ID NO: 440987 - DNA, 19 bp, Homo sapiens
tccaacccctttgctggtt

SEQ ID NO: 440988 - DNA, 19 bp, Homo sapiens
tccaacgttaaaagacagt

SEQ ID NO: 440989 - DNA, 24 bp, Homo sapiens
tccaactcttccccctctcccagt

SEQ ID NO: 440990 - DNA, 16 bp, Homo sapiens
tccaactgctgcccca

SEQ ID NO: 440991 - DNA, 17 bp, Homo sapiens
tccaacttttcatccag

SEQ ID NO: 440992 - DNA, 12 bp, Homo sapiens
tccaagaaaaat

SEQ ID NO: 440993 - DNA, 15 bp, Homo sapiens
tccaagaagccctcc

SEQ ID NO: 440994 - DNA, 21 bp, Homo sapiens
tccaagaagccctccttgcca

SEQ ID NO: 440995 - DNA, 11 bp, Homo sapiens
tccaagacatt

SEQ ID NO: 440996 - DNA, 20 bp, Homo sapiens
tccaagaccttacaaccaca

SEQ ID NO: 440997 - DNA, 19 bp, Homo sapiens
tccaagagaattcacttta

SEQ ID NO: 440998 - DNA, 23 bp, Homo sapiens
tccaagcaagtagctttccacat

SEQ ID NO: 440999 - DNA, 14 bp, Homo sapiens
tccaagcatcagca

SEQ ID NO: 441000 - DNA, 20 bp, Homo sapiens
tccaagcatcagcaagacaa

SEQ ID NO: 441001 - DNA, 15 bp, Homo sapiens
tccaagcctgggcca

SEQ ID NO: 441002 - DNA, 16 bp, Homo sapiens
tccaagcctgggccac

SEQ ID NO: 441003 - DNA, 18 bp, Homo sapiens
tccaaggagaccaagtcc

SEQ ID NO: 441004 - DNA, 12 bp, Homo sapiens
tccaaggatcct

SEQ ID NO: 441005 - DNA, 21 bp, Homo sapiens
tccagggactgtacctgtagg

SEQ ID NO: 441006 - DNA, 20 bp, Homo sapiens
tccagggatgccatctgtgg

SEQ ID NO: 441007 - DNA, 16 bp, Homo sapiens
tccagggcagcagccg

SEQ ID NO: 441008 - DNA, 13 bp, Homo sapiens
tccagggccccca

SEQ ID NO: 441009 - DNA, 11 bp, Homo sapiens
tccagggctcc

SEQ ID NO: 441010 - DNA, 14 bp, Homo sapiens
tccagggctgcccc

SEQ ID NO: 441011 - DNA, 12 bp, Homo sapiens
tccaggggcacc

SEQ ID NO: 441012 - DNA, 20 bp, Homo sapiens
tccaggggcccttgggacag

SEQ ID NO: 441013 - DNA, 23 bp, Homo sapiens
tccaggggcccttgggacagcca

SEQ ID NO: 441014 - DNA, 18 bp, Homo sapiens
tccagggggcctgcaggc

SEQ ID NO: 441015 - DNA, 19 bp, Homo sapiens
tccagggggcctgcaggcc

SEQ ID NO: 441016 - DNA, 18 bp, Homo sapiens
tccagggtaggcaaggct

SEQ ID NO: 441017 - DNA, 16 bp, Homo sapiens
tccagggtcttgggct

SEQ ID NO: 441018 - DNA, 17 bp, Homo sapiens
tccagggtcttgggcta

SEQ ID NO: 441019 - DNA, 16 bp, Homo sapiens
tccaggtcgggctcag

SEQ ID NO: 441020 - DNA, 22 bp, Homo sapiens
tccaggtcgggctcagctctgg

SEQ ID NO: 441021 - DNA, 17 bp, Homo sapiens
tccaggttccatccacc

SEQ ID NO: 441022 - DNA, 18 bp, Homo sapiens
tccaggttccatccacca

SEQ ID NO: 441023 - DNA, 18 bp, Homo sapiens
tccaggttcgtatagaaa

SEQ ID NO: 441024 - DNA, 17 bp, Homo sapiens
tccagtacctttgtcac

SEQ ID NO: 441025 - DNA, 19 bp, Homo sapiens
tccagtacgtcccgctgct

SEQ ID NO: 441026 - DNA, 21 bp, Homo sapiens
tccagtacgtcccgctgctgt

SEQ ID NO: 441027 - DNA, 15 bp, Homo sapiens
tccagtatcctgctg

SEQ ID NO: 441028 - DNA, 16 bp, Homo sapiens
tccagtatcttgaaga

SEQ ID NO: 441029 - DNA, 18 bp, Homo sapiens
tccagtatcttgaagact

SEQ ID NO: 441030 - DNA, 13 bp, Homo sapiens
tccagtattcttg

SEQ ID NO: 441031 - DNA, 21 bp, Homo sapiens
tccagtattgaaaacttcaaa

SEQ ID NO: 441032 - DNA, 17 bp, Homo sapiens
tccagtcctgctctcta

SEQ ID NO: 441033 - DNA, 16 bp, Homo sapiens
tccagtctccaccagg

SEQ ID NO: 441034 - DNA, 18 bp, Homo sapiens
tccagtctgctgccctcc

SEQ ID NO: 441035 - DNA, 14 bp, Homo sapiens
tccagtgcaattgt

SEQ ID NO: 441036 - DNA, 16 bp, Homo sapiens
tccagtgcttccacag

SEQ ID NO: 441037 - DNA, 17 bp, Homo sapiens
tccagtgcttccacaga

SEQ ID NO: 441038 - DNA, 23 bp, Homo sapiens
tccagtgcttggctgccccacag

SEQ ID NO: 441039 - DNA, 17 bp, Homo sapiens
tccagtggcctggctcc

SEQ ID NO: 441040 - DNA, 16 bp, Homo sapiens
tccagtgtattttctg

SEQ ID NO: 441041 - DNA, 19 bp, Homo sapiens
tccagtgtattttctgtgt

SEQ ID NO: 441042 - DNA, 17 bp, Homo sapiens
tccagtgttgcctcctc

SEQ ID NO: 441043 - DNA, 23 bp, Homo sapiens
tccataatctggactcctctgtc

SEQ ID NO: 441044 - DNA, 21 bp, Homo sapiens
tccataattatgacagttata

SEQ ID NO: 441045 - DNA, 16 bp, Homo sapiens
tccataccccctgccc

SEQ ID NO: 441046 - DNA, 18 bp, Homo sapiens
tccataccccctgcccca

SEQ ID NO: 441047 - DNA, 19 bp, Homo sapiens
tccataccccctgccccag

SEQ ID NO: 441048 - DNA, 20 bp, Homo sapiens
tccataccccctgccccaga

SEQ ID NO: 441049 - DNA, 22 bp, Homo sapiens
tccataccccctgccccagaga

SEQ ID NO: 441050 - DNA, 23 bp, Homo sapiens
tccataccccctgccccagagaa

SEQ ID NO: 441051 - DNA, 13 bp, Homo sapiens
tccatactcagga

SEQ ID NO: 441052 - DNA, 17 bp, Homo sapiens
tccatagacacagtatt

SEQ ID NO: 441053 - DNA, 17 bp, Homo sapiens
tccatagctgagctgga

SEQ ID NO: 441054 - DNA, 20 bp, Homo sapiens
tccataggaatcatgttgga

SEQ ID NO: 441055 - DNA, 19 bp, Homo sapiens
tccatagtagtattgattt

SEQ ID NO: 441056 - DNA, 16 bp, Homo sapiens
tccatatcagacctct

SEQ ID NO: 441057 - DNA, 14 bp, Homo sapiens
tccatatcagctct

SEQ ID NO: 441058 - DNA, 23 bp, Homo sapiens
tccatatccctttctctcttgtc

SEQ ID NO: 441059 - DNA, 14 bp, Homo sapiens
tccatcacagccag

SEQ ID NO: 441060 - DNA, 18 bp, Homo sapiens
tccatcacagccagccca

SEQ ID NO: 441061 - DNA, 14 bp, Homo sapiens
tccatcagcagtga

SEQ ID NO: 441062 - DNA, 15 bp, Homo sapiens
tccatcagtgcatga

SEQ ID NO: 441063 - DNA, 14 bp, Homo sapiens
tccatccatctcca

SEQ ID NO: 441064 - DNA, 15 bp, Homo sapiens
tccatccatctccag

SEQ ID NO: 441065 - DNA, 20 bp, Homo sapiens
tccatcccgaaaatctctcg

SEQ ID NO: 441066 - DNA, 16 bp, Homo sapiens
tccatccttgactgaa

SEQ ID NO: 441067 - DNA, 21 bp, Homo sapiens
tccatctaaaatactcaccaa

SEQ ID NO: 441068 - DNA, 22 bp, Homo sapiens
tccatctaaaatactcaccaaa

SEQ ID NO: 441069 - DNA, 12 bp, Homo sapiens
tccatctctctc

SEQ ID NO: 441070 - DNA, 14 bp, Homo sapiens
tccatctctctccc

SEQ ID NO: 441071 - DNA, 16 bp, Homo sapiens
tccatctctctccctt

SEQ ID NO: 441072 - DNA, 13 bp, Homo sapiens
tccatctggggat

SEQ ID NO: 441073 - DNA, 13 bp, Homo sapiens
tccatctgtctgt

SEQ ID NO: 441074 - DNA, 19 bp, Homo sapiens
tccatctgtctgtcctacc

SEQ ID NO: 441075 - DNA, 19 bp, Homo sapiens
tccatctgtggaaatgaca

SEQ ID NO: 441076 - DNA, 15 bp, Homo sapiens
tccatgaaaacgttt

SEQ ID NO: 441077 - DNA, 13 bp, Homo sapiens
tccatgaatgtat

SEQ ID NO: 441078 - DNA, 14 bp, Homo sapiens
tccatgaatgtatc

SEQ ID NO: 441079 - DNA, 16 bp, Homo sapiens
tccatgaatgtatcag

SEQ ID NO: 441080 - DNA, 14 bp, Homo sapiens
tccatgactggctg

SEQ ID NO: 441081 - DNA, 13 bp, Homo sapiens
tccatgagcaccc

SEQ ID NO: 441082 - DNA, 15 bp, Homo sapiens
tccatgagcacccca

SEQ ID NO: 441083 - DNA, 12 bp, Homo sapiens
tccatgatggag

SEQ ID NO: 441084 - DNA, 13 bp, Homo sapiens
tccatgcatgtgc

SEQ ID NO: 441085 - DNA, 17 bp, Homo sapiens
tccatgcctacagataa

SEQ ID NO: 441086 - DNA, 22 bp, Homo sapiens
tccatgcctatttactggaaac

SEQ ID NO: 441087 - DNA, 13 bp, Homo sapiens
tccatgcctgagg

SEQ ID NO: 441088 - DNA, 14 bp, Homo sapiens
tccatgcctgaggg

SEQ ID NO: 441089 - DNA, 17 bp, Homo sapiens
tccatgcggagtccatt

SEQ ID NO: 441090 - DNA, 19 bp, Homo sapiens
tccatgcggccggcctggg

SEQ ID NO: 441091 - DNA, 22 bp, Homo sapiens
tccatgcggccggcctggggcc

SEQ ID NO: 441092 - DNA, 22 bp, Homo sapiens
tccatgctcctcactgcccgca

SEQ ID NO: 441093 - DNA, 15 bp, Homo sapiens
tccatgctgcctcca

SEQ ID NO: 441094 - DNA, 18 bp, Homo sapiens
tccatggatgcatgccct

SEQ ID NO: 441095 - DNA, 17 bp, Homo sapiens
tccatggcaattttgta

SEQ ID NO: 441096 - DNA, 17 bp, Homo sapiens
tccatggcaggaaggcg

SEQ ID NO: 441097 - DNA, 13 bp, Homo sapiens
tccatggccaccc

SEQ ID NO: 441098 - DNA, 22 bp, Homo sapiens
tccatggcccatcactcggctg

SEQ ID NO: 441099 - DNA, 16 bp, Homo sapiens
tccatggcttcctgag

SEQ ID NO: 441100 - DNA, 17 bp, Homo sapiens
tccatgggggcagggca

SEQ ID NO: 441101 - DNA, 17 bp, Homo sapiens
tccatggggttcgagac

SEQ ID NO: 441102 - DNA, 13 bp, Homo sapiens
tccatggtgcctc

SEQ ID NO: 441103 - DNA, 15 bp, Homo sapiens
tccatggtgcctctg

SEQ ID NO: 441104 - DNA, 16 bp, Homo sapiens
tccatggtgcctctgg

SEQ ID NO: 441105 - DNA, 18 bp, Homo sapiens
tccatggtggtttcagaa

SEQ ID NO: 441106 - DNA, 23 bp, Homo sapiens
tccatggtggtttcagaaagggc

SEQ ID NO: 441107 - DNA, 14 bp, Homo sapiens
tccatgtactgtag

SEQ ID NO: 441108 - DNA, 14 bp, Homo sapiens
tccatgtgcccagt

SEQ ID NO: 441109 - DNA, 16 bp, Homo sapiens
tccatgtgcccagtta

SEQ ID NO: 441110 - DNA, 20 bp, Homo sapiens
tccatgtggccccaggtgcc

SEQ ID NO: 441111 - DNA, 21 bp, Homo sapiens
tccatgtgttttgcttttatc

SEQ ID NO: 441112 - DNA, 18 bp, Homo sapiens
tccatgtttagaaataaa

SEQ ID NO: 441113 - DNA, 17 bp, Homo sapiens
tccatgtttgcaatgct

SEQ ID NO: 441114 - DNA, 19 bp, Homo sapiens
tccattaaaaaaaacagaa

SEQ ID NO: 441115 - DNA, 14 bp, Homo sapiens
tccattaaatggtc

SEQ ID NO: 441116 - DNA, 18 bp, Homo sapiens
tccattagtaaaacacaa

SEQ ID NO: 441117 - DNA, 19 bp, Homo sapiens
tccattatctgctgttcct

SEQ ID NO: 441118 - DNA, 14 bp, Homo sapiens
tccattatttatat

SEQ ID NO: 441119 - DNA, 14 bp, Homo sapiens
tccattcagtctgc

SEQ ID NO: 441120 - DNA, 14 bp, Homo sapiens
tccattctcagccc

SEQ ID NO: 441121 - DNA, 18 bp, Homo sapiens
tccattctttctgataac

SEQ ID NO: 441122 - DNA, 14 bp, Homo sapiens
tccattctttcttc

SEQ ID NO: 441123 - DNA, 17 bp, Homo sapiens
tccattctttcttcctc

SEQ ID NO: 441124 - DNA, 19 bp, Homo sapiens
tccattctttcttcctcca

SEQ ID NO: 441125 - DNA, 18 bp, Homo sapiens
tccattgctcccagtgcc

SEQ ID NO: 441126 - DNA, 19 bp, Homo sapiens
tccattgcttattcttgag

SEQ ID NO: 441127 - DNA, 22 bp, Homo sapiens
tccattgcttattcttgagcac

SEQ ID NO: 441128 - DNA, 13 bp, Homo sapiens
tccattgtatctt

SEQ ID NO: 441129 - DNA, 17 bp, Homo sapiens
tccattgtattgtctga

SEQ ID NO: 441130 - DNA, 23 bp, Homo sapiens
tccatttaatcaatatttaagag

SEQ ID NO: 441131 - DNA, 15 bp, Homo sapiens
tccatttacctggaa

SEQ ID NO: 441132 - DNA, 22 bp, Homo sapiens
tccatttcatgtgatctattac

SEQ ID NO: 441133 - DNA, 12 bp, Homo sapiens
tccatttctgat

SEQ ID NO: 441134 - DNA, 17 bp, Homo sapiens
tccatttcttcagaggg

SEQ ID NO: 441135 - DNA, 14 bp, Homo sapiens
tccattttctaaac

SEQ ID NO: 441136 - DNA, 22 bp, Homo sapiens
tccctccacacctccacccgtc

SEQ ID NO: 441137 - DNA, 14 bp, Homo sapiens
tccctccaccccag

SEQ ID NO: 441138 - DNA, 17 bp, Homo sapiens
tccctccactcctccca

SEQ ID NO: 441139 - DNA, 22 bp, Homo sapiens
tccctccactcctcccaactct

SEQ ID NO: 441140 - DNA, 23 bp, Homo sapiens
tccctccactccttcctgccacc

SEQ ID NO: 441141 - DNA, 12 bp, Homo sapiens
tccctccatggc

SEQ ID NO: 441142 - DNA, 17 bp, Homo sapiens
tccctcccctgccctcg

SEQ ID NO: 441143 - DNA, 17 bp, Homo sapiens
tccctcccctgccctgg

SEQ ID NO: 441144 - DNA, 19 bp, Homo sapiens
tccctcccctgccctggtc

SEQ ID NO: 441145 - DNA, 22 bp, Homo sapiens
tccctcccggcatgggaaagcc

SEQ ID NO: 441146 - DNA, 12 bp, Homo sapiens
tccctccctcca

SEQ ID NO: 441147 - DNA, 16 bp, Homo sapiens
tccctccctccacacc

SEQ ID NO: 441148 - DNA, 15 bp, Homo sapiens
tccctccctcctggc

SEQ ID NO: 441149 - DNA, 18 bp, Homo sapiens
tccctccctgcagggtag

SEQ ID NO: 441150 - DNA, 15 bp, Homo sapiens
tccctccgactccag

SEQ ID NO: 441151 - DNA, 12 bp, Homo sapiens
tccctcctcacc

SEQ ID NO: 441152 - DNA, 14 bp, Homo sapiens
tccctcctcccatc

SEQ ID NO: 441153 - DNA, 15 bp, Homo sapiens
tccctcctcccatct

SEQ ID NO: 441154 - DNA, 15 bp, Homo sapiens
tccctcctctgtccc

SEQ ID NO: 441155 - DNA, 12 bp, Homo sapiens
tccctcctcttc

SEQ ID NO: 441156 - DNA, 14 bp, Homo sapiens
tccctcctgcaggc

SEQ ID NO: 441157 - DNA, 19 bp, Homo sapiens
tccctcctggctcacagcc

SEQ ID NO: 441158 - DNA, 20 bp, Homo sapiens
tccctcctggctcacagcca

SEQ ID NO: 441159 - DNA, 14 bp, Homo sapiens
tccctcctgttgcc

SEQ ID NO: 441160 - DNA, 18 bp, Homo sapiens
tccctcctgttgccacac

SEQ ID NO: 441161 - DNA, 17 bp, Homo sapiens
tccctcgcatccgcctc

SEQ ID NO: 441162 - DNA, 16 bp, Homo sapiens
tccctcgctgtatgat

SEQ ID NO: 441163 - DNA, 16 bp, Homo sapiens
tccctcggacccacca

SEQ ID NO: 441164 - DNA, 12 bp, Homo sapiens
tccctcggtcag

SEQ ID NO: 441165 - DNA, 16 bp, Homo sapiens
tccctcggtcagcacc

SEQ ID NO: 441166 - DNA, 16 bp, Homo sapiens
tccctctcactcccca

SEQ ID NO: 441167 - DNA, 22 bp, Homo sapiens
tccctctcaggcatgcctgtgt

SEQ ID NO: 441168 - DNA, 13 bp, Homo sapiens
tccctctcatcca

SEQ ID NO: 441169 - DNA, 14 bp, Homo sapiens
tccctctcatccag

SEQ ID NO: 441170 - DNA, 23 bp, Homo sapiens
tccctctcctatgtggcagctgg

SEQ ID NO: 441171 - DNA, 20 bp, Homo sapiens
tccctctcgctcccctctgc

SEQ ID NO: 441172 - DNA, 14 bp, Homo sapiens
tccctctctctgga

SEQ ID NO: 441173 - DNA, 12 bp, Homo sapiens
tccctctctctt

SEQ ID NO: 441174 - DNA, 21 bp, Homo sapiens
tccctctctcttctgctccac

SEQ ID NO: 441175 - DNA, 23 bp, Homo sapiens
tccctctctcttctgctccaccc

SEQ ID NO: 441176 - DNA, 11 bp, Homo sapiens
tccctctgccc

SEQ ID NO: 441177 - DNA, 16 bp, Homo sapiens
tccctctgccccaagc

SEQ ID NO: 441178 - DNA, 23 bp, Homo sapiens
tccctctgccccaagcagccagc

SEQ ID NO: 441179 - DNA, 16 bp, Homo sapiens
tccctctgcctgtccc

SEQ ID NO: 441180 - DNA, 20 bp, Homo sapiens
tccctctgctcctggagcct

SEQ ID NO: 441181 - DNA, 12 bp, Homo sapiens
tccctctgctct

SEQ ID NO: 441182 - DNA, 14 bp, Homo sapiens
tccctcttcccagc

SEQ ID NO: 441183 - DNA, 14 bp, Homo sapiens
tccctcttctcaag

SEQ ID NO: 441184 - DNA, 17 bp, Homo sapiens
tccctcttctcaagtgc

SEQ ID NO: 441185 - DNA, 12 bp, Homo sapiens
tccctctttcct

SEQ ID NO: 441186 - DNA, 14 bp, Homo sapiens
tccctctttcctgt

SEQ ID NO: 441187 - DNA, 20 bp, Homo sapiens
tccctgaagtcttgcattga

SEQ ID NO: 441188 - DNA, 17 bp, Homo sapiens
tccctgacctccctcta

SEQ ID NO: 441189 - DNA, 22 bp, Homo sapiens
tccctgaccttagcgttctgga

SEQ ID NO: 441190 - DNA, 23 bp, Homo sapiens
tccctgaccttagcgttctggac

SEQ ID NO: 441191 - DNA, 13 bp, Homo sapiens
tccctgacttccc

SEQ ID NO: 441192 - DNA, 19 bp, Homo sapiens
tccctgacttcccagctgg

SEQ ID NO: 441193 - DNA, 22 bp, Homo sapiens
tccctgacttcccagctggcag

SEQ ID NO: 441194 - DNA, 16 bp, Homo sapiens
tccctgagcagtctac

SEQ ID NO: 441195 - DNA, 20 bp, Homo sapiens
tccctgagcagtctacttct

SEQ ID NO: 441196 - DNA, 13 bp, Homo sapiens
tccctgagcctgc

SEQ ID NO: 441197 - DNA, 21 bp, Homo sapiens
tccctgagcctgccccagctg

SEQ ID NO: 441198 - DNA, 22 bp, Homo sapiens
tccctgagcctgccccagctgg

SEQ ID NO: 441199 - DNA, 14 bp, Homo sapiens
tccctgagctttgg

SEQ ID NO: 441200 - DNA, 21 bp, Homo sapiens
tccctgagttgcaccattctt

SEQ ID NO: 441201 - DNA, 14 bp, Homo sapiens
tccctgatcaagct

SEQ ID NO: 441202 - DNA, 15 bp, Homo sapiens
tccctgcacaagcca

SEQ ID NO: 441203 - DNA, 11 bp, Homo sapiens
tccctgcaccc

SEQ ID NO: 441204 - DNA, 17 bp, Homo sapiens
tccctgcaccctggaaa

SEQ ID NO: 441205 - DNA, 10 bp, Homo sapiens
tccctgcagg

SEQ ID NO: 441206 - DNA, 20 bp, Homo sapiens
tccctgccaagaactctggg

SEQ ID NO: 441207 - DNA, 16 bp, Homo sapiens
tccctgcccaggccgg

SEQ ID NO: 441208 - DNA, 14 bp, Homo sapiens
tccctgccccgccc

SEQ ID NO: 441209 - DNA, 21 bp, Homo sapiens
tccctgccccgccccccagag

SEQ ID NO: 441210 - DNA, 23 bp, Homo sapiens
tccctgccccgccccccagagcc

SEQ ID NO: 441211 - DNA, 14 bp, Homo sapiens
tccctgcccctccc

SEQ ID NO: 441212 - DNA, 19 bp, Homo sapiens
tccctgcccctcccttcaa

SEQ ID NO: 441213 - DNA, 20 bp, Homo sapiens
tccctgcccctcccttcaac

SEQ ID NO: 441214 - DNA, 18 bp, Homo sapiens
tccctgcctaggagctgg

SEQ ID NO: 441215 - DNA, 18 bp, Homo sapiens
tccctgcctgctccttgg

SEQ ID NO: 441216 - DNA, 21 bp, Homo sapiens
tccctgcctgctccttggcac

SEQ ID NO: 441217 - DNA, 18 bp, Homo sapiens
tccctgctcagctggccg

SEQ ID NO: 441218 - DNA, 15 bp, Homo sapiens
tccctgcttcatatc

SEQ ID NO: 441219 - DNA, 16 bp, Homo sapiens
tccctgcttcatatct

SEQ ID NO: 441220 - DNA, 21 bp, Homo sapiens
tccctgcttcatatctctccc

SEQ ID NO: 441221 - DNA, 16 bp, Homo sapiens
tccctgcttgcccgct

SEQ ID NO: 441222 - DNA, 20 bp, Homo sapiens
tccctgcttgcccgctccca

SEQ ID NO: 441223 - DNA, 17 bp, Homo sapiens
tccctggaccagatgct

SEQ ID NO: 441224 - DNA, 17 bp, Homo sapiens
tccctggaccagcctcc

SEQ ID NO: 441225 - DNA, 17 bp, Homo sapiens
tccctggactctgtggg

SEQ ID NO: 441226 - DNA, 19 bp, Homo sapiens
tccctggagctgtccttca

SEQ ID NO: 441227 - DNA, 20 bp, Homo sapiens
tccctggagctgtccttcat

SEQ ID NO: 441228 - DNA, 15 bp, Homo sapiens
tccctggccatctct

SEQ ID NO: 441229 - DNA, 13 bp, Homo sapiens
tccctggcctgtt

SEQ ID NO: 441230 - DNA, 14 bp, Homo sapiens
tccctggctcaggg

SEQ ID NO: 441231 - DNA, 14 bp, Homo sapiens
tccctggctcccat

SEQ ID NO: 441232 - DNA, 18 bp, Homo sapiens
tccctggctgtgagcagc

SEQ ID NO: 441233 - DNA, 21 bp, Homo sapiens
tccctggctgtgagcagcctc

SEQ ID NO: 441234 - DNA, 15 bp, Homo sapiens
tccctgggcctgtct

SEQ ID NO: 441235 - DNA, 18 bp, Homo sapiens
tccctggggaccaggagc

SEQ ID NO: 441236 - DNA, 22 bp, Homo sapiens
tccctggggatatgcaaccctt

SEQ ID NO: 441237 - DNA, 18 bp, Homo sapiens
tccctggggtttttttca

SEQ ID NO: 441238 - DNA, 20 bp, Homo sapiens
tccctggttttaccccagct

SEQ ID NO: 441239 - DNA, 22 bp, Homo sapiens
tccctggttttaccccagctcc

SEQ ID NO: 441240 - DNA, 23 bp, Homo sapiens
tccctgtaggagtaaagataaaa

SEQ ID NO: 441241 - DNA, 14 bp, Homo sapiens
tccctgtcagaggc

SEQ ID NO: 441242 - DNA, 13 bp, Homo sapiens
tccctgtcatagt

SEQ ID NO: 441243 - DNA, 13 bp, Homo sapiens
tccctgtccaccc

SEQ ID NO: 441244 - DNA, 17 bp, Homo sapiens
tccctgtccatccccag

SEQ ID NO: 441245 - DNA, 11 bp, Homo sapiens
tccctgtcccc

SEQ ID NO: 441246 - DNA, 15 bp, Homo sapiens
tccctgtccctgccc

SEQ ID NO: 441247 - DNA, 14 bp, Homo sapiens
tccctgtcgcctgc

SEQ ID NO: 441248 - DNA, 23 bp, Homo sapiens
tccctgtcgcctgcggactccat

SEQ ID NO: 441249 - DNA, 13 bp, Homo sapiens
tccctgtctccag

SEQ ID NO: 441250 - DNA, 20 bp, Homo sapiens
tccctgtgcctaacaccagc

SEQ ID NO: 441251 - DNA, 15 bp, Homo sapiens
tccctgtgtggacca

SEQ ID NO: 441252 - DNA, 22 bp, Homo sapiens
tccctgtgtgtcgttcccttgt

SEQ ID NO: 441253 - DNA, 12 bp, Homo sapiens
tccctgttcatt

SEQ ID NO: 441254 - DNA, 18 bp, Homo sapiens
tccctgttggtcggtggg

SEQ ID NO: 441255 - DNA, 17 bp, Homo sapiens
tcccttacgtgagtcct

SEQ ID NO: 441256 - DNA, 14 bp, Homo sapiens
tcccttagccccga

SEQ ID NO: 441257 - DNA, 14 bp, Homo sapiens
tcccttagcctctc

SEQ ID NO: 441258 - DNA, 20 bp, Homo sapiens
tcccttagcctctcccaccc

SEQ ID NO: 441259 - DNA, 19 bp, Homo sapiens
tcccttcaatcctgtcaat

SEQ ID NO: 441260 - DNA, 17 bp, Homo sapiens
tcccttccacctcacaa

SEQ ID NO: 441261 - DNA, 13 bp, Homo sapiens
tcccttccactgc

SEQ ID NO: 441262 - DNA, 14 bp, Homo sapiens
tcccttccactgcc

SEQ ID NO: 441263 - DNA, 18 bp, Homo sapiens
tcccttccactgcctctg

SEQ ID NO: 441264 - DNA, 22 bp, Homo sapiens
tcccttccactgcctctgcctt

SEQ ID NO: 441265 - DNA, 19 bp, Homo sapiens
tcccttccccactctgctc

SEQ ID NO: 441266 - DNA, 16 bp, Homo sapiens
tcccttcccctgcctg

SEQ ID NO: 441267 - DNA, 13 bp, Homo sapiens
tcctctccactgc

SEQ ID NO: 441268 - DNA, 15 bp, Homo sapiens
tcctctccactgcct

SEQ ID NO: 441269 - DNA, 17 bp, Homo sapiens
tcctctcccctctaagg

SEQ ID NO: 441270 - DNA, 15 bp, Homo sapiens
tcctctcctgcccag

SEQ ID NO: 441271 - DNA, 17 bp, Homo sapiens
tcctctcctgcccagct

SEQ ID NO: 441272 - DNA, 14 bp, Homo sapiens
tcctctccttgggc

SEQ ID NO: 441273 - DNA, 22 bp, Homo sapiens
tcctctccttgggctcctggct

SEQ ID NO: 441274 - DNA, 16 bp, Homo sapiens
tcctctcggctggaag

SEQ ID NO: 441275 - DNA, 21 bp, Homo sapiens
tcctctcggctggaagaacat

SEQ ID NO: 441276 - DNA, 20 bp, Homo sapiens
tcctctcgttggtagttgag

SEQ ID NO: 441277 - DNA, 17 bp, Homo sapiens
tcctctctccctgcctc

SEQ ID NO: 441278 - DNA, 13 bp, Homo sapiens
tcctctctctccc

SEQ ID NO: 441279 - DNA, 14 bp, Homo sapiens
tcctctctctccct

SEQ ID NO: 441280 - DNA, 17 bp, Homo sapiens
tcctctctctccctcca

SEQ ID NO: 441281 - DNA, 15 bp, Homo sapiens
tcctctctctctctc

SEQ ID NO: 441282 - DNA, 20 bp, Homo sapiens
tcctctctgctgggtttcca

SEQ ID NO: 441283 - DNA, 13 bp, Homo sapiens
tcctctctgggcc

SEQ ID NO: 441284 - DNA, 14 bp, Homo sapiens
tcctctctgggcct

SEQ ID NO: 441285 - DNA, 18 bp, Homo sapiens
tcctctgagctgttatct

SEQ ID NO: 441286 - DNA, 21 bp, Homo sapiens
tcctctgagctgttatcttgt

SEQ ID NO: 441287 - DNA, 16 bp, Homo sapiens
tcctctgattatcagg

SEQ ID NO: 441288 - DNA, 15 bp, Homo sapiens
tcctctgcagcctga

SEQ ID NO: 441289 - DNA, 18 bp, Homo sapiens
tcctctgcagcctgagct

SEQ ID NO: 441290 - DNA, 17 bp, Homo sapiens
tcctctgcagctgacct

SEQ ID NO: 441291 - DNA, 18 bp, Homo sapiens
tcctctgcagctgacctc

SEQ ID NO: 441292 - DNA, 20 bp, Homo sapiens
tcctctgcagctgacctctg

SEQ ID NO: 441293 - DNA, 22 bp, Homo sapiens
tcctctgcaggacacagatctg

SEQ ID NO: 441294 - DNA, 11 bp, Homo sapiens
tcctctgcccc

SEQ ID NO: 441295 - DNA, 20 bp, Homo sapiens
tcctctgccccctcccccgc

SEQ ID NO: 441296 - DNA, 20 bp, Homo sapiens
tcctctgggcaggacctcag

SEQ ID NO: 441297 - DNA, 13 bp, Homo sapiens
tcctctggggctc

SEQ ID NO: 441298 - DNA, 18 bp, Homo sapiens
tcctctgtcagtttgtga

SEQ ID NO: 441299 - DNA, 22 bp, Homo sapiens
tcctctgtcagtttgtgaagtg

SEQ ID NO: 441300 - DNA, 12 bp, Homo sapiens
tcctctgtgctc

SEQ ID NO: 441301 - DNA, 13 bp, Homo sapiens
tcctctgtgctcc

SEQ ID NO: 441302 - DNA, 15 bp, Homo sapiens
tcctcttaagacact

SEQ ID NO: 441303 - DNA, 16 bp, Homo sapiens
tcctcttaagacacta

SEQ ID NO: 441304 - DNA, 20 bp, Homo sapiens
tcctcttcaccccggcaggc

SEQ ID NO: 441305 - DNA, 19 bp, Homo sapiens
tcctcttcccttagcctct

SEQ ID NO: 441306 - DNA, 20 bp, Homo sapiens
tcctcttcccttagcctctc

SEQ ID NO: 441307 - DNA, 22 bp, Homo sapiens
tcctcttcccttagcctctccc

SEQ ID NO: 441308 - DNA, 12 bp, Homo sapiens
tcctcttccttc

SEQ ID NO: 441309 - DNA, 18 bp, Homo sapiens
tcctcttgcctctctcag

SEQ ID NO: 441310 - DNA, 17 bp, Homo sapiens
tcctctttcagaaaaca

SEQ ID NO: 441311 - DNA, 17 bp, Homo sapiens
tcctctttgcatggaat

SEQ ID NO: 441312 - DNA, 14 bp, Homo sapiens
tcctgaacaagaaa

SEQ ID NO: 441313 - DNA, 16 bp, Homo sapiens
tcctgaacaagaaaga

SEQ ID NO: 441314 - DNA, 15 bp, Homo sapiens
tcctgaagaattgaa

SEQ ID NO: 441315 - DNA, 16 bp, Homo sapiens
tcctgaagcagtgtcg

SEQ ID NO: 441316 - DNA, 18 bp, Homo sapiens
tcctgaagcagtgtcgcc

SEQ ID NO: 441317 - DNA, 14 bp, Homo sapiens
tcctgaagcctctg

SEQ ID NO: 441318 - DNA, 15 bp, Homo sapiens
tcctgaagcctctgc

SEQ ID NO: 441319 - DNA, 14 bp, Homo sapiens
tcctgaatgaaata

SEQ ID NO: 441320 - DNA, 14 bp, Homo sapiens
tcctgacccagtcc

SEQ ID NO: 441321 - DNA, 15 bp, Homo sapiens
tcctgacctcctgga

SEQ ID NO: 441322 - DNA, 23 bp, Homo sapiens
tcctgacgccctgcgttggagcc

SEQ ID NO: 441323 - DNA, 21 bp, Homo sapiens
tcctgacggcgcccccagtgt

SEQ ID NO: 441324 - DNA, 14 bp, Homo sapiens
tcctgactgtccta

SEQ ID NO: 441325 - DNA, 13 bp, Homo sapiens
tcctgacttctaa

SEQ ID NO: 441326 - DNA, 22 bp, Homo sapiens
tcctgagattctgggaaaggtg

SEQ ID NO: 441327 - DNA, 16 bp, Homo sapiens
tcctgagcctgtctct

SEQ ID NO: 441328 - DNA, 18 bp, Homo sapiens
tcctgagcctgtctctcc

SEQ ID NO: 441329 - DNA, 20 bp, Homo sapiens
tcctgagcttggccagaagg

SEQ ID NO: 441330 - DNA, 24 bp, Homo sapiens
tcctgagggctaattctgggaagg

SEQ ID NO: 441331 - DNA, 19 bp, Homo sapiens
tcctgaggggcatctgccc

SEQ ID NO: 441332 - DNA, 23 bp, Homo sapiens
tcctgatgaaaaatatgtgcttg

SEQ ID NO: 441333 - DNA, 15 bp, Homo sapiens
tcctgatggccaaga

SEQ ID NO: 441334 - DNA, 17 bp, Homo sapiens
tcctgatggccaagagc

SEQ ID NO: 441335 - DNA, 18 bp, Homo sapiens
tcctgatggccaagagca

SEQ ID NO: 441336 - DNA, 20 bp, Homo sapiens
tcctgatggtcagctccctt

SEQ ID NO: 441337 - DNA, 14 bp, Homo sapiens
tcctgattctccct

SEQ ID NO: 441338 - DNA, 13 bp, Homo sapiens
tcctgattgctct

SEQ ID NO: 441339 - DNA, 18 bp, Homo sapiens
tcctgattgctctggaag

SEQ ID NO: 441340 - DNA, 20 bp, Homo sapiens
tcctgattgctctggaagcc

SEQ ID NO: 441341 - DNA, 15 bp, Homo sapiens
tcctgatttttatct

SEQ ID NO: 441342 - DNA, 17 bp, Homo sapiens
tcctgcaaaattttata

SEQ ID NO: 441343 - DNA, 19 bp, Homo sapiens
tcctgcaaaattttatagc

SEQ ID NO: 441344 - DNA, 17 bp, Homo sapiens
tcctgcaaagggaactg

SEQ ID NO: 441345 - DNA, 22 bp, Homo sapiens
tcctgcaagagtgggctttcca

SEQ ID NO: 441346 - DNA, 16 bp, Homo sapiens
tcctgcaatctccagg

SEQ ID NO: 441347 - DNA, 19 bp, Homo sapiens
tcctgcaatctccagggct

SEQ ID NO: 441348 - DNA, 21 bp, Homo sapiens
tcctgcaatctccagggctgc

SEQ ID NO: 441349 - DNA, 15 bp, Homo sapiens
tcctgcaattttcta

SEQ ID NO: 441350 - DNA, 18 bp, Homo sapiens
tcctgcaccccagcattc

SEQ ID NO: 441351 - DNA, 16 bp, Homo sapiens
tcctgcaccctctgct

SEQ ID NO: 441352 - DNA, 16 bp, Homo sapiens
tcctgcagcagagcct

SEQ ID NO: 441353 - DNA, 18 bp, Homo sapiens
tcctgcagcctcctcctg

SEQ ID NO: 441354 - DNA, 22 bp, Homo sapiens
tcctgcagcctcctcctgacca

SEQ ID NO: 441355 - DNA, 14 bp, Homo sapiens
tcctgcagcctgga

SEQ ID NO: 441356 - DNA, 17 bp, Homo sapiens
tcctgcaggaacgagca

SEQ ID NO: 441357 - DNA, 15 bp, Homo sapiens
tcctgcaggctggct

SEQ ID NO: 441358 - DNA, 18 bp, Homo sapiens
tcctgcatccctccaccc

SEQ ID NO: 441359 - DNA, 19 bp, Homo sapiens
tcctgcatctttcatagtt

SEQ ID NO: 441360 - DNA, 11 bp, Homo sapiens
tcctgcatgca

SEQ ID NO: 441361 - DNA, 18 bp, Homo sapiens
tcctgccaagtggtttct

SEQ ID NO: 441362 - DNA, 13 bp, Homo sapiens
tcctgccacctgc

SEQ ID NO: 441363 - DNA, 18 bp, Homo sapiens
tcctgccacctggggcag

SEQ ID NO: 441364 - DNA, 15 bp, Homo sapiens
tcctgccagctgcct

SEQ ID NO: 441365 - DNA, 12 bp, Homo sapiens
tcctgccaggag

SEQ ID NO: 441366 - DNA, 20 bp, Homo sapiens
tcctgccaggctctccctct

SEQ ID NO: 441367 - DNA, 19 bp, Homo sapiens
tcctgcccagctctgaccc

SEQ ID NO: 441368 - DNA, 13 bp, Homo sapiens
tcctgcccagtgt

SEQ ID NO: 441369 - DNA, 17 bp, Homo sapiens
tcctgcccagtgttgtt

SEQ ID NO: 441370 - DNA, 15 bp, Homo sapiens
tcctgccccctgcca

SEQ ID NO: 441371 - DNA, 12 bp, Homo sapiens
tcctgccctgta

SEQ ID NO: 441372 - DNA, 22 bp, Homo sapiens
tcctgccctgtacctctctctg

SEQ ID NO: 441373 - DNA, 21 bp, Homo sapiens
tcctgccgggcaggtcccagg

SEQ ID NO: 441374 - DNA, 14 bp, Homo sapiens
tcctgcctcagcct

SEQ ID NO: 441375 - DNA, 16 bp, Homo sapiens
tcctgcctcagcctcc

SEQ ID NO: 441376 - DNA, 12 bp, Homo sapiens
tcctgcctggcc

SEQ ID NO: 441377 - DNA, 13 bp, Homo sapiens
tcctgcctggcca

SEQ ID NO: 441378 - DNA, 14 bp, Homo sapiens
tcctgccttctctt

SEQ ID NO: 441379 - DNA, 12 bp, Homo sapiens
tcctgcctttgg

SEQ ID NO: 441380 - DNA, 20 bp, Homo sapiens
tcctgctacaacttcagcag

SEQ ID NO: 441381 - DNA, 22 bp, Homo sapiens
tcctgctagctgtagaaatgta

SEQ ID NO: 441382 - DNA, 20 bp, Homo sapiens
tcctgctcacgtctgtgagt

SEQ ID NO: 441383 - DNA, 21 bp, Homo sapiens
tcctgctcacgtctgtgagtc

SEQ ID NO: 441384 - DNA, 16 bp, Homo sapiens
tcctgctccatgactg

SEQ ID NO: 441385 - DNA, 20 bp, Homo sapiens
tcctgctccatgactggctg

SEQ ID NO: 441386 - DNA, 23 bp, Homo sapiens
tcctgctccatgactggctgtct

SEQ ID NO: 441387 - DNA, 17 bp, Homo sapiens
tcctgctctctacccag

SEQ ID NO: 441388 - DNA, 18 bp, Homo sapiens
tcctgctctctacccagc

SEQ ID NO: 441389 - DNA, 12 bp, Homo sapiens
tcctgctgctcg

SEQ ID NO: 441390 - DNA, 16 bp, Homo sapiens
tcctgctgctcgggaa

SEQ ID NO: 441391 - DNA, 23 bp, Homo sapiens
tcctgctgctcgggaaggcctga

SEQ ID NO: 441392 - DNA, 12 bp, Homo sapiens
tcctgctgctgt

SEQ ID NO: 441393 - DNA, 13 bp, Homo sapiens
tcctgctgctgta

SEQ ID NO: 441394 - DNA, 21 bp, Homo sapiens
tcctgctgctgtaactgctga

SEQ ID NO: 441395 - DNA, 19 bp, Homo sapiens
tcctgctggctgaggcttg

SEQ ID NO: 441396 - DNA, 11 bp, Homo sapiens
tcctgctggta

SEQ ID NO: 441397 - DNA, 14 bp, Homo sapiens
tcctgctttctctt

SEQ ID NO: 441398 - DNA, 19 bp, Homo sapiens
tctaaaactatggttccca

SEQ ID NO: 441399 - DNA, 15 bp, Homo sapiens
tctaaaattctagtc

SEQ ID NO: 441400 - DNA, 13 bp, Homo sapiens
tctaaacattaat

SEQ ID NO: 441401 - DNA, 17 bp, Homo sapiens
tctaaacattaatcaat

SEQ ID NO: 441402 - DNA, 13 bp, Homo sapiens
tctaaactgtttt

SEQ ID NO: 441403 - DNA, 18 bp, Homo sapiens
tctaaagataatattact

SEQ ID NO: 441404 - DNA, 19 bp, Homo sapiens
tctaaagtgtgttgttgct

SEQ ID NO: 441405 - DNA, 15 bp, Homo sapiens
tctaaagtgttggtc

SEQ ID NO: 441406 - DNA, 22 bp, Homo sapiens
tctaaagtgttggtctttctaa

SEQ ID NO: 441407 - DNA, 13 bp, Homo sapiens
tctaaagtttaca

SEQ ID NO: 441408 - DNA, 17 bp, Homo sapiens
tctaaagtttacagtaa

SEQ ID NO: 441409 - DNA, 18 bp, Homo sapiens
tctaaagtttacagtaaa

SEQ ID NO: 441410 - DNA, 19 bp, Homo sapiens
tctaaagtttacagtaaat

SEQ ID NO: 441411 - DNA, 19 bp, Homo sapiens
tctaaattgatcattcata

SEQ ID NO: 441412 - DNA, 19 bp, Homo sapiens
tctaaatttttacttaact

SEQ ID NO: 441413 - DNA, 19 bp, Homo sapiens
tctaacaaaaaaatatatt

SEQ ID NO: 441414 - DNA, 23 bp, Homo sapiens
tctaacactcgactctgctgctc

SEQ ID NO: 441415 - DNA, 17 bp, Homo sapiens
tctaacagctcaggatc

SEQ ID NO: 441416 - DNA, 17 bp, Homo sapiens
tctaacaggacttgaat

SEQ ID NO: 441417 - DNA, 16 bp, Homo sapiens
tctaacaggggctggt

SEQ ID NO: 441418 - DNA, 19 bp, Homo sapiens
tctaacattactgccttca

SEQ ID NO: 441419 - DNA, 23 bp, Homo sapiens
tctaacatttgagtcccttccag

SEQ ID NO: 441420 - DNA, 20 bp, Homo sapiens
tctaaccctcccatggcacc

SEQ ID NO: 441421 - DNA, 14 bp, Homo sapiens
tctaactaaactaa

SEQ ID NO: 441422 - DNA, 11 bp, Homo sapiens
tctaactcatt

SEQ ID NO: 441423 - DNA, 16 bp, Homo sapiens
tctaactcattcttca

SEQ ID NO: 441424 - DNA, 17 bp, Homo sapiens
tctaagccagttttcat

SEQ ID NO: 441425 - DNA, 19 bp, Homo sapiens
tctaagccagttttcattt

SEQ ID NO: 441426 - DNA, 18 bp, Homo sapiens
tctaaggcatgctcccag

SEQ ID NO: 441427 - DNA, 18 bp, Homo sapiens
tctaaggttctcatagga

SEQ ID NO: 441428 - DNA, 14 bp, Homo sapiens
tctaagtatttaaa

SEQ ID NO: 441429 - DNA, 20 bp, Homo sapiens
tctaagtcagtttcacatat

SEQ ID NO: 441430 - DNA, 18 bp, Homo sapiens
tctaagtctccaagaata

SEQ ID NO: 441431 - DNA, 14 bp, Homo sapiens
tctaagtgtaaaaa

SEQ ID NO: 441432 - DNA, 13 bp, Homo sapiens
tctaagtgtactt

SEQ ID NO: 441433 - DNA, 18 bp, Homo sapiens
tctaagttcatgtttgta

SEQ ID NO: 441434 - DNA, 12 bp, Homo sapiens
tctaagttttgt

SEQ ID NO: 441435 - DNA, 22 bp, Homo sapiens
tctaataaaacagctgtctcta

SEQ ID NO: 441436 - DNA, 21 bp, Homo sapiens
tctaataaatatactatgaaa

SEQ ID NO: 441437 - DNA, 16 bp, Homo sapiens
tctaatataatgactt

SEQ ID NO: 441438 - DNA, 18 bp, Homo sapiens
tctaatattaaaaatatg

SEQ ID NO: 441439 - DNA, 12 bp, Homo sapiens
tctaatcaaaag

SEQ ID NO: 441440 - DNA, 15 bp, Homo sapiens
tctaatcataacata

SEQ ID NO: 441441 - DNA, 16 bp, Homo sapiens
tctaatccatgtgctg

SEQ ID NO: 441442 - DNA, 22 bp, Homo sapiens
tctaatgcattaacttttgtaa

SEQ ID NO: 441443 - DNA, 21 bp, Homo sapiens
tctaatggcccctccatttat

SEQ ID NO: 441444 - DNA, 14 bp, Homo sapiens
tctaatgtagctat

SEQ ID NO: 441445 - DNA, 17 bp, Homo sapiens
tctaatgtagctatttt

SEQ ID NO: 441446 - DNA, 14 bp, Homo sapiens
tctaatgtcttcat

SEQ ID NO: 441447 - DNA, 16 bp, Homo sapiens
tctaattaaaacactt

SEQ ID NO: 441448 - DNA, 19 bp, Homo sapiens
tctaattcccattttgcaa

SEQ ID NO: 441449 - DNA, 16 bp, Homo sapiens
tctaattctctaggaa

SEQ ID NO: 441450 - DNA, 15 bp, Homo sapiens
tctaattgccatgta

SEQ ID NO: 441451 - DNA, 12 bp, Homo sapiens
tctaatttactg

SEQ ID NO: 441452 - DNA, 22 bp, Homo sapiens
tctaatttatcttgtctctggg

SEQ ID NO: 441453 - DNA, 22 bp, Homo sapiens
tctaatttcaaaaatataactt

SEQ ID NO: 441454 - DNA, 14 bp, Homo sapiens
tctaattttgtgct

SEQ ID NO: 441455 - DNA, 16 bp, Homo sapiens
tctaattttgtgctct

SEQ ID NO: 441456 - DNA, 19 bp, Homo sapiens
tctaattttgtgctctttc

SEQ ID NO: 441457 - DNA, 20 bp, Homo sapiens
tctacaaaaaaaatcaaaaa

SEQ ID NO: 441458 - DNA, 19 bp, Homo sapiens
tctacaaatataagatttt

SEQ ID NO: 441459 - DNA, 15 bp, Homo sapiens
tctacaatctattta

SEQ ID NO: 441460 - DNA, 13 bp, Homo sapiens
tctacacctggac

SEQ ID NO: 441461 - DNA, 15 bp, Homo sapiens
tctacactctcctgg

SEQ ID NO: 441462 - DNA, 19 bp, Homo sapiens
tctacagccagtaaggcag

SEQ ID NO: 441463 - DNA, 23 bp, Homo sapiens
tctacagccagtaaggcagctct

SEQ ID NO: 441464 - DNA, 22 bp, Homo sapiens
tctacaggcccggcccagccta

SEQ ID NO: 441465 - DNA, 17 bp, Homo sapiens
tctacataagtaattca

SEQ ID NO: 441466 - DNA, 20 bp, Homo sapiens
tctacataagtaattcaaga

SEQ ID NO: 441467 - DNA, 22 bp, Homo sapiens
tctacataagtaattcaagaaa

SEQ ID NO: 441468 - DNA, 23 bp, Homo sapiens
tctacatttcacctactttgtaa

SEQ ID NO: 441469 - DNA, 15 bp, Homo sapiens
tctaccaagacataa

SEQ ID NO: 441470 - DNA, 18 bp, Homo sapiens
tctaccaagacataatgc

SEQ ID NO: 441471 - DNA, 19 bp, Homo sapiens
tctaccaagacataatgca

SEQ ID NO: 441472 - DNA, 17 bp, Homo sapiens
tctacccagactcagag

SEQ ID NO: 441473 - DNA, 14 bp, Homo sapiens
tctacccagcccat

SEQ ID NO: 441474 - DNA, 15 bp, Homo sapiens
tctacccatattaca

SEQ ID NO: 441475 - DNA, 16 bp, Homo sapiens
tctacccatgagcctg

SEQ ID NO: 441476 - DNA, 17 bp, Homo sapiens
tctacccatgagcctgc

SEQ ID NO: 441477 - DNA, 21 bp, Homo sapiens
tctacccatgagcctgcccgc

SEQ ID NO: 441478 - DNA, 21 bp, Homo sapiens
tctacccatgttgggaaaaac

SEQ ID NO: 441479 - DNA, 23 bp, Homo sapiens
tctacccatgttgggaaaaactg

SEQ ID NO: 441480 - DNA, 15 bp, Homo sapiens
tctacccccaacacc

SEQ ID NO: 441481 - DNA, 16 bp, Homo sapiens
tctacccccaacacca

SEQ ID NO: 441482 - DNA, 21 bp, Homo sapiens
tctacccccaacaccacccct

SEQ ID NO: 441483 - DNA, 15 bp, Homo sapiens
tctaccctcccaccc

SEQ ID NO: 441484 - DNA, 18 bp, Homo sapiens
tctaccctcccaccccct

SEQ ID NO: 441485 - DNA, 13 bp, Homo sapiens
tctaccctgaaag

SEQ ID NO: 441486 - DNA, 15 bp, Homo sapiens
tctacctcccgacct

SEQ ID NO: 441487 - DNA, 16 bp, Homo sapiens
tctacctgcaggactc

SEQ ID NO: 441488 - DNA, 16 bp, Homo sapiens
tctaccttgaggtctt

SEQ ID NO: 441489 - DNA, 15 bp, Homo sapiens
tctacctttctgagt

SEQ ID NO: 441490 - DNA, 20 bp, Homo sapiens
tctacgtataaatatgaaat

SEQ ID NO: 441491 - DNA, 17 bp, Homo sapiens
tctactcatgccagatt

SEQ ID NO: 441492 - DNA, 14 bp, Homo sapiens
tctactcatttttc

SEQ ID NO: 441493 - DNA, 20 bp, Homo sapiens
tctactcgagttacagacaa

SEQ ID NO: 441494 - DNA, 21 bp, Homo sapiens
tctactcgagttacagacaaa

SEQ ID NO: 441495 - DNA, 12 bp, Homo sapiens
tctactgagcca

SEQ ID NO: 441496 - DNA, 13 bp, Homo sapiens
tctactgagccac

SEQ ID NO: 441497 - DNA, 14 bp, Homo sapiens
tctactgagccacg

SEQ ID NO: 441498 - DNA, 18 bp, Homo sapiens
tctactggtaggaagagg

SEQ ID NO: 441499 - DNA, 19 bp, Homo sapiens
tctacttctgtgtctgtca

SEQ ID NO: 441500 - DNA, 20 bp, Homo sapiens
tctacttctgtgtctgtcac

SEQ ID NO: 441501 - DNA, 21 bp, Homo sapiens
tctacttctttttctttgaga

SEQ ID NO: 441502 - DNA, 20 bp, Homo sapiens
tctacttgatatttccttca

SEQ ID NO: 441503 - DNA, 14 bp, Homo sapiens
tctacttggtggtt

SEQ ID NO: 441504 - DNA, 16 bp, Homo sapiens
tctactttaagcacta

SEQ ID NO: 441505 - DNA, 14 bp, Homo sapiens
tctactttattaat

SEQ ID NO: 441506 - DNA, 21 bp, Homo sapiens
tctactttattaattgttttg

SEQ ID NO: 441507 - DNA, 17 bp, Homo sapiens
tctactttttccttcct

SEQ ID NO: 441508 - DNA, 22 bp, Homo sapiens
tctagaaagcccctcacctcag

SEQ ID NO: 441509 - DNA, 14 bp, Homo sapiens
tctagaatcctgct

SEQ ID NO: 441510 - DNA, 15 bp, Homo sapiens
tctagaatcctgctt

SEQ ID NO: 441511 - DNA, 23 bp, Homo sapiens
tctagaattataagtcacaaaga

SEQ ID NO: 441512 - DNA, 13 bp, Homo sapiens
tctagacaaccct

SEQ ID NO: 441513 - DNA, 14 bp, Homo sapiens
tctagagagggaat

SEQ ID NO: 441514 - DNA, 22 bp, Homo sapiens
tctagagagggaattctcttgg

SEQ ID NO: 441515 - DNA, 13 bp, Homo sapiens
tctagaggcctca

SEQ ID NO: 441516 - DNA, 15 bp, Homo sapiens
tctagaggcctcagt

SEQ ID NO: 441517 - DNA, 23 bp, Homo sapiens
tctagagtgagaatctggctcct

SEQ ID NO: 441518 - DNA, 21 bp, Homo sapiens
tctagatcaattaattcttaa

SEQ ID NO: 441519 - DNA, 22 bp, Homo sapiens
tctagatcctgcaccccagcat

SEQ ID NO: 441520 - DNA, 23 bp, Homo sapiens
tctagcaactgttggataataac

SEQ ID NO: 441521 - DNA, 21 bp, Homo sapiens
tctagcaagaagattctaaaa

SEQ ID NO: 441522 - DNA, 13 bp, Homo sapiens
tctagccaggcct

SEQ ID NO: 441523 - DNA, 14 bp, Homo sapiens
tctagccaggcctc

SEQ ID NO: 441524 - DNA, 21 bp, Homo sapiens
tctagctagaaatatgatttt

SEQ ID NO: 441525 - DNA, 22 bp, Homo sapiens
tctagctataacaactctattt

SEQ ID NO: 441526 - DNA, 14 bp, Homo sapiens
tctaggaggatgct

SEQ ID NO: 441527 - DNA, 20 bp, Homo sapiens
tctaggaggatgctgtgcct

SEQ ID NO: 441528 - DNA, 14 bp, Homo sapiens
tctccgtcactcca

SEQ ID NO: 441529 - DNA, 19 bp, Homo sapiens
tctcctaccccacctcatg

SEQ ID NO: 441530 - DNA, 14 bp, Homo sapiens
tctcctactctgtg

SEQ ID NO: 441531 - DNA, 17 bp, Homo sapiens
tctcctactctgtgtaa

SEQ ID NO: 441532 - DNA, 19 bp, Homo sapiens
tctcctagagacagaagca

SEQ ID NO: 441533 - DNA, 21 bp, Homo sapiens
tctcctatcttttatttcatt

SEQ ID NO: 441534 - DNA, 14 bp, Homo sapiens
tctcctatgtggca

SEQ ID NO: 441535 - DNA, 20 bp, Homo sapiens
tctcctatgtggcagctggg

SEQ ID NO: 441536 - DNA, 18 bp, Homo sapiens
tctcctatttttcagaat

SEQ ID NO: 441537 - DNA, 16 bp, Homo sapiens
tctcctcagggtgggg

SEQ ID NO: 441538 - DNA, 17 bp, Homo sapiens
tctcctcagggtggggg

SEQ ID NO: 441539 - DNA, 18 bp, Homo sapiens
tctcctcatctctaacag

SEQ ID NO: 441540 - DNA, 16 bp, Homo sapiens
tctcctccaaatgctg

SEQ ID NO: 441541 - DNA, 18 bp, Homo sapiens
tctcctccccacccgccc

SEQ ID NO: 441542 - DNA, 14 bp, Homo sapiens
tctcctccctcagc

SEQ ID NO: 441543 - DNA, 23 bp, Homo sapiens
tctcctccctgttatctgctaga

SEQ ID NO: 441544 - DNA, 12 bp, Homo sapiens
tctcctcctccc

SEQ ID NO: 441545 - DNA, 14 bp, Homo sapiens
tctcctcctcccct

SEQ ID NO: 441546 - DNA, 18 bp, Homo sapiens
tctcctcctcccctcctc

SEQ ID NO: 441547 - DNA, 21 bp, Homo sapiens
tctcctccttttcacagttct

SEQ ID NO: 441548 - DNA, 21 bp, Homo sapiens
tctcctcggccccctccatcg

SEQ ID NO: 441549 - DNA, 17 bp, Homo sapiens
tctcctcgtccggcctg

SEQ ID NO: 441550 - DNA, 20 bp, Homo sapiens
tctcctcgtccggcctgcag

SEQ ID NO: 441551 - DNA, 21 bp, Homo sapiens
tctcctcgtccggcctgcagc

SEQ ID NO: 441552 - DNA, 18 bp, Homo sapiens
tctcctctcagcttctaa

SEQ ID NO: 441553 - DNA, 18 bp, Homo sapiens
tctcctctctctccctcc

SEQ ID NO: 441554 - DNA, 13 bp, Homo sapiens
tctcctctctggg

SEQ ID NO: 441555 - DNA, 12 bp, Homo sapiens
tctcctctgtca

SEQ ID NO: 441556 - DNA, 16 bp, Homo sapiens
tctcctcttgccactg

SEQ ID NO: 441557 - DNA, 16 bp, Homo sapiens
tctcctcttttatctt

SEQ ID NO: 441558 - DNA, 16 bp, Homo sapiens
tctcctgacccagtcc

SEQ ID NO: 441559 - DNA, 15 bp, Homo sapiens
tctcctgagcctgtc

SEQ ID NO: 441560 - DNA, 16 bp, Homo sapiens
tctcctgattatttat

SEQ ID NO: 441561 - DNA, 19 bp, Homo sapiens
tctcctgcatccctccacc

SEQ ID NO: 441562 - DNA, 17 bp, Homo sapiens
tctcctgctcctcagga

SEQ ID NO: 441563 - DNA, 22 bp, Homo sapiens
tctcctgcttgtactaagccag

SEQ ID NO: 441564 - DNA, 19 bp, Homo sapiens
tctcctgggcccctcccta

SEQ ID NO: 441565 - DNA, 16 bp, Homo sapiens
tctcctgtaattttgt

SEQ ID NO: 441566 - DNA, 17 bp, Homo sapiens
tctcctgtagccactgg

SEQ ID NO: 441567 - DNA, 19 bp, Homo sapiens
tctcctgtataaccccacc

SEQ ID NO: 441568 - DNA, 15 bp, Homo sapiens
tctcctgtatcattt

SEQ ID NO: 441569 - DNA, 11 bp, Homo sapiens
tctcctgtgcc

SEQ ID NO: 441570 - DNA, 17 bp, Homo sapiens
tctcctgtgcccacatc

SEQ ID NO: 441571 - DNA, 17 bp, Homo sapiens
tctcctgtttcccttcc

SEQ ID NO: 441572 - DNA, 20 bp, Homo sapiens
tctccttactctgagcccag

SEQ ID NO: 441573 - DNA, 23 bp, Homo sapiens
tctccttactctgagcccaggcc

SEQ ID NO: 441574 - DNA, 11 bp, Homo sapiens
tctccttccaa

SEQ ID NO: 441575 - DNA, 21 bp, Homo sapiens
tctccttccaactgctgcccc

SEQ ID NO: 441576 - DNA, 15 bp, Homo sapiens
tctccttcccactgt

SEQ ID NO: 441577 - DNA, 17 bp, Homo sapiens
tctccttcccccagccc

SEQ ID NO: 441578 - DNA, 18 bp, Homo sapiens
tctccttcccccagccca

SEQ ID NO: 441579 - DNA, 21 bp, Homo sapiens
tctccttcccccagcccaata

SEQ ID NO: 441580 - DNA, 17 bp, Homo sapiens
tctccttctccttccca

SEQ ID NO: 441581 - DNA, 19 bp, Homo sapiens
tctccttgccccagtcctg

SEQ ID NO: 441582 - DNA, 13 bp, Homo sapiens
tctccttgcccta

SEQ ID NO: 441583 - DNA, 19 bp, Homo sapiens
tctccttgccctagatgag

SEQ ID NO: 441584 - DNA, 17 bp, Homo sapiens
tctccttgggctcctgg

SEQ ID NO: 441585 - DNA, 20 bp, Homo sapiens
tctccttgggctcctggctg

SEQ ID NO: 441586 - DNA, 23 bp, Homo sapiens
tctccttgggctcctggctgcca

SEQ ID NO: 441587 - DNA, 17 bp, Homo sapiens
tctcctttgcactgagg

SEQ ID NO: 441588 - DNA, 15 bp, Homo sapiens
tctcgaactcctgac

SEQ ID NO: 441589 - DNA, 15 bp, Homo sapiens
tctcgaagtcttcca

SEQ ID NO: 441590 - DNA, 19 bp, Homo sapiens
tctcgagtccaaaatcatt

SEQ ID NO: 441591 - DNA, 13 bp, Homo sapiens
tctcggaggccag

SEQ ID NO: 441592 - DNA, 14 bp, Homo sapiens
tctcggaggccagg

SEQ ID NO: 441593 - DNA, 14 bp, Homo sapiens
tctcggggcccttg

SEQ ID NO: 441594 - DNA, 22 bp, Homo sapiens
tctcggggcccttggggcctgg

SEQ ID NO: 441595 - DNA, 17 bp, Homo sapiens
tctcggttccacgtccc

SEQ ID NO: 441596 - DNA, 18 bp, Homo sapiens
tctcgtagatgctgccta

SEQ ID NO: 441597 - DNA, 14 bp, Homo sapiens
tctcgtgattgata

SEQ ID NO: 441598 - DNA, 18 bp, Homo sapiens
tctcgtgggagagccatc

SEQ ID NO: 441599 - DNA, 15 bp, Homo sapiens
tctcgtgggtaaata

SEQ ID NO: 441600 - DNA, 17 bp, Homo sapiens
tctcgtggtagaagcca

SEQ ID NO: 441601 - DNA, 16 bp, Homo sapiens
tctctaaaaataaaat

SEQ ID NO: 441602 - DNA, 18 bp, Homo sapiens
tctctaaaaataaaatga

SEQ ID NO: 441603 - DNA, 14 bp, Homo sapiens
tctctaaaacagca

SEQ ID NO: 441604 - DNA, 14 bp, Homo sapiens
tctctaaaattcta

SEQ ID NO: 441605 - DNA, 16 bp, Homo sapiens
tctctaaaattctagt

SEQ ID NO: 441606 - DNA, 13 bp, Homo sapiens
tctctaaagcact

SEQ ID NO: 441607 - DNA, 23 bp, Homo sapiens
tctctaaatgaggggcctcaggt

SEQ ID NO: 441608 - DNA, 14 bp, Homo sapiens
tctctaatagaagt

SEQ ID NO: 441609 - DNA, 21 bp, Homo sapiens
tctctacccactatgcacaga

SEQ ID NO: 441610 - DNA, 18 bp, Homo sapiens
tctctacccagcccatct

SEQ ID NO: 441611 - DNA, 20 bp, Homo sapiens
tctctacccagcccatcttg

SEQ ID NO: 441612 - DNA, 15 bp, Homo sapiens
tctctactggagtgg

SEQ ID NO: 441613 - DNA, 13 bp, Homo sapiens
tctctactggtag

SEQ ID NO: 441614 - DNA, 13 bp, Homo sapiens
tctctagaatttt

SEQ ID NO: 441615 - DNA, 15 bp, Homo sapiens
tctctagcctctttg

SEQ ID NO: 441616 - DNA, 16 bp, Homo sapiens
tctctagggaaggcca

SEQ ID NO: 441617 - DNA, 19 bp, Homo sapiens
tctctagggaaggccacct

SEQ ID NO: 441618 - DNA, 22 bp, Homo sapiens
tctctagggaaggccacctgca

SEQ ID NO: 441619 - DNA, 15 bp, Homo sapiens
tctctatatatacat

SEQ ID NO: 441620 - DNA, 21 bp, Homo sapiens
tctctatatatacatgtatag

SEQ ID NO: 441621 - DNA, 22 bp, Homo sapiens
tctctatggtaaagatattatt

SEQ ID NO: 441622 - DNA, 13 bp, Homo sapiens
tctctattctctg

SEQ ID NO: 441623 - DNA, 18 bp, Homo sapiens
tctctattctctgcaatt

SEQ ID NO: 441624 - DNA, 15 bp, Homo sapiens
tctctatttttgtta

SEQ ID NO: 441625 - DNA, 20 bp, Homo sapiens
tctctcaatttgggtcccag

SEQ ID NO: 441626 - DNA, 21 bp, Homo sapiens
tctctcaatttgggtcccagc

SEQ ID NO: 441627 - DNA, 20 bp, Homo sapiens
tctctcacctagaccttgcc

SEQ ID NO: 441628 - DNA, 11 bp, Homo sapiens
tctctcagacc

SEQ ID NO: 441629 - DNA, 13 bp, Homo sapiens
tctctcaggagca

SEQ ID NO: 441630 - DNA, 18 bp, Homo sapiens
tctctcaggagcacaggc

SEQ ID NO: 441631 - DNA, 16 bp, Homo sapiens
tctctcatttctttca

SEQ ID NO: 441632 - DNA, 21 bp, Homo sapiens
tctctccacttctggtcccct

SEQ ID NO: 441633 - DNA, 11 bp, Homo sapiens
tctctccagga

SEQ ID NO: 441634 - DNA, 18 bp, Homo sapiens
tctctcccacacaagcag

SEQ ID NO: 441635 - DNA, 13 bp, Homo sapiens
tctctccccaatg

SEQ ID NO: 441636 - DNA, 16 bp, Homo sapiens
tctctccccatatata

SEQ ID NO: 441637 - DNA, 21 bp, Homo sapiens
tctctccccatatataaatta

SEQ ID NO: 441638 - DNA, 23 bp, Homo sapiens
tctctccctaccctcttctcagc

SEQ ID NO: 441639 - DNA, 11 bp, Homo sapiens
tctctccctcc

SEQ ID NO: 441640 - DNA, 12 bp, Homo sapiens
tctctccctcca

SEQ ID NO: 441641 - DNA, 21 bp, Homo sapiens
tctctccctcccctgccattt

SEQ ID NO: 441642 - DNA, 15 bp, Homo sapiens
tctctccctgcctca

SEQ ID NO: 441643 - DNA, 13 bp, Homo sapiens
tctctccctgggg

SEQ ID NO: 441644 - DNA, 22 bp, Homo sapiens
tctctcccttactattcccact

SEQ ID NO: 441645 - DNA, 15 bp, Homo sapiens
tctctcggttccacg

SEQ ID NO: 441646 - DNA, 19 bp, Homo sapiens
tctctctaaaaataaaatg

SEQ ID NO: 441647 - DNA, 14 bp, Homo sapiens
tctctctatatata

SEQ ID NO: 441648 - DNA, 18 bp, Homo sapiens
tctctctatatatacatg

SEQ ID NO: 441649 - DNA, 13 bp, Homo sapiens
tctctctatgcaa

SEQ ID NO: 441650 - DNA, 22 bp, Homo sapiens
tctctctatgcaaaatgtctgt

SEQ ID NO: 441651 - DNA, 14 bp, Homo sapiens
tctctctccctcca

SEQ ID NO: 441652 - DNA, 15 bp, Homo sapiens
tctctctcccttact

SEQ ID NO: 441653 - DNA, 11 bp, Homo sapiens
tctctctctct

SEQ ID NO: 441654 - DNA, 10 bp, Homo sapiens
tctctctctg

SEQ ID NO: 441655 - DNA, 12 bp, Homo sapiens
tctctctgctcc

SEQ ID NO: 441656 - DNA, 15 bp, Homo sapiens
tctctctgctcctca

SEQ ID NO: 441657 - DNA, 14 bp, Homo sapiens
tctctctgtgtggc

SEQ ID NO: 441658 - DNA, 15 bp, Homo sapiens
tctctctgtgtggca

SEQ ID NO: 441659 - DNA, 23 bp, Homo sapiens
tctgtgacaaatgttgacctttg

SEQ ID NO: 441660 - DNA, 22 bp, Homo sapiens
tctgtgagtctgtcctttccca

SEQ ID NO: 441661 - DNA, 18 bp, Homo sapiens
tctgtgagttctgttgtg

SEQ ID NO: 441662 - DNA, 22 bp, Homo sapiens
tctgtgatcaccctctcggcct

SEQ ID NO: 441663 - DNA, 23 bp, Homo sapiens
tctgtgatgtcagtagtgcctgt

SEQ ID NO: 441664 - DNA, 22 bp, Homo sapiens
tctgtgattgccatttcttccc

SEQ ID NO: 441665 - DNA, 18 bp, Homo sapiens
tctgtgcaggtgctgcct

SEQ ID NO: 441666 - DNA, 17 bp, Homo sapiens
tctgtgcagtcatcaac

SEQ ID NO: 441667 - DNA, 23 bp, Homo sapiens
tctgtgcatttgtgtctgcctgc

SEQ ID NO: 441668 - DNA, 16 bp, Homo sapiens
tctgtgccagaaacag

SEQ ID NO: 441669 - DNA, 14 bp, Homo sapiens
tctgtgcccagctc

SEQ ID NO: 441670 - DNA, 14 bp, Homo sapiens
tctgtgccccatgc

SEQ ID NO: 441671 - DNA, 22 bp, Homo sapiens
tctgtgccccatgcctgtccag

SEQ ID NO: 441672 - DNA, 21 bp, Homo sapiens
tctgtgccgccacctctacct

SEQ ID NO: 441673 - DNA, 13 bp, Homo sapiens
tctgtgcctaata

SEQ ID NO: 441674 - DNA, 16 bp, Homo sapiens
tctgtgcctaataaag

SEQ ID NO: 441675 - DNA, 13 bp, Homo sapiens
tctgtgcctcccc

SEQ ID NO: 441676 - DNA, 18 bp, Homo sapiens
tctgtgcctccccccaga

SEQ ID NO: 441677 - DNA, 20 bp, Homo sapiens
tctgtgcctggagctcctgg

SEQ ID NO: 441678 - DNA, 21 bp, Homo sapiens
tctgtgcctggagctcctggg

SEQ ID NO: 441679 - DNA, 22 bp, Homo sapiens
tctgtgcgtgaaacacaccagg

SEQ ID NO: 441680 - DNA, 16 bp, Homo sapiens
tctgtgctccctcggt

SEQ ID NO: 441681 - DNA, 22 bp, Homo sapiens
tctgtgctcttttggtggggag

SEQ ID NO: 441682 - DNA, 15 bp, Homo sapiens
tctgtgctgtgcctg

SEQ ID NO: 441683 - DNA, 16 bp, Homo sapiens
tctgtggagaatgtac

SEQ ID NO: 441684 - DNA, 21 bp, Homo sapiens
tctgtggagagtgagaataat

SEQ ID NO: 441685 - DNA, 14 bp, Homo sapiens
tctgtggattctat

SEQ ID NO: 441686 - DNA, 20 bp, Homo sapiens
tctgtggattctatatttca

SEQ ID NO: 441687 - DNA, 22 bp, Homo sapiens
tctgtggcctgtgtccagcagc

SEQ ID NO: 441688 - DNA, 23 bp, Homo sapiens
tctgtggcctgtgtccagcagct

SEQ ID NO: 441689 - DNA, 15 bp, Homo sapiens
tctgtggccttgttc

SEQ ID NO: 441690 - DNA, 22 bp, Homo sapiens
tctgtggcgatatgagagggat

SEQ ID NO: 441691 - DNA, 13 bp, Homo sapiens
tctgtgggactgg

SEQ ID NO: 441692 - DNA, 21 bp, Homo sapiens
tctgtgggactggcccacccc

SEQ ID NO: 441693 - DNA, 18 bp, Homo sapiens
tctgtgggcttggccttg

SEQ ID NO: 441694 - DNA, 19 bp, Homo sapiens
tctgtgggcttggccttgt

SEQ ID NO: 441695 - DNA, 14 bp, Homo sapiens
tctgtggggccaca

SEQ ID NO: 441696 - DNA, 21 bp, Homo sapiens
tctgtggtccagaagaaatta

SEQ ID NO: 441697 - DNA, 16 bp, Homo sapiens
tctgtgtaatctctga

SEQ ID NO: 441698 - DNA, 18 bp, Homo sapiens
tctgtgtaatctctgatt

SEQ ID NO: 441699 - DNA, 12 bp, Homo sapiens
tctgtgtctctt

SEQ ID NO: 441700 - DNA, 14 bp, Homo sapiens
tctgtgtctgctgt

SEQ ID NO: 441701 - DNA, 15 bp, Homo sapiens
tctgtgtctgtgttt

SEQ ID NO: 441702 - DNA, 16 bp, Homo sapiens
tctgtgtggcaaacat

SEQ ID NO: 441703 - DNA, 17 bp, Homo sapiens
tctgtgtggcaaacatt

SEQ ID NO: 441704 - DNA, 19 bp, Homo sapiens
tctgtgtggcaaacattta

SEQ ID NO: 441705 - DNA, 23 bp, Homo sapiens
tctgtgttggcccaagctcttgt

SEQ ID NO: 441706 - DNA, 22 bp, Homo sapiens
tctgttaaccaaataaaacata

SEQ ID NO: 441707 - DNA, 15 bp, Homo sapiens
tctgttacccaggct

SEQ ID NO: 441708 - DNA, 13 bp, Homo sapiens
tctgttagatgct

SEQ ID NO: 441709 - DNA, 12 bp, Homo sapiens
tctgttccaagt

SEQ ID NO: 441710 - DNA, 18 bp, Homo sapiens
tctgttccaagtgtgtgt

SEQ ID NO: 441711 - DNA, 21 bp, Homo sapiens
tctgttccaagtgtgtgtgca

SEQ ID NO: 441712 - DNA, 20 bp, Homo sapiens
tctgttccccatggccactt

SEQ ID NO: 441713 - DNA, 18 bp, Homo sapiens
tctgttcccccaccctcc

SEQ ID NO: 441714 - DNA, 12 bp, Homo sapiens
tctgttccctgc

SEQ ID NO: 441715 - DNA, 14 bp, Homo sapiens
tctgttccctgctg

SEQ ID NO: 441716 - DNA, 23 bp, Homo sapiens
tctgttccctgctgggtgggaat

SEQ ID NO: 441717 - DNA, 12 bp, Homo sapiens
tctgttctcaca

SEQ ID NO: 441718 - DNA, 19 bp, Homo sapiens
tctgttctgccccctcagg

SEQ ID NO: 441719 - DNA, 12 bp, Homo sapiens
tctgttctgctc

SEQ ID NO: 441720 - DNA, 15 bp, Homo sapiens
tctgttctgctccca

SEQ ID NO: 441721 - DNA, 16 bp, Homo sapiens
tctgttctgctcccag

SEQ ID NO: 441722 - DNA, 18 bp, Homo sapiens
tctgttctgctcccagat

SEQ ID NO: 441723 - DNA, 16 bp, Homo sapiens
tctgttctggtggccc

SEQ ID NO: 441724 - DNA, 18 bp, Homo sapiens
tctgttctggtggcccca

SEQ ID NO: 441725 - DNA, 13 bp, Homo sapiens
tctgttgcccagg

SEQ ID NO: 441726 - DNA, 15 bp, Homo sapiens
tctgttgcctcctct

SEQ ID NO: 441727 - DNA, 23 bp, Homo sapiens
tctgttgcctcctctctccctgc

SEQ ID NO: 441728 - DNA, 23 bp, Homo sapiens
tctgttggtgggcgtgcccctga

SEQ ID NO: 441729 - DNA, 15 bp, Homo sapiens
tctgttgtcctcccc

SEQ ID NO: 441730 - DNA, 18 bp, Homo sapiens
tctgtttaccctccctgt

SEQ ID NO: 441731 - DNA, 21 bp, Homo sapiens
tctgtttgttaaaactggcat

SEQ ID NO: 441732 - DNA, 24 bp, Homo sapiens
tctgttttagttggaatgactgaa

SEQ ID NO: 441733 - DNA, 11 bp, Homo sapiens
tctgttttctg

SEQ ID NO: 441734 - DNA, 15 bp, Homo sapiens
tctgtttttctcaaa

SEQ ID NO: 441735 - DNA, 23 bp, Homo sapiens
tctgttttttttttttgtatttc

SEQ ID NO: 441736 - DNA, 20 bp, Homo sapiens
tcttaaaaattatctttaaa

SEQ ID NO: 441737 - DNA, 23 bp, Homo sapiens
tcttaaagaaacagctttcaagt

SEQ ID NO: 441738 - DNA, 20 bp, Homo sapiens
tcttaaagctgcctgtagtt

SEQ ID NO: 441739 - DNA, 17 bp, Homo sapiens
tcttaaaggcctggaac

SEQ ID NO: 441740 - DNA, 14 bp, Homo sapiens
tcttaaataaaact

SEQ ID NO: 441741 - DNA, 16 bp, Homo sapiens
tcttaaataaaactat

SEQ ID NO: 441742 - DNA, 21 bp, Homo sapiens
tcttaacaacagcttcttgct

SEQ ID NO: 441743 - DNA, 12 bp, Homo sapiens
tcttaagacact

SEQ ID NO: 441744 - DNA, 15 bp, Homo sapiens
tcttaagacactagt

SEQ ID NO: 441745 - DNA, 22 bp, Homo sapiens
tcttaagattccattttggaaa

SEQ ID NO: 441746 - DNA, 14 bp, Homo sapiens
tcttaagcactttg

SEQ ID NO: 441747 - DNA, 21 bp, Homo sapiens
tcttaaggcaataaaactagg

SEQ ID NO: 441748 - DNA, 14 bp, Homo sapiens
tcttaattctgatg

SEQ ID NO: 441749 - DNA, 13 bp, Homo sapiens
tcttaattttcta

SEQ ID NO: 441750 - DNA, 14 bp, Homo sapiens
tcttaattttctaa

SEQ ID NO: 441751 - DNA, 16 bp, Homo sapiens
tcttaattttctaaaa

SEQ ID NO: 441752 - DNA, 19 bp, Homo sapiens
tcttacaaaaacaagacac

SEQ ID NO: 441753 - DNA, 15 bp, Homo sapiens
tcttaccagatgcta

SEQ ID NO: 441754 - DNA, 16 bp, Homo sapiens
tcttacccttctgtgc

SEQ ID NO: 441755 - DNA, 20 bp, Homo sapiens
tcttacccttctgtgcccag

SEQ ID NO: 441756 - DNA, 21 bp, Homo sapiens
tcttacccttctgtgcccagc

SEQ ID NO: 441757 - DNA, 14 bp, Homo sapiens
tcttaccctttctt

SEQ ID NO: 441758 - DNA, 20 bp, Homo sapiens
tcttacctgtaatagcctca

SEQ ID NO: 441759 - DNA, 14 bp, Homo sapiens
tcttacctttatga

SEQ ID NO: 441760 - DNA, 15 bp, Homo sapiens
tcttacgctatttct

SEQ ID NO: 441761 - DNA, 14 bp, Homo sapiens
tcttactaaacatt

SEQ ID NO: 441762 - DNA, 15 bp, Homo sapiens
tcttactactttaaa

SEQ ID NO: 441763 - DNA, 21 bp, Homo sapiens
tcttactattaagcagtaaaa

SEQ ID NO: 441764 - DNA, 17 bp, Homo sapiens
tcttacttgagccttta

SEQ ID NO: 441765 - DNA, 12 bp, Homo sapiens
tcttactttgtg

SEQ ID NO: 441766 - DNA, 23 bp, Homo sapiens
tcttactttgtgcaaaagcaggc

SEQ ID NO: 441767 - DNA, 13 bp, Homo sapiens
tcttagaaatact

SEQ ID NO: 441768 - DNA, 14 bp, Homo sapiens
tcttagagaataag

SEQ ID NO: 441769 - DNA, 15 bp, Homo sapiens
tcttagagagagaga

SEQ ID NO: 441770 - DNA, 16 bp, Homo sapiens
tcttagcagcttccag

SEQ ID NO: 441771 - DNA, 12 bp, Homo sapiens
tcttagctttac

SEQ ID NO: 441772 - DNA, 16 bp, Homo sapiens
tcttagcttttctgca

SEQ ID NO: 441773 - DNA, 15 bp, Homo sapiens
tcttaggtcagatgg

SEQ ID NO: 441774 - DNA, 22 bp, Homo sapiens
tcttagtcctccctgctcagct

SEQ ID NO: 441775 - DNA, 15 bp, Homo sapiens
tcttagtgcccgcct

SEQ ID NO: 441776 - DNA, 18 bp, Homo sapiens
tcttagtgcctgagagta

SEQ ID NO: 441777 - DNA, 15 bp, Homo sapiens
tcttagttctcactg

SEQ ID NO: 441778 - DNA, 18 bp, Homo sapiens
tcttagtttcagaagtac

SEQ ID NO: 441779 - DNA, 17 bp, Homo sapiens
tcttagtttttaaaaag

SEQ ID NO: 441780 - DNA, 20 bp, Homo sapiens
tcttatagaatatttattac

SEQ ID NO: 441781 - DNA, 22 bp, Homo sapiens
tcttatccaacatcaacatctt

SEQ ID NO: 441782 - DNA, 23 bp, Homo sapiens
tcttatctagcaagaagattcta

SEQ ID NO: 441783 - DNA, 13 bp, Homo sapiens
tcttatgaaatgg

SEQ ID NO: 441784 - DNA, 19 bp, Homo sapiens
tcttatttatatatgaagt

SEQ ID NO: 441785 - DNA, 17 bp, Homo sapiens
tcttcaaactttcactt

SEQ ID NO: 441786 - DNA, 15 bp, Homo sapiens
tcttcaaccctgccc

SEQ ID NO: 441787 - DNA, 16 bp, Homo sapiens
tcttcaactgaccagc

SEQ ID NO: 441788 - DNA, 14 bp, Homo sapiens
tcttcaaggccaag

SEQ ID NO: 441789 - DNA, 22 bp, Homo sapiens
tctttgtaagtaaactgccctg

SEQ ID NO: 441790 - DNA, 17 bp, Homo sapiens
tctttgtaatgcttgta

SEQ ID NO: 441791 - DNA, 14 bp, Homo sapiens
tctttgtacagaca

SEQ ID NO: 441792 - DNA, 15 bp, Homo sapiens
tctttgtatcttaaa

SEQ ID NO: 441793 - DNA, 16 bp, Homo sapiens
tctttgtatcttaaat

SEQ ID NO: 441794 - DNA, 22 bp, Homo sapiens
tctttgtcaatgctctaacaaa

SEQ ID NO: 441795 - DNA, 16 bp, Homo sapiens
tctttgttactgtcca

SEQ ID NO: 441796 - DNA, 21 bp, Homo sapiens
tctttgttatcaaacttcagc

SEQ ID NO: 441797 - DNA, 14 bp, Homo sapiens
tctttgttcctgct

SEQ ID NO: 441798 - DNA, 17 bp, Homo sapiens
tctttgttcctgctttc

SEQ ID NO: 441799 - DNA, 18 bp, Homo sapiens
tctttgttcctgctttct

SEQ ID NO: 441800 - DNA, 17 bp, Homo sapiens
tctttgtttacatgagt

SEQ ID NO: 441801 - DNA, 15 bp, Homo sapiens
tcttttacatacagt

SEQ ID NO: 441802 - DNA, 18 bp, Homo sapiens
tcttttacatacagtgat

SEQ ID NO: 441803 - DNA, 20 bp, Homo sapiens
tcttttacatacagtgatat

SEQ ID NO: 441804 - DNA, 15 bp, Homo sapiens
tcttttactaagaca

SEQ ID NO: 441805 - DNA, 19 bp, Homo sapiens
tcttttactaagacatagt

SEQ ID NO: 441806 - DNA, 12 bp, Homo sapiens
tcttttactgtg

SEQ ID NO: 441807 - DNA, 14 bp, Homo sapiens
tcttttactgtgga

SEQ ID NO: 441808 - DNA, 17 bp, Homo sapiens
tcttttaggggaagtga

SEQ ID NO: 441809 - DNA, 14 bp, Homo sapiens
tcttttatatataa

SEQ ID NO: 441810 - DNA, 17 bp, Homo sapiens
tcttttatatataaaat

SEQ ID NO: 441811 - DNA, 20 bp, Homo sapiens
tcttttatatataaaataaa

SEQ ID NO: 441812 - DNA, 18 bp, Homo sapiens
tcttttatatctgtaaat

SEQ ID NO: 441813 - DNA, 23 bp, Homo sapiens
tcttttatatctgtaaatttaac

SEQ ID NO: 441814 - DNA, 21 bp, Homo sapiens
tcttttatcattgcaggccag

SEQ ID NO: 441815 - DNA, 13 bp, Homo sapiens
tcttttatttcat

SEQ ID NO: 441816 - DNA, 18 bp, Homo sapiens
tcttttcccctcattgca

SEQ ID NO: 441817 - DNA, 17 bp, Homo sapiens
tcttttcctagttttat

SEQ ID NO: 441818 - DNA, 22 bp, Homo sapiens
tcttttcgccgtggctgcggca

SEQ ID NO: 441819 - DNA, 12 bp, Homo sapiens
tcttttcttgga

SEQ ID NO: 441820 - DNA, 17 bp, Homo sapiens
tcttttgaataatgtag

SEQ ID NO: 441821 - DNA, 16 bp, Homo sapiens
tcttttgaatcaatct

SEQ ID NO: 441822 - DNA, 13 bp, Homo sapiens
tcttttgacatgt

SEQ ID NO: 441823 - DNA, 14 bp, Homo sapiens
tcttttgacatgtg

SEQ ID NO: 441824 - DNA, 22 bp, Homo sapiens
tcttttgaccccttcctgtctg

SEQ ID NO: 441825 - DNA, 16 bp, Homo sapiens
tcttttgatacattta

SEQ ID NO: 441826 - DNA, 14 bp, Homo sapiens
tcttttgattttgt

SEQ ID NO: 441827 - DNA, 14 bp, Homo sapiens
tcttttggccttgt

SEQ ID NO: 441828 - DNA, 18 bp, Homo sapiens
tctttttaaaaagttgca

SEQ ID NO: 441829 - DNA, 19 bp, Homo sapiens
tctttttgggagagacttg

SEQ ID NO: 441830 - DNA, 15 bp, Homo sapiens
tcttttttaaatgaa

SEQ ID NO: 441831 - DNA, 16 bp, Homo sapiens
tcttttttaaatgaat

SEQ ID NO: 441832 - DNA, 13 bp, Homo sapiens
tcttttttatgtg

SEQ ID NO: 441833 - DNA, 13 bp, Homo sapiens
tcttttttcaaaa

SEQ ID NO: 441834 - DNA, 20 bp, Homo sapiens
tctttttttaaaaagttgat

SEQ ID NO: 441835 - DNA, 22 bp, Homo sapiens
tcttttttttaggcaaaacctt

SEQ ID NO: 441836 - DNA, 17 bp, Homo sapiens
tcttttttttttcgtct

SEQ ID NO: 441837 - DNA, 23 bp, Homo sapiens
tctttttttttttttttaaagaa

SEQ ID NO: 441838 - DNA, 21 bp, Homo sapiens
tgaaaaaaaaattatttgcct

SEQ ID NO: 441839 - DNA, 18 bp, Homo sapiens
tgaaaaacattccaggaa

SEQ ID NO: 441840 - DNA, 22 bp, Homo sapiens
tgaaaaagacctttggagcaaa

SEQ ID NO: 441841 - DNA, 18 bp, Homo sapiens
tgaaaaagacttcaaatg

SEQ ID NO: 441842 - DNA, 21 bp, Homo sapiens
tgaaaaagcagctaccaggtg

SEQ ID NO: 441843 - DNA, 16 bp, Homo sapiens
tgaaaaatatgtgctt

SEQ ID NO: 441844 - DNA, 18 bp, Homo sapiens
tgaaaaatttaagcattg

SEQ ID NO: 441845 - DNA, 20 bp, Homo sapiens
tgaaaaatttaagcattgtt

SEQ ID NO: 441846 - DNA, 14 bp, Homo sapiens
tgaaaacataaaaa

SEQ ID NO: 441847 - DNA, 14 bp, Homo sapiens
tgaaaacatgtaat

SEQ ID NO: 441848 - DNA, 15 bp, Homo sapiens
tgaaaacattgatga

SEQ ID NO: 441849 - DNA, 20 bp, Homo sapiens
tgaaaacattgatgaatgag

SEQ ID NO: 441850 - DNA, 17 bp, Homo sapiens
tgaaaaccagtcttctc

SEQ ID NO: 441851 - DNA, 16 bp, Homo sapiens
tgaaaacgttttattg

SEQ ID NO: 441852 - DNA, 14 bp, Homo sapiens
tgaaaactgtaaat

SEQ ID NO: 441853 - DNA, 19 bp, Homo sapiens
tgaaaacttcaaagctgaa

SEQ ID NO: 441854 - DNA, 20 bp, Homo sapiens
tgaaaacttcaaagctgaat

SEQ ID NO: 441855 - DNA, 23 bp, Homo sapiens
tgaaaacttcaaagctgaatatt

SEQ ID NO: 441856 - DNA, 15 bp, Homo sapiens
tgaaaagaaatgcta

SEQ ID NO: 441857 - DNA, 23 bp, Homo sapiens
tgaaaagaggggaccagaagcca

SEQ ID NO: 441858 - DNA, 22 bp, Homo sapiens
tgaaaagataggtttgagttca

SEQ ID NO: 441859 - DNA, 18 bp, Homo sapiens
tgaaaagattccatttta

SEQ ID NO: 441860 - DNA, 18 bp, Homo sapiens
tgaaaagcaattgccctg

SEQ ID NO: 441861 - DNA, 21 bp, Homo sapiens
tgaaaaggactcttgagccct

SEQ ID NO: 441862 - DNA, 22 bp, Homo sapiens
tgaaaaggactcttgagccctc

SEQ ID NO: 441863 - DNA, 17 bp, Homo sapiens
tgaaaaggttgcctgaa

SEQ ID NO: 441864 - DNA, 12 bp, Homo sapiens
tgaaaagtagag

SEQ ID NO: 441865 - DNA, 16 bp, Homo sapiens
tgaaaagtagagcaat

SEQ ID NO: 441866 - DNA, 15 bp, Homo sapiens
tgaaaataaaataaa

SEQ ID NO: 441867 - DNA, 23 bp, Homo sapiens
tgaaaatacaacttaaataataa

SEQ ID NO: 441868 - DNA, 19 bp, Homo sapiens
tgaaaatattatctttgta

SEQ ID NO: 441869 - DNA, 16 bp, Homo sapiens
tgaaaatatttctatg

SEQ ID NO: 441870 - DNA, 21 bp, Homo sapiens
tgaaaatatttctatgtaaat

SEQ ID NO: 441871 - DNA, 19 bp, Homo sapiens
tgaaaatatttttttctag

SEQ ID NO: 441872 - DNA, 14 bp, Homo sapiens
tgaaaatcactata

SEQ ID NO: 441873 - DNA, 15 bp, Homo sapiens
tgaaaatcctaccaa

SEQ ID NO: 441874 - DNA, 15 bp, Homo sapiens
tgaaaatctaatatt

SEQ ID NO: 441875 - DNA, 19 bp, Homo sapiens
tgaaaatgccacattttgc

SEQ ID NO: 441876 - DNA, 22 bp, Homo sapiens
tgaaaatgtaagtaaatgtctg

SEQ ID NO: 441877 - DNA, 13 bp, Homo sapiens
tgaaaatgtactg

SEQ ID NO: 441878 - DNA, 13 bp, Homo sapiens
tgaaaatgttttt

SEQ ID NO: 441879 - DNA, 15 bp, Homo sapiens
tgaaaattattttaa

SEQ ID NO: 441880 - DNA, 16 bp, Homo sapiens
tgaaaattattttaaa

SEQ ID NO: 441881 - DNA, 18 bp, Homo sapiens
tgaaaattattttaaaca

SEQ ID NO: 441882 - DNA, 17 bp, Homo sapiens
tgaaaattcaaaaagtg

SEQ ID NO: 441883 - DNA, 19 bp, Homo sapiens
tgaaaattcaaaaagtgtt

SEQ ID NO: 441884 - DNA, 18 bp, Homo sapiens
tgaaaattccagaaagga

SEQ ID NO: 441885 - DNA, 13 bp, Homo sapiens
tgaaaatttgaga

SEQ ID NO: 441886 - DNA, 18 bp, Homo sapiens
tgaaaattttattgaata

SEQ ID NO: 441887 - DNA, 19 bp, Homo sapiens
tgaaacaaataatcacatt

SEQ ID NO: 441888 - DNA, 11 bp, Homo sapiens
tgaaacacaca

SEQ ID NO: 441889 - DNA, 13 bp, Homo sapiens
tgaaacacacaca

SEQ ID NO: 441890 - DNA, 15 bp, Homo sapiens
tgaaacacacacaca

SEQ ID NO: 441891 - DNA, 17 bp, Homo sapiens
tgaaacacaccaggctg

SEQ ID NO: 441892 - DNA, 20 bp, Homo sapiens
tgaaacacagtcatgtgtca

SEQ ID NO: 441893 - DNA, 22 bp, Homo sapiens
tgaaacactcgtgtgcatgaga

SEQ ID NO: 441894 - DNA, 13 bp, Homo sapiens
tgaaacagcctgg

SEQ ID NO: 441895 - DNA, 17 bp, Homo sapiens
tgaaacagcctgggtga

SEQ ID NO: 441896 - DNA, 20 bp, Homo sapiens
tgaaacaggagagaaagggg

SEQ ID NO: 441897 - DNA, 23 bp, Homo sapiens
tgaaacatttgacacataaaagt

SEQ ID NO: 441898 - DNA, 15 bp, Homo sapiens
tgaaaccatgactgt

SEQ ID NO: 441899 - DNA, 16 bp, Homo sapiens
tgaaacccagtaattc

SEQ ID NO: 441900 - DNA, 19 bp, Homo sapiens
tgaaaccttcctcttgagg

SEQ ID NO: 441901 - DNA, 17 bp, Homo sapiens
tgaaactatagaataaa

SEQ ID NO: 441902 - DNA, 19 bp, Homo sapiens
tgaaactcctgattttgta

SEQ ID NO: 441903 - DNA, 20 bp, Homo sapiens
tgaaactcctgattttgtag

SEQ ID NO: 441904 - DNA, 17 bp, Homo sapiens
tgaaactgacttgctgt

SEQ ID NO: 441905 - DNA, 14 bp, Homo sapiens
tgaaagaaacagtt

SEQ ID NO: 441906 - DNA, 16 bp, Homo sapiens
tgaaagagaaccagtt

SEQ ID NO: 441907 - DNA, 21 bp, Homo sapiens
tgaaagagagtaccatgctgg

SEQ ID NO: 441908 - DNA, 18 bp, Homo sapiens
tgaaagagcattattcct

SEQ ID NO: 441909 - DNA, 19 bp, Homo sapiens
tgaaagagttaagaatgtc

SEQ ID NO: 441910 - DNA, 21 bp, Homo sapiens
tgaaagcagcagctaggactg

SEQ ID NO: 441911 - DNA, 19 bp, Homo sapiens
tgaaagcagggaatttcta

SEQ ID NO: 441912 - DNA, 13 bp, Homo sapiens
tgaaagcctgtct

SEQ ID NO: 441913 - DNA, 16 bp, Homo sapiens
tgaaagctccatgttt

SEQ ID NO: 441914 - DNA, 22 bp, Homo sapiens
tgaaagctgattactgtcaata

SEQ ID NO: 441915 - DNA, 11 bp, Homo sapiens
tgaaaggaaaa

SEQ ID NO: 441916 - DNA, 12 bp, Homo sapiens
tgaaaggaaaaa

SEQ ID NO: 441917 - DNA, 13 bp, Homo sapiens
tgaaaggaaagta

SEQ ID NO: 441918 - DNA, 16 bp, Homo sapiens
tgaaaggcttctggga

SEQ ID NO: 441919 - DNA, 20 bp, Homo sapiens
tgacctcctggactgtagga

SEQ ID NO: 441920 - DNA, 18 bp, Homo sapiens
tgacctctgaagagctga

SEQ ID NO: 441921 - DNA, 15 bp, Homo sapiens
tgacctgaactctgc

SEQ ID NO: 441922 - DNA, 17 bp, Homo sapiens
tgacctgatttccattt

SEQ ID NO: 441923 - DNA, 21 bp, Homo sapiens
tgacctgcccccgctctgcca

SEQ ID NO: 441924 - DNA, 18 bp, Homo sapiens
tgacctgctccgccagga

SEQ ID NO: 441925 - DNA, 17 bp, Homo sapiens
tgacctggaagagctgg

SEQ ID NO: 441926 - DNA, 20 bp, Homo sapiens
tgacctggcatcttggaaat

SEQ ID NO: 441927 - DNA, 13 bp, Homo sapiens
tgacctgtccagg

SEQ ID NO: 441928 - DNA, 13 bp, Homo sapiens
tgacctgtgacca

SEQ ID NO: 441929 - DNA, 18 bp, Homo sapiens
tgacctgtgaccagcact

SEQ ID NO: 441930 - DNA, 22 bp, Homo sapiens
tgacctgtgaccagcactgtct

SEQ ID NO: 441931 - DNA, 22 bp, Homo sapiens
tgacctgtggggatttctccca

SEQ ID NO: 441932 - DNA, 17 bp, Homo sapiens
tgaccttcacagggaca

SEQ ID NO: 441933 - DNA, 15 bp, Homo sapiens
tgaccttcctctggg

SEQ ID NO: 441934 - DNA, 17 bp, Homo sapiens
tgaccttcctctggggc

SEQ ID NO: 441935 - DNA, 24 bp, Homo sapiens
tgaccttcctctggggctctaggg

SEQ ID NO: 441936 - DNA, 21 bp, Homo sapiens
tgaccttctgaacatgagtgt

SEQ ID NO: 441937 - DNA, 13 bp, Homo sapiens
tgaccttctggga

SEQ ID NO: 441938 - DNA, 14 bp, Homo sapiens
tgaccttctgggaa

SEQ ID NO: 441939 - DNA, 19 bp, Homo sapiens
tgaccttgaactcctgggc

SEQ ID NO: 441940 - DNA, 14 bp, Homo sapiens
tgacctttatttat

SEQ ID NO: 441941 - DNA, 16 bp, Homo sapiens
tgacctttatttatta

SEQ ID NO: 441942 - DNA, 18 bp, Homo sapiens
tgaccttttggcctttgt

SEQ ID NO: 441943 - DNA, 14 bp, Homo sapiens
tgacgaggctgggc

SEQ ID NO: 441944 - DNA, 14 bp, Homo sapiens
tgacggaagaacat

SEQ ID NO: 441945 - DNA, 18 bp, Homo sapiens
tgacggaagaacatagaa

SEQ ID NO: 441946 - DNA, 15 bp, Homo sapiens
tgacggacatccagg

SEQ ID NO: 441947 - DNA, 17 bp, Homo sapiens
tgacggacatccaggcg

SEQ ID NO: 441948 - DNA, 14 bp, Homo sapiens
tgacggccctgcaa

SEQ ID NO: 441949 - DNA, 15 bp, Homo sapiens
tgacggcgcccccag

SEQ ID NO: 441950 - DNA, 18 bp, Homo sapiens
tgacggctgtgtatttct

SEQ ID NO: 441951 - DNA, 21 bp, Homo sapiens
tgacggctgtgtatttctgta

SEQ ID NO: 441952 - DNA, 23 bp, Homo sapiens
tgacggctgtgtatttctgtaga

SEQ ID NO: 441953 - DNA, 18 bp, Homo sapiens
tgacgtaagctctatctg

SEQ ID NO: 441954 - DNA, 21 bp, Homo sapiens
tgacgtgaccaattgccctgc

SEQ ID NO: 441955 - DNA, 14 bp, Homo sapiens
tgacgtgtgtggtc

SEQ ID NO: 441956 - DNA, 22 bp, Homo sapiens
tgacgtttgacaccagggccag

SEQ ID NO: 441957 - DNA, 22 bp, Homo sapiens
tgactaataaaaaactgtgaac

SEQ ID NO: 441958 - DNA, 23 bp, Homo sapiens
tgactaataaaaaactgtgaacc

SEQ ID NO: 441959 - DNA, 15 bp, Homo sapiens
tgactagagacgcac

SEQ ID NO: 441960 - DNA, 23 bp, Homo sapiens
tgactagagacgcaccttgctgc

SEQ ID NO: 441961 - DNA, 19 bp, Homo sapiens
tgactagggattcaggctg

SEQ ID NO: 441962 - DNA, 16 bp, Homo sapiens
tgactagtacaaatta

SEQ ID NO: 441963 - DNA, 15 bp, Homo sapiens
tgactagtgctgaag

SEQ ID NO: 441964 - DNA, 22 bp, Homo sapiens
tgactagtgctgaagcttatta

SEQ ID NO: 441965 - DNA, 15 bp, Homo sapiens
tgactataaacatta

SEQ ID NO: 441966 - DNA, 21 bp, Homo sapiens
tgactataaacattaaaagaa

SEQ ID NO: 441967 - DNA, 19 bp, Homo sapiens
tgactataacaaaatctgg

SEQ ID NO: 441968 - DNA, 17 bp, Homo sapiens
tgactatatagagatgt

SEQ ID NO: 441969 - DNA, 18 bp, Homo sapiens
tgactatatagagatgtt

SEQ ID NO: 441970 - DNA, 20 bp, Homo sapiens
tgactatggctctggcacca

SEQ ID NO: 441971 - DNA, 21 bp, Homo sapiens
tgactattcttgatgtaaaat

SEQ ID NO: 441972 - DNA, 16 bp, Homo sapiens
tgactcaaatctccag

SEQ ID NO: 441973 - DNA, 14 bp, Homo sapiens
tgactcaacatgtt

SEQ ID NO: 441974 - DNA, 20 bp, Homo sapiens
tgactcaagtgtctcagtcc

SEQ ID NO: 441975 - DNA, 15 bp, Homo sapiens
tgactcacattgcct

SEQ ID NO: 441976 - DNA, 13 bp, Homo sapiens
tgactcatcctct

SEQ ID NO: 441977 - DNA, 22 bp, Homo sapiens
tgactcattcttttggattgct

SEQ ID NO: 441978 - DNA, 14 bp, Homo sapiens
tgactccagagtct

SEQ ID NO: 441979 - DNA, 15 bp, Homo sapiens
tgactccagagtctg

SEQ ID NO: 441980 - DNA, 21 bp, Homo sapiens
tgactccagagtctgagcccc

SEQ ID NO: 441981 - DNA, 21 bp, Homo sapiens
tgactcctcccttccccactc

SEQ ID NO: 441982 - DNA, 22 bp, Homo sapiens
tgactcttgaataaaaataact

SEQ ID NO: 441983 - DNA, 21 bp, Homo sapiens
tgactctttctattgtttctt

SEQ ID NO: 441984 - DNA, 19 bp, Homo sapiens
tgactgaaagaagaacagc

SEQ ID NO: 441985 - DNA, 22 bp, Homo sapiens
tgactgaagcgaacatcttcat

SEQ ID NO: 441986 - DNA, 23 bp, Homo sapiens
tgactgaagcgaacatcttcata

SEQ ID NO: 441987 - DNA, 18 bp, Homo sapiens
tgactgaatttgggcctc

SEQ ID NO: 441988 - DNA, 18 bp, Homo sapiens
tgactgacggctgtgtat

SEQ ID NO: 441989 - DNA, 15 bp, Homo sapiens
tgactgagcagactg

SEQ ID NO: 441990 - DNA, 21 bp, Homo sapiens
tgactgcaacttctgtccctt

SEQ ID NO: 441991 - DNA, 19 bp, Homo sapiens
tgactgccccttgcttctc

SEQ ID NO: 441992 - DNA, 21 bp, Homo sapiens
tgactgcttcacggactcttt

SEQ ID NO: 441993 - DNA, 21 bp, Homo sapiens
tgactggcaggtgcagatggg

SEQ ID NO: 441994 - DNA, 24 bp, Homo sapiens
tgactggcaggtgcagatgggctg

SEQ ID NO: 441995 - DNA, 19 bp, Homo sapiens
tgactggctgtctgcctgt

SEQ ID NO: 441996 - DNA, 22 bp, Homo sapiens
tgactggctgtctgcctgtatt

SEQ ID NO: 441997 - DNA, 11 bp, Homo sapiens
tgactggggct

SEQ ID NO: 441998 - DNA, 14 bp, Homo sapiens
tgactggggctggg

SEQ ID NO: 441999 - DNA, 15 bp, Homo sapiens
tgactgggggcctct

SEQ ID NO: 442000 - DNA, 21 bp, Homo sapiens
tgactggtatacctatttcat

SEQ ID NO: 442001 - DNA, 16 bp, Homo sapiens
tgactgtactcctccc

SEQ ID NO: 442002 - DNA, 20 bp, Homo sapiens
tgactgtaggcgcccctggg

SEQ ID NO: 442003 - DNA, 18 bp, Homo sapiens
tgactgtgaccaccttct

SEQ ID NO: 442004 - DNA, 23 bp, Homo sapiens
tgactgtgaccaccttctgtccc

SEQ ID NO: 442005 - DNA, 13 bp, Homo sapiens
tgactgtgattta

SEQ ID NO: 442006 - DNA, 15 bp, Homo sapiens
tgacttaagaagcct

SEQ ID NO: 442007 - DNA, 15 bp, Homo sapiens
tgacttattgattaa

SEQ ID NO: 442008 - DNA, 19 bp, Homo sapiens
tgacttatttagtattctg

SEQ ID NO: 442009 - DNA, 19 bp, Homo sapiens
tgacttattttctctgtgt

SEQ ID NO: 442010 - DNA, 16 bp, Homo sapiens
tgacttcaagatgcct

SEQ ID NO: 442011 - DNA, 13 bp, Homo sapiens
tgacttcagcagg

SEQ ID NO: 442012 - DNA, 12 bp, Homo sapiens
tgacttcatttc

SEQ ID NO: 442013 - DNA, 16 bp, Homo sapiens
tgacttctatcctgtt

SEQ ID NO: 442014 - DNA, 11 bp, Homo sapiens
tgacttcttgt

SEQ ID NO: 442015 - DNA, 12 bp, Homo sapiens
tgacttgaatgt

SEQ ID NO: 442016 - DNA, 15 bp, Homo sapiens
tgacttgaatgtaca

SEQ ID NO: 442017 - DNA, 19 bp, Homo sapiens
tgacttgaatgtacaaaga

SEQ ID NO: 442018 - DNA, 15 bp, Homo sapiens
tgacttgtgtcccat

SEQ ID NO: 442019 - DNA, 13 bp, Homo sapiens
tgacttttccatg

SEQ ID NO: 442020 - DNA, 17 bp, Homo sapiens
tgactttttaaaatata

SEQ ID NO: 442021 - DNA, 18 bp, Homo sapiens
tgactttttagccagtga

SEQ ID NO: 442022 - DNA, 16 bp, Homo sapiens
tgactttttcagagtt

SEQ ID NO: 442023 - DNA, 21 bp, Homo sapiens
tgagaaaacgaaactgctcta

SEQ ID NO: 442024 - DNA, 21 bp, Homo sapiens
tgagaaactttgatctctgct

SEQ ID NO: 442025 - DNA, 22 bp, Homo sapiens
tgagaaactttgatctctgctt

SEQ ID NO: 442026 - DNA, 10 bp, Homo sapiens
tgagaaagaa

SEQ ID NO: 442027 - DNA, 16 bp, Homo sapiens
tgagaaagaaaaggaa

SEQ ID NO: 442028 - DNA, 17 bp, Homo sapiens
tgagaaagcccacctgg

SEQ ID NO: 442029 - DNA, 20 bp, Homo sapiens
tgagaaagcccacctgggct

SEQ ID NO: 442030 - DNA, 22 bp, Homo sapiens
tgagaaagcccacctgggctgg

SEQ ID NO: 442031 - DNA, 23 bp, Homo sapiens
tgagaaagcccacctgggctggg

SEQ ID NO: 442032 - DNA, 20 bp, Homo sapiens
tgagaaatacagtgctttat

SEQ ID NO: 442033 - DNA, 22 bp, Homo sapiens
tgagaaatgaataatttcccaa

SEQ ID NO: 442034 - DNA, 19 bp, Homo sapiens
tgagaaatttttttccaga

SEQ ID NO: 442035 - DNA, 20 bp, Homo sapiens
tgagaaatttttttccagaa

SEQ ID NO: 442036 - DNA, 19 bp, Homo sapiens
tgagaacaaccaaaatctt

SEQ ID NO: 442037 - DNA, 18 bp, Homo sapiens
tgagaacaagtcacagct

SEQ ID NO: 442038 - DNA, 20 bp, Homo sapiens
tgagaacaagtcacagctgc

SEQ ID NO: 442039 - DNA, 21 bp, Homo sapiens
tgagaacagatctccaaagct

SEQ ID NO: 442040 - DNA, 13 bp, Homo sapiens
tgagaactaaata

SEQ ID NO: 442041 - DNA, 14 bp, Homo sapiens
tgagaactgacttt

SEQ ID NO: 442042 - DNA, 17 bp, Homo sapiens
tgagaactggttcttgc

SEQ ID NO: 442043 - DNA, 18 bp, Homo sapiens
tgagaactggttcttgcc

SEQ ID NO: 442044 - DNA, 19 bp, Homo sapiens
tgagaactggttcttgcct

SEQ ID NO: 442045 - DNA, 22 bp, Homo sapiens
tgagaactggttcttgccttcc

SEQ ID NO: 442046 - DNA, 17 bp, Homo sapiens
tgagaagactagcagct

SEQ ID NO: 442047 - DNA, 23 bp, Homo sapiens
tgagaagagggcctgtgggagcc

SEQ ID NO: 442048 - DNA, 18 bp, Homo sapiens
tgaggtcttttacataca

SEQ ID NO: 442049 - DNA, 17 bp, Homo sapiens
tgaggtcttttgacatg

SEQ ID NO: 442050 - DNA, 21 bp, Homo sapiens
tgaggtcttttgacatgtgga

SEQ ID NO: 442051 - DNA, 22 bp, Homo sapiens
tgaggtcttttgacatgtggaa

SEQ ID NO: 442052 - DNA, 17 bp, Homo sapiens
tgaggtgaaatgggaga

SEQ ID NO: 442053 - DNA, 15 bp, Homo sapiens
tgaggtgctgggagg

SEQ ID NO: 442054 - DNA, 16 bp, Homo sapiens
tgaggtgctgggaggg

SEQ ID NO: 442055 - DNA, 20 bp, Homo sapiens
tgaggtggtctgaatgttct

SEQ ID NO: 442056 - DNA, 14 bp, Homo sapiens
tgaggttcagcaag

SEQ ID NO: 442057 - DNA, 16 bp, Homo sapiens
tgaggtttcacctccg

SEQ ID NO: 442058 - DNA, 17 bp, Homo sapiens
tgagtaaataaactctt

SEQ ID NO: 442059 - DNA, 18 bp, Homo sapiens
tgagtaaataaactcttc

SEQ ID NO: 442060 - DNA, 15 bp, Homo sapiens
tgagtaactattatt

SEQ ID NO: 442061 - DNA, 16 bp, Homo sapiens
tgagtaagagctggtg

SEQ ID NO: 442062 - DNA, 23 bp, Homo sapiens
tgagtaagagctggtgtctgatt

SEQ ID NO: 442063 - DNA, 23 bp, Homo sapiens
tgagtaatgcagacatttacatg

SEQ ID NO: 442064 - DNA, 18 bp, Homo sapiens
tgagtacagtgaggaggg

SEQ ID NO: 442065 - DNA, 15 bp, Homo sapiens
tgagtagcatatata

SEQ ID NO: 442066 - DNA, 17 bp, Homo sapiens
tgagtatgtggaaggca

SEQ ID NO: 442067 - DNA, 12 bp, Homo sapiens
tgagtatgtgtg

SEQ ID NO: 442068 - DNA, 15 bp, Homo sapiens
tgagtatttgctgtt

SEQ ID NO: 442069 - DNA, 13 bp, Homo sapiens
tgagtcaatgtgc

SEQ ID NO: 442070 - DNA, 18 bp, Homo sapiens
tgagtcaatgtgcagtgt

SEQ ID NO: 442071 - DNA, 15 bp, Homo sapiens
tgagtcagggcccag

SEQ ID NO: 442072 - DNA, 16 bp, Homo sapiens
tgagtcagggcccaga

SEQ ID NO: 442073 - DNA, 20 bp, Homo sapiens
tgagtcaggtttgagtagag

SEQ ID NO: 442074 - DNA, 13 bp, Homo sapiens
tgagtccagctcc

SEQ ID NO: 442075 - DNA, 14 bp, Homo sapiens
tgagtccagctccc

SEQ ID NO: 442076 - DNA, 15 bp, Homo sapiens
tgagtccagctcccc

SEQ ID NO: 442077 - DNA, 15 bp, Homo sapiens
tgagtcccagtggga

SEQ ID NO: 442078 - DNA, 16 bp, Homo sapiens
tgagtcccagtgggag

SEQ ID NO: 442079 - DNA, 16 bp, Homo sapiens
tgagtccccacctgcg

SEQ ID NO: 442080 - DNA, 16 bp, Homo sapiens
tgagtcccttccaggc

SEQ ID NO: 442081 - DNA, 21 bp, Homo sapiens
tgagtcccttccaggccatca

SEQ ID NO: 442082 - DNA, 11 bp, Homo sapiens
tgagtcctggc

SEQ ID NO: 442083 - DNA, 14 bp, Homo sapiens
tgagtccttaaaca

SEQ ID NO: 442084 - DNA, 18 bp, Homo sapiens
tgagtcgtcatcactttt

SEQ ID NO: 442085 - DNA, 15 bp, Homo sapiens
tgagtctggcaaaca

SEQ ID NO: 442086 - DNA, 21 bp, Homo sapiens
tgagtctgtgaataaagccac

SEQ ID NO: 442087 - DNA, 13 bp, Homo sapiens
tgagtctgtggac

SEQ ID NO: 442088 - DNA, 19 bp, Homo sapiens
tgagtctgtggacactgtg

SEQ ID NO: 442089 - DNA, 16 bp, Homo sapiens
tgagtcttcacattta

SEQ ID NO: 442090 - DNA, 18 bp, Homo sapiens
tgagtgacatgcggctgc

SEQ ID NO: 442091 - DNA, 15 bp, Homo sapiens
tgagtgatcctccaa

SEQ ID NO: 442092 - DNA, 21 bp, Homo sapiens
tgagtgcagaccccttggcca

SEQ ID NO: 442093 - DNA, 12 bp, Homo sapiens
tgagtgcctgca

SEQ ID NO: 442094 - DNA, 15 bp, Homo sapiens
tgagtgcctgcagca

SEQ ID NO: 442095 - DNA, 20 bp, Homo sapiens
tgagtgccttacacaatggt

SEQ ID NO: 442096 - DNA, 13 bp, Homo sapiens
tgagtggcagcca

SEQ ID NO: 442097 - DNA, 15 bp, Homo sapiens
tgagtggcagccatg

SEQ ID NO: 442098 - DNA, 22 bp, Homo sapiens
tgagtggcatgtgggttgtgat

SEQ ID NO: 442099 - DNA, 17 bp, Homo sapiens
tgagtggctgacagagc

SEQ ID NO: 442100 - DNA, 17 bp, Homo sapiens
tgagtgggaggcgtgcc

SEQ ID NO: 442101 - DNA, 20 bp, Homo sapiens
tgagtggtccacattctgct

SEQ ID NO: 442102 - DNA, 22 bp, Homo sapiens
tgagtggtccacattctgctgc

SEQ ID NO: 442103 - DNA, 22 bp, Homo sapiens
tgagtgtacatttatgtgtgaa

SEQ ID NO: 442104 - DNA, 10 bp, Homo sapiens
tgagtgtcaa

SEQ ID NO: 442105 - DNA, 21 bp, Homo sapiens
tgagtgtgacgggggttgggg

SEQ ID NO: 442106 - DNA, 21 bp, Homo sapiens
tgagtgtgatgggccaccggg

SEQ ID NO: 442107 - DNA, 18 bp, Homo sapiens
tgagtgtggctcccctct

SEQ ID NO: 442108 - DNA, 23 bp, Homo sapiens
tgagtgttcaaactactgtacat

SEQ ID NO: 442109 - DNA, 18 bp, Homo sapiens
tgagttacttgtctgagg

SEQ ID NO: 442110 - DNA, 20 bp, Homo sapiens
tgagttacttgtctgaggcc

SEQ ID NO: 442111 - DNA, 15 bp, Homo sapiens
tgagttctacataag

SEQ ID NO: 442112 - DNA, 12 bp, Homo sapiens
tgagttctcact

SEQ ID NO: 442113 - DNA, 20 bp, Homo sapiens
tgagttctcactatgtttct

SEQ ID NO: 442114 - DNA, 16 bp, Homo sapiens
tgagttgatttataaa

SEQ ID NO: 442115 - DNA, 13 bp, Homo sapiens
tgagttggacaca

SEQ ID NO: 442116 - DNA, 20 bp, Homo sapiens
tgagtttaaaaaaataacat

SEQ ID NO: 442117 - DNA, 14 bp, Homo sapiens
tgagtttaaagcaa

SEQ ID NO: 442118 - DNA, 20 bp, Homo sapiens
tgagtttaccatttgtaata

SEQ ID NO: 442119 - DNA, 22 bp, Homo sapiens
tgagtttatgggaatgcctttt

SEQ ID NO: 442120 - DNA, 23 bp, Homo sapiens
tgagtttctggctgaaaatggtg

SEQ ID NO: 442121 - DNA, 15 bp, Homo sapiens
tgagttttacattac

SEQ ID NO: 442122 - DNA, 17 bp, Homo sapiens
tgataaaagatacattt

SEQ ID NO: 442123 - DNA, 13 bp, Homo sapiens
tgataaaaggaag

SEQ ID NO: 442124 - DNA, 14 bp, Homo sapiens
tgataaaaggaagt

SEQ ID NO: 442125 - DNA, 19 bp, Homo sapiens
tgataaaataagtaacata

SEQ ID NO: 442126 - DNA, 15 bp, Homo sapiens
tgataaacacagagg

SEQ ID NO: 442127 - DNA, 17 bp, Homo sapiens
tgataaagaaaagaatc

SEQ ID NO: 442128 - DNA, 17 bp, Homo sapiens
tgataaatttgactgtt

SEQ ID NO: 442129 - DNA, 16 bp, Homo sapiens
tgataacactggagtg

SEQ ID NO: 442130 - DNA, 18 bp, Homo sapiens
tgataactagatggtgct

SEQ ID NO: 442131 - DNA, 23 bp, Homo sapiens
tgataactagatggtgctgagaa

SEQ ID NO: 442132 - DNA, 17 bp, Homo sapiens
tgataacttggggaggc

SEQ ID NO: 442133 - DNA, 16 bp, Homo sapiens
tgataagtaaatgcta

SEQ ID NO: 442134 - DNA, 12 bp, Homo sapiens
tgataagtggaa

SEQ ID NO: 442135 - DNA, 13 bp, Homo sapiens
tgataagtggaaa

SEQ ID NO: 442136 - DNA, 15 bp, Homo sapiens
tgataagtggaaaaa

SEQ ID NO: 442137 - DNA, 13 bp, Homo sapiens
tgataataaattg

SEQ ID NO: 442138 - DNA, 13 bp, Homo sapiens
tgataatacccac

SEQ ID NO: 442139 - DNA, 14 bp, Homo sapiens
tgatacactgtatc

SEQ ID NO: 442140 - DNA, 15 bp, Homo sapiens
tgatacactgtatct

SEQ ID NO: 442141 - DNA, 16 bp, Homo sapiens
tgatacactgtatcta

SEQ ID NO: 442142 - DNA, 18 bp, Homo sapiens
tgatacactgtatctaaa

SEQ ID NO: 442143 - DNA, 19 bp, Homo sapiens
tgatacactgtatctaaaa

SEQ ID NO: 442144 - DNA, 13 bp, Homo sapiens
tgatacagtctcc

SEQ ID NO: 442145 - DNA, 18 bp, Homo sapiens
tgatacccatagcttcca

SEQ ID NO: 442146 - DNA, 21 bp, Homo sapiens
tgatacccatagcttccatga

SEQ ID NO: 442147 - DNA, 20 bp, Homo sapiens
tgatactgggtacaagagcc

SEQ ID NO: 442148 - DNA, 14 bp, Homo sapiens
tgatactgtctaag

SEQ ID NO: 442149 - DNA, 20 bp, Homo sapiens
tgatactgtctaagaataat

SEQ ID NO: 442150 - DNA, 14 bp, Homo sapiens
tgatagagcctttg

SEQ ID NO: 442151 - DNA, 16 bp, Homo sapiens
tgatagagcctttgat

SEQ ID NO: 442152 - DNA, 23 bp, Homo sapiens
tgatagcactggtttgtttctca

SEQ ID NO: 442153 - DNA, 16 bp, Homo sapiens
tgatagcgttggaatt

SEQ ID NO: 442154 - DNA, 16 bp, Homo sapiens
tgatagctaacatttt

SEQ ID NO: 442155 - DNA, 18 bp, Homo sapiens
tgatagctaacattttaa

SEQ ID NO: 442156 - DNA, 15 bp, Homo sapiens
tgatagctggggctt

SEQ ID NO: 442157 - DNA, 23 bp, Homo sapiens
tgatagctttattttttaagtat

SEQ ID NO: 442158 - DNA, 16 bp, Homo sapiens
tgataggagacttgta

SEQ ID NO: 442159 - DNA, 15 bp, Homo sapiens
tgatagtagtaaaat

SEQ ID NO: 442160 - DNA, 15 bp, Homo sapiens
tgatagtcacctgct

SEQ ID NO: 442161 - DNA, 12 bp, Homo sapiens
tgatagtgcttc

SEQ ID NO: 442162 - DNA, 14 bp, Homo sapiens
tgatagtgcttctt

SEQ ID NO: 442163 - DNA, 17 bp, Homo sapiens
tgatagtgcttcttgta

SEQ ID NO: 442164 - DNA, 19 bp, Homo sapiens
tgatagtgttttgtacttg

SEQ ID NO: 442165 - DNA, 21 bp, Homo sapiens
tgatatacttgagtgtgcaag

SEQ ID NO: 442166 - DNA, 14 bp, Homo sapiens
tgatatataaacct

SEQ ID NO: 442167 - DNA, 20 bp, Homo sapiens
tgatatataaaccttaaatg

SEQ ID NO: 442168 - DNA, 13 bp, Homo sapiens
tgatatatatgta

SEQ ID NO: 442169 - DNA, 16 bp, Homo sapiens
tgatatcccccagcct

SEQ ID NO: 442170 - DNA, 10 bp, Homo sapiens
tgatatgcat

SEQ ID NO: 442171 - DNA, 20 bp, Homo sapiens
tgatatggagccctgtaatt

SEQ ID NO: 442172 - DNA, 15 bp, Homo sapiens
tgatatgggctttct

SEQ ID NO: 442173 - DNA, 13 bp, Homo sapiens
tgatatgtgtaat

SEQ ID NO: 442174 - DNA, 14 bp, Homo sapiens
tgatatgtgtaata

SEQ ID NO: 442175 - DNA, 20 bp, Homo sapiens
tgatatgtgtaatatcattt

SEQ ID NO: 442176 - DNA, 23 bp, Homo sapiens
tgatatgtgtaatatcatttcat

SEQ ID NO: 442177 - DNA, 21 bp, Homo sapiens
tgatattaaagcgcaaatgaa

SEQ ID NO: 442178 - DNA, 18 bp, Homo sapiens
tgatattcaaacacacag

SEQ ID NO: 442179 - DNA, 18 bp, Homo sapiens
tgcagcagtgagtctctt

SEQ ID NO: 442180 - DNA, 14 bp, Homo sapiens
tgcagcatacaaaa

SEQ ID NO: 442181 - DNA, 19 bp, Homo sapiens
tgcagcatgacctgtgacc

SEQ ID NO: 442182 - DNA, 15 bp, Homo sapiens
tgcagcccacagagg

SEQ ID NO: 442183 - DNA, 12 bp, Homo sapiens
tgcagcccatgc

SEQ ID NO: 442184 - DNA, 19 bp, Homo sapiens
tgcagcccatgcccacctg

SEQ ID NO: 442185 - DNA, 14 bp, Homo sapiens
tgcagccccaggac

SEQ ID NO: 442186 - DNA, 18 bp, Homo sapiens
tgcagccccaggaccaag

SEQ ID NO: 442187 - DNA, 14 bp, Homo sapiens
tgcagcccttcctc

SEQ ID NO: 442188 - DNA, 18 bp, Homo sapiens
tgcagcccttcctcctga

SEQ ID NO: 442189 - DNA, 15 bp, Homo sapiens
tgcagcccttgggca

SEQ ID NO: 442190 - DNA, 17 bp, Homo sapiens
tgcagcccttgggcagt

SEQ ID NO: 442191 - DNA, 15 bp, Homo sapiens
tgcagccgccttcct

SEQ ID NO: 442192 - DNA, 16 bp, Homo sapiens
tgcagccgccttcctt

SEQ ID NO: 442193 - DNA, 14 bp, Homo sapiens
tgcagcctcctcct

SEQ ID NO: 442194 - DNA, 15 bp, Homo sapiens
tgcagcctcctcctg

SEQ ID NO: 442195 - DNA, 22 bp, Homo sapiens
tgcagcctcgaactcctgggct

SEQ ID NO: 442196 - DNA, 13 bp, Homo sapiens
tgcagcctctgcc

SEQ ID NO: 442197 - DNA, 12 bp, Homo sapiens
tgcagcctgagc

SEQ ID NO: 442198 - DNA, 16 bp, Homo sapiens
tgcagccttcccctcc

SEQ ID NO: 442199 - DNA, 20 bp, Homo sapiens
tgcagccttcccctccctgt

SEQ ID NO: 442200 - DNA, 19 bp, Homo sapiens
tgcagcggtggaaggagcc

SEQ ID NO: 442201 - DNA, 22 bp, Homo sapiens
tgcagctaagctcaaatgtata

SEQ ID NO: 442202 - DNA, 13 bp, Homo sapiens
tgcagctctgcag

SEQ ID NO: 442203 - DNA, 20 bp, Homo sapiens
tgcagctgacctctgttgtc

SEQ ID NO: 442204 - DNA, 15 bp, Homo sapiens
tgcagctgctcttgc

SEQ ID NO: 442205 - DNA, 13 bp, Homo sapiens
tgcagctgctggt

SEQ ID NO: 442206 - DNA, 18 bp, Homo sapiens
tgcagctgctggttttgg

SEQ ID NO: 442207 - DNA, 12 bp, Homo sapiens
tgcagctgggcc

SEQ ID NO: 442208 - DNA, 19 bp, Homo sapiens
tgcagctgggccccatgct

SEQ ID NO: 442209 - DNA, 15 bp, Homo sapiens
tgcagctttacatgc

SEQ ID NO: 442210 - DNA, 16 bp, Homo sapiens
tgcagctttacatgca

SEQ ID NO: 442211 - DNA, 17 bp, Homo sapiens
tgcagctttctggaaat

SEQ ID NO: 442212 - DNA, 20 bp, Homo sapiens
tgcaggaacgagcactggcc

SEQ ID NO: 442213 - DNA, 17 bp, Homo sapiens
tgcaggaataaggcctt

SEQ ID NO: 442214 - DNA, 16 bp, Homo sapiens
tgcaggacacagatct

SEQ ID NO: 442215 - DNA, 14 bp, Homo sapiens
tgcaggactcgggc

SEQ ID NO: 442216 - DNA, 23 bp, Homo sapiens
tgcaggagttaaaaagggcaggg

SEQ ID NO: 442217 - DNA, 11 bp, Homo sapiens
tgcaggccacc

SEQ ID NO: 442218 - DNA, 14 bp, Homo sapiens
tgcaggccaccagc

SEQ ID NO: 442219 - DNA, 18 bp, Homo sapiens
tgcaggccccagccaagt

SEQ ID NO: 442220 - DNA, 18 bp, Homo sapiens
tgcaggcgcgcaccgccc

SEQ ID NO: 442221 - DNA, 14 bp, Homo sapiens
tgcaggctctgggc

SEQ ID NO: 442222 - DNA, 20 bp, Homo sapiens
tgcaggctctgggctcaggg

SEQ ID NO: 442223 - DNA, 21 bp, Homo sapiens
tgcaggctggcaccgccttct

SEQ ID NO: 442224 - DNA, 22 bp, Homo sapiens
tgcaggctggcaccgccttctc

SEQ ID NO: 442225 - DNA, 18 bp, Homo sapiens
tgcagggaagagggcagt

SEQ ID NO: 442226 - DNA, 14 bp, Homo sapiens
tgcagggagaccag

SEQ ID NO: 442227 - DNA, 15 bp, Homo sapiens
tgcagggaggggagg

SEQ ID NO: 442228 - DNA, 19 bp, Homo sapiens
tgcagggcagcctgtggga

SEQ ID NO: 442229 - DNA, 21 bp, Homo sapiens
tgcagggcagcctgtgggaga

SEQ ID NO: 442230 - DNA, 20 bp, Homo sapiens
tgcaggggattgaagccctc

SEQ ID NO: 442231 - DNA, 21 bp, Homo sapiens
tgcaggggattgaagccctcc

SEQ ID NO: 442232 - DNA, 18 bp, Homo sapiens
tgcaggggtcccccctca

SEQ ID NO: 442233 - DNA, 22 bp, Homo sapiens
tgcagggtagggggcctgagtt

SEQ ID NO: 442234 - DNA, 19 bp, Homo sapiens
tgcagggtggtgctgggac

SEQ ID NO: 442235 - DNA, 14 bp, Homo sapiens
tgcaggtgctgcct

SEQ ID NO: 442236 - DNA, 18 bp, Homo sapiens
tgcagtactttacctcct

SEQ ID NO: 442237 - DNA, 18 bp, Homo sapiens
tgcagtagagagcaaaga

SEQ ID NO: 442238 - DNA, 16 bp, Homo sapiens
tgcagtagagtcatct

SEQ ID NO: 442239 - DNA, 19 bp, Homo sapiens
tgcagtagagtcatctcca

SEQ ID NO: 442240 - DNA, 22 bp, Homo sapiens
tgcagtagagtcatctccatca

SEQ ID NO: 442241 - DNA, 16 bp, Homo sapiens
tgcagtagtgtcactt

SEQ ID NO: 442242 - DNA, 18 bp, Homo sapiens
tgcagtcacccctgtctg

SEQ ID NO: 442243 - DNA, 19 bp, Homo sapiens
tgcagtcacccctgtctgc

SEQ ID NO: 442244 - DNA, 20 bp, Homo sapiens
tgcagtcacccctgtctgcg

SEQ ID NO: 442245 - DNA, 18 bp, Homo sapiens
tgcagtcaccctgtggca

SEQ ID NO: 442246 - DNA, 19 bp, Homo sapiens
tgcagtcaccctgtggcaa

SEQ ID NO: 442247 - DNA, 19 bp, Homo sapiens
tgcagtcctggtggggctg

SEQ ID NO: 442248 - DNA, 23 bp, Homo sapiens
tgcagtgatggcgcgggaggcac

SEQ ID NO: 442249 - DNA, 20 bp, Homo sapiens
tgcagtgcctttccccattc

SEQ ID NO: 442250 - DNA, 13 bp, Homo sapiens
tgcagtgctgctt

SEQ ID NO: 442251 - DNA, 20 bp, Homo sapiens
tgcagtggccccatccagca

SEQ ID NO: 442252 - DNA, 19 bp, Homo sapiens
tgcagtgggtggggctgta

SEQ ID NO: 442253 - DNA, 13 bp, Homo sapiens
tgcagtgtgcata

SEQ ID NO: 442254 - DNA, 17 bp, Homo sapiens
tgcagtgttcgcttggc

SEQ ID NO: 442255 - DNA, 19 bp, Homo sapiens
tgcagttattagaacttag

SEQ ID NO: 442256 - DNA, 21 bp, Homo sapiens
tgcagttcccccaacctcaga

SEQ ID NO: 442257 - DNA, 16 bp, Homo sapiens
tgcagttgaagagcct

SEQ ID NO: 442258 - DNA, 18 bp, Homo sapiens
tgcagttggactctcagg

SEQ ID NO: 442259 - DNA, 20 bp, Homo sapiens
tgcagttggactctcaggga

SEQ ID NO: 442260 - DNA, 14 bp, Homo sapiens
tgcagttgtatagt

SEQ ID NO: 442261 - DNA, 21 bp, Homo sapiens
tgcagtttatatatatgctac

SEQ ID NO: 442262 - DNA, 14 bp, Homo sapiens
tgcagttttccagg

SEQ ID NO: 442263 - DNA, 14 bp, Homo sapiens
tgcagtttttcagg

SEQ ID NO: 442264 - DNA, 14 bp, Homo sapiens
tgcataagtgaaaa

SEQ ID NO: 442265 - DNA, 14 bp, Homo sapiens
tgcataagttaact

SEQ ID NO: 442266 - DNA, 23 bp, Homo sapiens
tgcataataagctaaagaggctg

SEQ ID NO: 442267 - DNA, 22 bp, Homo sapiens
tgcatacttcctggattttctt

SEQ ID NO: 442268 - DNA, 14 bp, Homo sapiens
tgcatagacaaagg

SEQ ID NO: 442269 - DNA, 21 bp, Homo sapiens
tgcatagtaccaatcatttta

SEQ ID NO: 442270 - DNA, 17 bp, Homo sapiens
tgcatatcgctgggctc

SEQ ID NO: 442271 - DNA, 18 bp, Homo sapiens
tgcatatctctagtccct

SEQ ID NO: 442272 - DNA, 21 bp, Homo sapiens
tgcatattagcatcatgtctt

SEQ ID NO: 442273 - DNA, 15 bp, Homo sapiens
tgcatattctattgt

SEQ ID NO: 442274 - DNA, 17 bp, Homo sapiens
tgcatcatctgtagata

SEQ ID NO: 442275 - DNA, 15 bp, Homo sapiens
tgcatccaggcctga

SEQ ID NO: 442276 - DNA, 16 bp, Homo sapiens
tgcatccctccacccc

SEQ ID NO: 442277 - DNA, 19 bp, Homo sapiens
tgcatcccttggcccctct

SEQ ID NO: 442278 - DNA, 22 bp, Homo sapiens
tgcatcccttggcccctctctg

SEQ ID NO: 442279 - DNA, 16 bp, Homo sapiens
tgcatccgtgagcagt

SEQ ID NO: 442280 - DNA, 14 bp, Homo sapiens
tgcatcctcagccc

SEQ ID NO: 442281 - DNA, 16 bp, Homo sapiens
tgcatcctcagcccca

SEQ ID NO: 442282 - DNA, 17 bp, Homo sapiens
tgcatcctcagccccag

SEQ ID NO: 442283 - DNA, 18 bp, Homo sapiens
tgcatcctcagccccagg

SEQ ID NO: 442284 - DNA, 21 bp, Homo sapiens
tgcatcctcagccccagggcc

SEQ ID NO: 442285 - DNA, 15 bp, Homo sapiens
tgcatcctcctccca

SEQ ID NO: 442286 - DNA, 21 bp, Homo sapiens
tgcatcgctgtccaagtgttt

SEQ ID NO: 442287 - DNA, 18 bp, Homo sapiens
tgcatcgttttctttgct

SEQ ID NO: 442288 - DNA, 23 bp, Homo sapiens
tgcatcgttttctttgctgtgcc

SEQ ID NO: 442289 - DNA, 23 bp, Homo sapiens
tgcatctgggccagaagtcctcc

SEQ ID NO: 442290 - DNA, 16 bp, Homo sapiens
tgcatctgtctgtcct

SEQ ID NO: 442291 - DNA, 12 bp, Homo sapiens
tgcatctttcat

SEQ ID NO: 442292 - DNA, 21 bp, Homo sapiens
tgcatctttcatagttctgtt

SEQ ID NO: 442293 - DNA, 12 bp, Homo sapiens
tgcatctttgag

SEQ ID NO: 442294 - DNA, 17 bp, Homo sapiens
tgcatctttgagaatat

SEQ ID NO: 442295 - DNA, 17 bp, Homo sapiens
tgcatgagaatgtcatt

SEQ ID NO: 442296 - DNA, 21 bp, Homo sapiens
tgcatgagaatgtcatttgct

SEQ ID NO: 442297 - DNA, 13 bp, Homo sapiens
tgcatgagctccc

SEQ ID NO: 442298 - DNA, 14 bp, Homo sapiens
tgcatgagctccct

SEQ ID NO: 442299 - DNA, 21 bp, Homo sapiens
tgcatgatattgtatgtacct

SEQ ID NO: 442300 - DNA, 16 bp, Homo sapiens
tgcatgatctgtcaaa

SEQ ID NO: 442301 - DNA, 17 bp, Homo sapiens
tgcatgcaaaccaggag

SEQ ID NO: 442302 - DNA, 13 bp, Homo sapiens
tgcatgcaactaa

SEQ ID NO: 442303 - DNA, 14 bp, Homo sapiens
tgcatgcaactaat

SEQ ID NO: 442304 - DNA, 18 bp, Homo sapiens
tgcatgcagccactgtgc

SEQ ID NO: 442305 - DNA, 22 bp, Homo sapiens
tgcatgcagccactgtgctgaa

SEQ ID NO: 442306 - DNA, 15 bp, Homo sapiens
tgcatgcaggtctcc

SEQ ID NO: 442307 - DNA, 21 bp, Homo sapiens
tgcatgcaggtctccatgaag

SEQ ID NO: 442308 - DNA, 16 bp, Homo sapiens
tgcatgcttagagcat

SEQ ID NO: 442309 - DNA, 12 bp, Homo sapiens
tgccccacctgc

SEQ ID NO: 442310 - DNA, 13 bp, Homo sapiens
tgccccacctgcc

SEQ ID NO: 442311 - DNA, 17 bp, Homo sapiens
tgccccacctgccacta

SEQ ID NO: 442312 - DNA, 21 bp, Homo sapiens
tgccccacctgccactaggct

SEQ ID NO: 442313 - DNA, 13 bp, Homo sapiens
tgccccagagaag

SEQ ID NO: 442314 - DNA, 20 bp, Homo sapiens
tgccccagctgactgtggcc

SEQ ID NO: 442315 - DNA, 13 bp, Homo sapiens
tgccccagtcctg

SEQ ID NO: 442316 - DNA, 19 bp, Homo sapiens
tgccccatcagcagcttga

SEQ ID NO: 442317 - DNA, 19 bp, Homo sapiens
tgcccccactgtcccccta

SEQ ID NO: 442318 - DNA, 11 bp, Homo sapiens
tgcccccagcg

SEQ ID NO: 442319 - DNA, 15 bp, Homo sapiens
tgcccccatccctcg

SEQ ID NO: 442320 - DNA, 16 bp, Homo sapiens
tgcccccatctttcct

SEQ ID NO: 442321 - DNA, 15 bp, Homo sapiens
tgccccccaccccag

SEQ ID NO: 442322 - DNA, 15 bp, Homo sapiens
tgccccccttcccac

SEQ ID NO: 442323 - DNA, 18 bp, Homo sapiens
tgccccccttcccacccc

SEQ ID NO: 442324 - DNA, 22 bp, Homo sapiens
tgcccccgctcatgggcccctc

SEQ ID NO: 442325 - DNA, 15 bp, Homo sapiens
tgccccctcccccgc

SEQ ID NO: 442326 - DNA, 18 bp, Homo sapiens
tgccccctcccccgcaga

SEQ ID NO: 442327 - DNA, 22 bp, Homo sapiens
tgccccctcccccgcagacaga

SEQ ID NO: 442328 - DNA, 16 bp, Homo sapiens
tgcccccttctcccac

SEQ ID NO: 442329 - DNA, 16 bp, Homo sapiens
tgccccctttcagatg

SEQ ID NO: 442330 - DNA, 16 bp, Homo sapiens
tgccccgccccccaga

SEQ ID NO: 442331 - DNA, 19 bp, Homo sapiens
tgccccgccccccagagcc

SEQ ID NO: 442332 - DNA, 20 bp, Homo sapiens
tgccccgtcccctgggccac

SEQ ID NO: 442333 - DNA, 21 bp, Homo sapiens
tgccccgtcggactgccccca

SEQ ID NO: 442334 - DNA, 23 bp, Homo sapiens
tgccccgttccctgtcagaggct

SEQ ID NO: 442335 - DNA, 22 bp, Homo sapiens
tgcccctcccatggcccagcag

SEQ ID NO: 442336 - DNA, 12 bp, Homo sapiens
tgcccctccccc

SEQ ID NO: 442337 - DNA, 17 bp, Homo sapiens
tgcccctcccccaaccc

SEQ ID NO: 442338 - DNA, 15 bp, Homo sapiens
tgcccctcccttcaa

SEQ ID NO: 442339 - DNA, 20 bp, Homo sapiens
tgcccctccgtccccagggt

SEQ ID NO: 442340 - DNA, 15 bp, Homo sapiens
tgcccctgcccctgc

SEQ ID NO: 442341 - DNA, 15 bp, Homo sapiens
tgcccctgcccgaga

SEQ ID NO: 442342 - DNA, 21 bp, Homo sapiens
tgcccctgcccgagagctctt

SEQ ID NO: 442343 - DNA, 13 bp, Homo sapiens
tgcccctgctgcc

SEQ ID NO: 442344 - DNA, 23 bp, Homo sapiens
tgcccctgctgcctccccaaccc

SEQ ID NO: 442345 - DNA, 16 bp, Homo sapiens
tgccccttccccaaga

SEQ ID NO: 442346 - DNA, 16 bp, Homo sapiens
tgccccttctacactc

SEQ ID NO: 442347 - DNA, 16 bp, Homo sapiens
tgccccttcttgggcc

SEQ ID NO: 442348 - DNA, 12 bp, Homo sapiens
tgccccttgctt

SEQ ID NO: 442349 - DNA, 13 bp, Homo sapiens
tgccccttgcttc

SEQ ID NO: 442350 - DNA, 12 bp, Homo sapiens
tgccccttgggc

SEQ ID NO: 442351 - DNA, 16 bp, Homo sapiens
tgcccgagagctctta

SEQ ID NO: 442352 - DNA, 22 bp, Homo sapiens
tgcccgagagctcttagttttt

SEQ ID NO: 442353 - DNA, 13 bp, Homo sapiens
tgcccgagctggt

SEQ ID NO: 442354 - DNA, 16 bp, Homo sapiens
tgcccgagctggtgca

SEQ ID NO: 442355 - DNA, 16 bp, Homo sapiens
tgcccgcacaccctca

SEQ ID NO: 442356 - DNA, 22 bp, Homo sapiens
tgcccgcacaccctcactctgc

SEQ ID NO: 442357 - DNA, 16 bp, Homo sapiens
tgcccgcagagcccac

SEQ ID NO: 442358 - DNA, 19 bp, Homo sapiens
tgcccgcccacctctgctg

SEQ ID NO: 442359 - DNA, 21 bp, Homo sapiens
tgcccgcccacctctgctgcc

SEQ ID NO: 442360 - DNA, 18 bp, Homo sapiens
tgcccgccccaagccctg

SEQ ID NO: 442361 - DNA, 22 bp, Homo sapiens
tgcccgccccaagccctgcccc

SEQ ID NO: 442362 - DNA, 23 bp, Homo sapiens
tgcccgctcccacagcttcctga

SEQ ID NO: 442363 - DNA, 13 bp, Homo sapiens
tgcccgctgtccc

SEQ ID NO: 442364 - DNA, 15 bp, Homo sapiens
tgcccgctgtcccag

SEQ ID NO: 442365 - DNA, 19 bp, Homo sapiens
tgcccgctgtcccaggggt

SEQ ID NO: 442366 - DNA, 23 bp, Homo sapiens
tgcccggagattggacggcctga

SEQ ID NO: 442367 - DNA, 20 bp, Homo sapiens
tgcccggggcagctgccaga

SEQ ID NO: 442368 - DNA, 21 bp, Homo sapiens
tgcccggtggtttgccatgtc

SEQ ID NO: 442369 - DNA, 13 bp, Homo sapiens
tgccctaagggac

SEQ ID NO: 442370 - DNA, 18 bp, Homo sapiens
tgccctacagaggtctct

SEQ ID NO: 442371 - DNA, 14 bp, Homo sapiens
tgccctagcgctct

SEQ ID NO: 442372 - DNA, 16 bp, Homo sapiens
tgccctcaccacccac

SEQ ID NO: 442373 - DNA, 22 bp, Homo sapiens
tgccctcactccactcccctca

SEQ ID NO: 442374 - DNA, 20 bp, Homo sapiens
tgccctcagatgaaaataaa

SEQ ID NO: 442375 - DNA, 16 bp, Homo sapiens
tgccctccactgccct

SEQ ID NO: 442376 - DNA, 17 bp, Homo sapiens
tgccctccactgccctc

SEQ ID NO: 442377 - DNA, 19 bp, Homo sapiens
tgccctccactgccctctg

SEQ ID NO: 442378 - DNA, 21 bp, Homo sapiens
tgccctccactgccctctgtt

SEQ ID NO: 442379 - DNA, 18 bp, Homo sapiens
tgccctccagctctttcc

SEQ ID NO: 442380 - DNA, 19 bp, Homo sapiens
tgccctccagctctttcct

SEQ ID NO: 442381 - DNA, 17 bp, Homo sapiens
tgccctccccagagcac

SEQ ID NO: 442382 - DNA, 12 bp, Homo sapiens
tgccctccccca

SEQ ID NO: 442383 - DNA, 22 bp, Homo sapiens
tgccctccgtcctggcagggca

SEQ ID NO: 442384 - DNA, 13 bp, Homo sapiens
tgccctcgctgct

SEQ ID NO: 442385 - DNA, 19 bp, Homo sapiens
tgccctcgtctccctggcc

SEQ ID NO: 442386 - DNA, 17 bp, Homo sapiens
tgccctctccacaccca

SEQ ID NO: 442387 - DNA, 11 bp, Homo sapiens
tgccctctgtt

SEQ ID NO: 442388 - DNA, 17 bp, Homo sapiens
tgccctgaacctctgat

SEQ ID NO: 442389 - DNA, 18 bp, Homo sapiens
tgccctgacccctgcacc

SEQ ID NO: 442390 - DNA, 23 bp, Homo sapiens
tgccctgagctttccggggagga

SEQ ID NO: 442391 - DNA, 18 bp, Homo sapiens
tgccctgccaagcctgga

SEQ ID NO: 442392 - DNA, 20 bp, Homo sapiens
tgccctgccaagcctggagc

SEQ ID NO: 442393 - DNA, 14 bp, Homo sapiens
tgccctgccacctg

SEQ ID NO: 442394 - DNA, 15 bp, Homo sapiens
tgccctgccacctgt

SEQ ID NO: 442395 - DNA, 13 bp, Homo sapiens
tgccctgccaggc

SEQ ID NO: 442396 - DNA, 11 bp, Homo sapiens
tgccctgccat

SEQ ID NO: 442397 - DNA, 12 bp, Homo sapiens
tgccctgccatt

SEQ ID NO: 442398 - DNA, 16 bp, Homo sapiens
tgccctgcctcccttt

SEQ ID NO: 442399 - DNA, 14 bp, Homo sapiens
tgccctgcctgagg

SEQ ID NO: 442400 - DNA, 19 bp, Homo sapiens
tgccctgccttgtccctct

SEQ ID NO: 442401 - DNA, 11 bp, Homo sapiens
tgccctgctgc

SEQ ID NO: 442402 - DNA, 21 bp, Homo sapiens
tgccctgctgccgcctcccag

SEQ ID NO: 442403 - DNA, 22 bp, Homo sapiens
tgccctggctcccaagggaggc

SEQ ID NO: 442404 - DNA, 20 bp, Homo sapiens
tgccctgggccagcccagga

SEQ ID NO: 442405 - DNA, 14 bp, Homo sapiens
tgccctggtgctgc

SEQ ID NO: 442406 - DNA, 18 bp, Homo sapiens
tgccctggtgctgccaca

SEQ ID NO: 442407 - DNA, 21 bp, Homo sapiens
tgccctggtgctgccacactt

SEQ ID NO: 442408 - DNA, 15 bp, Homo sapiens
tgccctggtttcact

SEQ ID NO: 442409 - DNA, 17 bp, Homo sapiens
tgccctggtttcactgg

SEQ ID NO: 442410 - DNA, 12 bp, Homo sapiens
tgccctgtacct

SEQ ID NO: 442411 - DNA, 17 bp, Homo sapiens
tgccctgtacctctctc

SEQ ID NO: 442412 - DNA, 11 bp, Homo sapiens
tgccctgtgtc

SEQ ID NO: 442413 - DNA, 19 bp, Homo sapiens
tgccctgttgtgtatagat

SEQ ID NO: 442414 - DNA, 14 bp, Homo sapiens
tgcccttaaaataa

SEQ ID NO: 442415 - DNA, 19 bp, Homo sapiens
tgcccttaaaataatgatt

SEQ ID NO: 442416 - DNA, 12 bp, Homo sapiens
tgcccttccctg

SEQ ID NO: 442417 - DNA, 14 bp, Homo sapiens
tgccgacacgctcc

SEQ ID NO: 442418 - DNA, 16 bp, Homo sapiens
tgccgagagaggcgcg

SEQ ID NO: 442419 - DNA, 23 bp, Homo sapiens
tgccgagagaggcgcgtctgccc

SEQ ID NO: 442420 - DNA, 17 bp, Homo sapiens
tgccgagcctaatgaaa

SEQ ID NO: 442421 - DNA, 22 bp, Homo sapiens
tgccgccactggctgtgcctcc

SEQ ID NO: 442422 - DNA, 13 bp, Homo sapiens
tgccgcctcccag

SEQ ID NO: 442423 - DNA, 16 bp, Homo sapiens
tgccgcctcccagcct

SEQ ID NO: 442424 - DNA, 17 bp, Homo sapiens
tgccgcctcccagcctg

SEQ ID NO: 442425 - DNA, 18 bp, Homo sapiens
tgccgcctcccagcctgg

SEQ ID NO: 442426 - DNA, 20 bp, Homo sapiens
tgccgcgtgcgaccagaggt

SEQ ID NO: 442427 - DNA, 14 bp, Homo sapiens
tgccgctgggagag

SEQ ID NO: 442428 - DNA, 13 bp, Homo sapiens
tgccgctgtgtcc

SEQ ID NO: 442429 - DNA, 19 bp, Homo sapiens
tgccggcggcagccccact

SEQ ID NO: 442430 - DNA, 22 bp, Homo sapiens
tgccggctgcaccctgtatgga

SEQ ID NO: 442431 - DNA, 14 bp, Homo sapiens
tgccgggcctggac

SEQ ID NO: 442432 - DNA, 17 bp, Homo sapiens
tgccgtcgcgacacagg

SEQ ID NO: 442433 - DNA, 20 bp, Homo sapiens
tgccgtctcatatttttaca

SEQ ID NO: 442434 - DNA, 19 bp, Homo sapiens
tgccgtctttggttcctca

SEQ ID NO: 442435 - DNA, 13 bp, Homo sapiens
tgccgtgagcagg

SEQ ID NO: 442436 - DNA, 16 bp, Homo sapiens
tgccgtgagcaggctt

SEQ ID NO: 442437 - DNA, 21 bp, Homo sapiens
tgccgtgcacggggccagcat

SEQ ID NO: 442438 - DNA, 14 bp, Homo sapiens
tgccgtggcaactg

SEQ ID NO: 442439 - DNA, 13 bp, Homo sapiens
tgccgtgggaatt

SEQ ID NO: 442440 - DNA, 20 bp, Homo sapiens
tgctagatgtgcaaatgcaa

SEQ ID NO: 442441 - DNA, 14 bp, Homo sapiens
tgctagcacaatat

SEQ ID NO: 442442 - DNA, 17 bp, Homo sapiens
tgctagcgagccgcctc

SEQ ID NO: 442443 - DNA, 15 bp, Homo sapiens
tgctagctgtagaaa

SEQ ID NO: 442444 - DNA, 20 bp, Homo sapiens
tgctagggtgcctgctctcc

SEQ ID NO: 442445 - DNA, 17 bp, Homo sapiens
tgctaggtgggccagcc

SEQ ID NO: 442446 - DNA, 19 bp, Homo sapiens
tgctaggtgggccagcccc

SEQ ID NO: 442447 - DNA, 14 bp, Homo sapiens
tgctagtacctgta

SEQ ID NO: 442448 - DNA, 18 bp, Homo sapiens
tgctagtgagctgggcat

SEQ ID NO: 442449 - DNA, 19 bp, Homo sapiens
tgctagtgggccctctctc

SEQ ID NO: 442450 - DNA, 18 bp, Homo sapiens
tgctagtttattggaagt

SEQ ID NO: 442451 - DNA, 13 bp, Homo sapiens
tgctagttttaca

SEQ ID NO: 442452 - DNA, 16 bp, Homo sapiens
tgctagttttacagat

SEQ ID NO: 442453 - DNA, 23 bp, Homo sapiens
tgctataattctatactgttgat

SEQ ID NO: 442454 - DNA, 16 bp, Homo sapiens
tgctatattttcatga

SEQ ID NO: 442455 - DNA, 22 bp, Homo sapiens
tgctatcatatattataagatt

SEQ ID NO: 442456 - DNA, 15 bp, Homo sapiens
tgctatccagccgca

SEQ ID NO: 442457 - DNA, 16 bp, Homo sapiens
tgctatgaaaatgagc

SEQ ID NO: 442458 - DNA, 22 bp, Homo sapiens
tgctatgaaaatgagcatcaga

SEQ ID NO: 442459 - DNA, 13 bp, Homo sapiens
tgctatgtctgtg

SEQ ID NO: 442460 - DNA, 15 bp, Homo sapiens
tgctatgttagaagt

SEQ ID NO: 442461 - DNA, 22 bp, Homo sapiens
tgctatttgctttagagacagg

SEQ ID NO: 442462 - DNA, 17 bp, Homo sapiens
tgctcaaagatgtaatg

SEQ ID NO: 442463 - DNA, 20 bp, Homo sapiens
tgctcaaagatgtactgaga

SEQ ID NO: 442464 - DNA, 13 bp, Homo sapiens
tgctcaacccccc

SEQ ID NO: 442465 - DNA, 14 bp, Homo sapiens
tgctcaacccccct

SEQ ID NO: 442466 - DNA, 14 bp, Homo sapiens
tgctcaagaagaca

SEQ ID NO: 442467 - DNA, 15 bp, Homo sapiens
tgctcaagaagacat

SEQ ID NO: 442468 - DNA, 13 bp, Homo sapiens
tgctcaatgtgct

SEQ ID NO: 442469 - DNA, 20 bp, Homo sapiens
tgctcaatgtgctgttgatt

SEQ ID NO: 442470 - DNA, 19 bp, Homo sapiens
tgctcacactccacatccc

SEQ ID NO: 442471 - DNA, 15 bp, Homo sapiens
tgctcacccattgtc

SEQ ID NO: 442472 - DNA, 13 bp, Homo sapiens
tgctcacctctag

SEQ ID NO: 442473 - DNA, 17 bp, Homo sapiens
tgctcacgtctgtgagt

SEQ ID NO: 442474 - DNA, 22 bp, Homo sapiens
tgctcacgtctgtgagtctgtc

SEQ ID NO: 442475 - DNA, 12 bp, Homo sapiens
tgctcactccct

SEQ ID NO: 442476 - DNA, 15 bp, Homo sapiens
tgctcactccctaaa

SEQ ID NO: 442477 - DNA, 20 bp, Homo sapiens
tgctcactccctaaagccct

SEQ ID NO: 442478 - DNA, 19 bp, Homo sapiens
tgctcagacgagacaccct

SEQ ID NO: 442479 - DNA, 13 bp, Homo sapiens
tgctcaggccggg

SEQ ID NO: 442480 - DNA, 12 bp, Homo sapiens
tgctcaggcctc

SEQ ID NO: 442481 - DNA, 19 bp, Homo sapiens
tgctcaggcctcacctggc

SEQ ID NO: 442482 - DNA, 19 bp, Homo sapiens
tgctcaggcttgaaatgca

SEQ ID NO: 442483 - DNA, 13 bp, Homo sapiens
tgctcagtattga

SEQ ID NO: 442484 - DNA, 12 bp, Homo sapiens
tgctcagtgcct

SEQ ID NO: 442485 - DNA, 14 bp, Homo sapiens
tgctcagtgcctcc

SEQ ID NO: 442486 - DNA, 15 bp, Homo sapiens
tgctcagtgcctcct

SEQ ID NO: 442487 - DNA, 17 bp, Homo sapiens
tgctcagtgcctcctgg

SEQ ID NO: 442488 - DNA, 18 bp, Homo sapiens
tgctcagtggatcacaca

SEQ ID NO: 442489 - DNA, 15 bp, Homo sapiens
tgctcagttgtactt

SEQ ID NO: 442490 - DNA, 20 bp, Homo sapiens
tgctcatctcagtcctcaaa

SEQ ID NO: 442491 - DNA, 15 bp, Homo sapiens
tgctccaccacatcc

SEQ ID NO: 442492 - DNA, 17 bp, Homo sapiens
tgctccaccccactcac

SEQ ID NO: 442493 - DNA, 23 bp, Homo sapiens
tgctccacccttggcctgtctca

SEQ ID NO: 442494 - DNA, 21 bp, Homo sapiens
tgctccagcagtgctgggccc

SEQ ID NO: 442495 - DNA, 22 bp, Homo sapiens
tgctccagccaacccctgtgga

SEQ ID NO: 442496 - DNA, 13 bp, Homo sapiens
tgctccagggtct

SEQ ID NO: 442497 - DNA, 18 bp, Homo sapiens
tgctccagggtcttgggc

SEQ ID NO: 442498 - DNA, 13 bp, Homo sapiens
tgctccatgcaga

SEQ ID NO: 442499 - DNA, 22 bp, Homo sapiens
tgctccatgggcacctctgctg

SEQ ID NO: 442500 - DNA, 23 bp, Homo sapiens
tgctccatttataaccccagcct

SEQ ID NO: 442501 - DNA, 17 bp, Homo sapiens
tgctcccagatgccttc

SEQ ID NO: 442502 - DNA, 15 bp, Homo sapiens
tgctcccagcagccc

SEQ ID NO: 442503 - DNA, 20 bp, Homo sapiens
tgctcccagcagccctaagg

SEQ ID NO: 442504 - DNA, 21 bp, Homo sapiens
tgctcccagcatttgtccacc

SEQ ID NO: 442505 - DNA, 11 bp, Homo sapiens
tgctcccagcc

SEQ ID NO: 442506 - DNA, 21 bp, Homo sapiens
tgctcccagcctgctgagagc

SEQ ID NO: 442507 - DNA, 13 bp, Homo sapiens
tgctcccagtgcc

SEQ ID NO: 442508 - DNA, 16 bp, Homo sapiens
tgctccccacccgcct

SEQ ID NO: 442509 - DNA, 18 bp, Homo sapiens
tgctcccccatcctcccc

SEQ ID NO: 442510 - DNA, 22 bp, Homo sapiens
tgctcccccatcctccccttcc

SEQ ID NO: 442511 - DNA, 23 bp, Homo sapiens
tgctcccccatcctccccttccc

SEQ ID NO: 442512 - DNA, 17 bp, Homo sapiens
tgctcccctccctcctc

SEQ ID NO: 442513 - DNA, 18 bp, Homo sapiens
tgctccctcccctgccct

SEQ ID NO: 442514 - DNA, 18 bp, Homo sapiens
tgctccgcctctgctggc

SEQ ID NO: 442515 - DNA, 17 bp, Homo sapiens
tgctccgtgtgtctcat

SEQ ID NO: 442516 - DNA, 21 bp, Homo sapiens
tgctcctcacccccacccctg

SEQ ID NO: 442517 - DNA, 16 bp, Homo sapiens
tgctcctcacctgtct

SEQ ID NO: 442518 - DNA, 19 bp, Homo sapiens
tgctcctcactgcccgcac

SEQ ID NO: 442519 - DNA, 19 bp, Homo sapiens
tgctcctcctgccctgtcc

SEQ ID NO: 442520 - DNA, 22 bp, Homo sapiens
tgctcctcggccagagctccca

SEQ ID NO: 442521 - DNA, 23 bp, Homo sapiens
tgctcctgaaaaatgactgtccc

SEQ ID NO: 442522 - DNA, 23 bp, Homo sapiens
tgctcctgacttagcccgtcacc

SEQ ID NO: 442523 - DNA, 14 bp, Homo sapiens
tgctcctgcatgca

SEQ ID NO: 442524 - DNA, 21 bp, Homo sapiens
tgctcctggagcctttgaata

SEQ ID NO: 442525 - DNA, 15 bp, Homo sapiens
tgctccttgttccta

SEQ ID NO: 442526 - DNA, 23 bp, Homo sapiens
tgctccttgttcctagagtagag

SEQ ID NO: 442527 - DNA, 18 bp, Homo sapiens
tgctcctttcttgtttta

SEQ ID NO: 442528 - DNA, 19 bp, Homo sapiens
tgctcgggaaggcctgagg

SEQ ID NO: 442529 - DNA, 14 bp, Homo sapiens
tgctcgggagtggc

SEQ ID NO: 442530 - DNA, 20 bp, Homo sapiens
tgctctaagaggctcctaca

SEQ ID NO: 442531 - DNA, 18 bp, Homo sapiens
tgctctaagcacacggag

SEQ ID NO: 442532 - DNA, 20 bp, Homo sapiens
tgctctacccatgagcctgc

SEQ ID NO: 442533 - DNA, 13 bp, Homo sapiens
tgctctagccagg

SEQ ID NO: 442534 - DNA, 16 bp, Homo sapiens
tgctctagccaggagt

SEQ ID NO: 442535 - DNA, 19 bp, Homo sapiens
tgctctagccaggagtctg

SEQ ID NO: 442536 - DNA, 23 bp, Homo sapiens
tgctctagccaggagtctgtgct

SEQ ID NO: 442537 - DNA, 12 bp, Homo sapiens
tgctctagctgg

SEQ ID NO: 442538 - DNA, 13 bp, Homo sapiens
tgctctagctggc

SEQ ID NO: 442539 - DNA, 21 bp, Homo sapiens
tgctctattgtagcatttctt

SEQ ID NO: 442540 - DNA, 23 bp, Homo sapiens
tgctctcataggagttaggctgt

SEQ ID NO: 442541 - DNA, 13 bp, Homo sapiens
tgctctcccctgc

SEQ ID NO: 442542 - DNA, 22 bp, Homo sapiens
tgctctcctaccccacctcatg

SEQ ID NO: 442543 - DNA, 21 bp, Homo sapiens
tgctctccttcactctgacag

SEQ ID NO: 442544 - DNA, 16 bp, Homo sapiens
tgctctccttgccctg

SEQ ID NO: 442545 - DNA, 19 bp, Homo sapiens
tgctctccttgccctgggc

SEQ ID NO: 442546 - DNA, 18 bp, Homo sapiens
tgctctctacccagccca

SEQ ID NO: 442547 - DNA, 22 bp, Homo sapiens
tgctctctacccagcccatctt

SEQ ID NO: 442548 - DNA, 22 bp, Homo sapiens
tgctctgagacggatggaagga

SEQ ID NO: 442549 - DNA, 23 bp, Homo sapiens
tgctctgagacggatggaaggag

SEQ ID NO: 442550 - DNA, 13 bp, Homo sapiens
tgctctgcagccc

SEQ ID NO: 442551 - DNA, 16 bp, Homo sapiens
tgctctgcagcccaca

SEQ ID NO: 442552 - DNA, 17 bp, Homo sapiens
tgctctgccccaagccc

SEQ ID NO: 442553 - DNA, 18 bp, Homo sapiens
tgctctggcggcttcctg

SEQ ID NO: 442554 - DNA, 22 bp, Homo sapiens
tgctctggcggcttcctgtcca

SEQ ID NO: 442555 - DNA, 14 bp, Homo sapiens
tgctctggggattt

SEQ ID NO: 442556 - DNA, 21 bp, Homo sapiens
tgctctggggatttctgggat

SEQ ID NO: 442557 - DNA, 15 bp, Homo sapiens
tgctctgtcttggtc

SEQ ID NO: 442558 - DNA, 16 bp, Homo sapiens
tgctctgtgcctggga

SEQ ID NO: 442559 - DNA, 18 bp, Homo sapiens
tgctcttagtgcccgcct

SEQ ID NO: 442560 - DNA, 21 bp, Homo sapiens
tgctcttagtgcccgcctagg

SEQ ID NO: 442561 - DNA, 22 bp, Homo sapiens
tgctcttctacgtataaatatg

SEQ ID NO: 442562 - DNA, 22 bp, Homo sapiens
tgctcttctcttacgctctctg

SEQ ID NO: 442563 - DNA, 16 bp, Homo sapiens
tgctcttgcatctggg

SEQ ID NO: 442564 - DNA, 12 bp, Homo sapiens
tgctcttggaaa

SEQ ID NO: 442565 - DNA, 18 bp, Homo sapiens
tgctcttggaaagctgat

SEQ ID NO: 442566 - DNA, 18 bp, Homo sapiens
tgctctttcatctctgct

SEQ ID NO: 442567 - DNA, 12 bp, Homo sapiens
tgctctttctct

SEQ ID NO: 442568 - DNA, 18 bp, Homo sapiens
tgctctttctctgccagt

SEQ ID NO: 442569 - DNA, 14 bp, Homo sapiens
tgctctttgtggca

SEQ ID NO: 442570 - DNA, 14 bp, Homo sapiens
tgctgtgaaacagt

SEQ ID NO: 442571 - DNA, 23 bp, Homo sapiens
tgctgtgaacaagtgaacacatt

SEQ ID NO: 442572 - DNA, 18 bp, Homo sapiens
tgctgtgaccatttataa

SEQ ID NO: 442573 - DNA, 16 bp, Homo sapiens
tgctgtgaggctgtcc

SEQ ID NO: 442574 - DNA, 17 bp, Homo sapiens
tgctgtgcaaacagtgt

SEQ ID NO: 442575 - DNA, 22 bp, Homo sapiens
tgctgtgcaaacagtgtaagct

SEQ ID NO: 442576 - DNA, 23 bp, Homo sapiens
tgctgtgccaggactgtgactca

SEQ ID NO: 442577 - DNA, 16 bp, Homo sapiens
tgctgtgctctgggga

SEQ ID NO: 442578 - DNA, 12 bp, Homo sapiens
tgctgtggattt

SEQ ID NO: 442579 - DNA, 21 bp, Homo sapiens
tgctgtggattttgtggcttc

SEQ ID NO: 442580 - DNA, 13 bp, Homo sapiens
tgctgtggcatca

SEQ ID NO: 442581 - DNA, 17 bp, Homo sapiens
tgctgttcctgctccat

SEQ ID NO: 442582 - DNA, 22 bp, Homo sapiens
tgctgttgtcattgctttactg

SEQ ID NO: 442583 - DNA, 14 bp, Homo sapiens
tgctgttgtctgcc

SEQ ID NO: 442584 - DNA, 18 bp, Homo sapiens
tgctgttgttcagaagtt

SEQ ID NO: 442585 - DNA, 21 bp, Homo sapiens
tgctgtttagcttcctccaga

SEQ ID NO: 442586 - DNA, 15 bp, Homo sapiens
tgctgtttcccctgc

SEQ ID NO: 442587 - DNA, 16 bp, Homo sapiens
tgctgttttgttctgt

SEQ ID NO: 442588 - DNA, 17 bp, Homo sapiens
tgcttaaaaatcattga

SEQ ID NO: 442589 - DNA, 12 bp, Homo sapiens
tgcttaaacaaa

SEQ ID NO: 442590 - DNA, 21 bp, Homo sapiens
tgcttaatctagagctatgca

SEQ ID NO: 442591 - DNA, 23 bp, Homo sapiens
tgcttaatctagagctatgcaca

SEQ ID NO: 442592 - DNA, 14 bp, Homo sapiens
tgcttaatttctaa

SEQ ID NO: 442593 - DNA, 20 bp, Homo sapiens
tgcttaatttctaaagataa

SEQ ID NO: 442594 - DNA, 18 bp, Homo sapiens
tgcttacaattccctgct

SEQ ID NO: 442595 - DNA, 15 bp, Homo sapiens
tgcttacacatctca

SEQ ID NO: 442596 - DNA, 20 bp, Homo sapiens
tgcttacacatctcagaccc

SEQ ID NO: 442597 - DNA, 14 bp, Homo sapiens
tgcttacattttta

SEQ ID NO: 442598 - DNA, 15 bp, Homo sapiens
tgcttacatttttac

SEQ ID NO: 442599 - DNA, 18 bp, Homo sapiens
tgcttactaatgtgcccc

SEQ ID NO: 442600 - DNA, 18 bp, Homo sapiens
tgcttagaacccttctgc

SEQ ID NO: 442601 - DNA, 20 bp, Homo sapiens
tgcttagaacccttctgctt

SEQ ID NO: 442602 - DNA, 24 bp, Homo sapiens
tgcttagaacccttctgctttcta

SEQ ID NO: 442603 - DNA, 21 bp, Homo sapiens
tgcttagatgagggtgactgt

SEQ ID NO: 442604 - DNA, 23 bp, Homo sapiens
tgcttataagcaacatgaattaa

SEQ ID NO: 442605 - DNA, 18 bp, Homo sapiens
tgcttatgaatatttata

SEQ ID NO: 442606 - DNA, 20 bp, Homo sapiens
tgcttatgaatatttataac

SEQ ID NO: 442607 - DNA, 16 bp, Homo sapiens
tgcttatgtgttgcat

SEQ ID NO: 442608 - DNA, 22 bp, Homo sapiens
tgcttatgtgttgcataaacaa

SEQ ID NO: 442609 - DNA, 16 bp, Homo sapiens
tgcttattgttccaag

SEQ ID NO: 442610 - DNA, 14 bp, Homo sapiens
tgcttatttatatt

SEQ ID NO: 442611 - DNA, 13 bp, Homo sapiens
tgcttcaaaaaca

SEQ ID NO: 442612 - DNA, 14 bp, Homo sapiens
tgcttcaactgtct

SEQ ID NO: 442613 - DNA, 16 bp, Homo sapiens
tgcttcaataaatctt

SEQ ID NO: 442614 - DNA, 22 bp, Homo sapiens
tgcttcaataaatctttggaaa

SEQ ID NO: 442615 - DNA, 15 bp, Homo sapiens
tgcttcagcttgctt

SEQ ID NO: 442616 - DNA, 16 bp, Homo sapiens
tgcttcatatctctcc

SEQ ID NO: 442617 - DNA, 16 bp, Homo sapiens
tgcttcatgaaaatcc

SEQ ID NO: 442618 - DNA, 21 bp, Homo sapiens
tgcttcatgaaaatcctacca

SEQ ID NO: 442619 - DNA, 13 bp, Homo sapiens
tgcttccaagccc

SEQ ID NO: 442620 - DNA, 21 bp, Homo sapiens
tgcttccagttggactgtggc

SEQ ID NO: 442621 - DNA, 19 bp, Homo sapiens
tgcttccatggcttcctga

SEQ ID NO: 442622 - DNA, 20 bp, Homo sapiens
tgcttccatggcttcctgag

SEQ ID NO: 442623 - DNA, 19 bp, Homo sapiens
tgcttcccaaactcccagg

SEQ ID NO: 442624 - DNA, 14 bp, Homo sapiens
tgcttcccacctcc

SEQ ID NO: 442625 - DNA, 20 bp, Homo sapiens
tgcttcccacctccctgccc

SEQ ID NO: 442626 - DNA, 21 bp, Homo sapiens
tgcttcccacctccctgccca

SEQ ID NO: 442627 - DNA, 17 bp, Homo sapiens
tgcttcccattgtggct

SEQ ID NO: 442628 - DNA, 20 bp, Homo sapiens
tgcttcccattgtggctcct

SEQ ID NO: 442629 - DNA, 20 bp, Homo sapiens
tgcttccctctgcctgtccc

SEQ ID NO: 442630 - DNA, 16 bp, Homo sapiens
tgcttcctaacttatt

SEQ ID NO: 442631 - DNA, 18 bp, Homo sapiens
tgcttcctctgaatatta

SEQ ID NO: 442632 - DNA, 22 bp, Homo sapiens
tgcttctcggaggccaggccct

SEQ ID NO: 442633 - DNA, 19 bp, Homo sapiens
tgcttctgagagcaaaggg

SEQ ID NO: 442634 - DNA, 20 bp, Homo sapiens
tgcttctgagtggtgttttt

SEQ ID NO: 442635 - DNA, 13 bp, Homo sapiens
tgcttctgctcac

SEQ ID NO: 442636 - DNA, 12 bp, Homo sapiens
tgcttctgctgc

SEQ ID NO: 442637 - DNA, 14 bp, Homo sapiens
tgcttctgggaagg

SEQ ID NO: 442638 - DNA, 12 bp, Homo sapiens
tgcttctgggcc

SEQ ID NO: 442639 - DNA, 19 bp, Homo sapiens
tgcttctgggcctgatgga

SEQ ID NO: 442640 - DNA, 19 bp, Homo sapiens
tgcttcttaaccccagtaa

SEQ ID NO: 442641 - DNA, 19 bp, Homo sapiens
tgcttcttccccagggttc

SEQ ID NO: 442642 - DNA, 17 bp, Homo sapiens
tgcttcttgtgtttgaa

SEQ ID NO: 442643 - DNA, 21 bp, Homo sapiens
tgcttcttgtgtttgaaacac

SEQ ID NO: 442644 - DNA, 18 bp, Homo sapiens
tgcttctttttcttaccc

SEQ ID NO: 442645 - DNA, 14 bp, Homo sapiens
tgcttgagtcaggt

SEQ ID NO: 442646 - DNA, 23 bp, Homo sapiens
tgcttgagtcaggtttgagtaga

SEQ ID NO: 442647 - DNA, 13 bp, Homo sapiens
tgcttgcccgctc

SEQ ID NO: 442648 - DNA, 14 bp, Homo sapiens
tgcttgccgagcct

SEQ ID NO: 442649 - DNA, 12 bp, Homo sapiens
tgcttgctccta

SEQ ID NO: 442650 - DNA, 18 bp, Homo sapiens
tgcttgctgtgtgacctt

SEQ ID NO: 442651 - DNA, 21 bp, Homo sapiens
tgcttgctgttcccatccctg

SEQ ID NO: 442652 - DNA, 21 bp, Homo sapiens
tgcttggacctcgtgctttaa

SEQ ID NO: 442653 - DNA, 18 bp, Homo sapiens
tgcttggatccatacaaa

SEQ ID NO: 442654 - DNA, 17 bp, Homo sapiens
tgcttgggcttctgcgg

SEQ ID NO: 442655 - DNA, 14 bp, Homo sapiens
tgcttggggcctgg

SEQ ID NO: 442656 - DNA, 17 bp, Homo sapiens
tgcttggggctatttgt

SEQ ID NO: 442657 - DNA, 15 bp, Homo sapiens
tgcttggtggggctc

SEQ ID NO: 442658 - DNA, 22 bp, Homo sapiens
tgcttggtggggctcgtggcct

SEQ ID NO: 442659 - DNA, 18 bp, Homo sapiens
tgcttgtaacaagaaaac

SEQ ID NO: 442660 - DNA, 20 bp, Homo sapiens
tgcttgtaacaagaaaacat

SEQ ID NO: 442661 - DNA, 21 bp, Homo sapiens
tgcttgtaacaagaaaacata

SEQ ID NO: 442662 - DNA, 23 bp, Homo sapiens
tgcttgtaacaagaaaacataag

SEQ ID NO: 442663 - DNA, 16 bp, Homo sapiens
tgcttgtactaagcca

SEQ ID NO: 442664 - DNA, 14 bp, Homo sapiens
tgcttgtcatccac

SEQ ID NO: 442665 - DNA, 14 bp, Homo sapiens
tgcttgtgcctccc

SEQ ID NO: 442666 - DNA, 21 bp, Homo sapiens
tgcttgtgttgggccccaggg

SEQ ID NO: 442667 - DNA, 16 bp, Homo sapiens
tgcttgttccctctcc

SEQ ID NO: 442668 - DNA, 18 bp, Homo sapiens
tgcttgtttatgatattt

SEQ ID NO: 442669 - DNA, 13 bp, Homo sapiens
tgctttacaggat

SEQ ID NO: 442670 - DNA, 22 bp, Homo sapiens
tgctttacaggatcatgtaaat

SEQ ID NO: 442671 - DNA, 11 bp, Homo sapiens
tgctttactgg

SEQ ID NO: 442672 - DNA, 13 bp, Homo sapiens
tgctttagagaca

SEQ ID NO: 442673 - DNA, 17 bp, Homo sapiens
tgctttaggctcacggc

SEQ ID NO: 442674 - DNA, 20 bp, Homo sapiens
tgctttataccccatttgat

SEQ ID NO: 442675 - DNA, 22 bp, Homo sapiens
tgctttataccccatttgattt

SEQ ID NO: 442676 - DNA, 15 bp, Homo sapiens
tgctttcaacttaaa

SEQ ID NO: 442677 - DNA, 11 bp, Homo sapiens
tgctttctctt

SEQ ID NO: 442678 - DNA, 15 bp, Homo sapiens
tgctttctctttcag

SEQ ID NO: 442679 - DNA, 14 bp, Homo sapiens
tgctttctgaactc

SEQ ID NO: 442680 - DNA, 20 bp, Homo sapiens
tgctttctgaactcgcttct

SEQ ID NO: 442681 - DNA, 16 bp, Homo sapiens
tgctttctgcatgctt

SEQ ID NO: 442682 - DNA, 20 bp, Homo sapiens
tgctttgaaactagacttga

SEQ ID NO: 442683 - DNA, 22 bp, Homo sapiens
tgctttgaagcagttgtgtcag

SEQ ID NO: 442684 - DNA, 18 bp, Homo sapiens
tgctttgattgttcatat

SEQ ID NO: 442685 - DNA, 21 bp, Homo sapiens
tgctttgctgctatgaaaatg

SEQ ID NO: 442686 - DNA, 23 bp, Homo sapiens
tgctttgctggagtcctgttctc

SEQ ID NO: 442687 - DNA, 18 bp, Homo sapiens
tgctttggatacacacat

SEQ ID NO: 442688 - DNA, 20 bp, Homo sapiens
tgctttgggaggccaaggca

SEQ ID NO: 442689 - DNA, 17 bp, Homo sapiens
tgctttgggattttctt

SEQ ID NO: 442690 - DNA, 17 bp, Homo sapiens
tgctttgggctgccctg

SEQ ID NO: 442691 - DNA, 21 bp, Homo sapiens
tgctttgggctgccctggtgc

SEQ ID NO: 442692 - DNA, 15 bp, Homo sapiens
tgctttgggctttgc

SEQ ID NO: 442693 - DNA, 21 bp, Homo sapiens
tgctttgggctttgcaggctc

SEQ ID NO: 442694 - DNA, 16 bp, Homo sapiens
tgctttgtgtgattga

SEQ ID NO: 442695 - DNA, 16 bp, Homo sapiens
tgctttgttaatgaaa

SEQ ID NO: 442696 - DNA, 16 bp, Homo sapiens
tgctttgtttccttct

SEQ ID NO: 442697 - DNA, 18 bp, Homo sapiens
tgcttttatatggcccag

SEQ ID NO: 442698 - DNA, 21 bp, Homo sapiens
tgcttttatatggcccagcct

SEQ ID NO: 442699 - DNA, 21 bp, Homo sapiens
tggaggttctcagagccaagt

SEQ ID NO: 442700 - DNA, 20 bp, Homo sapiens
tggaggttgagtgagccggg

SEQ ID NO: 442701 - DNA, 15 bp, Homo sapiens
tggagtactatattt

SEQ ID NO: 442702 - DNA, 14 bp, Homo sapiens
tggagtcaggcttc

SEQ ID NO: 442703 - DNA, 22 bp, Homo sapiens
tggagtcagtaggtccaagggc

SEQ ID NO: 442704 - DNA, 14 bp, Homo sapiens
tggagtcctgttct

SEQ ID NO: 442705 - DNA, 18 bp, Homo sapiens
tggagtcctgttctcaga

SEQ ID NO: 442706 - DNA, 23 bp, Homo sapiens
tggagtcctgttctcagagctcc

SEQ ID NO: 442707 - DNA, 17 bp, Homo sapiens
tggagtgcagggaggag

SEQ ID NO: 442708 - DNA, 19 bp, Homo sapiens
tggagtgcagggaggagag

SEQ ID NO: 442709 - DNA, 12 bp, Homo sapiens
tggagtgcgctc

SEQ ID NO: 442710 - DNA, 16 bp, Homo sapiens
tggagtgctgcttgtg

SEQ ID NO: 442711 - DNA, 15 bp, Homo sapiens
tggagtgctggctcc

SEQ ID NO: 442712 - DNA, 20 bp, Homo sapiens
tggagtggaaggtctattgg

SEQ ID NO: 442713 - DNA, 11 bp, Homo sapiens
tggagtggagg

SEQ ID NO: 442714 - DNA, 13 bp, Homo sapiens
tggagtggaggca

SEQ ID NO: 442715 - DNA, 17 bp, Homo sapiens
tggagtggaggcattgt

SEQ ID NO: 442716 - DNA, 17 bp, Homo sapiens
tggagtggggcagtaga

SEQ ID NO: 442717 - DNA, 19 bp, Homo sapiens
tggagtggtaacaagagga

SEQ ID NO: 442718 - DNA, 22 bp, Homo sapiens
tggagtgtgtgggggtctggga

SEQ ID NO: 442719 - DNA, 12 bp, Homo sapiens
tggagtgtttga

SEQ ID NO: 442720 - DNA, 20 bp, Homo sapiens
tggagtgttttagttcttgg

SEQ ID NO: 442721 - DNA, 20 bp, Homo sapiens
tggagttacattaatgttaa

SEQ ID NO: 442722 - DNA, 13 bp, Homo sapiens
tggagttcagaga

SEQ ID NO: 442723 - DNA, 17 bp, Homo sapiens
tggagttcatcttgaat

SEQ ID NO: 442724 - DNA, 20 bp, Homo sapiens
tggataaaaaagaaaacatt

SEQ ID NO: 442725 - DNA, 22 bp, Homo sapiens
tggataaaacattagaagaaaa

SEQ ID NO: 442726 - DNA, 13 bp, Homo sapiens
tggataaatcatt

SEQ ID NO: 442727 - DNA, 15 bp, Homo sapiens
tggataaatttgaac

SEQ ID NO: 442728 - DNA, 21 bp, Homo sapiens
tggataaatttgaactccatg

SEQ ID NO: 442729 - DNA, 23 bp, Homo sapiens
tggataatcttcggccaatttat

SEQ ID NO: 442730 - DNA, 16 bp, Homo sapiens
tggatagtagatctgt

SEQ ID NO: 442731 - DNA, 22 bp, Homo sapiens
tggatcaaaatctgtagagcag

SEQ ID NO: 442732 - DNA, 24 bp, Homo sapiens
tggatcaaaatctgtagagcaggg

SEQ ID NO: 442733 - DNA, 12 bp, Homo sapiens
tggatcaagctt

SEQ ID NO: 442734 - DNA, 18 bp, Homo sapiens
tggatcaagcttgtgtac

SEQ ID NO: 442735 - DNA, 19 bp, Homo sapiens
tggatcaagcttgtgtact

SEQ ID NO: 442736 - DNA, 20 bp, Homo sapiens
tggatccatacaaaactatc

SEQ ID NO: 442737 - DNA, 20 bp, Homo sapiens
tggatccccagtgaaaacta

SEQ ID NO: 442738 - DNA, 17 bp, Homo sapiens
tggatcctgtgtggaga

SEQ ID NO: 442739 - DNA, 18 bp, Homo sapiens
tggatccttgtcagttgt

SEQ ID NO: 442740 - DNA, 15 bp, Homo sapiens
tggatctccccactc

SEQ ID NO: 442741 - DNA, 15 bp, Homo sapiens
tggatctgctccatg

SEQ ID NO: 442742 - DNA, 17 bp, Homo sapiens
tggatctgctccatgca

SEQ ID NO: 442743 - DNA, 14 bp, Homo sapiens
tggatctgggcaca

SEQ ID NO: 442744 - DNA, 15 bp, Homo sapiens
tggatgaaattttct

SEQ ID NO: 442745 - DNA, 17 bp, Homo sapiens
tggatgaaattttctag

SEQ ID NO: 442746 - DNA, 18 bp, Homo sapiens
tggatgaaattttctaga

SEQ ID NO: 442747 - DNA, 20 bp, Homo sapiens
tggatgactcggtctgagaa

SEQ ID NO: 442748 - DNA, 20 bp, Homo sapiens
tggatgagacttccaaacct

SEQ ID NO: 442749 - DNA, 23 bp, Homo sapiens
tggatggccgggctgctgctgat

SEQ ID NO: 442750 - DNA, 17 bp, Homo sapiens
tggatgggagtgagaca

SEQ ID NO: 442751 - DNA, 14 bp, Homo sapiens
tggatggggcccag

SEQ ID NO: 442752 - DNA, 15 bp, Homo sapiens
tggatggggcccagg

SEQ ID NO: 442753 - DNA, 15 bp, Homo sapiens
tggatgtagatacag

SEQ ID NO: 442754 - DNA, 14 bp, Homo sapiens
tggatgtttcttct

SEQ ID NO: 442755 - DNA, 16 bp, Homo sapiens
tggatgtttcttcttt

SEQ ID NO: 442756 - DNA, 14 bp, Homo sapiens
tggattaaatggca

SEQ ID NO: 442757 - DNA, 21 bp, Homo sapiens
tggattaaatggcacctgtat

SEQ ID NO: 442758 - DNA, 19 bp, Homo sapiens
tggattattcatttaaaat

SEQ ID NO: 442759 - DNA, 13 bp, Homo sapiens
tggattcacttct

SEQ ID NO: 442760 - DNA, 20 bp, Homo sapiens
tggattccaaagcattttca

SEQ ID NO: 442761 - DNA, 13 bp, Homo sapiens
tggattcctaagc

SEQ ID NO: 442762 - DNA, 16 bp, Homo sapiens
tggattcctaagcagt

SEQ ID NO: 442763 - DNA, 22 bp, Homo sapiens
tggattcctaagcagtgcttgt

SEQ ID NO: 442764 - DNA, 12 bp, Homo sapiens
tggattctcaga

SEQ ID NO: 442765 - DNA, 13 bp, Homo sapiens
tggattctcagat

SEQ ID NO: 442766 - DNA, 15 bp, Homo sapiens
tggattctcagatat

SEQ ID NO: 442767 - DNA, 16 bp, Homo sapiens
tggattctcagatatt

SEQ ID NO: 442768 - DNA, 21 bp, Homo sapiens
tggattgcacgtggcctcttg

SEQ ID NO: 442769 - DNA, 14 bp, Homo sapiens
tggattgggctgca

SEQ ID NO: 442770 - DNA, 19 bp, Homo sapiens
tggatttaaaaatgccaaa

SEQ ID NO: 442771 - DNA, 20 bp, Homo sapiens
tggatttccttctaacatgt

SEQ ID NO: 442772 - DNA, 14 bp, Homo sapiens
tggatttcttccta

SEQ ID NO: 442773 - DNA, 17 bp, Homo sapiens
tggatttgacacactca

SEQ ID NO: 442774 - DNA, 18 bp, Homo sapiens
tggattttctttctatgt

SEQ ID NO: 442775 - DNA, 23 bp, Homo sapiens
tggattttctttctatgtagaac

SEQ ID NO: 442776 - DNA, 20 bp, Homo sapiens
tggcaaaagacatcctcaaa

SEQ ID NO: 442777 - DNA, 15 bp, Homo sapiens
tggcaaaataaagaa

SEQ ID NO: 442778 - DNA, 16 bp, Homo sapiens
tggcaaaatatggttt

SEQ ID NO: 442779 - DNA, 14 bp, Homo sapiens
tggcaaacatgtgc

SEQ ID NO: 442780 - DNA, 12 bp, Homo sapiens
tggcaaacattt

SEQ ID NO: 442781 - DNA, 13 bp, Homo sapiens
tggcaaacattta

SEQ ID NO: 442782 - DNA, 14 bp, Homo sapiens
tggcaaagtgctgt

SEQ ID NO: 442783 - DNA, 17 bp, Homo sapiens
tggcaaattaacttgag

SEQ ID NO: 442784 - DNA, 20 bp, Homo sapiens
tggcaaattaacttgagttt

SEQ ID NO: 442785 - DNA, 20 bp, Homo sapiens
tggcaacagaaaacaattgt

SEQ ID NO: 442786 - DNA, 13 bp, Homo sapiens
tggcaacagaagc

SEQ ID NO: 442787 - DNA, 15 bp, Homo sapiens
tggcaacagaagcag

SEQ ID NO: 442788 - DNA, 14 bp, Homo sapiens
tggcaactgtggaa

SEQ ID NO: 442789 - DNA, 23 bp, Homo sapiens
tggcaagcagggaaagctccacg

SEQ ID NO: 442790 - DNA, 19 bp, Homo sapiens
tggcaaggtgggttccagg

SEQ ID NO: 442791 - DNA, 22 bp, Homo sapiens
tggcaaggtgggttccagggac

SEQ ID NO: 442792 - DNA, 15 bp, Homo sapiens
tggcaattcacaagt

SEQ ID NO: 442793 - DNA, 19 bp, Homo sapiens
tggcaattttgtaaattga

SEQ ID NO: 442794 - DNA, 20 bp, Homo sapiens
tggcacaatctcacacagct

SEQ ID NO: 442795 - DNA, 19 bp, Homo sapiens
tggcacagaaagggcagct

SEQ ID NO: 442796 - DNA, 23 bp, Homo sapiens
tggcacattagggtgggcgtgct

SEQ ID NO: 442797 - DNA, 19 bp, Homo sapiens
tggcaccagccccctggat

SEQ ID NO: 442798 - DNA, 13 bp, Homo sapiens
tggcacccactcc

SEQ ID NO: 442799 - DNA, 15 bp, Homo sapiens
tggcacccccatgct

SEQ ID NO: 442800 - DNA, 16 bp, Homo sapiens
tggcacccccatgctg

SEQ ID NO: 442801 - DNA, 19 bp, Homo sapiens
tggcacccccatgctgcct

SEQ ID NO: 442802 - DNA, 16 bp, Homo sapiens
tggcaccgccttctct

SEQ ID NO: 442803 - DNA, 15 bp, Homo sapiens
tggcacctcctgaga

SEQ ID NO: 442804 - DNA, 17 bp, Homo sapiens
tggcacctcctgagaag

SEQ ID NO: 442805 - DNA, 18 bp, Homo sapiens
tggcacctcctgagaagg

SEQ ID NO: 442806 - DNA, 12 bp, Homo sapiens
tggcacctgtat

SEQ ID NO: 442807 - DNA, 15 bp, Homo sapiens
tggcacgtgcctgta

SEQ ID NO: 442808 - DNA, 22 bp, Homo sapiens
tggcactgagatatttattgtt

SEQ ID NO: 442809 - DNA, 18 bp, Homo sapiens
tggcactgatgggcactg

SEQ ID NO: 442810 - DNA, 15 bp, Homo sapiens
tggcactggatgcag

SEQ ID NO: 442811 - DNA, 20 bp, Homo sapiens
tggcactggcattgtccctg

SEQ ID NO: 442812 - DNA, 22 bp, Homo sapiens
tggcactttagtgattgctttt

SEQ ID NO: 442813 - DNA, 12 bp, Homo sapiens
tggcagaaaaga

SEQ ID NO: 442814 - DNA, 23 bp, Homo sapiens
tggcagaaaagaggagaccctgg

SEQ ID NO: 442815 - DNA, 20 bp, Homo sapiens
tggcagaactgagctcctct

SEQ ID NO: 442816 - DNA, 16 bp, Homo sapiens
tggcagaagtgtttca

SEQ ID NO: 442817 - DNA, 14 bp, Homo sapiens
tggcagagaagaga

SEQ ID NO: 442818 - DNA, 16 bp, Homo sapiens
tggcagagaaggcctc

SEQ ID NO: 442819 - DNA, 19 bp, Homo sapiens
tggcagagaaggcctcttg

SEQ ID NO: 442820 - DNA, 12 bp, Homo sapiens
tggcagagggga

SEQ ID NO: 442821 - DNA, 19 bp, Homo sapiens
tggcagataatcagcctct

SEQ ID NO: 442822 - DNA, 14 bp, Homo sapiens
tggcagcaaaggaa

SEQ ID NO: 442823 - DNA, 19 bp, Homo sapiens
tggcagcaggcctgttgct

SEQ ID NO: 442824 - DNA, 22 bp, Homo sapiens
tggcagcaggcctgttgctttt

SEQ ID NO: 442825 - DNA, 14 bp, Homo sapiens
tggcagccatgcct

SEQ ID NO: 442826 - DNA, 16 bp, Homo sapiens
tggcagccgtgccttc

SEQ ID NO: 442827 - DNA, 18 bp, Homo sapiens
tggcagccgtgccttcag

SEQ ID NO: 442828 - DNA, 17 bp, Homo sapiens
tggcagcctcagggctt

SEQ ID NO: 442829 - DNA, 20 bp, Homo sapiens
tgggactggagtcagatgag

SEQ ID NO: 442830 - DNA, 12 bp, Homo sapiens
tgggactggccc

SEQ ID NO: 442831 - DNA, 12 bp, Homo sapiens
tgggactgggag

SEQ ID NO: 442832 - DNA, 15 bp, Homo sapiens
tgggactgggagggc

SEQ ID NO: 442833 - DNA, 15 bp, Homo sapiens
tgggacttattacaa

SEQ ID NO: 442834 - DNA, 19 bp, Homo sapiens
tgggacttccttgctctcc

SEQ ID NO: 442835 - DNA, 20 bp, Homo sapiens
tgggacttccttgctctccc

SEQ ID NO: 442836 - DNA, 22 bp, Homo sapiens
tgggagaaccaaaaagaggcta

SEQ ID NO: 442837 - DNA, 23 bp, Homo sapiens
tgggagaacctcgttgacatgca

SEQ ID NO: 442838 - DNA, 23 bp, Homo sapiens
tgggagaactaacagaggagaaa

SEQ ID NO: 442839 - DNA, 19 bp, Homo sapiens
tgggagaaggtgcttgggc

SEQ ID NO: 442840 - DNA, 17 bp, Homo sapiens
tgggagaagtggcccct

SEQ ID NO: 442841 - DNA, 15 bp, Homo sapiens
tgggagagacttgtt

SEQ ID NO: 442842 - DNA, 21 bp, Homo sapiens
tgggagagacttgttttggat

SEQ ID NO: 442843 - DNA, 14 bp, Homo sapiens
tgggagagcccctg

SEQ ID NO: 442844 - DNA, 18 bp, Homo sapiens
tgggagagcccctggggc

SEQ ID NO: 442845 - DNA, 13 bp, Homo sapiens
tgggagaggaagc

SEQ ID NO: 442846 - DNA, 17 bp, Homo sapiens
tgggagaggcagaaagg

SEQ ID NO: 442847 - DNA, 14 bp, Homo sapiens
tgggagatgaaaac

SEQ ID NO: 442848 - DNA, 15 bp, Homo sapiens
tgggagatgaaaacc

SEQ ID NO: 442849 - DNA, 16 bp, Homo sapiens
tgggagatgctgggac

SEQ ID NO: 442850 - DNA, 13 bp, Homo sapiens
tgggagcaaaaga

SEQ ID NO: 442851 - DNA, 21 bp, Homo sapiens
tgggagcaaaataaggaagag

SEQ ID NO: 442852 - DNA, 21 bp, Homo sapiens
tgggagccctgaccttggctg

SEQ ID NO: 442853 - DNA, 16 bp, Homo sapiens
tgggagcctcagactc

SEQ ID NO: 442854 - DNA, 18 bp, Homo sapiens
tgggagcctcgcccctcc

SEQ ID NO: 442855 - DNA, 19 bp, Homo sapiens
tgggagcctcgcccctcca

SEQ ID NO: 442856 - DNA, 23 bp, Homo sapiens
tgggagcctcgcccctccagtgt

SEQ ID NO: 442857 - DNA, 18 bp, Homo sapiens
tgggagcctgaggcagga

SEQ ID NO: 442858 - DNA, 20 bp, Homo sapiens
tgggagcctgaggcaggaga

SEQ ID NO: 442859 - DNA, 13 bp, Homo sapiens
tgggaggccaagg

SEQ ID NO: 442860 - DNA, 15 bp, Homo sapiens
tgggaggccaaggca

SEQ ID NO: 442861 - DNA, 17 bp, Homo sapiens
tgggaggccaaggcagg

SEQ ID NO: 442862 - DNA, 20 bp, Homo sapiens
tgggaggccaaggtgggcgg

SEQ ID NO: 442863 - DNA, 17 bp, Homo sapiens
tgggaggccgaggcacg

SEQ ID NO: 442864 - DNA, 16 bp, Homo sapiens
tgggaggcgtgccccc

SEQ ID NO: 442865 - DNA, 23 bp, Homo sapiens
tgggaggctcccagacccagggc

SEQ ID NO: 442866 - DNA, 18 bp, Homo sapiens
tgggagggatagaggggg

SEQ ID NO: 442867 - DNA, 12 bp, Homo sapiens
tgggagggccca

SEQ ID NO: 442868 - DNA, 23 bp, Homo sapiens
tgggagggcgaggcgggggagcc

SEQ ID NO: 442869 - DNA, 13 bp, Homo sapiens
tgggagggggccc

SEQ ID NO: 442870 - DNA, 16 bp, Homo sapiens
tgggaggggtgttcca

SEQ ID NO: 442871 - DNA, 14 bp, Homo sapiens
tgggagtcagagcc

SEQ ID NO: 442872 - DNA, 15 bp, Homo sapiens
tgggagtcagagccc

SEQ ID NO: 442873 - DNA, 20 bp, Homo sapiens
tgggagtcagggagccctgg

SEQ ID NO: 442874 - DNA, 16 bp, Homo sapiens
tgggagtccactttcc

SEQ ID NO: 442875 - DNA, 21 bp, Homo sapiens
tgggagtccactttcctctct

SEQ ID NO: 442876 - DNA, 13 bp, Homo sapiens
tgggagtgggaga

SEQ ID NO: 442877 - DNA, 17 bp, Homo sapiens
tgggagtgggagaggaa

SEQ ID NO: 442878 - DNA, 19 bp, Homo sapiens
tgggagtgggagaggaagc

SEQ ID NO: 442879 - DNA, 17 bp, Homo sapiens
tgggagtgggcacctca

SEQ ID NO: 442880 - DNA, 14 bp, Homo sapiens
tgggagtgttctgt

SEQ ID NO: 442881 - DNA, 15 bp, Homo sapiens
tgggagtgttctgtg

SEQ ID NO: 442882 - DNA, 17 bp, Homo sapiens
tgggagttcagctgctt

SEQ ID NO: 442883 - DNA, 19 bp, Homo sapiens
tgggagttcctagcaagtt

SEQ ID NO: 442884 - DNA, 15 bp, Homo sapiens
tgggatatgtggtgt

SEQ ID NO: 442885 - DNA, 16 bp, Homo sapiens
tgggatatgtggtgta

SEQ ID NO: 442886 - DNA, 13 bp, Homo sapiens
tgggatcagcctc

SEQ ID NO: 442887 - DNA, 15 bp, Homo sapiens
tgggatccagagaga

SEQ ID NO: 442888 - DNA, 14 bp, Homo sapiens
tgggatcctccctc

SEQ ID NO: 442889 - DNA, 23 bp, Homo sapiens
tgggatcggacctcagtttctgt

SEQ ID NO: 442890 - DNA, 23 bp, Homo sapiens
tgggatgacaggcgcctgccatc

SEQ ID NO: 442891 - DNA, 16 bp, Homo sapiens
tgggatgagcctctcc

SEQ ID NO: 442892 - DNA, 13 bp, Homo sapiens
tgggatgtagaac

SEQ ID NO: 442893 - DNA, 16 bp, Homo sapiens
tgggatgttcagcact

SEQ ID NO: 442894 - DNA, 20 bp, Homo sapiens
tgggatgttcagcactgtcc

SEQ ID NO: 442895 - DNA, 19 bp, Homo sapiens
tgggattatgggtcacagg

SEQ ID NO: 442896 - DNA, 18 bp, Homo sapiens
tgggattcaggaatgggc

SEQ ID NO: 442897 - DNA, 21 bp, Homo sapiens
tgggattgggggctggtgcca

SEQ ID NO: 442898 - DNA, 21 bp, Homo sapiens
tgggatttcttcgctgctcta

SEQ ID NO: 442899 - DNA, 19 bp, Homo sapiens
tgggatttgaactgagccg

SEQ ID NO: 442900 - DNA, 16 bp, Homo sapiens
tgggattttcttttct

SEQ ID NO: 442901 - DNA, 17 bp, Homo sapiens
tgggattttcttttctg

SEQ ID NO: 442902 - DNA, 22 bp, Homo sapiens
tgggcaaagccacaaggctggc

SEQ ID NO: 442903 - DNA, 18 bp, Homo sapiens
tgggcaaggcctttggct

SEQ ID NO: 442904 - DNA, 22 bp, Homo sapiens
tgggcaaggtgagggatgccat

SEQ ID NO: 442905 - DNA, 13 bp, Homo sapiens
tgggcaagtccct

SEQ ID NO: 442906 - DNA, 21 bp, Homo sapiens
tgggcaagtgaggcaagagaa

SEQ ID NO: 442907 - DNA, 13 bp, Homo sapiens
tgggcacctcaga

SEQ ID NO: 442908 - DNA, 21 bp, Homo sapiens
tgggcacctcagaaagtcacc

SEQ ID NO: 442909 - DNA, 23 bp, Homo sapiens
tgggcacctcatggactccagga

SEQ ID NO: 442910 - DNA, 15 bp, Homo sapiens
tgggcacctggggag

SEQ ID NO: 442911 - DNA, 19 bp, Homo sapiens
tgggcacgctgtgggcagg

SEQ ID NO: 442912 - DNA, 12 bp, Homo sapiens
tgggcagaagat

SEQ ID NO: 442913 - DNA, 16 bp, Homo sapiens
tgggcagaagatagag

SEQ ID NO: 442914 - DNA, 13 bp, Homo sapiens
tgggcagagcctg

SEQ ID NO: 442915 - DNA, 19 bp, Homo sapiens
tgggcagaggggagaggaa

SEQ ID NO: 442916 - DNA, 21 bp, Homo sapiens
tgggcagaggggagaggaagc

SEQ ID NO: 442917 - DNA, 22 bp, Homo sapiens
tgggcagatcatttgaggccag

SEQ ID NO: 442918 - DNA, 16 bp, Homo sapiens
tgggcagccaggctgc

SEQ ID NO: 442919 - DNA, 16 bp, Homo sapiens
tgggcagccatgagaa

SEQ ID NO: 442920 - DNA, 13 bp, Homo sapiens
tgggcagcccaga

SEQ ID NO: 442921 - DNA, 17 bp, Homo sapiens
tgggcagctgaacagtg

SEQ ID NO: 442922 - DNA, 12 bp, Homo sapiens
tgggcagctggg

SEQ ID NO: 442923 - DNA, 15 bp, Homo sapiens
tgggcagctgggccc

SEQ ID NO: 442924 - DNA, 16 bp, Homo sapiens
tgggcaggacctcaga

SEQ ID NO: 442925 - DNA, 12 bp, Homo sapiens
tgggcaggcggt

SEQ ID NO: 442926 - DNA, 21 bp, Homo sapiens
tgggcagggaggcaccattca

SEQ ID NO: 442927 - DNA, 12 bp, Homo sapiens
tgggcagggccg

SEQ ID NO: 442928 - DNA, 21 bp, Homo sapiens
tgggcagggccgcagggcgct

SEQ ID NO: 442929 - DNA, 13 bp, Homo sapiens
tgggcaggtcctg

SEQ ID NO: 442930 - DNA, 20 bp, Homo sapiens
tgggcaggtcctggggaggc

SEQ ID NO: 442931 - DNA, 20 bp, Homo sapiens
tgggcatccacccagtgctg

SEQ ID NO: 442932 - DNA, 16 bp, Homo sapiens
tgggcatccccagccc

SEQ ID NO: 442933 - DNA, 17 bp, Homo sapiens
tgggcatccccagcccc

SEQ ID NO: 442934 - DNA, 22 bp, Homo sapiens
tgggcatgccaccctcacacac

SEQ ID NO: 442935 - DNA, 13 bp, Homo sapiens
tgggcatggggtg

SEQ ID NO: 442936 - DNA, 22 bp, Homo sapiens
tgggcatggggtgggcctctgg

SEQ ID NO: 442937 - DNA, 16 bp, Homo sapiens
tgggcatggtggggca

SEQ ID NO: 442938 - DNA, 18 bp, Homo sapiens
tgggcattgggctgacac

SEQ ID NO: 442939 - DNA, 14 bp, Homo sapiens
tgggccaagccagg

SEQ ID NO: 442940 - DNA, 19 bp, Homo sapiens
tgggccacacccaggaagg

SEQ ID NO: 442941 - DNA, 22 bp, Homo sapiens
tgggccacacccaggaagggaa

SEQ ID NO: 442942 - DNA, 21 bp, Homo sapiens
tgggccaccagctccactggc

SEQ ID NO: 442943 - DNA, 14 bp, Homo sapiens
tgggccacccacca

SEQ ID NO: 442944 - DNA, 16 bp, Homo sapiens
tgggccacgattttaa

SEQ ID NO: 442945 - DNA, 18 bp, Homo sapiens
tgggccacgattttaaaa

SEQ ID NO: 442946 - DNA, 13 bp, Homo sapiens
tgggccagagaag

SEQ ID NO: 442947 - DNA, 14 bp, Homo sapiens
tgggccagcccctc

SEQ ID NO: 442948 - DNA, 14 bp, Homo sapiens
tgggccagtgtggg

SEQ ID NO: 442949 - DNA, 23 bp, Homo sapiens
tgggcccaagacagatgccccag

SEQ ID NO: 442950 - DNA, 12 bp, Homo sapiens
tgggcccagaag

SEQ ID NO: 442951 - DNA, 13 bp, Homo sapiens
tgggcccagctgg

SEQ ID NO: 442952 - DNA, 15 bp, Homo sapiens
tgggcccagctgggc

SEQ ID NO: 442953 - DNA, 12 bp, Homo sapiens
tgggcccaggca

SEQ ID NO: 442954 - DNA, 20 bp, Homo sapiens
tgggcccaggcagcacctgg

SEQ ID NO: 442955 - DNA, 14 bp, Homo sapiens
tgggcccagtagcc

SEQ ID NO: 442956 - DNA, 14 bp, Homo sapiens
tgggccccacctac

SEQ ID NO: 442957 - DNA, 22 bp, Homo sapiens
tgggccccagaccccagggcag

SEQ ID NO: 442958 - DNA, 12 bp, Homo sapiens
tgggccccagcc

SEQ ID NO: 442959 - DNA, 16 bp, Homo sapiens
tgggccccagccgtgg

SEQ ID NO: 442960 - DNA, 20 bp, Homo sapiens
tggtacagcagggtcttgct

SEQ ID NO: 442961 - DNA, 20 bp, Homo sapiens
tggtacaggaaggcttgcag

SEQ ID NO: 442962 - DNA, 16 bp, Homo sapiens
tggtacattcacagca

SEQ ID NO: 442963 - DNA, 14 bp, Homo sapiens
tggtaccagccctg

SEQ ID NO: 442964 - DNA, 20 bp, Homo sapiens
tggtaccagccctggggctg

SEQ ID NO: 442965 - DNA, 15 bp, Homo sapiens
tggtaccctggcaga

SEQ ID NO: 442966 - DNA, 18 bp, Homo sapiens
tggtaccctggcagagaa

SEQ ID NO: 442967 - DNA, 15 bp, Homo sapiens
tggtacgtgggtacc

SEQ ID NO: 442968 - DNA, 20 bp, Homo sapiens
tggtactactagatgtcttt

SEQ ID NO: 442969 - DNA, 17 bp, Homo sapiens
tggtactcattaaaaaa

SEQ ID NO: 442970 - DNA, 13 bp, Homo sapiens
tggtactctccta

SEQ ID NO: 442971 - DNA, 13 bp, Homo sapiens
tggtagagattca

SEQ ID NO: 442972 - DNA, 17 bp, Homo sapiens
tggtagaggtgtgtgcc

SEQ ID NO: 442973 - DNA, 14 bp, Homo sapiens
tggtagagtttatt

SEQ ID NO: 442974 - DNA, 18 bp, Homo sapiens
tggtagcagggtctttgt

SEQ ID NO: 442975 - DNA, 16 bp, Homo sapiens
tggtagcatgaccttt

SEQ ID NO: 442976 - DNA, 13 bp, Homo sapiens
tggtagctctgag

SEQ ID NO: 442977 - DNA, 14 bp, Homo sapiens
tggtaggttctgtc

SEQ ID NO: 442978 - DNA, 21 bp, Homo sapiens
tggtagttctgtgcctccccc

SEQ ID NO: 442979 - DNA, 20 bp, Homo sapiens
tggtatctttaattgtatct

SEQ ID NO: 442980 - DNA, 19 bp, Homo sapiens
tggtatgaacttgaggaca

SEQ ID NO: 442981 - DNA, 21 bp, Homo sapiens
tggtatgaacttgaggacaca

SEQ ID NO: 442982 - DNA, 13 bp, Homo sapiens
tggtatgtctctt

SEQ ID NO: 442983 - DNA, 20 bp, Homo sapiens
tggtatgtgaattgaagtca

SEQ ID NO: 442984 - DNA, 20 bp, Homo sapiens
tggtattacactgtatttgt

SEQ ID NO: 442985 - DNA, 19 bp, Homo sapiens
tggtatttgagacattcca

SEQ ID NO: 442986 - DNA, 20 bp, Homo sapiens
tggtattttcgtgcatttgt

SEQ ID NO: 442987 - DNA, 17 bp, Homo sapiens
tggtcaacccgctgctt

SEQ ID NO: 442988 - DNA, 15 bp, Homo sapiens
tggtcaagattttga

SEQ ID NO: 442989 - DNA, 20 bp, Homo sapiens
tggtcacaggactctgcctc

SEQ ID NO: 442990 - DNA, 22 bp, Homo sapiens
tggtcactgccatggaggcaca

SEQ ID NO: 442991 - DNA, 18 bp, Homo sapiens
tggtcagcagagccgccc

SEQ ID NO: 442992 - DNA, 19 bp, Homo sapiens
tggtcagctcccttctctg

SEQ ID NO: 442993 - DNA, 15 bp, Homo sapiens
tggtcagcttttgtt

SEQ ID NO: 442994 - DNA, 15 bp, Homo sapiens
tggtcagggcagggc

SEQ ID NO: 442995 - DNA, 21 bp, Homo sapiens
tggtcaggttatactcctcct

SEQ ID NO: 442996 - DNA, 18 bp, Homo sapiens
tggtcatttggtggctct

SEQ ID NO: 442997 - DNA, 19 bp, Homo sapiens
tggtcatttggtggctcta

SEQ ID NO: 442998 - DNA, 20 bp, Homo sapiens
tggtccaacagtttgatgct

SEQ ID NO: 442999 - DNA, 21 bp, Homo sapiens
tggtccaacagtttgatgctg

SEQ ID NO: 443000 - DNA, 13 bp, Homo sapiens
tggtccacacacc

SEQ ID NO: 443001 - DNA, 15 bp, Homo sapiens
tggtccacattctgc

SEQ ID NO: 443002 - DNA, 18 bp, Homo sapiens
tggtccacattctgctgc

SEQ ID NO: 443003 - DNA, 20 bp, Homo sapiens
tggtccacattctgctgccc

SEQ ID NO: 443004 - DNA, 21 bp, Homo sapiens
tggtccagaagaaattattta

SEQ ID NO: 443005 - DNA, 13 bp, Homo sapiens
tggtccagattgt

SEQ ID NO: 443006 - DNA, 19 bp, Homo sapiens
tggtccagggaagctggcc

SEQ ID NO: 443007 - DNA, 21 bp, Homo sapiens
tggtccagggctagtgacttg

SEQ ID NO: 443008 - DNA, 20 bp, Homo sapiens
tggtccatttcatgtgatct

SEQ ID NO: 443009 - DNA, 17 bp, Homo sapiens
tggtcccaggaagcagg

SEQ ID NO: 443010 - DNA, 23 bp, Homo sapiens
tggtccctcgtccacaggggcag

SEQ ID NO: 443011 - DNA, 19 bp, Homo sapiens
tggtcctaagtccctgccc

SEQ ID NO: 443012 - DNA, 20 bp, Homo sapiens
tggtcctgtgtgcagtgaag

SEQ ID NO: 443013 - DNA, 16 bp, Homo sapiens
tggtcctgttaaccct

SEQ ID NO: 443014 - DNA, 17 bp, Homo sapiens
tggtctattttgatttt

SEQ ID NO: 443015 - DNA, 12 bp, Homo sapiens
tggtctcagaaa

SEQ ID NO: 443016 - DNA, 22 bp, Homo sapiens
tggtctccatttttcccaggac

SEQ ID NO: 443017 - DNA, 12 bp, Homo sapiens
tggtctcctctg

SEQ ID NO: 443018 - DNA, 20 bp, Homo sapiens
tggtctcctctttgttttgt

SEQ ID NO: 443019 - DNA, 13 bp, Homo sapiens
tggtctctttctt

SEQ ID NO: 443020 - DNA, 16 bp, Homo sapiens
tggtctctttctttcc

SEQ ID NO: 443021 - DNA, 13 bp, Homo sapiens
tggtctgaatgtt

SEQ ID NO: 443022 - DNA, 18 bp, Homo sapiens
tggtctgaatgttctgac

SEQ ID NO: 443023 - DNA, 21 bp, Homo sapiens
tggtctgaatgttctgacatt

SEQ ID NO: 443024 - DNA, 14 bp, Homo sapiens
tggtctggagcccc

SEQ ID NO: 443025 - DNA, 17 bp, Homo sapiens
tggtctggagcccctat

SEQ ID NO: 443026 - DNA, 19 bp, Homo sapiens
tggtctgggacttccttgc

SEQ ID NO: 443027 - DNA, 13 bp, Homo sapiens
tggtctgttttct

SEQ ID NO: 443028 - DNA, 16 bp, Homo sapiens
tggtcttagctttaca

SEQ ID NO: 443029 - DNA, 14 bp, Homo sapiens
tggtcttggagagg

SEQ ID NO: 443030 - DNA, 15 bp, Homo sapiens
tggtgaaaatgtact

SEQ ID NO: 443031 - DNA, 15 bp, Homo sapiens
tggtgaagtgtggct

SEQ ID NO: 443032 - DNA, 21 bp, Homo sapiens
tggtgacagccttgggccttt

SEQ ID NO: 443033 - DNA, 19 bp, Homo sapiens
tggtgacaggcagacacat

SEQ ID NO: 443034 - DNA, 14 bp, Homo sapiens
tggtgagaattaaa

SEQ ID NO: 443035 - DNA, 13 bp, Homo sapiens
tggtgagctggga

SEQ ID NO: 443036 - DNA, 15 bp, Homo sapiens
tggtgagctgggaag

SEQ ID NO: 443037 - DNA, 21 bp, Homo sapiens
tggtgagctgggaagctgtac

SEQ ID NO: 443038 - DNA, 14 bp, Homo sapiens
tggtgaggaagctc

SEQ ID NO: 443039 - DNA, 13 bp, Homo sapiens
tggtgaggagcac

SEQ ID NO: 443040 - DNA, 15 bp, Homo sapiens
tggtgaggcccagcc

SEQ ID NO: 443041 - DNA, 23 bp, Homo sapiens
tggtgaggcccagcctgtcctgg

SEQ ID NO: 443042 - DNA, 19 bp, Homo sapiens
tggtgaggcttaacaatgt

SEQ ID NO: 443043 - DNA, 18 bp, Homo sapiens
tggtgaggggccactggg

SEQ ID NO: 443044 - DNA, 13 bp, Homo sapiens
tggtgataagtgg

SEQ ID NO: 443045 - DNA, 15 bp, Homo sapiens
tggtgataagtggaa

SEQ ID NO: 443046 - DNA, 17 bp, Homo sapiens
tggtgataagtggaaaa

SEQ ID NO: 443047 - DNA, 18 bp, Homo sapiens
tggtgataagtggaaaaa

SEQ ID NO: 443048 - DNA, 18 bp, Homo sapiens
tggtgatcaattaaatgt

SEQ ID NO: 443049 - DNA, 18 bp, Homo sapiens
tggtgatctgtagacttc

SEQ ID NO: 443050 - DNA, 18 bp, Homo sapiens
tggtgatgcaagtcacta

SEQ ID NO: 443051 - DNA, 14 bp, Homo sapiens
tggtgatgtaaaac

SEQ ID NO: 443052 - DNA, 15 bp, Homo sapiens
tggtgatgtgcctgt

SEQ ID NO: 443053 - DNA, 17 bp, Homo sapiens
tggtgcaattaactctg

SEQ ID NO: 443054 - DNA, 18 bp, Homo sapiens
tggtgcaattaactctgg

SEQ ID NO: 443055 - DNA, 17 bp, Homo sapiens
tggtgcagccccaggac

SEQ ID NO: 443056 - DNA, 22 bp, Homo sapiens
tggtgcagccttcccctccctg

SEQ ID NO: 443057 - DNA, 12 bp, Homo sapiens
tggtgcagtgaa

SEQ ID NO: 443058 - DNA, 15 bp, Homo sapiens
tggtgcatgttcttt

SEQ ID NO: 443059 - DNA, 13 bp, Homo sapiens
tggtgcattacag

SEQ ID NO: 443060 - DNA, 13 bp, Homo sapiens
tggtgccagcctt

SEQ ID NO: 443061 - DNA, 21 bp, Homo sapiens
tggtgccagccttcctctgca

SEQ ID NO: 443062 - DNA, 13 bp, Homo sapiens
tggtgccccacag

SEQ ID NO: 443063 - DNA, 14 bp, Homo sapiens
tggtgccccctggg

SEQ ID NO: 443064 - DNA, 13 bp, Homo sapiens
tggtgcccttgga

SEQ ID NO: 443065 - DNA, 21 bp, Homo sapiens
tggtgcctctggaggcctctg

SEQ ID NO: 443066 - DNA, 14 bp, Homo sapiens
tggtgccttttgtg

SEQ ID NO: 443067 - DNA, 20 bp, Homo sapiens
tggtgcgatcatggctcact

SEQ ID NO: 443068 - DNA, 14 bp, Homo sapiens
tggtgcgctgtgct

SEQ ID NO: 443069 - DNA, 15 bp, Homo sapiens
tggtgcgctgtgctc

SEQ ID NO: 443070 - DNA, 21 bp, Homo sapiens
tggtgcggtaggtgctggcct

SEQ ID NO: 443071 - DNA, 22 bp, Homo sapiens
tggtgcggtaggtgctggcctc

SEQ ID NO: 443072 - DNA, 21 bp, Homo sapiens
tggtgcgtgtggccctgtggg

SEQ ID NO: 443073 - DNA, 13 bp, Homo sapiens
tggtgctgagaag

SEQ ID NO: 443074 - DNA, 15 bp, Homo sapiens
tggtgctgagaagct

SEQ ID NO: 443075 - DNA, 19 bp, Homo sapiens
tggtgctgctgctgctgtg

SEQ ID NO: 443076 - DNA, 18 bp, Homo sapiens
tggtgctggatattttca

SEQ ID NO: 443077 - DNA, 13 bp, Homo sapiens
tggtgctgggact

SEQ ID NO: 443078 - DNA, 14 bp, Homo sapiens
tggtgctgggactg

SEQ ID NO: 443079 - DNA, 16 bp, Homo sapiens
tggtgctgggactgag

SEQ ID NO: 443080 - DNA, 21 bp, Homo sapiens
tggtgctgggactgagccagt

SEQ ID NO: 443081 - DNA, 22 bp, Homo sapiens
tggtgcttacacatctcagacc

SEQ ID NO: 443082 - DNA, 12 bp, Homo sapiens
tggtggaagagg

SEQ ID NO: 443083 - DNA, 23 bp, Homo sapiens
tggtggatggtgacttttgaaga

SEQ ID NO: 443084 - DNA, 17 bp, Homo sapiens
tggtggcacgtgcctgt

SEQ ID NO: 443085 - DNA, 14 bp, Homo sapiens
tggtggccctgggg

SEQ ID NO: 443086 - DNA, 17 bp, Homo sapiens
tggtggccgtcacgctt

SEQ ID NO: 443087 - DNA, 22 bp, Homo sapiens
tggtggcgctttctcctgtgcc

SEQ ID NO: 443088 - DNA, 14 bp, Homo sapiens
tggtggctcatggc

SEQ ID NO: 443089 - DNA, 23 bp, Homo sapiens
tggtgggaaaatgtcccccacct

SEQ ID NO: 443090 - DNA, 15 bp, Homo sapiens
tggtgggaggggtgt

SEQ ID NO: 443091 - DNA, 16 bp, Homo sapiens
tgtagaagaaagcaaa

SEQ ID NO: 443092 - DNA, 17 bp, Homo sapiens
tgtagaagaaagcaaaa

SEQ ID NO: 443093 - DNA, 16 bp, Homo sapiens
tgtagaagagggagaa

SEQ ID NO: 443094 - DNA, 18 bp, Homo sapiens
tgtagaagagggagaagg

SEQ ID NO: 443095 - DNA, 19 bp, Homo sapiens
tgtagaagagggagaagga

SEQ ID NO: 443096 - DNA, 20 bp, Homo sapiens
tgtagacatacttgtacgct

SEQ ID NO: 443097 - DNA, 21 bp, Homo sapiens
tgtagacattatcttttggct

SEQ ID NO: 443098 - DNA, 17 bp, Homo sapiens
tgtagagtggtctattt

SEQ ID NO: 443099 - DNA, 18 bp, Homo sapiens
tgtagatacaatcagctg

SEQ ID NO: 443100 - DNA, 14 bp, Homo sapiens
tgtagatacagatc

SEQ ID NO: 443101 - DNA, 23 bp, Homo sapiens
tgtagatacagatccgcatgtgt

SEQ ID NO: 443102 - DNA, 21 bp, Homo sapiens
tgtagatattgtgaagtacat

SEQ ID NO: 443103 - DNA, 22 bp, Homo sapiens
tgtagatattgtgaagtacata

SEQ ID NO: 443104 - DNA, 22 bp, Homo sapiens
tgtagatattgttttctgtaaa

SEQ ID NO: 443105 - DNA, 17 bp, Homo sapiens
tgtagatgtagcattgt

SEQ ID NO: 443106 - DNA, 21 bp, Homo sapiens
tgtagccatggctcaggcaag

SEQ ID NO: 443107 - DNA, 17 bp, Homo sapiens
tgtagcctgcgtcatgg

SEQ ID NO: 443108 - DNA, 20 bp, Homo sapiens
tgtagcctgcgtcatggctc

SEQ ID NO: 443109 - DNA, 22 bp, Homo sapiens
tgtagctaattaggaagcttga

SEQ ID NO: 443110 - DNA, 16 bp, Homo sapiens
tgtagctattctttga

SEQ ID NO: 443111 - DNA, 23 bp, Homo sapiens
tgtagctcccgagctactctctt

SEQ ID NO: 443112 - DNA, 22 bp, Homo sapiens
tgtagctccctcctcccatctc

SEQ ID NO: 443113 - DNA, 20 bp, Homo sapiens
tgtagctctgcatctcctgt

SEQ ID NO: 443114 - DNA, 20 bp, Homo sapiens
tgtagcttaaaaaaaggaaa

SEQ ID NO: 443115 - DNA, 21 bp, Homo sapiens
tgtagcttaaaaaaaggaaaa

SEQ ID NO: 443116 - DNA, 19 bp, Homo sapiens
tgtagcttccaaatttgaa

SEQ ID NO: 443117 - DNA, 16 bp, Homo sapiens
tgtaggaatctgcctt

SEQ ID NO: 443118 - DNA, 16 bp, Homo sapiens
tgtaggactatataaa

SEQ ID NO: 443119 - DNA, 13 bp, Homo sapiens
tgtaggagagact

SEQ ID NO: 443120 - DNA, 18 bp, Homo sapiens
tgtaggagagactggcca

SEQ ID NO: 443121 - DNA, 17 bp, Homo sapiens
tgtaggcacaaaaccag

SEQ ID NO: 443122 - DNA, 15 bp, Homo sapiens
tgtagggctggacct

SEQ ID NO: 443123 - DNA, 23 bp, Homo sapiens
tgtagggtagcggaaaagttgtc

SEQ ID NO: 443124 - DNA, 16 bp, Homo sapiens
tgtagggttataataa

SEQ ID NO: 443125 - DNA, 17 bp, Homo sapiens
tgtagggttataataat

SEQ ID NO: 443126 - DNA, 17 bp, Homo sapiens
tgtaggtatgaataagt

SEQ ID NO: 443127 - DNA, 21 bp, Homo sapiens
tgtaggtcaatgaaatatttg

SEQ ID NO: 443128 - DNA, 16 bp, Homo sapiens
tgtaggtgatgtttcc

SEQ ID NO: 443129 - DNA, 14 bp, Homo sapiens
tgtaggttgtctaa

SEQ ID NO: 443130 - DNA, 20 bp, Homo sapiens
tgtagtagtcaaggtgctca

SEQ ID NO: 443131 - DNA, 13 bp, Homo sapiens
tgtagtagtctca

SEQ ID NO: 443132 - DNA, 12 bp, Homo sapiens
tgtagtcccagc

SEQ ID NO: 443133 - DNA, 17 bp, Homo sapiens
tgtagtgagaaactgat

SEQ ID NO: 443134 - DNA, 22 bp, Homo sapiens
tgtagtgcccctcccatggccc

SEQ ID NO: 443135 - DNA, 18 bp, Homo sapiens
tgtagtggaagagcagcc

SEQ ID NO: 443136 - DNA, 19 bp, Homo sapiens
tgtagtggaagagcagcct

SEQ ID NO: 443137 - DNA, 23 bp, Homo sapiens
tgtagtggcttcttttgaactgt

SEQ ID NO: 443138 - DNA, 19 bp, Homo sapiens
tgtagtttttcttcaacat

SEQ ID NO: 443139 - DNA, 15 bp, Homo sapiens
tgtataaaaaagaaa

SEQ ID NO: 443140 - DNA, 20 bp, Homo sapiens
tgtataaataataaagaact

SEQ ID NO: 443141 - DNA, 13 bp, Homo sapiens
tgtataaataatg

SEQ ID NO: 443142 - DNA, 21 bp, Homo sapiens
tgtataacttcttaaaagttg

SEQ ID NO: 443143 - DNA, 19 bp, Homo sapiens
tgtatacattttgttatag

SEQ ID NO: 443144 - DNA, 17 bp, Homo sapiens
tgtataccacctgtaca

SEQ ID NO: 443145 - DNA, 18 bp, Homo sapiens
tgtataccacctgtacat

SEQ ID NO: 443146 - DNA, 17 bp, Homo sapiens
tgtataccatgatgcat

SEQ ID NO: 443147 - DNA, 18 bp, Homo sapiens
tgtatagatgcaagatat

SEQ ID NO: 443148 - DNA, 23 bp, Homo sapiens
tgtatagattagattatattgag

SEQ ID NO: 443149 - DNA, 22 bp, Homo sapiens
tgtatagcaacctatttgactg

SEQ ID NO: 443150 - DNA, 15 bp, Homo sapiens
tgtataggccatctg

SEQ ID NO: 443151 - DNA, 16 bp, Homo sapiens
tgtataggccatctgt

SEQ ID NO: 443152 - DNA, 19 bp, Homo sapiens
tgtataggccatctgtaaa

SEQ ID NO: 443153 - DNA, 23 bp, Homo sapiens
tgtataggccatctgtaaatatc

SEQ ID NO: 443154 - DNA, 20 bp, Homo sapiens
tgtatagtgagtgtggctta

SEQ ID NO: 443155 - DNA, 16 bp, Homo sapiens
tgtatagtgtaaaata

SEQ ID NO: 443156 - DNA, 24 bp, Homo sapiens
tgtatagtgtaaaataagaatgat

SEQ ID NO: 443157 - DNA, 20 bp, Homo sapiens
tgtatagttaggatagcatt

SEQ ID NO: 443158 - DNA, 23 bp, Homo sapiens
tgtatagttttataaaactcagt

SEQ ID NO: 443159 - DNA, 12 bp, Homo sapiens
tgtatataaaat

SEQ ID NO: 443160 - DNA, 12 bp, Homo sapiens
tgtatataaatg

SEQ ID NO: 443161 - DNA, 14 bp, Homo sapiens
tgtatatacatttc

SEQ ID NO: 443162 - DNA, 21 bp, Homo sapiens
tgtatatagctctacacaaca

SEQ ID NO: 443163 - DNA, 17 bp, Homo sapiens
tgtatatatctgcttca

SEQ ID NO: 443164 - DNA, 13 bp, Homo sapiens
tgtatatatgtgt

SEQ ID NO: 443165 - DNA, 19 bp, Homo sapiens
tgtatatatgtgtgtttaa

SEQ ID NO: 443166 - DNA, 14 bp, Homo sapiens
tgtatatatttaaa

SEQ ID NO: 443167 - DNA, 18 bp, Homo sapiens
tgtatatcagaaaaggga

SEQ ID NO: 443168 - DNA, 17 bp, Homo sapiens
tgtatatcatgaagcct

SEQ ID NO: 443169 - DNA, 17 bp, Homo sapiens
tgtatatccttccaaaa

SEQ ID NO: 443170 - DNA, 14 bp, Homo sapiens
tgtatatgttgtaa

SEQ ID NO: 443171 - DNA, 17 bp, Homo sapiens
tgtatattatcttctgg

SEQ ID NO: 443172 - DNA, 19 bp, Homo sapiens
tgtatattatcttctggtg

SEQ ID NO: 443173 - DNA, 21 bp, Homo sapiens
tgtatattgatgtaactgtgt

SEQ ID NO: 443174 - DNA, 15 bp, Homo sapiens
tgtatcaaactagtg

SEQ ID NO: 443175 - DNA, 16 bp, Homo sapiens
tgtatcaaactcgtct

SEQ ID NO: 443176 - DNA, 14 bp, Homo sapiens
tgtatcaaatctgt

SEQ ID NO: 443177 - DNA, 17 bp, Homo sapiens
tgtatcaaatctgtata

SEQ ID NO: 443178 - DNA, 18 bp, Homo sapiens
tgtatcaccctcagctgg

SEQ ID NO: 443179 - DNA, 16 bp, Homo sapiens
tgtatccatgggggca

SEQ ID NO: 443180 - DNA, 19 bp, Homo sapiens
tgtatccatgggggcaggg

SEQ ID NO: 443181 - DNA, 20 bp, Homo sapiens
tgtatcccccccctgtatag

SEQ ID NO: 443182 - DNA, 21 bp, Homo sapiens
tgtatccttccaatttggaat

SEQ ID NO: 443183 - DNA, 17 bp, Homo sapiens
tgtatcggagacagtga

SEQ ID NO: 443184 - DNA, 18 bp, Homo sapiens
tgtatcggagacagtgat

SEQ ID NO: 443185 - DNA, 21 bp, Homo sapiens
tgtatctaaaaaataactgtg

SEQ ID NO: 443186 - DNA, 23 bp, Homo sapiens
tgtatctaaaaaataactgtgca

SEQ ID NO: 443187 - DNA, 15 bp, Homo sapiens
tgtatctacctcact

SEQ ID NO: 443188 - DNA, 17 bp, Homo sapiens
tgtatctagtgcagctg

SEQ ID NO: 443189 - DNA, 18 bp, Homo sapiens
tgtatctctgaagcatgt

SEQ ID NO: 443190 - DNA, 19 bp, Homo sapiens
tgtatctctgaagcatgtt

SEQ ID NO: 443191 - DNA, 21 bp, Homo sapiens
tgtatctctgaagcatgtttc

SEQ ID NO: 443192 - DNA, 23 bp, Homo sapiens
tgtatctctgaagcatgtttcat

SEQ ID NO: 443193 - DNA, 22 bp, Homo sapiens
tgtatctgaaggagattttcct

SEQ ID NO: 443194 - DNA, 21 bp, Homo sapiens
tgtatgaagtacttttaacgt

SEQ ID NO: 443195 - DNA, 14 bp, Homo sapiens
tgtatgactaaaga

SEQ ID NO: 443196 - DNA, 21 bp, Homo sapiens
tgtatgactaaagagagaatg

SEQ ID NO: 443197 - DNA, 16 bp, Homo sapiens
tgtatgagaagtactt

SEQ ID NO: 443198 - DNA, 12 bp, Homo sapiens
tgtatgatgtat

SEQ ID NO: 443199 - DNA, 20 bp, Homo sapiens
tgtatgatttaggcttctat

SEQ ID NO: 443200 - DNA, 20 bp, Homo sapiens
tgtatgattttgatgcacaa

SEQ ID NO: 443201 - DNA, 16 bp, Homo sapiens
tgtatgccaagtgaga

SEQ ID NO: 443202 - DNA, 14 bp, Homo sapiens
tgtatgcccaaaga

SEQ ID NO: 443203 - DNA, 12 bp, Homo sapiens
tgtatgccttta

SEQ ID NO: 443204 - DNA, 14 bp, Homo sapiens
tgtatgctgatgat

SEQ ID NO: 443205 - DNA, 20 bp, Homo sapiens
tgtatgctgatgatcaaaac

SEQ ID NO: 443206 - DNA, 15 bp, Homo sapiens
tgtatggatatgtgt

SEQ ID NO: 443207 - DNA, 16 bp, Homo sapiens
tgtatggatatgtgta

SEQ ID NO: 443208 - DNA, 15 bp, Homo sapiens
tgtatgtaaaatatt

SEQ ID NO: 443209 - DNA, 13 bp, Homo sapiens
tgtatgtacatat

SEQ ID NO: 443210 - DNA, 19 bp, Homo sapiens
tgtatgtgaaagtgtaaaa

SEQ ID NO: 443211 - DNA, 11 bp, Homo sapiens
tgtatgtgcac

SEQ ID NO: 443212 - DNA, 19 bp, Homo sapiens
tgtatgtgcactgtcactt

SEQ ID NO: 443213 - DNA, 18 bp, Homo sapiens
tgtatgtgtctttatcag

SEQ ID NO: 443214 - DNA, 11 bp, Homo sapiens
tgtatgtgttt

SEQ ID NO: 443215 - DNA, 20 bp, Homo sapiens
tgtatgtgtttataattgtt

SEQ ID NO: 443216 - DNA, 19 bp, Homo sapiens
tgtatgttgtgaagatgtt

SEQ ID NO: 443217 - DNA, 11 bp, Homo sapiens
tgtatgtttac

SEQ ID NO: 443218 - DNA, 18 bp, Homo sapiens
tgtattaacctacctgtg

SEQ ID NO: 443219 - DNA, 18 bp, Homo sapiens
tgtattacataaataaat

SEQ ID NO: 443220 - DNA, 13 bp, Homo sapiens
tgtctaagttttg

SEQ ID NO: 443221 - DNA, 14 bp, Homo sapiens
tgtctaatgaaacc

SEQ ID NO: 443222 - DNA, 22 bp, Homo sapiens
tgtctacaaaagcaaagtgaag

SEQ ID NO: 443223 - DNA, 12 bp, Homo sapiens
tgtctacaaata

SEQ ID NO: 443224 - DNA, 17 bp, Homo sapiens
tgtctagaatcctgctt

SEQ ID NO: 443225 - DNA, 22 bp, Homo sapiens
tgtctagcaaagccaccaaggg

SEQ ID NO: 443226 - DNA, 22 bp, Homo sapiens
tgtctagtttgcatacttcctg

SEQ ID NO: 443227 - DNA, 18 bp, Homo sapiens
tgtctattctgagccttg

SEQ ID NO: 443228 - DNA, 18 bp, Homo sapiens
tgtctcaagagggcactg

SEQ ID NO: 443229 - DNA, 13 bp, Homo sapiens
tgtctcaccagct

SEQ ID NO: 443230 - DNA, 20 bp, Homo sapiens
tgtctcaccagctcagcccc

SEQ ID NO: 443231 - DNA, 23 bp, Homo sapiens
tgtctcaccagctcagccccggc

SEQ ID NO: 443232 - DNA, 14 bp, Homo sapiens
tgtctcagcctccc

SEQ ID NO: 443233 - DNA, 17 bp, Homo sapiens
tgtctcaggtccctgca

SEQ ID NO: 443234 - DNA, 13 bp, Homo sapiens
tgtctcatcccca

SEQ ID NO: 443235 - DNA, 18 bp, Homo sapiens
tgtctcatgccagcagca

SEQ ID NO: 443236 - DNA, 23 bp, Homo sapiens
tgtctcattgccagtggtgtcca

SEQ ID NO: 443237 - DNA, 16 bp, Homo sapiens
tgtctccaagaatgtt

SEQ ID NO: 443238 - DNA, 20 bp, Homo sapiens
tgtctccagacccccacccc

SEQ ID NO: 443239 - DNA, 15 bp, Homo sapiens
tgtctcctctgtcag

SEQ ID NO: 443240 - DNA, 11 bp, Homo sapiens
tgtctcctgca

SEQ ID NO: 443241 - DNA, 14 bp, Homo sapiens
tgtctccttcccac

SEQ ID NO: 443242 - DNA, 16 bp, Homo sapiens
tgtctccttcccactg

SEQ ID NO: 443243 - DNA, 18 bp, Homo sapiens
tgtctccttcccactgtc

SEQ ID NO: 443244 - DNA, 19 bp, Homo sapiens
tgtctccttcccactgtcc

SEQ ID NO: 443245 - DNA, 20 bp, Homo sapiens
tgtctccttcccactgtcct

SEQ ID NO: 443246 - DNA, 21 bp, Homo sapiens
tgtctccttcccactgtcctt

SEQ ID NO: 443247 - DNA, 20 bp, Homo sapiens
tgtctctacaaaaaaaatca

SEQ ID NO: 443248 - DNA, 22 bp, Homo sapiens
tgtctctacccactatgcacag

SEQ ID NO: 443249 - DNA, 16 bp, Homo sapiens
tgtctctccctaccct

SEQ ID NO: 443250 - DNA, 13 bp, Homo sapiens
tgtctctgagccc

SEQ ID NO: 443251 - DNA, 24 bp, Homo sapiens
tgtctctgagccccctgtgcccac

SEQ ID NO: 443252 - DNA, 15 bp, Homo sapiens
tgtctctgccatgtg

SEQ ID NO: 443253 - DNA, 14 bp, Homo sapiens
tgtctctgcttcca

SEQ ID NO: 443254 - DNA, 18 bp, Homo sapiens
tgtctctggcgtgtgggt

SEQ ID NO: 443255 - DNA, 12 bp, Homo sapiens
tgtctctgttca

SEQ ID NO: 443256 - DNA, 23 bp, Homo sapiens
tgtctcttcctctgcaggacaca

SEQ ID NO: 443257 - DNA, 15 bp, Homo sapiens
tgtctcttgtagaag

SEQ ID NO: 443258 - DNA, 18 bp, Homo sapiens
tgtctcttttctctttct

SEQ ID NO: 443259 - DNA, 18 bp, Homo sapiens
tgtctgagagaccatctc

SEQ ID NO: 443260 - DNA, 22 bp, Homo sapiens
tgtctgagccctgccctcactc

SEQ ID NO: 443261 - DNA, 14 bp, Homo sapiens
tgtctgagctgctg

SEQ ID NO: 443262 - DNA, 13 bp, Homo sapiens
tgtctgaggcctc

SEQ ID NO: 443263 - DNA, 14 bp, Homo sapiens
tgtctgaggcctca

SEQ ID NO: 443264 - DNA, 16 bp, Homo sapiens
tgtctgaggcctcatc

SEQ ID NO: 443265 - DNA, 17 bp, Homo sapiens
tgtctgatgtgtgccca

SEQ ID NO: 443266 - DNA, 12 bp, Homo sapiens
tgtctgattcta

SEQ ID NO: 443267 - DNA, 13 bp, Homo sapiens
tgtctgattctat

SEQ ID NO: 443268 - DNA, 16 bp, Homo sapiens
tgtctgattctatgcc

SEQ ID NO: 443269 - DNA, 19 bp, Homo sapiens
tgtctgcaaaggagggcct

SEQ ID NO: 443270 - DNA, 14 bp, Homo sapiens
tgtctgcaacatgg

SEQ ID NO: 443271 - DNA, 15 bp, Homo sapiens
tgtctgcattgttat

SEQ ID NO: 443272 - DNA, 16 bp, Homo sapiens
tgtctgccgtgagagc

SEQ ID NO: 443273 - DNA, 21 bp, Homo sapiens
tgtctgcgccgctgtgctgtt

SEQ ID NO: 443274 - DNA, 21 bp, Homo sapiens
tgtctgctaggcgctggggag

SEQ ID NO: 443275 - DNA, 23 bp, Homo sapiens
tgtctgctaggcgctggggagac

SEQ ID NO: 443276 - DNA, 15 bp, Homo sapiens
tgtctgctgctccca

SEQ ID NO: 443277 - DNA, 17 bp, Homo sapiens
tgtctggaagacgtggc

SEQ ID NO: 443278 - DNA, 16 bp, Homo sapiens
tgtctggaatcccagc

SEQ ID NO: 443279 - DNA, 17 bp, Homo sapiens
tgtctggaatcccagct

SEQ ID NO: 443280 - DNA, 23 bp, Homo sapiens
tgtctggaatcccagctccgctg

SEQ ID NO: 443281 - DNA, 13 bp, Homo sapiens
tgtctggatgcac

SEQ ID NO: 443282 - DNA, 15 bp, Homo sapiens
tgtctggctgtggcc

SEQ ID NO: 443283 - DNA, 20 bp, Homo sapiens
tgtctggctgtggcccctcc

SEQ ID NO: 443284 - DNA, 15 bp, Homo sapiens
tgtctggctttcccg

SEQ ID NO: 443285 - DNA, 18 bp, Homo sapiens
tgtctgggaaagcagagt

SEQ ID NO: 443286 - DNA, 17 bp, Homo sapiens
tgtctggtccacacacc

SEQ ID NO: 443287 - DNA, 18 bp, Homo sapiens
tgtctggtccacacacca

SEQ ID NO: 443288 - DNA, 21 bp, Homo sapiens
tgtctggtccacacaccacag

SEQ ID NO: 443289 - DNA, 15 bp, Homo sapiens
tgtctggtgggtgga

SEQ ID NO: 443290 - DNA, 13 bp, Homo sapiens
tgtctgtaagaga

SEQ ID NO: 443291 - DNA, 23 bp, Homo sapiens
tgtctgtaatcacactctcttct

SEQ ID NO: 443292 - DNA, 14 bp, Homo sapiens
tgtctgtagtgttt

SEQ ID NO: 443293 - DNA, 16 bp, Homo sapiens
tgtctgtcccagttaa

SEQ ID NO: 443294 - DNA, 14 bp, Homo sapiens
tgtctgtcctaccc

SEQ ID NO: 443295 - DNA, 18 bp, Homo sapiens
tgtctgtcctacccgccc

SEQ ID NO: 443296 - DNA, 19 bp, Homo sapiens
tgtctgtcctacccgcccg

SEQ ID NO: 443297 - DNA, 14 bp, Homo sapiens
tgtctgtgtgctgt

SEQ ID NO: 443298 - DNA, 19 bp, Homo sapiens
tgtctgttaccatgtcact

SEQ ID NO: 443299 - DNA, 13 bp, Homo sapiens
tgtcttaaaaggt

SEQ ID NO: 443300 - DNA, 17 bp, Homo sapiens
tgtcttaaataaaacta

SEQ ID NO: 443301 - DNA, 17 bp, Homo sapiens
tgtcttacaaggcaggc

SEQ ID NO: 443302 - DNA, 18 bp, Homo sapiens
tgtcttacattggctttt

SEQ ID NO: 443303 - DNA, 13 bp, Homo sapiens
tgtcttagagaga

SEQ ID NO: 443304 - DNA, 15 bp, Homo sapiens
tgtcttagagagaga

SEQ ID NO: 443305 - DNA, 18 bp, Homo sapiens
tgtcttagggaattctga

SEQ ID NO: 443306 - DNA, 13 bp, Homo sapiens
tgtcttatatata

SEQ ID NO: 443307 - DNA, 19 bp, Homo sapiens
tgtcttcacagctctgtgt

SEQ ID NO: 443308 - DNA, 13 bp, Homo sapiens
tgtcttcagatcc

SEQ ID NO: 443309 - DNA, 21 bp, Homo sapiens
tgtcttcagatcctgctgccg

SEQ ID NO: 443310 - DNA, 19 bp, Homo sapiens
tgtcttcatttcattgtat

SEQ ID NO: 443311 - DNA, 23 bp, Homo sapiens
tgtcttcatttcattgtatgatg

SEQ ID NO: 443312 - DNA, 24 bp, Homo sapiens
tgtcttccaaggagaccaagtcct

SEQ ID NO: 443313 - DNA, 14 bp, Homo sapiens
tgtcttccataatg

SEQ ID NO: 443314 - DNA, 14 bp, Homo sapiens
tgtcttccttttct

SEQ ID NO: 443315 - DNA, 18 bp, Homo sapiens
tgtcttcgtacagttctt

SEQ ID NO: 443316 - DNA, 14 bp, Homo sapiens
tgtcttctctccac

SEQ ID NO: 443317 - DNA, 17 bp, Homo sapiens
tgtcttctgcctgttat

SEQ ID NO: 443318 - DNA, 16 bp, Homo sapiens
tgtcttctttctcctg

SEQ ID NO: 443319 - DNA, 21 bp, Homo sapiens
tgtcttctttctcctgtggtt

SEQ ID NO: 443320 - DNA, 20 bp, Homo sapiens
tgtcttgagagcgctggcct

SEQ ID NO: 443321 - DNA, 14 bp, Homo sapiens
tgtcttgagatgta

SEQ ID NO: 443322 - DNA, 20 bp, Homo sapiens
tgtcttgcaaagcctttaaa

SEQ ID NO: 443323 - DNA, 15 bp, Homo sapiens
tgtcttgtaagcaaa

SEQ ID NO: 443324 - DNA, 14 bp, Homo sapiens
tgtcttgtcatctt

SEQ ID NO: 443325 - DNA, 16 bp, Homo sapiens
tgtcttgtcatctttt

SEQ ID NO: 443326 - DNA, 16 bp, Homo sapiens
tgtcttgtgtttttgt

SEQ ID NO: 443327 - DNA, 21 bp, Homo sapiens
tgtctttaggcagcagctttt

SEQ ID NO: 443328 - DNA, 20 bp, Homo sapiens
tgtctttcagatacatggtt

SEQ ID NO: 443329 - DNA, 13 bp, Homo sapiens
tgtctttgctgtt

SEQ ID NO: 443330 - DNA, 17 bp, Homo sapiens
tgtcttttatgcagata

SEQ ID NO: 443331 - DNA, 22 bp, Homo sapiens
tgtcttttcccctcattgcatt

SEQ ID NO: 443332 - DNA, 15 bp, Homo sapiens
tgtctttttccttcc

SEQ ID NO: 443333 - DNA, 16 bp, Homo sapiens
tgtctttttttactta

SEQ ID NO: 443334 - DNA, 16 bp, Homo sapiens
tgtgaaaagagtatgt

SEQ ID NO: 443335 - DNA, 18 bp, Homo sapiens
tgtgaaagtatgtgatat

SEQ ID NO: 443336 - DNA, 14 bp, Homo sapiens
tgtgaaatgctggc

SEQ ID NO: 443337 - DNA, 14 bp, Homo sapiens
tgtgaaatgtgcaa

SEQ ID NO: 443338 - DNA, 21 bp, Homo sapiens
tgtgaaatttgttaatatata

SEQ ID NO: 443339 - DNA, 13 bp, Homo sapiens
tgtgaagaaatgg

SEQ ID NO: 443340 - DNA, 19 bp, Homo sapiens
tgtgaagataatttgcata

SEQ ID NO: 443341 - DNA, 13 bp, Homo sapiens
tgtgaagcatgct

SEQ ID NO: 443342 - DNA, 17 bp, Homo sapiens
tgtgaagccctttgcct

SEQ ID NO: 443343 - DNA, 19 bp, Homo sapiens
tgtgaagccctttgcctgt

SEQ ID NO: 443344 - DNA, 17 bp, Homo sapiens
tgtgaagtgattgacat

SEQ ID NO: 443345 - DNA, 19 bp, Homo sapiens
tgtgaagtgattgacattt

SEQ ID NO: 443346 - DNA, 14 bp, Homo sapiens
tgtgaagtttacat

SEQ ID NO: 443347 - DNA, 15 bp, Homo sapiens
tgtgaataaagccac

SEQ ID NO: 443348 - DNA, 19 bp, Homo sapiens
tgtgaatacaattaaaggt

SEQ ID NO: 443349 - DNA, 21 bp, Homo sapiens
tgtgaatatttccatatggat

SEQ ID NO: 443350 - DNA, 23 bp, Homo sapiens
tgtgaatatttccatatggattt

SEQ ID NO: 443351 - DNA, 16 bp, Homo sapiens
tgttactttggaatga

SEQ ID NO: 443352 - DNA, 18 bp, Homo sapiens
tgttagaattgatttcca

SEQ ID NO: 443353 - DNA, 22 bp, Homo sapiens
tgttagatgctgaatatctgtt

SEQ ID NO: 443354 - DNA, 17 bp, Homo sapiens
tgttagccccataattt

SEQ ID NO: 443355 - DNA, 22 bp, Homo sapiens
tgttaggaggccacatgatact

SEQ ID NO: 443356 - DNA, 14 bp, Homo sapiens
tgttagtcttaccg

SEQ ID NO: 443357 - DNA, 21 bp, Homo sapiens
tgttagtcttaccgaataagg

SEQ ID NO: 443358 - DNA, 17 bp, Homo sapiens
tgttagtgatttgctat

SEQ ID NO: 443359 - DNA, 17 bp, Homo sapiens
tgttagtgggaagagct

SEQ ID NO: 443360 - DNA, 19 bp, Homo sapiens
tgttagtgggaagagctgg

SEQ ID NO: 443361 - DNA, 21 bp, Homo sapiens
tgttagtgggaagagctgggt

SEQ ID NO: 443362 - DNA, 21 bp, Homo sapiens
tgttagttattttaggagaca

SEQ ID NO: 443363 - DNA, 14 bp, Homo sapiens
tgttataaataaaa

SEQ ID NO: 443364 - DNA, 15 bp, Homo sapiens
tgttataaataaaat

SEQ ID NO: 443365 - DNA, 14 bp, Homo sapiens
tgttatacttcaaa

SEQ ID NO: 443366 - DNA, 14 bp, Homo sapiens
tgttatatcaggga

SEQ ID NO: 443367 - DNA, 18 bp, Homo sapiens
tgttatattcattcttta

SEQ ID NO: 443368 - DNA, 23 bp, Homo sapiens
tgttatcctgctagctgtagaaa

SEQ ID NO: 443369 - DNA, 13 bp, Homo sapiens
tgttatctgtctt

SEQ ID NO: 443370 - DNA, 23 bp, Homo sapiens
tgttatctgtctttatgatttca

SEQ ID NO: 443371 - DNA, 23 bp, Homo sapiens
tgttatgataaaaggaagtagat

SEQ ID NO: 443372 - DNA, 12 bp, Homo sapiens
tgttatgctatt

SEQ ID NO: 443373 - DNA, 17 bp, Homo sapiens
tgttattaatccacaaa

SEQ ID NO: 443374 - DNA, 14 bp, Homo sapiens
tgttattattggct

SEQ ID NO: 443375 - DNA, 19 bp, Homo sapiens
tgttattcaataactattg

SEQ ID NO: 443376 - DNA, 22 bp, Homo sapiens
tgttattgggcaagtgattgaa

SEQ ID NO: 443377 - DNA, 18 bp, Homo sapiens
tgttattttcagtatttt

SEQ ID NO: 443378 - DNA, 16 bp, Homo sapiens
tgttatttttgtttct

SEQ ID NO: 443379 - DNA, 21 bp, Homo sapiens
tgttatttttgtttcttccaa

SEQ ID NO: 443380 - DNA, 16 bp, Homo sapiens
tgttcaaaatgttaat

SEQ ID NO: 443381 - DNA, 17 bp, Homo sapiens
tgttcaaactactgtac

SEQ ID NO: 443382 - DNA, 21 bp, Homo sapiens
tgttcaaagaacccccctccc

SEQ ID NO: 443383 - DNA, 23 bp, Homo sapiens
tgttcaaagaacccccctcccca

SEQ ID NO: 443384 - DNA, 15 bp, Homo sapiens
tgttcaatctgtgaa

SEQ ID NO: 443385 - DNA, 13 bp, Homo sapiens
tgttcagaagttg

SEQ ID NO: 443386 - DNA, 21 bp, Homo sapiens
tgttcagaagttgttagtgat

SEQ ID NO: 443387 - DNA, 18 bp, Homo sapiens
tgttcagagttccacagt

SEQ ID NO: 443388 - DNA, 22 bp, Homo sapiens
tgttcagtaacagggccttgct

SEQ ID NO: 443389 - DNA, 17 bp, Homo sapiens
tgttcagttccagcttt

SEQ ID NO: 443390 - DNA, 17 bp, Homo sapiens
tgttcatgttttgctaa

SEQ ID NO: 443391 - DNA, 21 bp, Homo sapiens
tgttcattaaacgtcattcag

SEQ ID NO: 443392 - DNA, 12 bp, Homo sapiens
tgttcattgtaa

SEQ ID NO: 443393 - DNA, 16 bp, Homo sapiens
tgttcattgtaatgtt

SEQ ID NO: 443394 - DNA, 20 bp, Homo sapiens
tgttcattgtaatgttactg

SEQ ID NO: 443395 - DNA, 21 bp, Homo sapiens
tgttcattgtaatgttactga

SEQ ID NO: 443396 - DNA, 14 bp, Homo sapiens
tgttcatttctgtc

SEQ ID NO: 443397 - DNA, 19 bp, Homo sapiens
tgttccaacagttaaactt

SEQ ID NO: 443398 - DNA, 20 bp, Homo sapiens
tgttccaagacattgtcaat

SEQ ID NO: 443399 - DNA, 14 bp, Homo sapiens
tgttccaagtgtgt

SEQ ID NO: 443400 - DNA, 19 bp, Homo sapiens
tgttccacaagttaaataa

SEQ ID NO: 443401 - DNA, 20 bp, Homo sapiens
tgttccacaagttaaataaa

SEQ ID NO: 443402 - DNA, 14 bp, Homo sapiens
tgttccagctcttt

SEQ ID NO: 443403 - DNA, 17 bp, Homo sapiens
tgttccatcctgtacaa

SEQ ID NO: 443404 - DNA, 18 bp, Homo sapiens
tgttccatgacttcagag

SEQ ID NO: 443405 - DNA, 22 bp, Homo sapiens
tgttcccagtgacacttcagag

SEQ ID NO: 443406 - DNA, 21 bp, Homo sapiens
tgttcccatccctgaaacatt

SEQ ID NO: 443407 - DNA, 22 bp, Homo sapiens
tgttccccactgacagcctccc

SEQ ID NO: 443408 - DNA, 18 bp, Homo sapiens
tgttccccatggccactt

SEQ ID NO: 443409 - DNA, 17 bp, Homo sapiens
tgttcccctaagtggat

SEQ ID NO: 443410 - DNA, 18 bp, Homo sapiens
tgttccctctccctgttg

SEQ ID NO: 443411 - DNA, 13 bp, Homo sapiens
tgttccctgcacc

SEQ ID NO: 443412 - DNA, 17 bp, Homo sapiens
tgttccctgcaccctgg

SEQ ID NO: 443413 - DNA, 12 bp, Homo sapiens
tgttccctgctg

SEQ ID NO: 443414 - DNA, 19 bp, Homo sapiens
tgttcctacagcccctttt

SEQ ID NO: 443415 - DNA, 23 bp, Homo sapiens
tgttcctcaccaataacttcaga

SEQ ID NO: 443416 - DNA, 22 bp, Homo sapiens
tgttcctgaattctatttgctg

SEQ ID NO: 443417 - DNA, 16 bp, Homo sapiens
tgttcctgatgtgcca

SEQ ID NO: 443418 - DNA, 13 bp, Homo sapiens
tgttcctgccttc

SEQ ID NO: 443419 - DNA, 16 bp, Homo sapiens
tgttcctgccttctct

SEQ ID NO: 443420 - DNA, 15 bp, Homo sapiens
tgttcctgctccatg

SEQ ID NO: 443421 - DNA, 17 bp, Homo sapiens
tgttcctgctttctctt

SEQ ID NO: 443422 - DNA, 17 bp, Homo sapiens
tgttcctggctttgaca

SEQ ID NO: 443423 - DNA, 18 bp, Homo sapiens
tgttcctttgttaaattt

SEQ ID NO: 443424 - DNA, 23 bp, Homo sapiens
tgttcgccgtctggcgagccctt

SEQ ID NO: 443425 - DNA, 19 bp, Homo sapiens
tgttcgcttggctccatgc

SEQ ID NO: 443426 - DNA, 13 bp, Homo sapiens
tgttctacttgat

SEQ ID NO: 443427 - DNA, 16 bp, Homo sapiens
tgttctacttgatatt

SEQ ID NO: 443428 - DNA, 11 bp, Homo sapiens
tgttctagact

SEQ ID NO: 443429 - DNA, 20 bp, Homo sapiens
tgttctagacttccccatcc

SEQ ID NO: 443430 - DNA, 13 bp, Homo sapiens
tgttctatgcaaa

SEQ ID NO: 443431 - DNA, 20 bp, Homo sapiens
tgttctcacataacagagta

SEQ ID NO: 443432 - DNA, 14 bp, Homo sapiens
tgttctcagagctc

SEQ ID NO: 443433 - DNA, 20 bp, Homo sapiens
tgttctcagagctccacaga

SEQ ID NO: 443434 - DNA, 21 bp, Homo sapiens
tgttctctccccttgcactgg

SEQ ID NO: 443435 - DNA, 12 bp, Homo sapiens
tgttctctcttg

SEQ ID NO: 443436 - DNA, 20 bp, Homo sapiens
tgttctgacattaacagttt

SEQ ID NO: 443437 - DNA, 22 bp, Homo sapiens
tgttctgacattaacagttttc

SEQ ID NO: 443438 - DNA, 16 bp, Homo sapiens
tgttctgagaactgac

SEQ ID NO: 443439 - DNA, 22 bp, Homo sapiens
tgttctgattagaaatgaccaa

SEQ ID NO: 443440 - DNA, 18 bp, Homo sapiens
tgttctgccccctcaggg

SEQ ID NO: 443441 - DNA, 16 bp, Homo sapiens
tgttctggacctcccc

SEQ ID NO: 443442 - DNA, 20 bp, Homo sapiens
tgttctggacctccccctct

SEQ ID NO: 443443 - DNA, 14 bp, Homo sapiens
tgttctgtgtccct

SEQ ID NO: 443444 - DNA, 17 bp, Homo sapiens
tgttctgtttgttaaaa

SEQ ID NO: 443445 - DNA, 20 bp, Homo sapiens
tgttctgtttgttaaaactg

SEQ ID NO: 443446 - DNA, 18 bp, Homo sapiens
tgttctgttttgttttgt

SEQ ID NO: 443447 - DNA, 12 bp, Homo sapiens
tgttcttaattt

SEQ ID NO: 443448 - DNA, 17 bp, Homo sapiens
tgttcttgtaaaactgt

SEQ ID NO: 443449 - DNA, 13 bp, Homo sapiens
tgttcttttgata

SEQ ID NO: 443450 - DNA, 13 bp, Homo sapiens
tgttgaaaatgag

SEQ ID NO: 443451 - DNA, 21 bp, Homo sapiens
tgttgaaaatgagcctgtaat

SEQ ID NO: 443452 - DNA, 22 bp, Homo sapiens
tgttgaaaattattttaaacaa

SEQ ID NO: 443453 - DNA, 18 bp, Homo sapiens
tgttgaagaatacagtta

SEQ ID NO: 443454 - DNA, 13 bp, Homo sapiens
tgttgactgctgc

SEQ ID NO: 443455 - DNA, 16 bp, Homo sapiens
tgttgactgctgctcc

SEQ ID NO: 443456 - DNA, 22 bp, Homo sapiens
tgttgactgtaggcgcccctgg

SEQ ID NO: 443457 - DNA, 20 bp, Homo sapiens
tgttgacttattttctctgt

SEQ ID NO: 443458 - DNA, 21 bp, Homo sapiens
tgttgacttattttctctgtg

SEQ ID NO: 443459 - DNA, 22 bp, Homo sapiens
tgttgacttattttctctgtgt

SEQ ID NO: 443460 - DNA, 18 bp, Homo sapiens
tgttgacttctatcctgt

SEQ ID NO: 443461 - DNA, 15 bp, Homo sapiens
tgttgagaggctgag

SEQ ID NO: 443462 - DNA, 23 bp, Homo sapiens
tgttgaggtggtctgaatgttct

SEQ ID NO: 443463 - DNA, 17 bp, Homo sapiens
tgttgagtatttgctgt

SEQ ID NO: 443464 - DNA, 18 bp, Homo sapiens
tgttgagtatttgctgtt

SEQ ID NO: 443465 - DNA, 17 bp, Homo sapiens
tgttgagtctctgaaca

SEQ ID NO: 443466 - DNA, 13 bp, Homo sapiens
tgttgagtgttca

SEQ ID NO: 443467 - DNA, 18 bp, Homo sapiens
tgttgagtgttcatttta

SEQ ID NO: 443468 - DNA, 19 bp, Homo sapiens
tgttgagttggacacactg

SEQ ID NO: 443469 - DNA, 20 bp, Homo sapiens
tgttgatcagatcttacaag

SEQ ID NO: 443470 - DNA, 22 bp, Homo sapiens
tgttgatgggcacttgagaact

SEQ ID NO: 443471 - DNA, 15 bp, Homo sapiens
tgttgattctttcaa

SEQ ID NO: 443472 - DNA, 14 bp, Homo sapiens
tgttgcataaacaa

SEQ ID NO: 443473 - DNA, 19 bp, Homo sapiens
tgttgccaaagctggcttt

SEQ ID NO: 443474 - DNA, 22 bp, Homo sapiens
tgttgccaaatatgtcctgggg

SEQ ID NO: 443475 - DNA, 23 bp, Homo sapiens
tgttgccaaatatgtcctggggt

SEQ ID NO: 443476 - DNA, 14 bp, Homo sapiens
tgttgccaagctgg

SEQ ID NO: 443477 - DNA, 15 bp, Homo sapiens
tgttgccacaggaca

SEQ ID NO: 443478 - DNA, 14 bp, Homo sapiens
tgttgccaggcagg

SEQ ID NO: 443479 - DNA, 18 bp, Homo sapiens
tgttgccaggttgcagct

SEQ ID NO: 443480 - DNA, 22 bp, Homo sapiens
ttaaattatatgatatgcatgt

SEQ ID NO: 443481 - DNA, 14 bp, Homo sapiens
ttaaattctctcta

SEQ ID NO: 443482 - DNA, 17 bp, Homo sapiens
ttaaattctctctaaca

SEQ ID NO: 443483 - DNA, 16 bp, Homo sapiens
ttaaattgcttttgtt

SEQ ID NO: 443484 - DNA, 15 bp, Homo sapiens
ttaaattttgagttc

SEQ ID NO: 443485 - DNA, 18 bp, Homo sapiens
ttaacaaaacaagaaaga

SEQ ID NO: 443486 - DNA, 21 bp, Homo sapiens
ttaacaaaacaagaaagaaac

SEQ ID NO: 443487 - DNA, 14 bp, Homo sapiens
ttaacaaatctaat

SEQ ID NO: 443488 - DNA, 20 bp, Homo sapiens
ttaacaaatctaatctctta

SEQ ID NO: 443489 - DNA, 16 bp, Homo sapiens
ttaacaaatgttttca

SEQ ID NO: 443490 - DNA, 15 bp, Homo sapiens
ttaacaacagcttct

SEQ ID NO: 443491 - DNA, 12 bp, Homo sapiens
ttaacaaggaat

SEQ ID NO: 443492 - DNA, 18 bp, Homo sapiens
ttaacaataactactgtg

SEQ ID NO: 443493 - DNA, 23 bp, Homo sapiens
ttaacaataactactgtgttcct

SEQ ID NO: 443494 - DNA, 21 bp, Homo sapiens
ttaacaatgtcttgtaagcaa

SEQ ID NO: 443495 - DNA, 23 bp, Homo sapiens
ttaacaatttctgtccttcagat

SEQ ID NO: 443496 - DNA, 19 bp, Homo sapiens
ttaacacatgaatttctgc

SEQ ID NO: 443497 - DNA, 20 bp, Homo sapiens
ttaacactgtaatatcttta

SEQ ID NO: 443498 - DNA, 19 bp, Homo sapiens
ttaacagctttctccagaa

SEQ ID NO: 443499 - DNA, 21 bp, Homo sapiens
ttaacaggtctttgaaatatg

SEQ ID NO: 443500 - DNA, 14 bp, Homo sapiens
ttaacagttttcca

SEQ ID NO: 443501 - DNA, 16 bp, Homo sapiens
ttaacagttttccatg

SEQ ID NO: 443502 - DNA, 17 bp, Homo sapiens
ttaacagttttccatga

SEQ ID NO: 443503 - DNA, 19 bp, Homo sapiens
ttaacagttttccatgaaa

SEQ ID NO: 443504 - DNA, 19 bp, Homo sapiens
ttaacataaaagagtggaa

SEQ ID NO: 443505 - DNA, 18 bp, Homo sapiens
ttaacatataatatatgt

SEQ ID NO: 443506 - DNA, 17 bp, Homo sapiens
ttaacatatttactaag

SEQ ID NO: 443507 - DNA, 23 bp, Homo sapiens
ttaacatcaaagactccgagaag

SEQ ID NO: 443508 - DNA, 14 bp, Homo sapiens
ttaacatgctgtgt

SEQ ID NO: 443509 - DNA, 20 bp, Homo sapiens
ttaacattgaccaagaactg

SEQ ID NO: 443510 - DNA, 21 bp, Homo sapiens
ttaacattgaccaagaactgc

SEQ ID NO: 443511 - DNA, 15 bp, Homo sapiens
ttaaccaaagaaagt

SEQ ID NO: 443512 - DNA, 14 bp, Homo sapiens
ttaaccatttaagt

SEQ ID NO: 443513 - DNA, 17 bp, Homo sapiens
ttaacctagatgtttaa

SEQ ID NO: 443514 - DNA, 22 bp, Homo sapiens
ttaacctagatgtttaacaaat

SEQ ID NO: 443515 - DNA, 18 bp, Homo sapiens
ttaacctcaggttccaaa

SEQ ID NO: 443516 - DNA, 20 bp, Homo sapiens
ttaacctgcatgcagcaaca

SEQ ID NO: 443517 - DNA, 17 bp, Homo sapiens
ttaacctggtgctggat

SEQ ID NO: 443518 - DNA, 21 bp, Homo sapiens
ttaacctttttgtaaatactg

SEQ ID NO: 443519 - DNA, 17 bp, Homo sapiens
ttaacggctccaggatt

SEQ ID NO: 443520 - DNA, 16 bp, Homo sapiens
ttaacgtatgtatttc

SEQ ID NO: 443521 - DNA, 12 bp, Homo sapiens
ttaactagaatt

SEQ ID NO: 443522 - DNA, 20 bp, Homo sapiens
ttaactagtgtttctgcaga

SEQ ID NO: 443523 - DNA, 23 bp, Homo sapiens
ttaactcatctgttatcctgcta

SEQ ID NO: 443524 - DNA, 22 bp, Homo sapiens
ttaactccctagttacccaccc

SEQ ID NO: 443525 - DNA, 15 bp, Homo sapiens
ttaactgcatataga

SEQ ID NO: 443526 - DNA, 14 bp, Homo sapiens
ttaactgtgaataa

SEQ ID NO: 443527 - DNA, 21 bp, Homo sapiens
ttaactgtgtgaagaaatgga

SEQ ID NO: 443528 - DNA, 20 bp, Homo sapiens
ttaacttagtgtttagcatt

SEQ ID NO: 443529 - DNA, 12 bp, Homo sapiens
ttaacttctgcc

SEQ ID NO: 443530 - DNA, 22 bp, Homo sapiens
ttaacttgagggtaataaactt

SEQ ID NO: 443531 - DNA, 23 bp, Homo sapiens
ttaactttatcacattatttgca

SEQ ID NO: 443532 - DNA, 21 bp, Homo sapiens
ttaagaaaaaataacacacat

SEQ ID NO: 443533 - DNA, 16 bp, Homo sapiens
ttaagaaaaacatgtc

SEQ ID NO: 443534 - DNA, 19 bp, Homo sapiens
ttaagaaaaacatgtcatg

SEQ ID NO: 443535 - DNA, 23 bp, Homo sapiens
ttaagaaaacccgacaacatttc

SEQ ID NO: 443536 - DNA, 20 bp, Homo sapiens
ttaagaaacaatttaaattg

SEQ ID NO: 443537 - DNA, 15 bp, Homo sapiens
ttaagaaagctatat

SEQ ID NO: 443538 - DNA, 17 bp, Homo sapiens
ttaagaatagtctctgg

SEQ ID NO: 443539 - DNA, 16 bp, Homo sapiens
ttaagagagagagcct

SEQ ID NO: 443540 - DNA, 22 bp, Homo sapiens
ttaagagtggcatataattttc

SEQ ID NO: 443541 - DNA, 17 bp, Homo sapiens
ttaagatacactcctgc

SEQ ID NO: 443542 - DNA, 17 bp, Homo sapiens
ttaagatggattctcag

SEQ ID NO: 443543 - DNA, 18 bp, Homo sapiens
ttaagatggattctcaga

SEQ ID NO: 443544 - DNA, 21 bp, Homo sapiens
ttaagatggattctcagatat

SEQ ID NO: 443545 - DNA, 12 bp, Homo sapiens
ttaagattcttg

SEQ ID NO: 443546 - DNA, 18 bp, Homo sapiens
ttaagattttacaaaaga

SEQ ID NO: 443547 - DNA, 22 bp, Homo sapiens
ttaagcactacataaactgact

SEQ ID NO: 443548 - DNA, 14 bp, Homo sapiens
ttaagcactttgaa

SEQ ID NO: 443549 - DNA, 16 bp, Homo sapiens
ttaagcagaagcatta

SEQ ID NO: 443550 - DNA, 13 bp, Homo sapiens
ttaagcagccttt

SEQ ID NO: 443551 - DNA, 21 bp, Homo sapiens
ttaagcagcctttctgtggag

SEQ ID NO: 443552 - DNA, 23 bp, Homo sapiens
ttaagcatttgcgtatgtaaaca

SEQ ID NO: 443553 - DNA, 17 bp, Homo sapiens
ttaagccaataaataat

SEQ ID NO: 443554 - DNA, 22 bp, Homo sapiens
ttaagccaatatttactcatca

SEQ ID NO: 443555 - DNA, 15 bp, Homo sapiens
ttaagctccttcagt

SEQ ID NO: 443556 - DNA, 14 bp, Homo sapiens
ttaagctgtttcca

SEQ ID NO: 443557 - DNA, 17 bp, Homo sapiens
ttaaggaagaaaaatca

SEQ ID NO: 443558 - DNA, 18 bp, Homo sapiens
ttaaggaagaaaaatcag

SEQ ID NO: 443559 - DNA, 15 bp, Homo sapiens
ttaaggcaataaaac

SEQ ID NO: 443560 - DNA, 16 bp, Homo sapiens
ttaaggggatctaaaa

SEQ ID NO: 443561 - DNA, 18 bp, Homo sapiens
ttaaggggggatgtcttg

SEQ ID NO: 443562 - DNA, 22 bp, Homo sapiens
ttaaggggggcagggagtgatg

SEQ ID NO: 443563 - DNA, 22 bp, Homo sapiens
ttaaggtctgggagtgttctgt

SEQ ID NO: 443564 - DNA, 9 bp, Homo sapiens
ttaaggtgg

SEQ ID NO: 443565 - DNA, 19 bp, Homo sapiens
ttaagtatcttttttcaaa

SEQ ID NO: 443566 - DNA, 21 bp, Homo sapiens
ttaagtattccttggcccagc

SEQ ID NO: 443567 - DNA, 11 bp, Homo sapiens
ttaagtattta

SEQ ID NO: 443568 - DNA, 17 bp, Homo sapiens
ttaagtatttatatatt

SEQ ID NO: 443569 - DNA, 22 bp, Homo sapiens
ttaagtcgggaaattctgctgc

SEQ ID NO: 443570 - DNA, 24 bp, Homo sapiens
ttaagtcgggaaattctgctgctt

SEQ ID NO: 443571 - DNA, 16 bp, Homo sapiens
ttaagtgatgaacatt

SEQ ID NO: 443572 - DNA, 20 bp, Homo sapiens
ttaagtggctgtgattaatt

SEQ ID NO: 443573 - DNA, 19 bp, Homo sapiens
ttaagtgtactaattaaca

SEQ ID NO: 443574 - DNA, 16 bp, Homo sapiens
ttaagtgtcatttctt

SEQ ID NO: 443575 - DNA, 11 bp, Homo sapiens
ttaagttcaat

SEQ ID NO: 443576 - DNA, 11 bp, Homo sapiens
ttaagtttaga

SEQ ID NO: 443577 - DNA, 12 bp, Homo sapiens
ttaagtttagaa

SEQ ID NO: 443578 - DNA, 18 bp, Homo sapiens
ttaagtttagaaattaca

SEQ ID NO: 443579 - DNA, 20 bp, Homo sapiens
ttaataaaactgcacagtgc

SEQ ID NO: 443580 - DNA, 23 bp, Homo sapiens
ttaataaaactgcacagtgctgt

SEQ ID NO: 443581 - DNA, 12 bp, Homo sapiens
ttaataacaatt

SEQ ID NO: 443582 - DNA, 16 bp, Homo sapiens
ttaataactttgctgg

SEQ ID NO: 443583 - DNA, 12 bp, Homo sapiens
ttaatacagatg

SEQ ID NO: 443584 - DNA, 20 bp, Homo sapiens
ttaatacataagttaatatt

SEQ ID NO: 443585 - DNA, 14 bp, Homo sapiens
ttaatacctttaaa

SEQ ID NO: 443586 - DNA, 19 bp, Homo sapiens
ttaatacctttaaatatca

SEQ ID NO: 443587 - DNA, 16 bp, Homo sapiens
ttaatactcacctcct

SEQ ID NO: 443588 - DNA, 14 bp, Homo sapiens
ttaatactgaattt

SEQ ID NO: 443589 - DNA, 20 bp, Homo sapiens
ttaatagccatttgaagaag

SEQ ID NO: 443590 - DNA, 18 bp, Homo sapiens
ttaatagcttttattgta

SEQ ID NO: 443591 - DNA, 14 bp, Homo sapiens
ttaatagtatatct

SEQ ID NO: 443592 - DNA, 15 bp, Homo sapiens
ttaatataactgcct

SEQ ID NO: 443593 - DNA, 21 bp, Homo sapiens
ttaatatactaaccatttctt

SEQ ID NO: 443594 - DNA, 20 bp, Homo sapiens
ttaatatactgcatatcctg

SEQ ID NO: 443595 - DNA, 12 bp, Homo sapiens
ttaatatgagtt

SEQ ID NO: 443596 - DNA, 14 bp, Homo sapiens
ttaatattaattta

SEQ ID NO: 443597 - DNA, 18 bp, Homo sapiens
ttaatattactgtcttta

SEQ ID NO: 443598 - DNA, 13 bp, Homo sapiens
ttaatattattat

SEQ ID NO: 443599 - DNA, 15 bp, Homo sapiens
ttaatattctattaa

SEQ ID NO: 443600 - DNA, 16 bp, Homo sapiens
ttaatatttattgaat

SEQ ID NO: 443601 - DNA, 15 bp, Homo sapiens
ttaatcaccaaagta

SEQ ID NO: 443602 - DNA, 22 bp, Homo sapiens
ttaatcagaaaccccacttcca

SEQ ID NO: 443603 - DNA, 16 bp, Homo sapiens
ttaatcagacaaagta

SEQ ID NO: 443604 - DNA, 15 bp, Homo sapiens
ttaatcatcttctct

SEQ ID NO: 443605 - DNA, 16 bp, Homo sapiens
ttaatcatcttctctt

SEQ ID NO: 443606 - DNA, 22 bp, Homo sapiens
ttaatcattttgcctcttttct

SEQ ID NO: 443607 - DNA, 14 bp, Homo sapiens
ttaatcccagccct

SEQ ID NO: 443608 - DNA, 21 bp, Homo sapiens
ttaatcctagctgtgtgcagt

SEQ ID NO: 443609 - DNA, 13 bp, Homo sapiens
ttaatctagagct

SEQ ID NO: 443610 - DNA, 13 bp, Homo sapiens
ttcaaacacacag

SEQ ID NO: 443611 - DNA, 18 bp, Homo sapiens
ttcaaacagcatcaaaat

SEQ ID NO: 443612 - DNA, 12 bp, Homo sapiens
ttcaaactttca

SEQ ID NO: 443613 - DNA, 16 bp, Homo sapiens
ttcaaactttcacttt

SEQ ID NO: 443614 - DNA, 19 bp, Homo sapiens
ttcaaagaacccccctccc

SEQ ID NO: 443615 - DNA, 20 bp, Homo sapiens
ttcaaagaacccccctcccc

SEQ ID NO: 443616 - DNA, 16 bp, Homo sapiens
ttcaaagcaaccacct

SEQ ID NO: 443617 - DNA, 18 bp, Homo sapiens
ttcaaagctgaatatttt

SEQ ID NO: 443618 - DNA, 15 bp, Homo sapiens
ttcaaatacttttgg

SEQ ID NO: 443619 - DNA, 14 bp, Homo sapiens
ttcaaatgcatgat

SEQ ID NO: 443620 - DNA, 21 bp, Homo sapiens
ttcaaatgcatgatattgtat

SEQ ID NO: 443621 - DNA, 18 bp, Homo sapiens
ttcaaatgctgtaacttt

SEQ ID NO: 443622 - DNA, 18 bp, Homo sapiens
ttcaaattggactttcaa

SEQ ID NO: 443623 - DNA, 19 bp, Homo sapiens
ttcaaattggactttcaaa

SEQ ID NO: 443624 - DNA, 13 bp, Homo sapiens
ttcaaatttcaca

SEQ ID NO: 443625 - DNA, 17 bp, Homo sapiens
ttcaacacttattttct

SEQ ID NO: 443626 - DNA, 21 bp, Homo sapiens
ttcaacacttattttctgaat

SEQ ID NO: 443627 - DNA, 21 bp, Homo sapiens
ttcaacaggttttcctgaaga

SEQ ID NO: 443628 - DNA, 19 bp, Homo sapiens
ttcaacatcaatgttcatt

SEQ ID NO: 443629 - DNA, 22 bp, Homo sapiens
ttcaacatcaatgttcattgta

SEQ ID NO: 443630 - DNA, 21 bp, Homo sapiens
ttcaaccatgaggtaaaagag

SEQ ID NO: 443631 - DNA, 22 bp, Homo sapiens
ttcaaccatgaggtaaaagagc

SEQ ID NO: 443632 - DNA, 17 bp, Homo sapiens
ttcaaccattccccatg

SEQ ID NO: 443633 - DNA, 14 bp, Homo sapiens
ttcaacgcagccct

SEQ ID NO: 443634 - DNA, 20 bp, Homo sapiens
ttcaacgcagccctgctttg

SEQ ID NO: 443635 - DNA, 17 bp, Homo sapiens
ttcaagaaagatatcta

SEQ ID NO: 443636 - DNA, 20 bp, Homo sapiens
ttcaagaaagatatctatga

SEQ ID NO: 443637 - DNA, 21 bp, Homo sapiens
ttcaagaaagatatctatgac

SEQ ID NO: 443638 - DNA, 13 bp, Homo sapiens
ttcaagaaaggaa

SEQ ID NO: 443639 - DNA, 19 bp, Homo sapiens
ttcaagactgaaatggctt

SEQ ID NO: 443640 - DNA, 18 bp, Homo sapiens
ttcaagatcttcaaccat

SEQ ID NO: 443641 - DNA, 20 bp, Homo sapiens
ttcaagcaaacatcaaataa

SEQ ID NO: 443642 - DNA, 21 bp, Homo sapiens
ttcaagcaaacatcaaataaa

SEQ ID NO: 443643 - DNA, 11 bp, Homo sapiens
ttcaagcaaat

SEQ ID NO: 443644 - DNA, 16 bp, Homo sapiens
ttcaagcttttccttt

SEQ ID NO: 443645 - DNA, 19 bp, Homo sapiens
ttcaagcttttcctttctt

SEQ ID NO: 443646 - DNA, 16 bp, Homo sapiens
ttcaaggagaatatga

SEQ ID NO: 443647 - DNA, 16 bp, Homo sapiens
ttcaagggaagaaaca

SEQ ID NO: 443648 - DNA, 17 bp, Homo sapiens
ttcaaggtggccaaatt

SEQ ID NO: 443649 - DNA, 16 bp, Homo sapiens
ttcaagtaattgtgaa

SEQ ID NO: 443650 - DNA, 20 bp, Homo sapiens
ttcaagtgattctcctgcct

SEQ ID NO: 443651 - DNA, 13 bp, Homo sapiens
ttcaagtgccttt

SEQ ID NO: 443652 - DNA, 14 bp, Homo sapiens
ttcaagtgctaaaa

SEQ ID NO: 443653 - DNA, 21 bp, Homo sapiens
ttcaagtgttgctcttggaaa

SEQ ID NO: 443654 - DNA, 16 bp, Homo sapiens
ttcaagtgttttcaca

SEQ ID NO: 443655 - DNA, 13 bp, Homo sapiens
ttcaagttaaagt

SEQ ID NO: 443656 - DNA, 17 bp, Homo sapiens
ttcaagttattgtacag

SEQ ID NO: 443657 - DNA, 20 bp, Homo sapiens
ttcaataaaatgcactgacc

SEQ ID NO: 443658 - DNA, 21 bp, Homo sapiens
ttcaataaagaaaaaaatagt

SEQ ID NO: 443659 - DNA, 22 bp, Homo sapiens
ttcaatccacagtattgttctt

SEQ ID NO: 443660 - DNA, 17 bp, Homo sapiens
ttcaatcccaattctgt

SEQ ID NO: 443661 - DNA, 17 bp, Homo sapiens
ttcaatctctgttctgc

SEQ ID NO: 443662 - DNA, 15 bp, Homo sapiens
ttcaatctgtgaagc

SEQ ID NO: 443663 - DNA, 23 bp, Homo sapiens
ttcaatctgtgaagcctttatct

SEQ ID NO: 443664 - DNA, 12 bp, Homo sapiens
ttcaatgatcta

SEQ ID NO: 443665 - DNA, 23 bp, Homo sapiens
ttcaatgggagtgaacatttcta

SEQ ID NO: 443666 - DNA, 23 bp, Homo sapiens
ttcaatggttgggacaatggcaa

SEQ ID NO: 443667 - DNA, 21 bp, Homo sapiens
ttcaatgtgattctaatgtct

SEQ ID NO: 443668 - DNA, 18 bp, Homo sapiens
ttcaattgtgtctgtggt

SEQ ID NO: 443669 - DNA, 23 bp, Homo sapiens
ttcaatttactttttaaacagtg

SEQ ID NO: 443670 - DNA, 14 bp, Homo sapiens
ttcaatttctcaca

SEQ ID NO: 443671 - DNA, 15 bp, Homo sapiens
ttcacaaaatttcca

SEQ ID NO: 443672 - DNA, 15 bp, Homo sapiens
ttcacaaacagtaaa

SEQ ID NO: 443673 - DNA, 18 bp, Homo sapiens
ttcacaagctgcctccct

SEQ ID NO: 443674 - DNA, 23 bp, Homo sapiens
ttcacaaggtgactgggatgtag

SEQ ID NO: 443675 - DNA, 11 bp, Homo sapiens
ttcacacacag

SEQ ID NO: 443676 - DNA, 13 bp, Homo sapiens
ttcacacacagcc

SEQ ID NO: 443677 - DNA, 20 bp, Homo sapiens
ttcacacacagcctggcctc

SEQ ID NO: 443678 - DNA, 21 bp, Homo sapiens
ttcacacacagcctggcctcc

SEQ ID NO: 443679 - DNA, 12 bp, Homo sapiens
ttcacaccctgc

SEQ ID NO: 443680 - DNA, 14 bp, Homo sapiens
ttcacaccctgcaa

SEQ ID NO: 443681 - DNA, 19 bp, Homo sapiens
ttcacacctcacgctctgg

SEQ ID NO: 443682 - DNA, 15 bp, Homo sapiens
ttcacagcacgggca

SEQ ID NO: 443683 - DNA, 15 bp, Homo sapiens
ttcacagttctctcc

SEQ ID NO: 443684 - DNA, 20 bp, Homo sapiens
ttcacagttctctccttctt

SEQ ID NO: 443685 - DNA, 23 bp, Homo sapiens
ttcacagttggctggatgaaatt

SEQ ID NO: 443686 - DNA, 15 bp, Homo sapiens
ttcacataccctccc

SEQ ID NO: 443687 - DNA, 14 bp, Homo sapiens
ttcacatttagaat

SEQ ID NO: 443688 - DNA, 13 bp, Homo sapiens
ttcaccaggaaga

SEQ ID NO: 443689 - DNA, 15 bp, Homo sapiens
ttcaccagtctgtct

SEQ ID NO: 443690 - DNA, 22 bp, Homo sapiens
ttcaccagtttccaagtttatt

SEQ ID NO: 443691 - DNA, 15 bp, Homo sapiens
ttcaccatcatgtac

SEQ ID NO: 443692 - DNA, 15 bp, Homo sapiens
ttcaccatctttcta

SEQ ID NO: 443693 - DNA, 18 bp, Homo sapiens
ttcaccatgttagccggg

SEQ ID NO: 443694 - DNA, 13 bp, Homo sapiens
ttcacccccaact

SEQ ID NO: 443695 - DNA, 13 bp, Homo sapiens
ttcacccccatcc

SEQ ID NO: 443696 - DNA, 18 bp, Homo sapiens
ttcaccccggcaggccct

SEQ ID NO: 443697 - DNA, 21 bp, Homo sapiens
ttcaccccggcaggccctgca

SEQ ID NO: 443698 - DNA, 13 bp, Homo sapiens
ttcacccttttct

SEQ ID NO: 443699 - DNA, 14 bp, Homo sapiens
ttcacctctatcca

SEQ ID NO: 443700 - DNA, 16 bp, Homo sapiens
ttcacctgtgacaaag

SEQ ID NO: 443701 - DNA, 15 bp, Homo sapiens
ttcacgccattctcc

SEQ ID NO: 443702 - DNA, 19 bp, Homo sapiens
ttcacgccattctcctgcc

SEQ ID NO: 443703 - DNA, 22 bp, Homo sapiens
ttcacgccattctcctgcctca

SEQ ID NO: 443704 - DNA, 18 bp, Homo sapiens
ttcacggactctttgctg

SEQ ID NO: 443705 - DNA, 16 bp, Homo sapiens
ttcacggcagaccaga

SEQ ID NO: 443706 - DNA, 20 bp, Homo sapiens
ttcacgtcactgccagagct

SEQ ID NO: 443707 - DNA, 18 bp, Homo sapiens
ttcacgtcttggtgcctt

SEQ ID NO: 443708 - DNA, 22 bp, Homo sapiens
ttcacgtcttggtgccttttgt

SEQ ID NO: 443709 - DNA, 13 bp, Homo sapiens
ttcactctaattg

SEQ ID NO: 443710 - DNA, 12 bp, Homo sapiens
ttcactctctga

SEQ ID NO: 443711 - DNA, 18 bp, Homo sapiens
ttcactgaagtgaataca

SEQ ID NO: 443712 - DNA, 21 bp, Homo sapiens
ttcactgccaacttttagtgg

SEQ ID NO: 443713 - DNA, 20 bp, Homo sapiens
ttcactgccatgatagctgg

SEQ ID NO: 443714 - DNA, 24 bp, Homo sapiens
ttcactgccatgatagctggggct

SEQ ID NO: 443715 - DNA, 18 bp, Homo sapiens
ttcactgctgctcctctt

SEQ ID NO: 443716 - DNA, 22 bp, Homo sapiens
ttcactgctgctcctctttccc

SEQ ID NO: 443717 - DNA, 16 bp, Homo sapiens
ttcactggagttacat

SEQ ID NO: 443718 - DNA, 19 bp, Homo sapiens
ttcactggagttacattaa

SEQ ID NO: 443719 - DNA, 14 bp, Homo sapiens
ttcactttggtcac

SEQ ID NO: 443720 - DNA, 17 bp, Homo sapiens
ttcagaaaacagaaaaa

SEQ ID NO: 443721 - DNA, 19 bp, Homo sapiens
ttcagaaaacagaaaaaaa

SEQ ID NO: 443722 - DNA, 23 bp, Homo sapiens
ttcagaaaacccttttctacagt

SEQ ID NO: 443723 - DNA, 14 bp, Homo sapiens
ttcagaaaagacac

SEQ ID NO: 443724 - DNA, 15 bp, Homo sapiens
ttcagaaaagacact

SEQ ID NO: 443725 - DNA, 19 bp, Homo sapiens
ttcagaaaagacacttcaa

SEQ ID NO: 443726 - DNA, 14 bp, Homo sapiens
ttcagaaaatatta

SEQ ID NO: 443727 - DNA, 22 bp, Homo sapiens
ttcagaaacaaagcatttgact

SEQ ID NO: 443728 - DNA, 19 bp, Homo sapiens
ttcagaaagggcagcccct

SEQ ID NO: 443729 - DNA, 16 bp, Homo sapiens
ttcagaaagtgtgctt

SEQ ID NO: 443730 - DNA, 17 bp, Homo sapiens
ttcagaaatgctgcctg

SEQ ID NO: 443731 - DNA, 20 bp, Homo sapiens
ttcagaaatgctgcctgcct

SEQ ID NO: 443732 - DNA, 20 bp, Homo sapiens
ttcagaacaccaagacttga

SEQ ID NO: 443733 - DNA, 17 bp, Homo sapiens
ttcagaacctcttcccc

SEQ ID NO: 443734 - DNA, 19 bp, Homo sapiens
ttcagaacctcttccccag

SEQ ID NO: 443735 - DNA, 22 bp, Homo sapiens
ttcagaactctcagactctaaa

SEQ ID NO: 443736 - DNA, 22 bp, Homo sapiens
ttcagaactgctaccatgaagt

SEQ ID NO: 443737 - DNA, 12 bp, Homo sapiens
ttcagaagagat

SEQ ID NO: 443738 - DNA, 11 bp, Homo sapiens
ttcagaagtac

SEQ ID NO: 443739 - DNA, 20 bp, Homo sapiens
ttcagaagtttggcaatagt

SEQ ID NO: 443740 - DNA, 16 bp, Homo sapiens
ttccatggcttcctga

SEQ ID NO: 443741 - DNA, 21 bp, Homo sapiens
ttccatgtcgcctctgcattc

SEQ ID NO: 443742 - DNA, 12 bp, Homo sapiens
ttccatgtgttt

SEQ ID NO: 443743 - DNA, 15 bp, Homo sapiens
ttccattaatttcaa

SEQ ID NO: 443744 - DNA, 19 bp, Homo sapiens
ttccattagtaaaacacaa

SEQ ID NO: 443745 - DNA, 13 bp, Homo sapiens
ttccattcttggt

SEQ ID NO: 443746 - DNA, 13 bp, Homo sapiens
ttccattgtgtga

SEQ ID NO: 443747 - DNA, 17 bp, Homo sapiens
ttccatttcttcagagg

SEQ ID NO: 443748 - DNA, 11 bp, Homo sapiens
ttccattttat

SEQ ID NO: 443749 - DNA, 22 bp, Homo sapiens
ttccattttgccacctttcctg

SEQ ID NO: 443750 - DNA, 14 bp, Homo sapiens
ttccattttggaaa

SEQ ID NO: 443751 - DNA, 18 bp, Homo sapiens
ttcccaaactacagaata

SEQ ID NO: 443752 - DNA, 19 bp, Homo sapiens
ttcccaacacttcagactg

SEQ ID NO: 443753 - DNA, 19 bp, Homo sapiens
ttcccaactcactgtgctc

SEQ ID NO: 443754 - DNA, 22 bp, Homo sapiens
ttcccaactcactgtgctccta

SEQ ID NO: 443755 - DNA, 19 bp, Homo sapiens
ttcccaacttccctgttct

SEQ ID NO: 443756 - DNA, 12 bp, Homo sapiens
ttcccaataaaa

SEQ ID NO: 443757 - DNA, 16 bp, Homo sapiens
ttcccaataaaagtga

SEQ ID NO: 443758 - DNA, 19 bp, Homo sapiens
ttcccacacatattcaaat

SEQ ID NO: 443759 - DNA, 18 bp, Homo sapiens
ttcccacaccccagcgcc

SEQ ID NO: 443760 - DNA, 15 bp, Homo sapiens
ttcccaccagctccc

SEQ ID NO: 443761 - DNA, 16 bp, Homo sapiens
ttcccaccagctccca

SEQ ID NO: 443762 - DNA, 17 bp, Homo sapiens
ttcccacggccactgca

SEQ ID NO: 443763 - DNA, 21 bp, Homo sapiens
ttcccactaagctttctcctt

SEQ ID NO: 443764 - DNA, 15 bp, Homo sapiens
ttcccactgcacttg

SEQ ID NO: 443765 - DNA, 13 bp, Homo sapiens
ttcccactgtcct

SEQ ID NO: 443766 - DNA, 17 bp, Homo sapiens
ttcccactgtcctttct

SEQ ID NO: 443767 - DNA, 21 bp, Homo sapiens
ttcccactgtcctttctccag

SEQ ID NO: 443768 - DNA, 17 bp, Homo sapiens
ttcccactttcattcaa

SEQ ID NO: 443769 - DNA, 19 bp, Homo sapiens
ttcccagccctttccaggg

SEQ ID NO: 443770 - DNA, 13 bp, Homo sapiens
ttcccagctggca

SEQ ID NO: 443771 - DNA, 22 bp, Homo sapiens
ttcccagctggcagcgcctccc

SEQ ID NO: 443772 - DNA, 12 bp, Homo sapiens
ttcccaggcagg

SEQ ID NO: 443773 - DNA, 17 bp, Homo sapiens
ttcccaggcagggaggg

SEQ ID NO: 443774 - DNA, 10 bp, Homo sapiens
ttcccaggcc

SEQ ID NO: 443775 - DNA, 12 bp, Homo sapiens
ttcccaggccag

SEQ ID NO: 443776 - DNA, 16 bp, Homo sapiens
ttcccagggctggaga

SEQ ID NO: 443777 - DNA, 17 bp, Homo sapiens
ttcccaggttacaatgg

SEQ ID NO: 443778 - DNA, 15 bp, Homo sapiens
ttcccagtgggctgt

SEQ ID NO: 443779 - DNA, 14 bp, Homo sapiens
ttcccatcacccct

SEQ ID NO: 443780 - DNA, 17 bp, Homo sapiens
ttcccatcactgctgtc

SEQ ID NO: 443781 - DNA, 22 bp, Homo sapiens
ttcccatgactgcacccagctc

SEQ ID NO: 443782 - DNA, 20 bp, Homo sapiens
ttcccatggtagactgtgac

SEQ ID NO: 443783 - DNA, 17 bp, Homo sapiens
ttcccattggtctgcat

SEQ ID NO: 443784 - DNA, 18 bp, Homo sapiens
ttcccattggtctgcatg

SEQ ID NO: 443785 - DNA, 22 bp, Homo sapiens
ttcccatttcgtgtaatattct

SEQ ID NO: 443786 - DNA, 17 bp, Homo sapiens
ttcccattttgcaaaat

SEQ ID NO: 443787 - DNA, 18 bp, Homo sapiens
ttccccaacgaaaagcac

SEQ ID NO: 443788 - DNA, 19 bp, Homo sapiens
ttccccaccttcccccaac

SEQ ID NO: 443789 - DNA, 12 bp, Homo sapiens
ttccccactccc

SEQ ID NO: 443790 - DNA, 20 bp, Homo sapiens
ttccccactctgctcccagc

SEQ ID NO: 443791 - DNA, 22 bp, Homo sapiens
ttccccactctgctcccagccc

SEQ ID NO: 443792 - DNA, 17 bp, Homo sapiens
ttccccactgacagcct

SEQ ID NO: 443793 - DNA, 18 bp, Homo sapiens
ttccccagaggctcccaa

SEQ ID NO: 443794 - DNA, 18 bp, Homo sapiens
ttccccaggggaaaatga

SEQ ID NO: 443795 - DNA, 20 bp, Homo sapiens
ttccccatatttgtgttcag

SEQ ID NO: 443796 - DNA, 11 bp, Homo sapiens
ttccccatggg

SEQ ID NO: 443797 - DNA, 20 bp, Homo sapiens
ttcccccaaatcttcctctg

SEQ ID NO: 443798 - DNA, 15 bp, Homo sapiens
ttcccccagcccaat

SEQ ID NO: 443799 - DNA, 16 bp, Homo sapiens
ttcccccagcccaata

SEQ ID NO: 443800 - DNA, 17 bp, Homo sapiens
ttcccccagcccaataa

SEQ ID NO: 443801 - DNA, 15 bp, Homo sapiens
ttcccccagccctgt

SEQ ID NO: 443802 - DNA, 21 bp, Homo sapiens
ttcccccagtacctccaagca

SEQ ID NO: 443803 - DNA, 14 bp, Homo sapiens
ttccccctccatgt

SEQ ID NO: 443804 - DNA, 17 bp, Homo sapiens
ttccccctctcccagtt

SEQ ID NO: 443805 - DNA, 10 bp, Homo sapiens
ttcccccttc

SEQ ID NO: 443806 - DNA, 13 bp, Homo sapiens
ttcccccttcccc

SEQ ID NO: 443807 - DNA, 20 bp, Homo sapiens
ttcccctcagaacaccctgt

SEQ ID NO: 443808 - DNA, 14 bp, Homo sapiens
ttcccctcccacct

SEQ ID NO: 443809 - DNA, 17 bp, Homo sapiens
ttcccctccctggctcc

SEQ ID NO: 443810 - DNA, 14 bp, Homo sapiens
ttcccctccctggg

SEQ ID NO: 443811 - DNA, 17 bp, Homo sapiens
ttcccctcctttgtctt

SEQ ID NO: 443812 - DNA, 16 bp, Homo sapiens
ttcccctgcgccctcc

SEQ ID NO: 443813 - DNA, 17 bp, Homo sapiens
ttcccctgcgccctccc

SEQ ID NO: 443814 - DNA, 19 bp, Homo sapiens
ttcccctgcgccctccctc

SEQ ID NO: 443815 - DNA, 12 bp, Homo sapiens
ttcccctgctga

SEQ ID NO: 443816 - DNA, 14 bp, Homo sapiens
ttcccctgttcact

SEQ ID NO: 443817 - DNA, 22 bp, Homo sapiens
ttccccttgggatgggcacagg

SEQ ID NO: 443818 - DNA, 17 bp, Homo sapiens
ttccccttttgcctggc

SEQ ID NO: 443819 - DNA, 18 bp, Homo sapiens
ttccccttttgcctggct

SEQ ID NO: 443820 - DNA, 14 bp, Homo sapiens
ttcccgcctcagcc

SEQ ID NO: 443821 - DNA, 15 bp, Homo sapiens
ttcccgcctcagcct

SEQ ID NO: 443822 - DNA, 15 bp, Homo sapiens
ttcccgctcagccct

SEQ ID NO: 443823 - DNA, 21 bp, Homo sapiens
ttcccgctcagccctccctgc

SEQ ID NO: 443824 - DNA, 20 bp, Homo sapiens
ttcccggagcacagccctgg

SEQ ID NO: 443825 - DNA, 21 bp, Homo sapiens
ttccctacccacagggcctga

SEQ ID NO: 443826 - DNA, 15 bp, Homo sapiens
ttccctacctcaggc

SEQ ID NO: 443827 - DNA, 13 bp, Homo sapiens
ttccctacttcct

SEQ ID NO: 443828 - DNA, 15 bp, Homo sapiens
ttccctagaaagcca

SEQ ID NO: 443829 - DNA, 18 bp, Homo sapiens
ttccctagaaagccatat

SEQ ID NO: 443830 - DNA, 21 bp, Homo sapiens
ttccctagaaagccatattcc

SEQ ID NO: 443831 - DNA, 16 bp, Homo sapiens
ttccctagatggttcc

SEQ ID NO: 443832 - DNA, 12 bp, Homo sapiens
ttccctatcact

SEQ ID NO: 443833 - DNA, 20 bp, Homo sapiens
ttccctccccacagtcctca

SEQ ID NO: 443834 - DNA, 14 bp, Homo sapiens
ttccctctcatcca

SEQ ID NO: 443835 - DNA, 14 bp, Homo sapiens
ttccctctccctgt

SEQ ID NO: 443836 - DNA, 14 bp, Homo sapiens
ttccctctgctcca

SEQ ID NO: 443837 - DNA, 15 bp, Homo sapiens
ttccctctgctcctg

SEQ ID NO: 443838 - DNA, 16 bp, Homo sapiens
ttccctcttccctggt

SEQ ID NO: 443839 - DNA, 16 bp, Homo sapiens
ttccctgcatcccttg

SEQ ID NO: 443840 - DNA, 20 bp, Homo sapiens
ttccctgcctaggagctggg

SEQ ID NO: 443841 - DNA, 12 bp, Homo sapiens
ttccctgctggc

SEQ ID NO: 443842 - DNA, 13 bp, Homo sapiens
ttccctgctggcc

SEQ ID NO: 443843 - DNA, 19 bp, Homo sapiens
ttccctgctggccaaagtc

SEQ ID NO: 443844 - DNA, 11 bp, Homo sapiens
ttccctggaga

SEQ ID NO: 443845 - DNA, 16 bp, Homo sapiens
ttccctggctcaggga

SEQ ID NO: 443846 - DNA, 12 bp, Homo sapiens
ttccctgtagga

SEQ ID NO: 443847 - DNA, 14 bp, Homo sapiens
ttccctgtcagagg

SEQ ID NO: 443848 - DNA, 22 bp, Homo sapiens
ttcccttagcctctcccacccg

SEQ ID NO: 443849 - DNA, 13 bp, Homo sapiens
ttcccttccactg

SEQ ID NO: 443850 - DNA, 19 bp, Homo sapiens
ttcccttccactgcctctg

SEQ ID NO: 443851 - DNA, 17 bp, Homo sapiens
ttcccttctccttccaa

SEQ ID NO: 443852 - DNA, 20 bp, Homo sapiens
ttcccttggaatgcatatcg

SEQ ID NO: 443853 - DNA, 14 bp, Homo sapiens
ttcccttggcctca

SEQ ID NO: 443854 - DNA, 15 bp, Homo sapiens
ttcccttggcctcag

SEQ ID NO: 443855 - DNA, 16 bp, Homo sapiens
ttcccttggcctcaga

SEQ ID NO: 443856 - DNA, 15 bp, Homo sapiens
ttccctttgacttca

SEQ ID NO: 443857 - DNA, 17 bp, Homo sapiens
ttccctttgctccaccc

SEQ ID NO: 443858 - DNA, 17 bp, Homo sapiens
ttccctttgttgctgtc

SEQ ID NO: 443859 - DNA, 15 bp, Homo sapiens
ttccggccctggctg

SEQ ID NO: 443860 - DNA, 17 bp, Homo sapiens
ttccgtgggtcatccca

SEQ ID NO: 443861 - DNA, 23 bp, Homo sapiens
ttccgttaacctttttgtaaata

SEQ ID NO: 443862 - DNA, 13 bp, Homo sapiens
ttcctaaatatcc

SEQ ID NO: 443863 - DNA, 18 bp, Homo sapiens
ttcctaacacagcatgtg

SEQ ID NO: 443864 - DNA, 13 bp, Homo sapiens
ttcctaagctgtt

SEQ ID NO: 443865 - DNA, 17 bp, Homo sapiens
ttcctaatcagaaattt

SEQ ID NO: 443866 - DNA, 21 bp, Homo sapiens
ttcctaattaaaataagaatt

SEQ ID NO: 443867 - DNA, 20 bp, Homo sapiens
ttcctacaagagcagcctgt

SEQ ID NO: 443868 - DNA, 18 bp, Homo sapiens
ttcctacacccttggact

SEQ ID NO: 443869 - DNA, 18 bp, Homo sapiens
ttcctacagccccttttt

SEQ ID NO: 443870 - DNA, 23 bp, Homo sapiens
ttcctaccattatggctttgtgc

SEQ ID NO: 443871 - DNA, 14 bp, Homo sapiens
ttcctacttaaaca

SEQ ID NO: 443872 - DNA, 15 bp, Homo sapiens
ttctcctctctgggc

SEQ ID NO: 443873 - DNA, 13 bp, Homo sapiens
ttctcctgcctca

SEQ ID NO: 443874 - DNA, 15 bp, Homo sapiens
ttctcctgcctcagc

SEQ ID NO: 443875 - DNA, 13 bp, Homo sapiens
ttctcctgcttgt

SEQ ID NO: 443876 - DNA, 13 bp, Homo sapiens
ttctcctgtgccc

SEQ ID NO: 443877 - DNA, 15 bp, Homo sapiens
ttctccttagtcttc

SEQ ID NO: 443878 - DNA, 22 bp, Homo sapiens
ttctccttccaactgctgcccc

SEQ ID NO: 443879 - DNA, 14 bp, Homo sapiens
ttctcggaggccag

SEQ ID NO: 443880 - DNA, 18 bp, Homo sapiens
ttctcgtagatgctgcct

SEQ ID NO: 443881 - DNA, 14 bp, Homo sapiens
ttctcgtgacccag

SEQ ID NO: 443882 - DNA, 19 bp, Homo sapiens
ttctcgtgacccagtggca

SEQ ID NO: 443883 - DNA, 21 bp, Homo sapiens
ttctctaacttcaaggcccat

SEQ ID NO: 443884 - DNA, 17 bp, Homo sapiens
ttctctatttttgttaa

SEQ ID NO: 443885 - DNA, 13 bp, Homo sapiens
ttctctcacctcc

SEQ ID NO: 443886 - DNA, 19 bp, Homo sapiens
ttctctcccttcctctctc

SEQ ID NO: 443887 - DNA, 12 bp, Homo sapiens
ttctctctatgc

SEQ ID NO: 443888 - DNA, 18 bp, Homo sapiens
ttctctctatggtaaaga

SEQ ID NO: 443889 - DNA, 22 bp, Homo sapiens
ttctctctatggtaaagatatt

SEQ ID NO: 443890 - DNA, 14 bp, Homo sapiens
ttctctcttctctc

SEQ ID NO: 443891 - DNA, 15 bp, Homo sapiens
ttctctgctccacca

SEQ ID NO: 443892 - DNA, 23 bp, Homo sapiens
ttctctgggtaggtgttgaaaat

SEQ ID NO: 443893 - DNA, 15 bp, Homo sapiens
ttctctgtccagggc

SEQ ID NO: 443894 - DNA, 20 bp, Homo sapiens
ttctctgtgaacgatttaga

SEQ ID NO: 443895 - DNA, 24 bp, Homo sapiens
ttctctgtgtttgttcctacagcc

SEQ ID NO: 443896 - DNA, 14 bp, Homo sapiens
ttctcttaacttaa

SEQ ID NO: 443897 - DNA, 15 bp, Homo sapiens
ttctcttaatttaat

SEQ ID NO: 443898 - DNA, 15 bp, Homo sapiens
ttctcttcagtgtgt

SEQ ID NO: 443899 - DNA, 16 bp, Homo sapiens
ttctcttcagtgtgtt

SEQ ID NO: 443900 - DNA, 15 bp, Homo sapiens
ttctcttgggctgag

SEQ ID NO: 443901 - DNA, 15 bp, Homo sapiens
ttctcttgtaaaaag

SEQ ID NO: 443902 - DNA, 13 bp, Homo sapiens
ttctctttcaaag

SEQ ID NO: 443903 - DNA, 17 bp, Homo sapiens
ttctcttttcctcgcag

SEQ ID NO: 443904 - DNA, 12 bp, Homo sapiens
ttctgaactcgc

SEQ ID NO: 443905 - DNA, 16 bp, Homo sapiens
ttctgaactttggaag

SEQ ID NO: 443906 - DNA, 18 bp, Homo sapiens
ttctgaaggttggaactg

SEQ ID NO: 443907 - DNA, 21 bp, Homo sapiens
ttctgaaggttggaactgctg

SEQ ID NO: 443908 - DNA, 15 bp, Homo sapiens
ttctgaataacttga

SEQ ID NO: 443909 - DNA, 17 bp, Homo sapiens
ttctgaataacttgaag

SEQ ID NO: 443910 - DNA, 16 bp, Homo sapiens
ttctgaataatttctt

SEQ ID NO: 443911 - DNA, 18 bp, Homo sapiens
ttctgacaataaataata

SEQ ID NO: 443912 - DNA, 14 bp, Homo sapiens
ttctgacattaaca

SEQ ID NO: 443913 - DNA, 23 bp, Homo sapiens
ttctgacattaacagttttccat

SEQ ID NO: 443914 - DNA, 23 bp, Homo sapiens
ttctgaccccacttatgctgctg

SEQ ID NO: 443915 - DNA, 23 bp, Homo sapiens
ttctgagcacgggcaaagaaaac

SEQ ID NO: 443916 - DNA, 10 bp, Homo sapiens
ttctgagccc

SEQ ID NO: 443917 - DNA, 11 bp, Homo sapiens
ttctgagcccc

SEQ ID NO: 443918 - DNA, 22 bp, Homo sapiens
ttctgagcccccacctgcctga

SEQ ID NO: 443919 - DNA, 13 bp, Homo sapiens
ttctgagccttga

SEQ ID NO: 443920 - DNA, 19 bp, Homo sapiens
ttctgagcttttcatggaa

SEQ ID NO: 443921 - DNA, 20 bp, Homo sapiens
ttctgagcttttcatggaag

SEQ ID NO: 443922 - DNA, 22 bp, Homo sapiens
ttctgataactagatggtgctg

SEQ ID NO: 443923 - DNA, 23 bp, Homo sapiens
ttctgataactagatggtgctga

SEQ ID NO: 443924 - DNA, 14 bp, Homo sapiens
ttctgatattaatt

SEQ ID NO: 443925 - DNA, 18 bp, Homo sapiens
ttctgattcactattaga

SEQ ID NO: 443926 - DNA, 19 bp, Homo sapiens
ttctgcaaatagaaaacag

SEQ ID NO: 443927 - DNA, 23 bp, Homo sapiens
ttctgcaaatagaaaacaggaaa

SEQ ID NO: 443928 - DNA, 17 bp, Homo sapiens
ttctgcaactagccaag

SEQ ID NO: 443929 - DNA, 21 bp, Homo sapiens
ttctgcaagcacatctgcatt

SEQ ID NO: 443930 - DNA, 12 bp, Homo sapiens
ttctgcagaggc

SEQ ID NO: 443931 - DNA, 12 bp, Homo sapiens
ttctgcagctgt

SEQ ID NO: 443932 - DNA, 15 bp, Homo sapiens
ttctgcagctgtttt

SEQ ID NO: 443933 - DNA, 22 bp, Homo sapiens
ttctgccacttgcactgtgctt

SEQ ID NO: 443934 - DNA, 10 bp, Homo sapiens
ttctgccagc

SEQ ID NO: 443935 - DNA, 19 bp, Homo sapiens
ttctgcccccgttccagct

SEQ ID NO: 443936 - DNA, 15 bp, Homo sapiens
ttctgcctgcctggg

SEQ ID NO: 443937 - DNA, 16 bp, Homo sapiens
ttctgcggtgaggcag

SEQ ID NO: 443938 - DNA, 24 bp, Homo sapiens
ttctgctaggtagaggcatttgtc

SEQ ID NO: 443939 - DNA, 18 bp, Homo sapiens
ttctgctcacattccctc

SEQ ID NO: 443940 - DNA, 18 bp, Homo sapiens
ttctgctccacccttggc

SEQ ID NO: 443941 - DNA, 15 bp, Homo sapiens
ttctgctggcctgga

SEQ ID NO: 443942 - DNA, 19 bp, Homo sapiens
ttctgctggcctggatctc

SEQ ID NO: 443943 - DNA, 16 bp, Homo sapiens
ttctgcttaggagaga

SEQ ID NO: 443944 - DNA, 21 bp, Homo sapiens
ttctgctttctattacccctc

SEQ ID NO: 443945 - DNA, 20 bp, Homo sapiens
ttctggaaattcttccctgg

SEQ ID NO: 443946 - DNA, 18 bp, Homo sapiens
ttctggaaggctggctga

SEQ ID NO: 443947 - DNA, 19 bp, Homo sapiens
ttctggaaggctggctgag

SEQ ID NO: 443948 - DNA, 15 bp, Homo sapiens
ttctggaatgtaatc

SEQ ID NO: 443949 - DNA, 20 bp, Homo sapiens
ttctggaatgtaatcaatgt

SEQ ID NO: 443950 - DNA, 20 bp, Homo sapiens
ttctggactctgccccaatc

SEQ ID NO: 443951 - DNA, 23 bp, Homo sapiens
ttctggatggccgggctgctgct

SEQ ID NO: 443952 - DNA, 12 bp, Homo sapiens
ttctggcctcag

SEQ ID NO: 443953 - DNA, 15 bp, Homo sapiens
ttctgggaaaggtgc

SEQ ID NO: 443954 - DNA, 22 bp, Homo sapiens
ttctgggaagaaaatgagatgg

SEQ ID NO: 443955 - DNA, 21 bp, Homo sapiens
ttctgggaagcttgagcctcc

SEQ ID NO: 443956 - DNA, 22 bp, Homo sapiens
ttctgggaagcttgagcctccc

SEQ ID NO: 443957 - DNA, 21 bp, Homo sapiens
ttctgggaagggagagttctt

SEQ ID NO: 443958 - DNA, 19 bp, Homo sapiens
ttctgggcaccctcccacc

SEQ ID NO: 443959 - DNA, 13 bp, Homo sapiens
ttctgggcagagc

SEQ ID NO: 443960 - DNA, 20 bp, Homo sapiens
ttctgggcagagcctgtccc

SEQ ID NO: 443961 - DNA, 19 bp, Homo sapiens
ttctgggcttggggtgtgg

SEQ ID NO: 443962 - DNA, 22 bp, Homo sapiens
ttctggggtggggcttggaagg

SEQ ID NO: 443963 - DNA, 14 bp, Homo sapiens
ttctggtaacctgt

SEQ ID NO: 443964 - DNA, 18 bp, Homo sapiens
ttctggtagatagaaata

SEQ ID NO: 443965 - DNA, 13 bp, Homo sapiens
ttctggtggcccc

SEQ ID NO: 443966 - DNA, 14 bp, Homo sapiens
ttctggtggcccca

SEQ ID NO: 443967 - DNA, 19 bp, Homo sapiens
ttctggttagctcagcccc

SEQ ID NO: 443968 - DNA, 16 bp, Homo sapiens
ttctgtaaaatggaaa

SEQ ID NO: 443969 - DNA, 19 bp, Homo sapiens
ttctgtaaactcaaaactt

SEQ ID NO: 443970 - DNA, 13 bp, Homo sapiens
ttctgtaaataac

SEQ ID NO: 443971 - DNA, 13 bp, Homo sapiens
ttctgtaaatgaa

SEQ ID NO: 443972 - DNA, 20 bp, Homo sapiens
ttctgtagtactccttaaga

SEQ ID NO: 443973 - DNA, 18 bp, Homo sapiens
ttctgtatcaagcccctg

SEQ ID NO: 443974 - DNA, 22 bp, Homo sapiens
ttctgtatcaagcccctgtcta

SEQ ID NO: 443975 - DNA, 14 bp, Homo sapiens
ttctgtccatcagt

SEQ ID NO: 443976 - DNA, 19 bp, Homo sapiens
ttctgtccatcagtgcatg

SEQ ID NO: 443977 - DNA, 14 bp, Homo sapiens
ttctgtccctgtcc

SEQ ID NO: 443978 - DNA, 18 bp, Homo sapiens
ttctgtccctgtccctgc

SEQ ID NO: 443979 - DNA, 23 bp, Homo sapiens
ttctgtccttttggcactgagat

SEQ ID NO: 443980 - DNA, 22 bp, Homo sapiens
ttctgtgaagccctttgcctgt

SEQ ID NO: 443981 - DNA, 21 bp, Homo sapiens
ttctgtgcatttgtgtctgcc

SEQ ID NO: 443982 - DNA, 22 bp, Homo sapiens
ttctgtgcatttgtgtctgcct

SEQ ID NO: 443983 - DNA, 24 bp, Homo sapiens
ttctgtgcatttgtgtctgcctgc

SEQ ID NO: 443984 - DNA, 14 bp, Homo sapiens
ttctgtgcccagct

SEQ ID NO: 443985 - DNA, 12 bp, Homo sapiens
ttctgtgcctcc

SEQ ID NO: 443986 - DNA, 14 bp, Homo sapiens
ttctgtgcctcccc

SEQ ID NO: 443987 - DNA, 15 bp, Homo sapiens
ttctgtgtctgtcac

SEQ ID NO: 443988 - DNA, 20 bp, Homo sapiens
ttctgtgtgttttcataata

SEQ ID NO: 443989 - DNA, 17 bp, Homo sapiens
ttctgttaaaatcagga

SEQ ID NO: 443990 - DNA, 23 bp, Homo sapiens
ttctgttcctctcttttcctgtt

SEQ ID NO: 443991 - DNA, 12 bp, Homo sapiens
ttctgttctgcc

SEQ ID NO: 443992 - DNA, 20 bp, Homo sapiens
ttctgtttccataggaatca

SEQ ID NO: 443993 - DNA, 15 bp, Homo sapiens
ttctgttttagagtt

SEQ ID NO: 443994 - DNA, 21 bp, Homo sapiens
ttctgttttgcctgaagttgg

SEQ ID NO: 443995 - DNA, 17 bp, Homo sapiens
ttctgtttttctcaaat

SEQ ID NO: 443996 - DNA, 20 bp, Homo sapiens
ttctgtttttctcaaataaa

SEQ ID NO: 443997 - DNA, 23 bp, Homo sapiens
ttcttaaaattcaagaaaataaa

SEQ ID NO: 443998 - DNA, 14 bp, Homo sapiens
ttcttaaatggaat

SEQ ID NO: 443999 - DNA, 18 bp, Homo sapiens
ttcttaagacatgtatca

SEQ ID NO: 444000 - DNA, 19 bp, Homo sapiens
ttcttaaggcaataaaact

SEQ ID NO: 444001 - DNA, 16 bp, Homo sapiens
ttcttacatgcatttg

SEQ ID NO: 444002 - DNA, 18 bp, Homo sapiens
ttgagtgggtatttctta

SEQ ID NO: 444003 - DNA, 17 bp, Homo sapiens
ttgagtgttttaagata

SEQ ID NO: 444004 - DNA, 18 bp, Homo sapiens
ttgagttctgtagagcct

SEQ ID NO: 444005 - DNA, 14 bp, Homo sapiens
ttgagttggacaca

SEQ ID NO: 444006 - DNA, 17 bp, Homo sapiens
ttgagttggacacactg

SEQ ID NO: 444007 - DNA, 17 bp, Homo sapiens
ttgagtttcatttttca

SEQ ID NO: 444008 - DNA, 16 bp, Homo sapiens
ttgagtttgacattta

SEQ ID NO: 444009 - DNA, 23 bp, Homo sapiens
ttgagtttgctgtatacaaacag

SEQ ID NO: 444010 - DNA, 16 bp, Homo sapiens
ttgagttttatttatt

SEQ ID NO: 444011 - DNA, 23 bp, Homo sapiens
ttgataaaatgttccttttgaca

SEQ ID NO: 444012 - DNA, 19 bp, Homo sapiens
ttgataataaattgaaatt

SEQ ID NO: 444013 - DNA, 19 bp, Homo sapiens
ttgataggagacttgtaca

SEQ ID NO: 444014 - DNA, 14 bp, Homo sapiens
ttgatatattcttt

SEQ ID NO: 444015 - DNA, 15 bp, Homo sapiens
ttgatatattctttc

SEQ ID NO: 444016 - DNA, 16 bp, Homo sapiens
ttgatatattctttcc

SEQ ID NO: 444017 - DNA, 21 bp, Homo sapiens
ttgatatattctttccatgca

SEQ ID NO: 444018 - DNA, 17 bp, Homo sapiens
ttgatatgattgtaaca

SEQ ID NO: 444019 - DNA, 22 bp, Homo sapiens
ttgatatgattgtaacatattt

SEQ ID NO: 444020 - DNA, 16 bp, Homo sapiens
ttgatatgcttataca

SEQ ID NO: 444021 - DNA, 22 bp, Homo sapiens
ttgatattttcaacgcagccct

SEQ ID NO: 444022 - DNA, 16 bp, Homo sapiens
ttgatcatgcaggaac

SEQ ID NO: 444023 - DNA, 19 bp, Homo sapiens
ttgatcatgcaggaactga

SEQ ID NO: 444024 - DNA, 13 bp, Homo sapiens
ttgatcattcata

SEQ ID NO: 444025 - DNA, 21 bp, Homo sapiens
ttgatcattcataattttatc

SEQ ID NO: 444026 - DNA, 15 bp, Homo sapiens
ttgatcgatgttaaa

SEQ ID NO: 444027 - DNA, 19 bp, Homo sapiens
ttgatctaaggcatgctcc

SEQ ID NO: 444028 - DNA, 16 bp, Homo sapiens
ttgatctccgtggctt

SEQ ID NO: 444029 - DNA, 14 bp, Homo sapiens
ttgatctgaaattc

SEQ ID NO: 444030 - DNA, 12 bp, Homo sapiens
ttgatctggtgc

SEQ ID NO: 444031 - DNA, 11 bp, Homo sapiens
ttgatgaaaag

SEQ ID NO: 444032 - DNA, 18 bp, Homo sapiens
ttgatgaaattcttgaag

SEQ ID NO: 444033 - DNA, 19 bp, Homo sapiens
ttgatgataatacccacat

SEQ ID NO: 444034 - DNA, 14 bp, Homo sapiens
ttgatgccagctgt

SEQ ID NO: 444035 - DNA, 17 bp, Homo sapiens
ttgatgctggagaggtt

SEQ ID NO: 444036 - DNA, 18 bp, Homo sapiens
ttgatgctggagaggtta

SEQ ID NO: 444037 - DNA, 14 bp, Homo sapiens
ttgatggagaagga

SEQ ID NO: 444038 - DNA, 18 bp, Homo sapiens
ttgatggagaaggaaaag

SEQ ID NO: 444039 - DNA, 13 bp, Homo sapiens
ttgatgggttcta

SEQ ID NO: 444040 - DNA, 15 bp, Homo sapiens
ttgatggtgaatatt

SEQ ID NO: 444041 - DNA, 12 bp, Homo sapiens
ttgatggtttat

SEQ ID NO: 444042 - DNA, 13 bp, Homo sapiens
ttgatgtaaaatc

SEQ ID NO: 444043 - DNA, 15 bp, Homo sapiens
ttgatgtaaaatctt

SEQ ID NO: 444044 - DNA, 20 bp, Homo sapiens
ttgatgtacagtctgtcatg

SEQ ID NO: 444045 - DNA, 13 bp, Homo sapiens
ttgatgtcagcct

SEQ ID NO: 444046 - DNA, 17 bp, Homo sapiens
ttgatgtgcgtgctgtc

SEQ ID NO: 444047 - DNA, 20 bp, Homo sapiens
ttgatgtgcgtgctgtctgt

SEQ ID NO: 444048 - DNA, 19 bp, Homo sapiens
ttgatgtgtatgtgtttat

SEQ ID NO: 444049 - DNA, 11 bp, Homo sapiens
ttgatgtgttt

SEQ ID NO: 444050 - DNA, 18 bp, Homo sapiens
ttgatgtgtttttgtatg

SEQ ID NO: 444051 - DNA, 13 bp, Homo sapiens
ttgatgtttgtgg

SEQ ID NO: 444052 - DNA, 15 bp, Homo sapiens
ttgatgtttgtggcc

SEQ ID NO: 444053 - DNA, 18 bp, Homo sapiens
ttgatgtttgtggcctca

SEQ ID NO: 444054 - DNA, 22 bp, Homo sapiens
ttgatgtttgtggcctcagaat

SEQ ID NO: 444055 - DNA, 21 bp, Homo sapiens
ttgattaaactgtatgtctta

SEQ ID NO: 444056 - DNA, 17 bp, Homo sapiens
ttgattaagattttaca

SEQ ID NO: 444057 - DNA, 23 bp, Homo sapiens
ttgattacataatgttagtagca

SEQ ID NO: 444058 - DNA, 14 bp, Homo sapiens
ttgattccatctcc

SEQ ID NO: 444059 - DNA, 13 bp, Homo sapiens
ttgattctgtccc

SEQ ID NO: 444060 - DNA, 22 bp, Homo sapiens
ttgattctgtcccccacgtgga

SEQ ID NO: 444061 - DNA, 19 bp, Homo sapiens
ttgattgaaaaaagagaaa

SEQ ID NO: 444062 - DNA, 22 bp, Homo sapiens
ttgattgatttttaaagtttaa

SEQ ID NO: 444063 - DNA, 21 bp, Homo sapiens
ttgattgtcagctactaatga

SEQ ID NO: 444064 - DNA, 16 bp, Homo sapiens
ttgatttgaagtggaa

SEQ ID NO: 444065 - DNA, 22 bp, Homo sapiens
ttgattttaattactttctgaa

SEQ ID NO: 444066 - DNA, 14 bp, Homo sapiens
ttgattttcaagct

SEQ ID NO: 444067 - DNA, 20 bp, Homo sapiens
ttgattttcaagctttcaaa

SEQ ID NO: 444068 - DNA, 21 bp, Homo sapiens
ttgattttccccctaattctt

SEQ ID NO: 444069 - DNA, 18 bp, Homo sapiens
ttgatttttaaagtttaa

SEQ ID NO: 444070 - DNA, 20 bp, Homo sapiens
ttgcaaaaagtgaacagatt

SEQ ID NO: 444071 - DNA, 14 bp, Homo sapiens
ttgcaaaacaaaca

SEQ ID NO: 444072 - DNA, 17 bp, Homo sapiens
ttgcaaaagactaattt

SEQ ID NO: 444073 - DNA, 14 bp, Homo sapiens
ttgcaaaaggttaa

SEQ ID NO: 444074 - DNA, 16 bp, Homo sapiens
ttgcaaaatttccagt

SEQ ID NO: 444075 - DNA, 22 bp, Homo sapiens
ttgcaaaatttccagtaccttt

SEQ ID NO: 444076 - DNA, 20 bp, Homo sapiens
ttgcaaattccacccctcct

SEQ ID NO: 444077 - DNA, 19 bp, Homo sapiens
ttgcaacaataataaatgt

SEQ ID NO: 444078 - DNA, 15 bp, Homo sapiens
ttgcaacacacagac

SEQ ID NO: 444079 - DNA, 12 bp, Homo sapiens
ttgcaacttcat

SEQ ID NO: 444080 - DNA, 19 bp, Homo sapiens
ttgcaagggaatgaatcca

SEQ ID NO: 444081 - DNA, 20 bp, Homo sapiens
ttgcacaaaaagcacaagca

SEQ ID NO: 444082 - DNA, 15 bp, Homo sapiens
ttgcacacttcaaat

SEQ ID NO: 444083 - DNA, 13 bp, Homo sapiens
ttgcacacttgtg

SEQ ID NO: 444084 - DNA, 17 bp, Homo sapiens
ttgcacagtccctcctg

SEQ ID NO: 444085 - DNA, 13 bp, Homo sapiens
ttgcacatatatt

SEQ ID NO: 444086 - DNA, 20 bp, Homo sapiens
ttgcacatatattttttaca

SEQ ID NO: 444087 - DNA, 20 bp, Homo sapiens
ttgcacatggattgattaaa

SEQ ID NO: 444088 - DNA, 21 bp, Homo sapiens
ttgcaccccaaagctttcctg

SEQ ID NO: 444089 - DNA, 22 bp, Homo sapiens
ttgcaccccaaagctttcctgc

SEQ ID NO: 444090 - DNA, 17 bp, Homo sapiens
ttgcacctacctcacag

SEQ ID NO: 444091 - DNA, 17 bp, Homo sapiens
ttgcacgcccatgtgtg

SEQ ID NO: 444092 - DNA, 13 bp, Homo sapiens
ttgcactgctgtt

SEQ ID NO: 444093 - DNA, 23 bp, Homo sapiens
ttgcactgggggaacagatgcta

SEQ ID NO: 444094 - DNA, 19 bp, Homo sapiens
ttgcactttataaacactg

SEQ ID NO: 444095 - DNA, 20 bp, Homo sapiens
ttgcagaagggggtctcttc

SEQ ID NO: 444096 - DNA, 12 bp, Homo sapiens
ttgcagacctgg

SEQ ID NO: 444097 - DNA, 17 bp, Homo sapiens
ttgcagacctgggactt

SEQ ID NO: 444098 - DNA, 20 bp, Homo sapiens
ttgcagacctgggactttag

SEQ ID NO: 444099 - DNA, 19 bp, Homo sapiens
ttgcagactcagtttgtca

SEQ ID NO: 444100 - DNA, 18 bp, Homo sapiens
ttgcagagaagccttggt

SEQ ID NO: 444101 - DNA, 14 bp, Homo sapiens
ttgcagcagtacca

SEQ ID NO: 444102 - DNA, 12 bp, Homo sapiens
ttgcagcagtga

SEQ ID NO: 444103 - DNA, 20 bp, Homo sapiens
ttgcagccggcacagggtct

SEQ ID NO: 444104 - DNA, 19 bp, Homo sapiens
ttgcagcctagtaggagct

SEQ ID NO: 444105 - DNA, 17 bp, Homo sapiens
ttgcagctgctcttgca

SEQ ID NO: 444106 - DNA, 11 bp, Homo sapiens
ttgcaggaagg

SEQ ID NO: 444107 - DNA, 21 bp, Homo sapiens
ttgcagggctaaggcccccaa

SEQ ID NO: 444108 - DNA, 13 bp, Homo sapiens
ttgcagtaaagtt

SEQ ID NO: 444109 - DNA, 14 bp, Homo sapiens
ttgcataaaattgg

SEQ ID NO: 444110 - DNA, 19 bp, Homo sapiens
ttgcataatactaatttat

SEQ ID NO: 444111 - DNA, 22 bp, Homo sapiens
ttgcatagtaccaatcatttta

SEQ ID NO: 444112 - DNA, 23 bp, Homo sapiens
ttgcatagtaccaatcattttaa

SEQ ID NO: 444113 - DNA, 14 bp, Homo sapiens
ttgcatctgggcca

SEQ ID NO: 444114 - DNA, 15 bp, Homo sapiens
ttgcatgttcttgtt

SEQ ID NO: 444115 - DNA, 11 bp, Homo sapiens
ttgcattagaa

SEQ ID NO: 444116 - DNA, 16 bp, Homo sapiens
ttgcattagaaactga

SEQ ID NO: 444117 - DNA, 16 bp, Homo sapiens
ttgcatttacttttaa

SEQ ID NO: 444118 - DNA, 20 bp, Homo sapiens
ttgcatttacttttaataaa

SEQ ID NO: 444119 - DNA, 15 bp, Homo sapiens
ttgcatttctttatt

SEQ ID NO: 444120 - DNA, 15 bp, Homo sapiens
ttgcatttgctcttt

SEQ ID NO: 444121 - DNA, 20 bp, Homo sapiens
ttgcatttgtaccttattga

SEQ ID NO: 444122 - DNA, 22 bp, Homo sapiens
ttgccaaataaagttaaaagta

SEQ ID NO: 444123 - DNA, 16 bp, Homo sapiens
ttgccaaatatgtcct

SEQ ID NO: 444124 - DNA, 21 bp, Homo sapiens
ttgccaagaaaatgaagggat

SEQ ID NO: 444125 - DNA, 17 bp, Homo sapiens
ttgccaagctttcttct

SEQ ID NO: 444126 - DNA, 18 bp, Homo sapiens
ttgccaaggctctcccct

SEQ ID NO: 444127 - DNA, 21 bp, Homo sapiens
ttgccaatgaggtctgaaatg

SEQ ID NO: 444128 - DNA, 22 bp, Homo sapiens
ttgccaatggtgtagctgtcct

SEQ ID NO: 444129 - DNA, 19 bp, Homo sapiens
ttgccacactttcactggg

SEQ ID NO: 444130 - DNA, 14 bp, Homo sapiens
ttgccaccaggaga

SEQ ID NO: 444131 - DNA, 16 bp, Homo sapiens
ttgccaccaggagaac

SEQ ID NO: 444132 - DNA, 22 bp, Homo sapiens
ttgggattgggggctggtgcca

SEQ ID NO: 444133 - DNA, 20 bp, Homo sapiens
ttgggcacgggagagcgcca

SEQ ID NO: 444134 - DNA, 20 bp, Homo sapiens
ttgggcatccacccagtgct

SEQ ID NO: 444135 - DNA, 21 bp, Homo sapiens
ttgggcatccacccagtgctg

SEQ ID NO: 444136 - DNA, 23 bp, Homo sapiens
ttgggcatccacccagtgctgcc

SEQ ID NO: 444137 - DNA, 12 bp, Homo sapiens
ttgggcccagct

SEQ ID NO: 444138 - DNA, 17 bp, Homo sapiens
ttgggcccagctgggct

SEQ ID NO: 444139 - DNA, 16 bp, Homo sapiens
ttgggcccagtagccc

SEQ ID NO: 444140 - DNA, 22 bp, Homo sapiens
ttgggccccagaccccagggca

SEQ ID NO: 444141 - DNA, 17 bp, Homo sapiens
ttgggccccagggaact

SEQ ID NO: 444142 - DNA, 16 bp, Homo sapiens
ttgggcccctcagagc

SEQ ID NO: 444143 - DNA, 18 bp, Homo sapiens
ttgggcccctcagagccc

SEQ ID NO: 444144 - DNA, 16 bp, Homo sapiens
ttgggcggctgagagc

SEQ ID NO: 444145 - DNA, 19 bp, Homo sapiens
ttgggctactggcagctcc

SEQ ID NO: 444146 - DNA, 16 bp, Homo sapiens
ttgggctcctggctgc

SEQ ID NO: 444147 - DNA, 17 bp, Homo sapiens
ttgggctcctggctgcc

SEQ ID NO: 444148 - DNA, 19 bp, Homo sapiens
ttgggctcctggctgccag

SEQ ID NO: 444149 - DNA, 21 bp, Homo sapiens
ttgggctcctggctgccaggc

SEQ ID NO: 444150 - DNA, 17 bp, Homo sapiens
ttgggcttgtgatttcc

SEQ ID NO: 444151 - DNA, 20 bp, Homo sapiens
ttgggctttgcaggctctgg

SEQ ID NO: 444152 - DNA, 19 bp, Homo sapiens
ttggggaagaacgaagcca

SEQ ID NO: 444153 - DNA, 18 bp, Homo sapiens
ttggggacagttggcaga

SEQ ID NO: 444154 - DNA, 18 bp, Homo sapiens
ttggggcctcacccagaa

SEQ ID NO: 444155 - DNA, 11 bp, Homo sapiens
ttggggcctgg

SEQ ID NO: 444156 - DNA, 12 bp, Homo sapiens
ttggggcctggc

SEQ ID NO: 444157 - DNA, 15 bp, Homo sapiens
ttggggcctggcttg

SEQ ID NO: 444158 - DNA, 17 bp, Homo sapiens
ttggggcgaggcagagg

SEQ ID NO: 444159 - DNA, 16 bp, Homo sapiens
ttggggctatttgtgt

SEQ ID NO: 444160 - DNA, 22 bp, Homo sapiens
ttgggggccctggggtccccac

SEQ ID NO: 444161 - DNA, 12 bp, Homo sapiens
ttgggggctggt

SEQ ID NO: 444162 - DNA, 14 bp, Homo sapiens
ttgggggctggtgc

SEQ ID NO: 444163 - DNA, 19 bp, Homo sapiens
ttgggggttaccaaaaata

SEQ ID NO: 444164 - DNA, 16 bp, Homo sapiens
ttggggtacaattgta

SEQ ID NO: 444165 - DNA, 16 bp, Homo sapiens
ttggggtagagaggac

SEQ ID NO: 444166 - DNA, 19 bp, Homo sapiens
ttggggtggggcgggaggc

SEQ ID NO: 444167 - DNA, 21 bp, Homo sapiens
ttggggtgtttcaaaagtgga

SEQ ID NO: 444168 - DNA, 20 bp, Homo sapiens
ttgggtacatggcccgcagt

SEQ ID NO: 444169 - DNA, 17 bp, Homo sapiens
ttgggttcattattgga

SEQ ID NO: 444170 - DNA, 20 bp, Homo sapiens
ttgggtttgccttaattctt

SEQ ID NO: 444171 - DNA, 17 bp, Homo sapiens
ttggtaacttgctgtga

SEQ ID NO: 444172 - DNA, 14 bp, Homo sapiens
ttggtaagagggag

SEQ ID NO: 444173 - DNA, 23 bp, Homo sapiens
ttggtaatgatgattcaatcatt

SEQ ID NO: 444174 - DNA, 13 bp, Homo sapiens
ttggtagagattc

SEQ ID NO: 444175 - DNA, 12 bp, Homo sapiens
ttggtagagttt

SEQ ID NO: 444176 - DNA, 21 bp, Homo sapiens
ttggtagttctgtgcctcccc

SEQ ID NO: 444177 - DNA, 12 bp, Homo sapiens
ttggtcagcttt

SEQ ID NO: 444178 - DNA, 23 bp, Homo sapiens
ttggtccaaattctttattcttc

SEQ ID NO: 444179 - DNA, 12 bp, Homo sapiens
ttggtccctggt

SEQ ID NO: 444180 - DNA, 22 bp, Homo sapiens
ttggtcctgttaaccctccacc

SEQ ID NO: 444181 - DNA, 17 bp, Homo sapiens
ttggtctccatttttcc

SEQ ID NO: 444182 - DNA, 14 bp, Homo sapiens
ttggtctctttctt

SEQ ID NO: 444183 - DNA, 17 bp, Homo sapiens
ttggtctgggacttcct

SEQ ID NO: 444184 - DNA, 20 bp, Homo sapiens
ttggtcttagctttacattt

SEQ ID NO: 444185 - DNA, 15 bp, Homo sapiens
ttggtgaacagtttt

SEQ ID NO: 444186 - DNA, 14 bp, Homo sapiens
ttggtgataagtgg

SEQ ID NO: 444187 - DNA, 18 bp, Homo sapiens
ttggtgataagtggaaaa

SEQ ID NO: 444188 - DNA, 20 bp, Homo sapiens
ttggtgataagtggaaaaaa

SEQ ID NO: 444189 - DNA, 16 bp, Homo sapiens
ttggtgattttagatt

SEQ ID NO: 444190 - DNA, 18 bp, Homo sapiens
ttggtgccttttgtgtga

SEQ ID NO: 444191 - DNA, 19 bp, Homo sapiens
ttggtggcctaatttacaa

SEQ ID NO: 444192 - DNA, 21 bp, Homo sapiens
ttggtgggcgtgcccctgaag

SEQ ID NO: 444193 - DNA, 15 bp, Homo sapiens
ttggtgtctgatgtg

SEQ ID NO: 444194 - DNA, 21 bp, Homo sapiens
ttggtgtgaatgctgtacctt

SEQ ID NO: 444195 - DNA, 20 bp, Homo sapiens
ttggtgtgttcgtggagcca

SEQ ID NO: 444196 - DNA, 23 bp, Homo sapiens
ttggtgtgttcgtggagccacag

SEQ ID NO: 444197 - DNA, 22 bp, Homo sapiens
ttggttaatcacttaacctgct

SEQ ID NO: 444198 - DNA, 13 bp, Homo sapiens
ttggttagctgga

SEQ ID NO: 444199 - DNA, 17 bp, Homo sapiens
ttggttcctgcccccgc

SEQ ID NO: 444200 - DNA, 15 bp, Homo sapiens
ttggttctaatagaa

SEQ ID NO: 444201 - DNA, 19 bp, Homo sapiens
ttggttctaatagaactca

SEQ ID NO: 444202 - DNA, 22 bp, Homo sapiens
ttggttcttggtagagattcat

SEQ ID NO: 444203 - DNA, 12 bp, Homo sapiens
ttggttgtcaat

SEQ ID NO: 444204 - DNA, 22 bp, Homo sapiens
ttggttgtcaatattaaataca

SEQ ID NO: 444205 - DNA, 13 bp, Homo sapiens
ttggttttgtatt

SEQ ID NO: 444206 - DNA, 13 bp, Homo sapiens
ttgtaaaaatatg

SEQ ID NO: 444207 - DNA, 14 bp, Homo sapiens
ttgtaaaactgtga

SEQ ID NO: 444208 - DNA, 18 bp, Homo sapiens
ttgtaaaactgtgacatt

SEQ ID NO: 444209 - DNA, 23 bp, Homo sapiens
ttgtaaaactgtgacattccaca

SEQ ID NO: 444210 - DNA, 15 bp, Homo sapiens
ttgtaaacctggagg

SEQ ID NO: 444211 - DNA, 16 bp, Homo sapiens
ttgtaaacgtttcagt

SEQ ID NO: 444212 - DNA, 18 bp, Homo sapiens
ttgtaaacgtttcagtaa

SEQ ID NO: 444213 - DNA, 15 bp, Homo sapiens
ttgtaaactgtatca

SEQ ID NO: 444214 - DNA, 14 bp, Homo sapiens
ttgtaaactttttc

SEQ ID NO: 444215 - DNA, 20 bp, Homo sapiens
ttgtaaactttttcaatggt

SEQ ID NO: 444216 - DNA, 11 bp, Homo sapiens
ttgtaaataca

SEQ ID NO: 444217 - DNA, 14 bp, Homo sapiens
ttgtaaatacacca

SEQ ID NO: 444218 - DNA, 13 bp, Homo sapiens
ttgtaaatattct

SEQ ID NO: 444219 - DNA, 14 bp, Homo sapiens
ttgtaaatattctt

SEQ ID NO: 444220 - DNA, 17 bp, Homo sapiens
ttgtaacaagaaaacat

SEQ ID NO: 444221 - DNA, 15 bp, Homo sapiens
ttgtaacctcagctc

SEQ ID NO: 444222 - DNA, 19 bp, Homo sapiens
ttgtaacctcagctctggg

SEQ ID NO: 444223 - DNA, 13 bp, Homo sapiens
ttgtaactttgca

SEQ ID NO: 444224 - DNA, 16 bp, Homo sapiens
ttgtaactttgcatgt

SEQ ID NO: 444225 - DNA, 21 bp, Homo sapiens
ttgtaagaaataacactgtga

SEQ ID NO: 444226 - DNA, 20 bp, Homo sapiens
ttgtaaggaatgattaatta

SEQ ID NO: 444227 - DNA, 15 bp, Homo sapiens
ttgtaaggtactgaa

SEQ ID NO: 444228 - DNA, 18 bp, Homo sapiens
ttgtaataaagtatataa

SEQ ID NO: 444229 - DNA, 19 bp, Homo sapiens
ttgtaatatacagtttttg

SEQ ID NO: 444230 - DNA, 12 bp, Homo sapiens
ttgtaatatgat

SEQ ID NO: 444231 - DNA, 21 bp, Homo sapiens
ttgtaatatttcttcaagtga

SEQ ID NO: 444232 - DNA, 20 bp, Homo sapiens
ttgtaatctgctttgttaat

SEQ ID NO: 444233 - DNA, 17 bp, Homo sapiens
ttgtaattgcttacatt

SEQ ID NO: 444234 - DNA, 19 bp, Homo sapiens
ttgtaattgcttacatttt

SEQ ID NO: 444235 - DNA, 22 bp, Homo sapiens
ttgtacacaacacctaaaacca

SEQ ID NO: 444236 - DNA, 20 bp, Homo sapiens
ttgtacagaatcattgctta

SEQ ID NO: 444237 - DNA, 12 bp, Homo sapiens
ttgtacagacaa

SEQ ID NO: 444238 - DNA, 22 bp, Homo sapiens
ttgtacagttaactctcccagg

SEQ ID NO: 444239 - DNA, 15 bp, Homo sapiens
ttgtacagttcagtt

SEQ ID NO: 444240 - DNA, 16 bp, Homo sapiens
ttgtacagttcagttc

SEQ ID NO: 444241 - DNA, 16 bp, Homo sapiens
ttgtacatcgcttctt

SEQ ID NO: 444242 - DNA, 18 bp, Homo sapiens
ttgtacatcgcttctttt

SEQ ID NO: 444243 - DNA, 21 bp, Homo sapiens
ttgtacgtgggagaggcagaa

SEQ ID NO: 444244 - DNA, 22 bp, Homo sapiens
ttgtacgtgggagaggcagaaa

SEQ ID NO: 444245 - DNA, 16 bp, Homo sapiens
ttgtactaagccagga

SEQ ID NO: 444246 - DNA, 16 bp, Homo sapiens
ttgtactatttaactg

SEQ ID NO: 444247 - DNA, 22 bp, Homo sapiens
ttgtagatacaatcagctgctt

SEQ ID NO: 444248 - DNA, 16 bp, Homo sapiens
ttgtagatggcacttt

SEQ ID NO: 444249 - DNA, 15 bp, Homo sapiens
ttgtagcttaaaaaa

SEQ ID NO: 444250 - DNA, 22 bp, Homo sapiens
ttgtagcttaaaaaaaggaaaa

SEQ ID NO: 444251 - DNA, 17 bp, Homo sapiens
ttgtaggggtcaaagaa

SEQ ID NO: 444252 - DNA, 15 bp, Homo sapiens
ttgtagtagtctcat

SEQ ID NO: 444253 - DNA, 19 bp, Homo sapiens
ttgtataaataataaagaa

SEQ ID NO: 444254 - DNA, 17 bp, Homo sapiens
ttgtataggccatctgt

SEQ ID NO: 444255 - DNA, 18 bp, Homo sapiens
ttgtataggccatctgta

SEQ ID NO: 444256 - DNA, 19 bp, Homo sapiens
ttgtataggccatctgtaa

SEQ ID NO: 444257 - DNA, 21 bp, Homo sapiens
ttgtataggccatctgtaaat

SEQ ID NO: 444258 - DNA, 22 bp, Homo sapiens
ttgtataggccatctgtaaata

SEQ ID NO: 444259 - DNA, 23 bp, Homo sapiens
ttgtataggccatctgtaaatat

SEQ ID NO: 444260 - DNA, 16 bp, Homo sapiens
ttgtatagtgtaaaat

SEQ ID NO: 444261 - DNA, 11 bp, Homo sapiens
ttgtatatatc

SEQ ID NO: 444262 - DNA, 21 bp, Homo sapiens
tttagtgtattttctgtcact

SEQ ID NO: 444263 - DNA, 14 bp, Homo sapiens
tttagttgaatttt

SEQ ID NO: 444264 - DNA, 19 bp, Homo sapiens
tttagttgcagaaacattt

SEQ ID NO: 444265 - DNA, 21 bp, Homo sapiens
tttataaaccataaaataaat

SEQ ID NO: 444266 - DNA, 14 bp, Homo sapiens
tttataaactagat

SEQ ID NO: 444267 - DNA, 21 bp, Homo sapiens
tttataaatatattcaggagt

SEQ ID NO: 444268 - DNA, 16 bp, Homo sapiens
tttataaattaaatat

SEQ ID NO: 444269 - DNA, 15 bp, Homo sapiens
tttataacaattgat

SEQ ID NO: 444270 - DNA, 20 bp, Homo sapiens
tttataactcatcataaaat

SEQ ID NO: 444271 - DNA, 21 bp, Homo sapiens
tttatactgcactttagtgta

SEQ ID NO: 444272 - DNA, 16 bp, Homo sapiens
tttatactgtttactg

SEQ ID NO: 444273 - DNA, 22 bp, Homo sapiens
tttatacttaaacagctttttt

SEQ ID NO: 444274 - DNA, 21 bp, Homo sapiens
tttatagaataatgtgggaag

SEQ ID NO: 444275 - DNA, 16 bp, Homo sapiens
tttatagctcagttta

SEQ ID NO: 444276 - DNA, 16 bp, Homo sapiens
tttatagggcttttat

SEQ ID NO: 444277 - DNA, 15 bp, Homo sapiens
tttatataataaagt

SEQ ID NO: 444278 - DNA, 20 bp, Homo sapiens
tttatataataaagtattcc

SEQ ID NO: 444279 - DNA, 17 bp, Homo sapiens
tttatataattatgtta

SEQ ID NO: 444280 - DNA, 17 bp, Homo sapiens
tttatatataaaataaa

SEQ ID NO: 444281 - DNA, 23 bp, Homo sapiens
tttatatataaaataaatatact

SEQ ID NO: 444282 - DNA, 13 bp, Homo sapiens
tttatatatgtat

SEQ ID NO: 444283 - DNA, 17 bp, Homo sapiens
tttatatcccattttta

SEQ ID NO: 444284 - DNA, 20 bp, Homo sapiens
tttatattgtttttatatat

SEQ ID NO: 444285 - DNA, 14 bp, Homo sapiens
tttatatttaaatg

SEQ ID NO: 444286 - DNA, 17 bp, Homo sapiens
tttatatttaattatta

SEQ ID NO: 444287 - DNA, 19 bp, Homo sapiens
tttatatttggggtccttt

SEQ ID NO: 444288 - DNA, 17 bp, Homo sapiens
tttatcacacttctgtg

SEQ ID NO: 444289 - DNA, 22 bp, Homo sapiens
tttatcagattgcttttgtgca

SEQ ID NO: 444290 - DNA, 13 bp, Homo sapiens
tttatcagtgaca

SEQ ID NO: 444291 - DNA, 18 bp, Homo sapiens
tttatcagtgacagagtt

SEQ ID NO: 444292 - DNA, 24 bp, Homo sapiens
tttatcagtgcttaatgtgaacta

SEQ ID NO: 444293 - DNA, 14 bp, Homo sapiens
tttatcatgacatg

SEQ ID NO: 444294 - DNA, 15 bp, Homo sapiens
tttatcatgacatgt

SEQ ID NO: 444295 - DNA, 15 bp, Homo sapiens
tttatcattaaacat

SEQ ID NO: 444296 - DNA, 17 bp, Homo sapiens
tttatcccacggaaaat

SEQ ID NO: 444297 - DNA, 18 bp, Homo sapiens
tttatcgtttattgctta

SEQ ID NO: 444298 - DNA, 20 bp, Homo sapiens
tttatctacccagtcatgta

SEQ ID NO: 444299 - DNA, 22 bp, Homo sapiens
tttatctcaagtatataaagtt

SEQ ID NO: 444300 - DNA, 17 bp, Homo sapiens
tttatctgggattatgg

SEQ ID NO: 444301 - DNA, 22 bp, Homo sapiens
tttatctgtgaatcctttgtac

SEQ ID NO: 444302 - DNA, 12 bp, Homo sapiens
tttatctgttaa

SEQ ID NO: 444303 - DNA, 12 bp, Homo sapiens
tttatcttctgt

SEQ ID NO: 444304 - DNA, 19 bp, Homo sapiens
tttatcttctgtttttctc

SEQ ID NO: 444305 - DNA, 18 bp, Homo sapiens
tttatcttggtagtacat

SEQ ID NO: 444306 - DNA, 22 bp, Homo sapiens
tttatgaagaaagatactaata

SEQ ID NO: 444307 - DNA, 13 bp, Homo sapiens
tttatgaaggttt

SEQ ID NO: 444308 - DNA, 22 bp, Homo sapiens
tttatgacgagacctcagatgt

SEQ ID NO: 444309 - DNA, 12 bp, Homo sapiens
tttatgagccag

SEQ ID NO: 444310 - DNA, 19 bp, Homo sapiens
tttatgagccagacaaatg

SEQ ID NO: 444311 - DNA, 21 bp, Homo sapiens
tttatgagtaactattattat

SEQ ID NO: 444312 - DNA, 12 bp, Homo sapiens
tttatgatttca

SEQ ID NO: 444313 - DNA, 14 bp, Homo sapiens
tttatgcagtgctg

SEQ ID NO: 444314 - DNA, 17 bp, Homo sapiens
tttatgcagtgctgctt

SEQ ID NO: 444315 - DNA, 10 bp, Homo sapiens
tttatgcatt

SEQ ID NO: 444316 - DNA, 11 bp, Homo sapiens
tttatgcattt

SEQ ID NO: 444317 - DNA, 15 bp, Homo sapiens
tttatgcatttatgc

SEQ ID NO: 444318 - DNA, 20 bp, Homo sapiens
tttatgcatttgcatttgct

SEQ ID NO: 444319 - DNA, 22 bp, Homo sapiens
tttatggcctcagctgcctcac

SEQ ID NO: 444320 - DNA, 19 bp, Homo sapiens
tttatggtattttcgtgca

SEQ ID NO: 444321 - DNA, 22 bp, Homo sapiens
tttatgttacttaaacatcatt

SEQ ID NO: 444322 - DNA, 10 bp, Homo sapiens
tttatgttta

SEQ ID NO: 444323 - DNA, 13 bp, Homo sapiens
tttatgtttaagt

SEQ ID NO: 444324 - DNA, 17 bp, Homo sapiens
tttatgtttaagtgctt

SEQ ID NO: 444325 - DNA, 22 bp, Homo sapiens
tttattaaaatgattgtaaaat

SEQ ID NO: 444326 - DNA, 18 bp, Homo sapiens
tttattaaacttcagcaa

SEQ ID NO: 444327 - DNA, 18 bp, Homo sapiens
tttattaacatatattgt

SEQ ID NO: 444328 - DNA, 15 bp, Homo sapiens
tttattaagatggat

SEQ ID NO: 444329 - DNA, 22 bp, Homo sapiens
tttattaagatggattctcaga

SEQ ID NO: 444330 - DNA, 14 bp, Homo sapiens
tttattaagtctgg

SEQ ID NO: 444331 - DNA, 15 bp, Homo sapiens
tttattaatgaactg

SEQ ID NO: 444332 - DNA, 23 bp, Homo sapiens
tttattacaaattttcactgctg

SEQ ID NO: 444333 - DNA, 24 bp, Homo sapiens
tttattagctgtaaatacatgtgt

SEQ ID NO: 444334 - DNA, 17 bp, Homo sapiens
tttattcagcttcattt

SEQ ID NO: 444335 - DNA, 21 bp, Homo sapiens
tttattcagcttcatttgtgt

SEQ ID NO: 444336 - DNA, 13 bp, Homo sapiens
tttattgtataaa

SEQ ID NO: 444337 - DNA, 14 bp, Homo sapiens
tttattgtcaaagt

SEQ ID NO: 444338 - DNA, 21 bp, Homo sapiens
tttatttaatttcataaattg

SEQ ID NO: 444339 - DNA, 22 bp, Homo sapiens
tttatttattaaacttcagcaa

SEQ ID NO: 444340 - DNA, 16 bp, Homo sapiens
tttatttgcaacattt

SEQ ID NO: 444341 - DNA, 19 bp, Homo sapiens
tttattttagcagttctgc

SEQ ID NO: 444342 - DNA, 11 bp, Homo sapiens
tttattttcat

SEQ ID NO: 444343 - DNA, 22 bp, Homo sapiens
tttattttctggtagatagaaa

SEQ ID NO: 444344 - DNA, 23 bp, Homo sapiens
tttattttgtatttttgaataaa

SEQ ID NO: 444345 - DNA, 16 bp, Homo sapiens
tttatttttcatattg

SEQ ID NO: 444346 - DNA, 15 bp, Homo sapiens
tttatttttgtactg

SEQ ID NO: 444347 - DNA, 16 bp, Homo sapiens
tttatttttgtactgt

SEQ ID NO: 444348 - DNA, 22 bp, Homo sapiens
tttatttttttgatggctaaga

SEQ ID NO: 444349 - DNA, 17 bp, Homo sapiens
tttcaaaaatataactt

SEQ ID NO: 444350 - DNA, 18 bp, Homo sapiens
tttcaaaaatataactta

SEQ ID NO: 444351 - DNA, 13 bp, Homo sapiens
tttcaaaagtgga

SEQ ID NO: 444352 - DNA, 21 bp, Homo sapiens
tttcaaacagcatcaaaatac

SEQ ID NO: 444353 - DNA, 23 bp, Homo sapiens
tttcaacaagaatattgtatgtt

SEQ ID NO: 444354 - DNA, 14 bp, Homo sapiens
tttcaacttaaatc

SEQ ID NO: 444355 - DNA, 15 bp, Homo sapiens
tttcaagggttgctt

SEQ ID NO: 444356 - DNA, 23 bp, Homo sapiens
tttcaagtgcctttctgcagttt

SEQ ID NO: 444357 - DNA, 12 bp, Homo sapiens
tttcaatgattg

SEQ ID NO: 444358 - DNA, 20 bp, Homo sapiens
tttcaatgtgattctaatgt

SEQ ID NO: 444359 - DNA, 22 bp, Homo sapiens
tttcaatgtgattctaatgtct

SEQ ID NO: 444360 - DNA, 21 bp, Homo sapiens
tttcaattgcagatgccaaaa

SEQ ID NO: 444361 - DNA, 16 bp, Homo sapiens
tttcacaaccttctgt

SEQ ID NO: 444362 - DNA, 14 bp, Homo sapiens
tttcacaatataaa

SEQ ID NO: 444363 - DNA, 14 bp, Homo sapiens
tttcacagcttctt

SEQ ID NO: 444364 - DNA, 18 bp, Homo sapiens
tttcacatatttgtagct

SEQ ID NO: 444365 - DNA, 16 bp, Homo sapiens
tttcacctactttgta

SEQ ID NO: 444366 - DNA, 16 bp, Homo sapiens
tttcacgtcttggtgc

SEQ ID NO: 444367 - DNA, 23 bp, Homo sapiens
tttcacgtcttggtgccttttgt

SEQ ID NO: 444368 - DNA, 22 bp, Homo sapiens
tttcactgacactgcgaactct

SEQ ID NO: 444369 - DNA, 12 bp, Homo sapiens
tttcactgctgc

SEQ ID NO: 444370 - DNA, 22 bp, Homo sapiens
tttcactgctggctgccttaga

SEQ ID NO: 444371 - DNA, 13 bp, Homo sapiens
tttcactggggat

SEQ ID NO: 444372 - DNA, 19 bp, Homo sapiens
tttcacttgtcttgctctt

SEQ ID NO: 444373 - DNA, 12 bp, Homo sapiens
tttcagaaaaca

SEQ ID NO: 444374 - DNA, 13 bp, Homo sapiens
tttcagaaaacag

SEQ ID NO: 444375 - DNA, 16 bp, Homo sapiens
tttcagaaaacagaaa

SEQ ID NO: 444376 - DNA, 19 bp, Homo sapiens
tttcagaaagggcagcccc

SEQ ID NO: 444377 - DNA, 18 bp, Homo sapiens
tttcagaacctcttcccc

SEQ ID NO: 444378 - DNA, 19 bp, Homo sapiens
tttcagaacctcttcccca

SEQ ID NO: 444379 - DNA, 17 bp, Homo sapiens
tttcagaagctgcagct

SEQ ID NO: 444380 - DNA, 20 bp, Homo sapiens
tttcagacagggtctgaagg

SEQ ID NO: 444381 - DNA, 20 bp, Homo sapiens
tttcagagccctcggagcca

SEQ ID NO: 444382 - DNA, 15 bp, Homo sapiens
tttcagatatatatc

SEQ ID NO: 444383 - DNA, 15 bp, Homo sapiens
tttcagatgtcttct

SEQ ID NO: 444384 - DNA, 17 bp, Homo sapiens
tttcagatgtcttctgc

SEQ ID NO: 444385 - DNA, 16 bp, Homo sapiens
tttcagcacccccacc

SEQ ID NO: 444386 - DNA, 21 bp, Homo sapiens
tttcagcacccccacccacct

SEQ ID NO: 444387 - DNA, 20 bp, Homo sapiens
tttcagcatcaaacatgaaa

SEQ ID NO: 444388 - DNA, 21 bp, Homo sapiens
tttcagcatcaaacatgaaaa

SEQ ID NO: 444389 - DNA, 23 bp, Homo sapiens
tttcagcatcaaacatgaaaaca

SEQ ID NO: 444390 - DNA, 21 bp, Homo sapiens
tttcagctgtgaacatggact

SEQ ID NO: 444391 - DNA, 23 bp, Homo sapiens
tttgagagagagaacctttccac

SEQ ID NO: 444392 - DNA, 13 bp, Homo sapiens
tttgagagttcta

SEQ ID NO: 444393 - DNA, 14 bp, Homo sapiens
tttgagagttctaa

SEQ ID NO: 444394 - DNA, 12 bp, Homo sapiens
tttgagcatttt

SEQ ID NO: 444395 - DNA, 15 bp, Homo sapiens
tttgaggagagtgaa

SEQ ID NO: 444396 - DNA, 21 bp, Homo sapiens
tttgaggagcagcttcagttg

SEQ ID NO: 444397 - DNA, 22 bp, Homo sapiens
tttgaggagcagcttcagttgt

SEQ ID NO: 444398 - DNA, 15 bp, Homo sapiens
tttgaggaggaagca

SEQ ID NO: 444399 - DNA, 21 bp, Homo sapiens
tttgagggactgcctctgcca

SEQ ID NO: 444400 - DNA, 23 bp, Homo sapiens
tttgaggtcaagtaagaagacat

SEQ ID NO: 444401 - DNA, 16 bp, Homo sapiens
tttgagtaattttctg

SEQ ID NO: 444402 - DNA, 13 bp, Homo sapiens
tttgagtgcctta

SEQ ID NO: 444403 - DNA, 15 bp, Homo sapiens
tttgagtgtcaggct

SEQ ID NO: 444404 - DNA, 21 bp, Homo sapiens
tttgagtgtcaggctctgaat

SEQ ID NO: 444405 - DNA, 19 bp, Homo sapiens
tttgagtttcctttaaata

SEQ ID NO: 444406 - DNA, 21 bp, Homo sapiens
tttgagtttctggctgaaaat

SEQ ID NO: 444407 - DNA, 23 bp, Homo sapiens
tttgataacattttgtttatgtt

SEQ ID NO: 444408 - DNA, 11 bp, Homo sapiens
tttgatacatt

SEQ ID NO: 444409 - DNA, 18 bp, Homo sapiens
tttgatacatttatcttc

SEQ ID NO: 444410 - DNA, 23 bp, Homo sapiens
tttgatatgggctttctctttgg

SEQ ID NO: 444411 - DNA, 12 bp, Homo sapiens
tttgatcttcag

SEQ ID NO: 444412 - DNA, 20 bp, Homo sapiens
tttgatgccatttgtctttt

SEQ ID NO: 444413 - DNA, 16 bp, Homo sapiens
tttgatgctggagagg

SEQ ID NO: 444414 - DNA, 18 bp, Homo sapiens
tttgatgctggagaggtt

SEQ ID NO: 444415 - DNA, 15 bp, Homo sapiens
tttgatggtgaatat

SEQ ID NO: 444416 - DNA, 13 bp, Homo sapiens
tttgattaatgtt

SEQ ID NO: 444417 - DNA, 17 bp, Homo sapiens
tttgattaatgtttctt

SEQ ID NO: 444418 - DNA, 23 bp, Homo sapiens
tttgatttacagtgcctgtatct

SEQ ID NO: 444419 - DNA, 13 bp, Homo sapiens
tttgatttctatt

SEQ ID NO: 444420 - DNA, 23 bp, Homo sapiens
tttgcaagcttatttagcacatt

SEQ ID NO: 444421 - DNA, 14 bp, Homo sapiens
tttgcaatgtcaca

SEQ ID NO: 444422 - DNA, 20 bp, Homo sapiens
tttgcacaggaaagagtcac

SEQ ID NO: 444423 - DNA, 15 bp, Homo sapiens
tttgcacatatattt

SEQ ID NO: 444424 - DNA, 12 bp, Homo sapiens
tttgcactgagg

SEQ ID NO: 444425 - DNA, 22 bp, Homo sapiens
tttgcactgagggccacactat

SEQ ID NO: 444426 - DNA, 21 bp, Homo sapiens
tttgcagcagtgagtctcttc

SEQ ID NO: 444427 - DNA, 11 bp, Homo sapiens
tttgcagcttt

SEQ ID NO: 444428 - DNA, 18 bp, Homo sapiens
tttgcaggcccagcagac

SEQ ID NO: 444429 - DNA, 12 bp, Homo sapiens
tttgcaggctct

SEQ ID NO: 444430 - DNA, 14 bp, Homo sapiens
tttgcaggctctgg

SEQ ID NO: 444431 - DNA, 17 bp, Homo sapiens
tttgcaggctctgggct

SEQ ID NO: 444432 - DNA, 21 bp, Homo sapiens
tttgcatacttcctggatttt

SEQ ID NO: 444433 - DNA, 12 bp, Homo sapiens
tttgcatgttct

SEQ ID NO: 444434 - DNA, 19 bp, Homo sapiens
tttgcatttttgtattttg

SEQ ID NO: 444435 - DNA, 13 bp, Homo sapiens
tttgccatacatc

SEQ ID NO: 444436 - DNA, 15 bp, Homo sapiens
tttgccatgctgcta

SEQ ID NO: 444437 - DNA, 19 bp, Homo sapiens
tttgccatgggcctgctgc

SEQ ID NO: 444438 - DNA, 15 bp, Homo sapiens
tttgcccttaaggac

SEQ ID NO: 444439 - DNA, 13 bp, Homo sapiens
tttgcctggctgt

SEQ ID NO: 444440 - DNA, 21 bp, Homo sapiens
tttgcgcacaacttaaaaagt

SEQ ID NO: 444441 - DNA, 23 bp, Homo sapiens
tttgcgtggatcaagcttgtgta

SEQ ID NO: 444442 - DNA, 16 bp, Homo sapiens
tttgctaatgaatttt

SEQ ID NO: 444443 - DNA, 17 bp, Homo sapiens
tttgctcagaacacatt

SEQ ID NO: 444444 - DNA, 19 bp, Homo sapiens
tttgctgagcatgtactga

SEQ ID NO: 444445 - DNA, 18 bp, Homo sapiens
tttgctgattgctaaggg

SEQ ID NO: 444446 - DNA, 21 bp, Homo sapiens
tttgctgctataattctatac

SEQ ID NO: 444447 - DNA, 14 bp, Homo sapiens
tttgctggagtgct

SEQ ID NO: 444448 - DNA, 21 bp, Homo sapiens
tttgctgtatacaaacaggtg

SEQ ID NO: 444449 - DNA, 19 bp, Homo sapiens
tttgctgtgaggctgtcct

SEQ ID NO: 444450 - DNA, 16 bp, Homo sapiens
tttgcttattgttcca

SEQ ID NO: 444451 - DNA, 17 bp, Homo sapiens
tttgcttcttatggtat

SEQ ID NO: 444452 - DNA, 18 bp, Homo sapiens
tttgctttgggattttct

SEQ ID NO: 444453 - DNA, 24 bp, Homo sapiens
tttggaaaacataaaaatcactca

SEQ ID NO: 444454 - DNA, 16 bp, Homo sapiens
tttggaattggtgtat

SEQ ID NO: 444455 - DNA, 13 bp, Homo sapiens
tttggaatttgaa

SEQ ID NO: 444456 - DNA, 16 bp, Homo sapiens
tttggacgcacacagc

SEQ ID NO: 444457 - DNA, 15 bp, Homo sapiens
tttggactttgttac

SEQ ID NO: 444458 - DNA, 18 bp, Homo sapiens
tttggagcactctgagtt

SEQ ID NO: 444459 - DNA, 16 bp, Homo sapiens
tttggagggatcattt

SEQ ID NO: 444460 - DNA, 20 bp, Homo sapiens
tttggagttaggtcctcact

SEQ ID NO: 444461 - DNA, 19 bp, Homo sapiens
tttggatctatcacctgtc

SEQ ID NO: 444462 - DNA, 19 bp, Homo sapiens
tttggatgggagtgagaca

SEQ ID NO: 444463 - DNA, 14 bp, Homo sapiens
tttggcaattcaca

SEQ ID NO: 444464 - DNA, 19 bp, Homo sapiens
tttggcaatttttttatac

SEQ ID NO: 444465 - DNA, 10 bp, Homo sapiens
tttggccttg

SEQ ID NO: 444466 - DNA, 14 bp, Homo sapiens
tttggcctttgtaa

SEQ ID NO: 444467 - DNA, 19 bp, Homo sapiens
tttggcgctattacaaata

SEQ ID NO: 444468 - DNA, 17 bp, Homo sapiens
tttggcgggccaaggac

SEQ ID NO: 444469 - DNA, 15 bp, Homo sapiens
tttggctgaaattat

SEQ ID NO: 444470 - DNA, 18 bp, Homo sapiens
tttggctgtaatttaatt

SEQ ID NO: 444471 - DNA, 15 bp, Homo sapiens
tttggcttataaaca

SEQ ID NO: 444472 - DNA, 16 bp, Homo sapiens
tttgggactgtcttga

SEQ ID NO: 444473 - DNA, 23 bp, Homo sapiens
tttgggagagacttgttttggat

SEQ ID NO: 444474 - DNA, 15 bp, Homo sapiens
tttgggagctctgct

SEQ ID NO: 444475 - DNA, 15 bp, Homo sapiens
tttgggcccctcaga

SEQ ID NO: 444476 - DNA, 13 bp, Homo sapiens
tttggggaagaac

SEQ ID NO: 444477 - DNA, 18 bp, Homo sapiens
tttggggcgaggcagagg

SEQ ID NO: 444478 - DNA, 22 bp, Homo sapiens
tttgggggattcaaatgcatga

SEQ ID NO: 444479 - DNA, 13 bp, Homo sapiens
tttgggtaaatca

SEQ ID NO: 444480 - DNA, 20 bp, Homo sapiens
tttggtaaaatacttcttga

SEQ ID NO: 444481 - DNA, 22 bp, Homo sapiens
tttggtctccatttttcccagg

SEQ ID NO: 444482 - DNA, 18 bp, Homo sapiens
tttggtcttagctttaca

SEQ ID NO: 444483 - DNA, 19 bp, Homo sapiens
tttggtcttagctttacat

SEQ ID NO: 444484 - DNA, 18 bp, Homo sapiens
tttggtggcccctcccca

SEQ ID NO: 444485 - DNA, 13 bp, Homo sapiens
tttggtggctcta

SEQ ID NO: 444486 - DNA, 22 bp, Homo sapiens
tttggtgttttttttaagggca

SEQ ID NO: 444487 - DNA, 13 bp, Homo sapiens
tttggttctgggg

SEQ ID NO: 444488 - DNA, 14 bp, Homo sapiens
tttggttctggggc

SEQ ID NO: 444489 - DNA, 12 bp, Homo sapiens
tttggtttccac

SEQ ID NO: 444490 - DNA, 14 bp, Homo sapiens
tttgtaaataagag

SEQ ID NO: 444491 - DNA, 15 bp, Homo sapiens
tttgtaaataagaga

SEQ ID NO: 444492 - DNA, 12 bp, Homo sapiens
tttgtaaatatt

SEQ ID NO: 444493 - DNA, 14 bp, Homo sapiens
tttgtaaatattct

SEQ ID NO: 444494 - DNA, 17 bp, Homo sapiens
tttgtaaattaatactt

SEQ ID NO: 444495 - DNA, 17 bp, Homo sapiens
tttgtaactattcttca

SEQ ID NO: 444496 - DNA, 14 bp, Homo sapiens
tttgtaagacacac

SEQ ID NO: 444497 - DNA, 19 bp, Homo sapiens
tttgtaagacacacagcct

SEQ ID NO: 444498 - DNA, 23 bp, Homo sapiens
tttgtaagacacacagcctttct

SEQ ID NO: 444499 - DNA, 18 bp, Homo sapiens
tttgtaaggtactgaata

SEQ ID NO: 444500 - DNA, 13 bp, Homo sapiens
tttgtaagttatt

SEQ ID NO: 444501 - DNA, 13 bp, Homo sapiens
tttgtaagtttat

SEQ ID NO: 444502 - DNA, 14 bp, Homo sapiens
tttgtaataaagta

SEQ ID NO: 444503 - DNA, 15 bp, Homo sapiens
tttgtaatatgattt

SEQ ID NO: 444504 - DNA, 20 bp, Homo sapiens
tttgtaattgcttacatttt

SEQ ID NO: 444505 - DNA, 19 bp, Homo sapiens
tttgtaatttttttctagt

SEQ ID NO: 444506 - DNA, 14 bp, Homo sapiens
tttgtacagacaac

SEQ ID NO: 444507 - DNA, 15 bp, Homo sapiens
tttgtacattcctga

SEQ ID NO: 444508 - DNA, 18 bp, Homo sapiens
tttgtaccttattgatct

SEQ ID NO: 444509 - DNA, 15 bp, Homo sapiens
tttgtactgtgctga

SEQ ID NO: 444510 - DNA, 22 bp, Homo sapiens
tttgtagctagtttaaaattat

SEQ ID NO: 444511 - DNA, 23 bp, Homo sapiens
tttgtagctagtttaaaattatt

SEQ ID NO: 444512 - DNA, 22 bp, Homo sapiens
tttgtagcttaaaaaaaggaaa

SEQ ID NO: 444513 - DNA, 15 bp, Homo sapiens
tttgtagggtttcta

SEQ ID NO: 444514 - DNA, 13 bp, Homo sapiens
tttgtataaaatg

SEQ ID NO: 444515 - DNA, 14 bp, Homo sapiens
tttgtataaataat

SEQ ID NO: 444516 - DNA, 16 bp, Homo sapiens
tttgtatataaatggt

SEQ ID NO: 444517 - DNA, 19 bp, Homo sapiens
tttgtatatatacataaca

SEQ ID NO: 444518 - DNA, 22 bp, Homo sapiens
tttgtatccaactgcatccagg

SEQ ID NO: 444519 - DNA, 17 bp, Homo sapiens
tttgtatgaagtacttt

SEQ ID NO: 444520 - DNA, 16 bp, Homo sapiens
tttgtatgcactttgt

SEQ ID NO: 444521 - DNA, 22 bp, Homo sapiens
tttgtatgccaagtgagaagat

SEQ ID NO: 444522 - DNA, 11 bp, Homo sapiens
ttttggccttg

SEQ ID NO: 444523 - DNA, 14 bp, Homo sapiens
ttttggcctttgta

SEQ ID NO: 444524 - DNA, 17 bp, Homo sapiens
ttttggcctttgtaaga

SEQ ID NO: 444525 - DNA, 14 bp, Homo sapiens
ttttggctctgaag

SEQ ID NO: 444526 - DNA, 18 bp, Homo sapiens
ttttggctctttcagaga

SEQ ID NO: 444527 - DNA, 18 bp, Homo sapiens
ttttggggggtaatcagc

SEQ ID NO: 444528 - DNA, 12 bp, Homo sapiens
ttttgtaacttg

SEQ ID NO: 444529 - DNA, 18 bp, Homo sapiens
ttttgtaaggtactgaat

SEQ ID NO: 444530 - DNA, 14 bp, Homo sapiens
ttttgtacaattac

SEQ ID NO: 444531 - DNA, 14 bp, Homo sapiens
ttttgtactgtgct

SEQ ID NO: 444532 - DNA, 23 bp, Homo sapiens
ttttgtatcaaactcgtctgatg

SEQ ID NO: 444533 - DNA, 21 bp, Homo sapiens
ttttgtattacatctaatgct

SEQ ID NO: 444534 - DNA, 16 bp, Homo sapiens
ttttgtatttctttta

SEQ ID NO: 444535 - DNA, 18 bp, Homo sapiens
ttttgtatttcttttata

SEQ ID NO: 444536 - DNA, 14 bp, Homo sapiens
ttttgtatttttga

SEQ ID NO: 444537 - DNA, 20 bp, Homo sapiens
ttttgtcccccaacttgaga

SEQ ID NO: 444538 - DNA, 14 bp, Homo sapiens
ttttgtctgagcct

SEQ ID NO: 444539 - DNA, 14 bp, Homo sapiens
ttttgtcttttatg

SEQ ID NO: 444540 - DNA, 22 bp, Homo sapiens
ttttgtgaaatgaaaacatgta

SEQ ID NO: 444541 - DNA, 19 bp, Homo sapiens
ttttgtgatgatgctgtga

SEQ ID NO: 444542 - DNA, 19 bp, Homo sapiens
ttttgtgatttagaactgt

SEQ ID NO: 444543 - DNA, 16 bp, Homo sapiens
ttttgtgctctttcct

SEQ ID NO: 444544 - DNA, 22 bp, Homo sapiens
ttttgtgggtttctctgtgctc

SEQ ID NO: 444545 - DNA, 17 bp, Homo sapiens
ttttgtgtacagtatgt

SEQ ID NO: 444546 - DNA, 13 bp, Homo sapiens
ttttgtgtattct

SEQ ID NO: 444547 - DNA, 14 bp, Homo sapiens
ttttgtgtgtatat

SEQ ID NO: 444548 - DNA, 17 bp, Homo sapiens
ttttgtgttcctctttg

SEQ ID NO: 444549 - DNA, 18 bp, Homo sapiens
ttttgttaatcatcttct

SEQ ID NO: 444550 - DNA, 15 bp, Homo sapiens
ttttgttccaacagt

SEQ ID NO: 444551 - DNA, 15 bp, Homo sapiens
ttttgttccacaagt

SEQ ID NO: 444552 - DNA, 15 bp, Homo sapiens
ttttgtttcttccaa

SEQ ID NO: 444553 - DNA, 14 bp, Homo sapiens
tttttaaaaagcaa

SEQ ID NO: 444554 - DNA, 22 bp, Homo sapiens
tttttaaaaaggcctttgggat

SEQ ID NO: 444555 - DNA, 21 bp, Homo sapiens
tttttaaaaataaatctaaat

SEQ ID NO: 444556 - DNA, 21 bp, Homo sapiens
tttttaaagaaaatgtgtctg

SEQ ID NO: 444557 - DNA, 18 bp, Homo sapiens
tttttaaaggacaaacag

SEQ ID NO: 444558 - DNA, 14 bp, Homo sapiens
tttttaaagtttaa

SEQ ID NO: 444559 - DNA, 20 bp, Homo sapiens
tttttaaagtttaaatacca

SEQ ID NO: 444560 - DNA, 16 bp, Homo sapiens
tttttaaataaaagca

SEQ ID NO: 444561 - DNA, 14 bp, Homo sapiens
tttttaaattttct

SEQ ID NO: 444562 - DNA, 16 bp, Homo sapiens
tttttaactgattctt

SEQ ID NO: 444563 - DNA, 17 bp, Homo sapiens
tttttaactgcattcta

SEQ ID NO: 444564 - DNA, 23 bp, Homo sapiens
tttttaagctgtaaaaagagaga

SEQ ID NO: 444565 - DNA, 20 bp, Homo sapiens
tttttaaggtgagttctcac

SEQ ID NO: 444566 - DNA, 15 bp, Homo sapiens
tttttaagtacaaaa

SEQ ID NO: 444567 - DNA, 20 bp, Homo sapiens
tttttaatatactaaccatt

SEQ ID NO: 444568 - DNA, 23 bp, Homo sapiens
tttttaatgtgagacagcaagtt

SEQ ID NO: 444569 - DNA, 22 bp, Homo sapiens
tttttaatttgatgaaagctga

SEQ ID NO: 444570 - DNA, 18 bp, Homo sapiens
tttttacaagttttaaat

SEQ ID NO: 444571 - DNA, 12 bp, Homo sapiens
tttttactaaag

SEQ ID NO: 444572 - DNA, 17 bp, Homo sapiens
tttttactacataatta

SEQ ID NO: 444573 - DNA, 17 bp, Homo sapiens
tttttagaacagaaaac

SEQ ID NO: 444574 - DNA, 14 bp, Homo sapiens
tttttagccattgt

SEQ ID NO: 444575 - DNA, 12 bp, Homo sapiens
tttttaggccac

SEQ ID NO: 444576 - DNA, 12 bp, Homo sapiens
tttttataggtt

SEQ ID NO: 444577 - DNA, 13 bp, Homo sapiens
tttttatatatta

SEQ ID NO: 444578 - DNA, 21 bp, Homo sapiens
tttttcaaaacgccatgtcct

SEQ ID NO: 444579 - DNA, 19 bp, Homo sapiens
tttttcaaagatgtgttgc

SEQ ID NO: 444580 - DNA, 13 bp, Homo sapiens
tttttcaatggtt

SEQ ID NO: 444581 - DNA, 20 bp, Homo sapiens
tttttcaggagcgcaagata

SEQ ID NO: 444582 - DNA, 17 bp, Homo sapiens
tttttccctcctgacaa

SEQ ID NO: 444583 - DNA, 12 bp, Homo sapiens
tttttcctacca

SEQ ID NO: 444584 - DNA, 14 bp, Homo sapiens
tttttccttcctga

SEQ ID NO: 444585 - DNA, 14 bp, Homo sapiens
tttttctagctata

SEQ ID NO: 444586 - DNA, 19 bp, Homo sapiens
tttttctgttccctgctgg

SEQ ID NO: 444587 - DNA, 11 bp, Homo sapiens
tttttcttggt

SEQ ID NO: 444588 - DNA, 18 bp, Homo sapiens
tttttgaagttctggcaa

SEQ ID NO: 444589 - DNA, 23 bp, Homo sapiens
tttttgaataaaaaacatttgta

SEQ ID NO: 444590 - DNA, 9 bp, Homo sapiens
tttttggaa

SEQ ID NO: 444591 - DNA, 15 bp, Homo sapiens
tttttggaggtgctt

SEQ ID NO: 444592 - DNA, 19 bp, Homo sapiens
tttttggttgtttgctgtt

SEQ ID NO: 444593 - DNA, 22 bp, Homo sapiens
tttttgtaaactgtatcaaatc

SEQ ID NO: 444594 - DNA, 21 bp, Homo sapiens
tttttgtaaccatatgattga

SEQ ID NO: 444595 - DNA, 13 bp, Homo sapiens
tttttgtatttct

SEQ ID NO: 444596 - DNA, 14 bp, Homo sapiens
tttttgtatttctt

SEQ ID NO: 444597 - DNA, 17 bp, Homo sapiens
tttttgtatttctttta

SEQ ID NO: 444598 - DNA, 12 bp, Homo sapiens
tttttgtatttt

SEQ ID NO: 444599 - DNA, 13 bp, Homo sapiens
tttttgtctcgaa

SEQ ID NO: 444600 - DNA, 16 bp, Homo sapiens
tttttgttaagctcag

SEQ ID NO: 444601 - DNA, 14 bp, Homo sapiens
ttttttaaagaaaa

SEQ ID NO: 444602 - DNA, 23 bp, Homo sapiens
ttttttaaagaaaatgtgtctgc

SEQ ID NO: 444603 - DNA, 18 bp, Homo sapiens
ttttttaatttgttttgt

SEQ ID NO: 444604 - DNA, 11 bp, Homo sapiens
ttttttctgag

SEQ ID NO: 444605 - DNA, 16 bp, Homo sapiens
ttttttgatggctaag

SEQ ID NO: 444606 - DNA, 14 bp, Homo sapiens
ttttttgtatttct

SEQ ID NO: 444607 - DNA, 13 bp, Homo sapiens
tttttttccagca

SEQ ID NO: 444608 - DNA, 10 bp, Homo sapiens
tttttttcct

SEQ ID NO: 444609 - DNA, 17 bp, Homo sapiens
gcaggcaccagcagcag

SEQ ID NO: 444610 - DNA, 22 bp, Homo sapiens
gcaggcggcctttgttgctcag

SEQ ID NO: 444611 - DNA, 16 bp, Homo sapiens
gccaagctttcttcta

SEQ ID NO: 444612 - DNA, 20 bp, Homo sapiens
gccagtaaggcagctctgtc

SEQ ID NO: 444613 - DNA, 16 bp, Homo sapiens
gccatttcttcccaag

SEQ ID NO: 444614 - DNA, 18 bp, Homo sapiens
gcccacagacagatccca

SEQ ID NO: 444615 - DNA, 22 bp, Homo sapiens
gccccaccctcgtggacacctg

SEQ ID NO: 444616 - DNA, 16 bp, Homo sapiens
gccccggtgtgcggtg

SEQ ID NO: 444617 - DNA, 16 bp, Homo sapiens
gccctgccacctgtct

SEQ ID NO: 444618 - DNA, 16 bp, Homo sapiens
gcctcagaccaactct

SEQ ID NO: 444619 - DNA, 13 bp, Homo sapiens
gcctgcaccagga

SEQ ID NO: 444620 - DNA, 23 bp, Homo sapiens
gcctgggtggcagagtgagactc

SEQ ID NO: 444621 - DNA, 18 bp, Homo sapiens
gcctttggcaattcttct

SEQ ID NO: 444622 - DNA, 16 bp, Homo sapiens
gcgaactctcaggact

SEQ ID NO: 444623 - DNA, 19 bp, Homo sapiens
gcggtggctcttgcctgta

SEQ ID NO: 444624 - DNA, 19 bp, Homo sapiens
gctggacttttgcagcttc

SEQ ID NO: 444625 - DNA, 20 bp, Homo sapiens
gctgggattacaggtgcgtg

SEQ ID NO: 444626 - DNA, 16 bp, Homo sapiens
gctgtcagaccttctt

SEQ ID NO: 444627 - DNA, 20 bp, Homo sapiens
gctgttctcattgccagtga

SEQ ID NO: 444628 - DNA, 13 bp, Homo sapiens
gcttctattaaat

SEQ ID NO: 444629 - DNA, 23 bp, Homo sapiens
gcttgacgcgtggtcacaggacg

SEQ ID NO: 444630 - DNA, 15 bp, Homo sapiens
gctttttaatattga

SEQ ID NO: 444631 - DNA, 14 bp, Homo sapiens
ggaaggaggtgcct

SEQ ID NO: 444632 - DNA, 15 bp, Homo sapiens
ggacaaacccttctt

SEQ ID NO: 444633 - DNA, 11 bp, Homo sapiens
ggacacctgcc

SEQ ID NO: 444634 - DNA, 12 bp, Homo sapiens
ggacacctgccc

SEQ ID NO: 444635 - DNA, 15 bp, Homo sapiens
ggacacctgccctgc

SEQ ID NO: 444636 - DNA, 16 bp, Homo sapiens
ggacacctgccctgcc

SEQ ID NO: 444637 - DNA, 19 bp, Homo sapiens
ggagcctccaattgcagtg

SEQ ID NO: 444638 - DNA, 20 bp, Homo sapiens
ggagcctccaattgcagtgg

SEQ ID NO: 444639 - DNA, 14 bp, Homo sapiens
ggaggttgcagtga

SEQ ID NO: 444640 - DNA, 22 bp, Homo sapiens
ggagtaaccaatttctttctaa

SEQ ID NO: 444641 - DNA, 15 bp, Homo sapiens
ggatgattgtacaga

SEQ ID NO: 444642 - DNA, 15 bp, Homo sapiens
ggatgggatttcatg

SEQ ID NO: 444643 - DNA, 23 bp, Homo sapiens
ggcagagtgagactcgtctcaaa

SEQ ID NO: 444644 - DNA, 13 bp, Homo sapiens
ggcagctctgtcg

SEQ ID NO: 444645 - DNA, 20 bp, Homo sapiens
ggcaggcagatcacaaggtc

SEQ ID NO: 444646 - DNA, 19 bp, Homo sapiens
ggcaggggttccagcttcc

SEQ ID NO: 444647 - DNA, 13 bp, Homo sapiens
ggctttgcagtgc

SEQ ID NO: 444648 - DNA, 17 bp, Homo sapiens
gggtcgaggcctgccca

SEQ ID NO: 444649 - DNA, 16 bp, Homo sapiens
gggttccagcttccct

SEQ ID NO: 444650 - DNA, 19 bp, Homo sapiens
ggtaaattgtaaacagcta

SEQ ID NO: 444651 - DNA, 19 bp, Homo sapiens
ggtatgaacttgaggacac

SEQ ID NO: 444652 - DNA, 20 bp, Homo sapiens
ggtatgaacttgaggacaca

SEQ ID NO: 444653 - DNA, 12 bp, Homo sapiens
ggtcagtgcctt

SEQ ID NO: 444654 - DNA, 18 bp, Homo sapiens
ggtgaaaccctgtctcta

SEQ ID NO: 444655 - DNA, 15 bp, Homo sapiens
ggtgagaccacctct

SEQ ID NO: 444656 - DNA, 17 bp, Homo sapiens
ggtgcactggccccacc

SEQ ID NO: 444657 - DNA, 22 bp, Homo sapiens
ggtgcatacacccccacctcct

SEQ ID NO: 444658 - DNA, 14 bp, Homo sapiens
ggtggcccctgcct

SEQ ID NO: 444659 - DNA, 19 bp, Homo sapiens
gtaaccaatttctttctaa

SEQ ID NO: 444660 - DNA, 22 bp, Homo sapiens
gtaactctatagttattgtttt

SEQ ID NO: 444661 - DNA, 16 bp, Homo sapiens
gtagggttataataat

SEQ ID NO: 444662 - DNA, 19 bp, Homo sapiens
gtataaaatggtgttttca

SEQ ID NO: 444663 - DNA, 16 bp, Homo sapiens
gtatatgtcatttatt

SEQ ID NO: 444664 - DNA, 15 bp, Homo sapiens
gtatgaacttgagga

SEQ ID NO: 444665 - DNA, 15 bp, Homo sapiens
gtattacataaataa

SEQ ID NO: 444666 - DNA, 23 bp, Homo sapiens
gtattccatttttactaaagcag

SEQ ID NO: 444667 - DNA, 16 bp, Homo sapiens
gtcaatatttgatcta

SEQ ID NO: 444668 - DNA, 16 bp, Homo sapiens
gtcaccggtcagtgcc

SEQ ID NO: 444669 - DNA, 19 bp, Homo sapiens
gtcagaccttcttccacag

SEQ ID NO: 444670 - DNA, 16 bp, Homo sapiens
gtccttccctcaaaga

SEQ ID NO: 444671 - DNA, 13 bp, Homo sapiens
gtctccatgtttg

SEQ ID NO: 444672 - DNA, 12 bp, Homo sapiens
gtctgatgtttg

SEQ ID NO: 444673 - DNA, 14 bp, Homo sapiens
gtctgatgtttgtt

SEQ ID NO: 444674 - DNA, 21 bp, Homo sapiens
gtcttcaatttgtataaaatg

SEQ ID NO: 444675 - DNA, 24 bp, Homo sapiens
gtgaacgtgggagttcagctgctt

SEQ ID NO: 444676 - DNA, 13 bp, Homo sapiens
gtgagaccacctc

SEQ ID NO: 444677 - DNA, 14 bp, Homo sapiens
gtgcctatagaaaa

SEQ ID NO: 444678 - DNA, 23 bp, Homo sapiens
tatttaaaagtataaaactgctt

SEQ ID NO: 444679 - DNA, 17 bp, Homo sapiens
tcaaaagattgttttat

SEQ ID NO: 444680 - DNA, 21 bp, Homo sapiens
tcaagattcccggctggactt

SEQ ID NO: 444681 - DNA, 13 bp, Homo sapiens
tcaagcactgaca

SEQ ID NO: 444682 - DNA, 16 bp, Homo sapiens
tcacaaggtcaggagt

SEQ ID NO: 444683 - DNA, 23 bp, Homo sapiens
tcacctcttatgcacacctccca

SEQ ID NO: 444684 - DNA, 12 bp, Homo sapiens
tcagatttgaac

SEQ ID NO: 444685 - DNA, 21 bp, Homo sapiens
tcagatttgaactcttcaatc

SEQ ID NO: 444686 - DNA, 20 bp, Homo sapiens
tcagcaaggggctctgccct

SEQ ID NO: 444687 - DNA, 22 bp, Homo sapiens
tcaggactaccgttaccaagag

SEQ ID NO: 444688 - DNA, 16 bp, Homo sapiens
tcatatttacttctta

SEQ ID NO: 444689 - DNA, 15 bp, Homo sapiens
tcatgtaaataaata

SEQ ID NO: 444690 - DNA, 17 bp, Homo sapiens
tcatttatgatacaaaa

SEQ ID NO: 444691 - DNA, 13 bp, Homo sapiens
tcatttattttgt

SEQ ID NO: 444692 - DNA, 21 bp, Homo sapiens
tccaataaaaacattttgaag

SEQ ID NO: 444693 - DNA, 23 bp, Homo sapiens
tccaataaaaacattttgaagtg

SEQ ID NO: 444694 - DNA, 17 bp, Homo sapiens
tccacatctaacaaagt

SEQ ID NO: 444695 - DNA, 15 bp, Homo sapiens
tccaccaaattctga

SEQ ID NO: 444696 - DNA, 22 bp, Homo sapiens
tccacctcccgggttcacgcca

SEQ ID NO: 444697 - DNA, 21 bp, Homo sapiens
tccagaattttccttcttcag

SEQ ID NO: 444698 - DNA, 13 bp, Homo sapiens
tccatcagctccc

SEQ ID NO: 444699 - DNA, 17 bp, Homo sapiens
tccatgactgcatttta

SEQ ID NO: 444700 - DNA, 19 bp, Homo sapiens
tccatttttactaaagcag

SEQ ID NO: 444701 - DNA, 21 bp, Homo sapiens
tcccatggatgtttcttcttt

SEQ ID NO: 444702 - DNA, 22 bp, Homo sapiens
tccccatgtgcctgcaccagga

SEQ ID NO: 444703 - DNA, 14 bp, Homo sapiens
tcccggctggactt

SEQ ID NO: 444704 - DNA, 22 bp, Homo sapiens
tcctatctgtatgtctgcctaa

SEQ ID NO: 444705 - DNA, 21 bp, Homo sapiens
tcctcattcttctctcccaca

SEQ ID NO: 444706 - DNA, 22 bp, Homo sapiens
tcctgtataatctctctcctgt

SEQ ID NO: 444707 - DNA, 19 bp, Homo sapiens
tccttccaagtcttcctga

SEQ ID NO: 444708 - DNA, 15 bp, Homo sapiens
tcctttttgcagtat

SEQ ID NO: 444709 - DNA, 15 bp, Homo sapiens
tcggtgtccatttat

SEQ ID NO: 444710 - DNA, 17 bp, Homo sapiens
tcgtggacacctgccct

SEQ ID NO: 444711 - DNA, 12 bp, Homo sapiens
tctaaaatgtca

SEQ ID NO: 444712 - DNA, 22 bp, Homo sapiens
tctaagttgcatctttaatcct

SEQ ID NO: 444713 - DNA, 23 bp, Homo sapiens
tctacaaccagagccccccacaa

SEQ ID NO: 444714 - DNA, 19 bp, Homo sapiens
tctatagttattgttttat

SEQ ID NO: 444715 - DNA, 22 bp, Homo sapiens
tctatcatgttgaagtcaaatt

SEQ ID NO: 444716 - DNA, 18 bp, Homo sapiens
tctcaatattcaataaag

SEQ ID NO: 444717 - DNA, 22 bp, Homo sapiens
tctccccatgtgcctgcaccag

SEQ ID NO: 444718 - DNA, 16 bp, Homo sapiens
tctcctgattatttat

SEQ ID NO: 444719 - DNA, 20 bp, Homo sapiens
tctcctgtataaccccacct

SEQ ID NO: 444720 - DNA, 15 bp, Homo sapiens
tctctttacattttg

SEQ ID NO: 444721 - DNA, 15 bp, Homo sapiens
tctgaagttggacag

SEQ ID NO: 444722 - DNA, 17 bp, Homo sapiens
tctgaagtttcatttat

SEQ ID NO: 444723 - DNA, 18 bp, Homo sapiens
tctgaggcagatgagctt

SEQ ID NO: 444724 - DNA, 15 bp, Homo sapiens
tctgctggtcttcaa

SEQ ID NO: 444725 - DNA, 22 bp, Homo sapiens
tctggtatgaacttgaggacac

SEQ ID NO: 444726 - DNA, 14 bp, Homo sapiens
tctgtctgtcccaa

SEQ ID NO: 444727 - DNA, 15 bp, Homo sapiens
tctgtctgtctgtcc

SEQ ID NO: 444728 - DNA, 18 bp, Homo sapiens
tctgtctgtctgtcccaa

SEQ ID NO: 444729 - DNA, 16 bp, Homo sapiens
tctgtgtgtctgatgt

SEQ ID NO: 444730 - DNA, 22 bp, Homo sapiens
tcttatccaacatcaacatctt

SEQ ID NO: 444731 - DNA, 16 bp, Homo sapiens
tcttctacaaccagag

SEQ ID NO: 444732 - DNA, 19 bp, Homo sapiens
tcttctacaaccagagccc

SEQ ID NO: 444733 - DNA, 21 bp, Homo sapiens
tctttaaccagtctgaagttt

SEQ ID NO: 444734 - DNA, 17 bp, Homo sapiens
tctttgagtcaagtcaa

SEQ ID NO: 444735 - DNA, 21 bp, Homo sapiens
tctttttttttttgagacagt

SEQ ID NO: 444736 - DNA, 20 bp, Homo sapiens
tgaaaatggaagtggcaata

SEQ ID NO: 444737 - DNA, 16 bp, Homo sapiens
tgaaatgactgtctaa

SEQ ID NO: 444738 - DNA, 18 bp, Homo sapiens
tgaactcttcaatctctt

SEQ ID NO: 444739 - DNA, 17 bp, Homo sapiens
tgaacttgaggacacat

SEQ ID NO: 444740 - DNA, 14 bp, Homo sapiens
tgaacttttcagga

SEQ ID NO: 444741 - DNA, 18 bp, Homo sapiens
tgaagttggacagcaaaa

SEQ ID NO: 444742 - DNA, 14 bp, Homo sapiens
tgaatttcctatct

SEQ ID NO: 444743 - DNA, 16 bp, Homo sapiens
tgacagctgtgctgta

SEQ ID NO: 444744 - DNA, 14 bp, Homo sapiens
tgacatgatcgctt

SEQ ID NO: 444745 - DNA, 14 bp, Homo sapiens
tgacatgtgcctgt

SEQ ID NO: 444746 - DNA, 21 bp, Homo sapiens
tgactgcattttactgtacag

SEQ ID NO: 444747 - DNA, 20 bp, Homo sapiens
tgagaacttctcttcccata

SEQ ID NO: 444748 - DNA, 12 bp, Homo sapiens
tgaggacacatg

SEQ ID NO: 444749 - DNA, 14 bp, Homo sapiens
tgaggacacatgtc

SEQ ID NO: 444750 - DNA, 17 bp, Homo sapiens
tgataaagaaaagaatc

SEQ ID NO: 444751 - DNA, 18 bp, Homo sapiens
tgatgattaaacacctga

SEQ ID NO: 444752 - DNA, 12 bp, Homo sapiens
tgattaaacacc

SEQ ID NO: 444753 - DNA, 17 bp, Homo sapiens
tgattaaacacctgaca

SEQ ID NO: 444754 - DNA, 21 bp, Homo sapiens
tgattaaacacctgacacatc

SEQ ID NO: 444755 - DNA, 17 bp, Homo sapiens
tgattatttatcacata

SEQ ID NO: 444756 - DNA, 17 bp, Homo sapiens
tgattgccatttcttcc

SEQ ID NO: 444757 - DNA, 15 bp, Homo sapiens
tgcactggccccacc

SEQ ID NO: 444758 - DNA, 15 bp, Homo sapiens
tgccacctgtctgtc

SEQ ID NO: 444759 - DNA, 14 bp, Homo sapiens
tgccatttcttccc

SEQ ID NO: 444760 - DNA, 16 bp, Homo sapiens
tgccatttcttcccaa

SEQ ID NO: 444761 - DNA, 15 bp, Homo sapiens
tgccctgccacctgt

SEQ ID NO: 444762 - DNA, 22 bp, Homo sapiens
tgccctgccacctgtctgtctg

SEQ ID NO: 444763 - DNA, 15 bp, Homo sapiens
tgccctgccctgcca

SEQ ID NO: 444764 - DNA, 23 bp, Homo sapiens
tgcccttttcatctccagtgtga

SEQ ID NO: 444765 - DNA, 18 bp, Homo sapiens
tgcctcagcctcccgagt

SEQ ID NO: 444766 - DNA, 14 bp, Homo sapiens
tgcctcctctgtcc

SEQ ID NO: 444767 - DNA, 15 bp, Homo sapiens
tgcctcctctgtcct

SEQ ID NO: 444768 - DNA, 18 bp, Homo sapiens
tgcctgcaccaggagaca

SEQ ID NO: 444769 - DNA, 19 bp, Homo sapiens
tgcctgcaccaggagacag

SEQ ID NO: 444770 - DNA, 19 bp, Homo sapiens
tgcctttggcaattcttct

SEQ ID NO: 444771 - DNA, 20 bp, Homo sapiens
tgcggttagaatcccatgga

SEQ ID NO: 444772 - DNA, 23 bp, Homo sapiens
tgctatagatttgtattttaaaa

SEQ ID NO: 444773 - DNA, 17 bp, Homo sapiens
tgctattttcttatcct

SEQ ID NO: 444774 - DNA, 20 bp, Homo sapiens
tgctcagcaaggggctctgc

SEQ ID NO: 444775 - DNA, 23 bp, Homo sapiens
tgctgtcagaccttcttccacag

SEQ ID NO: 444776 - DNA, 19 bp, Homo sapiens
tgcttctcatagccccggt

SEQ ID NO: 444777 - DNA, 19 bp, Homo sapiens
tgctttgtatccatgaggg

SEQ ID NO: 444778 - DNA, 23 bp, Homo sapiens
tgctttttaatattgatatgctt

SEQ ID NO: 444779 - DNA, 21 bp, Homo sapiens
tggaaatttgttataatgaat

SEQ ID NO: 444780 - DNA, 11 bp, Homo sapiens
tggacacctgc

SEQ ID NO: 444781 - DNA, 13 bp, Homo sapiens
tggacacctgccc

SEQ ID NO: 444782 - DNA, 15 bp, Homo sapiens
tggacacctgccctg

SEQ ID NO: 444783 - DNA, 17 bp, Homo sapiens
tggactggtggcccctg

SEQ ID NO: 444784 - DNA, 14 bp, Homo sapiens
tggcccctgccttg

SEQ ID NO: 444785 - DNA, 13 bp, Homo sapiens
tggcctttcttct

SEQ ID NO: 444786 - DNA, 15 bp, Homo sapiens
tggctcttgcctgta

SEQ ID NO: 444787 - DNA, 22 bp, Homo sapiens
tgggaaattaaatccaataaaa

SEQ ID NO: 444788 - DNA, 18 bp, Homo sapiens
tggtaaaaactgcagtgt

SEQ ID NO: 444789 - DNA, 19 bp, Homo sapiens
tggtatgaacttgaggaca

SEQ ID NO: 444790 - DNA, 22 bp, Homo sapiens
tggtatgaacttgaggacacat

SEQ ID NO: 444791 - DNA, 17 bp, Homo sapiens
tgtacagaatcattgct

SEQ ID NO: 444792 - DNA, 13 bp, Homo sapiens
tgtatctgagcag

SEQ ID NO: 444793 - DNA, 15 bp, Homo sapiens
tgtattacataaata

SEQ ID NO: 444794 - DNA, 23 bp, Homo sapiens
tgtcaatacccctgttaagcaat

SEQ ID NO: 444795 - DNA, 16 bp, Homo sapiens
tgtcctcattcttctc

SEQ ID NO: 444796 - DNA, 17 bp, Homo sapiens
tgtcgtggtagcagatg

SEQ ID NO: 444797 - DNA, 22 bp, Homo sapiens
tgtctaagagatctggtcaaag

SEQ ID NO: 444798 - DNA, 13 bp, Homo sapiens
tgtgacatgctaa

SEQ ID NO: 444799 - DNA, 14 bp, Homo sapiens
tgtgcctgcaccag

SEQ ID NO: 444800 - DNA, 16 bp, Homo sapiens
tgtgcctgcaccagga

SEQ ID NO: 444801 - DNA, 18 bp, Homo sapiens
tgtgcctgcaccaggaga

SEQ ID NO: 444802 - DNA, 17 bp, Homo sapiens
tgtgtactgtaaagaat

SEQ ID NO: 444803 - DNA, 21 bp, Homo sapiens
tgttaacatggacatgatctt

SEQ ID NO: 444804 - DNA, 20 bp, Homo sapiens
tgttccacaagttaaataaa

SEQ ID NO: 444805 - DNA, 15 bp, Homo sapiens
tgtttaagtggcttt

SEQ ID NO: 444806 - DNA, 22 bp, Homo sapiens
ttccaatttacatactctgctt

SEQ ID NO: 444807 - DNA, 13 bp, Homo sapiens
ttccaccaaattc

SEQ ID NO: 444808 - DNA, 18 bp, Homo sapiens
ttccatgactgcatttta

SEQ ID NO: 444809 - DNA, 22 bp, Homo sapiens
ttcctatctgtatgtctgccta

SEQ ID NO: 444810 - DNA, 14 bp, Homo sapiens
ttcctgtgtccaca

SEQ ID NO: 444811 - DNA, 18 bp, Homo sapiens
ttctacaaccagagcccc

SEQ ID NO: 444812 - DNA, 14 bp, Homo sapiens
ttctcaagcactga

SEQ ID NO: 444813 - DNA, 16 bp, Homo sapiens
ttctcatagccccggt

SEQ ID NO: 444814 - DNA, 12 bp, Homo sapiens
ttctggcctcag

SEQ ID NO: 444815 - DNA, 17 bp, Homo sapiens
ttcttctacaaccagag

SEQ ID NO: 444816 - DNA, 19 bp, Homo sapiens
ttcttctacaaccagagcc

SEQ ID NO: 444817 - DNA, 21 bp, Homo sapiens
ttgaactgttctggcctcaga

SEQ ID NO: 444818 - DNA, 22 bp, Homo sapiens
ttgaatttcctatctgtatgtc

SEQ ID NO: 444819 - DNA, 16 bp, Homo sapiens
ttgagacttcaagctt

SEQ ID NO: 444820 - DNA, 14 bp, Homo sapiens
ttgaggacacatgt

SEQ ID NO: 444821 - DNA, 21 bp, Homo sapiens
ttgagtgctgtctccatgttt

SEQ ID NO: 444822 - DNA, 16 bp, Homo sapiens
ttgatatgcttataca

SEQ ID NO: 444823 - DNA, 19 bp, Homo sapiens
ttgtaaacagctaataatg

SEQ ID NO: 444824 - DNA, 19 bp, Homo sapiens
ttgtacagaatcattgctt

SEQ ID NO: 444825 - DNA, 16 bp, Homo sapiens
ttgtctaaaatgtcag

SEQ ID NO: 444826 - DNA, 17 bp, Homo sapiens
ttgtgacccaattaagt

SEQ ID NO: 444827 - DNA, 13 bp, Homo sapiens
ttgtggttaatct

SEQ ID NO: 444828 - DNA, 22 bp, Homo sapiens
tttaaaagtataaaactgcttt

SEQ ID NO: 444829 - DNA, 16 bp, Homo sapiens
tttacagtatccaaaa

SEQ ID NO: 444830 - DNA, 13 bp, Homo sapiens
tttacttcttata

SEQ ID NO: 444831 - DNA, 14 bp, Homo sapiens
tttacttcttatac

SEQ ID NO: 444832 - DNA, 22 bp, Homo sapiens
tttacttcttatacatttgata

SEQ ID NO: 444833 - DNA, 19 bp, Homo sapiens
tttatgatttactcattat

SEQ ID NO: 444834 - DNA, 15 bp, Homo sapiens
tttcagatgctttag

SEQ ID NO: 444835 - DNA, 23 bp, Homo sapiens
tttcatgtaaccaagagtattcc

SEQ ID NO: 444836 - DNA, 20 bp, Homo sapiens
tttctacactgtattacata

SEQ ID NO: 444837 - DNA, 18 bp, Homo sapiens
tttcttctacaaccagag

SEQ ID NO: 444838 - DNA, 14 bp, Homo sapiens
tttgaactcttcaa

SEQ ID NO: 444839 - DNA, 20 bp, Homo sapiens
tttgattttttgctgcagac

SEQ ID NO: 444840 - DNA, 19 bp, Homo sapiens
tttgcagcttccttccaag

SEQ ID NO: 444841 - DNA, 22 bp, Homo sapiens
tttgggggaaaatttagaaata

SEQ ID NO: 444842 - DNA, 12 bp, Homo sapiens
ttttcacctcat

SEQ ID NO: 444843 - DNA, 17 bp, Homo sapiens
tttttactaaagcagtg

SEQ ID NO: 444844 - DNA, 22 bp, Homo sapiens
tttttgttccacaagttaaata

SEQ ID NO: 444845 - DNA, 18 bp, Homo sapiens
aaaaaatacaaacattct

SEQ ID NO: 444846 - DNA, 16 bp, Homo sapiens
aaaaacattttgaagt

SEQ ID NO: 444847 - DNA, 14 bp, Homo sapiens
aaaaccattgcttc

SEQ ID NO: 444848 - DNA, 19 bp, Homo sapiens
aaaagaatccctgttcatt

SEQ ID NO: 444849 - DNA, 13 bp, Homo sapiens
aaaatagccctgc

SEQ ID NO: 444850 - DNA, 21 bp, Homo sapiens
aaaatctggggaggacaaagg

SEQ ID NO: 444851 - DNA, 22 bp, Homo sapiens
aaaatgaaatgtttttgctata

SEQ ID NO: 444852 - DNA, 16 bp, Homo sapiens
aaaattcagagtcctt

SEQ ID NO: 444853 - DNA, 12 bp, Homo sapiens
aaaccattgctt

SEQ ID NO: 444854 - DNA, 16 bp, Homo sapiens
aaaccattgcttcact

SEQ ID NO: 444855 - DNA, 16 bp, Homo sapiens
aaagaatccctgttca

SEQ ID NO: 444856 - DNA, 12 bp, Homo sapiens
aaagcagtgttt

SEQ ID NO: 444857 - DNA, 13 bp, Homo sapiens
aaagcagtgtttt

SEQ ID NO: 444858 - DNA, 20 bp, Homo sapiens
aaagcagttgagattctcta

SEQ ID NO: 444859 - DNA, 15 bp, Homo sapiens
aaagcctctcactaa

SEQ ID NO: 444860 - DNA, 15 bp, Homo sapiens
aaagcttgttaagat

SEQ ID NO: 444861 - DNA, 16 bp, Homo sapiens
aaagttttaacctcag

SEQ ID NO: 444862 - DNA, 13 bp, Homo sapiens
aaatcagtaattg

SEQ ID NO: 444863 - DNA, 13 bp, Homo sapiens
aaatccaataaaa

SEQ ID NO: 444864 - DNA, 21 bp, Homo sapiens
aaatgtcagtgtttgggaaat

SEQ ID NO: 444865 - DNA, 13 bp, Homo sapiens
aaattagtaattg

SEQ ID NO: 444866 - DNA, 18 bp, Homo sapiens
aaatttgttataatgaat

SEQ ID NO: 444867 - DNA, 20 bp, Homo sapiens
aacaaagaaataaaatcctg

SEQ ID NO: 444868 - DNA, 14 bp, Homo sapiens
aacacctgacacat

SEQ ID NO: 444869 - DNA, 15 bp, Homo sapiens
aacacctgacacatc

SEQ ID NO: 444870 - DNA, 18 bp, Homo sapiens
aaccagagccccccacaa

SEQ ID NO: 444871 - DNA, 20 bp, Homo sapiens
aaccagagccccccacaatg

SEQ ID NO: 444872 - DNA, 14 bp, Homo sapiens
aaccagtctgaagt

SEQ ID NO: 444873 - DNA, 16 bp, Homo sapiens
aaccattgcttcacta

SEQ ID NO: 444874 - DNA, 23 bp, Homo sapiens
aacgtgggagttcagctgcttct

SEQ ID NO: 444875 - DNA, 22 bp, Homo sapiens
aactctatagttattgttttat

SEQ ID NO: 444876 - DNA, 21 bp, Homo sapiens
aactcttcaatctcttgcact

SEQ ID NO: 444877 - DNA, 13 bp, Homo sapiens
aactcttcatctt

SEQ ID NO: 444878 - DNA, 13 bp, Homo sapiens
aacttccaattta

SEQ ID NO: 444879 - DNA, 13 bp, Homo sapiens
aacttgaggacac

SEQ ID NO: 444880 - DNA, 20 bp, Homo sapiens
aacttgaggacacatgtcca

SEQ ID NO: 444881 - DNA, 15 bp, Homo sapiens
aacttgtgttctatt

SEQ ID NO: 444882 - DNA, 12 bp, Homo sapiens
aagaaaagaatc

SEQ ID NO: 444883 - DNA, 13 bp, Homo sapiens
aagaaacaaaccc

SEQ ID NO: 444884 - DNA, 16 bp, Homo sapiens
aagaacgtcattttgg

SEQ ID NO: 444885 - DNA, 13 bp, Homo sapiens
aagattgttttat

SEQ ID NO: 444886 - DNA, 11 bp, Homo sapiens
aagcagtgttt

SEQ ID NO: 444887 - DNA, 19 bp, Homo sapiens
aagcagttgagattctcta

SEQ ID NO: 444888 - DNA, 16 bp, Homo sapiens
aagtctattgtttgtt

SEQ ID NO: 444889 - DNA, 17 bp, Homo sapiens
aagtgtgtttctttcta

SEQ ID NO: 444890 - DNA, 14 bp, Homo sapiens
aagttaaataaatc

SEQ ID NO: 444891 - DNA, 16 bp, Homo sapiens
aagttgctgtgcccca

SEQ ID NO: 444892 - DNA, 13 bp, Homo sapiens
aagtttcatttat

SEQ ID NO: 444893 - DNA, 18 bp, Homo sapiens
aataatgaagttattctt

SEQ ID NO: 444894 - DNA, 12 bp, Homo sapiens
aatacattcttg

SEQ ID NO: 444895 - DNA, 13 bp, Homo sapiens
aatatatggtctg

SEQ ID NO: 444896 - DNA, 15 bp, Homo sapiens
aatattcaataaagc

SEQ ID NO: 444897 - DNA, 18 bp, Homo sapiens
ccaaatgatagaaacaga

SEQ ID NO: 444898 - DNA, 16 bp, Homo sapiens
ccaacatcaacatctt

SEQ ID NO: 444899 - DNA, 16 bp, Homo sapiens
ccaactctctcctgta

SEQ ID NO: 444900 - DNA, 17 bp, Homo sapiens
ccaagagtattccattt

SEQ ID NO: 444901 - DNA, 14 bp, Homo sapiens
ccaagtcttcctga

SEQ ID NO: 444902 - DNA, 16 bp, Homo sapiens
ccaatttctttctaaa

SEQ ID NO: 444903 - DNA, 20 bp, Homo sapiens
ccacagcagcctctgaagtt

SEQ ID NO: 444904 - DNA, 21 bp, Homo sapiens
ccacattcagttcttatcaaa

SEQ ID NO: 444905 - DNA, 17 bp, Homo sapiens
ccaccctcgtggacacc

SEQ ID NO: 444906 - DNA, 20 bp, Homo sapiens
ccaccctcgtggacacctgc

SEQ ID NO: 444907 - DNA, 21 bp, Homo sapiens
ccaccctcgtggacacctgcc

SEQ ID NO: 444908 - DNA, 21 bp, Homo sapiens
ccagagccccccacaatgatg

SEQ ID NO: 444909 - DNA, 19 bp, Homo sapiens
ccagatgcctcctctgtcc

SEQ ID NO: 444910 - DNA, 16 bp, Homo sapiens
ccaggagacagacaga

SEQ ID NO: 444911 - DNA, 14 bp, Homo sapiens
ccagtctgaagttt

SEQ ID NO: 444912 - DNA, 20 bp, Homo sapiens
ccagtctgaagtttcattta

SEQ ID NO: 444913 - DNA, 12 bp, Homo sapiens
ccatcagctccc

SEQ ID NO: 444914 - DNA, 17 bp, Homo sapiens
ccatgtgcctgcaccag

SEQ ID NO: 444915 - DNA, 19 bp, Homo sapiens
ccatgtgcctgcaccagga

SEQ ID NO: 444916 - DNA, 20 bp, Homo sapiens
ccatgtgcctgcaccaggag

SEQ ID NO: 444917 - DNA, 16 bp, Homo sapiens
ccatttttactaaagc

SEQ ID NO: 444918 - DNA, 22 bp, Homo sapiens
ccatttttactaaagcagtgtt

SEQ ID NO: 444919 - DNA, 20 bp, Homo sapiens
cccaccctcgtggacacctg

SEQ ID NO: 444920 - DNA, 15 bp, Homo sapiens
cccatcagcagcttg

SEQ ID NO: 444921 - DNA, 16 bp, Homo sapiens
cccatccatcagctcc

SEQ ID NO: 444922 - DNA, 18 bp, Homo sapiens
cccatccatcagctccct

SEQ ID NO: 444923 - DNA, 19 bp, Homo sapiens
cccatcggtgtccatttat

SEQ ID NO: 444924 - DNA, 18 bp, Homo sapiens
cccatggatgtttcttct

SEQ ID NO: 444925 - DNA, 16 bp, Homo sapiens
cccatgtcaccggtca

SEQ ID NO: 444926 - DNA, 21 bp, Homo sapiens
cccatgtcaccggtcagtgcc

SEQ ID NO: 444927 - DNA, 23 bp, Homo sapiens
ccccaccctcgtggacacctgcc

SEQ ID NO: 444928 - DNA, 14 bp, Homo sapiens
ccccatgtgcctgc

SEQ ID NO: 444929 - DNA, 18 bp, Homo sapiens
ccccggtgtgcggtgcat

SEQ ID NO: 444930 - DNA, 18 bp, Homo sapiens
ccctcgtggacacctgcc

SEQ ID NO: 444931 - DNA, 22 bp, Homo sapiens
ccctcgtggacacctgccctgc

SEQ ID NO: 444932 - DNA, 13 bp, Homo sapiens
ccctgccacctgt

SEQ ID NO: 444933 - DNA, 16 bp, Homo sapiens
ccctgccacctgtctg

SEQ ID NO: 444934 - DNA, 18 bp, Homo sapiens
ccctgccctgccacctgt

SEQ ID NO: 444935 - DNA, 19 bp, Homo sapiens
ccgagtagctgggattacg

SEQ ID NO: 444936 - DNA, 13 bp, Homo sapiens
ccggctggacttt

SEQ ID NO: 444937 - DNA, 15 bp, Homo sapiens
ccggtcagtgccttt

SEQ ID NO: 444938 - DNA, 15 bp, Homo sapiens
cctcaaagaggcctt

SEQ ID NO: 444939 - DNA, 18 bp, Homo sapiens
cctcagaccaactctctc

SEQ ID NO: 444940 - DNA, 15 bp, Homo sapiens
cctcctctgtcctca

SEQ ID NO: 444941 - DNA, 12 bp, Homo sapiens
cctgccacctgt

SEQ ID NO: 444942 - DNA, 13 bp, Homo sapiens
cctgccacctgtc

SEQ ID NO: 444943 - DNA, 16 bp, Homo sapiens
cctgccacctgtctgt

SEQ ID NO: 444944 - DNA, 11 bp, Homo sapiens
cctgccctgcc

SEQ ID NO: 444945 - DNA, 18 bp, Homo sapiens
cctgccctgccacctgtc

SEQ ID NO: 444946 - DNA, 15 bp, Homo sapiens
cctgccctgccctgc

SEQ ID NO: 444947 - DNA, 22 bp, Homo sapiens
cctgccttggggaaggtctccc

SEQ ID NO: 444948 - DNA, 17 bp, Homo sapiens
cctggactggtggcccc

SEQ ID NO: 444949 - DNA, 19 bp, Homo sapiens
cctggtgcactggccccac

SEQ ID NO: 444950 - DNA, 20 bp, Homo sapiens
cctgtataatctctctcctg

SEQ ID NO: 444951 - DNA, 22 bp, Homo sapiens
cctgtctgtctgtctgtcccaa

SEQ ID NO: 444952 - DNA, 18 bp, Homo sapiens
ccttgaactgttctggcc

SEQ ID NO: 444953 - DNA, 16 bp, Homo sapiens
ccttgccaagctttct

SEQ ID NO: 444954 - DNA, 18 bp, Homo sapiens
ccttttcatctccagtgt

SEQ ID NO: 444955 - DNA, 22 bp, Homo sapiens
ccttttctttttcccttgaact

SEQ ID NO: 444956 - DNA, 20 bp, Homo sapiens
cgcggtggctcttgcctgta

SEQ ID NO: 444957 - DNA, 17 bp, Homo sapiens
cgcgtggtcacaggacg

SEQ ID NO: 444958 - DNA, 17 bp, Homo sapiens
cggcctttgttgctcag

SEQ ID NO: 444959 - DNA, 20 bp, Homo sapiens
cggctggacttttgcagctt

SEQ ID NO: 444960 - DNA, 23 bp, Homo sapiens
cggctggacttttgcagcttcct

SEQ ID NO: 444961 - DNA, 19 bp, Homo sapiens
cggtcagtgccttttggaa

SEQ ID NO: 444962 - DNA, 15 bp, Homo sapiens
cggtgtccatttata

SEQ ID NO: 444963 - DNA, 17 bp, Homo sapiens
cgtggacacctgccctg

SEQ ID NO: 444964 - DNA, 14 bp, Homo sapiens
cgttgtaatgcaca

SEQ ID NO: 444965 - DNA, 20 bp, Homo sapiens
ctaagaggctatttaaaagt

SEQ ID NO: 444966 - DNA, 18 bp, Homo sapiens
ctaatgtgaattgttcct

SEQ ID NO: 444967 - DNA, 16 bp, Homo sapiens
ctacaaccagagcccc

SEQ ID NO: 444968 - DNA, 19 bp, Homo sapiens
ctacaaccagagcccccca

SEQ ID NO: 444969 - DNA, 22 bp, Homo sapiens
ctacaaccagagccccccacaa

SEQ ID NO: 444970 - DNA, 14 bp, Homo sapiens
ctacagacattaaa

SEQ ID NO: 444971 - DNA, 23 bp, Homo sapiens
ctacccatcggtgtccatttata

SEQ ID NO: 444972 - DNA, 19 bp, Homo sapiens
ctcaatattcaataaagct

SEQ ID NO: 444973 - DNA, 21 bp, Homo sapiens
ctcagaccaactctctcctgt

SEQ ID NO: 444974 - DNA, 18 bp, Homo sapiens
ctcagcaaggggctctgc

SEQ ID NO: 444975 - DNA, 13 bp, Homo sapiens
ctcaggttccaaa

SEQ ID NO: 444976 - DNA, 21 bp, Homo sapiens
ctcattatcgccttttgacag

SEQ ID NO: 444977 - DNA, 21 bp, Homo sapiens
ctccccatgtgcctgcaccag

SEQ ID NO: 444978 - DNA, 18 bp, Homo sapiens
ctcccttttctttttccc

SEQ ID NO: 444979 - DNA, 11 bp, Homo sapiens
ctcctctgtcc

SEQ ID NO: 444980 - DNA, 10 bp, Homo sapiens
ctctcaatat

SEQ ID NO: 444981 - DNA, 18 bp, Homo sapiens
ctctcaatattcaataaa

SEQ ID NO: 444982 - DNA, 19 bp, Homo sapiens
ctctcaatattcaataaag

SEQ ID NO: 444983 - DNA, 20 bp, Homo sapiens
ctctcccacacaagcagtct

SEQ ID NO: 444984 - DNA, 20 bp, Homo sapiens
ctctgccctccctccttcct

SEQ ID NO: 444985 - DNA, 14 bp, Homo sapiens
ctgaagttggacag

SEQ ID NO: 444986 - DNA, 15 bp, Homo sapiens
ctgaagtttcattta

SEQ ID NO: 444987 - DNA, 15 bp, Homo sapiens
ctgaattctgaactt

SEQ ID NO: 444988 - DNA, 23 bp, Homo sapiens
ctgagatcttctctgttattcct

SEQ ID NO: 444989 - DNA, 15 bp, Homo sapiens
ctgatgccttcatct

SEQ ID NO: 444990 - DNA, 17 bp, Homo sapiens
ctgatgccttcatctgt

SEQ ID NO: 444991 - DNA, 12 bp, Homo sapiens
ctgatgtttgtt

SEQ ID NO: 444992 - DNA, 14 bp, Homo sapiens
ctgcaccaggagac

SEQ ID NO: 444993 - DNA, 21 bp, Homo sapiens
ctgcagctctttcttctttga

SEQ ID NO: 444994 - DNA, 16 bp, Homo sapiens
ctgccacctgtctgtc

SEQ ID NO: 444995 - DNA, 14 bp, Homo sapiens
ctgccctgccacct

SEQ ID NO: 444996 - DNA, 15 bp, Homo sapiens
ctgccctgccacctg

SEQ ID NO: 444997 - DNA, 16 bp, Homo sapiens
ctgccctgccacctgt

SEQ ID NO: 444998 - DNA, 18 bp, Homo sapiens
ctgccctgccacctgtct

SEQ ID NO: 444999 - DNA, 16 bp, Homo sapiens
aatgtattctatctct

SEQ ID NO: 445000 - DNA, 14 bp, Homo sapiens
aattaaataaaata

SEQ ID NO: 445001 - DNA, 14 bp, Homo sapiens
aattcagagtcctt

SEQ ID NO: 445002 - DNA, 15 bp, Homo sapiens
aatttaattcatgta

SEQ ID NO: 445003 - DNA, 19 bp, Homo sapiens
aatttacatactctgctta

SEQ ID NO: 445004 - DNA, 17 bp, Homo sapiens
aatttagaaatataatt

SEQ ID NO: 445005 - DNA, 14 bp, Homo sapiens
aatttcctatctgt

SEQ ID NO: 445006 - DNA, 18 bp, Homo sapiens
aatttgggggaaaattta

SEQ ID NO: 445007 - DNA, 14 bp, Homo sapiens
aatttgtataaaat

SEQ ID NO: 445008 - DNA, 15 bp, Homo sapiens
aatttgtataaaatg

SEQ ID NO: 445009 - DNA, 16 bp, Homo sapiens
aatttgttataatgaa

SEQ ID NO: 445010 - DNA, 23 bp, Homo sapiens
aattttctttaaccagtctgaag

SEQ ID NO: 445011 - DNA, 12 bp, Homo sapiens
acaaccagagcc

SEQ ID NO: 445012 - DNA, 17 bp, Homo sapiens
acaacttgtgttctatt

SEQ ID NO: 445013 - DNA, 15 bp, Homo sapiens
acaagttaaataaat

SEQ ID NO: 445014 - DNA, 16 bp, Homo sapiens
acaatttataattaca

SEQ ID NO: 445015 - DNA, 23 bp, Homo sapiens
acacaatgggtatctaataaata

SEQ ID NO: 445016 - DNA, 18 bp, Homo sapiens
acacattaataaacaatc

SEQ ID NO: 445017 - DNA, 11 bp, Homo sapiens
acacctgacac

SEQ ID NO: 445018 - DNA, 23 bp, Homo sapiens
acacctgccctgccctgccacct

SEQ ID NO: 445019 - DNA, 20 bp, Homo sapiens
acacttatttttttcccaag

SEQ ID NO: 445020 - DNA, 18 bp, Homo sapiens
acagaatgctgttttaaa

SEQ ID NO: 445021 - DNA, 21 bp, Homo sapiens
acagacagagaaggcagcagg

SEQ ID NO: 445022 - DNA, 15 bp, Homo sapiens
acagcaaaaccattg

SEQ ID NO: 445023 - DNA, 15 bp, Homo sapiens
acagcaaatgagatg

SEQ ID NO: 445024 - DNA, 17 bp, Homo sapiens
acagccagtaaggcagc

SEQ ID NO: 445025 - DNA, 20 bp, Homo sapiens
acagccagtaaggcagctct

SEQ ID NO: 445026 - DNA, 13 bp, Homo sapiens
acagtaaaaataa

SEQ ID NO: 445027 - DNA, 14 bp, Homo sapiens
acatactctgctta

SEQ ID NO: 445028 - DNA, 15 bp, Homo sapiens
acatcagtaatgtat

SEQ ID NO: 445029 - DNA, 22 bp, Homo sapiens
acatgagaaaatcagtaattgg

SEQ ID NO: 445030 - DNA, 13 bp, Homo sapiens
acattcagttctt

SEQ ID NO: 445031 - DNA, 18 bp, Homo sapiens
accaaacggaactcttca

SEQ ID NO: 445032 - DNA, 12 bp, Homo sapiens
accaaattctga

SEQ ID NO: 445033 - DNA, 21 bp, Homo sapiens
accaagaattctccaaaacaa

SEQ ID NO: 445034 - DNA, 14 bp, Homo sapiens
accaagagtattcc

SEQ ID NO: 445035 - DNA, 15 bp, Homo sapiens
accacctctcaatat

SEQ ID NO: 445036 - DNA, 16 bp, Homo sapiens
accagagccccccaca

SEQ ID NO: 445037 - DNA, 20 bp, Homo sapiens
accagagccccccacaatga

SEQ ID NO: 445038 - DNA, 21 bp, Homo sapiens
accagtctgaagtttcattta

SEQ ID NO: 445039 - DNA, 23 bp, Homo sapiens
accagtctgaagtttcatttatg

SEQ ID NO: 445040 - DNA, 11 bp, Homo sapiens
accattgcttc

SEQ ID NO: 445041 - DNA, 23 bp, Homo sapiens
acccaggaggcggaggttgcagt

SEQ ID NO: 445042 - DNA, 20 bp, Homo sapiens
acccatgtcaccggtcagtg

SEQ ID NO: 445043 - DNA, 22 bp, Homo sapiens
accccaccttgccaagctttct

SEQ ID NO: 445044 - DNA, 19 bp, Homo sapiens
accctcgtggacacctgcc

SEQ ID NO: 445045 - DNA, 20 bp, Homo sapiens
accctcgtggacacctgccc

SEQ ID NO: 445046 - DNA, 13 bp, Homo sapiens
accggtcagtgcc

SEQ ID NO: 445047 - DNA, 14 bp, Homo sapiens
accggtcagtgcct

SEQ ID NO: 445048 - DNA, 15 bp, Homo sapiens
accggtcagtgcctt

SEQ ID NO: 445049 - DNA, 16 bp, Homo sapiens
accggtcagtgccttt

SEQ ID NO: 445050 - DNA, 17 bp, Homo sapiens
acctccacctcccgggt

SEQ ID NO: 445051 - DNA, 20 bp, Homo sapiens
acctctcaatattcaataaa

SEQ ID NO: 445052 - DNA, 13 bp, Homo sapiens
acctgccctgccc

SEQ ID NO: 445053 - DNA, 17 bp, Homo sapiens
acctgccctgccctgcc

SEQ ID NO: 445054 - DNA, 13 bp, Homo sapiens
accttcttccaca

SEQ ID NO: 445055 - DNA, 20 bp, Homo sapiens
accttgcactattggacttt

SEQ ID NO: 445056 - DNA, 20 bp, Homo sapiens
accttgccaagctttcttct

SEQ ID NO: 445057 - DNA, 16 bp, Homo sapiens
accttggtaaattgta

SEQ ID NO: 445058 - DNA, 20 bp, Homo sapiens
acgagggatgggatttcatg

SEQ ID NO: 445059 - DNA, 19 bp, Homo sapiens
actctatagttattgtttt

SEQ ID NO: 445060 - DNA, 20 bp, Homo sapiens
actgacactgcgaactctca

SEQ ID NO: 445061 - DNA, 12 bp, Homo sapiens
actggccccacc

SEQ ID NO: 445062 - DNA, 17 bp, Homo sapiens
acttacactttatgcac

SEQ ID NO: 445063 - DNA, 18 bp, Homo sapiens
acttcttatacatttgat

SEQ ID NO: 445064 - DNA, 22 bp, Homo sapiens
acttgtacgctcacttgcccca

SEQ ID NO: 445065 - DNA, 13 bp, Homo sapiens
acttgttttcccc

SEQ ID NO: 445066 - DNA, 14 bp, Homo sapiens
acttttctttgaag

SEQ ID NO: 445067 - DNA, 16 bp, Homo sapiens
acttttgcagcttcct

SEQ ID NO: 445068 - DNA, 14 bp, Homo sapiens
agaaatataattga

SEQ ID NO: 445069 - DNA, 12 bp, Homo sapiens
agaagatgaaaa

SEQ ID NO: 445070 - DNA, 22 bp, Homo sapiens
agaagatgaaaatggaagtggc

SEQ ID NO: 445071 - DNA, 13 bp, Homo sapiens
agaaggcagcagg

SEQ ID NO: 445072 - DNA, 14 bp, Homo sapiens
agaatcattgctta

SEQ ID NO: 445073 - DNA, 14 bp, Homo sapiens
agaatccctgttca

SEQ ID NO: 445074 - DNA, 22 bp, Homo sapiens
agaatcgatgggggatgcttca

SEQ ID NO: 445075 - DNA, 23 bp, Homo sapiens
agaatcgatgggggatgcttcat

SEQ ID NO: 445076 - DNA, 14 bp, Homo sapiens
agacaataaaacat

SEQ ID NO: 445077 - DNA, 13 bp, Homo sapiens
agacttttctttg

SEQ ID NO: 445078 - DNA, 16 bp, Homo sapiens
agatcttacatctgca

SEQ ID NO: 445079 - DNA, 18 bp, Homo sapiens
agatcttaggcaaaatac

SEQ ID NO: 445080 - DNA, 17 bp, Homo sapiens
agatgtgtcttcaattt

SEQ ID NO: 445081 - DNA, 11 bp, Homo sapiens
agattcaattt

SEQ ID NO: 445082 - DNA, 13 bp, Homo sapiens
agattcatattta

SEQ ID NO: 445083 - DNA, 22 bp, Homo sapiens
agattcatatttacttcttata

SEQ ID NO: 445084 - DNA, 17 bp, Homo sapiens
agatttgaactcttcaa

SEQ ID NO: 445085 - DNA, 17 bp, Homo sapiens
agcaaaaccattgcttc

SEQ ID NO: 445086 - DNA, 20 bp, Homo sapiens
agcaaaaccattgcttcact

SEQ ID NO: 445087 - DNA, 15 bp, Homo sapiens
agcaaggggctctgc

SEQ ID NO: 445088 - DNA, 23 bp, Homo sapiens
agcagctctgctatgagtgtgtg

SEQ ID NO: 445089 - DNA, 18 bp, Homo sapiens
agcaggatgctcagtgat

SEQ ID NO: 445090 - DNA, 20 bp, Homo sapiens
agcaggcaccagcagcagaa

SEQ ID NO: 445091 - DNA, 19 bp, Homo sapiens
agcctacaacatttttcag

SEQ ID NO: 445092 - DNA, 21 bp, Homo sapiens
agctctgtcgtggtagcagat

SEQ ID NO: 445093 - DNA, 11 bp, Homo sapiens
agctttcttct

SEQ ID NO: 445094 - DNA, 12 bp, Homo sapiens
aggacacatgtc

SEQ ID NO: 445095 - DNA, 23 bp, Homo sapiens
aggacgagggatgggatttcatg

SEQ ID NO: 445096 - DNA, 14 bp, Homo sapiens
aggcagagacaata

SEQ ID NO: 445097 - DNA, 21 bp, Homo sapiens
aggcagagacaataaaacatt

SEQ ID NO: 445098 - DNA, 21 bp, Homo sapiens
aggcggcctttgttgctcagc

SEQ ID NO: 445099 - DNA, 13 bp, Homo sapiens
aggctatttaaaa

SEQ ID NO: 445100 - DNA, 18 bp, Homo sapiens
agggcccacccatgtcac

SEQ ID NO: 445101 - DNA, 15 bp, Homo sapiens
aggtgagaccacctc

SEQ ID NO: 445102 - DNA, 20 bp, Homo sapiens
aggtgattttcctgtgtcca

SEQ ID NO: 445103 - DNA, 15 bp, Homo sapiens
agtaaccaatttctt

SEQ ID NO: 445104 - DNA, 12 bp, Homo sapiens
agtagagacagg

SEQ ID NO: 445105 - DNA, 15 bp, Homo sapiens
agtataaaactgctt

SEQ ID NO: 445106 - DNA, 17 bp, Homo sapiens
agtatttcagatgcttt

SEQ ID NO: 445107 - DNA, 19 bp, Homo sapiens
agtcatctccaaaaacagt

SEQ ID NO: 445108 - DNA, 18 bp, Homo sapiens
agtctgaagtttcattta

SEQ ID NO: 445109 - DNA, 17 bp, Homo sapiens
agtgaaaggtcacacta

SEQ ID NO: 445110 - DNA, 20 bp, Homo sapiens
agtgctgggattacaggcgt

SEQ ID NO: 445111 - DNA, 14 bp, Homo sapiens
agtggactgtgtcc

SEQ ID NO: 445112 - DNA, 15 bp, Homo sapiens
agttgctgtgcccca

SEQ ID NO: 445113 - DNA, 22 bp, Homo sapiens
agttttaacctcaggttccaaa

SEQ ID NO: 445114 - DNA, 12 bp, Homo sapiens
ataaccccacct

SEQ ID NO: 445115 - DNA, 18 bp, Homo sapiens
tcgtggacacctgccctg

SEQ ID NO: 445116 - DNA, 22 bp, Homo sapiens
tctaaccatagctgacctttgt

SEQ ID NO: 445117 - DNA, 16 bp, Homo sapiens
tctacaaccagagccc

SEQ ID NO: 445118 - DNA, 19 bp, Homo sapiens
tctagtgatttcctgtata

SEQ ID NO: 445119 - DNA, 13 bp, Homo sapiens
tctattgtttgtt

SEQ ID NO: 445120 - DNA, 14 bp, Homo sapiens
tctcaagcactgac

SEQ ID NO: 445121 - DNA, 20 bp, Homo sapiens
tctcaatattcaataaagct

SEQ ID NO: 445122 - DNA, 15 bp, Homo sapiens
tctcccacacaagca

SEQ ID NO: 445123 - DNA, 22 bp, Homo sapiens
tctcctgtataaccccaccttg

SEQ ID NO: 445124 - DNA, 22 bp, Homo sapiens
tctcttgcctaagtattccttt

SEQ ID NO: 445125 - DNA, 14 bp, Homo sapiens
tctgaagttggaca

SEQ ID NO: 445126 - DNA, 16 bp, Homo sapiens
tctgaagttggacagc

SEQ ID NO: 445127 - DNA, 18 bp, Homo sapiens
tctgatgtttgttgctag

SEQ ID NO: 445128 - DNA, 19 bp, Homo sapiens
tctgcaggatgattgtaca

SEQ ID NO: 445129 - DNA, 20 bp, Homo sapiens
tctggcctcagaccaactct

SEQ ID NO: 445130 - DNA, 23 bp, Homo sapiens
tctggtatgaacttgaggacaca

SEQ ID NO: 445131 - DNA, 22 bp, Homo sapiens
tctgtgattgccatttcttccc

SEQ ID NO: 445132 - DNA, 23 bp, Homo sapiens
tctgtgattgccatttcttccca

SEQ ID NO: 445133 - DNA, 14 bp, Homo sapiens
tcttatacatttga

SEQ ID NO: 445134 - DNA, 18 bp, Homo sapiens
tcttcaatttgtataaaa

SEQ ID NO: 445135 - DNA, 13 bp, Homo sapiens
tcttccacagcaa

SEQ ID NO: 445136 - DNA, 22 bp, Homo sapiens
tcttcctgaccaccttgcacta

SEQ ID NO: 445137 - DNA, 17 bp, Homo sapiens
tcttctacaaccagagc

SEQ ID NO: 445138 - DNA, 20 bp, Homo sapiens
tcttctacaaccagagcccc

SEQ ID NO: 445139 - DNA, 15 bp, Homo sapiens
tcttctctcccacac

SEQ ID NO: 445140 - DNA, 12 bp, Homo sapiens
tcttcttctcaa

SEQ ID NO: 445141 - DNA, 13 bp, Homo sapiens
tcttcttctcaag

SEQ ID NO: 445142 - DNA, 22 bp, Homo sapiens
tcttggctcgcaacctccgcct

SEQ ID NO: 445143 - DNA, 18 bp, Homo sapiens
tctttgaaaaataaagtt

SEQ ID NO: 445144 - DNA, 18 bp, Homo sapiens
tctttgactataacaaaa

SEQ ID NO: 445145 - DNA, 20 bp, Homo sapiens
tctttgataaagaaaagaat

SEQ ID NO: 445146 - DNA, 17 bp, Homo sapiens
tgaaatgacagaatgct

SEQ ID NO: 445147 - DNA, 14 bp, Homo sapiens
tgaagttggacagc

SEQ ID NO: 445148 - DNA, 16 bp, Homo sapiens
tgaatttcctatctgt

SEQ ID NO: 445149 - DNA, 16 bp, Homo sapiens
tgacagaatgctgttt

SEQ ID NO: 445150 - DNA, 15 bp, Homo sapiens
tgacatgtgcctgta

SEQ ID NO: 445151 - DNA, 14 bp, Homo sapiens
tgacccaattaagt

SEQ ID NO: 445152 - DNA, 20 bp, Homo sapiens
tgacgcgtggtcacaggacg

SEQ ID NO: 445153 - DNA, 20 bp, Homo sapiens
tgactacagacattaaataa

SEQ ID NO: 445154 - DNA, 15 bp, Homo sapiens
tgactataacaaaat

SEQ ID NO: 445155 - DNA, 18 bp, Homo sapiens
ttttacagtatccaaaaa

SEQ ID NO: 445156 - DNA, 17 bp, Homo sapiens
ttttactaaagcagtgt

SEQ ID NO: 445157 - DNA, 12 bp, Homo sapiens
tttttactaaag

SEQ ID NO: 445158 - DNA, 13 bp, Homo sapiens
aaaaccattgctt

SEQ ID NO: 445159 - DNA, 21 bp, Homo sapiens
aaaactatttatgaatattaa

SEQ ID NO: 445160 - DNA, 14 bp, Homo sapiens
aaaatatatattgt

SEQ ID NO: 445161 - DNA, 15 bp, Homo sapiens
aaaatgaaatgtttt

SEQ ID NO: 445162 - DNA, 17 bp, Homo sapiens
aaaatgaaatgtttttg

SEQ ID NO: 445163 - DNA, 17 bp, Homo sapiens
aaaatggtgttttcatg

SEQ ID NO: 445164 - DNA, 13 bp, Homo sapiens
aaacacctgacac

SEQ ID NO: 445165 - DNA, 17 bp, Homo sapiens
aaacacctgacacatct

SEQ ID NO: 445166 - DNA, 15 bp, Homo sapiens
aaacattttgaagtg

SEQ ID NO: 445167 - DNA, 14 bp, Homo sapiens
aaaccattgcttca

SEQ ID NO: 445168 - DNA, 15 bp, Homo sapiens
aaaccattgcttcac

SEQ ID NO: 445169 - DNA, 17 bp, Homo sapiens
aaaccattgcttcacta

SEQ ID NO: 445170 - DNA, 18 bp, Homo sapiens
aaagatagtatcttttaa

SEQ ID NO: 445171 - DNA, 10 bp, Homo sapiens
aaagcagtgt

SEQ ID NO: 445172 - DNA, 23 bp, Homo sapiens
aaagctgctgagaatctagcctc

SEQ ID NO: 445173 - DNA, 14 bp, Homo sapiens
aaaggtgattttcc

SEQ ID NO: 445174 - DNA, 17 bp, Homo sapiens
aaagtctattgtttgtt

SEQ ID NO: 445175 - DNA, 13 bp, Homo sapiens
aaataaaataacc

SEQ ID NO: 445176 - DNA, 17 bp, Homo sapiens
aaatatggcctttcttc

SEQ ID NO: 445177 - DNA, 19 bp, Homo sapiens
aaatatggcctttcttcta

SEQ ID NO: 445178 - DNA, 22 bp, Homo sapiens
aaatggtgttttcatgtaaata

SEQ ID NO: 445179 - DNA, 19 bp, Homo sapiens
aaatgtcagtgtttgggaa

SEQ ID NO: 445180 - DNA, 15 bp, Homo sapiens
aaattaaataaaata

SEQ ID NO: 445181 - DNA, 13 bp, Homo sapiens
aacacctgacaca

SEQ ID NO: 445182 - DNA, 12 bp, Homo sapiens
aaccaatttctt

SEQ ID NO: 445183 - DNA, 11 bp, Homo sapiens
aaccagagccc

SEQ ID NO: 445184 - DNA, 13 bp, Homo sapiens
aaccagagccccc

SEQ ID NO: 445185 - DNA, 21 bp, Homo sapiens
aaccagtctgaagtttcattt

SEQ ID NO: 445186 - DNA, 22 bp, Homo sapiens
aaccagtctgaagtttcattta

SEQ ID NO: 445187 - DNA, 23 bp, Homo sapiens
aaccagtctgaagtttcatttat

SEQ ID NO: 445188 - DNA, 12 bp, Homo sapiens
aaccattgcttc

SEQ ID NO: 445189 - DNA, 14 bp, Homo sapiens
aaccattgcttcac

SEQ ID NO: 445190 - DNA, 15 bp, Homo sapiens
aaccattgcttcact

SEQ ID NO: 445191 - DNA, 19 bp, Homo sapiens
aaccccaccttgccaagct

SEQ ID NO: 445192 - DNA, 19 bp, Homo sapiens
aacctccacctcccgggtt

SEQ ID NO: 445193 - DNA, 18 bp, Homo sapiens
aacgtgggagttcagctg

SEQ ID NO: 445194 - DNA, 16 bp, Homo sapiens
aacttgaggacacatg

SEQ ID NO: 445195 - DNA, 19 bp, Homo sapiens
aagaaaattagtaattgta

SEQ ID NO: 445196 - DNA, 21 bp, Homo sapiens
aagaatccctgttcattgtaa

SEQ ID NO: 445197 - DNA, 23 bp, Homo sapiens
aagaatcgatgggggatgcttca

SEQ ID NO: 445198 - DNA, 19 bp, Homo sapiens
aagaattctccaaaacaat

SEQ ID NO: 445199 - DNA, 17 bp, Homo sapiens
aagatgaaaatggaagt

SEQ ID NO: 445200 - DNA, 15 bp, Homo sapiens
aagatgtgtcttcaa

SEQ ID NO: 445201 - DNA, 16 bp, Homo sapiens
cgggctggcctgtgcc

SEQ ID NO: 445202 - DNA, 23 bp, Homo sapiens
cggtgcatacacccccacctcct

SEQ ID NO: 445203 - DNA, 20 bp, Homo sapiens
cggtggctcttgcctgtaat

SEQ ID NO: 445204 - DNA, 12 bp, Homo sapiens
cgtggacacctg

SEQ ID NO: 445205 - DNA, 17 bp, Homo sapiens
cgtgtcttcaattaaaa

SEQ ID NO: 445206 - DNA, 11 bp, Homo sapiens
ctaaagcagtg

SEQ ID NO: 445207 - DNA, 22 bp, Homo sapiens
ctaactaaggtcccataataaa

SEQ ID NO: 445208 - DNA, 14 bp, Homo sapiens
ctacaaccagagcc

SEQ ID NO: 445209 - DNA, 17 bp, Homo sapiens
ctatagttattgtttta

SEQ ID NO: 445210 - DNA, 16 bp, Homo sapiens
ctcaatattcaataaa

SEQ ID NO: 445211 - DNA, 17 bp, Homo sapiens
ctcaatattcaataaag

SEQ ID NO: 445212 - DNA, 20 bp, Homo sapiens
ctcagcaaggggctctgccc

SEQ ID NO: 445213 - DNA, 16 bp, Homo sapiens
ctcagtcatattctta

SEQ ID NO: 445214 - DNA, 24 bp, Homo sapiens
ctcatcctttttaaatgagacttg

SEQ ID NO: 445215 - DNA, 18 bp, Homo sapiens
ctcattaccgtctgtgat

SEQ ID NO: 445216 - DNA, 21 bp, Homo sapiens
ctccaaaaacagtaaaaataa

SEQ ID NO: 445217 - DNA, 16 bp, Homo sapiens
ctccccatgtgcctgc

SEQ ID NO: 445218 - DNA, 23 bp, Homo sapiens
ctccccatgtgcctgcaccagga

SEQ ID NO: 445219 - DNA, 20 bp, Homo sapiens
ctccctccttccttcttgct

SEQ ID NO: 445220 - DNA, 20 bp, Homo sapiens
ctcctgtataaccccacctt

SEQ ID NO: 445221 - DNA, 14 bp, Homo sapiens
ctcgtggacacctg

SEQ ID NO: 445222 - DNA, 17 bp, Homo sapiens
ctcgtggacacctgccc

SEQ ID NO: 445223 - DNA, 20 bp, Homo sapiens
ctctcctgtataatctctct

SEQ ID NO: 445224 - DNA, 16 bp, Homo sapiens
ctctgaagttggacag

SEQ ID NO: 445225 - DNA, 18 bp, Homo sapiens
ctctgaagttggacagca

SEQ ID NO: 445226 - DNA, 15 bp, Homo sapiens
ctctgctatgagtgt

SEQ ID NO: 445227 - DNA, 16 bp, Homo sapiens
ctctgctggtcttcaa

SEQ ID NO: 445228 - DNA, 13 bp, Homo sapiens
ctctttcttcttt

SEQ ID NO: 445229 - DNA, 14 bp, Homo sapiens
ctctttcttctttg

SEQ ID NO: 445230 - DNA, 17 bp, Homo sapiens
ctgaagtttcatttatg

SEQ ID NO: 445231 - DNA, 22 bp, Homo sapiens
ctgacactgcgaactctcagga

SEQ ID NO: 445232 - DNA, 21 bp, Homo sapiens
ctgactcggtcaaaatatttt

SEQ ID NO: 445233 - DNA, 17 bp, Homo sapiens
ctgcaccaggagacaga

SEQ ID NO: 445234 - DNA, 12 bp, Homo sapiens
ctgccacctgtc

SEQ ID NO: 445235 - DNA, 13 bp, Homo sapiens
ctgccacctgtct

SEQ ID NO: 445236 - DNA, 14 bp, Homo sapiens
ctgccacctgtctg

SEQ ID NO: 445237 - DNA, 18 bp, Homo sapiens
ctgccctccctccttcct

SEQ ID NO: 445238 - DNA, 11 bp, Homo sapiens
ctgccctgcca

SEQ ID NO: 445239 - DNA, 21 bp, Homo sapiens
ctgccctgccacctgtctgtc

SEQ ID NO: 445240 - DNA, 15 bp, Homo sapiens
ctgccctgccctgcc

SEQ ID NO: 445241 - DNA, 20 bp, Homo sapiens
ctgcttgcttgctttttaat

SEQ ID NO: 445242 - DNA, 22 bp, Homo sapiens
ctggacttttgcagcttccttc

SEQ ID NO: 445243 - DNA, 16 bp, Homo sapiens
ctggggaggacaaagg

SEQ ID NO: 445244 - DNA, 21 bp, Homo sapiens
ctggtatgaacttgaggacac

SEQ ID NO: 445245 - DNA, 22 bp, Homo sapiens
ctggtatgaacttgaggacaca

SEQ ID NO: 445246 - DNA, 15 bp, Homo sapiens
ctggtggcccctgcc

SEQ ID NO: 445247 - DNA, 16 bp, Homo sapiens
ctggtggcccctgcct

SEQ ID NO: 445248 - DNA, 15 bp, Homo sapiens
ctgtataatttaaca

SEQ ID NO: 445249 - DNA, 21 bp, Homo sapiens
ctgtcagaccttcttccacag

SEQ ID NO: 445250 - DNA, 14 bp, Homo sapiens
ctgtctgtctgtcc

SEQ ID NO: 445251 - DNA, 18 bp, Homo sapiens
ctgttaagcaattccttt

SEQ ID NO: 445252 - DNA, 19 bp, Homo sapiens
cttataattacaatgcaca

SEQ ID NO: 445253 - DNA, 15 bp, Homo sapiens
cttatacatttgata

SEQ ID NO: 445254 - DNA, 17 bp, Homo sapiens
cttatttttttcccaag

SEQ ID NO: 445255 - DNA, 16 bp, Homo sapiens
cttcatcgcagtggac

SEQ ID NO: 445256 - DNA, 19 bp, Homo sapiens
cttcatcgcagtggactgt

SEQ ID NO: 445257 - DNA, 16 bp, Homo sapiens
cttctacaaccagagc

SEQ ID NO: 445258 - DNA, 20 bp, Homo sapiens
cttctacaaccagagccccc

SEQ ID NO: 445259 - DNA, 16 bp, Homo sapiens
cttctattaaatgtat

SEQ ID NO: 445260 - DNA, 13 bp, Homo sapiens
cttcttatacatt

SEQ ID NO: 445261 - DNA, 13 bp, Homo sapiens
cttcttgcttctc

SEQ ID NO: 445262 - DNA, 22 bp, Homo sapiens
cttctttataattctactttga

SEQ ID NO: 445263 - DNA, 22 bp, Homo sapiens
cttctttgaatttcctatctgt

SEQ ID NO: 445264 - DNA, 22 bp, Homo sapiens
cttctttgactataacaaaatc

SEQ ID NO: 445265 - DNA, 21 bp, Homo sapiens
cttgaactgttctggcctcag

SEQ ID NO: 445266 - DNA, 13 bp, Homo sapiens
cttgaggacacat

SEQ ID NO: 445267 - DNA, 14 bp, Homo sapiens
cttgaggacacatg

SEQ ID NO: 445268 - DNA, 17 bp, Homo sapiens
cttgcactattggactt

SEQ ID NO: 445269 - DNA, 18 bp, Homo sapiens
ctttaaccagtctgaagt

SEQ ID NO: 445270 - DNA, 17 bp, Homo sapiens
ctttacatatgctttaa

SEQ ID NO: 445271 - DNA, 18 bp, Homo sapiens
ctttgactataacaaaat

SEQ ID NO: 445272 - DNA, 19 bp, Homo sapiens
cttttaagatgtgtcttca

SEQ ID NO: 445273 - DNA, 23 bp, Homo sapiens
cttttctttgaaggatgactaca

SEQ ID NO: 445274 - DNA, 18 bp, Homo sapiens
cttttttttttttttaca

SEQ ID NO: 445275 - DNA, 20 bp, Homo sapiens
cttttttttttttttacagt

SEQ ID NO: 445276 - DNA, 15 bp, Homo sapiens
gaaaggtcacactac

SEQ ID NO: 445277 - DNA, 12 bp, Homo sapiens
gaaataaaatcc

SEQ ID NO: 445278 - DNA, 17 bp, Homo sapiens
gaaataacccagactta

SEQ ID NO: 445279 - DNA, 22 bp, Homo sapiens
gaaatgacagaatgctgtttta

SEQ ID NO: 445280 - DNA, 22 bp, Homo sapiens
gaactgttctggcctcagacca

SEQ ID NO: 445281 - DNA, 14 bp, Homo sapiens
gaacttgaggacac

SEQ ID NO: 445282 - DNA, 15 bp, Homo sapiens
gaacttgaggacaca

SEQ ID NO: 445283 - DNA, 16 bp, Homo sapiens
gaacttgaggacacat

SEQ ID NO: 445284 - DNA, 16 bp, Homo sapiens
gaagttggacagcaaa

SEQ ID NO: 445285 - DNA, 13 bp, Homo sapiens
gaagtttcattta

SEQ ID NO: 445286 - DNA, 15 bp, Homo sapiens
gaagtttcatttatg

SEQ ID NO: 445287 - DNA, 17 bp, Homo sapiens
gaatccctgttcattgt

SEQ ID NO: 445288 - DNA, 16 bp, Homo sapiens
gaattaagaggataca

SEQ ID NO: 445289 - DNA, 15 bp, Homo sapiens
gaatttcctatctgt

SEQ ID NO: 445290 - DNA, 13 bp, Homo sapiens
gacaataaaacat

SEQ ID NO: 445291 - DNA, 9 bp, Homo sapiens
gacacctgc

SEQ ID NO: 445292 - DNA, 12 bp, Homo sapiens
gacacctgccct

SEQ ID NO: 445293 - DNA, 15 bp, Homo sapiens
gacacctgccctgcc

SEQ ID NO: 445294 - DNA, 20 bp, Homo sapiens
gacagcaaaaccattgcttc

SEQ ID NO: 445295 - DNA, 22 bp, Homo sapiens
gacagcaaaaccattgcttcac

SEQ ID NO: 445296 - DNA, 18 bp, Homo sapiens
gacatataccttctcaaa

SEQ ID NO: 445297 - DNA, 14 bp, Homo sapiens
gaccttcttccaca

SEQ ID NO: 445298 - DNA, 18 bp, Homo sapiens
gacgagggatgggatttc

SEQ ID NO: 445299 - DNA, 20 bp, Homo sapiens
gagaaacattctttcctaaa

SEQ ID NO: 445300 - DNA, 16 bp, Homo sapiens
gagacaataaaacatt

SEQ ID NO: 445301 - DNA, 16 bp, Homo sapiens
gagcagagaattctct

SEQ ID NO: 445302 - DNA, 14 bp, Homo sapiens
gagcaggcaccagc

SEQ ID NO: 445303 - DNA, 13 bp, Homo sapiens
gagccccccacaa

SEQ ID NO: 445304 - DNA, 14 bp, Homo sapiens
gaggacacatgtcc

SEQ ID NO: 445305 - DNA, 20 bp, Homo sapiens
gagtgcttccgctgcggtga

SEQ ID NO: 445306 - DNA, 15 bp, Homo sapiens
gagttcagctgcttc

SEQ ID NO: 445307 - DNA, 11 bp, Homo sapiens
gatagaaacag

SEQ ID NO: 445308 - DNA, 18 bp, Homo sapiens
gatcactatgcattttaa

SEQ ID NO: 445309 - DNA, 21 bp, Homo sapiens
gatcccatccatcagctccct

SEQ ID NO: 445310 - DNA, 20 bp, Homo sapiens
gatcttaggcaaaataccag

SEQ ID NO: 445311 - DNA, 14 bp, Homo sapiens
gatgccttcatctg

SEQ ID NO: 445312 - DNA, 16 bp, Homo sapiens
gatgtaaaaaatacaa

SEQ ID NO: 445313 - DNA, 13 bp, Homo sapiens
gatgtatgcccaa

SEQ ID NO: 445314 - DNA, 17 bp, Homo sapiens
gatgtttgttgctagga

SEQ ID NO: 445315 - DNA, 16 bp, Homo sapiens
gattaaacacctgaca

SEQ ID NO: 445316 - DNA, 20 bp, Homo sapiens
gattgccatttcttcccaag

SEQ ID NO: 445317 - DNA, 12 bp, Homo sapiens
gcaccaggagac

SEQ ID NO: 445318 - DNA, 15 bp, Homo sapiens
gcactattggacttt

SEQ ID NO: 445319 - DNA, 14 bp, Homo sapiens
gcactggccccacc

SEQ ID NO: 445320 - DNA, 21 bp, Homo sapiens
gcagagacaataaaacattcc

SEQ ID NO: 445321 - DNA, 13 bp, Homo sapiens
gcagcagtgagct

SEQ ID NO: 445322 - DNA, 14 bp, Homo sapiens
gcagcctctgaagt

SEQ ID NO: 445323 - DNA, 22 bp, Homo sapiens
gcagcctctgaagttggacagc

SEQ ID NO: 445324 - DNA, 15 bp, Homo sapiens
gcagctctttcttct

SEQ ID NO: 445325 - DNA, 17 bp, Homo sapiens
gcagctctttcttcttt

SEQ ID NO: 445326 - DNA, 19 bp, Homo sapiens
gcagctggttctgcaatga

SEQ ID NO: 445327 - DNA, 13 bp, Homo sapiens
gcagcttgacgcg

SEQ ID NO: 445328 - DNA, 15 bp, Homo sapiens
tggtcagatttgaac

SEQ ID NO: 445329 - DNA, 18 bp, Homo sapiens
tggtgacatgtgcctgta

SEQ ID NO: 445330 - DNA, 23 bp, Homo sapiens
tgtaatcccagctactcaggagg

SEQ ID NO: 445331 - DNA, 16 bp, Homo sapiens
tgtagggttataataa

SEQ ID NO: 445332 - DNA, 17 bp, Homo sapiens
tgtagggttataataat

SEQ ID NO: 445333 - DNA, 17 bp, Homo sapiens
tgtataatttaacagtg

SEQ ID NO: 445334 - DNA, 15 bp, Homo sapiens
tgtatcaaactagtg

SEQ ID NO: 445335 - DNA, 14 bp, Homo sapiens
tgtatgcccaaaga

SEQ ID NO: 445336 - DNA, 12 bp, Homo sapiens
tgtatgtctgcc

SEQ ID NO: 445337 - DNA, 18 bp, Homo sapiens
tgtcaccggtcagtgcct

SEQ ID NO: 445338 - DNA, 19 bp, Homo sapiens
tgtcagaccttcttccaca

SEQ ID NO: 445339 - DNA, 20 bp, Homo sapiens
tgtcagaccttcttccacag

SEQ ID NO: 445340 - DNA, 22 bp, Homo sapiens
tgtcagccctgctgtcagacct

SEQ ID NO: 445341 - DNA, 15 bp, Homo sapiens
tgtcctcattcttct

SEQ ID NO: 445342 - DNA, 17 bp, Homo sapiens
tgtccttccctcaaaga

SEQ ID NO: 445343 - DNA, 13 bp, Homo sapiens
tgtcttctttgct

SEQ ID NO: 445344 - DNA, 16 bp, Homo sapiens
tgtcttctttgctaga

SEQ ID NO: 445345 - DNA, 17 bp, Homo sapiens
tgtgcctgcaccaggag

SEQ ID NO: 445346 - DNA, 19 bp, Homo sapiens
tgtgcctgcaccaggagac

SEQ ID NO: 445347 - DNA, 17 bp, Homo sapiens
tgtgtcttcaatttgta

SEQ ID NO: 445348 - DNA, 16 bp, Homo sapiens
tgttctggcctcagac

SEQ ID NO: 445349 - DNA, 18 bp, Homo sapiens
tgttctggcctcagacca

SEQ ID NO: 445350 - DNA, 18 bp, Homo sapiens
tgttgaagtcaaatttgg

SEQ ID NO: 445351 - DNA, 16 bp, Homo sapiens
ttaaacacctgacaca

SEQ ID NO: 445352 - DNA, 20 bp, Homo sapiens
ttaaaccaaacggaactctt

SEQ ID NO: 445353 - DNA, 12 bp, Homo sapiens
ttaaataaaata

SEQ ID NO: 445354 - DNA, 15 bp, Homo sapiens
ttaaataaatcataa

SEQ ID NO: 445355 - DNA, 22 bp, Homo sapiens
ttaaccagtctgaagtttcatt

SEQ ID NO: 445356 - DNA, 21 bp, Homo sapiens
ttaagatgtgtcttcaatttg

SEQ ID NO: 445357 - DNA, 22 bp, Homo sapiens
ttaatattgatatgcttataca

SEQ ID NO: 445358 - DNA, 15 bp, Homo sapiens
ttaatcgtgtcttca

SEQ ID NO: 445359 - DNA, 13 bp, Homo sapiens
ttacactttatgc

SEQ ID NO: 445360 - DNA, 13 bp, Homo sapiens
ttactaaagcagt

SEQ ID NO: 445361 - DNA, 16 bp, Homo sapiens
ttactaaagcagtgtt

SEQ ID NO: 445362 - DNA, 11 bp, Homo sapiens
ttagaaatata

SEQ ID NO: 445363 - DNA, 12 bp, Homo sapiens
ttagaaatataa

SEQ ID NO: 445364 - DNA, 14 bp, Homo sapiens
ttagaaatataatt

SEQ ID NO: 445365 - DNA, 15 bp, Homo sapiens
ttataataatgttaa

SEQ ID NO: 445366 - DNA, 13 bp, Homo sapiens
ttatcaaatacat

SEQ ID NO: 445367 - DNA, 21 bp, Homo sapiens
ttatcgccttttgacagctgt

SEQ ID NO: 445368 - DNA, 20 bp, Homo sapiens
ttattttgtttaagtggctt

SEQ ID NO: 445369 - DNA, 19 bp, Homo sapiens
ttcaccgtgttagccagga

SEQ ID NO: 445370 - DNA, 17 bp, Homo sapiens
ttcagtgtttatttcct

SEQ ID NO: 445371 - DNA, 14 bp, Homo sapiens
ttcatctccagtgt

SEQ ID NO: 445372 - DNA, 15 bp, Homo sapiens
ttccaagtcttcctg

SEQ ID NO: 445373 - DNA, 22 bp, Homo sapiens
ttcccataccacccaaaatcat

SEQ ID NO: 445374 - DNA, 14 bp, Homo sapiens
ttcccggctggact

SEQ ID NO: 445375 - DNA, 13 bp, Homo sapiens
ttctaaaacacat

SEQ ID NO: 445376 - DNA, 13 bp, Homo sapiens
ttctacaaccaga

SEQ ID NO: 445377 - DNA, 15 bp, Homo sapiens
ttctacaaccagagc

SEQ ID NO: 445378 - DNA, 17 bp, Homo sapiens
ttctagtgatttcctgt

SEQ ID NO: 445379 - DNA, 22 bp, Homo sapiens
ttctagtgatttcctgtataat

SEQ ID NO: 445380 - DNA, 21 bp, Homo sapiens
ttcttatacatttgataaagt

SEQ ID NO: 445381 - DNA, 14 bp, Homo sapiens
ttctttaaccagtc

SEQ ID NO: 445382 - DNA, 18 bp, Homo sapiens
ttctttataattctactt

SEQ ID NO: 445383 - DNA, 17 bp, Homo sapiens
ttctttctaaaacacat

SEQ ID NO: 445384 - DNA, 19 bp, Homo sapiens
ttgaactcttcaatctctt

SEQ ID NO: 445385 - DNA, 19 bp, Homo sapiens
ttgacaggattattggaaa

SEQ ID NO: 445386 - DNA, 11 bp, Homo sapiens
ttgaggacaca

SEQ ID NO: 445387 - DNA, 12 bp, Homo sapiens
ttgataaagtaa

SEQ ID NO: 445388 - DNA, 14 bp, Homo sapiens
ttgccatttcttcc

SEQ ID NO: 445389 - DNA, 18 bp, Homo sapiens
ttgccatttcttcccaag

SEQ ID NO: 445390 - DNA, 24 bp, Homo sapiens
ttgccatttcttcccaaggccagt

SEQ ID NO: 445391 - DNA, 23 bp, Homo sapiens
ttggacagcaaaaccattgcttc

SEQ ID NO: 445392 - DNA, 16 bp, Homo sapiens
ttggcaattcttcttc

SEQ ID NO: 445393 - DNA, 22 bp, Homo sapiens
ttggtaaattgtaaacagctaa

SEQ ID NO: 445394 - DNA, 21 bp, Homo sapiens
ttgtcatataagattcatatt

SEQ ID NO: 445395 - DNA, 15 bp, Homo sapiens
ttgtctaaaatgtca

SEQ ID NO: 445396 - DNA, 19 bp, Homo sapiens
tttaacttcatttttctaa

SEQ ID NO: 445397 - DNA, 22 bp, Homo sapiens
tttaagatgtgtcttcaatttg

SEQ ID NO: 445398 - DNA, 13 bp, Homo sapiens
tttactaaagcag

SEQ ID NO: 445399 - DNA, 14 bp, Homo sapiens
tttactaaagcagt

SEQ ID NO: 445400 - DNA, 15 bp, Homo sapiens
tttacttcttataca

SEQ ID NO: 445401 - DNA, 21 bp, Homo sapiens
tttatagaataatgtgggaag

SEQ ID NO: 445402 - DNA, 12 bp, Homo sapiens
tttatgttctag

SEQ ID NO: 445403 - DNA, 14 bp, Homo sapiens
tttcatgtaaataa

SEQ ID NO: 445404 - DNA, 19 bp, Homo sapiens
tttccatgactgcatttta

SEQ ID NO: 445405 - DNA, 20 bp, Homo sapiens
tttccatgactgcattttac

SEQ ID NO: 445406 - DNA, 22 bp, Homo sapiens
tttcctgtgtccacatctaaca

SEQ ID NO: 445407 - DNA, 11 bp, Homo sapiens
tttcttctttg

SEQ ID NO: 445408 - DNA, 22 bp, Homo sapiens
tttgaagatgccgcatttggat

SEQ ID NO: 445409 - DNA, 16 bp, Homo sapiens
tttgccacctctgccc

SEQ ID NO: 445410 - DNA, 13 bp, Homo sapiens
tttgtataaaatg

SEQ ID NO: 445411 - DNA, 16 bp, Homo sapiens
ttttactaaagcagtg

SEQ ID NO: 445412 - DNA, 23 bp, Homo sapiens
ttttctacagccagtaaggcagc

SEQ ID NO: 445413 - DNA, 11 bp, Homo sapiens
ttttgaagtgt

SEQ ID NO: 445414 - DNA, 19 bp, Homo sapiens
ttttgcagcttccttccaa

SEQ ID NO: 445415 - DNA, 16 bp, Homo sapiens
ttttgtcatataagat

SEQ ID NO: 445416 - DNA, 21 bp, Homo sapiens
ttttgttccacaagttaaata

SEQ ID NO: 445417 - DNA, 12 bp, Homo sapiens
tttttaaagtct

SEQ ID NO: 445418 - DNA, 17 bp, Homo sapiens
tttttatctttaaatag

SEQ ID NO: 445419 - DNA, 22 bp, Homo sapiens
tacactgtattacataaataaa

SEQ ID NO: 445420 - DNA, 13 bp, Homo sapiens
tacactttatgca

SEQ ID NO: 445421 - DNA, 18 bp, Homo sapiens
tacagccagtaaggcagc

SEQ ID NO: 445422 - DNA, 13 bp, Homo sapiens
tacatatgcttta

SEQ ID NO: 445423 - DNA, 17 bp, Homo sapiens
tacatatgctttaagaa

SEQ ID NO: 445424 - DNA, 23 bp, Homo sapiens
tacatctgcagctctttcttctt

SEQ ID NO: 445425 - DNA, 22 bp, Homo sapiens
taccttctcaaaagattgtttt

SEQ ID NO: 445426 - DNA, 13 bp, Homo sapiens
tactaaagcagtg

SEQ ID NO: 445427 - DNA, 14 bp, Homo sapiens
tactaaagcagtgt

SEQ ID NO: 445428 - DNA, 14 bp, Homo sapiens
tactgtaaagaatt

SEQ ID NO: 445429 - DNA, 19 bp, Homo sapiens
tacttcatcgcagtggact

SEQ ID NO: 445430 - DNA, 23 bp, Homo sapiens
tactttacatatgctttaagaat

SEQ ID NO: 445431 - DNA, 15 bp, Homo sapiens
tagaaatataattga

SEQ ID NO: 445432 - DNA, 15 bp, Homo sapiens
tagatcttacatctg

SEQ ID NO: 445433 - DNA, 16 bp, Homo sapiens
tagatgcctgaacttg

SEQ ID NO: 445434 - DNA, 18 bp, Homo sapiens
tagatttgtattttaaaa

SEQ ID NO: 445435 - DNA, 17 bp, Homo sapiens
tagggttataataatgt

SEQ ID NO: 445436 - DNA, 13 bp, Homo sapiens
tagtaattgtaag

SEQ ID NO: 445437 - DNA, 14 bp, Homo sapiens
tagtatcttttaaa

SEQ ID NO: 445438 - DNA, 15 bp, Homo sapiens
tagtatcttttaaaa

SEQ ID NO: 445439 - DNA, 16 bp, Homo sapiens
tagtgatttcctgtat

SEQ ID NO: 445440 - DNA, 12 bp, Homo sapiens
tataaccccacc

SEQ ID NO: 445441 - DNA, 17 bp, Homo sapiens
tataattctactttgag

SEQ ID NO: 445442 - DNA, 13 bp, Homo sapiens
tataccttctcaa

SEQ ID NO: 445443 - DNA, 16 bp, Homo sapiens
tatatggtctgtgtgt

SEQ ID NO: 445444 - DNA, 19 bp, Homo sapiens
tatccaaaaatagccctgc

SEQ ID NO: 445445 - DNA, 17 bp, Homo sapiens
tatcgccttttgacagc

SEQ ID NO: 445446 - DNA, 20 bp, Homo sapiens
tatgaacttgaggacacatg

SEQ ID NO: 445447 - DNA, 16 bp, Homo sapiens
tatgatctatgctata

SEQ ID NO: 445448 - DNA, 21 bp, Homo sapiens
tatgcacacctcccaccccct

SEQ ID NO: 445449 - DNA, 17 bp, Homo sapiens
tatgtcatttattttgt

SEQ ID NO: 445450 - DNA, 23 bp, Homo sapiens
tatgttctagtgatttcctgtat

SEQ ID NO: 445451 - DNA, 17 bp, Homo sapiens
tattaagtaaaaaatat

SEQ ID NO: 445452 - DNA, 21 bp, Homo sapiens
tattgatttaacttcattttt

SEQ ID NO: 445453 - DNA, 16 bp, Homo sapiens
tcaatattcaataaag

SEQ ID NO: 445454 - DNA, 17 bp, Homo sapiens
tcaatattcaataaagc

SEQ ID NO: 445455 - DNA, 16 bp, Homo sapiens
tcaatttgtataaaat

SEQ ID NO: 445456 - DNA, 15 bp, Homo sapiens
tcaccggtcagtgcc

SEQ ID NO: 445457 - DNA, 18 bp, Homo sapiens
tcaccgtgttagccagga

SEQ ID NO: 445458 - DNA, 15 bp, Homo sapiens
tcactatgcatttta

SEQ ID NO: 445459 - DNA, 23 bp, Homo sapiens
tcacttaagttgagatttttgct

SEQ ID NO: 445460 - DNA, 20 bp, Homo sapiens
tcagaccaactctctcctgt

SEQ ID NO: 445461 - DNA, 15 bp, Homo sapiens
tcagaccttcttcca

SEQ ID NO: 445462 - DNA, 23 bp, Homo sapiens
tcagagtccttgcaaaattgtct

SEQ ID NO: 445463 - DNA, 13 bp, Homo sapiens
tcaggttccaaat

SEQ ID NO: 445464 - DNA, 20 bp, Homo sapiens
tcatatttacttcttataca

SEQ ID NO: 445465 - DNA, 21 bp, Homo sapiens
tcatatttacttcttatacat

SEQ ID NO: 445466 - DNA, 22 bp, Homo sapiens
tcatatttacttcttatacatt

SEQ ID NO: 445467 - DNA, 15 bp, Homo sapiens
tcatctgttcagtca

SEQ ID NO: 445468 - DNA, 14 bp, Homo sapiens
tcatgtaaataaat

SEQ ID NO: 445469 - DNA, 11 bp, Homo sapiens
tcatttatgat

SEQ ID NO: 445470 - DNA, 22 bp, Homo sapiens
tcattttgtctctctcacatta

SEQ ID NO: 445471 - DNA, 20 bp, Homo sapiens
tgcagctctttcttctttga

SEQ ID NO: 445472 - DNA, 17 bp, Homo sapiens
tgcagcttccttccaag

SEQ ID NO: 445473 - DNA, 14 bp, Homo sapiens
tgcataagttaact

SEQ ID NO: 445474 - DNA, 16 bp, Homo sapiens
tgccaagctttcttct

SEQ ID NO: 445475 - DNA, 10 bp, Homo sapiens
tgccacctgt

SEQ ID NO: 445476 - DNA, 11 bp, Homo sapiens
tgccacctgtc

SEQ ID NO: 445477 - DNA, 13 bp, Homo sapiens
tgccacctgtctg

SEQ ID NO: 445478 - DNA, 16 bp, Homo sapiens
tgccacctgtctgtct

SEQ ID NO: 445479 - DNA, 20 bp, Homo sapiens
tgcctatcacctcttatgca

SEQ ID NO: 445480 - DNA, 14 bp, Homo sapiens
tgcctgcaccagga

SEQ ID NO: 445481 - DNA, 16 bp, Homo sapiens
tgcctgcaccaggaga

SEQ ID NO: 445482 - DNA, 17 bp, Homo sapiens
tgcctgcaccaggagac

SEQ ID NO: 445483 - DNA, 20 bp, Homo sapiens
tgcctgcaccaggagacaga

SEQ ID NO: 445484 - DNA, 18 bp, Homo sapiens
tgctctgctggtcttcaa

SEQ ID NO: 445485 - DNA, 20 bp, Homo sapiens
tgctgtcagccctgctgtca

SEQ ID NO: 445486 - DNA, 22 bp, Homo sapiens
tgcttgctggtactaagaggct

SEQ ID NO: 445487 - DNA, 23 bp, Homo sapiens
tggaaatttgttataatgaatga

SEQ ID NO: 445488 - DNA, 18 bp, Homo sapiens
tggacacctgccctgccc

SEQ ID NO: 445489 - DNA, 21 bp, Homo sapiens
tggacagcaaaaccattgctt

SEQ ID NO: 445490 - DNA, 22 bp, Homo sapiens
tggacagcaaaaccattgcttc

SEQ ID NO: 445491 - DNA, 12 bp, Homo sapiens
tggactgtgtcc

SEQ ID NO: 445492 - DNA, 21 bp, Homo sapiens
tgggaaattaaatccaataaa

SEQ ID NO: 445493 - DNA, 14 bp, Homo sapiens
tgggaagaaacaaa

SEQ ID NO: 445494 - DNA, 23 bp, Homo sapiens
tgggcaggggttccagcttccct

SEQ ID NO: 445495 - DNA, 21 bp, Homo sapiens
tggtatgaacttgaggacaca

SEQ ID NO: 445496 - DNA, 23 bp, Homo sapiens
tggtatgaacttgaggacacatg

SEQ ID NO: 445497 - DNA, 16 bp, Homo sapiens
tggtcagatttgaact

SEQ ID NO: 445498 - DNA, 14 bp, Homo sapiens
tgtaaaaaatacaa

SEQ ID NO: 445499 - DNA, 11 bp, Homo sapiens
tgtaacacaag

SEQ ID NO: 445500 - DNA, 20 bp, Homo sapiens
tgtacagattgctgcttctg

SEQ ID NO: 445501 - DNA, 21 bp, Homo sapiens
tgtaccgggctggcctgtgcc

SEQ ID NO: 445502 - DNA, 16 bp, Homo sapiens
tgtactgtaaagaatt

SEQ ID NO: 445503 - DNA, 22 bp, Homo sapiens
tgtataatttaacagtgccctt

SEQ ID NO: 445504 - DNA, 21 bp, Homo sapiens
tgtatttttagtagagacagg

SEQ ID NO: 445505 - DNA, 17 bp, Homo sapiens
tgtcaccggtcagtgcc

SEQ ID NO: 445506 - DNA, 12 bp, Homo sapiens
tgtccatttata

SEQ ID NO: 445507 - DNA, 14 bp, Homo sapiens
tgtctaaaatgtca

SEQ ID NO: 445508 - DNA, 15 bp, Homo sapiens
tgtctgtctgtccca

SEQ ID NO: 445509 - DNA, 15 bp, Homo sapiens
tgtctgtctgtctgt

SEQ ID NO: 445510 - DNA, 21 bp, Homo sapiens
tgtcttcaatttgtataaaat

SEQ ID NO: 445511 - DNA, 19 bp, Homo sapiens
tgtgattgccatttcttcc

SEQ ID NO: 445512 - DNA, 19 bp, Homo sapiens
tgtgccccatcagcagctt

SEQ ID NO: 445513 - DNA, 19 bp, Homo sapiens
tgtgggaagaaacaaaccc

SEQ ID NO: 445514 - DNA, 19 bp, Homo sapiens
tgttccacaagttaaataa

SEQ ID NO: 445515 - DNA, 23 bp, Homo sapiens
tgttgctcagcaaggggctctgc

SEQ ID NO: 445516 - DNA, 19 bp, Homo sapiens
tgttttcatgtaaataaat

SEQ ID NO: 445517 - DNA, 20 bp, Homo sapiens
ttaaatgtatatgtcattta

SEQ ID NO: 445518 - DNA, 18 bp, Homo sapiens
ggatgtttcttctttgac

SEQ ID NO: 445519 - DNA, 17 bp, Homo sapiens
ggcaagacttttctttg

SEQ ID NO: 445520 - DNA, 18 bp, Homo sapiens
ggcagagacaataaaaca

SEQ ID NO: 445521 - DNA, 16 bp, Homo sapiens
ggcagatcacaaggtc

SEQ ID NO: 445522 - DNA, 18 bp, Homo sapiens
ggccagtctgaacctgag

SEQ ID NO: 445523 - DNA, 14 bp, Homo sapiens
ggcccctgccttgg

SEQ ID NO: 445524 - DNA, 23 bp, Homo sapiens
ggcctcagaccaactctctcctg

SEQ ID NO: 445525 - DNA, 19 bp, Homo sapiens
ggcggaggttgcagtgagc

SEQ ID NO: 445526 - DNA, 21 bp, Homo sapiens
ggctggacttttgcagcttcc

SEQ ID NO: 445527 - DNA, 22 bp, Homo sapiens
gggagctcagtctccctggcct

SEQ ID NO: 445528 - DNA, 12 bp, Homo sapiens
gggatgcttcat

SEQ ID NO: 445529 - DNA, 18 bp, Homo sapiens
gggcccacccatgtcacc

SEQ ID NO: 445530 - DNA, 21 bp, Homo sapiens
gggctctgccctccctccttc

SEQ ID NO: 445531 - DNA, 22 bp, Homo sapiens
ggggcccacagacagatcccat

SEQ ID NO: 445532 - DNA, 23 bp, Homo sapiens
ggggctctgccctccctccttcc

SEQ ID NO: 445533 - DNA, 22 bp, Homo sapiens
ggtcagtgccttttggaactgt

SEQ ID NO: 445534 - DNA, 15 bp, Homo sapiens
ggtgattttcctgtg

SEQ ID NO: 445535 - DNA, 19 bp, Homo sapiens
gtaaaactcactgaatcta

SEQ ID NO: 445536 - DNA, 15 bp, Homo sapiens
gtaaccaagagtatt

SEQ ID NO: 445537 - DNA, 20 bp, Homo sapiens
gtaaccaagagtattccatt

SEQ ID NO: 445538 - DNA, 18 bp, Homo sapiens
gtacagaatcattgctta

SEQ ID NO: 445539 - DNA, 20 bp, Homo sapiens
gtatccaaaaatagccctgc

SEQ ID NO: 445540 - DNA, 19 bp, Homo sapiens
gtatgaacttgaggacaca

SEQ ID NO: 445541 - DNA, 23 bp, Homo sapiens
gtatgaacttgaggacacatgtc

SEQ ID NO: 445542 - DNA, 19 bp, Homo sapiens
gtcaccggtcagtgccttt

SEQ ID NO: 445543 - DNA, 17 bp, Homo sapiens
gtcatctccaaaaacag

SEQ ID NO: 445544 - DNA, 14 bp, Homo sapiens
gtcctcattcttct

SEQ ID NO: 445545 - DNA, 15 bp, Homo sapiens
gtctctctcacatta

SEQ ID NO: 445546 - DNA, 15 bp, Homo sapiens
gtgaatatatggtct

SEQ ID NO: 445547 - DNA, 17 bp, Homo sapiens
gtgattttcctgtgtcc

SEQ ID NO: 445548 - DNA, 13 bp, Homo sapiens
gtgcactggcccc

SEQ ID NO: 445549 - DNA, 19 bp, Homo sapiens
gtgcataagttaacttcca

SEQ ID NO: 445550 - DNA, 17 bp, Homo sapiens
gtgccccatcagcagct

SEQ ID NO: 445551 - DNA, 14 bp, Homo sapiens
gtgcctgcaccagg

SEQ ID NO: 445552 - DNA, 18 bp, Homo sapiens
gtgcctgcaccaggagac

SEQ ID NO: 445553 - DNA, 20 bp, Homo sapiens
gtgctgggattacaggcgtg

SEQ ID NO: 445554 - DNA, 11 bp, Homo sapiens
gtggacacctg

SEQ ID NO: 445555 - DNA, 12 bp, Homo sapiens
gtggacacctgc

SEQ ID NO: 445556 - DNA, 19 bp, Homo sapiens
gtggacacctgccctgccc

SEQ ID NO: 445557 - DNA, 22 bp, Homo sapiens
gtggagcctccaattgcagtgg

SEQ ID NO: 445558 - DNA, 15 bp, Homo sapiens
gtgtctgatgtttgt

SEQ ID NO: 445559 - DNA, 23 bp, Homo sapiens
gttagcagcagtgagcttctatt

SEQ ID NO: 445560 - DNA, 23 bp, Homo sapiens
gttggacagcaaaaccattgctt

SEQ ID NO: 445561 - DNA, 22 bp, Homo sapiens
gttgtgcttgctggtactaaga

SEQ ID NO: 445562 - DNA, 14 bp, Homo sapiens
gttgtggttaatct

SEQ ID NO: 445563 - DNA, 22 bp, Homo sapiens
gtttcttttttttttttttaca

SEQ ID NO: 445564 - DNA, 14 bp, Homo sapiens
gtttttgctataga

SEQ ID NO: 445565 - DNA, 18 bp, Homo sapiens
taaaaacaaagaaataaa

SEQ ID NO: 445566 - DNA, 15 bp, Homo sapiens
taaaaacattttgaa

SEQ ID NO: 445567 - DNA, 23 bp, Homo sapiens
taaaactcactgaatctaaccat

SEQ ID NO: 445568 - DNA, 16 bp, Homo sapiens
taaaactgctttgtat

SEQ ID NO: 445569 - DNA, 20 bp, Homo sapiens
taaaacttgatgtgttatct

SEQ ID NO: 445570 - DNA, 17 bp, Homo sapiens
taaaagttttaacctca

SEQ ID NO: 445571 - DNA, 16 bp, Homo sapiens
taaaatgaaatgtttt

SEQ ID NO: 445572 - DNA, 15 bp, Homo sapiens
taaacacctgacaca

SEQ ID NO: 445573 - DNA, 16 bp, Homo sapiens
taaacacctgacacat

SEQ ID NO: 445574 - DNA, 21 bp, Homo sapiens
taaaccaaacggaactcttca

SEQ ID NO: 445575 - DNA, 13 bp, Homo sapiens
taaagcagtgttt

SEQ ID NO: 445576 - DNA, 23 bp, Homo sapiens
taaccagtctgaagtttcattta

SEQ ID NO: 445577 - DNA, 17 bp, Homo sapiens
taacctcaggttccaaa

SEQ ID NO: 445578 - DNA, 20 bp, Homo sapiens
taacttcatttttctaataa

SEQ ID NO: 445579 - DNA, 17 bp, Homo sapiens
taacttccaatttacat

SEQ ID NO: 445580 - DNA, 16 bp, Homo sapiens
taagatgtgtcttcaa

SEQ ID NO: 445581 - DNA, 14 bp, Homo sapiens
taagattcatattt

SEQ ID NO: 445582 - DNA, 23 bp, Homo sapiens
taagtcctactttacatatgctt

SEQ ID NO: 445583 - DNA, 17 bp, Homo sapiens
taatgaatgaaacattt

SEQ ID NO: 445584 - DNA, 20 bp, Homo sapiens
taattgacaggattattgga

SEQ ID NO: 445585 - DNA, 17 bp, Homo sapiens
tacaacatttttcagtt

SEQ ID NO: 445586 - DNA, 12 bp, Homo sapiens
tacaaccagagc

SEQ ID NO: 445587 - DNA, 15 bp, Homo sapiens
tacaaccagagcccc

SEQ ID NO: 445588 - DNA, 22 bp, Homo sapiens
tacaaccagagccccccacaat

SEQ ID NO: 445589 - DNA, 15 bp, Homo sapiens
attagtaattgtaag

SEQ ID NO: 445590 - DNA, 23 bp, Homo sapiens
attcaacccatttactttggtca

SEQ ID NO: 445591 - DNA, 13 bp, Homo sapiens
attcagagtcctt

SEQ ID NO: 445592 - DNA, 19 bp, Homo sapiens
attcatatttacttcttat

SEQ ID NO: 445593 - DNA, 16 bp, Homo sapiens
attcccggctggactt

SEQ ID NO: 445594 - DNA, 22 bp, Homo sapiens
attctgtgacatgctaattatt

SEQ ID NO: 445595 - DNA, 18 bp, Homo sapiens
attgatttaacttcattt

SEQ ID NO: 445596 - DNA, 21 bp, Homo sapiens
attgatttaacttcatttttc

SEQ ID NO: 445597 - DNA, 15 bp, Homo sapiens
attgccatttcttcc

SEQ ID NO: 445598 - DNA, 23 bp, Homo sapiens
attgcgaaacaacttgtgttcta

SEQ ID NO: 445599 - DNA, 13 bp, Homo sapiens
atttactcattat

SEQ ID NO: 445600 - DNA, 18 bp, Homo sapiens
atttatgaatattaaaaa

SEQ ID NO: 445601 - DNA, 15 bp, Homo sapiens
atttattttgtttaa

SEQ ID NO: 445602 - DNA, 14 bp, Homo sapiens
atttcctatctgta

SEQ ID NO: 445603 - DNA, 22 bp, Homo sapiens
atttctcatcaattctctatca

SEQ ID NO: 445604 - DNA, 13 bp, Homo sapiens
atttctgaaatga

SEQ ID NO: 445605 - DNA, 12 bp, Homo sapiens
atttcttcccaa

SEQ ID NO: 445606 - DNA, 22 bp, Homo sapiens
attttaaagttaaacattttta

SEQ ID NO: 445607 - DNA, 21 bp, Homo sapiens
attttgtctctctcacattaa

SEQ ID NO: 445608 - DNA, 15 bp, Homo sapiens
caaaaatagccctgc

SEQ ID NO: 445609 - DNA, 16 bp, Homo sapiens
caaaggtgattttcct

SEQ ID NO: 445610 - DNA, 22 bp, Homo sapiens
caaatgagatgtatgcccaaag

SEQ ID NO: 445611 - DNA, 18 bp, Homo sapiens
caaatgatagaaacagac

SEQ ID NO: 445612 - DNA, 22 bp, Homo sapiens
caaattctgcttgcttgctttt

SEQ ID NO: 445613 - DNA, 16 bp, Homo sapiens
caagagtattccattt

SEQ ID NO: 445614 - DNA, 12 bp, Homo sapiens
caagctttcttc

SEQ ID NO: 445615 - DNA, 21 bp, Homo sapiens
caagctttcttctacaaccag

SEQ ID NO: 445616 - DNA, 21 bp, Homo sapiens
caaggccagtctgaacctgag

SEQ ID NO: 445617 - DNA, 20 bp, Homo sapiens
caagtagatgcctgaacttg

SEQ ID NO: 445618 - DNA, 12 bp, Homo sapiens
caataaaacatt

SEQ ID NO: 445619 - DNA, 15 bp, Homo sapiens
caataaagctgctga

SEQ ID NO: 445620 - DNA, 17 bp, Homo sapiens
caataaagctgctgaga

SEQ ID NO: 445621 - DNA, 14 bp, Homo sapiens
caatattcaataaa

SEQ ID NO: 445622 - DNA, 17 bp, Homo sapiens
caatattcaataaagct

SEQ ID NO: 445623 - DNA, 22 bp, Homo sapiens
cacaagtagatgcctgaacttg

SEQ ID NO: 445624 - DNA, 20 bp, Homo sapiens
cacaatgatgattaaacacc

SEQ ID NO: 445625 - DNA, 22 bp, Homo sapiens
cacaatgatgattaaacacctg

SEQ ID NO: 445626 - DNA, 23 bp, Homo sapiens
cacaatgatgattaaacacctga

SEQ ID NO: 445627 - DNA, 19 bp, Homo sapiens
cacaggacgatttcactga

SEQ ID NO: 445628 - DNA, 16 bp, Homo sapiens
cccaccttgccaagct

SEQ ID NO: 445629 - DNA, 21 bp, Homo sapiens
cccagatgcctcctctgtcct

SEQ ID NO: 445630 - DNA, 15 bp, Homo sapiens
cccatccatcagctc

SEQ ID NO: 445631 - DNA, 17 bp, Homo sapiens
cccatccatcagctccc

SEQ ID NO: 445632 - DNA, 22 bp, Homo sapiens
cccatgtcaccggtcagtgcct

SEQ ID NO: 445633 - DNA, 19 bp, Homo sapiens
cccatgtgcctgcaccagg

SEQ ID NO: 445634 - DNA, 21 bp, Homo sapiens
ccccaccctcgtggacacctg

SEQ ID NO: 445635 - DNA, 23 bp, Homo sapiens
ccccatgtgcctgcaccaggaga

SEQ ID NO: 445636 - DNA, 20 bp, Homo sapiens
ccccttagccagttgtatat

SEQ ID NO: 445637 - DNA, 14 bp, Homo sapiens
ccctccctccttcc

SEQ ID NO: 445638 - DNA, 16 bp, Homo sapiens
ccctcgtggacacctg

SEQ ID NO: 445639 - DNA, 17 bp, Homo sapiens
ccctcgtggacacctgc

SEQ ID NO: 445640 - DNA, 19 bp, Homo sapiens
ccctcgtggacacctgccc

SEQ ID NO: 445641 - DNA, 23 bp, Homo sapiens
ccctcgtggacacctgccctgcc

SEQ ID NO: 445642 - DNA, 15 bp, Homo sapiens
ccctgccacctgtct

SEQ ID NO: 445643 - DNA, 13 bp, Homo sapiens
ccctgttcattgt

SEQ ID NO: 445644 - DNA, 11 bp, Homo sapiens
ccgagattgca

SEQ ID NO: 445645 - DNA, 14 bp, Homo sapiens
cctcagaccaactc

SEQ ID NO: 445646 - DNA, 20 bp, Homo sapiens
cctcagaccaactctctcct

SEQ ID NO: 445647 - DNA, 15 bp, Homo sapiens
cctcaggttccaaat

SEQ ID NO: 445648 - DNA, 14 bp, Homo sapiens
cctcattcttctct

SEQ ID NO: 445649 - DNA, 15 bp, Homo sapiens
cctcgtggacacctg

SEQ ID NO: 445650 - DNA, 21 bp, Homo sapiens
cctcgtggacacctgccctgc

SEQ ID NO: 445651 - DNA, 18 bp, Homo sapiens
cctctcaatattcaataa

SEQ ID NO: 445652 - DNA, 20 bp, Homo sapiens
cctctcaatattcaataaag

SEQ ID NO: 445653 - DNA, 22 bp, Homo sapiens
cctctcaatattcaataaagct

SEQ ID NO: 445654 - DNA, 22 bp, Homo sapiens
cctgcaaaaattcagagtcctt

SEQ ID NO: 445655 - DNA, 17 bp, Homo sapiens
cctgccacctgtctgtc

SEQ ID NO: 445656 - DNA, 12 bp, Homo sapiens
cctgccctgcca

SEQ ID NO: 445657 - DNA, 17 bp, Homo sapiens
cctgccctgccacctgt

SEQ ID NO: 445658 - DNA, 21 bp, Homo sapiens
cctgccctgccacctgtctgt

SEQ ID NO: 445659 - DNA, 21 bp, Homo sapiens
cctgctgtcagaccttcttcc

SEQ ID NO: 445660 - DNA, 22 bp, Homo sapiens
cctggactggtggcccctgcct

SEQ ID NO: 445661 - DNA, 20 bp, Homo sapiens
cctgtctgtctgtctgtccc

SEQ ID NO: 445662 - DNA, 16 bp, Homo sapiens
cctgttcattgtaagc

SEQ ID NO: 445663 - DNA, 18 bp, Homo sapiens
ccttagccagttgtatat

SEQ ID NO: 445664 - DNA, 15 bp, Homo sapiens
ccttcttccacagca

SEQ ID NO: 445665 - DNA, 14 bp, Homo sapiens
ccttttctttttcc

SEQ ID NO: 445666 - DNA, 14 bp, Homo sapiens
cctttttgcagtat

SEQ ID NO: 445667 - DNA, 18 bp, Homo sapiens
cgaaacaacttgtgttct

SEQ ID NO: 445668 - DNA, 14 bp, Homo sapiens
cgaggtcaaggaga

SEQ ID NO: 445669 - DNA, 21 bp, Homo sapiens
cgagtgcttccgctgcggtga

SEQ ID NO: 445670 - DNA, 19 bp, Homo sapiens
cgatgggggatgcttcatg

SEQ ID NO: 445671 - DNA, 17 bp, Homo sapiens
cgctttctacactgtat

SEQ ID NO: 445672 - DNA, 20 bp, Homo sapiens
cggccacattcagttcttat

SEQ ID NO: 445673 - DNA, 14 bp, Homo sapiens
cggctttgcagtgc

SEQ ID NO: 445674 - DNA, 17 bp, Homo sapiens
cgggctggcctgtgcct

SEQ ID NO: 445675 - DNA, 23 bp, Homo sapiens
acctgccctgccctgccacctgt

SEQ ID NO: 445676 - DNA, 11 bp, Homo sapiens
acctgtctgtc

SEQ ID NO: 445677 - DNA, 12 bp, Homo sapiens
acctgtctgtct

SEQ ID NO: 445678 - DNA, 19 bp, Homo sapiens
accttgccaagctttcttc

SEQ ID NO: 445679 - DNA, 21 bp, Homo sapiens
accttgccaagctttcttcta

SEQ ID NO: 445680 - DNA, 18 bp, Homo sapiens
accttggtaaattgtaaa

SEQ ID NO: 445681 - DNA, 23 bp, Homo sapiens
accttggttatcaaatacatctc

SEQ ID NO: 445682 - DNA, 19 bp, Homo sapiens
actaaagcagtgttttcac

SEQ ID NO: 445683 - DNA, 18 bp, Homo sapiens
actagatcttacatctgc

SEQ ID NO: 445684 - DNA, 14 bp, Homo sapiens
actgcgaactctca

SEQ ID NO: 445685 - DNA, 18 bp, Homo sapiens
acttatttttttcccaag

SEQ ID NO: 445686 - DNA, 15 bp, Homo sapiens
acttcatttttctaa

SEQ ID NO: 445687 - DNA, 12 bp, Homo sapiens
acttgaggacac

SEQ ID NO: 445688 - DNA, 13 bp, Homo sapiens
acttgaggacaca

SEQ ID NO: 445689 - DNA, 14 bp, Homo sapiens
acttgaggacacat

SEQ ID NO: 445690 - DNA, 17 bp, Homo sapiens
acttgaggacacatgtc

SEQ ID NO: 445691 - DNA, 14 bp, Homo sapiens
actttggaaggagg

SEQ ID NO: 445692 - DNA, 21 bp, Homo sapiens
agaaaagaatccctgttcatt

SEQ ID NO: 445693 - DNA, 20 bp, Homo sapiens
agaaaaggttatcttaaata

SEQ ID NO: 445694 - DNA, 18 bp, Homo sapiens
agaaacattctttcctaa

SEQ ID NO: 445695 - DNA, 18 bp, Homo sapiens
agaacttctcttcccata

SEQ ID NO: 445696 - DNA, 16 bp, Homo sapiens
agaatccctgttcatt

SEQ ID NO: 445697 - DNA, 21 bp, Homo sapiens
agaatcgatgggggatgcttc

SEQ ID NO: 445698 - DNA, 18 bp, Homo sapiens
agaatcggctttgcagtg

SEQ ID NO: 445699 - DNA, 21 bp, Homo sapiens
agaccttcttccacagcaaat

SEQ ID NO: 445700 - DNA, 21 bp, Homo sapiens
agacggtagaattaaagaaga

SEQ ID NO: 445701 - DNA, 21 bp, Homo sapiens
agagaaacattctttcctaaa

SEQ ID NO: 445702 - DNA, 14 bp, Homo sapiens
agagaaggcagcag

SEQ ID NO: 445703 - DNA, 15 bp, Homo sapiens
agagacaataaaaca

SEQ ID NO: 445704 - DNA, 14 bp, Homo sapiens
agagccccccacaa

SEQ ID NO: 445705 - DNA, 15 bp, Homo sapiens
agaggctatttaaaa

SEQ ID NO: 445706 - DNA, 20 bp, Homo sapiens
agagtgagactcgtctcaaa

SEQ ID NO: 445707 - DNA, 14 bp, Homo sapiens
ataagattcatatt

SEQ ID NO: 445708 - DNA, 14 bp, Homo sapiens
ataataaaaagata

SEQ ID NO: 445709 - DNA, 21 bp, Homo sapiens
ataatgtgggaagaaacaaac

SEQ ID NO: 445710 - DNA, 12 bp, Homo sapiens
ataatgttaaca

SEQ ID NO: 445711 - DNA, 16 bp, Homo sapiens
ataattcacacattaa

SEQ ID NO: 445712 - DNA, 13 bp, Homo sapiens
ataatttaacagt

SEQ ID NO: 445713 - DNA, 17 bp, Homo sapiens
atagatttgtattttaa

SEQ ID NO: 445714 - DNA, 22 bp, Homo sapiens
atagttaagcgtgcataagtta

SEQ ID NO: 445715 - DNA, 15 bp, Homo sapiens
atataccttctcaaa

SEQ ID NO: 445716 - DNA, 14 bp, Homo sapiens
atatgcttatacac

SEQ ID NO: 445717 - DNA, 21 bp, Homo sapiens
atatgcttatacacttacact

SEQ ID NO: 445718 - DNA, 18 bp, Homo sapiens
atattaaaaaaagacata

SEQ ID NO: 445719 - DNA, 16 bp, Homo sapiens
atatttgatctaagtt

SEQ ID NO: 445720 - DNA, 15 bp, Homo sapiens
atatttgtcattttc

SEQ ID NO: 445721 - DNA, 16 bp, Homo sapiens
cagtaaggcagctctg

SEQ ID NO: 445722 - DNA, 17 bp, Homo sapiens
cagtgtttgggaaatta

SEQ ID NO: 445723 - DNA, 16 bp, Homo sapiens
cagtttgcaaatagaa

SEQ ID NO: 445724 - DNA, 11 bp, Homo sapiens
catactctgct

SEQ ID NO: 445725 - DNA, 23 bp, Homo sapiens
catataagattcatatttacttc

SEQ ID NO: 445726 - DNA, 13 bp, Homo sapiens
catatgctatgtt

SEQ ID NO: 445727 - DNA, 16 bp, Homo sapiens
catatttacttcttat

SEQ ID NO: 445728 - DNA, 15 bp, Homo sapiens
catccatcagctccc

SEQ ID NO: 445729 - DNA, 13 bp, Homo sapiens
catgactgcattt

SEQ ID NO: 445730 - DNA, 16 bp, Homo sapiens
catgactgcattttac

SEQ ID NO: 445731 - DNA, 17 bp, Homo sapiens
catgcctggacaaaccc

SEQ ID NO: 445732 - DNA, 18 bp, Homo sapiens
catgtaaccaagagtatt

SEQ ID NO: 445733 - DNA, 19 bp, Homo sapiens
catgtcaccggtcagtgcc

SEQ ID NO: 445734 - DNA, 20 bp, Homo sapiens
catgtcaccggtcagtgcct

SEQ ID NO: 445735 - DNA, 20 bp, Homo sapiens
catgtgcctgcaccaggaga

SEQ ID NO: 445736 - DNA, 13 bp, Homo sapiens
cattctttcctaa

SEQ ID NO: 445737 - DNA, 14 bp, Homo sapiens
cattctttcctaaa

SEQ ID NO: 445738 - DNA, 11 bp, Homo sapiens
cattgcttcac

SEQ ID NO: 445739 - DNA, 14 bp, Homo sapiens
catttcttcccaag

SEQ ID NO: 445740 - DNA, 16 bp, Homo sapiens
cattttactgtacaga

SEQ ID NO: 445741 - DNA, 19 bp, Homo sapiens
ccaaacggaactcttcatc

SEQ ID NO: 445742 - DNA, 19 bp, Homo sapiens
aaaaagttgttttatccat

SEQ ID NO: 445743 - DNA, 16 bp, Homo sapiens
aaaaccattgcttcac

SEQ ID NO: 445744 - DNA, 22 bp, Homo sapiens
aaaacttgatgtgttatctctt

SEQ ID NO: 445745 - DNA, 20 bp, Homo sapiens
aaaagaccacagacttctgg

SEQ ID NO: 445746 - DNA, 20 bp, Homo sapiens
aaaatggtgttttcatgtaa

SEQ ID NO: 445747 - DNA, 21 bp, Homo sapiens
aaaatgtagggttataataat

SEQ ID NO: 445748 - DNA, 19 bp, Homo sapiens
aaaattcaacccatttact

SEQ ID NO: 445749 - DNA, 17 bp, Homo sapiens
aaacattctttcctaaa

SEQ ID NO: 445750 - DNA, 17 bp, Homo sapiens
aaacattttgaagtgtg

SEQ ID NO: 445751 - DNA, 20 bp, Homo sapiens
aaagaagagtaaaatggctg

SEQ ID NO: 445752 - DNA, 21 bp, Homo sapiens
aaagaatccctgttcattgta

SEQ ID NO: 445753 - DNA, 22 bp, Homo sapiens
aaagaatccctgttcattgtaa

SEQ ID NO: 445754 - DNA, 22 bp, Homo sapiens
aaagatagtatcttttaaaatg

SEQ ID NO: 445755 - DNA, 18 bp, Homo sapiens
aaagcagtgttttcacct

SEQ ID NO: 445756 - DNA, 15 bp, Homo sapiens
aaatataaatgaaaa

SEQ ID NO: 445757 - DNA, 14 bp, Homo sapiens
aaatataattgaca

SEQ ID NO: 445758 - DNA, 15 bp, Homo sapiens
aaatatatattgtat

SEQ ID NO: 445759 - DNA, 17 bp, Homo sapiens
aaatattttttaaagtc

SEQ ID NO: 445760 - DNA, 18 bp, Homo sapiens
aaatggtgttttcatgta

SEQ ID NO: 445761 - DNA, 19 bp, Homo sapiens
aaatggtgttttcatgtaa

SEQ ID NO: 445762 - DNA, 14 bp, Homo sapiens
aaattagtaattgt

SEQ ID NO: 445763 - DNA, 15 bp, Homo sapiens
aaattagtaattgta

SEQ ID NO: 445764 - DNA, 15 bp, Homo sapiens
aaattcagagtcctt

SEQ ID NO: 445765 - DNA, 10 bp, Homo sapiens
aaattttaaa

SEQ ID NO: 445766 - DNA, 18 bp, Homo sapiens
aacaaagtcaagattccc

SEQ ID NO: 445767 - DNA, 14 bp, Homo sapiens
aacaattttctgca

SEQ ID NO: 445768 - DNA, 23 bp, Homo sapiens
aacacaagtagatgcctgaactt

SEQ ID NO: 445769 - DNA, 20 bp, Homo sapiens
aacacatttaaaattttaaa

SEQ ID NO: 445770 - DNA, 14 bp, Homo sapiens
aacatcaacatctt

SEQ ID NO: 445771 - DNA, 15 bp, Homo sapiens
aacattttgaagtgt

SEQ ID NO: 445772 - DNA, 17 bp, Homo sapiens
aaccagagccccccaca

SEQ ID NO: 445773 - DNA, 13 bp, Homo sapiens
aacccttctttta

SEQ ID NO: 445774 - DNA, 14 bp, Homo sapiens
aacctcaggttcca

SEQ ID NO: 445775 - DNA, 16 bp, Homo sapiens
aacctcaggttccaaa

SEQ ID NO: 445776 - DNA, 21 bp, Homo sapiens
aactcttcatcttaaactaca

SEQ ID NO: 445777 - DNA, 21 bp, Homo sapiens
aactgttctggcctcagacca

SEQ ID NO: 445778 - DNA, 22 bp, Homo sapiens
aacttataattacaatgcacaa

SEQ ID NO: 445779 - DNA, 12 bp, Homo sapiens
aacttcattttt

SEQ ID NO: 445780 - DNA, 12 bp, Homo sapiens
aacttgaggaca

SEQ ID NO: 445781 - DNA, 19 bp, Homo sapiens
aacttgaggacacatgtcc

SEQ ID NO: 445782 - DNA, 13 bp, Homo sapiens
aacttgtgttcta

SEQ ID NO: 445783 - DNA, 15 bp, Homo sapiens
aagaatccctgttca

SEQ ID NO: 445784 - DNA, 15 bp, Homo sapiens
aagagtattccattt

SEQ ID NO: 445785 - DNA, 16 bp, Homo sapiens
aagccaatattttaag

SEQ ID NO: 445786 - DNA, 21 bp, Homo sapiens
aagctgctgagaatctagcct

SEQ ID NO: 445787 - DNA, 15 bp, Homo sapiens
aaggcagctctgtcg

SEQ ID NO: 445788 - DNA, 23 bp, Homo sapiens
aagtctattgtttgttgtgcttg

SEQ ID NO: 445789 - DNA, 11 bp, Homo sapiens
aagtcttcctg

SEQ ID NO: 445790 - DNA, 12 bp, Homo sapiens
aagttaaataaa

SEQ ID NO: 445791 - DNA, 12 bp, Homo sapiens
aagtttcattta

SEQ ID NO: 445792 - DNA, 14 bp, Homo sapiens
aataaagctgctga

SEQ ID NO: 445793 - DNA, 16 bp, Homo sapiens
aataaatacattcttg

SEQ ID NO: 445794 - DNA, 22 bp, Homo sapiens
aataatcataaactatattctg

SEQ ID NO: 445795 - DNA, 21 bp, Homo sapiens
aataatgtgggaagaaacaaa

SEQ ID NO: 445796 - DNA, 19 bp, Homo sapiens
aataatgttaacatggaca

SEQ ID NO: 445797 - DNA, 14 bp, Homo sapiens
aatattcaataaag

SEQ ID NO: 445798 - DNA, 15 bp, Homo sapiens
aatgaaatgtttttg

SEQ ID NO: 445799 - DNA, 16 bp, Homo sapiens
aatgacagaatgctgt

SEQ ID NO: 445800 - DNA, 22 bp, Homo sapiens
aatgactgtctaagagatctgg

SEQ ID NO: 445801 - DNA, 17 bp, Homo sapiens
aatgatgattaaacacc

SEQ ID NO: 445802 - DNA, 18 bp, Homo sapiens
aatgtcagtgtttgggaa

SEQ ID NO: 445803 - DNA, 21 bp, Homo sapiens
aatgtgggaagaaacaaaccc

SEQ ID NO: 445804 - DNA, 17 bp, Homo sapiens
aattagtaattgtcaat

SEQ ID NO: 445805 - DNA, 14 bp, Homo sapiens
aattctactttgag

SEQ ID NO: 445806 - DNA, 15 bp, Homo sapiens
aatttcctatctgta

SEQ ID NO: 445807 - DNA, 21 bp, Homo sapiens
aatttctttctaaaacacatt

SEQ ID NO: 445808 - DNA, 22 bp, Homo sapiens
acaaaatgtagggttataataa

SEQ ID NO: 445809 - DNA, 13 bp, Homo sapiens
acaaccagagccc

SEQ ID NO: 445810 - DNA, 17 bp, Homo sapiens
acaaccagagcccccca

SEQ ID NO: 445811 - DNA, 23 bp, Homo sapiens
acaacttataattacaatgcaca

SEQ ID NO: 445812 - DNA, 20 bp, Homo sapiens
acaaggtcaggagttcgaga

SEQ ID NO: 445813 - DNA, 14 bp, Homo sapiens
acaataaaacattc

SEQ ID NO: 445814 - DNA, 18 bp, Homo sapiens
acacccccacctcctgca

SEQ ID NO: 445815 - DNA, 20 bp, Homo sapiens
acacctcccaccccctgtat

SEQ ID NO: 445816 - DNA, 14 bp, Homo sapiens
acacctgccctgcc

SEQ ID NO: 445817 - DNA, 15 bp, Homo sapiens
acacctgccctgccc

SEQ ID NO: 445818 - DNA, 17 bp, Homo sapiens
acacctgccctgccctg

SEQ ID NO: 445819 - DNA, 18 bp, Homo sapiens
acacctgccctgccctgc

SEQ ID NO: 445820 - DNA, 20 bp, Homo sapiens
acacctgccctgccctgcca

SEQ ID NO: 445821 - DNA, 15 bp, Homo sapiens
acactgcgaactctc

SEQ ID NO: 445822 - DNA, 16 bp, Homo sapiens
acacttacactttatg

SEQ ID NO: 445823 - DNA, 18 bp, Homo sapiens
acacttacactttatgca

SEQ ID NO: 445824 - DNA, 16 bp, Homo sapiens
acagaatcattgctta

SEQ ID NO: 445825 - DNA, 21 bp, Homo sapiens
acagacagatcccatccatca

SEQ ID NO: 445826 - DNA, 22 bp, Homo sapiens
acagatcccatccatcagctcc

SEQ ID NO: 445827 - DNA, 21 bp, Homo sapiens
acagcaaaaccattgcttcac

SEQ ID NO: 445828 - DNA, 16 bp, Homo sapiens
acagcagcctctgaag

SEQ ID NO: 445829 - DNA, 23 bp, Homo sapiens
acataaataaattaaataaaata

SEQ ID NO: 445830 - DNA, 20 bp, Homo sapiens
acatatgctttaagaatcga

SEQ ID NO: 445831 - DNA, 18 bp, Homo sapiens
acatcaacatcttggtca

SEQ ID NO: 445832 - DNA, 14 bp, Homo sapiens
acatctaacaaagt

SEQ ID NO: 445833 - DNA, 21 bp, Homo sapiens
acatctgcagctctttcttct

SEQ ID NO: 445834 - DNA, 19 bp, Homo sapiens
acatcttggtcagatttga

SEQ ID NO: 445835 - DNA, 19 bp, Homo sapiens
acatgatcttctttataat

SEQ ID NO: 445836 - DNA, 13 bp, Homo sapiens
acatgtgcctgta

SEQ ID NO: 445837 - DNA, 12 bp, Homo sapiens
acattaaataat

SEQ ID NO: 445838 - DNA, 19 bp, Homo sapiens
acattctttcctaaatata

SEQ ID NO: 445839 - DNA, 19 bp, Homo sapiens
accaaatgatagaaacaga

SEQ ID NO: 445840 - DNA, 22 bp, Homo sapiens
accaagaattctccaaaacaat

SEQ ID NO: 445841 - DNA, 22 bp, Homo sapiens
accaccttgcactattggactt

SEQ ID NO: 445842 - DNA, 11 bp, Homo sapiens
accagagcccc

SEQ ID NO: 445843 - DNA, 19 bp, Homo sapiens
accagagccccccacaatg

SEQ ID NO: 445844 - DNA, 20 bp, Homo sapiens
accagcctgaccaacatggt

SEQ ID NO: 445845 - DNA, 14 bp, Homo sapiens
accagtctgaagtt

SEQ ID NO: 445846 - DNA, 16 bp, Homo sapiens
accattgcttcactac

SEQ ID NO: 445847 - DNA, 21 bp, Homo sapiens
accattgcttcactacccatc

SEQ ID NO: 445848 - DNA, 19 bp, Homo sapiens
acccaggctggagtgcagt

SEQ ID NO: 445849 - DNA, 18 bp, Homo sapiens
accctcgtggacacctgc

SEQ ID NO: 445850 - DNA, 22 bp, Homo sapiens
accctcgtggacacctgccctg

SEQ ID NO: 445851 - DNA, 23 bp, Homo sapiens
acctcagcctcccaaagtgcagg

SEQ ID NO: 445852 - DNA, 15 bp, Homo sapiens
acctcaggttccaaa

SEQ ID NO: 445853 - DNA, 14 bp, Homo sapiens
acctcatatgctat

SEQ ID NO: 445854 - DNA, 12 bp, Homo sapiens
acctctcaatat

SEQ ID NO: 445855 - DNA, 21 bp, Homo sapiens
acctctcaatattcaataaag

SEQ ID NO: 445856 - DNA, 12 bp, Homo sapiens
acctgccctgcc

SEQ ID NO: 445857 - DNA, 20 bp, Homo sapiens
acctgccctgccctgccacc

SEQ ID NO: 445858 - DNA, 22 bp, Homo sapiens
acctgccctgccctgccacctg

SEQ ID NO: 445859 - DNA, 14 bp, Homo sapiens
gtcatattcttatg

SEQ ID NO: 445860 - DNA, 13 bp, Homo sapiens
gtcattttctctt

SEQ ID NO: 445861 - DNA, 24 bp, Homo sapiens
gtccagtgggaggtgagaccacct

SEQ ID NO: 445862 - DNA, 14 bp, Homo sapiens
gtctgtctgtctgt

SEQ ID NO: 445863 - DNA, 15 bp, Homo sapiens
gtcttcaattaaaag

SEQ ID NO: 445864 - DNA, 13 bp, Homo sapiens
gtctttgataaag

SEQ ID NO: 445865 - DNA, 14 bp, Homo sapiens
gtgagaccacctct

SEQ ID NO: 445866 - DNA, 18 bp, Homo sapiens
gtgattgccatttcttcc

SEQ ID NO: 445867 - DNA, 16 bp, Homo sapiens
gtgcactggccccacc

SEQ ID NO: 445868 - DNA, 14 bp, Homo sapiens
gtgccttttggaac

SEQ ID NO: 445869 - DNA, 14 bp, Homo sapiens
gtggacacctgccc

SEQ ID NO: 445870 - DNA, 18 bp, Homo sapiens
gtggacacctgccctgcc

SEQ ID NO: 445871 - DNA, 15 bp, Homo sapiens
gttcagctgcttctc

SEQ ID NO: 445872 - DNA, 16 bp, Homo sapiens
gttctggcctcagacc

SEQ ID NO: 445873 - DNA, 22 bp, Homo sapiens
gttgctcagcaaggggctctgc

SEQ ID NO: 445874 - DNA, 21 bp, Homo sapiens
gttgtaatgcacacttatttt

SEQ ID NO: 445875 - DNA, 18 bp, Homo sapiens
gtttcatttatgatacaa

SEQ ID NO: 445876 - DNA, 15 bp, Homo sapiens
gttttaacattttta

SEQ ID NO: 445877 - DNA, 21 bp, Homo sapiens
gttttaacctcaggttccaaa

SEQ ID NO: 445878 - DNA, 19 bp, Homo sapiens
gttttcccctctctttgag

SEQ ID NO: 445879 - DNA, 20 bp, Homo sapiens
taaaataaccccgggcaaga

SEQ ID NO: 445880 - DNA, 19 bp, Homo sapiens
taaacccaggaggcggagg

SEQ ID NO: 445881 - DNA, 16 bp, Homo sapiens
taaagcagtgttttca

SEQ ID NO: 445882 - DNA, 18 bp, Homo sapiens
taaagttaaacattttta

SEQ ID NO: 445883 - DNA, 11 bp, Homo sapiens
taaataaaata

SEQ ID NO: 445884 - DNA, 14 bp, Homo sapiens
taaataaaataacc

SEQ ID NO: 445885 - DNA, 12 bp, Homo sapiens
taaataaataca

SEQ ID NO: 445886 - DNA, 22 bp, Homo sapiens
taaatgtacctgagacatatta

SEQ ID NO: 445887 - DNA, 18 bp, Homo sapiens
taaccaatttctttctaa

SEQ ID NO: 445888 - DNA, 21 bp, Homo sapiens
taaccagtctgaagtttcatt

SEQ ID NO: 445889 - DNA, 13 bp, Homo sapiens
taacttcattttt

SEQ ID NO: 445890 - DNA, 21 bp, Homo sapiens
taagagatctggtcaaagcaa

SEQ ID NO: 445891 - DNA, 21 bp, Homo sapiens
taagatatatttgtcattttc

SEQ ID NO: 445892 - DNA, 19 bp, Homo sapiens
taagtatttcagatgcttt

SEQ ID NO: 445893 - DNA, 21 bp, Homo sapiens
taagtatttcagatgctttag

SEQ ID NO: 445894 - DNA, 21 bp, Homo sapiens
taatattgatatgcttataca

SEQ ID NO: 445895 - DNA, 17 bp, Homo sapiens
taatgtgggaagaaaca

SEQ ID NO: 445896 - DNA, 22 bp, Homo sapiens
tacaaaaattagccgggggtgg

SEQ ID NO: 445897 - DNA, 14 bp, Homo sapiens
tacaaccagagccc

SEQ ID NO: 445898 - DNA, 17 bp, Homo sapiens
tacaatatgtatttatg

SEQ ID NO: 445899 - DNA, 16 bp, Homo sapiens
tacacttacactttat

SEQ ID NO: 445900 - DNA, 17 bp, Homo sapiens
tacagaatcattgctta

SEQ ID NO: 445901 - DNA, 21 bp, Homo sapiens
tacatatgctttaagaatcga

SEQ ID NO: 445902 - DNA, 22 bp, Homo sapiens
tacatctgcagctctttcttct

SEQ ID NO: 445903 - DNA, 18 bp, Homo sapiens
tacccatcggtgtccatt

SEQ ID NO: 445904 - DNA, 21 bp, Homo sapiens
tacccatcggtgtccatttat

SEQ ID NO: 445905 - DNA, 18 bp, Homo sapiens
tactgtacagattgctgc

SEQ ID NO: 445906 - DNA, 14 bp, Homo sapiens
tacttcttatacat

SEQ ID NO: 445907 - DNA, 21 bp, Homo sapiens
tagaagtccaggcagagacaa

SEQ ID NO: 445908 - DNA, 23 bp, Homo sapiens
tagaagtccaggcagagacaata

SEQ ID NO: 445909 - DNA, 22 bp, Homo sapiens
tagaataatgtgggaagaaaca

SEQ ID NO: 445910 - DNA, 23 bp, Homo sapiens
tagaataatgtgggaagaaacaa

SEQ ID NO: 445911 - DNA, 21 bp, Homo sapiens
tagttattgttttatgttcta

SEQ ID NO: 445912 - DNA, 16 bp, Homo sapiens
tataaaactgctttgt

SEQ ID NO: 445913 - DNA, 23 bp, Homo sapiens
tataaccccaccttgccaagctt

SEQ ID NO: 445914 - DNA, 19 bp, Homo sapiens
tatccaacatcaacatctt

SEQ ID NO: 445915 - DNA, 18 bp, Homo sapiens
tatgaacttgaggacaca

SEQ ID NO: 445916 - DNA, 21 bp, Homo sapiens
tatgaacttgaggacacatgt

SEQ ID NO: 445917 - DNA, 22 bp, Homo sapiens
tatgcttatacacttacacttt

SEQ ID NO: 445918 - DNA, 14 bp, Homo sapiens
tatgtagattgcct

SEQ ID NO: 445919 - DNA, 22 bp, Homo sapiens
tattaaatgtatatgtcattta

SEQ ID NO: 445920 - DNA, 23 bp, Homo sapiens
tattccatttttactaaagcagt

SEQ ID NO: 445921 - DNA, 21 bp, Homo sapiens
tattgatatgcttatacactt

SEQ ID NO: 445922 - DNA, 22 bp, Homo sapiens
tattggaaatttgttataatga

SEQ ID NO: 445923 - DNA, 17 bp, Homo sapiens
tattgttttatgttcta

SEQ ID NO: 445924 - DNA, 18 bp, Homo sapiens
tatttacttcttatacat

SEQ ID NO: 445925 - DNA, 16 bp, Homo sapiens
tcaaatacatctccag

SEQ ID NO: 445926 - DNA, 16 bp, Homo sapiens
tcaatacccctgttaa

SEQ ID NO: 445927 - DNA, 22 bp, Homo sapiens
tcacaggacgatttcactgaca

SEQ ID NO: 445928 - DNA, 19 bp, Homo sapiens
tcacatgtgccctctgcca

SEQ ID NO: 445929 - DNA, 17 bp, Homo sapiens
tcaccggtcagtgcctt

SEQ ID NO: 445930 - DNA, 13 bp, Homo sapiens
tcactatgcattt

SEQ ID NO: 445931 - DNA, 20 bp, Homo sapiens
tcagcctcccgagtagctgg

SEQ ID NO: 445932 - DNA, 12 bp, Homo sapiens
tcagctgcttct

SEQ ID NO: 445933 - DNA, 18 bp, Homo sapiens
tcatataagattcatatt

SEQ ID NO: 445934 - DNA, 20 bp, Homo sapiens
tccaaaaacagtaaaaataa

SEQ ID NO: 445935 - DNA, 22 bp, Homo sapiens
tccaataaaaacattttgaagt

SEQ ID NO: 445936 - DNA, 17 bp, Homo sapiens
tccaatttacatactct

SEQ ID NO: 445937 - DNA, 18 bp, Homo sapiens
tccacaagttaaataaat

SEQ ID NO: 445938 - DNA, 20 bp, Homo sapiens
tccatgagggtttcattgtg

SEQ ID NO: 445939 - DNA, 18 bp, Homo sapiens
tcccatccatcagctccc

SEQ ID NO: 445940 - DNA, 19 bp, Homo sapiens
tcccatggatgtttcttct

SEQ ID NO: 445941 - DNA, 17 bp, Homo sapiens
tccctcaaagaggcctt

SEQ ID NO: 445942 - DNA, 12 bp, Homo sapiens
tccctgttcatt

SEQ ID NO: 445943 - DNA, 18 bp, Homo sapiens
tcctactttacatatgct

SEQ ID NO: 445944 - DNA, 16 bp, Homo sapiens
tcctgtataatttaac

SEQ ID NO: 445945 - DNA, 19 bp, Homo sapiens
tcgatgggggatgcttcat

SEQ ID NO: 445946 - DNA, 13 bp, Homo sapiens
tcgtggacacctg

SEQ ID NO: 445947 - DNA, 16 bp, Homo sapiens
ttcagctgcttctctt

SEQ ID NO: 445948 - DNA, 16 bp, Homo sapiens
ttcatatttacttctt

SEQ ID NO: 445949 - DNA, 21 bp, Homo sapiens
ttcatatttacttcttataca

SEQ ID NO: 445950 - DNA, 16 bp, Homo sapiens
ttcatgtaaccaagag

SEQ ID NO: 445951 - DNA, 12 bp, Homo sapiens
ttccagcttccc

SEQ ID NO: 445952 - DNA, 21 bp, Homo sapiens
ttccatttttactaaagcagt

SEQ ID NO: 445953 - DNA, 18 bp, Homo sapiens
ttcctaaatataaatgaa

SEQ ID NO: 445954 - DNA, 16 bp, Homo sapiens
ttcctttttgcagtat

SEQ ID NO: 445955 - DNA, 23 bp, Homo sapiens
ttctacaaccagagccccccaca

SEQ ID NO: 445956 - DNA, 20 bp, Homo sapiens
ttctagtgatttcctgtata

SEQ ID NO: 445957 - DNA, 20 bp, Homo sapiens
ttctattaagatatatttgt

SEQ ID NO: 445958 - DNA, 18 bp, Homo sapiens
ttctcaagcactgacact

SEQ ID NO: 445959 - DNA, 17 bp, Homo sapiens
ttctcatagccccggtg

SEQ ID NO: 445960 - DNA, 13 bp, Homo sapiens
ttctctcccacac

SEQ ID NO: 445961 - DNA, 22 bp, Homo sapiens
ttctctcccacacaagcagtct

SEQ ID NO: 445962 - DNA, 22 bp, Homo sapiens
ttctgaaatgacagaatgctgt

SEQ ID NO: 445963 - DNA, 20 bp, Homo sapiens
ttcttctacaaccagagccc

SEQ ID NO: 445964 - DNA, 21 bp, Homo sapiens
ttcttctacaaccagagcccc

SEQ ID NO: 445965 - DNA, 11 bp, Homo sapiens
ttctttcctaa

SEQ ID NO: 445966 - DNA, 16 bp, Homo sapiens
ttgaatttcctatctg

SEQ ID NO: 445967 - DNA, 13 bp, Homo sapiens
ttgaggacacatg

SEQ ID NO: 445968 - DNA, 15 bp, Homo sapiens
ttgaggacacatgtc

SEQ ID NO: 445969 - DNA, 16 bp, Homo sapiens
ttgaggacacatgtcc

SEQ ID NO: 445970 - DNA, 18 bp, Homo sapiens
ttgatttaacttcatttt

SEQ ID NO: 445971 - DNA, 12 bp, Homo sapiens
ttgcagcttcct

SEQ ID NO: 445972 - DNA, 16 bp, Homo sapiens
ttgccatttcttccca

SEQ ID NO: 445973 - DNA, 21 bp, Homo sapiens
ttgctcgcgcggccgtggcct

SEQ ID NO: 445974 - DNA, 21 bp, Homo sapiens
ttgctggagaatgcttggact

SEQ ID NO: 445975 - DNA, 14 bp, Homo sapiens
ttggacagcaaaac

SEQ ID NO: 445976 - DNA, 18 bp, Homo sapiens
ttggacagcaaaaccatt

SEQ ID NO: 445977 - DNA, 22 bp, Homo sapiens
ttggacagcaaaaccattgctt

SEQ ID NO: 445978 - DNA, 22 bp, Homo sapiens
ttgggaaattaaatccaataaa

SEQ ID NO: 445979 - DNA, 23 bp, Homo sapiens
ttgggaaattaaatccaataaaa

SEQ ID NO: 445980 - DNA, 20 bp, Homo sapiens
ttgtacagaatcattgctta

SEQ ID NO: 445981 - DNA, 18 bp, Homo sapiens
ttgtattttaaaacataa

SEQ ID NO: 445982 - DNA, 20 bp, Homo sapiens
ttgttgctcagcaaggggct

SEQ ID NO: 445983 - DNA, 12 bp, Homo sapiens
tttaaagtctat

SEQ ID NO: 445984 - DNA, 22 bp, Homo sapiens
tttaacctcaggttccaaattc

SEQ ID NO: 445985 - DNA, 19 bp, Homo sapiens
tttacttcttatacatttg

SEQ ID NO: 445986 - DNA, 14 bp, Homo sapiens
tttagaaatataat

SEQ ID NO: 445987 - DNA, 16 bp, Homo sapiens
tttagctgtatcaaac

SEQ ID NO: 445988 - DNA, 22 bp, Homo sapiens
tttcactgacactgcgaactct

SEQ ID NO: 445989 - DNA, 17 bp, Homo sapiens
tttcctatctgtatgtc

SEQ ID NO: 445990 - DNA, 21 bp, Homo sapiens
tttcttctacaaccagagccc

SEQ ID NO: 445991 - DNA, 10 bp, Homo sapiens
tttgaagtgt

SEQ ID NO: 445992 - DNA, 18 bp, Homo sapiens
tttgcagtatatttctga

SEQ ID NO: 445993 - DNA, 21 bp, Homo sapiens
ttttaacctcaggttccaaat

SEQ ID NO: 445994 - DNA, 17 bp, Homo sapiens
aagatgtgtcttcaatt

SEQ ID NO: 445995 - DNA, 19 bp, Homo sapiens
aagatgtgtcttcaatttg

SEQ ID NO: 445996 - DNA, 20 bp, Homo sapiens
aagattcccggctggacttt

SEQ ID NO: 445997 - DNA, 13 bp, Homo sapiens
aagcactgacact

SEQ ID NO: 445998 - DNA, 14 bp, Homo sapiens
aagcagtgttttca

SEQ ID NO: 445999 - DNA, 23 bp, Homo sapiens
aagctttcttctacaaccagagc

SEQ ID NO: 446000 - DNA, 13 bp, Homo sapiens
aaggcagcaggcg

SEQ ID NO: 446001 - DNA, 23 bp, Homo sapiens
aaggcatgcctggacaaaccctt

SEQ ID NO: 446002 - DNA, 21 bp, Homo sapiens
aaggtgattttcctgtgtcca

SEQ ID NO: 446003 - DNA, 22 bp, Homo sapiens
aagtattcctttcctgatcact

SEQ ID NO: 446004 - DNA, 20 bp, Homo sapiens
aagtccaggcagagacaata

SEQ ID NO: 446005 - DNA, 12 bp, Homo sapiens
aataaaacattc

SEQ ID NO: 446006 - DNA, 12 bp, Homo sapiens
aataaaataacc

SEQ ID NO: 446007 - DNA, 16 bp, Homo sapiens
aataaatcataaaact

SEQ ID NO: 446008 - DNA, 16 bp, Homo sapiens
aataatgtgggaagaa

SEQ ID NO: 446009 - DNA, 22 bp, Homo sapiens
aatacatctccagtacattccg

SEQ ID NO: 446010 - DNA, 22 bp, Homo sapiens
aatagatcttaggcaaaatacc

SEQ ID NO: 446011 - DNA, 18 bp, Homo sapiens
aatatggcctttcttcta

SEQ ID NO: 446012 - DNA, 17 bp, Homo sapiens
aatattgatatgcttat

SEQ ID NO: 446013 - DNA, 18 bp, Homo sapiens
aatattgatatgcttata

SEQ ID NO: 446014 - DNA, 21 bp, Homo sapiens
aatcgatgggggatgcttcat

SEQ ID NO: 446015 - DNA, 17 bp, Homo sapiens
aatgaaacattttgtca

SEQ ID NO: 446016 - DNA, 16 bp, Homo sapiens
aatgaagttattcttg

SEQ ID NO: 446017 - DNA, 21 bp, Homo sapiens
aatgacagaatgctgttttaa

SEQ ID NO: 446018 - DNA, 18 bp, Homo sapiens
aatgagacttgttttccc

SEQ ID NO: 446019 - DNA, 17 bp, Homo sapiens
aatgtatatgtcattta

SEQ ID NO: 446020 - DNA, 21 bp, Homo sapiens
aatgtattctatctctcttta

SEQ ID NO: 446021 - DNA, 17 bp, Homo sapiens
aattaaataaaataacc

SEQ ID NO: 446022 - DNA, 21 bp, Homo sapiens
aattacaatatgtatttatgt

SEQ ID NO: 446023 - DNA, 17 bp, Homo sapiens
aattgtctaaaatgtca

SEQ ID NO: 446024 - DNA, 18 bp, Homo sapiens
aattgtctaaaatgtcag

SEQ ID NO: 446025 - DNA, 19 bp, Homo sapiens
aattgtctaaaatgtcagt

SEQ ID NO: 446026 - DNA, 15 bp, Homo sapiens
aatttacaacttata

SEQ ID NO: 446027 - DNA, 15 bp, Homo sapiens
aatttacatactctg

SEQ ID NO: 446028 - DNA, 14 bp, Homo sapiens
acaaccagagcccc

SEQ ID NO: 446029 - DNA, 13 bp, Homo sapiens
acaacctaaaaaa

SEQ ID NO: 446030 - DNA, 13 bp, Homo sapiens
acaataaaacatt

SEQ ID NO: 446031 - DNA, 21 bp, Homo sapiens
acaatgatgattaaacacctg

SEQ ID NO: 446032 - DNA, 22 bp, Homo sapiens
acaatgatgattaaacacctga

SEQ ID NO: 446033 - DNA, 13 bp, Homo sapiens
acacattaataaa

SEQ ID NO: 446034 - DNA, 12 bp, Homo sapiens
acacctgacaca

SEQ ID NO: 446035 - DNA, 22 bp, Homo sapiens
acacctgccctgccctgccacc

SEQ ID NO: 446036 - DNA, 16 bp, Homo sapiens
acactgcgaactctca

SEQ ID NO: 446037 - DNA, 16 bp, Homo sapiens
acagaatgctgtttta

SEQ ID NO: 446038 - DNA, 17 bp, Homo sapiens
acagaatgctgttttaa

SEQ ID NO: 446039 - DNA, 13 bp, Homo sapiens
acagattgctgct

SEQ ID NO: 446040 - DNA, 16 bp, Homo sapiens
acagattgctgcttct

SEQ ID NO: 446041 - DNA, 17 bp, Homo sapiens
acagattgctgcttctg

SEQ ID NO: 446042 - DNA, 20 bp, Homo sapiens
acagcaaaaccattgcttca

SEQ ID NO: 446043 - DNA, 22 bp, Homo sapiens
acagcaaaaccattgcttcact

SEQ ID NO: 446044 - DNA, 17 bp, Homo sapiens
acagcagcctctgaagt

SEQ ID NO: 446045 - DNA, 14 bp, Homo sapiens
acaggattattgga

SEQ ID NO: 446046 - DNA, 22 bp, Homo sapiens
acatacttcatcgcagtggact

SEQ ID NO: 446047 - DNA, 23 bp, Homo sapiens
acatacttcatcgcagtggactg

SEQ ID NO: 446048 - DNA, 16 bp, Homo sapiens
acatcaacatcttggt

SEQ ID NO: 446049 - DNA, 15 bp, Homo sapiens
acatgatcttcttta

SEQ ID NO: 446050 - DNA, 17 bp, Homo sapiens
acatgatcttctttata

SEQ ID NO: 446051 - DNA, 19 bp, Homo sapiens
acattaggcattgagactt

SEQ ID NO: 446052 - DNA, 12 bp, Homo sapiens
acattttgaagt

SEQ ID NO: 446053 - DNA, 21 bp, Homo sapiens
accagagccccccacaatgat

SEQ ID NO: 446054 - DNA, 13 bp, Homo sapiens
accattgcttcac

SEQ ID NO: 446055 - DNA, 21 bp, Homo sapiens
acccatcggtgtccatttata

SEQ ID NO: 446056 - DNA, 23 bp, Homo sapiens
acccatgtcaccggtcagtgcct

SEQ ID NO: 446057 - DNA, 18 bp, Homo sapiens
accccaccttgccaagct

SEQ ID NO: 446058 - DNA, 21 bp, Homo sapiens
acccgttttatgatttactca

SEQ ID NO: 446059 - DNA, 15 bp, Homo sapiens
accctcgtggacacc

SEQ ID NO: 446060 - DNA, 17 bp, Homo sapiens
accctcgtggacacctg

SEQ ID NO: 446061 - DNA, 23 bp, Homo sapiens
accctcgtggacacctgccctgc

SEQ ID NO: 446062 - DNA, 22 bp, Homo sapiens
accggtcagtgccttttggaac

SEQ ID NO: 446063 - DNA, 16 bp, Homo sapiens
acctcaggttccaaat

SEQ ID NO: 446064 - DNA, 19 bp, Homo sapiens
acctctcaatattcaataa

SEQ ID NO: 446065 - DNA, 23 bp, Homo sapiens
acctctcaatattcaataaagct

SEQ ID NO: 446066 - DNA, 14 bp, Homo sapiens
acctgacacatctt

SEQ ID NO: 446067 - DNA, 15 bp, Homo sapiens
acctgacacatcttg

SEQ ID NO: 446068 - DNA, 15 bp, Homo sapiens
acctgagacatatta

SEQ ID NO: 446069 - DNA, 21 bp, Homo sapiens
acctgccctgccctgccacct

SEQ ID NO: 446070 - DNA, 21 bp, Homo sapiens
accttctcaaaagattgtttt

SEQ ID NO: 446071 - DNA, 22 bp, Homo sapiens
acgagggatgggatttcatgta

SEQ ID NO: 446072 - DNA, 11 bp, Homo sapiens
acggaactctt

SEQ ID NO: 446073 - DNA, 23 bp, Homo sapiens
acgtgggagttcagctgcttctc

SEQ ID NO: 446074 - DNA, 15 bp, Homo sapiens
actaaagcagtgttt

SEQ ID NO: 446075 - DNA, 18 bp, Homo sapiens
actacagacattaaataa

SEQ ID NO: 446076 - DNA, 20 bp, Homo sapiens
actctatagttattgtttta

SEQ ID NO: 446077 - DNA, 20 bp, Homo sapiens
actgcaacctccacctcccg

SEQ ID NO: 446078 - DNA, 22 bp, Homo sapiens
actgtacagattgctgcttctg

SEQ ID NO: 446079 - DNA, 20 bp, Homo sapiens
actgttctggcctcagacca

SEQ ID NO: 446080 - DNA, 16 bp, Homo sapiens
acttacactttatgca

SEQ ID NO: 446081 - DNA, 18 bp, Homo sapiens
acttgaggacacatgtcc

SEQ ID NO: 446082 - DNA, 19 bp, Homo sapiens
acttgaggacacatgtcca

SEQ ID NO: 446083 - DNA, 19 bp, Homo sapiens
acttttgcagcttccttcc

SEQ ID NO: 446084 - DNA, 12 bp, Homo sapiens
agaaacaaaccc

SEQ ID NO: 446085 - DNA, 22 bp, Homo sapiens
agaaagaaaattagtaattgta

SEQ ID NO: 446086 - DNA, 17 bp, Homo sapiens
agaagaggcagattcaa

SEQ ID NO: 446087 - DNA, 23 bp, Homo sapiens
agaatcccatggatgtttcttct

SEQ ID NO: 446088 - DNA, 19 bp, Homo sapiens
agaattctccaaaacaatt

SEQ ID NO: 446089 - DNA, 12 bp, Homo sapiens
agaccacctctc

SEQ ID NO: 446090 - DNA, 16 bp, Homo sapiens
agagacaataaaacat

SEQ ID NO: 446091 - DNA, 17 bp, Homo sapiens
agagacaataaaacatt

SEQ ID NO: 446092 - DNA, 16 bp, Homo sapiens
agagccccccacaatg

SEQ ID NO: 446093 - DNA, 14 bp, Homo sapiens
agatatatttgtca

SEQ ID NO: 446094 - DNA, 20 bp, Homo sapiens
agatcccatccatcagctcc

SEQ ID NO: 446095 - DNA, 15 bp, Homo sapiens
agatgtatgcccaaa

SEQ ID NO: 446096 - DNA, 19 bp, Homo sapiens
agattcatatttacttctt

SEQ ID NO: 446097 - DNA, 17 bp, Homo sapiens
agattcccggctggact

SEQ ID NO: 446098 - DNA, 20 bp, Homo sapiens
agattcccggctggactttt

SEQ ID NO: 446099 - DNA, 15 bp, Homo sapiens
agattgctgcttctg

SEQ ID NO: 446100 - DNA, 23 bp, Homo sapiens
agattgttttatatgtagtacta

SEQ ID NO: 446101 - DNA, 19 bp, Homo sapiens
agcaaatgagatgtatgcc

SEQ ID NO: 446102 - DNA, 21 bp, Homo sapiens
agcagagaattctcttatcca

SEQ ID NO: 446103 - DNA, 12 bp, Homo sapiens
agcagcctctga

SEQ ID NO: 446104 - DNA, 13 bp, Homo sapiens
agccaatatttta

SEQ ID NO: 446105 - DNA, 21 bp, Homo sapiens
agccactgcgcccggccacat

SEQ ID NO: 446106 - DNA, 19 bp, Homo sapiens
agccagtaaggcagctctg

SEQ ID NO: 446107 - DNA, 20 bp, Homo sapiens
agccagtaaggcagctctgt

SEQ ID NO: 446108 - DNA, 16 bp, Homo sapiens
agccccccacaatgat

SEQ ID NO: 446109 - DNA, 20 bp, Homo sapiens
agcctctgaagttggacagc

SEQ ID NO: 446110 - DNA, 22 bp, Homo sapiens
agctatttctcatcaattctct

SEQ ID NO: 446111 - DNA, 15 bp, Homo sapiens
agctctttcttcttt

SEQ ID NO: 446112 - DNA, 11 bp, Homo sapiens
agctgtatcaa

SEQ ID NO: 446113 - DNA, 17 bp, Homo sapiens
agcttctattaaatgta

SEQ ID NO: 446114 - DNA, 17 bp, Homo sapiens
agctttcttctacaacc

SEQ ID NO: 446115 - DNA, 21 bp, Homo sapiens
agctttcttctacaaccagag

SEQ ID NO: 446116 - DNA, 11 bp, Homo sapiens
aggacacatgt

SEQ ID NO: 446117 - DNA, 13 bp, Homo sapiens
aggacacatgtcc

SEQ ID NO: 446118 - DNA, 20 bp, Homo sapiens
aggacgatttcactgacact

SEQ ID NO: 446119 - DNA, 16 bp, Homo sapiens
gcagtggactgtgtcc

SEQ ID NO: 446120 - DNA, 17 bp, Homo sapiens
gcagtggactgtgtccc

SEQ ID NO: 446121 - DNA, 14 bp, Homo sapiens
gcatgcctggacaa

SEQ ID NO: 446122 - DNA, 16 bp, Homo sapiens
gccacagcagcctctg

SEQ ID NO: 446123 - DNA, 17 bp, Homo sapiens
gccacagcagcctctga

SEQ ID NO: 446124 - DNA, 20 bp, Homo sapiens
gccacagcagcctctgaagt

SEQ ID NO: 446125 - DNA, 12 bp, Homo sapiens
gccacctgtctg

SEQ ID NO: 446126 - DNA, 15 bp, Homo sapiens
gccacctgtctgtct

SEQ ID NO: 446127 - DNA, 20 bp, Homo sapiens
gccccaccctcgtggacacc

SEQ ID NO: 446128 - DNA, 21 bp, Homo sapiens
gccccaccctcgtggacacct

SEQ ID NO: 446129 - DNA, 23 bp, Homo sapiens
gccccaccctcgtggacacctgc

SEQ ID NO: 446130 - DNA, 19 bp, Homo sapiens
gcccggaagttgctgtgcc

SEQ ID NO: 446131 - DNA, 18 bp, Homo sapiens
gccctgccacctgtctgt

SEQ ID NO: 446132 - DNA, 13 bp, Homo sapiens
gccctgccctgcc

SEQ ID NO: 446133 - DNA, 19 bp, Homo sapiens
gcctctgaagttggacagc

SEQ ID NO: 446134 - DNA, 12 bp, Homo sapiens
gcctgcaccagg

SEQ ID NO: 446135 - DNA, 22 bp, Homo sapiens
gcgaaacaacttgtgttctatt

SEQ ID NO: 446136 - DNA, 20 bp, Homo sapiens
gcggcctttgttgctcagca

SEQ ID NO: 446137 - DNA, 20 bp, Homo sapiens
gctctgccctccctccttcc

SEQ ID NO: 446138 - DNA, 20 bp, Homo sapiens
gctctgtcgtggtagcagat

SEQ ID NO: 446139 - DNA, 23 bp, Homo sapiens
gctctgtgggttttaacattttt

SEQ ID NO: 446140 - DNA, 20 bp, Homo sapiens
gctgcccctggtgcactggc

SEQ ID NO: 446141 - DNA, 21 bp, Homo sapiens
gctggacttttgcagcttcct

SEQ ID NO: 446142 - DNA, 14 bp, Homo sapiens
gctggagtgcagta

SEQ ID NO: 446143 - DNA, 15 bp, Homo sapiens
gctggagtgcagtgg

SEQ ID NO: 446144 - DNA, 19 bp, Homo sapiens
gctgtcagaccttcttcca

SEQ ID NO: 446145 - DNA, 20 bp, Homo sapiens
gctgtgccccatcagcagct

SEQ ID NO: 446146 - DNA, 22 bp, Homo sapiens
gctgtgccccatcagcagcttg

SEQ ID NO: 446147 - DNA, 12 bp, Homo sapiens
gcttatacactt

SEQ ID NO: 446148 - DNA, 18 bp, Homo sapiens
gcttctattaaatgtata

SEQ ID NO: 446149 - DNA, 18 bp, Homo sapiens
gctttcttctacaaccag

SEQ ID NO: 446150 - DNA, 20 bp, Homo sapiens
gctttcttctacaaccagag

SEQ ID NO: 446151 - DNA, 21 bp, Homo sapiens
gctttcttctacaaccagagc

SEQ ID NO: 446152 - DNA, 23 bp, Homo sapiens
gctttcttctacaaccagagccc

SEQ ID NO: 446153 - DNA, 20 bp, Homo sapiens
ggaaattaaatccaataaaa

SEQ ID NO: 446154 - DNA, 17 bp, Homo sapiens
ggaagttgctgtgcccc

SEQ ID NO: 446155 - DNA, 12 bp, Homo sapiens
ggacacatgtcc

SEQ ID NO: 446156 - DNA, 13 bp, Homo sapiens
ggacacatgtcca

SEQ ID NO: 446157 - DNA, 19 bp, Homo sapiens
ggacacatgtccagtggga

SEQ ID NO: 446158 - DNA, 15 bp, Homo sapiens
ggacagcaaaaccat

SEQ ID NO: 446159 - DNA, 19 bp, Homo sapiens
ggacttttgcagcttcctt

SEQ ID NO: 446160 - DNA, 13 bp, Homo sapiens
ggatgctcagtga

SEQ ID NO: 446161 - DNA, 22 bp, Homo sapiens
ggatgcttcatgtgaacgtggg

SEQ ID NO: 446162 - DNA, 13 bp, Homo sapiens
ggatgtttcttct

SEQ ID NO: 446163 - DNA, 16 bp, Homo sapiens
ggcaattcttcttctc

SEQ ID NO: 446164 - DNA, 13 bp, Homo sapiens
ggcaccagcagca

SEQ ID NO: 446165 - DNA, 23 bp, Homo sapiens
ggccccaccctcgtggacacctg

SEQ ID NO: 446166 - DNA, 18 bp, Homo sapiens
ggcccggaagttgctgtg

SEQ ID NO: 446167 - DNA, 12 bp, Homo sapiens
ggcctcagacca

SEQ ID NO: 446168 - DNA, 21 bp, Homo sapiens
ggcggaggttgcagtgagccg

SEQ ID NO: 446169 - DNA, 19 bp, Homo sapiens
ggcggtcctactgctgtga

SEQ ID NO: 446170 - DNA, 13 bp, Homo sapiens
ggctatttaaaag

SEQ ID NO: 446171 - DNA, 22 bp, Homo sapiens
ggctatttaaaagtataaaact

SEQ ID NO: 446172 - DNA, 18 bp, Homo sapiens
gggaggtgagaccacctc

SEQ ID NO: 446173 - DNA, 21 bp, Homo sapiens
ggggagccttctgtgctgtga

SEQ ID NO: 446174 - DNA, 23 bp, Homo sapiens
ggggagccttctgtgctgtgagt

SEQ ID NO: 446175 - DNA, 20 bp, Homo sapiens
gggtttcaccgtgttagcca

SEQ ID NO: 446176 - DNA, 17 bp, Homo sapiens
ggtaaaaactgcagtgt

SEQ ID NO: 446177 - DNA, 16 bp, Homo sapiens
ggtatgaacttgagga

SEQ ID NO: 446178 - DNA, 21 bp, Homo sapiens
ggtatgaacttgaggacacat

SEQ ID NO: 446179 - DNA, 23 bp, Homo sapiens
ggtatgaacttgaggacacatgt

SEQ ID NO: 446180 - DNA, 18 bp, Homo sapiens
ggtattgcgaaacaactt

SEQ ID NO: 446181 - DNA, 13 bp, Homo sapiens
ggtcagtgccttt

SEQ ID NO: 446182 - DNA, 17 bp, Homo sapiens
ggtgacatgtgcctgta

SEQ ID NO: 446183 - DNA, 18 bp, Homo sapiens
ggtgattttcctgtgtcc

SEQ ID NO: 446184 - DNA, 16 bp, Homo sapiens
ggtggcagagtgagac

SEQ ID NO: 446185 - DNA, 17 bp, Homo sapiens
gtaaggcagctctgtcg

SEQ ID NO: 446186 - DNA, 21 bp, Homo sapiens
gtacagaatcattgcttatga

SEQ ID NO: 446187 - DNA, 22 bp, Homo sapiens
gtagctctaggagggctggcaa

SEQ ID NO: 446188 - DNA, 22 bp, Homo sapiens
gtaggtgagcgctttgcagtca

SEQ ID NO: 446189 - DNA, 20 bp, Homo sapiens
gtataaccccaccttgccaa

SEQ ID NO: 446190 - DNA, 12 bp, Homo sapiens
gtatctgagcag

SEQ ID NO: 446191 - DNA, 16 bp, Homo sapiens
gtatgaacttgaggac

SEQ ID NO: 446192 - DNA, 22 bp, Homo sapiens
gtatgaacttgaggacacatgt

SEQ ID NO: 446193 - DNA, 23 bp, Homo sapiens
gtattgcgaaacaacttgtgttc

SEQ ID NO: 446194 - DNA, 16 bp, Homo sapiens
gtatttcagatgcttt

SEQ ID NO: 446195 - DNA, 19 bp, Homo sapiens
gtatttttagtagagacag

SEQ ID NO: 446196 - DNA, 22 bp, Homo sapiens
gtcacaggacgatttcactgac

SEQ ID NO: 446197 - DNA, 15 bp, Homo sapiens
gtcagccctgctgtc

SEQ ID NO: 446198 - DNA, 21 bp, Homo sapiens
gtcatataagattcatattta

SEQ ID NO: 446199 - DNA, 16 bp, Homo sapiens
gtccacatctaacaaa

SEQ ID NO: 446200 - DNA, 21 bp, Homo sapiens
gtcctactttacatatgcttt

SEQ ID NO: 446201 - DNA, 22 bp, Homo sapiens
gtccttccctcaaagaggcctt

SEQ ID NO: 446202 - DNA, 20 bp, Homo sapiens
gtcgcccaggctggagtgca

SEQ ID NO: 446203 - DNA, 18 bp, Homo sapiens
gtctccccatgtgcctgc

SEQ ID NO: 446204 - DNA, 16 bp, Homo sapiens
gtctgtctgtctgtcc

SEQ ID NO: 446205 - DNA, 14 bp, Homo sapiens
gtctgtgattgcca

SEQ ID NO: 446206 - DNA, 17 bp, Homo sapiens
gtgaaaccctgtctcta

SEQ ID NO: 446207 - DNA, 20 bp, Homo sapiens
gtgagaccacctctcaatat

SEQ ID NO: 446208 - DNA, 22 bp, Homo sapiens
gtgattgccatttcttcccaag

SEQ ID NO: 446209 - DNA, 17 bp, Homo sapiens
gtgcactggccccaccc

SEQ ID NO: 446210 - DNA, 18 bp, Homo sapiens
gtgcactggccccaccct

SEQ ID NO: 446211 - DNA, 17 bp, Homo sapiens
gtgcagaaactaccaga

SEQ ID NO: 446212 - DNA, 15 bp, Homo sapiens
gtgcctgcaccagga

SEQ ID NO: 446213 - DNA, 16 bp, Homo sapiens
gtggacacctgccctg

SEQ ID NO: 446214 - DNA, 17 bp, Homo sapiens
gtggacacctgccctgc

SEQ ID NO: 446215 - DNA, 14 bp, Homo sapiens
gtggacctgaagga

SEQ ID NO: 446216 - DNA, 13 bp, Homo sapiens
gtggactgtgtcc

SEQ ID NO: 446217 - DNA, 21 bp, Homo sapiens
gtggtcttgccttctgatttt

SEQ ID NO: 446218 - DNA, 14 bp, Homo sapiens
gtggtgtgcagtgg

SEQ ID NO: 446219 - DNA, 14 bp, Homo sapiens
gtgttctattaatc

SEQ ID NO: 446220 - DNA, 21 bp, Homo sapiens
gttgctgtgccccatcagcag

SEQ ID NO: 446221 - DNA, 13 bp, Homo sapiens
gttggacagtagt

SEQ ID NO: 446222 - DNA, 16 bp, Homo sapiens
gttttcatgtaaataa

SEQ ID NO: 446223 - DNA, 14 bp, Homo sapiens
taaaactatttatg

SEQ ID NO: 446224 - DNA, 22 bp, Homo sapiens
taaaacttgatgtgttatctct

SEQ ID NO: 446225 - DNA, 11 bp, Homo sapiens
taaacacctga

SEQ ID NO: 446226 - DNA, 18 bp, Homo sapiens
taaacacctgacacatct

SEQ ID NO: 446227 - DNA, 18 bp, Homo sapiens
taaagtctattgtttgtt

SEQ ID NO: 446228 - DNA, 16 bp, Homo sapiens
taaattaaataaaata

SEQ ID NO: 446229 - DNA, 18 bp, Homo sapiens
taacatggacatgatctt

SEQ ID NO: 446230 - DNA, 23 bp, Homo sapiens
taacatggacatgatcttcttta

SEQ ID NO: 446231 - DNA, 14 bp, Homo sapiens
taacttcatttttc

SEQ ID NO: 446232 - DNA, 22 bp, Homo sapiens
taagaggctatttaaaagtata

SEQ ID NO: 446233 - DNA, 18 bp, Homo sapiens
taatgtgggaagaaacaa

SEQ ID NO: 446234 - DNA, 22 bp, Homo sapiens
taattgacaggattattggaaa

SEQ ID NO: 446235 - DNA, 16 bp, Homo sapiens
tacaaaagaagatgaa

SEQ ID NO: 446236 - DNA, 16 bp, Homo sapiens
tacaaccagagccccc

SEQ ID NO: 446237 - DNA, 21 bp, Homo sapiens
tacaaccagagccccccacaa

SEQ ID NO: 446238 - DNA, 17 bp, Homo sapiens
tacacacgtttgtttct

SEQ ID NO: 446239 - DNA, 13 bp, Homo sapiens
tacagaagcagga

SEQ ID NO: 446240 - DNA, 11 bp, Homo sapiens
tacagaatcat

SEQ ID NO: 446241 - DNA, 16 bp, Homo sapiens
tacagaatcattgctt

SEQ ID NO: 446242 - DNA, 18 bp, Homo sapiens
tacagaatcattgcttat

SEQ ID NO: 446243 - DNA, 17 bp, Homo sapiens
tacagattgctgcttct

SEQ ID NO: 446244 - DNA, 21 bp, Homo sapiens
aaaaattcagagtccttgcaa

SEQ ID NO: 446245 - DNA, 15 bp, Homo sapiens
aaaacattttgaagt

SEQ ID NO: 446246 - DNA, 23 bp, Homo sapiens
aaaatggtgttttcatgtaaata

SEQ ID NO: 446247 - DNA, 12 bp, Homo sapiens
aaaattagtaat

SEQ ID NO: 446248 - DNA, 20 bp, Homo sapiens
aaaattgtctaaaatgtcag

SEQ ID NO: 446249 - DNA, 19 bp, Homo sapiens
aaaatttagaaatataatt

SEQ ID NO: 446250 - DNA, 12 bp, Homo sapiens
aaacaacttgtg

SEQ ID NO: 446251 - DNA, 12 bp, Homo sapiens
aaacacctgaca

SEQ ID NO: 446252 - DNA, 14 bp, Homo sapiens
aaacacctgacaca

SEQ ID NO: 446253 - DNA, 19 bp, Homo sapiens
aaacattttgtcatataag

SEQ ID NO: 446254 - DNA, 13 bp, Homo sapiens
aaaccattgcttc

SEQ ID NO: 446255 - DNA, 21 bp, Homo sapiens
aaacccgttttatgatttact

SEQ ID NO: 446256 - DNA, 21 bp, Homo sapiens
aaacctcagtcatattcttat

SEQ ID NO: 446257 - DNA, 22 bp, Homo sapiens
aaacttgatgtgttatctctta

SEQ ID NO: 446258 - DNA, 11 bp, Homo sapiens
aaagcagtgtt

SEQ ID NO: 446259 - DNA, 14 bp, Homo sapiens
aaagcagtgttttc

SEQ ID NO: 446260 - DNA, 21 bp, Homo sapiens
aaatagccctgcaaaaattca

SEQ ID NO: 446261 - DNA, 20 bp, Homo sapiens
aaatgagatgtatgcccaaa

SEQ ID NO: 446262 - DNA, 17 bp, Homo sapiens
aaatggaagtggcaata

SEQ ID NO: 446263 - DNA, 18 bp, Homo sapiens
aaattgtctaaaatgtca

SEQ ID NO: 446264 - DNA, 17 bp, Homo sapiens
aacacctgacacatctt

SEQ ID NO: 446265 - DNA, 20 bp, Homo sapiens
aacattctttcctaaatata

SEQ ID NO: 446266 - DNA, 16 bp, Homo sapiens
aacattttgtcatata

SEQ ID NO: 446267 - DNA, 10 bp, Homo sapiens
aaccagagcc

SEQ ID NO: 446268 - DNA, 15 bp, Homo sapiens
aaccagtctgaagtt

SEQ ID NO: 446269 - DNA, 13 bp, Homo sapiens
aaccattgcttca

SEQ ID NO: 446270 - DNA, 23 bp, Homo sapiens
aaccattgcttcactacccatcg

SEQ ID NO: 446271 - DNA, 14 bp, Homo sapiens
aacccttcttttaa

SEQ ID NO: 446272 - DNA, 14 bp, Homo sapiens
aacggaactcttca

SEQ ID NO: 446273 - DNA, 13 bp, Homo sapiens
aactctcaggact

SEQ ID NO: 446274 - DNA, 14 bp, Homo sapiens
aacttataattaca

SEQ ID NO: 446275 - DNA, 14 bp, Homo sapiens
aacttgaggacaca

SEQ ID NO: 446276 - DNA, 15 bp, Homo sapiens
aacttgaggacacat

SEQ ID NO: 446277 - DNA, 17 bp, Homo sapiens
aacttgaggacacatgt

SEQ ID NO: 446278 - DNA, 18 bp, Homo sapiens
aacttgaggacacatgtc

SEQ ID NO: 446279 - DNA, 20 bp, Homo sapiens
aagaaaagaatccctgttca

SEQ ID NO: 446280 - DNA, 16 bp, Homo sapiens
aagaaacaaacccgtt

SEQ ID NO: 446281 - DNA, 20 bp, Homo sapiens
aagaattctccaaaacaatt

SEQ ID NO: 446282 - DNA, 14 bp, Homo sapiens
aagagtattccatt

SEQ ID NO: 446283 - DNA, 20 bp, Homo sapiens
aagatatatttgtcattttc

SEQ ID NO: 446284 - DNA, 20 bp, Homo sapiens
aagattcatatttacttctt

SEQ ID NO: 446285 - DNA, 21 bp, Homo sapiens
aaggcatgcctggacaaaccc

SEQ ID NO: 446286 - DNA, 13 bp, Homo sapiens
aagtaaaaaatat

SEQ ID NO: 446287 - DNA, 15 bp, Homo sapiens
aagttttaacctcag

SEQ ID NO: 446288 - DNA, 20 bp, Homo sapiens
aataaaaacattttgaagtg

SEQ ID NO: 446289 - DNA, 14 bp, Homo sapiens
aataaaatcctgct

SEQ ID NO: 446290 - DNA, 21 bp, Homo sapiens
aataaattaaataaaataacc

SEQ ID NO: 446291 - DNA, 20 bp, Homo sapiens
aatcataaactatattctgt

SEQ ID NO: 446292 - DNA, 13 bp, Homo sapiens
aatccacacatca

SEQ ID NO: 446293 - DNA, 17 bp, Homo sapiens
aatccctgttcattgta

SEQ ID NO: 446294 - DNA, 20 bp, Homo sapiens
aatcgatgggggatgcttca

SEQ ID NO: 446295 - DNA, 14 bp, Homo sapiens
aatgacagaatgct

SEQ ID NO: 446296 - DNA, 15 bp, Homo sapiens
aatgatgattaaaca

SEQ ID NO: 446297 - DNA, 12 bp, Homo sapiens
aatgtcagtgtt

SEQ ID NO: 446298 - DNA, 22 bp, Homo sapiens
aattaaaaaaatatatattgta

SEQ ID NO: 446299 - DNA, 17 bp, Homo sapiens
aattaaatccaataaaa

SEQ ID NO: 446300 - DNA, 19 bp, Homo sapiens
aattaagaggatacacacg

SEQ ID NO: 446301 - DNA, 15 bp, Homo sapiens
aattctcttatccaa

SEQ ID NO: 446302 - DNA, 14 bp, Homo sapiens
aatttataattaca

SEQ ID NO: 446303 - DNA, 16 bp, Homo sapiens
aatttcctatctgtat

SEQ ID NO: 446304 - DNA, 20 bp, Homo sapiens
acaaaatgtagggttataat

SEQ ID NO: 446305 - DNA, 19 bp, Homo sapiens
acaaaggtgattttcctgt

SEQ ID NO: 446306 - DNA, 16 bp, Homo sapiens
acaacttgtgttctat

SEQ ID NO: 446307 - DNA, 20 bp, Homo sapiens
acaagtagatgcctgaactt

SEQ ID NO: 446308 - DNA, 12 bp, Homo sapiens
acaataaaacat

SEQ ID NO: 446309 - DNA, 19 bp, Homo sapiens
acaatgatgattaaacacc

SEQ ID NO: 446310 - DNA, 15 bp, Homo sapiens
acacattaataaaca

SEQ ID NO: 446311 - DNA, 12 bp, Homo sapiens
acacctgccctg

SEQ ID NO: 446312 - DNA, 13 bp, Homo sapiens
acacctgccctgc

SEQ ID NO: 446313 - DNA, 21 bp, Homo sapiens
acacttacactttatgcacaa

SEQ ID NO: 446314 - DNA, 16 bp, Homo sapiens
acagagaaggcagcag

SEQ ID NO: 446315 - DNA, 23 bp, Homo sapiens
acagatcccatccatcagctccc

SEQ ID NO: 446316 - DNA, 18 bp, Homo sapiens
acagcagcctctgaagtt

SEQ ID NO: 446317 - DNA, 21 bp, Homo sapiens
acagctgtgctgtaacacaag

SEQ ID NO: 446318 - DNA, 21 bp, Homo sapiens
acatgtccagtgggaggtgag

SEQ ID NO: 446319 - DNA, 14 bp, Homo sapiens
acattaataaacaa

SEQ ID NO: 446320 - DNA, 15 bp, Homo sapiens
acattctttcctaaa

SEQ ID NO: 446321 - DNA, 13 bp, Homo sapiens
acattttgaagtg

SEQ ID NO: 446322 - DNA, 16 bp, Homo sapiens
accaaacggaactctt

SEQ ID NO: 446323 - DNA, 20 bp, Homo sapiens
accaaatgatagaaacagac

SEQ ID NO: 446324 - DNA, 16 bp, Homo sapiens
accaatttctttctaa

SEQ ID NO: 446325 - DNA, 20 bp, Homo sapiens
accaatttctttctaaaaca

SEQ ID NO: 446326 - DNA, 23 bp, Homo sapiens
accacctctcaatattcaataaa

SEQ ID NO: 446327 - DNA, 10 bp, Homo sapiens
accagagccc

SEQ ID NO: 446328 - DNA, 15 bp, Homo sapiens
accagagccccccac

SEQ ID NO: 446329 - DNA, 11 bp, Homo sapiens
accaggagaca

SEQ ID NO: 446330 - DNA, 12 bp, Homo sapiens
accaggagacag

SEQ ID NO: 446331 - DNA, 13 bp, Homo sapiens
accagtctgaagt

SEQ ID NO: 446332 - DNA, 19 bp, Homo sapiens
accagtctgaagtttcatt

SEQ ID NO: 446333 - DNA, 15 bp, Homo sapiens
accattgcttcacta

SEQ ID NO: 446334 - DNA, 20 bp, Homo sapiens
accattgcttcactacccat

SEQ ID NO: 446335 - DNA, 15 bp, Homo sapiens
acccaataattctgt

SEQ ID NO: 446336 - DNA, 22 bp, Homo sapiens
acccaattaagtcctactttac

SEQ ID NO: 446337 - DNA, 19 bp, Homo sapiens
acccatcggtgtccattta

SEQ ID NO: 446338 - DNA, 12 bp, Homo sapiens
acccatgtcacc

SEQ ID NO: 446339 - DNA, 21 bp, Homo sapiens
acccctgttaagcaattcctt

SEQ ID NO: 446340 - DNA, 14 bp, Homo sapiens
acccgttttatgat

SEQ ID NO: 446341 - DNA, 22 bp, Homo sapiens
acccgttttatgatttactcat

SEQ ID NO: 446342 - DNA, 16 bp, Homo sapiens
acctcctgcaataaaa

SEQ ID NO: 446343 - DNA, 16 bp, Homo sapiens
acctgccctgccctgc

SEQ ID NO: 446344 - DNA, 18 bp, Homo sapiens
acctgccctgccctgcca

SEQ ID NO: 446345 - DNA, 14 bp, Homo sapiens
acctgtctgtctgt

SEQ ID NO: 446346 - DNA, 18 bp, Homo sapiens
acctgtctgtctgtctgt

SEQ ID NO: 446347 - DNA, 20 bp, Homo sapiens
acctgtctgtctgtctgtcc

SEQ ID NO: 446348 - DNA, 22 bp, Homo sapiens
accttctcaaaagattgtttta

SEQ ID NO: 446349 - DNA, 20 bp, Homo sapiens
accttggttatcaaatacat

SEQ ID NO: 446350 - DNA, 17 bp, Homo sapiens
acgatttcactgacact

SEQ ID NO: 446351 - DNA, 21 bp, Homo sapiens
acgtgggagttcagctgcttc

SEQ ID NO: 446352 - DNA, 11 bp, Homo sapiens
actaaagcagt

SEQ ID NO: 446353 - DNA, 12 bp, Homo sapiens
actaaagcagtg

SEQ ID NO: 446354 - DNA, 14 bp, Homo sapiens
actaaagcagtgtt

SEQ ID NO: 446355 - DNA, 18 bp, Homo sapiens
actaagaggctatttaaa

SEQ ID NO: 446356 - DNA, 20 bp, Homo sapiens
actacccatcggtgtccatt

SEQ ID NO: 446357 - DNA, 13 bp, Homo sapiens
actataacaaaat

SEQ ID NO: 446358 - DNA, 22 bp, Homo sapiens
actcggtcaaaatattttttaa

SEQ ID NO: 446359 - DNA, 13 bp, Homo sapiens
actggccccaccc

SEQ ID NO: 446360 - DNA, 21 bp, Homo sapiens
actgtacagattgctgcttct

SEQ ID NO: 446361 - DNA, 20 bp, Homo sapiens
attcatatttacttcttata

SEQ ID NO: 446362 - DNA, 22 bp, Homo sapiens
attccatttttactaaagcagt

SEQ ID NO: 446363 - DNA, 16 bp, Homo sapiens
attgttttatgttcta

SEQ ID NO: 446364 - DNA, 15 bp, Homo sapiens
atttagaaatataat

SEQ ID NO: 446365 - DNA, 14 bp, Homo sapiens
atttcagatgcttt

SEQ ID NO: 446366 - DNA, 11 bp, Homo sapiens
atttgtatttt

SEQ ID NO: 446367 - DNA, 14 bp, Homo sapiens
atttgtattttaaa

SEQ ID NO: 446368 - DNA, 14 bp, Homo sapiens
attttcctgtgtcc

SEQ ID NO: 446369 - DNA, 17 bp, Homo sapiens
attttcctgtgtccaca

SEQ ID NO: 446370 - DNA, 17 bp, Homo sapiens
atttttactaaagcagt

SEQ ID NO: 446371 - DNA, 21 bp, Homo sapiens
atttttactaaagcagtgttt

SEQ ID NO: 446372 - DNA, 22 bp, Homo sapiens
atttttttcccaaggagtaacc

SEQ ID NO: 446373 - DNA, 13 bp, Homo sapiens
caaagaaataaaa

SEQ ID NO: 446374 - DNA, 16 bp, Homo sapiens
caaagcttgttaagat

SEQ ID NO: 446375 - DNA, 19 bp, Homo sapiens
caaagtgctgggattacag

SEQ ID NO: 446376 - DNA, 21 bp, Homo sapiens
caaatgagatgtatgcccaaa

SEQ ID NO: 446377 - DNA, 15 bp, Homo sapiens
caacatttttcagtt

SEQ ID NO: 446378 - DNA, 12 bp, Homo sapiens
caaccagagccc

SEQ ID NO: 446379 - DNA, 13 bp, Homo sapiens
caaccagagcccc

SEQ ID NO: 446380 - DNA, 19 bp, Homo sapiens
caacctccacctcccgggt

SEQ ID NO: 446381 - DNA, 15 bp, Homo sapiens
caactctctcctgta

SEQ ID NO: 446382 - DNA, 14 bp, Homo sapiens
ccccaccttgccaa

SEQ ID NO: 446383 - DNA, 18 bp, Homo sapiens
ccccatgtgcctgcacca

SEQ ID NO: 446384 - DNA, 13 bp, Homo sapiens
cccggctggactt

SEQ ID NO: 446385 - DNA, 21 bp, Homo sapiens
cccgggcaagacttttctttg

SEQ ID NO: 446386 - DNA, 19 bp, Homo sapiens
cccgttttatgatttactc

SEQ ID NO: 446387 - DNA, 16 bp, Homo sapiens
ccctcaaagaggcctt

SEQ ID NO: 446388 - DNA, 20 bp, Homo sapiens
ccctcggtgcagaaactacc

SEQ ID NO: 446389 - DNA, 14 bp, Homo sapiens
ccctctctttgagt

SEQ ID NO: 446390 - DNA, 18 bp, Homo sapiens
ccctgccacctgtctgtc

SEQ ID NO: 446391 - DNA, 23 bp, Homo sapiens
ccctgtattcccacccctggact

SEQ ID NO: 446392 - DNA, 12 bp, Homo sapiens
ccctgttcattg

SEQ ID NO: 446393 - DNA, 21 bp, Homo sapiens
cccttgaactgttctggcctc

SEQ ID NO: 446394 - DNA, 22 bp, Homo sapiens
cccttttctttttcccttgaac

SEQ ID NO: 446395 - DNA, 12 bp, Homo sapiens
ccggtcagtgcc

SEQ ID NO: 446396 - DNA, 19 bp, Homo sapiens
cctaaaagttttaacctca

SEQ ID NO: 446397 - DNA, 19 bp, Homo sapiens
cctacaacatttttcagtt

SEQ ID NO: 446398 - DNA, 22 bp, Homo sapiens
cctcagaccaactctctcctgt

SEQ ID NO: 446399 - DNA, 12 bp, Homo sapiens
cctccctccttc

SEQ ID NO: 446400 - DNA, 14 bp, Homo sapiens
cctccctccttcct

SEQ ID NO: 446401 - DNA, 18 bp, Homo sapiens
cctcgtggacacctgccc

SEQ ID NO: 446402 - DNA, 20 bp, Homo sapiens
cctcgtggacacctgccctg

SEQ ID NO: 446403 - DNA, 22 bp, Homo sapiens
cctcgtggacacctgccctgcc

SEQ ID NO: 446404 - DNA, 20 bp, Homo sapiens
cctctgaagttggacagcaa

SEQ ID NO: 446405 - DNA, 14 bp, Homo sapiens
cctgcaccaggaga

SEQ ID NO: 446406 - DNA, 15 bp, Homo sapiens
cctgccacctgtctg

SEQ ID NO: 446407 - DNA, 14 bp, Homo sapiens
cctgccctgccacc

SEQ ID NO: 446408 - DNA, 15 bp, Homo sapiens
cctgccctgccacct

SEQ ID NO: 446409 - DNA, 22 bp, Homo sapiens
cggtcaaaatattttttaaagt

SEQ ID NO: 446410 - DNA, 23 bp, Homo sapiens
cgtctgtgattgccatttcttcc

SEQ ID NO: 446411 - DNA, 13 bp, Homo sapiens
cgtggacacctgc

SEQ ID NO: 446412 - DNA, 14 bp, Homo sapiens
cgtggacacctgcc

SEQ ID NO: 446413 - DNA, 17 bp, Homo sapiens
ctaaagcagtgttttca

SEQ ID NO: 446414 - DNA, 13 bp, Homo sapiens
ctacaaccagagc

SEQ ID NO: 446415 - DNA, 15 bp, Homo sapiens
ctacaaccagagccc

SEQ ID NO: 446416 - DNA, 22 bp, Homo sapiens
ctacactgtattacataaataa

SEQ ID NO: 446417 - DNA, 19 bp, Homo sapiens
ctacagacattaaataatc

SEQ ID NO: 446418 - DNA, 18 bp, Homo sapiens
ctacagccagtaaggcag

SEQ ID NO: 446419 - DNA, 16 bp, Homo sapiens
ctagatcttacatctg

SEQ ID NO: 446420 - DNA, 20 bp, Homo sapiens
ctagatcttacatctgcagc

SEQ ID NO: 446421 - DNA, 17 bp, Homo sapiens
ctatctgtatgtctgcc

SEQ ID NO: 446422 - DNA, 19 bp, Homo sapiens
ctatgcattttaaagttaa

SEQ ID NO: 446423 - DNA, 21 bp, Homo sapiens
ctatttaaaagtataaaactg

SEQ ID NO: 446424 - DNA, 17 bp, Homo sapiens
ctcaaaagattgtttta

SEQ ID NO: 446425 - DNA, 18 bp, Homo sapiens
ctcaatattcaataaagc

SEQ ID NO: 446426 - DNA, 13 bp, Homo sapiens
ctcagaccaactc

SEQ ID NO: 446427 - DNA, 16 bp, Homo sapiens
ctcagcaaggggctct

SEQ ID NO: 446428 - DNA, 21 bp, Homo sapiens
ctcatatgctatgttagaagt

SEQ ID NO: 446429 - DNA, 15 bp, Homo sapiens
ctccaaaaacagtaa

SEQ ID NO: 446430 - DNA, 20 bp, Homo sapiens
ctccccatgtgcctgcacca

SEQ ID NO: 446431 - DNA, 17 bp, Homo sapiens
ctcccgtagttttttct

SEQ ID NO: 446432 - DNA, 19 bp, Homo sapiens
ctccctccttccttcttgc

SEQ ID NO: 446433 - DNA, 20 bp, Homo sapiens
ctccgtgatgctgtttttct

SEQ ID NO: 446434 - DNA, 15 bp, Homo sapiens
ctcctgattatttat

SEQ ID NO: 446435 - DNA, 21 bp, Homo sapiens
ctcctgcctcagcctcccgag

SEQ ID NO: 446436 - DNA, 16 bp, Homo sapiens
ctcgtggacacctgcc

SEQ ID NO: 446437 - DNA, 19 bp, Homo sapiens
ctcgtggacacctgccctg

SEQ ID NO: 446438 - DNA, 20 bp, Homo sapiens
ctcgtggacacctgccctgc

SEQ ID NO: 446439 - DNA, 21 bp, Homo sapiens
ctcgtggacacctgccctgcc

SEQ ID NO: 446440 - DNA, 21 bp, Homo sapiens
ctctcaatattcaataaagct

SEQ ID NO: 446441 - DNA, 22 bp, Homo sapiens
ctctcctgtataaccccacctt

SEQ ID NO: 446442 - DNA, 18 bp, Homo sapiens
ctctgctggtcttcaatt

SEQ ID NO: 446443 - DNA, 17 bp, Homo sapiens
ctcttatgcacacctcc

SEQ ID NO: 446444 - DNA, 15 bp, Homo sapiens
ctgaagttggacagc

SEQ ID NO: 446445 - DNA, 19 bp, Homo sapiens
ctgacactgcgaactctca

SEQ ID NO: 446446 - DNA, 20 bp, Homo sapiens
ctgatcactatgcattttaa

SEQ ID NO: 446447 - DNA, 11 bp, Homo sapiens
ctgcaccagga

SEQ ID NO: 446448 - DNA, 13 bp, Homo sapiens
ctgcaccaggaga

SEQ ID NO: 446449 - DNA, 19 bp, Homo sapiens
ctgcaggatgattgtacag

SEQ ID NO: 446450 - DNA, 20 bp, Homo sapiens
ctgcaggatgattgtacaga

SEQ ID NO: 446451 - DNA, 15 bp, Homo sapiens
ctgccacctgtctgt

SEQ ID NO: 446452 - DNA, 17 bp, Homo sapiens
ctgccctccctccttcc

SEQ ID NO: 446453 - DNA, 13 bp, Homo sapiens
ctgccctgccacc

SEQ ID NO: 446454 - DNA, 17 bp, Homo sapiens
ctgccctgccacctgtc

SEQ ID NO: 446455 - DNA, 11 bp, Homo sapiens
ctgccctgccc

SEQ ID NO: 446456 - DNA, 14 bp, Homo sapiens
ctgctggtcttcaa

SEQ ID NO: 446457 - DNA, 17 bp, Homo sapiens
ctgctggtcttcaatta

SEQ ID NO: 446458 - DNA, 20 bp, Homo sapiens
ctggacttttgcagcttcct

SEQ ID NO: 446459 - DNA, 14 bp, Homo sapiens
ctggagtgcagtgg

SEQ ID NO: 446460 - DNA, 23 bp, Homo sapiens
ctggccccaccctcgtggacacc

SEQ ID NO: 446461 - DNA, 21 bp, Homo sapiens
ctgggattacaggcgtgagcc

SEQ ID NO: 446462 - DNA, 15 bp, Homo sapiens
ctggttctgcaatga

SEQ ID NO: 446463 - DNA, 12 bp, Homo sapiens
ctgtaaagaatt

SEQ ID NO: 446464 - DNA, 17 bp, Homo sapiens
ctgtataatttaacagt

SEQ ID NO: 446465 - DNA, 17 bp, Homo sapiens
ctgtattacataaataa

SEQ ID NO: 446466 - DNA, 20 bp, Homo sapiens
ctgtcagaccttcttccaca

SEQ ID NO: 446467 - DNA, 22 bp, Homo sapiens
ctgtcctcattcttctctccca

SEQ ID NO: 446468 - DNA, 17 bp, Homo sapiens
ctgtcgtggtagcagat

SEQ ID NO: 446469 - DNA, 18 bp, Homo sapiens
ctgtctccatgtttgatg

SEQ ID NO: 446470 - DNA, 16 bp, Homo sapiens
ctgtctgtctgtccca

SEQ ID NO: 446471 - DNA, 14 bp, Homo sapiens
ctgtctgtctgtct

SEQ ID NO: 446472 - DNA, 20 bp, Homo sapiens
ctgtgacattcctgcaggga

SEQ ID NO: 446473 - DNA, 23 bp, Homo sapiens
ctgtgccccatcagcagcttgac

SEQ ID NO: 446474 - DNA, 18 bp, Homo sapiens
ctgtgtgtctgatgtttg

SEQ ID NO: 446475 - DNA, 16 bp, Homo sapiens
ctgttctggcctcaga

SEQ ID NO: 446476 - DNA, 16 bp, Homo sapiens
cttatttttttcccaa

SEQ ID NO: 446477 - DNA, 22 bp, Homo sapiens
cttccacagcaaatgagatgta

SEQ ID NO: 446478 - DNA, 15 bp, Homo sapiens
cttctacaaccagag

SEQ ID NO: 446479 - DNA, 17 bp, Homo sapiens
cttctcaagcactgaca

SEQ ID NO: 446480 - DNA, 13 bp, Homo sapiens
cttctctcccaca

SEQ ID NO: 446481 - DNA, 21 bp, Homo sapiens
cttctctcccacacaagcagt

SEQ ID NO: 446482 - DNA, 23 bp, Homo sapiens
cttcttttaagatgtgtcttcaa

SEQ ID NO: 446483 - DNA, 20 bp, Homo sapiens
gatcccatccatcagctccc

SEQ ID NO: 446484 - DNA, 14 bp, Homo sapiens
gatgattaaacacc

SEQ ID NO: 446485 - DNA, 23 bp, Homo sapiens
gatgattaaacacctgacacatc

SEQ ID NO: 446486 - DNA, 16 bp, Homo sapiens
gatgtatgcccaaaga

SEQ ID NO: 446487 - DNA, 17 bp, Homo sapiens
gatgtgtcttcaatttg

SEQ ID NO: 446488 - DNA, 12 bp, Homo sapiens
gatgtttcttct

SEQ ID NO: 446489 - DNA, 14 bp, Homo sapiens
gattaaacacctga

SEQ ID NO: 446490 - DNA, 15 bp, Homo sapiens
gattaaacacctgac

SEQ ID NO: 446491 - DNA, 19 bp, Homo sapiens
gattaaacacctgacacat

SEQ ID NO: 446492 - DNA, 17 bp, Homo sapiens
gattcaattttctttaa

SEQ ID NO: 446493 - DNA, 19 bp, Homo sapiens
gattcatatttacttctta

SEQ ID NO: 446494 - DNA, 16 bp, Homo sapiens
gattgccatttcttcc

SEQ ID NO: 446495 - DNA, 22 bp, Homo sapiens
gattgccatttcttcccaaggc

SEQ ID NO: 446496 - DNA, 22 bp, Homo sapiens
gattgtacagaatcattgctta

SEQ ID NO: 446497 - DNA, 15 bp, Homo sapiens
gatttcactgacact

SEQ ID NO: 446498 - DNA, 18 bp, Homo sapiens
gattttcctgtgtccaca

SEQ ID NO: 446499 - DNA, 17 bp, Homo sapiens
gcaaaaccattgcttca

SEQ ID NO: 446500 - DNA, 22 bp, Homo sapiens
gcaaacctcagtcatattctta

SEQ ID NO: 446501 - DNA, 14 bp, Homo sapiens
gcactctgcagtga

SEQ ID NO: 446502 - DNA, 12 bp, Homo sapiens
gcagagacaata

SEQ ID NO: 446503 - DNA, 14 bp, Homo sapiens
gcagctctgtcgtg

SEQ ID NO: 446504 - DNA, 16 bp, Homo sapiens
gcagcttccttccaag

SEQ ID NO: 446505 - DNA, 18 bp, Homo sapiens
gcaggatgattgtacaga

SEQ ID NO: 446506 - DNA, 18 bp, Homo sapiens
gcagtctttttctacagc

SEQ ID NO: 446507 - DNA, 19 bp, Homo sapiens
gccagtaaggcagctctgt

SEQ ID NO: 446508 - DNA, 14 bp, Homo sapiens
gccatttcttccca

SEQ ID NO: 446509 - DNA, 19 bp, Homo sapiens
gcccaggctggagtgcagt

SEQ ID NO: 446510 - DNA, 18 bp, Homo sapiens
gcccggaagttgctgtgc

SEQ ID NO: 446511 - DNA, 13 bp, Homo sapiens
gccctgccacctg

SEQ ID NO: 446512 - DNA, 15 bp, Homo sapiens
gccctgccacctgtc

SEQ ID NO: 446513 - DNA, 20 bp, Homo sapiens
gccctgccacctgtctgtct

SEQ ID NO: 446514 - DNA, 23 bp, Homo sapiens
gccctgctgtcagaccttcttcc

SEQ ID NO: 446515 - DNA, 20 bp, Homo sapiens
gcctcagaccaactctctcc

SEQ ID NO: 446516 - DNA, 18 bp, Homo sapiens
gcctctgaagttggacag

SEQ ID NO: 446517 - DNA, 14 bp, Homo sapiens
gcctgcaccaggag

SEQ ID NO: 446518 - DNA, 15 bp, Homo sapiens
gcctgcaccaggaga

SEQ ID NO: 446519 - DNA, 21 bp, Homo sapiens
gcctgcaccaggagacagaca

SEQ ID NO: 446520 - DNA, 15 bp, Homo sapiens
gcctttgttgctcag

SEQ ID NO: 446521 - DNA, 13 bp, Homo sapiens
gcgtgtgcagtgc

SEQ ID NO: 446522 - DNA, 16 bp, Homo sapiens
gctatttaaaagtata

SEQ ID NO: 446523 - DNA, 13 bp, Homo sapiens
gctcttgcctgta

SEQ ID NO: 446524 - DNA, 16 bp, Homo sapiens
gctcttgcctgtaatc

SEQ ID NO: 446525 - DNA, 16 bp, Homo sapiens
gctggttctgcaatga

SEQ ID NO: 446526 - DNA, 17 bp, Homo sapiens
gctgtctccatgtttga

SEQ ID NO: 446527 - DNA, 20 bp, Homo sapiens
gcttatacacttacacttta

SEQ ID NO: 446528 - DNA, 22 bp, Homo sapiens
gctttcttctacaaccagagcc

SEQ ID NO: 446529 - DNA, 18 bp, Homo sapiens
gctttgtatccatgaggg

SEQ ID NO: 446530 - DNA, 12 bp, Homo sapiens
ggaagaaacaaa

SEQ ID NO: 446531 - DNA, 13 bp, Homo sapiens
ggacacctgccct

SEQ ID NO: 446532 - DNA, 14 bp, Homo sapiens
ggacacctgccctg

SEQ ID NO: 446533 - DNA, 17 bp, Homo sapiens
ggacacctgccctgccc

SEQ ID NO: 446534 - DNA, 21 bp, Homo sapiens
ggacagcaaaaccattgcttc

SEQ ID NO: 446535 - DNA, 22 bp, Homo sapiens
ggacagcaaaaccattgcttca

SEQ ID NO: 446536 - DNA, 14 bp, Homo sapiens
ggacctgaaggacg

SEQ ID NO: 446537 - DNA, 19 bp, Homo sapiens
ggactggtggcccctgcct

SEQ ID NO: 446538 - DNA, 20 bp, Homo sapiens
ggaggcggaggttgcagtga

SEQ ID NO: 446539 - DNA, 17 bp, Homo sapiens
ggaggtgagaccacctc

SEQ ID NO: 446540 - DNA, 19 bp, Homo sapiens
ggaggttcacctgcagcga

SEQ ID NO: 446541 - DNA, 18 bp, Homo sapiens
tccaatttacatactctg

SEQ ID NO: 446542 - DNA, 17 bp, Homo sapiens
tccacaagttaaataaa

SEQ ID NO: 446543 - DNA, 11 bp, Homo sapiens
tccagcttccc

SEQ ID NO: 446544 - DNA, 22 bp, Homo sapiens
tccaggcagagacaataaaaca

SEQ ID NO: 446545 - DNA, 23 bp, Homo sapiens
tccagtgggaggtgagaccacct

SEQ ID NO: 446546 - DNA, 18 bp, Homo sapiens
tccatttttactaaagca

SEQ ID NO: 446547 - DNA, 20 bp, Homo sapiens
tccatttttactaaagcagt

SEQ ID NO: 446548 - DNA, 21 bp, Homo sapiens
tccatttttactaaagcagtg

SEQ ID NO: 446549 - DNA, 22 bp, Homo sapiens
tccatttttactaaagcagtgt

SEQ ID NO: 446550 - DNA, 20 bp, Homo sapiens
tcccaaagtgctgggattac

SEQ ID NO: 446551 - DNA, 20 bp, Homo sapiens
tccccatgtgcctgcaccag

SEQ ID NO: 446552 - DNA, 20 bp, Homo sapiens
tcccgagtagctgggattac

SEQ ID NO: 446553 - DNA, 23 bp, Homo sapiens
tcccttgaactgttctggcctca

SEQ ID NO: 446554 - DNA, 23 bp, Homo sapiens
tcctgactcggtcaaaatatttt

SEQ ID NO: 446555 - DNA, 23 bp, Homo sapiens
tcctttttgcagtatatttctga

SEQ ID NO: 446556 - DNA, 17 bp, Homo sapiens
tcgatgggggatgcttc

SEQ ID NO: 446557 - DNA, 22 bp, Homo sapiens
tcgatgggggatgcttcatgtg

SEQ ID NO: 446558 - DNA, 22 bp, Homo sapiens
tcggtgtccatttatagaataa

SEQ ID NO: 446559 - DNA, 14 bp, Homo sapiens
tcgtggacacctgc

SEQ ID NO: 446560 - DNA, 15 bp, Homo sapiens
tcgtggacacctgcc

SEQ ID NO: 446561 - DNA, 16 bp, Homo sapiens
tcgtggacacctgccc

SEQ ID NO: 446562 - DNA, 20 bp, Homo sapiens
tcgtggacacctgccctgcc

SEQ ID NO: 446563 - DNA, 13 bp, Homo sapiens
tctacaaccagag

SEQ ID NO: 446564 - DNA, 15 bp, Homo sapiens
tctacaaccagagcc

SEQ ID NO: 446565 - DNA, 19 bp, Homo sapiens
tctacagccagtaaggcag

SEQ ID NO: 446566 - DNA, 15 bp, Homo sapiens
tctagtgatttcctg

SEQ ID NO: 446567 - DNA, 15 bp, Homo sapiens
tctcaagcactgaca

SEQ ID NO: 446568 - DNA, 19 bp, Homo sapiens
tctcctgtataaccccacc

SEQ ID NO: 446569 - DNA, 21 bp, Homo sapiens
tctctcccacacaagcagtct

SEQ ID NO: 446570 - DNA, 22 bp, Homo sapiens
tctctcctgtataaccccacct

SEQ ID NO: 446571 - DNA, 16 bp, Homo sapiens
tctgaagtttcattta

SEQ ID NO: 446572 - DNA, 18 bp, Homo sapiens
tctgccctccctccttcc

SEQ ID NO: 446573 - DNA, 17 bp, Homo sapiens
tctgctggtcttcaatt

SEQ ID NO: 446574 - DNA, 15 bp, Homo sapiens
tctggcctcagacca

SEQ ID NO: 446575 - DNA, 16 bp, Homo sapiens
tctggcctcagaccaa

SEQ ID NO: 446576 - DNA, 16 bp, Homo sapiens
tctgtctgtcccaaag

SEQ ID NO: 446577 - DNA, 21 bp, Homo sapiens
tctgtgattgccatttcttcc

SEQ ID NO: 446578 - DNA, 20 bp, Homo sapiens
tcttcaatttgtataaaatg

SEQ ID NO: 446579 - DNA, 19 bp, Homo sapiens
tcttccacagcaaatgaga

SEQ ID NO: 446580 - DNA, 14 bp, Homo sapiens
tcttcccaaggcca

SEQ ID NO: 446581 - DNA, 19 bp, Homo sapiens
tcttcccaaggccagtctg

SEQ ID NO: 446582 - DNA, 20 bp, Homo sapiens
tcttcccaaggccagtctga

SEQ ID NO: 446583 - DNA, 19 bp, Homo sapiens
tcttctttgactataacaa

SEQ ID NO: 446584 - DNA, 17 bp, Homo sapiens
tcttggtcagatttgaa

SEQ ID NO: 446585 - DNA, 20 bp, Homo sapiens
tctttataattctactttga

SEQ ID NO: 446586 - DNA, 20 bp, Homo sapiens
tctttcctaaatataaatga

SEQ ID NO: 446587 - DNA, 19 bp, Homo sapiens
tctttgaatttcctatctg

SEQ ID NO: 446588 - DNA, 20 bp, Homo sapiens
tctttgagtcaagtcaaata

SEQ ID NO: 446589 - DNA, 21 bp, Homo sapiens
tcttttaaaatgaaatgtttt

SEQ ID NO: 446590 - DNA, 23 bp, Homo sapiens
tcttttttttttttttacagtat

SEQ ID NO: 446591 - DNA, 16 bp, Homo sapiens
tgaaaccctgtctcta

SEQ ID NO: 446592 - DNA, 16 bp, Homo sapiens
tgaacttgaggacaca

SEQ ID NO: 446593 - DNA, 18 bp, Homo sapiens
tgaacttgaggacacatg

SEQ ID NO: 446594 - DNA, 20 bp, Homo sapiens
tgaacttgaggacacatgtc

SEQ ID NO: 446595 - DNA, 22 bp, Homo sapiens
tgaacttgaggacacatgtcca

SEQ ID NO: 446596 - DNA, 21 bp, Homo sapiens
tgaagtttcatttatgataca

SEQ ID NO: 446597 - DNA, 16 bp, Homo sapiens
tgaatatatggtctgt

SEQ ID NO: 446598 - DNA, 18 bp, Homo sapiens
tgacagaatgctgtttta

SEQ ID NO: 446599 - DNA, 19 bp, Homo sapiens
tgactataacaaaatctgg

SEQ ID NO: 446600 - DNA, 15 bp, Homo sapiens
tgagaccacctctca

SEQ ID NO: 446601 - DNA, 15 bp, Homo sapiens
tgagactcgtctcaa

SEQ ID NO: 446602 - DNA, 13 bp, Homo sapiens
tgaggacacatgt

SEQ ID NO: 446603 - DNA, 16 bp, Homo sapiens
tgaggacacatgtcca

SEQ ID NO: 446604 - DNA, 16 bp, Homo sapiens
tgagggacgaggtcaa

SEQ ID NO: 446605 - DNA, 21 bp, Homo sapiens
tgagggtttcattgtgtgtta

SEQ ID NO: 446606 - DNA, 22 bp, Homo sapiens
tgatgattaaacacctgacaca

SEQ ID NO: 446607 - DNA, 14 bp, Homo sapiens
tgattaaacacctg

SEQ ID NO: 446608 - DNA, 15 bp, Homo sapiens
tgattaaacacctga

SEQ ID NO: 446609 - DNA, 16 bp, Homo sapiens
tgattaaacacctgac

SEQ ID NO: 446610 - DNA, 19 bp, Homo sapiens
tgattaaacacctgacaca

SEQ ID NO: 446611 - DNA, 19 bp, Homo sapiens
tgattgtacagaatcattg

SEQ ID NO: 446612 - DNA, 16 bp, Homo sapiens
tgattttcctgtgtcc

SEQ ID NO: 446613 - DNA, 22 bp, Homo sapiens
tgcaaaattgtctaaaatgtca

SEQ ID NO: 446614 - DNA, 12 bp, Homo sapiens
tgcaccaggaga

SEQ ID NO: 446615 - DNA, 13 bp, Homo sapiens
tgcaccaggagac

SEQ ID NO: 446616 - DNA, 17 bp, Homo sapiens
tgcactggccccaccct

SEQ ID NO: 446617 - DNA, 20 bp, Homo sapiens
ttaacagtgcccttttcatc

SEQ ID NO: 446618 - DNA, 18 bp, Homo sapiens
ttaacctcaggttccaaa

SEQ ID NO: 446619 - DNA, 17 bp, Homo sapiens
ttaagatgtgtcttcaa

SEQ ID NO: 446620 - DNA, 18 bp, Homo sapiens
ttaatattgatatgctta

SEQ ID NO: 446621 - DNA, 22 bp, Homo sapiens
ttaatctggtttatttttgttc

SEQ ID NO: 446622 - DNA, 20 bp, Homo sapiens
ttacactttatgcacaaaat

SEQ ID NO: 446623 - DNA, 14 bp, Homo sapiens
ttactaaagcagtg

SEQ ID NO: 446624 - DNA, 19 bp, Homo sapiens
ttactaaagcagtgttttc

SEQ ID NO: 446625 - DNA, 17 bp, Homo sapiens
ttagaatcccatggatg

SEQ ID NO: 446626 - DNA, 18 bp, Homo sapiens
ttataataatgttaacat

SEQ ID NO: 446627 - DNA, 12 bp, Homo sapiens
ttcaataaagct

SEQ ID NO: 446628 - DNA, 13 bp, Homo sapiens
ttcaataaagctg

SEQ ID NO: 446629 - DNA, 12 bp, Homo sapiens
ttcactgacact

SEQ ID NO: 446630 - DNA, 22 bp, Homo sapiens
ttcagtcatctccaaaaacagt

SEQ ID NO: 446631 - DNA, 14 bp, Homo sapiens
ttcatgtaaataaa

SEQ ID NO: 446632 - DNA, 15 bp, Homo sapiens
ttccaaattctgctt

SEQ ID NO: 446633 - DNA, 19 bp, Homo sapiens
ttccatttttactaaagca

SEQ ID NO: 446634 - DNA, 22 bp, Homo sapiens
ttccatttttactaaagcagtg

SEQ ID NO: 446635 - DNA, 21 bp, Homo sapiens
ttcccaaggccagtctgaacc

SEQ ID NO: 446636 - DNA, 14 bp, Homo sapiens
ttctacaaccagag

SEQ ID NO: 446637 - DNA, 16 bp, Homo sapiens
ttctacaaccagagcc

SEQ ID NO: 446638 - DNA, 17 bp, Homo sapiens
ttctacaaccagagccc

SEQ ID NO: 446639 - DNA, 20 bp, Homo sapiens
ttctctcctgattatttatc

SEQ ID NO: 446640 - DNA, 20 bp, Homo sapiens
ttctgaaatgacagaatgct

SEQ ID NO: 446641 - DNA, 18 bp, Homo sapiens
ttctgatttttaatttgt

SEQ ID NO: 446642 - DNA, 21 bp, Homo sapiens
ttctggtatgaacttgaggac

SEQ ID NO: 446643 - DNA, 22 bp, Homo sapiens
ttctggtatgaacttgaggaca

SEQ ID NO: 446644 - DNA, 23 bp, Homo sapiens
ttcttgccagttagactgggcct

SEQ ID NO: 446645 - DNA, 18 bp, Homo sapiens
ttctttctaaaacacatt

SEQ ID NO: 446646 - DNA, 22 bp, Homo sapiens
ttcttttttttttttttacagt

SEQ ID NO: 446647 - DNA, 14 bp, Homo sapiens
ttgaaaatgaaatg

SEQ ID NO: 446648 - DNA, 14 bp, Homo sapiens
ttgaaccttggtaa

SEQ ID NO: 446649 - DNA, 15 bp, Homo sapiens
ttgactataacaaaa

SEQ ID NO: 446650 - DNA, 17 bp, Homo sapiens
ttgcagcttccttccaa

SEQ ID NO: 446651 - DNA, 15 bp, Homo sapiens
ttgcagtatatttct

SEQ ID NO: 446652 - DNA, 17 bp, Homo sapiens
ttgccaagctttcttct

SEQ ID NO: 446653 - DNA, 17 bp, Homo sapiens
ttgccatttcttcccaa

SEQ ID NO: 446654 - DNA, 18 bp, Homo sapiens
ttgcctaagtattccttt

SEQ ID NO: 446655 - DNA, 13 bp, Homo sapiens
ttggacagcaaaa

SEQ ID NO: 446656 - DNA, 20 bp, Homo sapiens
ttggcaattcttcttctcaa

SEQ ID NO: 446657 - DNA, 21 bp, Homo sapiens
ttgttccacaagttaaataaa

SEQ ID NO: 446658 - DNA, 15 bp, Homo sapiens
ttgttttatgttcta

SEQ ID NO: 446659 - DNA, 17 bp, Homo sapiens
tttaaaatgaaatgttt

SEQ ID NO: 446660 - DNA, 15 bp, Homo sapiens
tttactaaagcagtg

SEQ ID NO: 446661 - DNA, 13 bp, Homo sapiens
tttactcattatc

SEQ ID NO: 446662 - DNA, 19 bp, Homo sapiens
tttcatttatgatacaaaa

SEQ ID NO: 446663 - DNA, 15 bp, Homo sapiens
tttccaccaaattct

SEQ ID NO: 446664 - DNA, 22 bp, Homo sapiens
tttggattggatgaattccaaa

SEQ ID NO: 446665 - DNA, 12 bp, Homo sapiens
tttgtcattttc

SEQ ID NO: 446666 - DNA, 14 bp, Homo sapiens
ttttactaaagcag

SEQ ID NO: 446667 - DNA, 15 bp, Homo sapiens
ttttactaaagcagt

SEQ ID NO: 446668 - DNA, 20 bp, Homo sapiens
ttttactaaagcagtgtttt

SEQ ID NO: 446669 - DNA, 15 bp, Homo sapiens
ttttgttccacaagt

SEQ ID NO: 446670 - DNA, 15 bp, Homo sapiens
tttttactaaagcag

SEQ ID NO: 446671 - DNA, 16 bp, Homo sapiens
aatattcaataaagct

SEQ ID NO: 446672 - DNA, 12 bp, Homo sapiens
aatcattgctta

SEQ ID NO: 446673 - DNA, 22 bp, Homo sapiens
aatccaataaaaacattttgaa

SEQ ID NO: 446674 - DNA, 12 bp, Homo sapiens
aatccctgttca

SEQ ID NO: 446675 - DNA, 14 bp, Homo sapiens
aatccctgttcatt

SEQ ID NO: 446676 - DNA, 14 bp, Homo sapiens
aatgaatgaaacat

SEQ ID NO: 446677 - DNA, 20 bp, Homo sapiens
aatgatgattaaacacctga

SEQ ID NO: 446678 - DNA, 19 bp, Homo sapiens
ctggacttttgcagcttcc

SEQ ID NO: 446679 - DNA, 12 bp, Homo sapiens
ctggccccaccc

SEQ ID NO: 446680 - DNA, 18 bp, Homo sapiens
ctggtatgaacttgagga

SEQ ID NO: 446681 - DNA, 20 bp, Homo sapiens
ctggtatgaacttgaggaca

SEQ ID NO: 446682 - DNA, 23 bp, Homo sapiens
ctggtatgaacttgaggacacat

SEQ ID NO: 446683 - DNA, 16 bp, Homo sapiens
ctggtgcactggcccc

SEQ ID NO: 446684 - DNA, 19 bp, Homo sapiens
ctggtgcactggccccacc

SEQ ID NO: 446685 - DNA, 22 bp, Homo sapiens
ctgtacagattgctgcttctgc

SEQ ID NO: 446686 - DNA, 16 bp, Homo sapiens
ctgtatgtctgcctaa

SEQ ID NO: 446687 - DNA, 15 bp, Homo sapiens
ctgtctgtctgtctg

SEQ ID NO: 446688 - DNA, 19 bp, Homo sapiens
ctgtgattgccatttcttc

SEQ ID NO: 446689 - DNA, 20 bp, Homo sapiens
ctgtgattgccatttcttcc

SEQ ID NO: 446690 - DNA, 18 bp, Homo sapiens
ctgtgccccatcagcagc

SEQ ID NO: 446691 - DNA, 19 bp, Homo sapiens
ctgttctggcctcagacca

SEQ ID NO: 446692 - DNA, 14 bp, Homo sapiens
cttcaaacaaataa

SEQ ID NO: 446693 - DNA, 10 bp, Homo sapiens
cttcaatttg

SEQ ID NO: 446694 - DNA, 18 bp, Homo sapiens
cttcatcgcagtggactg

SEQ ID NO: 446695 - DNA, 17 bp, Homo sapiens
cttcattttttattcct

SEQ ID NO: 446696 - DNA, 14 bp, Homo sapiens
cttccacagcaaat

SEQ ID NO: 446697 - DNA, 22 bp, Homo sapiens
cttccctttgattttttgctgc

SEQ ID NO: 446698 - DNA, 16 bp, Homo sapiens
cttctaagagatataa

SEQ ID NO: 446699 - DNA, 17 bp, Homo sapiens
cttctacaaccagagcc

SEQ ID NO: 446700 - DNA, 18 bp, Homo sapiens
cttctacaaccagagccc

SEQ ID NO: 446701 - DNA, 19 bp, Homo sapiens
cttctacaaccagagcccc

SEQ ID NO: 446702 - DNA, 14 bp, Homo sapiens
cttctcttcccata

SEQ ID NO: 446703 - DNA, 16 bp, Homo sapiens
cttcttatacatttga

SEQ ID NO: 446704 - DNA, 22 bp, Homo sapiens
cttgaactgttctggcctcaga

SEQ ID NO: 446705 - DNA, 20 bp, Homo sapiens
aggaggcggaggttgcagtg

SEQ ID NO: 446706 - DNA, 14 bp, Homo sapiens
aggattattggaaa

SEQ ID NO: 446707 - DNA, 19 bp, Homo sapiens
aggcaaaataccagctgat

SEQ ID NO: 446708 - DNA, 20 bp, Homo sapiens
aggcggaggttgcagtgagc

SEQ ID NO: 446709 - DNA, 14 bp, Homo sapiens
agggtttcattgtg

SEQ ID NO: 446710 - DNA, 21 bp, Homo sapiens
aggtctccccatgtgcctgca

SEQ ID NO: 446711 - DNA, 14 bp, Homo sapiens
aggtgagaccacct

SEQ ID NO: 446712 - DNA, 16 bp, Homo sapiens
aggtgagaccacctct

SEQ ID NO: 446713 - DNA, 19 bp, Homo sapiens
aggttcacctgcagcgagt

SEQ ID NO: 446714 - DNA, 12 bp, Homo sapiens
aggttgcagtga

SEQ ID NO: 446715 - DNA, 13 bp, Homo sapiens
agtatatttctga

SEQ ID NO: 446716 - DNA, 14 bp, Homo sapiens
agtatcttttaaaa

SEQ ID NO: 446717 - DNA, 15 bp, Homo sapiens
agtatcttttaaaat

SEQ ID NO: 446718 - DNA, 14 bp, Homo sapiens
agtcaagtcaaata

SEQ ID NO: 446719 - DNA, 20 bp, Homo sapiens
agtcatctccaaaaacagta

SEQ ID NO: 446720 - DNA, 16 bp, Homo sapiens
agtggactgtgtccct

SEQ ID NO: 446721 - DNA, 20 bp, Homo sapiens
agtgtgaatatatggtctgt

SEQ ID NO: 446722 - DNA, 12 bp, Homo sapiens
agttaaataaat

SEQ ID NO: 446723 - DNA, 19 bp, Homo sapiens
agttattgttttatgttct

SEQ ID NO: 446724 - DNA, 19 bp, Homo sapiens
ataaaaacattttgaagtg

SEQ ID NO: 446725 - DNA, 12 bp, Homo sapiens
ataaaacattcc

SEQ ID NO: 446726 - DNA, 15 bp, Homo sapiens
ataaaactgctttgt

SEQ ID NO: 446727 - DNA, 21 bp, Homo sapiens
ataaaatggtgttttcatgta

SEQ ID NO: 446728 - DNA, 20 bp, Homo sapiens
ataagcaaattagtaattgt

SEQ ID NO: 446729 - DNA, 15 bp, Homo sapiens
ataatgaatgaaaca

SEQ ID NO: 446730 - DNA, 19 bp, Homo sapiens
ataatgtgggaagaaacaa

SEQ ID NO: 446731 - DNA, 13 bp, Homo sapiens
ataatgttcacta

SEQ ID NO: 446732 - DNA, 14 bp, Homo sapiens
ataattctactttg

SEQ ID NO: 446733 - DNA, 13 bp, Homo sapiens
atacacttacact

SEQ ID NO: 446734 - DNA, 20 bp, Homo sapiens
atacatctccagtacattcc

SEQ ID NO: 446735 - DNA, 23 bp, Homo sapiens
atagatttgtattttaaaacata

SEQ ID NO: 446736 - DNA, 15 bp, Homo sapiens
atataggaattaaga

SEQ ID NO: 446737 - DNA, 20 bp, Homo sapiens
atattcaataaagctgctga

SEQ ID NO: 446738 - DNA, 15 bp, Homo sapiens
atattgatatgctta

SEQ ID NO: 446739 - DNA, 16 bp, Homo sapiens
atattgtattatgcta

SEQ ID NO: 446740 - DNA, 15 bp, Homo sapiens
atcaattctctatca

SEQ ID NO: 446741 - DNA, 11 bp, Homo sapiens
atcagctccct

SEQ ID NO: 446742 - DNA, 15 bp, Homo sapiens
atcataaaacttgat

SEQ ID NO: 446743 - DNA, 15 bp, Homo sapiens
atcccatccatcagc

SEQ ID NO: 446744 - DNA, 12 bp, Homo sapiens
atccctgttcat

SEQ ID NO: 446745 - DNA, 13 bp, Homo sapiens
atccctgttcatt

SEQ ID NO: 446746 - DNA, 14 bp, Homo sapiens
atccctgttcattg

SEQ ID NO: 446747 - DNA, 17 bp, Homo sapiens
atccctgttcattgtaa

SEQ ID NO: 446748 - DNA, 21 bp, Homo sapiens
atcgatgggggatgcttcatg

SEQ ID NO: 446749 - DNA, 21 bp, Homo sapiens
atcggtgctgtcagccctgct

SEQ ID NO: 446750 - DNA, 15 bp, Homo sapiens
atcggtgtccattta

SEQ ID NO: 446751 - DNA, 23 bp, Homo sapiens
atcggtgtccatttatagaataa

SEQ ID NO: 446752 - DNA, 15 bp, Homo sapiens
atcttacatctgcag

SEQ ID NO: 446753 - DNA, 19 bp, Homo sapiens
atcttaggcaaaataccag

SEQ ID NO: 446754 - DNA, 14 bp, Homo sapiens
atcttctttataat

SEQ ID NO: 446755 - DNA, 16 bp, Homo sapiens
atgaacttgaggacac

SEQ ID NO: 446756 - DNA, 20 bp, Homo sapiens
atgaacttgaggacacatgt

SEQ ID NO: 446757 - DNA, 21 bp, Homo sapiens
atgaacttgaggacacatgtc

SEQ ID NO: 446758 - DNA, 22 bp, Homo sapiens
atgaacttgaggacacatgtcc

SEQ ID NO: 446759 - DNA, 17 bp, Homo sapiens
atgagggtttcattgtg

SEQ ID NO: 446760 - DNA, 14 bp, Homo sapiens
atgatcttctttat

SEQ ID NO: 446761 - DNA, 15 bp, Homo sapiens
atgatcttctttata

SEQ ID NO: 446762 - DNA, 16 bp, Homo sapiens
atgattaaacacctga

SEQ ID NO: 446763 - DNA, 15 bp, Homo sapiens
atgatttactcatta

SEQ ID NO: 446764 - DNA, 22 bp, Homo sapiens
atgcattttaaagttaaacatt

SEQ ID NO: 446765 - DNA, 15 bp, Homo sapiens
atgcctcctctgtcc

SEQ ID NO: 446766 - DNA, 13 bp, Homo sapiens
atgggatttcatg

SEQ ID NO: 446767 - DNA, 14 bp, Homo sapiens
atgggggatgcttc

SEQ ID NO: 446768 - DNA, 13 bp, Homo sapiens
atgtaaaaaatac

SEQ ID NO: 446769 - DNA, 22 bp, Homo sapiens
atgtaactctatagttattgtt

SEQ ID NO: 446770 - DNA, 15 bp, Homo sapiens
atgtatctgagcagg

SEQ ID NO: 446771 - DNA, 22 bp, Homo sapiens
atgtcaccggtcagtgcctttt

SEQ ID NO: 446772 - DNA, 15 bp, Homo sapiens
atgtgggaagaaaca

SEQ ID NO: 446773 - DNA, 20 bp, Homo sapiens
atgtgggaagaaacaaaccc

SEQ ID NO: 446774 - DNA, 14 bp, Homo sapiens
attaaacacctgac

SEQ ID NO: 446775 - DNA, 15 bp, Homo sapiens
attaaatccaataaa

SEQ ID NO: 446776 - DNA, 21 bp, Homo sapiens
attaaatgtatatgtcattta

SEQ ID NO: 446777 - DNA, 16 bp, Homo sapiens
attaagcctacaacat

SEQ ID NO: 446778 - DNA, 14 bp, Homo sapiens
attacataaataaa

SEQ ID NO: 446779 - DNA, 16 bp, Homo sapiens
attagtaattgtaagt

SEQ ID NO: 446780 - DNA, 22 bp, Homo sapiens
attcaattttctttaaccagtc

SEQ ID NO: 446781 - DNA, 16 bp, Homo sapiens
attcacacattaataa

SEQ ID NO: 446782 - DNA, 14 bp, Homo sapiens
attcatatttactt

SEQ ID NO: 446783 - DNA, 18 bp, Homo sapiens
attcatatttacttctta

SEQ ID NO: 446784 - DNA, 21 bp, Homo sapiens
attccatttttactaaagcag

SEQ ID NO: 446785 - DNA, 16 bp, Homo sapiens
attctactttgagtgc

SEQ ID NO: 446786 - DNA, 14 bp, Homo sapiens
attctcttatccaa

SEQ ID NO: 446787 - DNA, 15 bp, Homo sapiens
attctcttatccaac

SEQ ID NO: 446788 - DNA, 15 bp, Homo sapiens
attcttcttctcaag

SEQ ID NO: 446789 - DNA, 13 bp, Homo sapiens
attctttcctaaa

SEQ ID NO: 446790 - DNA, 22 bp, Homo sapiens
attgcctttggcaattcttctt

SEQ ID NO: 446791 - DNA, 12 bp, Homo sapiens
attgtgtgttag

SEQ ID NO: 446792 - DNA, 14 bp, Homo sapiens
atttacttcttata

SEQ ID NO: 446793 - DNA, 17 bp, Homo sapiens
atttacttcttatacat

SEQ ID NO: 446794 - DNA, 20 bp, Homo sapiens
atttacttcttatacatttg

SEQ ID NO: 446795 - DNA, 15 bp, Homo sapiens
atttagctgtatcaa

SEQ ID NO: 446796 - DNA, 19 bp, Homo sapiens
atttagctgtatcaaacta

SEQ ID NO: 446797 - DNA, 14 bp, Homo sapiens
atttcatgtaacca

SEQ ID NO: 446798 - DNA, 12 bp, Homo sapiens
atttctttctaa

SEQ ID NO: 446799 - DNA, 20 bp, Homo sapiens
atttctttctaaaacacatt

SEQ ID NO: 446800 - DNA, 14 bp, Homo sapiens
atttgttataatga

SEQ ID NO: 446801 - DNA, 22 bp, Homo sapiens
attttctttaaccagtctgaag

SEQ ID NO: 446802 - DNA, 14 bp, Homo sapiens
atttttactaaagc

SEQ ID NO: 446803 - DNA, 15 bp, Homo sapiens
atttttactaaagca

SEQ ID NO: 446804 - DNA, 16 bp, Homo sapiens
atttttactaaagcag

SEQ ID NO: 446805 - DNA, 18 bp, Homo sapiens
atttttactaaagcagtg

SEQ ID NO: 446806 - DNA, 15 bp, Homo sapiens
caaaaattagccggg

SEQ ID NO: 446807 - DNA, 23 bp, Homo sapiens
caaaaattcagagtccttgcaaa

SEQ ID NO: 446808 - DNA, 15 bp, Homo sapiens
caaaaccattgcttc

SEQ ID NO: 446809 - DNA, 17 bp, Homo sapiens
caaaaccattgcttcac

SEQ ID NO: 446810 - DNA, 11 bp, Homo sapiens
caaaatcataa

SEQ ID NO: 446811 - DNA, 22 bp, Homo sapiens
caaacctcagtcatattcttat

SEQ ID NO: 446812 - DNA, 17 bp, Homo sapiens
caaagaaataacccaga

SEQ ID NO: 446813 - DNA, 15 bp, Homo sapiens
caaattatttttcct

SEQ ID NO: 446814 - DNA, 11 bp, Homo sapiens
caaccagagcc

SEQ ID NO: 446815 - DNA, 19 bp, Homo sapiens
caaccagagccccccacaa

SEQ ID NO: 446816 - DNA, 22 bp, Homo sapiens
caacttataattacaatgcaca

SEQ ID NO: 446817 - DNA, 14 bp, Homo sapiens
caacttgtgttcta

SEQ ID NO: 446818 - DNA, 19 bp, Homo sapiens
caagaattctccaaaacaa

SEQ ID NO: 446819 - DNA, 21 bp, Homo sapiens
caagaattctccaaaacaatt

SEQ ID NO: 446820 - DNA, 18 bp, Homo sapiens
caagacttttctttgaag

SEQ ID NO: 446821 - DNA, 23 bp, Homo sapiens
caagctttcttctacaaccagag

SEQ ID NO: 446822 - DNA, 13 bp, Homo sapiens
caagtcttcctga

SEQ ID NO: 446823 - DNA, 18 bp, Homo sapiens
caataaaaacattttgaa

SEQ ID NO: 446824 - DNA, 20 bp, Homo sapiens
caataaaaacattttgaagt

SEQ ID NO: 446825 - DNA, 22 bp, Homo sapiens
caataaaaacattttgaagtgt

SEQ ID NO: 446826 - DNA, 13 bp, Homo sapiens
caataaaacattc

SEQ ID NO: 446827 - DNA, 21 bp, Homo sapiens
caatgatgattaaacacctga

SEQ ID NO: 446828 - DNA, 22 bp, Homo sapiens
caatgatgattaaacacctgac

SEQ ID NO: 446829 - DNA, 19 bp, Homo sapiens
caattttctttaaccagtc

SEQ ID NO: 446830 - DNA, 21 bp, Homo sapiens
cacaagtagatgcctgaactt

SEQ ID NO: 446831 - DNA, 15 bp, Homo sapiens
cacagacagatccca

SEQ ID NO: 446832 - DNA, 23 bp, Homo sapiens
cacaggacgatttcactgacact

SEQ ID NO: 446833 - DNA, 12 bp, Homo sapiens
cacatgtccagt

SEQ ID NO: 446834 - DNA, 14 bp, Homo sapiens
cacattaataaaca

SEQ ID NO: 446835 - DNA, 14 bp, Homo sapiens
caccaggagacaga

SEQ ID NO: 446836 - DNA, 19 bp, Homo sapiens
caccctcgtggacacctgc

SEQ ID NO: 446837 - DNA, 20 bp, Homo sapiens
caccctcgtggacacctgcc

SEQ ID NO: 446838 - DNA, 14 bp, Homo sapiens
caccggtcagtgcc

SEQ ID NO: 446839 - DNA, 18 bp, Homo sapiens
cacctcttatgcacacct

SEQ ID NO: 446840 - DNA, 12 bp, Homo sapiens
cacctgccctgc

SEQ ID NO: 446841 - DNA, 18 bp, Homo sapiens
cacctgccctgccctgcc

SEQ ID NO: 446842 - DNA, 21 bp, Homo sapiens
cacctgccctgccctgccacc

SEQ ID NO: 446843 - DNA, 22 bp, Homo sapiens
cacctgccctgccctgccacct

SEQ ID NO: 446844 - DNA, 12 bp, Homo sapiens
cacctgtctgtc

SEQ ID NO: 446845 - DNA, 14 bp, Homo sapiens
cacctgtctgtctg

SEQ ID NO: 446846 - DNA, 16 bp, Homo sapiens
cacctgtctgtctgtc

SEQ ID NO: 446847 - DNA, 20 bp, Homo sapiens
caccttgcactattggactt

SEQ ID NO: 446848 - DNA, 18 bp, Homo sapiens
caccttgccaagctttct

SEQ ID NO: 446849 - DNA, 21 bp, Homo sapiens
cactagacgttgtaatgcaca

SEQ ID NO: 446850 - DNA, 14 bp, Homo sapiens
cactatgcatttta

SEQ ID NO: 446851 - DNA, 13 bp, Homo sapiens
cactattggactt

SEQ ID NO: 446852 - DNA, 12 bp, Homo sapiens
cactgaatctaa

SEQ ID NO: 446853 - DNA, 16 bp, Homo sapiens
cactgcgaactctcag

SEQ ID NO: 446854 - DNA, 18 bp, Homo sapiens
cacttacactttatgcac

SEQ ID NO: 446855 - DNA, 15 bp, Homo sapiens
cagaatcattgctta

SEQ ID NO: 446856 - DNA, 20 bp, Homo sapiens
cagaatcattgcttatgaca

SEQ ID NO: 446857 - DNA, 21 bp, Homo sapiens
cagatgcctcctctgtcctca

SEQ ID NO: 446858 - DNA, 13 bp, Homo sapiens
cagattcaatttt

SEQ ID NO: 446859 - DNA, 17 bp, Homo sapiens
cagcaaaaccattgctt

SEQ ID NO: 446860 - DNA, 18 bp, Homo sapiens
cagcaaaaccattgcttc

SEQ ID NO: 446861 - DNA, 20 bp, Homo sapiens
cagcaaggggctctgccctc

SEQ ID NO: 446862 - DNA, 13 bp, Homo sapiens
cagcagcctctga

SEQ ID NO: 446863 - DNA, 23 bp, Homo sapiens
cagcaggcggcctttgttgctca

SEQ ID NO: 446864 - DNA, 20 bp, Homo sapiens
cagcatcatggaggtttgaa

SEQ ID NO: 446865 - DNA, 12 bp, Homo sapiens
cagcctctgaag

SEQ ID NO: 446866 - DNA, 23 bp, Homo sapiens
cagctatttctcatcaattctct

SEQ ID NO: 446867 - DNA, 16 bp, Homo sapiens
cagctctgctatgagt

SEQ ID NO: 446868 - DNA, 16 bp, Homo sapiens
cagctctttcttcttt

SEQ ID NO: 446869 - DNA, 18 bp, Homo sapiens
caggcaccagcagcagaa

SEQ ID NO: 446870 - DNA, 12 bp, Homo sapiens
cagtaaggcagc

SEQ ID NO: 446871 - DNA, 18 bp, Homo sapiens
cagtacagctatttctca

SEQ ID NO: 446872 - DNA, 14 bp, Homo sapiens
cagtatatttctga

SEQ ID NO: 446873 - DNA, 20 bp, Homo sapiens
cagtcatctccaaaaacagt

SEQ ID NO: 446874 - DNA, 17 bp, Homo sapiens
cagtgccttttggaact

SEQ ID NO: 446875 - DNA, 21 bp, Homo sapiens
cagtgggaggtgagaccacct

SEQ ID NO: 446876 - DNA, 16 bp, Homo sapiens
cataaactatattctg

SEQ ID NO: 446877 - DNA, 22 bp, Homo sapiens
cataaataaattaaataaaata

SEQ ID NO: 446878 - DNA, 21 bp, Homo sapiens
cataattcacacattaataaa

SEQ ID NO: 446879 - DNA, 23 bp, Homo sapiens
catacttcatcgcagtggactgt

SEQ ID NO: 446880 - DNA, 14 bp, Homo sapiens
catatttacttctt

SEQ ID NO: 446881 - DNA, 17 bp, Homo sapiens
catatttacttcttata

SEQ ID NO: 446882 - DNA, 20 bp, Homo sapiens
catatttacttcttatacat

SEQ ID NO: 446883 - DNA, 16 bp, Homo sapiens
catcaattctctatca

SEQ ID NO: 446884 - DNA, 13 bp, Homo sapiens
catcagcagcttg

SEQ ID NO: 446885 - DNA, 18 bp, Homo sapiens
catcggtgtccatttata

SEQ ID NO: 446886 - DNA, 16 bp, Homo sapiens
catctccaaaaacagt

SEQ ID NO: 446887 - DNA, 19 bp, Homo sapiens
catctgatgccttcatctg

SEQ ID NO: 446888 - DNA, 18 bp, Homo sapiens
catctgcacctaaaccca

SEQ ID NO: 446889 - DNA, 15 bp, Homo sapiens
catctgcagctcttt

SEQ ID NO: 446890 - DNA, 17 bp, Homo sapiens
catgagaaaatcagtaa

SEQ ID NO: 446891 - DNA, 15 bp, Homo sapiens
catgatgtaaaaaat

SEQ ID NO: 446892 - DNA, 17 bp, Homo sapiens
catgatgtaaaaaatac

SEQ ID NO: 446893 - DNA, 19 bp, Homo sapiens
catgatgtaaaaaatacaa

SEQ ID NO: 446894 - DNA, 18 bp, Homo sapiens
catggacatgatcttctt

SEQ ID NO: 446895 - DNA, 14 bp, Homo sapiens
catgtaaataaata

SEQ ID NO: 446896 - DNA, 21 bp, Homo sapiens
catgtcaccggtcagtgcctt

SEQ ID NO: 446897 - DNA, 23 bp, Homo sapiens
catgtttgatgtatctgagcagg

SEQ ID NO: 446898 - DNA, 15 bp, Homo sapiens
cattgcttcactacc

SEQ ID NO: 446899 - DNA, 17 bp, Homo sapiens
cattgcttcactaccca

SEQ ID NO: 446900 - DNA, 12 bp, Homo sapiens
cattttgaagtg

SEQ ID NO: 446901 - DNA, 20 bp, Homo sapiens
catttttctaataatcataa

SEQ ID NO: 446902 - DNA, 20 bp, Homo sapiens
ccaaattttatgatttttct

SEQ ID NO: 446903 - DNA, 13 bp, Homo sapiens
ccaacatcaacat

SEQ ID NO: 446904 - DNA, 21 bp, Homo sapiens
ccaataaaaacattttgaagt

SEQ ID NO: 446905 - DNA, 23 bp, Homo sapiens
ccacaatgatgattaaacacctg

SEQ ID NO: 446906 - DNA, 16 bp, Homo sapiens
ccacagacagatccca

SEQ ID NO: 446907 - DNA, 19 bp, Homo sapiens
ccacagcagcctctgaagt

SEQ ID NO: 446908 - DNA, 23 bp, Homo sapiens
ccacctctcaatattcaataaag

SEQ ID NO: 446909 - DNA, 11 bp, Homo sapiens
ccacctgtctg

SEQ ID NO: 446910 - DNA, 12 bp, Homo sapiens
ccacctgtctgt

SEQ ID NO: 446911 - DNA, 22 bp, Homo sapiens
ccacctgtctgtctgtctgtcc

SEQ ID NO: 446912 - DNA, 23 bp, Homo sapiens
ccagatgcctcctctgtcctcat

SEQ ID NO: 446913 - DNA, 18 bp, Homo sapiens
ccaggctggagtgcagtg

SEQ ID NO: 446914 - DNA, 17 bp, Homo sapiens
ccagtctgaagtttcat

SEQ ID NO: 446915 - DNA, 18 bp, Homo sapiens
ccagttgtatattattct

SEQ ID NO: 446916 - DNA, 22 bp, Homo sapiens
ccatcggtgtccatttatagaa

SEQ ID NO: 446917 - DNA, 15 bp, Homo sapiens
ccatgactgcatttt

SEQ ID NO: 446918 - DNA, 12 bp, Homo sapiens
ccattgcttcac

SEQ ID NO: 446919 - DNA, 14 bp, Homo sapiens
ccatttatagaata

SEQ ID NO: 446920 - DNA, 20 bp, Homo sapiens
ccatttttactaaagcagtg

SEQ ID NO: 446921 - DNA, 15 bp, Homo sapiens
cccaaggccagtctg

SEQ ID NO: 446922 - DNA, 18 bp, Homo sapiens
cccacagacagatcccat

SEQ ID NO: 446923 - DNA, 20 bp, Homo sapiens
cccaccttgccaagctttct

SEQ ID NO: 446924 - DNA, 22 bp, Homo sapiens
cccatgtgcctgcaccaggaga

SEQ ID NO: 446925 - DNA, 13 bp, Homo sapiens
ccccacctcctgc

SEQ ID NO: 446926 - DNA, 19 bp, Homo sapiens
ccccaccttgccaagcttt

SEQ ID NO: 446927 - DNA, 23 bp, Homo sapiens
cccctggtgcactggccccaccc

SEQ ID NO: 446928 - DNA, 14 bp, Homo sapiens
ccctgccacctgtc

SEQ ID NO: 446929 - DNA, 17 bp, Homo sapiens
ccctgccacctgtctgt

SEQ ID NO: 446930 - DNA, 15 bp, Homo sapiens
ccctgccctgccacc

SEQ ID NO: 446931 - DNA, 17 bp, Homo sapiens
ccctgccctgccacctg

SEQ ID NO: 446932 - DNA, 23 bp, Homo sapiens
ccctggactggtggcccctgcct

SEQ ID NO: 446933 - DNA, 21 bp, Homo sapiens
ccctggtgcactggccccacc

SEQ ID NO: 446934 - DNA, 15 bp, Homo sapiens
ccggctggacttttg

SEQ ID NO: 446935 - DNA, 13 bp, Homo sapiens
ccggtcagtgcct

SEQ ID NO: 446936 - DNA, 20 bp, Homo sapiens
ccggtcagtgccttttggaa

SEQ ID NO: 446937 - DNA, 16 bp, Homo sapiens
cctcgtggacacctgc

SEQ ID NO: 446938 - DNA, 17 bp, Homo sapiens
cctcgtggacacctgcc

SEQ ID NO: 446939 - DNA, 13 bp, Homo sapiens
cctctctttgagt

SEQ ID NO: 446940 - DNA, 17 bp, Homo sapiens
cctgaagtgagaaccca

SEQ ID NO: 446941 - DNA, 12 bp, Homo sapiens
cctgcaccagga

SEQ ID NO: 446942 - DNA, 17 bp, Homo sapiens
cctgcaccaggagacag

SEQ ID NO: 446943 - DNA, 14 bp, Homo sapiens
cctgccacctgtct

SEQ ID NO: 446944 - DNA, 13 bp, Homo sapiens
cctggacaaaccc

SEQ ID NO: 446945 - DNA, 17 bp, Homo sapiens
cctggtgcactggcccc

SEQ ID NO: 446946 - DNA, 16 bp, Homo sapiens
cctgtataaccccacc

SEQ ID NO: 446947 - DNA, 23 bp, Homo sapiens
cctgtgtccacatctaacaaagt

SEQ ID NO: 446948 - DNA, 18 bp, Homo sapiens
ccttcatctgttcagtca

SEQ ID NO: 446949 - DNA, 18 bp, Homo sapiens
ccttcttccacagcaaat

SEQ ID NO: 446950 - DNA, 18 bp, Homo sapiens
ccttgccaagctttcttc

SEQ ID NO: 446951 - DNA, 14 bp, Homo sapiens
ccttggttatcaaa

SEQ ID NO: 446952 - DNA, 14 bp, Homo sapiens
cctttgttgctcag

SEQ ID NO: 446953 - DNA, 21 bp, Homo sapiens
cctttttaaatgagacttgtt

SEQ ID NO: 446954 - DNA, 19 bp, Homo sapiens
cgagggatgggatttcatg

SEQ ID NO: 446955 - DNA, 16 bp, Homo sapiens
cgcagtggactgtgtc

SEQ ID NO: 446956 - DNA, 20 bp, Homo sapiens
cgcccaggctggagtgcagt

SEQ ID NO: 446957 - DNA, 14 bp, Homo sapiens
cggccgcttggccg

SEQ ID NO: 446958 - DNA, 14 bp, Homo sapiens
tacattccgttctt

SEQ ID NO: 446959 - DNA, 11 bp, Homo sapiens
tactaaagcag

SEQ ID NO: 446960 - DNA, 19 bp, Homo sapiens
tactaaagcagtgttttca

SEQ ID NO: 446961 - DNA, 15 bp, Homo sapiens
tactaagaggctatt

SEQ ID NO: 446962 - DNA, 19 bp, Homo sapiens
tactgtacagattgctgct

SEQ ID NO: 446963 - DNA, 21 bp, Homo sapiens
tagaataatgtgggaagaaac

SEQ ID NO: 446964 - DNA, 15 bp, Homo sapiens
tagggttataataat

SEQ ID NO: 446965 - DNA, 15 bp, Homo sapiens
tagttattgttttat

SEQ ID NO: 446966 - DNA, 22 bp, Homo sapiens
tataaaatggtgttttcatgta

SEQ ID NO: 446967 - DNA, 13 bp, Homo sapiens
tataaccccacct

SEQ ID NO: 446968 - DNA, 18 bp, Homo sapiens
tataatgaatgaaacatt

SEQ ID NO: 446969 - DNA, 23 bp, Homo sapiens
tatgaacttgaggacacatgtcc

SEQ ID NO: 446970 - DNA, 15 bp, Homo sapiens
tatgcttatacactt

SEQ ID NO: 446971 - DNA, 12 bp, Homo sapiens
tattatgctacc

SEQ ID NO: 446972 - DNA, 11 bp, Homo sapiens
tattcaataaa

SEQ ID NO: 446973 - DNA, 12 bp, Homo sapiens
tattcaataaag

SEQ ID NO: 446974 - DNA, 13 bp, Homo sapiens
tattcaataaagc

SEQ ID NO: 446975 - DNA, 16 bp, Homo sapiens
tattcttatgcagggt

SEQ ID NO: 446976 - DNA, 20 bp, Homo sapiens
tattgatatgcttatacact

SEQ ID NO: 446977 - DNA, 16 bp, Homo sapiens
tattgttttatgttct

SEQ ID NO: 446978 - DNA, 13 bp, Homo sapiens
tatttatcacata

SEQ ID NO: 446979 - DNA, 22 bp, Homo sapiens
tcaagattcccggctggacttt

SEQ ID NO: 446980 - DNA, 15 bp, Homo sapiens
tcaatattcaataaa

SEQ ID NO: 446981 - DNA, 14 bp, Homo sapiens
tcaattttctttaa

SEQ ID NO: 446982 - DNA, 16 bp, Homo sapiens
tcaccggtcagtgcct

SEQ ID NO: 446983 - DNA, 17 bp, Homo sapiens
tcactaagtatgatcta

SEQ ID NO: 446984 - DNA, 22 bp, Homo sapiens
tcactacccatcggtgtccatt

SEQ ID NO: 446985 - DNA, 22 bp, Homo sapiens
tcactgacactgcgaactctca

SEQ ID NO: 446986 - DNA, 15 bp, Homo sapiens
tcagccctgctgtca

SEQ ID NO: 446987 - DNA, 18 bp, Homo sapiens
tcaggaggtactgtgagg

SEQ ID NO: 446988 - DNA, 14 bp, Homo sapiens
tcagtcatattctt

SEQ ID NO: 446989 - DNA, 15 bp, Homo sapiens
tcagtcatattctta

SEQ ID NO: 446990 - DNA, 14 bp, Homo sapiens
tcagtcatctccaa

SEQ ID NO: 446991 - DNA, 15 bp, Homo sapiens
tcatatttacttctt

SEQ ID NO: 446992 - DNA, 23 bp, Homo sapiens
tcatatttacttcttatacattt

SEQ ID NO: 446993 - DNA, 17 bp, Homo sapiens
tcatcaattctctatca

SEQ ID NO: 446994 - DNA, 13 bp, Homo sapiens
tcatctccagtgt

SEQ ID NO: 446995 - DNA, 15 bp, Homo sapiens
tcatgttgaagtcaa

SEQ ID NO: 446996 - DNA, 16 bp, Homo sapiens
tcattgcttatgacat

SEQ ID NO: 446997 - DNA, 18 bp, Homo sapiens
tccagtggacctgaagga

SEQ ID NO: 446998 - DNA, 14 bp, Homo sapiens
tccatcagctccct

SEQ ID NO: 446999 - DNA, 21 bp, Homo sapiens
tcccaaagaagttctggtatg

SEQ ID NO: 447000 - DNA, 14 bp, Homo sapiens
tcccacacaagcag

SEQ ID NO: 447001 - DNA, 21 bp, Homo sapiens
tcctaaaagttttaacctcag

SEQ ID NO: 447002 - DNA, 20 bp, Homo sapiens
tcctgattatttatcacata

SEQ ID NO: 447003 - DNA, 14 bp, Homo sapiens
tcctgcctcagcct

SEQ ID NO: 447004 - DNA, 22 bp, Homo sapiens
tcctgggggtggaggcctgcct

SEQ ID NO: 447005 - DNA, 21 bp, Homo sapiens
tcctgtgtccacatctaacaa

SEQ ID NO: 447006 - DNA, 15 bp, Homo sapiens
tccttcttcagctca

SEQ ID NO: 447007 - DNA, 16 bp, Homo sapiens
tcctttttaaatgaga

SEQ ID NO: 447008 - DNA, 22 bp, Homo sapiens
tcctttttgcagtatatttctg

SEQ ID NO: 447009 - DNA, 19 bp, Homo sapiens
tcgcccaggctggagtgca

SEQ ID NO: 447010 - DNA, 12 bp, Homo sapiens
tcgtggacacct

SEQ ID NO: 447011 - DNA, 19 bp, Homo sapiens
tcgtggacacctgccctgc

SEQ ID NO: 447012 - DNA, 15 bp, Homo sapiens
tctaattaaaggctt

SEQ ID NO: 447013 - DNA, 17 bp, Homo sapiens
tctacaaccagagcccc

SEQ ID NO: 447014 - DNA, 23 bp, Homo sapiens
tctacagccagtaaggcagctct

SEQ ID NO: 447015 - DNA, 17 bp, Homo sapiens
tctcaatattcaataaa

SEQ ID NO: 447016 - DNA, 13 bp, Homo sapiens
tctccaaaaacag

SEQ ID NO: 447017 - DNA, 16 bp, Homo sapiens
tctccatgtttgatgt

SEQ ID NO: 447018 - DNA, 15 bp, Homo sapiens
tctcctgattattta

SEQ ID NO: 447019 - DNA, 18 bp, Homo sapiens
tctctcccacacaagcag

SEQ ID NO: 447020 - DNA, 18 bp, Homo sapiens
tctgaagtttcatttatg

SEQ ID NO: 447021 - DNA, 13 bp, Homo sapiens
tctgatgtttgtt

SEQ ID NO: 447022 - DNA, 15 bp, Homo sapiens
tctgtctgtcccaaa

SEQ ID NO: 447023 - DNA, 19 bp, Homo sapiens
tctgtgtgtctgatgtttg

SEQ ID NO: 447024 - DNA, 12 bp, Homo sapiens
tcttacatctgc

SEQ ID NO: 447025 - DNA, 15 bp, Homo sapiens
tcttatacatttgat

SEQ ID NO: 447026 - DNA, 18 bp, Homo sapiens
tcttctacaaccagagcc

SEQ ID NO: 447027 - DNA, 15 bp, Homo sapiens
tcttcttctcaagca

SEQ ID NO: 447028 - DNA, 20 bp, Homo sapiens
tcttgcctaagtattccttt

SEQ ID NO: 447029 - DNA, 14 bp, Homo sapiens
tgaaacattttgtc

SEQ ID NO: 447030 - DNA, 14 bp, Homo sapiens
tgaaaccctgtctc

SEQ ID NO: 447031 - DNA, 21 bp, Homo sapiens
tgaaccttggtaaattgtaaa

SEQ ID NO: 447032 - DNA, 15 bp, Homo sapiens
tgaactcttcaatct

SEQ ID NO: 447033 - DNA, 19 bp, Homo sapiens
tgaacttgaggacacatgt

SEQ ID NO: 447034 - DNA, 21 bp, Homo sapiens
tgaacttgaggacacatgtcc

SEQ ID NO: 447035 - DNA, 15 bp, Homo sapiens
tgaagtttcatttat

SEQ ID NO: 447036 - DNA, 15 bp, Homo sapiens
tgaatcggtgctgtc

SEQ ID NO: 447037 - DNA, 18 bp, Homo sapiens
tgacactgcgaactctca

SEQ ID NO: 447038 - DNA, 13 bp, Homo sapiens
tgacagctgtgct

SEQ ID NO: 447039 - DNA, 15 bp, Homo sapiens
tgacatgatcgcttt

SEQ ID NO: 447040 - DNA, 18 bp, Homo sapiens
tgacgcgtggtcacagga

SEQ ID NO: 447041 - DNA, 20 bp, Homo sapiens
tgagaattttgatttcttaa

SEQ ID NO: 447042 - DNA, 19 bp, Homo sapiens
tgagaccacctctcaatat

SEQ ID NO: 447043 - DNA, 18 bp, Homo sapiens
tgagcttctattaaatgt

SEQ ID NO: 447044 - DNA, 15 bp, Homo sapiens
tgaggacacatgtcc

SEQ ID NO: 447045 - DNA, 23 bp, Homo sapiens
tgagggacgaggtcaaggagata

SEQ ID NO: 447046 - DNA, 20 bp, Homo sapiens
tgatcttctttataattcta

SEQ ID NO: 447047 - DNA, 15 bp, Homo sapiens
tgatgattaaacacc

SEQ ID NO: 447048 - DNA, 17 bp, Homo sapiens
tgatgattaaacacctg

SEQ ID NO: 447049 - DNA, 20 bp, Homo sapiens
tgatgattaaacacctgaca

SEQ ID NO: 447050 - DNA, 21 bp, Homo sapiens
tgatgattaaacacctgacac

SEQ ID NO: 447051 - DNA, 23 bp, Homo sapiens
tgattgtacagaatcattgctta

SEQ ID NO: 447052 - DNA, 13 bp, Homo sapiens
tgattttcctgtg

SEQ ID NO: 447053 - DNA, 20 bp, Homo sapiens
tgcaacctccacctcccggg

SEQ ID NO: 447054 - DNA, 21 bp, Homo sapiens
tgcaacctccacctcccgggt

SEQ ID NO: 447055 - DNA, 19 bp, Homo sapiens
tgcacacattaggcattga

SEQ ID NO: 447056 - DNA, 22 bp, Homo sapiens
tgcacacttatttttttcccaa

SEQ ID NO: 447057 - DNA, 21 bp, Homo sapiens
tgcagctctttcttctttgaa

SEQ ID NO: 447058 - DNA, 19 bp, Homo sapiens
tgcaggatgattgtacaga

SEQ ID NO: 447059 - DNA, 17 bp, Homo sapiens
tgcataagttaacttcc

SEQ ID NO: 447060 - DNA, 12 bp, Homo sapiens
tgccacctgtct

SEQ ID NO: 447061 - DNA, 14 bp, Homo sapiens
tgccacctgtctgt

SEQ ID NO: 447062 - DNA, 13 bp, Homo sapiens
tgccatttcttcc

SEQ ID NO: 447063 - DNA, 15 bp, Homo sapiens
tgccatttcttccca

SEQ ID NO: 447064 - DNA, 17 bp, Homo sapiens
tgccatttcttcccaag

SEQ ID NO: 447065 - DNA, 19 bp, Homo sapiens
tgccatttcttcccaaggc

SEQ ID NO: 447066 - DNA, 19 bp, Homo sapiens
tgccccatcagcagcttga

SEQ ID NO: 447067 - DNA, 15 bp, Homo sapiens
tgccctccctccttc

SEQ ID NO: 447068 - DNA, 14 bp, Homo sapiens
tgccctgccacctg

SEQ ID NO: 447069 - DNA, 20 bp, Homo sapiens
tgccctgccacctgtctgtc

SEQ ID NO: 447070 - DNA, 14 bp, Homo sapiens
tgccctgccctgcc

SEQ ID NO: 447071 - DNA, 16 bp, Homo sapiens
tgcctcctctgtcctc

SEQ ID NO: 447072 - DNA, 15 bp, Homo sapiens
tgcctgcaccaggag

SEQ ID NO: 447073 - DNA, 22 bp, Homo sapiens
tgcgaaacaacttgtgttctat

SEQ ID NO: 447074 - DNA, 21 bp, Homo sapiens
tgcgcccggccacattcagtt

SEQ ID NO: 447075 - DNA, 22 bp, Homo sapiens
tgctgtcagaccttcttccaca

SEQ ID NO: 447076 - DNA, 12 bp, Homo sapiens
tggacacctgcc

SEQ ID NO: 447077 - DNA, 16 bp, Homo sapiens
tggacacctgccctgc

SEQ ID NO: 447078 - DNA, 18 bp, Homo sapiens
tggacagcaaaaccattg

SEQ ID NO: 447079 - DNA, 20 bp, Homo sapiens
tggacagcaaaaccattgct

SEQ ID NO: 447080 - DNA, 22 bp, Homo sapiens
tggactttggaaggaggtgcct

SEQ ID NO: 447081 - DNA, 14 bp, Homo sapiens
tggatgtttcttct

SEQ ID NO: 447082 - DNA, 16 bp, Homo sapiens
tggatgtttcttcttt

SEQ ID NO: 447083 - DNA, 12 bp, Homo sapiens
tgggaagaaaca

SEQ ID NO: 447084 - DNA, 19 bp, Homo sapiens
tgggaggtgagaccacctc

SEQ ID NO: 447085 - DNA, 20 bp, Homo sapiens
actgtattacataaataaat

SEQ ID NO: 447086 - DNA, 18 bp, Homo sapiens
actgtgaggaagagcagg

SEQ ID NO: 447087 - DNA, 20 bp, Homo sapiens
acttagaggtggggagcaga

SEQ ID NO: 447088 - DNA, 18 bp, Homo sapiens
acttccaatttacatact

SEQ ID NO: 447089 - DNA, 15 bp, Homo sapiens
acttctcttcccata

SEQ ID NO: 447090 - DNA, 17 bp, Homo sapiens
acttcttatacatttga

SEQ ID NO: 447091 - DNA, 11 bp, Homo sapiens
acttgaggaca

SEQ ID NO: 447092 - DNA, 15 bp, Homo sapiens
acttgaggacacatg

SEQ ID NO: 447093 - DNA, 16 bp, Homo sapiens
acttgaggacacatgt

SEQ ID NO: 447094 - DNA, 15 bp, Homo sapiens
acttgtgttctatta

SEQ ID NO: 447095 - DNA, 14 bp, Homo sapiens
agaaaattagtaat

SEQ ID NO: 447096 - DNA, 19 bp, Homo sapiens
agaaacattctttcctaaa

SEQ ID NO: 447097 - DNA, 22 bp, Homo sapiens
agaagtggagagaaaatacaaa

SEQ ID NO: 447098 - DNA, 21 bp, Homo sapiens
agaataatgtgggaagaaaca

SEQ ID NO: 447099 - DNA, 22 bp, Homo sapiens
agaataatgtgggaagaaacaa

SEQ ID NO: 447100 - DNA, 13 bp, Homo sapiens
agaatcattgctt

SEQ ID NO: 447101 - DNA, 15 bp, Homo sapiens
agaatccctgttcat

SEQ ID NO: 447102 - DNA, 17 bp, Homo sapiens
agaattctcttatccaa

SEQ ID NO: 447103 - DNA, 15 bp, Homo sapiens
agacaataaaacatt

SEQ ID NO: 447104 - DNA, 16 bp, Homo sapiens
agacaataaaacattc

SEQ ID NO: 447105 - DNA, 16 bp, Homo sapiens
agacagatcccatcca

SEQ ID NO: 447106 - DNA, 14 bp, Homo sapiens
agacattaaataat

SEQ ID NO: 447107 - DNA, 17 bp, Homo sapiens
agaccacctctcaatat

SEQ ID NO: 447108 - DNA, 15 bp, Homo sapiens
agaccttcttccaca

SEQ ID NO: 447109 - DNA, 17 bp, Homo sapiens
agacgttgtaatgcaca

SEQ ID NO: 447110 - DNA, 18 bp, Homo sapiens
agacttaatcttgaatga

SEQ ID NO: 447111 - DNA, 17 bp, Homo sapiens
agacttgttttcccctc

SEQ ID NO: 447112 - DNA, 18 bp, Homo sapiens
agagacaataaaacattc

SEQ ID NO: 447113 - DNA, 22 bp, Homo sapiens
agagcaggcaccagcagcagaa

SEQ ID NO: 447114 - DNA, 16 bp, Homo sapiens
agaggtggggagcaga

SEQ ID NO: 447115 - DNA, 21 bp, Homo sapiens
agagtccttgcaaaattgtct

SEQ ID NO: 447116 - DNA, 19 bp, Homo sapiens
agagtgagactcgtctcaa

SEQ ID NO: 447117 - DNA, 19 bp, Homo sapiens
agatcccatccatcagctc

SEQ ID NO: 447118 - DNA, 17 bp, Homo sapiens
agatcttacatctgcag

SEQ ID NO: 447119 - DNA, 14 bp, Homo sapiens
agattgctgcttct

SEQ ID NO: 447120 - DNA, 19 bp, Homo sapiens
agcaaaaccattgcttcac

SEQ ID NO: 447121 - DNA, 22 bp, Homo sapiens
agcaaaaccattgcttcactac

SEQ ID NO: 447122 - DNA, 20 bp, Homo sapiens
agcaaaatatggcctttctt

SEQ ID NO: 447123 - DNA, 12 bp, Homo sapiens
agcactgacact

SEQ ID NO: 447124 - DNA, 14 bp, Homo sapiens
agcagagaattctc

SEQ ID NO: 447125 - DNA, 14 bp, Homo sapiens
agcagatggtccca

SEQ ID NO: 447126 - DNA, 13 bp, Homo sapiens
agcagcagtgagc

SEQ ID NO: 447127 - DNA, 15 bp, Homo sapiens
agcgtgcataagtta

SEQ ID NO: 447128 - DNA, 19 bp, Homo sapiens
agctcccttttctttttcc

SEQ ID NO: 447129 - DNA, 17 bp, Homo sapiens
agctctttcttctttga

SEQ ID NO: 447130 - DNA, 14 bp, Homo sapiens
agcttccttccaag

SEQ ID NO: 447131 - DNA, 23 bp, Homo sapiens
agctttcttctacaaccagagcc

SEQ ID NO: 447132 - DNA, 15 bp, Homo sapiens
aggatgattgtacag

SEQ ID NO: 447133 - DNA, 20 bp, Homo sapiens
aggatgattgtacagaatca

SEQ ID NO: 447134 - DNA, 16 bp, Homo sapiens
aggcagctctgtcgtg

SEQ ID NO: 447135 - DNA, 11 bp, Homo sapiens
aggggctctgc

SEQ ID NO: 447136 - DNA, 17 bp, Homo sapiens
aggggttccagcttccc

SEQ ID NO: 447137 - DNA, 20 bp, Homo sapiens
agtaaccaatttctttctaa

SEQ ID NO: 447138 - DNA, 15 bp, Homo sapiens
agtaaggcagctctg

SEQ ID NO: 447139 - DNA, 18 bp, Homo sapiens
agtaaggcagctctgtcg

SEQ ID NO: 447140 - DNA, 12 bp, Homo sapiens
agtacagctatt

SEQ ID NO: 447141 - DNA, 15 bp, Homo sapiens
agtatatttctgaaa

SEQ ID NO: 447142 - DNA, 20 bp, Homo sapiens
agtattgatttaacttcatt

SEQ ID NO: 447143 - DNA, 19 bp, Homo sapiens
agtatttcagatgctttag

SEQ ID NO: 447144 - DNA, 15 bp, Homo sapiens
agtcatattcttatg

SEQ ID NO: 447145 - DNA, 15 bp, Homo sapiens
agtctattgtttgtt

SEQ ID NO: 447146 - DNA, 17 bp, Homo sapiens
agtctgaagtttcattt

SEQ ID NO: 447147 - DNA, 14 bp, Homo sapiens
agtggacagtgaat

SEQ ID NO: 447148 - DNA, 23 bp, Homo sapiens
agttattgttttatgttctagtg

SEQ ID NO: 447149 - DNA, 15 bp, Homo sapiens
agttcagctgcttct

SEQ ID NO: 447150 - DNA, 22 bp, Homo sapiens
ataaaatggtgttttcatgtaa

SEQ ID NO: 447151 - DNA, 13 bp, Homo sapiens
ataaccccacctt

SEQ ID NO: 447152 - DNA, 21 bp, Homo sapiens
ataagattcatatttacttct

SEQ ID NO: 447153 - DNA, 17 bp, Homo sapiens
ataagcaaattagtaat

SEQ ID NO: 447154 - DNA, 22 bp, Homo sapiens
ataattgacaggattattggaa

SEQ ID NO: 447155 - DNA, 22 bp, Homo sapiens
atacacttacactttatgcaca

SEQ ID NO: 447156 - DNA, 16 bp, Homo sapiens
atacatttgataaagt

SEQ ID NO: 447157 - DNA, 16 bp, Homo sapiens
atactctgcttagaat

SEQ ID NO: 447158 - DNA, 17 bp, Homo sapiens
atatatttgtcattttc

SEQ ID NO: 447159 - DNA, 16 bp, Homo sapiens
atatgcttatacactt

SEQ ID NO: 447160 - DNA, 15 bp, Homo sapiens
atattcaataaagct

SEQ ID NO: 447161 - DNA, 19 bp, Homo sapiens
atcatggaggtttgaagat

SEQ ID NO: 447162 - DNA, 18 bp, Homo sapiens
atccaaaaatagccctgc

SEQ ID NO: 447163 - DNA, 16 bp, Homo sapiens
atcccatccatcagct

SEQ ID NO: 447164 - DNA, 16 bp, Homo sapiens
atccctgttcattgta

SEQ ID NO: 447165 - DNA, 19 bp, Homo sapiens
atctgcagctctttcttct

SEQ ID NO: 447166 - DNA, 20 bp, Homo sapiens
atctgcagctctttcttctt

SEQ ID NO: 447167 - DNA, 20 bp, Homo sapiens
atcttggtcagatttgaact

SEQ ID NO: 447168 - DNA, 22 bp, Homo sapiens
atcttttaaaatgaaatgtttt

SEQ ID NO: 447169 - DNA, 17 bp, Homo sapiens
atgaaatgactgtctaa

SEQ ID NO: 447170 - DNA, 13 bp, Homo sapiens
atgaacttgagga

SEQ ID NO: 447171 - DNA, 18 bp, Homo sapiens
atgaacttgaggacacat

SEQ ID NO: 447172 - DNA, 14 bp, Homo sapiens
atgatagaaacaga

SEQ ID NO: 447173 - DNA, 18 bp, Homo sapiens
atgatcttctttataatt

SEQ ID NO: 447174 - DNA, 20 bp, Homo sapiens
atgatgattaaacacctgac

SEQ ID NO: 447175 - DNA, 23 bp, Homo sapiens
atgatgattaaacacctgacaca

SEQ ID NO: 447176 - DNA, 16 bp, Homo sapiens
atgatgtaaaaaatac

SEQ ID NO: 447177 - DNA, 18 bp, Homo sapiens
atgatgtaaaaaatacaa

SEQ ID NO: 447178 - DNA, 13 bp, Homo sapiens
atgattaaacacc

SEQ ID NO: 447179 - DNA, 19 bp, Homo sapiens
atgattaaacacctgacac

SEQ ID NO: 447180 - DNA, 20 bp, Homo sapiens
atgattaaacacctgacaca

SEQ ID NO: 447181 - DNA, 14 bp, Homo sapiens
atgatttactcatt

SEQ ID NO: 447182 - DNA, 23 bp, Homo sapiens
atgcctcctctgtcctcattctt

SEQ ID NO: 447183 - DNA, 19 bp, Homo sapiens
atggacatgatcttcttta

SEQ ID NO: 447184 - DNA, 16 bp, Homo sapiens
atgggggatgcttcat

SEQ ID NO: 447185 - DNA, 21 bp, Homo sapiens
atggtgttttcatgtaaataa

SEQ ID NO: 447186 - DNA, 19 bp, Homo sapiens
atgtcaccggtcagtgcct

SEQ ID NO: 447187 - DNA, 19 bp, Homo sapiens
atgtgcctgcaccaggaga

SEQ ID NO: 447188 - DNA, 13 bp, Homo sapiens
atgtgtcttcaat

SEQ ID NO: 447189 - DNA, 12 bp, Homo sapiens
attaaacacctg

SEQ ID NO: 447190 - DNA, 15 bp, Homo sapiens
attaaacacctgaca

SEQ ID NO: 447191 - DNA, 19 bp, Homo sapiens
attaaacacctgacacatc

SEQ ID NO: 447192 - DNA, 20 bp, Homo sapiens
attaaacacctgacacatct

SEQ ID NO: 447193 - DNA, 13 bp, Homo sapiens
attcaataaagct

SEQ ID NO: 447194 - DNA, 16 bp, Homo sapiens
caacttgtgttctatt

SEQ ID NO: 447195 - DNA, 15 bp, Homo sapiens
caagacttttctttg

SEQ ID NO: 447196 - DNA, 22 bp, Homo sapiens
caagagaaacattctttcctaa

SEQ ID NO: 447197 - DNA, 20 bp, Homo sapiens
caagattcccggctggactt

SEQ ID NO: 447198 - DNA, 18 bp, Homo sapiens
caagtagatgcctgaact

SEQ ID NO: 447199 - DNA, 14 bp, Homo sapiens
caagttaaataaat

SEQ ID NO: 447200 - DNA, 19 bp, Homo sapiens
caataaaaacattttgaag

SEQ ID NO: 447201 - DNA, 16 bp, Homo sapiens
caatattcaataaagc

SEQ ID NO: 447202 - DNA, 18 bp, Homo sapiens
caatgatgattaaacacc

SEQ ID NO: 447203 - DNA, 20 bp, Homo sapiens
caatgatgattaaacacctg

SEQ ID NO: 447204 - DNA, 15 bp, Homo sapiens
caattcttcttctca

SEQ ID NO: 447205 - DNA, 16 bp, Homo sapiens
caatttgtataaaatg

SEQ ID NO: 447206 - DNA, 20 bp, Homo sapiens
cacagacagatcccatccat

SEQ ID NO: 447207 - DNA, 17 bp, Homo sapiens
caccctcgtggacacct

SEQ ID NO: 447208 - DNA, 21 bp, Homo sapiens
caccctcgtggacacctgccc

SEQ ID NO: 447209 - DNA, 16 bp, Homo sapiens
caccggtcagtgcctt

SEQ ID NO: 447210 - DNA, 12 bp, Homo sapiens
cacctcatatgc

SEQ ID NO: 447211 - DNA, 23 bp, Homo sapiens
cacctgccctgccctgccacctg

SEQ ID NO: 447212 - DNA, 14 bp, Homo sapiens
cactgcgaactctc

SEQ ID NO: 447213 - DNA, 21 bp, Homo sapiens
cactgcgaactctcaggacta

SEQ ID NO: 447214 - DNA, 23 bp, Homo sapiens
cactgtattacataaataaatta

SEQ ID NO: 447215 - DNA, 16 bp, Homo sapiens
cacttacactttatgc

SEQ ID NO: 447216 - DNA, 19 bp, Homo sapiens
cacttatttttttcccaag

SEQ ID NO: 447217 - DNA, 14 bp, Homo sapiens
cagaatcattgctt

SEQ ID NO: 447218 - DNA, 16 bp, Homo sapiens
cagaatgctgttttaa

SEQ ID NO: 447219 - DNA, 18 bp, Homo sapiens
cagaatgctgttttaaaa

SEQ ID NO: 447220 - DNA, 16 bp, Homo sapiens
cagacattaaataatc

SEQ ID NO: 447221 - DNA, 15 bp, Homo sapiens
cagagaattctctta

SEQ ID NO: 447222 - DNA, 18 bp, Homo sapiens
cagagacaataaaacatt

SEQ ID NO: 447223 - DNA, 14 bp, Homo sapiens
cagatcccatccat

SEQ ID NO: 447224 - DNA, 23 bp, Homo sapiens
cagatcccatccatcagctccct

SEQ ID NO: 447225 - DNA, 19 bp, Homo sapiens
cagatttgaactcttcaat

SEQ ID NO: 447226 - DNA, 13 bp, Homo sapiens
cagcaaaaccatt

SEQ ID NO: 447227 - DNA, 12 bp, Homo sapiens
cagcaaggggct

SEQ ID NO: 447228 - DNA, 16 bp, Homo sapiens
cagcaaggggctctgc

SEQ ID NO: 447229 - DNA, 17 bp, Homo sapiens
cagcaaggggctctgcc

SEQ ID NO: 447230 - DNA, 16 bp, Homo sapiens
cagcagcctctgaagt

SEQ ID NO: 447231 - DNA, 16 bp, Homo sapiens
cagccagtaaggcagc

SEQ ID NO: 447232 - DNA, 20 bp, Homo sapiens
cagcctctgaagttggacag

SEQ ID NO: 447233 - DNA, 21 bp, Homo sapiens
cagcctctgaagttggacagc

SEQ ID NO: 447234 - DNA, 14 bp, Homo sapiens
cagctatttctcat

SEQ ID NO: 447235 - DNA, 19 bp, Homo sapiens
caggacgatttcactgaca

SEQ ID NO: 447236 - DNA, 23 bp, Homo sapiens
caggcagagacaataaaacattc

SEQ ID NO: 447237 - DNA, 18 bp, Homo sapiens
caggggttccagcttccc

SEQ ID NO: 447238 - DNA, 19 bp, Homo sapiens
cagtaaggcagctctgtcg

SEQ ID NO: 447239 - DNA, 13 bp, Homo sapiens
cagtctgaagttt

SEQ ID NO: 447240 - DNA, 15 bp, Homo sapiens
cagtggactgtgtcc

SEQ ID NO: 447241 - DNA, 22 bp, Homo sapiens
cagtgggaggtgagaccacctc

SEQ ID NO: 447242 - DNA, 19 bp, Homo sapiens
cagtgtgaatatatggtct

SEQ ID NO: 447243 - DNA, 23 bp, Homo sapiens
cataattcacacattaataaaca

SEQ ID NO: 447244 - DNA, 22 bp, Homo sapiens
catacacccccacctcctgcaa

SEQ ID NO: 447245 - DNA, 11 bp, Homo sapiens
catcagctccc

SEQ ID NO: 447246 - DNA, 14 bp, Homo sapiens
catcagctcccttt

SEQ ID NO: 447247 - DNA, 16 bp, Homo sapiens
catccatcagctccct

SEQ ID NO: 447248 - DNA, 17 bp, Homo sapiens
catcggtgtccatttat

SEQ ID NO: 447249 - DNA, 17 bp, Homo sapiens
catctccaaaaacagta

SEQ ID NO: 447250 - DNA, 23 bp, Homo sapiens
catgactgcattttactgtacag

SEQ ID NO: 447251 - DNA, 19 bp, Homo sapiens
catgcctggacaaaccctt

SEQ ID NO: 447252 - DNA, 17 bp, Homo sapiens
catggaggtttgaagat

SEQ ID NO: 447253 - DNA, 15 bp, Homo sapiens
catgtgcctgcacca

SEQ ID NO: 447254 - DNA, 16 bp, Homo sapiens
catgtgcctgcaccag

SEQ ID NO: 447255 - DNA, 21 bp, Homo sapiens
catgtgcctgcaccaggagac

SEQ ID NO: 447256 - DNA, 22 bp, Homo sapiens
catgtgcctgcaccaggagaca

SEQ ID NO: 447257 - DNA, 23 bp, Homo sapiens
catgtgcctgcaccaggagacag

SEQ ID NO: 447258 - DNA, 22 bp, Homo sapiens
cattatcgccttttgacagctg

SEQ ID NO: 447259 - DNA, 17 bp, Homo sapiens
cattcttctctcccaca

SEQ ID NO: 447260 - DNA, 15 bp, Homo sapiens
catttactttggtca

SEQ ID NO: 447261 - DNA, 15 bp, Homo sapiens
catttggattggatg

SEQ ID NO: 447262 - DNA, 22 bp, Homo sapiens
cattttactgtacagattgctg

SEQ ID NO: 447263 - DNA, 17 bp, Homo sapiens
catttttactaaagcag

SEQ ID NO: 447264 - DNA, 18 bp, Homo sapiens
catttttactaaagcagt

SEQ ID NO: 447265 - DNA, 15 bp, Homo sapiens
ccaagctttcttcta

SEQ ID NO: 447266 - DNA, 23 bp, Homo sapiens
ccaagctttcttctacaaccaga

SEQ ID NO: 447267 - DNA, 13 bp, Homo sapiens
ccaagtcttcctg

SEQ ID NO: 447268 - DNA, 13 bp, Homo sapiens
ccaataaaaacat

SEQ ID NO: 447269 - DNA, 23 bp, Homo sapiens
ccaataaaaacattttgaagtgt

SEQ ID NO: 447270 - DNA, 20 bp, Homo sapiens
ccacaagttaaataaatcat

SEQ ID NO: 447271 - DNA, 17 bp, Homo sapiens
ccacagacagatcccat

SEQ ID NO: 447272 - DNA, 19 bp, Homo sapiens
ccaccctcgtggacacctg

SEQ ID NO: 447273 - DNA, 14 bp, Homo sapiens
ccacctctcaatat

SEQ ID NO: 447274 - DNA, 14 bp, Homo sapiens
ccacctgtctgtct

SEQ ID NO: 447275 - DNA, 16 bp, Homo sapiens
ccacctgtctgtctgt

SEQ ID NO: 447276 - DNA, 21 bp, Homo sapiens
ccaccttgcactattggactt

SEQ ID NO: 447277 - DNA, 10 bp, Homo sapiens
ccagagcccc

SEQ ID NO: 447278 - DNA, 23 bp, Homo sapiens
ccagagccccccacaatgatgat

SEQ ID NO: 447279 - DNA, 13 bp, Homo sapiens
ccaggcagagaca

SEQ ID NO: 447280 - DNA, 17 bp, Homo sapiens
ccagtaaggcagctctg

SEQ ID NO: 447281 - DNA, 21 bp, Homo sapiens
ccagtctgaagtttcatttat

SEQ ID NO: 447282 - DNA, 16 bp, Homo sapiens
ccatccatcagctccc

SEQ ID NO: 447283 - DNA, 21 bp, Homo sapiens
ccatgtcaccggtcagtgcct

SEQ ID NO: 447284 - DNA, 15 bp, Homo sapiens
ccatgtgcctgcacc

SEQ ID NO: 447285 - DNA, 18 bp, Homo sapiens
ccatgtgcctgcaccagg

SEQ ID NO: 447286 - DNA, 22 bp, Homo sapiens
ccattattctagggtcttactc

SEQ ID NO: 447287 - DNA, 10 bp, Homo sapiens
ccattgcttc

SEQ ID NO: 447288 - DNA, 13 bp, Homo sapiens
ccatttcttccca

SEQ ID NO: 447289 - DNA, 23 bp, Homo sapiens
cccaccctcgtggacacctgccc

SEQ ID NO: 447290 - DNA, 13 bp, Homo sapiens
cccacctcctgca

SEQ ID NO: 447291 - DNA, 20 bp, Homo sapiens
cccaggaggcggaggttgca

SEQ ID NO: 447292 - DNA, 19 bp, Homo sapiens
cccaggctggagtgcagtg

SEQ ID NO: 447293 - DNA, 14 bp, Homo sapiens
cccatccatcagct

SEQ ID NO: 447294 - DNA, 20 bp, Homo sapiens
cccatcggtgtccatttata

SEQ ID NO: 447295 - DNA, 22 bp, Homo sapiens
ccccaccctcgtggacacctgc

SEQ ID NO: 447296 - DNA, 16 bp, Homo sapiens
cctgccctgccctgcc

SEQ ID NO: 447297 - DNA, 20 bp, Homo sapiens
cctggtgcactggccccacc

SEQ ID NO: 447298 - DNA, 17 bp, Homo sapiens
cctgtataaccccacct

SEQ ID NO: 447299 - DNA, 21 bp, Homo sapiens
cctgtctgtctgtctgtccca

SEQ ID NO: 447300 - DNA, 12 bp, Homo sapiens
cctgtgtccaca

SEQ ID NO: 447301 - DNA, 14 bp, Homo sapiens
ccttccttcttgct

SEQ ID NO: 447302 - DNA, 20 bp, Homo sapiens
ccttgcactattggactttg

SEQ ID NO: 447303 - DNA, 19 bp, Homo sapiens
ccttgccaagctttcttct

SEQ ID NO: 447304 - DNA, 22 bp, Homo sapiens
ccttggttatcaaatacatctc

SEQ ID NO: 447305 - DNA, 20 bp, Homo sapiens
ccttttctttttcccttgaa

SEQ ID NO: 447306 - DNA, 11 bp, Homo sapiens
ccttttggaac

SEQ ID NO: 447307 - DNA, 18 bp, Homo sapiens
cgatgggggatgcttcat

SEQ ID NO: 447308 - DNA, 21 bp, Homo sapiens
cgatgggggatgcttcatgtg

SEQ ID NO: 447309 - DNA, 15 bp, Homo sapiens
cggcgtgtgcagtgc

SEQ ID NO: 447310 - DNA, 21 bp, Homo sapiens
cgggcggtcctactgctgtga

SEQ ID NO: 447311 - DNA, 13 bp, Homo sapiens
cggtcagtgcctt

SEQ ID NO: 447312 - DNA, 21 bp, Homo sapiens
cggtgtccatttatagaataa

SEQ ID NO: 447313 - DNA, 15 bp, Homo sapiens
cgtggacacctgccc

SEQ ID NO: 447314 - DNA, 18 bp, Homo sapiens
cgtggacacctgccctgc

SEQ ID NO: 447315 - DNA, 19 bp, Homo sapiens
cgtggacacctgccctgcc

SEQ ID NO: 447316 - DNA, 14 bp, Homo sapiens
ctaaagcagtgttt

SEQ ID NO: 447317 - DNA, 19 bp, Homo sapiens
ctaaggtcccataataaaa

SEQ ID NO: 447318 - DNA, 14 bp, Homo sapiens
ctaataatcataaa

SEQ ID NO: 447319 - DNA, 17 bp, Homo sapiens
ctacagacattaaataa

SEQ ID NO: 447320 - DNA, 22 bp, Homo sapiens
ctacagccagtaaggcagctct

SEQ ID NO: 447321 - DNA, 19 bp, Homo sapiens
ctacttctcacctgggcct

SEQ ID NO: 447322 - DNA, 17 bp, Homo sapiens
ctatttaaaagtataaa

SEQ ID NO: 447323 - DNA, 14 bp, Homo sapiens
ctcaaagaggcctt

SEQ ID NO: 447324 - DNA, 16 bp, Homo sapiens
ctcaagcactgacact

SEQ ID NO: 447325 - DNA, 17 bp, Homo sapiens
ctcaatatatttttgct

SEQ ID NO: 447326 - DNA, 20 bp, Homo sapiens
ctcatagccccggtgtgcgg

SEQ ID NO: 447327 - DNA, 23 bp, Homo sapiens
ctccagtgtgaatatatggtctg

SEQ ID NO: 447328 - DNA, 14 bp, Homo sapiens
ctcggcctcccaaa

SEQ ID NO: 447329 - DNA, 12 bp, Homo sapiens
ctcgtggacacc

SEQ ID NO: 447330 - DNA, 15 bp, Homo sapiens
ctcgtggacacctgc

SEQ ID NO: 447331 - DNA, 12 bp, Homo sapiens
ctctctcctgta

SEQ ID NO: 447332 - DNA, 17 bp, Homo sapiens
ctctgaagttggacagc

SEQ ID NO: 447333 - DNA, 17 bp, Homo sapiens
ctctgctggtcttcaat

SEQ ID NO: 447334 - DNA, 14 bp, Homo sapiens
ctcttcaatctctt

SEQ ID NO: 447335 - DNA, 12 bp, Homo sapiens
ctcttgcctgta

SEQ ID NO: 447336 - DNA, 15 bp, Homo sapiens
ctgaacttttcagga

SEQ ID NO: 447337 - DNA, 15 bp, Homo sapiens
ctgcaccaggagaca

SEQ ID NO: 447338 - DNA, 11 bp, Homo sapiens
ctgccacctgt

SEQ ID NO: 447339 - DNA, 17 bp, Homo sapiens
ctgccacctgtctgtct

SEQ ID NO: 447340 - DNA, 18 bp, Homo sapiens
ctgccacctgtctgtctg

SEQ ID NO: 447341 - DNA, 20 bp, Homo sapiens
ctgccctgccacctgtctgt

SEQ ID NO: 447342 - DNA, 14 bp, Homo sapiens
ctgccctgccctgc

SEQ ID NO: 447343 - DNA, 16 bp, Homo sapiens
ctgcgaactctcagga

SEQ ID NO: 447344 - DNA, 22 bp, Homo sapiens
ctgcgcccggccacattcagtt

SEQ ID NO: 447345 - DNA, 14 bp, Homo sapiens
ctgctgtcagacct

SEQ ID NO: 447346 - DNA, 20 bp, Homo sapiens
ctgctgtcagaccttcttcc

SEQ ID NO: 447347 - DNA, 23 bp, Homo sapiens
ctgctgtcagaccttcttccaca

SEQ ID NO: 447348 - DNA, 21 bp, Homo sapiens
ctggactggtggcccctgcct

SEQ ID NO: 447349 - DNA, 17 bp, Homo sapiens
ctggacttttgcagctt

SEQ ID NO: 447350 - DNA, 18 bp, Homo sapiens
ctggacttttgcagcttc

SEQ ID NO: 447351 - DNA, 20 bp, Homo sapiens
ctgtacagattgctgcttct

SEQ ID NO: 447352 - DNA, 20 bp, Homo sapiens
ctgtataatttaacagtgcc

SEQ ID NO: 447353 - DNA, 20 bp, Homo sapiens
ctgtattaactgaattctga

SEQ ID NO: 447354 - DNA, 15 bp, Homo sapiens
ctgtctgtctgtccc

SEQ ID NO: 447355 - DNA, 17 bp, Homo sapiens
ctgtctgtctgtcccaa

SEQ ID NO: 447356 - DNA, 20 bp, Homo sapiens
ctgtgccccatcagcagctt

SEQ ID NO: 447357 - DNA, 21 bp, Homo sapiens
ctgtgggttttaacattttta

SEQ ID NO: 447358 - DNA, 22 bp, Homo sapiens
ctgtgtccacatctaacaaagt

SEQ ID NO: 447359 - DNA, 12 bp, Homo sapiens
ctgttcattgta

SEQ ID NO: 447360 - DNA, 13 bp, Homo sapiens
ctgttcattgtaa

SEQ ID NO: 447361 - DNA, 14 bp, Homo sapiens
ctgttcattgtaag

SEQ ID NO: 447362 - DNA, 14 bp, Homo sapiens
ctgttctggcctca

SEQ ID NO: 447363 - DNA, 24 bp, Homo sapiens
ctgttttaaaaacaaagaaataaa

SEQ ID NO: 447364 - DNA, 19 bp, Homo sapiens
cttcaatttgtataaaatg

SEQ ID NO: 447365 - DNA, 22 bp, Homo sapiens
cttccttccaagtcttcctgac

SEQ ID NO: 447366 - DNA, 13 bp, Homo sapiens
cttctattaaatg

SEQ ID NO: 447367 - DNA, 21 bp, Homo sapiens
cttctcaaaagattgttttat

SEQ ID NO: 447368 - DNA, 23 bp, Homo sapiens
cttctttgaatttcctatctgta

SEQ ID NO: 447369 - DNA, 16 bp, Homo sapiens
cttgaggacacatgtc

SEQ ID NO: 447370 - DNA, 17 bp, Homo sapiens
cttgaggacacatgtcc

SEQ ID NO: 447371 - DNA, 18 bp, Homo sapiens
cttgaggacacatgtcca

SEQ ID NO: 447372 - DNA, 15 bp, Homo sapiens
cttgatgtgttatct

SEQ ID NO: 447373 - DNA, 18 bp, Homo sapiens
cttgcactattggacttt

SEQ ID NO: 447374 - DNA, 22 bp, Homo sapiens
cttgccccagatgcctcctctg

SEQ ID NO: 447375 - DNA, 13 bp, Homo sapiens
cttgcttgctttt

SEQ ID NO: 447376 - DNA, 16 bp, Homo sapiens
cttggtaaattgtaaa

SEQ ID NO: 447377 - DNA, 17 bp, Homo sapiens
ctttaaccagtctgaag

SEQ ID NO: 447378 - DNA, 13 bp, Homo sapiens
ctttataattcta

SEQ ID NO: 447379 - DNA, 21 bp, Homo sapiens
ctttcttctacaaccagagcc

SEQ ID NO: 447380 - DNA, 19 bp, Homo sapiens
ctttgaatttcctatctgt

SEQ ID NO: 447381 - DNA, 20 bp, Homo sapiens
ctttgactataacaaaatct

SEQ ID NO: 447382 - DNA, 11 bp, Homo sapiens
cttttaaaatg

SEQ ID NO: 447383 - DNA, 17 bp, Homo sapiens
cttttaaaatgaaatgt

SEQ ID NO: 447384 - DNA, 21 bp, Homo sapiens
cttttcatctccagtgtgaat

SEQ ID NO: 447385 - DNA, 12 bp, Homo sapiens
cttttgcagctt

SEQ ID NO: 447386 - DNA, 21 bp, Homo sapiens
cttttgcagcttccttccaag

SEQ ID NO: 447387 - DNA, 13 bp, Homo sapiens
gaaatataattga

SEQ ID NO: 447388 - DNA, 13 bp, Homo sapiens
gaacttgaggaca

SEQ ID NO: 447389 - DNA, 15 bp, Homo sapiens
gaagtccaggcagag

SEQ ID NO: 447390 - DNA, 13 bp, Homo sapiens
gaagttggacagc

SEQ ID NO: 447391 - DNA, 23 bp, Homo sapiens
gaagttggacagcaaaaccattg

SEQ ID NO: 447392 - DNA, 21 bp, Homo sapiens
gaagtttcatttatgatacaa

SEQ ID NO: 447393 - DNA, 14 bp, Homo sapiens
gacaaaggtgattt

SEQ ID NO: 447394 - DNA, 10 bp, Homo sapiens
gacacctgcc

SEQ ID NO: 447395 - DNA, 17 bp, Homo sapiens
gacagagaaggcagcag

SEQ ID NO: 447396 - DNA, 21 bp, Homo sapiens
gacagcaaaaccattgcttca

SEQ ID NO: 447397 - DNA, 16 bp, Homo sapiens
gaccacctctcaatat

SEQ ID NO: 447398 - DNA, 21 bp, Homo sapiens
gacgagggatgggatttcatg

SEQ ID NO: 447399 - DNA, 12 bp, Homo sapiens
gagaccacctct

SEQ ID NO: 447400 - DNA, 21 bp, Homo sapiens
gaggaaggcatgcctggacaa

SEQ ID NO: 447401 - DNA, 11 bp, Homo sapiens
gaggacacatg

SEQ ID NO: 447402 - DNA, 12 bp, Homo sapiens
gaggacacatgt

SEQ ID NO: 447403 - DNA, 13 bp, Homo sapiens
gaggacacatgtc

SEQ ID NO: 447404 - DNA, 14 bp, Homo sapiens
gaggggtgctctgc

SEQ ID NO: 447405 - DNA, 19 bp, Homo sapiens
gatcttctttataattcta

SEQ ID NO: 447406 - DNA, 17 bp, Homo sapiens
gatgattaaacacctga

SEQ ID NO: 447407 - DNA, 19 bp, Homo sapiens
gatgattaaacacctgaca

SEQ ID NO: 447408 - DNA, 14 bp, Homo sapiens
gatgcctgaacttg

SEQ ID NO: 447409 - DNA, 19 bp, Homo sapiens
gatgcttcatgtgaacgtg

SEQ ID NO: 447410 - DNA, 15 bp, Homo sapiens
gatgggggatgcttc

SEQ ID NO: 447411 - DNA, 19 bp, Homo sapiens
gattaatttaattcatgta

SEQ ID NO: 447412 - DNA, 12 bp, Homo sapiens
gattattggaaa

SEQ ID NO: 447413 - DNA, 18 bp, Homo sapiens
gattcatatttacttctt

SEQ ID NO: 447414 - DNA, 17 bp, Homo sapiens
gattcccggctggactt

SEQ ID NO: 447415 - DNA, 18 bp, Homo sapiens
gattcccggctggacttt

SEQ ID NO: 447416 - DNA, 21 bp, Homo sapiens
gattgtacagaatcattgctt

SEQ ID NO: 447417 - DNA, 22 bp, Homo sapiens
gatttcatgtaaccaagagtat

SEQ ID NO: 447418 - DNA, 16 bp, Homo sapiens
gcaaaaccattgcttc

SEQ ID NO: 447419 - DNA, 18 bp, Homo sapiens
gcaaaaccattgcttcac

SEQ ID NO: 447420 - DNA, 12 bp, Homo sapiens
gcaaattagtaa

SEQ ID NO: 447421 - DNA, 13 bp, Homo sapiens
gcaaattagtaat

SEQ ID NO: 447422 - DNA, 13 bp, Homo sapiens
gcaccaggagaca

SEQ ID NO: 447423 - DNA, 14 bp, Homo sapiens
gcactattggactt

SEQ ID NO: 447424 - DNA, 19 bp, Homo sapiens
gcagagacaataaaacatt

SEQ ID NO: 447425 - DNA, 16 bp, Homo sapiens
gcaggatgctcagtga

SEQ ID NO: 447426 - DNA, 17 bp, Homo sapiens
gtgcctgcaccaggaga

SEQ ID NO: 447427 - DNA, 19 bp, Homo sapiens
gtgcctgcaccaggagaca

SEQ ID NO: 447428 - DNA, 21 bp, Homo sapiens
gtgcctgcaccaggagacaga

SEQ ID NO: 447429 - DNA, 13 bp, Homo sapiens
gtggacacctgcc

SEQ ID NO: 447430 - DNA, 21 bp, Homo sapiens
gtgggaagaaacaaacccgtt

SEQ ID NO: 447431 - DNA, 17 bp, Homo sapiens
gtgggaggtgagaccac

SEQ ID NO: 447432 - DNA, 21 bp, Homo sapiens
gtgggcaggggttccagcttc

SEQ ID NO: 447433 - DNA, 14 bp, Homo sapiens
gtgtactgtaaaga

SEQ ID NO: 447434 - DNA, 14 bp, Homo sapiens
gttatcaaatacat

SEQ ID NO: 447435 - DNA, 17 bp, Homo sapiens
gttctggcctcagacca

SEQ ID NO: 447436 - DNA, 23 bp, Homo sapiens
gttctggtatgaacttgaggaca

SEQ ID NO: 447437 - DNA, 19 bp, Homo sapiens
gttggacagcaaaaccatt

SEQ ID NO: 447438 - DNA, 18 bp, Homo sapiens
taaaaacattttgaagtg

SEQ ID NO: 447439 - DNA, 19 bp, Homo sapiens
taaaaacattttgaagtgt

SEQ ID NO: 447440 - DNA, 11 bp, Homo sapiens
taaaacattcc

SEQ ID NO: 447441 - DNA, 16 bp, Homo sapiens
taaaatggtgttttca

SEQ ID NO: 447442 - DNA, 21 bp, Homo sapiens
taaaatgtcagtgtttgggaa

SEQ ID NO: 447443 - DNA, 13 bp, Homo sapiens
taaacacctgaca

SEQ ID NO: 447444 - DNA, 14 bp, Homo sapiens
taaacacctgacac

SEQ ID NO: 447445 - DNA, 18 bp, Homo sapiens
taaacagctaataatgaa

SEQ ID NO: 447446 - DNA, 19 bp, Homo sapiens
taaaccaaacggaactctt

SEQ ID NO: 447447 - DNA, 12 bp, Homo sapiens
taaataaaataa

SEQ ID NO: 447448 - DNA, 14 bp, Homo sapiens
taaatccaataaaa

SEQ ID NO: 447449 - DNA, 15 bp, Homo sapiens
taaattaaataaaat

SEQ ID NO: 447450 - DNA, 21 bp, Homo sapiens
taactaaggtcccataataaa

SEQ ID NO: 447451 - DNA, 22 bp, Homo sapiens
taactctatagttattgtttta

SEQ ID NO: 447452 - DNA, 20 bp, Homo sapiens
taagatgtgtcttcaatttg

SEQ ID NO: 447453 - DNA, 18 bp, Homo sapiens
taaggcagctctgtcgtg

SEQ ID NO: 447454 - DNA, 20 bp, Homo sapiens
taagtatttcagatgcttta

SEQ ID NO: 447455 - DNA, 22 bp, Homo sapiens
taatgtgggaagaaacaaaccc

SEQ ID NO: 447456 - DNA, 13 bp, Homo sapiens
tacaaccagagcc

SEQ ID NO: 447457 - DNA, 16 bp, Homo sapiens
tacactgtattacata

SEQ ID NO: 447458 - DNA, 15 bp, Homo sapiens
tacagctatttctca

SEQ ID NO: 447459 - DNA, 14 bp, Homo sapiens
tacatatgctttaa

SEQ ID NO: 447460 - DNA, 20 bp, Homo sapiens
tacccatcggtgtccattta

SEQ ID NO: 447461 - DNA, 12 bp, Homo sapiens
tactaaagcagt

SEQ ID NO: 447462 - DNA, 16 bp, Homo sapiens
tactaaagcagtgttt

SEQ ID NO: 447463 - DNA, 15 bp, Homo sapiens
tacttcttatacatt

SEQ ID NO: 447464 - DNA, 16 bp, Homo sapiens
tacttcttatacattt

SEQ ID NO: 447465 - DNA, 17 bp, Homo sapiens
tactttacatatgcttt

SEQ ID NO: 447466 - DNA, 21 bp, Homo sapiens
tagctctaggagggctggcaa

SEQ ID NO: 447467 - DNA, 21 bp, Homo sapiens
taggacatataccttctcaaa

SEQ ID NO: 447468 - DNA, 20 bp, Homo sapiens
tataatgaatgaaacatttt

SEQ ID NO: 447469 - DNA, 17 bp, Homo sapiens
tataattacaatgcaca

SEQ ID NO: 447470 - DNA, 15 bp, Homo sapiens
tataatttaacagtg

SEQ ID NO: 447471 - DNA, 21 bp, Homo sapiens
tatacacttacactttatgca

SEQ ID NO: 447472 - DNA, 22 bp, Homo sapiens
tatacacttacactttatgcac

SEQ ID NO: 447473 - DNA, 14 bp, Homo sapiens
tatacatttgataa

SEQ ID NO: 447474 - DNA, 22 bp, Homo sapiens
tatagaataatgtgggaagaaa

SEQ ID NO: 447475 - DNA, 17 bp, Homo sapiens
tatagatttgtatttta

SEQ ID NO: 447476 - DNA, 12 bp, Homo sapiens
tatccttttcta

SEQ ID NO: 447477 - DNA, 16 bp, Homo sapiens
tatgaacttgaggaca

SEQ ID NO: 447478 - DNA, 19 bp, Homo sapiens
tatgaacttgaggacacat

SEQ ID NO: 447479 - DNA, 22 bp, Homo sapiens
tatgaacttgaggacacatgtc

SEQ ID NO: 447480 - DNA, 17 bp, Homo sapiens
tattaaatgtaagtcgt

SEQ ID NO: 447481 - DNA, 13 bp, Homo sapiens
tattacataaata

SEQ ID NO: 447482 - DNA, 14 bp, Homo sapiens
tattacataaataa

SEQ ID NO: 447483 - DNA, 14 bp, Homo sapiens
tattattaaatgta

SEQ ID NO: 447484 - DNA, 14 bp, Homo sapiens
tattcaataaagct

SEQ ID NO: 447485 - DNA, 22 bp, Homo sapiens
tattccatttttactaaagcag

SEQ ID NO: 447486 - DNA, 18 bp, Homo sapiens
tattgttttatgttctag

SEQ ID NO: 447487 - DNA, 14 bp, Homo sapiens
tgttttatgttcta

SEQ ID NO: 447488 - DNA, 20 bp, Homo sapiens
tgttttcatgtaaataaata

SEQ ID NO: 447489 - DNA, 11 bp, Homo sapiens
ttaaacacctg

SEQ ID NO: 447490 - DNA, 14 bp, Homo sapiens
ttaaacacctgaca

SEQ ID NO: 447491 - DNA, 18 bp, Homo sapiens
ttaaacacctgacacatc

SEQ ID NO: 447492 - DNA, 15 bp, Homo sapiens
ttaaataaaataacc

SEQ ID NO: 447493 - DNA, 13 bp, Homo sapiens
ttaaataaatcat

SEQ ID NO: 447494 - DNA, 15 bp, Homo sapiens
ttaaatccaataaaa

SEQ ID NO: 447495 - DNA, 20 bp, Homo sapiens
ttaacatttatatatttcca

SEQ ID NO: 447496 - DNA, 16 bp, Homo sapiens
ttaaccagtctgaagt

SEQ ID NO: 447497 - DNA, 21 bp, Homo sapiens
ttaaccagtctgaagtttcat

SEQ ID NO: 447498 - DNA, 15 bp, Homo sapiens
ttaagtaaaaaatat

SEQ ID NO: 447499 - DNA, 17 bp, Homo sapiens
ttaatccacacatcagt

SEQ ID NO: 447500 - DNA, 23 bp, Homo sapiens
ttacttcttatacatttgataaa

SEQ ID NO: 447501 - DNA, 15 bp, Homo sapiens
ttataatgaatgaaa

SEQ ID NO: 447502 - DNA, 23 bp, Homo sapiens
ttcactacccatcggtgtccatt

SEQ ID NO: 447503 - DNA, 17 bp, Homo sapiens
agatataatgttcacta

SEQ ID NO: 447504 - DNA, 12 bp, Homo sapiens
agatataccaag

SEQ ID NO: 447505 - DNA, 21 bp, Homo sapiens
agatcccatccatcagctccc

SEQ ID NO: 447506 - DNA, 22 bp, Homo sapiens
agatcccatccatcagctccct

SEQ ID NO: 447507 - DNA, 16 bp, Homo sapiens
agatgccgcatttgga

SEQ ID NO: 447508 - DNA, 17 bp, Homo sapiens
agattcaattttcttta

SEQ ID NO: 447509 - DNA, 16 bp, Homo sapiens
agattcatatttactt

SEQ ID NO: 447510 - DNA, 19 bp, Homo sapiens
agattcccggctggacttt

SEQ ID NO: 447511 - DNA, 16 bp, Homo sapiens
agcaaaaccattgctt

SEQ ID NO: 447512 - DNA, 18 bp, Homo sapiens
agcaaaaccattgcttca

SEQ ID NO: 447513 - DNA, 22 bp, Homo sapiens
agcaaacctcagtcatattctt

SEQ ID NO: 447514 - DNA, 21 bp, Homo sapiens
agcaaatgagatgtatgccca

SEQ ID NO: 447515 - DNA, 14 bp, Homo sapiens
agcaaattagtaat

SEQ ID NO: 447516 - DNA, 16 bp, Homo sapiens
agcaaggggctctgcc

SEQ ID NO: 447517 - DNA, 14 bp, Homo sapiens
agcagcctctgaag

SEQ ID NO: 447518 - DNA, 18 bp, Homo sapiens
agcaggcaccagcagcag

SEQ ID NO: 447519 - DNA, 17 bp, Homo sapiens
agcagtgagcttctatt

SEQ ID NO: 447520 - DNA, 12 bp, Homo sapiens
agcagtgttttc

SEQ ID NO: 447521 - DNA, 19 bp, Homo sapiens
agcctctgaagttggacag

SEQ ID NO: 447522 - DNA, 15 bp, Homo sapiens
agctttcttctacaa

SEQ ID NO: 447523 - DNA, 20 bp, Homo sapiens
agctttcttctacaaccaga

SEQ ID NO: 447524 - DNA, 22 bp, Homo sapiens
agctttcttctacaaccagagc

SEQ ID NO: 447525 - DNA, 11 bp, Homo sapiens
aggagtagaat

SEQ ID NO: 447526 - DNA, 17 bp, Homo sapiens
aggagtgactttgcagg

SEQ ID NO: 447527 - DNA, 20 bp, Homo sapiens
aggcagagacaataaaacat

SEQ ID NO: 447528 - DNA, 16 bp, Homo sapiens
aggcagattcaatttt

SEQ ID NO: 447529 - DNA, 18 bp, Homo sapiens
aggcagttgtcctgacct

SEQ ID NO: 447530 - DNA, 17 bp, Homo sapiens
agggatgggatttcatg

SEQ ID NO: 447531 - DNA, 24 bp, Homo sapiens
agggatgggatttcatgtaaccaa

SEQ ID NO: 447532 - DNA, 19 bp, Homo sapiens
agggcccacccatgtcacc

SEQ ID NO: 447533 - DNA, 13 bp, Homo sapiens
agggttataataa

SEQ ID NO: 447534 - DNA, 20 bp, Homo sapiens
agtattccatttttactaaa

SEQ ID NO: 447535 - DNA, 22 bp, Homo sapiens
agtattccatttttactaaagc

SEQ ID NO: 447536 - DNA, 22 bp, Homo sapiens
agtcaagattcccggctggact

SEQ ID NO: 447537 - DNA, 22 bp, Homo sapiens
agtcctactttacatatgcttt

SEQ ID NO: 447538 - DNA, 14 bp, Homo sapiens
agtgccttttggaa

SEQ ID NO: 447539 - DNA, 15 bp, Homo sapiens
agtgccttttggaac

SEQ ID NO: 447540 - DNA, 17 bp, Homo sapiens
agtgttttcacctcata

SEQ ID NO: 447541 - DNA, 21 bp, Homo sapiens
agttattgttttatgttctag

SEQ ID NO: 447542 - DNA, 16 bp, Homo sapiens
agttcagctgcttctc

SEQ ID NO: 447543 - DNA, 20 bp, Homo sapiens
agttggacagcaaaaccatt

SEQ ID NO: 447544 - DNA, 13 bp, Homo sapiens
agtttcatttatg

SEQ ID NO: 447545 - DNA, 21 bp, Homo sapiens
agtttcatttatgatacaaaa

SEQ ID NO: 447546 - DNA, 16 bp, Homo sapiens
ataaactatattctgt

SEQ ID NO: 447547 - DNA, 21 bp, Homo sapiens
ataaccccaccttgccaagct

SEQ ID NO: 447548 - DNA, 17 bp, Homo sapiens
ataagttaacttccaat

SEQ ID NO: 447549 - DNA, 22 bp, Homo sapiens
ataagttaacttccaatttaca

SEQ ID NO: 447550 - DNA, 17 bp, Homo sapiens
ataatgtgggaagaaac

SEQ ID NO: 447551 - DNA, 13 bp, Homo sapiens
atagaaacagact

SEQ ID NO: 447552 - DNA, 18 bp, Homo sapiens
atagatttgtattttaaa

SEQ ID NO: 447553 - DNA, 19 bp, Homo sapiens
atagccctgcaaaaattca

SEQ ID NO: 447554 - DNA, 22 bp, Homo sapiens
atagttattgttttatgttcta

SEQ ID NO: 447555 - DNA, 21 bp, Homo sapiens
atatatggtctgtgtgtctga

SEQ ID NO: 447556 - DNA, 19 bp, Homo sapiens
atatgcttatacacttaca

SEQ ID NO: 447557 - DNA, 13 bp, Homo sapiens
atattcaataaag

SEQ ID NO: 447558 - DNA, 19 bp, Homo sapiens
atatttacttcttatacat

SEQ ID NO: 447559 - DNA, 13 bp, Homo sapiens
atatttgtcattt

SEQ ID NO: 447560 - DNA, 15 bp, Homo sapiens
atcactatgcatttt

SEQ ID NO: 447561 - DNA, 11 bp, Homo sapiens
atcattgctta

SEQ ID NO: 447562 - DNA, 14 bp, Homo sapiens
atccatcagctccc

SEQ ID NO: 447563 - DNA, 21 bp, Homo sapiens
atccatcagctcccttttctt

SEQ ID NO: 447564 - DNA, 19 bp, Homo sapiens
atcccatccatcagctccc

SEQ ID NO: 447565 - DNA, 20 bp, Homo sapiens
atcgatgggggatgcttcat

SEQ ID NO: 447566 - DNA, 13 bp, Homo sapiens
atctccaaaaaca

SEQ ID NO: 447567 - DNA, 18 bp, Homo sapiens
atctgatgccttcatctg

SEQ ID NO: 447568 - DNA, 13 bp, Homo sapiens
atcttacatctgc

SEQ ID NO: 447569 - DNA, 17 bp, Homo sapiens
atcttctttataattct

SEQ ID NO: 447570 - DNA, 14 bp, Homo sapiens
atgaaatgactgtc

SEQ ID NO: 447571 - DNA, 15 bp, Homo sapiens
atgaacttgaggaca

SEQ ID NO: 447572 - DNA, 19 bp, Homo sapiens
atgaacttgaggacacatg

SEQ ID NO: 447573 - DNA, 13 bp, Homo sapiens
atgactgcatttt

SEQ ID NO: 447574 - DNA, 21 bp, Homo sapiens
atgagatgtatgcccaaagac

SEQ ID NO: 447575 - DNA, 16 bp, Homo sapiens
atgatgattaaacacc

SEQ ID NO: 447576 - DNA, 19 bp, Homo sapiens
atgatgattaaacacctga

SEQ ID NO: 447577 - DNA, 15 bp, Homo sapiens
atgattaaacacctg

SEQ ID NO: 447578 - DNA, 14 bp, Homo sapiens
atgcagggtattgc

SEQ ID NO: 447579 - DNA, 20 bp, Homo sapiens
atgcatgatgtaaaaaatac

SEQ ID NO: 447580 - DNA, 15 bp, Homo sapiens
atgcctgaacttgaa

SEQ ID NO: 447581 - DNA, 12 bp, Homo sapiens
atgcttcatgtg

SEQ ID NO: 447582 - DNA, 14 bp, Homo sapiens
atggacatgatctt

SEQ ID NO: 447583 - DNA, 15 bp, Homo sapiens
atggatgtttcttct

SEQ ID NO: 447584 - DNA, 16 bp, Homo sapiens
atggatgtttcttctt

SEQ ID NO: 447585 - DNA, 14 bp, Homo sapiens
atgtaaaaaataca

SEQ ID NO: 447586 - DNA, 18 bp, Homo sapiens
atgtcaccggtcagtgcc

SEQ ID NO: 447587 - DNA, 17 bp, Homo sapiens
atgttagaagtccaggc

SEQ ID NO: 447588 - DNA, 16 bp, Homo sapiens
atgttgaagtcaaatt

SEQ ID NO: 447589 - DNA, 13 bp, Homo sapiens
attaaacacctga

SEQ ID NO: 447590 - DNA, 14 bp, Homo sapiens
attaagtaaaaaat

SEQ ID NO: 447591 - DNA, 16 bp, Homo sapiens
attaagtaaaaaatat

SEQ ID NO: 447592 - DNA, 16 bp, Homo sapiens
attaatcgtgtcttca

SEQ ID NO: 447593 - DNA, 14 bp, Homo sapiens
caccagcagcagaa

SEQ ID NO: 447594 - DNA, 15 bp, Homo sapiens
caccggtcagtgcct

SEQ ID NO: 447595 - DNA, 13 bp, Homo sapiens
cacctctcaatat

SEQ ID NO: 447596 - DNA, 23 bp, Homo sapiens
cacctctcaatattcaataaagc

SEQ ID NO: 447597 - DNA, 11 bp, Homo sapiens
cacctgacaca

SEQ ID NO: 447598 - DNA, 13 bp, Homo sapiens
cacctgacacatc

SEQ ID NO: 447599 - DNA, 16 bp, Homo sapiens
cacctgccctgccctg

SEQ ID NO: 447600 - DNA, 17 bp, Homo sapiens
cacctgccctgccctgc

SEQ ID NO: 447601 - DNA, 13 bp, Homo sapiens
cacctgtctgtct

SEQ ID NO: 447602 - DNA, 12 bp, Homo sapiens
cactatgcattt

SEQ ID NO: 447603 - DNA, 15 bp, Homo sapiens
cactatgcattttaa

SEQ ID NO: 447604 - DNA, 14 bp, Homo sapiens
cactattggacttt

SEQ ID NO: 447605 - DNA, 13 bp, Homo sapiens
cactggccccacc

SEQ ID NO: 447606 - DNA, 14 bp, Homo sapiens
cactggccccaccc

SEQ ID NO: 447607 - DNA, 16 bp, Homo sapiens
cactggccccaccctc

SEQ ID NO: 447608 - DNA, 18 bp, Homo sapiens
cactgtattacataaata

SEQ ID NO: 447609 - DNA, 12 bp, Homo sapiens
cagaatgctgtt

SEQ ID NO: 447610 - DNA, 13 bp, Homo sapiens
cagacagatccca

SEQ ID NO: 447611 - DNA, 15 bp, Homo sapiens
cagagaaggcagcag

SEQ ID NO: 447612 - DNA, 16 bp, Homo sapiens
cagagaaggcagcagg

SEQ ID NO: 447613 - DNA, 15 bp, Homo sapiens
cagagccccccacaa

SEQ ID NO: 447614 - DNA, 18 bp, Homo sapiens
cagatgcctcctctgtcc

SEQ ID NO: 447615 - DNA, 12 bp, Homo sapiens
cagcaaaaccat

SEQ ID NO: 447616 - DNA, 14 bp, Homo sapiens
cagcaaggggctct

SEQ ID NO: 447617 - DNA, 20 bp, Homo sapiens
cagccagtaaggcagctctg

SEQ ID NO: 447618 - DNA, 23 bp, Homo sapiens
cagccagtaaggcagctctgtcg

SEQ ID NO: 447619 - DNA, 18 bp, Homo sapiens
cagctctgctatgagtgt

SEQ ID NO: 447620 - DNA, 11 bp, Homo sapiens
cagctgcttct

SEQ ID NO: 447621 - DNA, 17 bp, Homo sapiens
caggcagagacaataaa

SEQ ID NO: 447622 - DNA, 21 bp, Homo sapiens
caggcagagacaataaaacat

SEQ ID NO: 447623 - DNA, 17 bp, Homo sapiens
caggggttccagcttcc

SEQ ID NO: 447624 - DNA, 12 bp, Homo sapiens
cagtaaaaataa

SEQ ID NO: 447625 - DNA, 14 bp, Homo sapiens
catcaacatcttgg

SEQ ID NO: 447626 - DNA, 12 bp, Homo sapiens
catcagctccct

SEQ ID NO: 447627 - DNA, 20 bp, Homo sapiens
catctccaaaaacagtaaaa

SEQ ID NO: 447628 - DNA, 16 bp, Homo sapiens
catggatgtttcttct

SEQ ID NO: 447629 - DNA, 23 bp, Homo sapiens
catgtcaccggtcagtgcctttt

SEQ ID NO: 447630 - DNA, 17 bp, Homo sapiens
catgtgcctgcaccagg

SEQ ID NO: 447631 - DNA, 18 bp, Homo sapiens
catgtgcctgcaccagga

SEQ ID NO: 447632 - DNA, 12 bp, Homo sapiens
catgtgcctgta

SEQ ID NO: 447633 - DNA, 22 bp, Homo sapiens
cattaatgtgaagcaaaacaca

SEQ ID NO: 447634 - DNA, 20 bp, Homo sapiens
cattatcgccttttgacagc

SEQ ID NO: 447635 - DNA, 15 bp, Homo sapiens
cattcttctctccca

SEQ ID NO: 447636 - DNA, 19 bp, Homo sapiens
cattctttcctaaatataa

SEQ ID NO: 447637 - DNA, 12 bp, Homo sapiens
catttcttccca

SEQ ID NO: 447638 - DNA, 18 bp, Homo sapiens
cattttaaagttaaacat

SEQ ID NO: 447639 - DNA, 19 bp, Homo sapiens
catttttactaaagcagtg

SEQ ID NO: 447640 - DNA, 21 bp, Homo sapiens
catttttactaaagcagtgtt

SEQ ID NO: 447641 - DNA, 13 bp, Homo sapiens
ccaataattctgt

SEQ ID NO: 447642 - DNA, 19 bp, Homo sapiens
ccaattaagtcctacttta

SEQ ID NO: 447643 - DNA, 15 bp, Homo sapiens
ccacaagttaaataa

SEQ ID NO: 447644 - DNA, 21 bp, Homo sapiens
ccacaatgatgattaaacacc

SEQ ID NO: 447645 - DNA, 15 bp, Homo sapiens
ccacagacagatccc

SEQ ID NO: 447646 - DNA, 20 bp, Homo sapiens
ccacagacagatcccatcca

SEQ ID NO: 447647 - DNA, 17 bp, Homo sapiens
ccacagcagcctctgaa

SEQ ID NO: 447648 - DNA, 14 bp, Homo sapiens
ccacccatgtcacc

SEQ ID NO: 447649 - DNA, 18 bp, Homo sapiens
ccaccctcgtggacacct

SEQ ID NO: 447650 - DNA, 22 bp, Homo sapiens
ccaccctcgtggacacctgccc

SEQ ID NO: 447651 - DNA, 22 bp, Homo sapiens
ccacctcccgggttcacgccat

SEQ ID NO: 447652 - DNA, 13 bp, Homo sapiens
ccacctctcaata

SEQ ID NO: 447653 - DNA, 19 bp, Homo sapiens
ccaccttgccaagctttct

SEQ ID NO: 447654 - DNA, 14 bp, Homo sapiens
ccagagccccccac

SEQ ID NO: 447655 - DNA, 16 bp, Homo sapiens
ccagagccccccacaa

SEQ ID NO: 447656 - DNA, 12 bp, Homo sapiens
ccagcagcagaa

SEQ ID NO: 447657 - DNA, 10 bp, Homo sapiens
ccagcttccc

SEQ ID NO: 447658 - DNA, 23 bp, Homo sapiens
ccaggcagagacaataaaacatt

SEQ ID NO: 447659 - DNA, 20 bp, Homo sapiens
ccagtaaggcagctctgtcg

SEQ ID NO: 447660 - DNA, 15 bp, Homo sapiens
ccagtctgaacctga

SEQ ID NO: 447661 - DNA, 12 bp, Homo sapiens
ccagtctgaagt

SEQ ID NO: 447662 - DNA, 20 bp, Homo sapiens
ccagtgggaggtgagaccac

SEQ ID NO: 447663 - DNA, 23 bp, Homo sapiens
ccagtgggaggtgagaccacctc

SEQ ID NO: 447664 - DNA, 13 bp, Homo sapiens
ccatcagctccct

SEQ ID NO: 447665 - DNA, 17 bp, Homo sapiens
ccatccatcagctccct

SEQ ID NO: 447666 - DNA, 17 bp, Homo sapiens
ccatgactgcattttac

SEQ ID NO: 447667 - DNA, 21 bp, Homo sapiens
ccatggatgtttcttctttga

SEQ ID NO: 447668 - DNA, 20 bp, Homo sapiens
ccatgtcaccggtcagtgcc

SEQ ID NO: 447669 - DNA, 14 bp, Homo sapiens
ccattgcttcacta

SEQ ID NO: 447670 - DNA, 15 bp, Homo sapiens
ccatttcttcccaag

SEQ ID NO: 447671 - DNA, 18 bp, Homo sapiens
ccatttttactaaagcag

SEQ ID NO: 447672 - DNA, 23 bp, Homo sapiens
ccatttttactaaagcagtgttt

SEQ ID NO: 447673 - DNA, 22 bp, Homo sapiens
cccaatattaagtaaaaaatat

SEQ ID NO: 447674 - DNA, 14 bp, Homo sapiens
cccacaatgatgat

SEQ ID NO: 447675 - DNA, 22 bp, Homo sapiens
cccaccctcgtggacacctgcc

SEQ ID NO: 447676 - DNA, 23 bp, Homo sapiens
cttgaactgttctggcctcagac

SEQ ID NO: 447677 - DNA, 22 bp, Homo sapiens
cttgacgcgtggtcacaggacg

SEQ ID NO: 447678 - DNA, 12 bp, Homo sapiens
cttgaggacaca

SEQ ID NO: 447679 - DNA, 15 bp, Homo sapiens
cttgaggacacatgt

SEQ ID NO: 447680 - DNA, 20 bp, Homo sapiens
cttggtaaaaactgcagtgt

SEQ ID NO: 447681 - DNA, 16 bp, Homo sapiens
cttgttaagatagtta

SEQ ID NO: 447682 - DNA, 19 bp, Homo sapiens
ctttataattctactttga

SEQ ID NO: 447683 - DNA, 22 bp, Homo sapiens
ctttcttctacaaccagagccc

SEQ ID NO: 447684 - DNA, 23 bp, Homo sapiens
ctttggcaattcttcttctcaag

SEQ ID NO: 447685 - DNA, 22 bp, Homo sapiens
ctttgtactgtagctaaatgta

SEQ ID NO: 447686 - DNA, 23 bp, Homo sapiens
ctttgtatgatgaaaagaatgtg

SEQ ID NO: 447687 - DNA, 20 bp, Homo sapiens
cttttaagatgtgtcttcaa

SEQ ID NO: 447688 - DNA, 22 bp, Homo sapiens
cttttcaggaggtactgtgagg

SEQ ID NO: 447689 - DNA, 13 bp, Homo sapiens
cttttctttttcc

SEQ ID NO: 447690 - DNA, 19 bp, Homo sapiens
cttttctttttcccttgaa

SEQ ID NO: 447691 - DNA, 13 bp, Homo sapiens
cttttgcagcttc

SEQ ID NO: 447692 - DNA, 20 bp, Homo sapiens
ctttttttttttgagacagt

SEQ ID NO: 447693 - DNA, 19 bp, Homo sapiens
gaaaatggaagtggcaata

SEQ ID NO: 447694 - DNA, 18 bp, Homo sapiens
gaaacaacttgtgttcta

SEQ ID NO: 447695 - DNA, 21 bp, Homo sapiens
gaaccttggtaaattgtaaac

SEQ ID NO: 447696 - DNA, 23 bp, Homo sapiens
gaacgtgggagttcagctgcttc

SEQ ID NO: 447697 - DNA, 12 bp, Homo sapiens
gaactctcagga

SEQ ID NO: 447698 - DNA, 16 bp, Homo sapiens
gaactgttctggcctc

SEQ ID NO: 447699 - DNA, 17 bp, Homo sapiens
gaacttgaggacacatg

SEQ ID NO: 447700 - DNA, 21 bp, Homo sapiens
gaacttgaggacacatgtcca

SEQ ID NO: 447701 - DNA, 16 bp, Homo sapiens
gaagaggcagattcaa

SEQ ID NO: 447702 - DNA, 23 bp, Homo sapiens
gaagggaggttcacctgcagcga

SEQ ID NO: 447703 - DNA, 14 bp, Homo sapiens
gaagtttcatttat

SEQ ID NO: 447704 - DNA, 20 bp, Homo sapiens
gaataatgtgggaagaaaca

SEQ ID NO: 447705 - DNA, 22 bp, Homo sapiens
gaatcccatggatgtttcttct

SEQ ID NO: 447706 - DNA, 21 bp, Homo sapiens
gaatcggtgctgtcagccctg

SEQ ID NO: 447707 - DNA, 23 bp, Homo sapiens
gaattaagtgaaaggtcacacta

SEQ ID NO: 447708 - DNA, 13 bp, Homo sapiens
gaattctgaactt

SEQ ID NO: 447709 - DNA, 14 bp, Homo sapiens
gaatttcctatctg

SEQ ID NO: 447710 - DNA, 12 bp, Homo sapiens
gacaaacccttc

SEQ ID NO: 447711 - DNA, 11 bp, Homo sapiens
gacacctgccc

SEQ ID NO: 447712 - DNA, 13 bp, Homo sapiens
gacacctgccctg

SEQ ID NO: 447713 - DNA, 14 bp, Homo sapiens
gacacctgccctgc

SEQ ID NO: 447714 - DNA, 18 bp, Homo sapiens
gacactcattaccgtctg

SEQ ID NO: 447715 - DNA, 16 bp, Homo sapiens
gacagcaaaaccattg

SEQ ID NO: 447716 - DNA, 19 bp, Homo sapiens
gacagcaaaaccattgctt

SEQ ID NO: 447717 - DNA, 15 bp, Homo sapiens
gacagctgtgctgta

SEQ ID NO: 447718 - DNA, 17 bp, Homo sapiens
gaccaactctctcctgt

SEQ ID NO: 447719 - DNA, 20 bp, Homo sapiens
gactgcattttactgtacag

SEQ ID NO: 447720 - DNA, 18 bp, Homo sapiens
gagaaacattctttccta

SEQ ID NO: 447721 - DNA, 14 bp, Homo sapiens
gagacaataaaaca

SEQ ID NO: 447722 - DNA, 13 bp, Homo sapiens
gagagcacttgaa

SEQ ID NO: 447723 - DNA, 20 bp, Homo sapiens
gaggcggaggttgcagtgag

SEQ ID NO: 447724 - DNA, 16 bp, Homo sapiens
gaggctatttaaaagt

SEQ ID NO: 447725 - DNA, 18 bp, Homo sapiens
gagggatgggatttcatg

SEQ ID NO: 447726 - DNA, 16 bp, Homo sapiens
gaggtgagaccacctc

SEQ ID NO: 447727 - DNA, 13 bp, Homo sapiens
gaggttgcagtga

SEQ ID NO: 447728 - DNA, 16 bp, Homo sapiens
gagttcagctgcttct

SEQ ID NO: 447729 - DNA, 14 bp, Homo sapiens
gataaagaaaagaa

SEQ ID NO: 447730 - DNA, 15 bp, Homo sapiens
gatagtatcttttaa

SEQ ID NO: 447731 - DNA, 15 bp, Homo sapiens
atattttttaaagtc

SEQ ID NO: 447732 - DNA, 15 bp, Homo sapiens
atccatcagctccct

SEQ ID NO: 447733 - DNA, 20 bp, Homo sapiens
atcccatggatgtttcttct

SEQ ID NO: 447734 - DNA, 18 bp, Homo sapiens
atccttttctattaagat

SEQ ID NO: 447735 - DNA, 23 bp, Homo sapiens
atcgatgggggatgcttcatgtg

SEQ ID NO: 447736 - DNA, 17 bp, Homo sapiens
atcggtgtccatttata

SEQ ID NO: 447737 - DNA, 23 bp, Homo sapiens
atctccaaaaacagtaaaaataa

SEQ ID NO: 447738 - DNA, 12 bp, Homo sapiens
atctttaaatag

SEQ ID NO: 447739 - DNA, 17 bp, Homo sapiens
atgaacttgaggacaca

SEQ ID NO: 447740 - DNA, 17 bp, Homo sapiens
atgaatgaaacattttg

SEQ ID NO: 447741 - DNA, 17 bp, Homo sapiens
atgatgattaaacacct

SEQ ID NO: 447742 - DNA, 22 bp, Homo sapiens
atgatgattaaacacctgacac

SEQ ID NO: 447743 - DNA, 18 bp, Homo sapiens
atgattaaacacctgaca

SEQ ID NO: 447744 - DNA, 21 bp, Homo sapiens
atgattaaacacctgacacat

SEQ ID NO: 447745 - DNA, 22 bp, Homo sapiens
atgattaaacacctgacacatc

SEQ ID NO: 447746 - DNA, 16 bp, Homo sapiens
atggtgttttcatgta

SEQ ID NO: 447747 - DNA, 19 bp, Homo sapiens
atgtaaaaaatacaaacat

SEQ ID NO: 447748 - DNA, 21 bp, Homo sapiens
atgtaaccaagagtattccat

SEQ ID NO: 447749 - DNA, 20 bp, Homo sapiens
atgtatatgtcatttatttt

SEQ ID NO: 447750 - DNA, 19 bp, Homo sapiens
atgtattaaaatatcccaa

SEQ ID NO: 447751 - DNA, 16 bp, Homo sapiens
atgtatttatgtcttt

SEQ ID NO: 447752 - DNA, 21 bp, Homo sapiens
atgtcaccggtcagtgccttt

SEQ ID NO: 447753 - DNA, 17 bp, Homo sapiens
atgtcagtgtttgggaa

SEQ ID NO: 447754 - DNA, 15 bp, Homo sapiens
atgtgcctgcaccag

SEQ ID NO: 447755 - DNA, 17 bp, Homo sapiens
atgtgcctgcaccagga

SEQ ID NO: 447756 - DNA, 22 bp, Homo sapiens
atgtgcctgcaccaggagacag

SEQ ID NO: 447757 - DNA, 18 bp, Homo sapiens
atgtgggaagaaacaaac

SEQ ID NO: 447758 - DNA, 17 bp, Homo sapiens
attaaacacctgacaca

SEQ ID NO: 447759 - DNA, 19 bp, Homo sapiens
attaactgaattctgaact

SEQ ID NO: 447760 - DNA, 21 bp, Homo sapiens
attaatcgtgtcttcaattaa

SEQ ID NO: 447761 - DNA, 22 bp, Homo sapiens
attacataaataaattaaataa

SEQ ID NO: 447762 - DNA, 14 bp, Homo sapiens
attagtaattgtaa

SEQ ID NO: 447763 - DNA, 15 bp, Homo sapiens
attagtaattgtcaa

SEQ ID NO: 447764 - DNA, 18 bp, Homo sapiens
attatcgccttttgacag

SEQ ID NO: 447765 - DNA, 12 bp, Homo sapiens
attcaataaagc

SEQ ID NO: 447766 - DNA, 23 bp, Homo sapiens
attccatttttactaaagcagtg

SEQ ID NO: 447767 - DNA, 18 bp, Homo sapiens
attcctttcctgatcact

SEQ ID NO: 447768 - DNA, 13 bp, Homo sapiens
attctactttgag

SEQ ID NO: 447769 - DNA, 16 bp, Homo sapiens
attctatctctcttta

SEQ ID NO: 447770 - DNA, 12 bp, Homo sapiens
attctcttatcc

SEQ ID NO: 447771 - DNA, 23 bp, Homo sapiens
attctgaatttgtagacatactt

SEQ ID NO: 447772 - DNA, 12 bp, Homo sapiens
attctttcctaa

SEQ ID NO: 447773 - DNA, 18 bp, Homo sapiens
attgacaggattattgga

SEQ ID NO: 447774 - DNA, 17 bp, Homo sapiens
attgatatgcttataca

SEQ ID NO: 447775 - DNA, 20 bp, Homo sapiens
attgatttaacttcattttt

SEQ ID NO: 447776 - DNA, 19 bp, Homo sapiens
attgccatttcttcccaag

SEQ ID NO: 447777 - DNA, 20 bp, Homo sapiens
attgtacagaatcattgctt

SEQ ID NO: 447778 - DNA, 21 bp, Homo sapiens
attgtacagaatcattgctta

SEQ ID NO: 447779 - DNA, 17 bp, Homo sapiens
attgtctaaaatgtcag

SEQ ID NO: 447780 - DNA, 16 bp, Homo sapiens
atttacttcttataca

SEQ ID NO: 447781 - DNA, 19 bp, Homo sapiens
atttacttcttatacattt

SEQ ID NO: 447782 - DNA, 21 bp, Homo sapiens
atttcactgacactgcgaact

SEQ ID NO: 447783 - DNA, 16 bp, Homo sapiens
atttcagatgctttag

SEQ ID NO: 447784 - DNA, 13 bp, Homo sapiens
atttcctatctgt

SEQ ID NO: 447785 - DNA, 22 bp, Homo sapiens
atttcctgtataatttaacagt

SEQ ID NO: 447786 - DNA, 13 bp, Homo sapiens
atttctttctaaa

SEQ ID NO: 447787 - DNA, 14 bp, Homo sapiens
atttgtataaaatg

SEQ ID NO: 447788 - DNA, 23 bp, Homo sapiens
attttgtcatataagattcatat

SEQ ID NO: 447789 - DNA, 19 bp, Homo sapiens
atttttactaaagcagtgt

SEQ ID NO: 447790 - DNA, 13 bp, Homo sapiens
atttttttcccaa

SEQ ID NO: 447791 - DNA, 16 bp, Homo sapiens
caaaaccattgcttca

SEQ ID NO: 447792 - DNA, 15 bp, Homo sapiens
caaaagattgtttta

SEQ ID NO: 447793 - DNA, 15 bp, Homo sapiens
caaaatgtagggtta

SEQ ID NO: 447794 - DNA, 20 bp, Homo sapiens
caaaattgtctaaaatgtca

SEQ ID NO: 447795 - DNA, 18 bp, Homo sapiens
caaaggtgattttcctgt

SEQ ID NO: 447796 - DNA, 17 bp, Homo sapiens
caaatgatagaaacaga

SEQ ID NO: 447797 - DNA, 22 bp, Homo sapiens
caacatcttggtcagatttgaa

SEQ ID NO: 447798 - DNA, 12 bp, Homo sapiens
caactctctcct

SEQ ID NO: 447799 - DNA, 17 bp, Homo sapiens
caagacttttctttgaa

SEQ ID NO: 447800 - DNA, 23 bp, Homo sapiens
caagagaaacattctttcctaaa

SEQ ID NO: 447801 - DNA, 19 bp, Homo sapiens
caagctttcttctacaacc

SEQ ID NO: 447802 - DNA, 22 bp, Homo sapiens
caagctttcttctacaaccaga

SEQ ID NO: 447803 - DNA, 22 bp, Homo sapiens
caataaagctgctgagaatcta

SEQ ID NO: 447804 - DNA, 23 bp, Homo sapiens
caataaagctgctgagaatctag

SEQ ID NO: 447805 - DNA, 15 bp, Homo sapiens
caatattcaataaag

SEQ ID NO: 447806 - DNA, 12 bp, Homo sapiens
cacacaagcagt

SEQ ID NO: 447807 - DNA, 20 bp, Homo sapiens
cacacttatttttttcccaa

SEQ ID NO: 447808 - DNA, 14 bp, Homo sapiens
cacagacagatccc

SEQ ID NO: 447809 - DNA, 17 bp, Homo sapiens
cacagacagatcccatc

SEQ ID NO: 447810 - DNA, 18 bp, Homo sapiens
cacagcagcctctgaagt

SEQ ID NO: 447811 - DNA, 18 bp, Homo sapiens
caccctcgtggacacctg

SEQ ID NO: 447812 - DNA, 23 bp, Homo sapiens
caccctcgtggacacctgccctg

SEQ ID NO: 447813 - DNA, 18 bp, Homo sapiens
caccggtcagtgcctttt

SEQ ID NO: 447814 - DNA, 21 bp, Homo sapiens
cacctctcaatattcaataaa

SEQ ID NO: 447815 - DNA, 22 bp, Homo sapiens
cacctctcaatattcaataaag

SEQ ID NO: 447816 - DNA, 13 bp, Homo sapiens
cacctgccctgcc

SEQ ID NO: 447817 - DNA, 14 bp, Homo sapiens
cacctgccctgccc

SEQ ID NO: 447818 - DNA, 19 bp, Homo sapiens
cacctgccctgccctgcca

SEQ ID NO: 447819 - DNA, 11 bp, Homo sapiens
cacctgtctgt

SEQ ID NO: 447820 - DNA, 22 bp, Homo sapiens
cacctgtctgtctgtctgtccc

SEQ ID NO: 447821 - DNA, 22 bp, Homo sapiens
cactacccatcggtgtccattt

SEQ ID NO: 447822 - DNA, 20 bp, Homo sapiens
cactgcaacctccacctccc

SEQ ID NO: 447823 - DNA, 21 bp, Homo sapiens
cagaattttccttcttcagct

SEQ ID NO: 447824 - DNA, 15 bp, Homo sapiens
cagaccaactctctc

SEQ ID NO: 447825 - DNA, 18 bp, Homo sapiens
cagaccaactctctcctg

SEQ ID NO: 447826 - DNA, 17 bp, Homo sapiens
cagatcccatccatcag

SEQ ID NO: 447827 - DNA, 22 bp, Homo sapiens
cagatcccatccatcagctccc

SEQ ID NO: 447828 - DNA, 20 bp, Homo sapiens
cagatgcctcctctgtcctc

SEQ ID NO: 447829 - DNA, 15 bp, Homo sapiens
cagattgctgcttct

SEQ ID NO: 447830 - DNA, 19 bp, Homo sapiens
cagcaaaaccattgcttca

SEQ ID NO: 447831 - DNA, 20 bp, Homo sapiens
cagcaaaaccattgcttcac

SEQ ID NO: 447832 - DNA, 18 bp, Homo sapiens
cagcagcctctgaagttg

SEQ ID NO: 447833 - DNA, 23 bp, Homo sapiens
cagcagcctctgaagttggacag

SEQ ID NO: 447834 - DNA, 15 bp, Homo sapiens
cagcagtgagcttct

SEQ ID NO: 447835 - DNA, 20 bp, Homo sapiens
caggaggcggaggttgcagt

SEQ ID NO: 447836 - DNA, 21 bp, Homo sapiens
caggaggtactgtgaggaaga

SEQ ID NO: 447837 - DNA, 17 bp, Homo sapiens
caggatgattgtacaga

SEQ ID NO: 447838 - DNA, 20 bp, Homo sapiens
cttgacgcgtggtcacagga

SEQ ID NO: 447839 - DNA, 18 bp, Homo sapiens
cttgatgtgttatctctt

SEQ ID NO: 447840 - DNA, 18 bp, Homo sapiens
cttgccaagctttcttct

SEQ ID NO: 447841 - DNA, 20 bp, Homo sapiens
cttgccaagctttcttctac

SEQ ID NO: 447842 - DNA, 23 bp, Homo sapiens
cttggtaaattgtaaacagctaa

SEQ ID NO: 447843 - DNA, 15 bp, Homo sapiens
ctttatgcacaaaat

SEQ ID NO: 447844 - DNA, 21 bp, Homo sapiens
ctttcctaaatataaatgaaa

SEQ ID NO: 447845 - DNA, 20 bp, Homo sapiens
ctttcttctacaaccagagc

SEQ ID NO: 447846 - DNA, 20 bp, Homo sapiens
ctttgttgctcagcaagggg

SEQ ID NO: 447847 - DNA, 18 bp, Homo sapiens
cttttaaaatgaaatgtt

SEQ ID NO: 447848 - DNA, 18 bp, Homo sapiens
cttttgcagcttccttcc

SEQ ID NO: 447849 - DNA, 22 bp, Homo sapiens
ctttttaatattgatatgctta

SEQ ID NO: 447850 - DNA, 12 bp, Homo sapiens
gaaaattagtaa

SEQ ID NO: 447851 - DNA, 16 bp, Homo sapiens
gaaacattctttccta

SEQ ID NO: 447852 - DNA, 17 bp, Homo sapiens
gaaacattctttcctaa

SEQ ID NO: 447853 - DNA, 18 bp, Homo sapiens
gaaacattctttcctaaa

SEQ ID NO: 447854 - DNA, 17 bp, Homo sapiens
gaaagaaaattagtaat

SEQ ID NO: 447855 - DNA, 18 bp, Homo sapiens
gaaattaaatccaataaa

SEQ ID NO: 447856 - DNA, 17 bp, Homo sapiens
gaaatttgttataatga

SEQ ID NO: 447857 - DNA, 18 bp, Homo sapiens
gaacttgaggacacatgt

SEQ ID NO: 447858 - DNA, 19 bp, Homo sapiens
gaacttgaggacacatgtc

SEQ ID NO: 447859 - DNA, 18 bp, Homo sapiens
gaaggcatgcctggacaa

SEQ ID NO: 447860 - DNA, 17 bp, Homo sapiens
gaataatgtgggaagaa

SEQ ID NO: 447861 - DNA, 21 bp, Homo sapiens
gaataatgtgggaagaaacaa

SEQ ID NO: 447862 - DNA, 12 bp, Homo sapiens
gaatcattgctt

SEQ ID NO: 447863 - DNA, 14 bp, Homo sapiens
gaatcattgcttat

SEQ ID NO: 447864 - DNA, 14 bp, Homo sapiens
gaatccctgttcat

SEQ ID NO: 447865 - DNA, 18 bp, Homo sapiens
gaatccctgttcattgta

SEQ ID NO: 447866 - DNA, 21 bp, Homo sapiens
gaatcgatgggggatgcttca

SEQ ID NO: 447867 - DNA, 22 bp, Homo sapiens
gaatcgatgggggatgcttcat

SEQ ID NO: 447868 - DNA, 18 bp, Homo sapiens
gaatcggctttgcagtgc

SEQ ID NO: 447869 - DNA, 15 bp, Homo sapiens
gaatcggtgctgtca

SEQ ID NO: 447870 - DNA, 14 bp, Homo sapiens
gaatgatacgatta

SEQ ID NO: 447871 - DNA, 14 bp, Homo sapiens
gacaataaaacatt

SEQ ID NO: 447872 - DNA, 16 bp, Homo sapiens
gacacctgccctgccc

SEQ ID NO: 447873 - DNA, 22 bp, Homo sapiens
gacacctgccctgccctgccac

SEQ ID NO: 447874 - DNA, 23 bp, Homo sapiens
gacacctgccctgccctgccacc

SEQ ID NO: 447875 - DNA, 14 bp, Homo sapiens
gacatgatcttctt

SEQ ID NO: 447876 - DNA, 14 bp, Homo sapiens
gacatgtgcctgta

SEQ ID NO: 447877 - DNA, 13 bp, Homo sapiens
gacattaaataat

SEQ ID NO: 447878 - DNA, 23 bp, Homo sapiens
gacgggcggtcctactgctgtga

SEQ ID NO: 447879 - DNA, 20 bp, Homo sapiens
gagacagacagagaaggcag

SEQ ID NO: 447880 - DNA, 16 bp, Homo sapiens
gagatgtatgcccaaa

SEQ ID NO: 447881 - DNA, 21 bp, Homo sapiens
gagattgcaccactgcactcc

SEQ ID NO: 447882 - DNA, 15 bp, Homo sapiens
gaggtgagaccacct

SEQ ID NO: 447883 - DNA, 18 bp, Homo sapiens
gatcccatccatcagctc

SEQ ID NO: 447884 - DNA, 16 bp, Homo sapiens
gatgattaaacacctg

SEQ ID NO: 447885 - DNA, 13 bp, Homo sapiens
gatgattgtacag

SEQ ID NO: 447886 - DNA, 15 bp, Homo sapiens
gatgcctcctctgtc

SEQ ID NO: 447887 - DNA, 10 bp, Homo sapiens
gatgtttgtt

SEQ ID NO: 447888 - DNA, 13 bp, Homo sapiens
gattaaacacctg

SEQ ID NO: 447889 - DNA, 18 bp, Homo sapiens
gattaaacacctgacaca

SEQ ID NO: 447890 - DNA, 17 bp, Homo sapiens
gattcatatttacttct

SEQ ID NO: 447891 - DNA, 15 bp, Homo sapiens
gcaaaaccattgctt

SEQ ID NO: 447892 - DNA, 14 bp, Homo sapiens
gcaaggggctctgc

SEQ ID NO: 447893 - DNA, 16 bp, Homo sapiens
gcactattggactttg

SEQ ID NO: 447894 - DNA, 15 bp, Homo sapiens
gcactggccccaccc

SEQ ID NO: 447895 - DNA, 21 bp, Homo sapiens
gcagagaattctcttatccaa

SEQ ID NO: 447896 - DNA, 18 bp, Homo sapiens
gcagagacaataaaacat

SEQ ID NO: 447897 - DNA, 23 bp, Homo sapiens
gcagcttccttccaagtcttcct

SEQ ID NO: 447898 - DNA, 16 bp, Homo sapiens
gcagtgagcttctatt

SEQ ID NO: 447899 - DNA, 17 bp, Homo sapiens
gcagtgagcttctatta

SEQ ID NO: 447900 - DNA, 18 bp, Homo sapiens
gcagtggactgtgtccct

SEQ ID NO: 447901 - DNA, 20 bp, Homo sapiens
gcagtgttttcacctcatat

SEQ ID NO: 447902 - DNA, 21 bp, Homo sapiens
gcatacacccccacctcctgc

SEQ ID NO: 447903 - DNA, 17 bp, Homo sapiens
gcattttactgtacaga

SEQ ID NO: 447904 - DNA, 10 bp, Homo sapiens
gccacctgtc

SEQ ID NO: 447905 - DNA, 13 bp, Homo sapiens
gccacctgtctgt

SEQ ID NO: 447906 - DNA, 14 bp, Homo sapiens
gccacctgtctgtc

SEQ ID NO: 447907 - DNA, 23 bp, Homo sapiens
gcccaatattaagtaaaaaatat

SEQ ID NO: 447908 - DNA, 20 bp, Homo sapiens
gcccaggctggagtgcagtg

SEQ ID NO: 447909 - DNA, 21 bp, Homo sapiens
gccccagatgcctcctctgtc

SEQ ID NO: 447910 - DNA, 16 bp, Homo sapiens
gccccatcagcagctt

SEQ ID NO: 447911 - DNA, 19 bp, Homo sapiens
gccccatcagcagcttgac

SEQ ID NO: 447912 - DNA, 14 bp, Homo sapiens
gccctgccacctgt

SEQ ID NO: 447913 - DNA, 17 bp, Homo sapiens
gccctgccacctgtctg

SEQ ID NO: 447914 - DNA, 17 bp, Homo sapiens
gccctgccctgccacct

SEQ ID NO: 447915 - DNA, 12 bp, Homo sapiens
gcctcagaccaa

SEQ ID NO: 447916 - DNA, 13 bp, Homo sapiens
gcctcctctgtcc

SEQ ID NO: 447917 - DNA, 16 bp, Homo sapiens
gcctgcaccaggagac

SEQ ID NO: 447918 - DNA, 14 bp, Homo sapiens
gcctggacaaaccc

SEQ ID NO: 447919 - DNA, 16 bp, Homo sapiens
gcctggacaaaccctt

SEQ ID NO: 447920 - DNA, 20 bp, Homo sapiens
gcctgggtggcagagtgaga

SEQ ID NO: 447921 - DNA, 13 bp, Homo sapiens
gccttttgacagc

SEQ ID NO: 447922 - DNA, 17 bp, Homo sapiens
gcgaactctcaggacta

SEQ ID NO: 447923 - DNA, 19 bp, Homo sapiens
gctcagcaaggggctctgc

SEQ ID NO: 447924 - DNA, 22 bp, Homo sapiens
gctctgctcaaatgttgcagga

SEQ ID NO: 447925 - DNA, 16 bp, Homo sapiens
gctgcgtctgcactga

SEQ ID NO: 447926 - DNA, 14 bp, Homo sapiens
gctggagtgcagtg

SEQ ID NO: 447927 - DNA, 22 bp, Homo sapiens
gctgtcagaccttcttccacag

SEQ ID NO: 447928 - DNA, 18 bp, Homo sapiens
gctgtcagccctgctgtc

SEQ ID NO: 447929 - DNA, 12 bp, Homo sapiens
gctttgcagtgc

SEQ ID NO: 447930 - DNA, 19 bp, Homo sapiens
ggaaggcatgcctggacaa

SEQ ID NO: 447931 - DNA, 14 bp, Homo sapiens
ggaagttgctgtgc

SEQ ID NO: 447932 - DNA, 10 bp, Homo sapiens
ggacacctgc

SEQ ID NO: 447933 - DNA, 20 bp, Homo sapiens
ggacagcaaaaccattgctt

SEQ ID NO: 447934 - DNA, 12 bp, Homo sapiens
tgagaccacctc

SEQ ID NO: 447935 - DNA, 12 bp, Homo sapiens
tgatagaaacag

SEQ ID NO: 447936 - DNA, 15 bp, Homo sapiens
tgatgtaaaaaatac

SEQ ID NO: 447937 - DNA, 16 bp, Homo sapiens
tgatgtgttatctctt

SEQ ID NO: 447938 - DNA, 16 bp, Homo sapiens
tgattatttatcacat

SEQ ID NO: 447939 - DNA, 18 bp, Homo sapiens
tgattgccatttcttccc

SEQ ID NO: 447940 - DNA, 20 bp, Homo sapiens
tgattgccatttcttcccaa

SEQ ID NO: 447941 - DNA, 20 bp, Homo sapiens
tgcaaaaattcagagtcctt

SEQ ID NO: 447942 - DNA, 10 bp, Homo sapiens
tgcaccagga

SEQ ID NO: 447943 - DNA, 14 bp, Homo sapiens
tgcaccaggagaca

SEQ ID NO: 447944 - DNA, 15 bp, Homo sapiens
tgcaccaggagacag

SEQ ID NO: 447945 - DNA, 16 bp, Homo sapiens
tgcactggccccaccc

SEQ ID NO: 447946 - DNA, 21 bp, Homo sapiens
tgcattttaaagttaaacatt

SEQ ID NO: 447947 - DNA, 15 bp, Homo sapiens
tgccccatcagcagc

SEQ ID NO: 447948 - DNA, 20 bp, Homo sapiens
tgccccatcagcagcttgac

SEQ ID NO: 447949 - DNA, 16 bp, Homo sapiens
tgccctccctccttcc

SEQ ID NO: 447950 - DNA, 16 bp, Homo sapiens
tgccctgccacctgtc

SEQ ID NO: 447951 - DNA, 17 bp, Homo sapiens
tgccctgccacctgtct

SEQ ID NO: 447952 - DNA, 19 bp, Homo sapiens
tgccctgccacctgtctgt

SEQ ID NO: 447953 - DNA, 21 bp, Homo sapiens
tgccctgccacctgtctgtct

SEQ ID NO: 447954 - DNA, 18 bp, Homo sapiens
tgccctgccctgccacct

SEQ ID NO: 447955 - DNA, 21 bp, Homo sapiens
tgcccttttcatctccagtgt

SEQ ID NO: 447956 - DNA, 17 bp, Homo sapiens
tgcctaagtattccttt

SEQ ID NO: 447957 - DNA, 17 bp, Homo sapiens
tgcctcctctgtcctca

SEQ ID NO: 447958 - DNA, 15 bp, Homo sapiens
tgcctggacaaaccc

SEQ ID NO: 447959 - DNA, 18 bp, Homo sapiens
tgcgaactctcaggacta

SEQ ID NO: 447960 - DNA, 18 bp, Homo sapiens
tgcgcccggccacattca

SEQ ID NO: 447961 - DNA, 23 bp, Homo sapiens
tgctatatttgtgatataggaat

SEQ ID NO: 447962 - DNA, 15 bp, Homo sapiens
tgctatgttagaagt

SEQ ID NO: 447963 - DNA, 13 bp, Homo sapiens
tgctgcagactca

SEQ ID NO: 447964 - DNA, 13 bp, Homo sapiens
tgcttatacactt

SEQ ID NO: 447965 - DNA, 19 bp, Homo sapiens
tggacaaacccttctttta

SEQ ID NO: 447966 - DNA, 10 bp, Homo sapiens
tggacacctg

SEQ ID NO: 447967 - DNA, 14 bp, Homo sapiens
tggacacctgccct

SEQ ID NO: 447968 - DNA, 17 bp, Homo sapiens
tggacacctgccctgcc

SEQ ID NO: 447969 - DNA, 23 bp, Homo sapiens
tggacacctgccctgccctgcca

SEQ ID NO: 447970 - DNA, 15 bp, Homo sapiens
tggacagcaaaacca

SEQ ID NO: 447971 - DNA, 17 bp, Homo sapiens
tggacagcaaaaccatt

SEQ ID NO: 447972 - DNA, 13 bp, Homo sapiens
tggacctgaagga

SEQ ID NO: 447973 - DNA, 16 bp, Homo sapiens
tggactggtggcccct

SEQ ID NO: 447974 - DNA, 19 bp, Homo sapiens
tggacttttgcagcttcct

SEQ ID NO: 447975 - DNA, 16 bp, Homo sapiens
tggagagaaaatacaa

SEQ ID NO: 447976 - DNA, 22 bp, Homo sapiens
tggccccaccctcgtggacacc

SEQ ID NO: 447977 - DNA, 13 bp, Homo sapiens
tggcctcagacca

SEQ ID NO: 447978 - DNA, 16 bp, Homo sapiens
tggcctcagaccaact

SEQ ID NO: 447979 - DNA, 17 bp, Homo sapiens
tgggagttcagctgctt

SEQ ID NO: 447980 - DNA, 19 bp, Homo sapiens
tgggagttcagctgcttct

SEQ ID NO: 447981 - DNA, 20 bp, Homo sapiens
tgggcaggggttccagcttc

SEQ ID NO: 447982 - DNA, 15 bp, Homo sapiens
tgggggatgcttcat

SEQ ID NO: 447983 - DNA, 14 bp, Homo sapiens
tggtaaattgtaaa

SEQ ID NO: 447984 - DNA, 23 bp, Homo sapiens
tggtactaagaggctatttaaaa

SEQ ID NO: 447985 - DNA, 22 bp, Homo sapiens
tggtcagatttgaactcttcaa

SEQ ID NO: 447986 - DNA, 24 bp, Homo sapiens
tggtgaaaccctgtctctactaaa

SEQ ID NO: 447987 - DNA, 17 bp, Homo sapiens
tggtgacatgtgcctgt

SEQ ID NO: 447988 - DNA, 16 bp, Homo sapiens
tggttattttacatta

SEQ ID NO: 447989 - DNA, 12 bp, Homo sapiens
tgtaaaaaatac

SEQ ID NO: 447990 - DNA, 18 bp, Homo sapiens
tgtaagtacccctgataa

SEQ ID NO: 447991 - DNA, 20 bp, Homo sapiens
tgtagacatacttgtacgct

SEQ ID NO: 447992 - DNA, 23 bp, Homo sapiens
tgtataatttaacagtgcccttt

SEQ ID NO: 447993 - DNA, 14 bp, Homo sapiens
tgtatatgtcattt

SEQ ID NO: 447994 - DNA, 18 bp, Homo sapiens
tgtattacataaataaat

SEQ ID NO: 447995 - DNA, 21 bp, Homo sapiens
tgtattacataaataaattaa

SEQ ID NO: 447996 - DNA, 18 bp, Homo sapiens
tgtattcccacccctgga

SEQ ID NO: 447997 - DNA, 17 bp, Homo sapiens
tgtcaatacccctgtta

SEQ ID NO: 447998 - DNA, 14 bp, Homo sapiens
tgtcattttctctt

SEQ ID NO: 447999 - DNA, 21 bp, Homo sapiens
tgtccacatctaacaaagtca

SEQ ID NO: 448000 - DNA, 15 bp, Homo sapiens
tgtctgatgtttgtt

SEQ ID NO: 448001 - DNA, 14 bp, Homo sapiens
tgtctgtctgtccc

SEQ ID NO: 448002 - DNA, 16 bp, Homo sapiens
tgtctgtctgtctgtc

SEQ ID NO: 448003 - DNA, 20 bp, Homo sapiens
tgtcttcaatttgtataaaa

SEQ ID NO: 448004 - DNA, 15 bp, Homo sapiens
tgtgcggtgcataca

SEQ ID NO: 448005 - DNA, 15 bp, Homo sapiens
tgtgggaagaaacaa

SEQ ID NO: 448006 - DNA, 23 bp, Homo sapiens
tgtttcttttttttttttttaca

SEQ ID NO: 448007 - DNA, 20 bp, Homo sapiens
tgttttaagccaatatttta

SEQ ID NO: 448008 - DNA, 17 bp, Homo sapiens
ttaaacacctgacacat

SEQ ID NO: 448009 - DNA, 14 bp, Homo sapiens
ttaaatccaataaa

SEQ ID NO: 448010 - DNA, 14 bp, Homo sapiens
ttacataaataaat

SEQ ID NO: 448011 - DNA, 17 bp, Homo sapiens
ttactaaagcagtgttt

SEQ ID NO: 448012 - DNA, 18 bp, Homo sapiens
ttactaaagcagtgtttt

SEQ ID NO: 448013 - DNA, 22 bp, Homo sapiens
ttactaaagcagtgttttcacc

SEQ ID NO: 448014 - DNA, 17 bp, Homo sapiens
ttactcattatcgcctt

SEQ ID NO: 448015 - DNA, 14 bp, Homo sapiens
ttcagatgctttag

SEQ ID NO: 448016 - DNA, 22 bp, Homo sapiens
ggacgagggatgggatttcatg

SEQ ID NO: 448017 - DNA, 20 bp, Homo sapiens
ggacttttgcagcttccttc

SEQ ID NO: 448018 - DNA, 23 bp, Homo sapiens
ggaggacaaaggtgattttcctg

SEQ ID NO: 448019 - DNA, 21 bp, Homo sapiens
ggatgaattccaaattctgct

SEQ ID NO: 448020 - DNA, 11 bp, Homo sapiens
ggatgcttcat

SEQ ID NO: 448021 - DNA, 15 bp, Homo sapiens
ggcatgcctggacaa

SEQ ID NO: 448022 - DNA, 14 bp, Homo sapiens
ggcgtgtgcagtgc

SEQ ID NO: 448023 - DNA, 21 bp, Homo sapiens
ggctctgccctccctccttcc

SEQ ID NO: 448024 - DNA, 22 bp, Homo sapiens
ggctggacttttgcagcttcct

SEQ ID NO: 448025 - DNA, 20 bp, Homo sapiens
ggctggagtgcagtggcgca

SEQ ID NO: 448026 - DNA, 20 bp, Homo sapiens
gggcccacagacagatccca

SEQ ID NO: 448027 - DNA, 16 bp, Homo sapiens
gggctctgccctccct

SEQ ID NO: 448028 - DNA, 22 bp, Homo sapiens
gggctctgccctccctccttcc

SEQ ID NO: 448029 - DNA, 13 bp, Homo sapiens
ggggatgcttcat

SEQ ID NO: 448030 - DNA, 21 bp, Homo sapiens
gggtttcattgtgtgttagca

SEQ ID NO: 448031 - DNA, 22 bp, Homo sapiens
ggtatgaacttgaggacacatg

SEQ ID NO: 448032 - DNA, 14 bp, Homo sapiens
ggtgagaccacctc

SEQ ID NO: 448033 - DNA, 17 bp, Homo sapiens
ggtggctcttgcctgta

SEQ ID NO: 448034 - DNA, 14 bp, Homo sapiens
ggtgttttcatgta

SEQ ID NO: 448035 - DNA, 14 bp, Homo sapiens
ggttccagcttccc

SEQ ID NO: 448036 - DNA, 11 bp, Homo sapiens
ggttgcagtga

SEQ ID NO: 448037 - DNA, 16 bp, Homo sapiens
gtaaggcagctctgtc

SEQ ID NO: 448038 - DNA, 23 bp, Homo sapiens
gtaaggttttttttatctttaaa

SEQ ID NO: 448039 - DNA, 23 bp, Homo sapiens
gtaattttgggtggggagaagag

SEQ ID NO: 448040 - DNA, 17 bp, Homo sapiens
gtacagaatcattgctt

SEQ ID NO: 448041 - DNA, 17 bp, Homo sapiens
gtacagattgctgcttc

SEQ ID NO: 448042 - DNA, 19 bp, Homo sapiens
gtacagattgctgcttctg

SEQ ID NO: 448043 - DNA, 20 bp, Homo sapiens
gtacagattgctgcttctgc

SEQ ID NO: 448044 - DNA, 14 bp, Homo sapiens
gtatatgtcattta

SEQ ID NO: 448045 - DNA, 22 bp, Homo sapiens
gtatctttgggtctttgataaa

SEQ ID NO: 448046 - DNA, 20 bp, Homo sapiens
gtatgaacttgaggacacat

SEQ ID NO: 448047 - DNA, 17 bp, Homo sapiens
gtcaccggtcagtgcct

SEQ ID NO: 448048 - DNA, 18 bp, Homo sapiens
gtcaccggtcagtgcctt

SEQ ID NO: 448049 - DNA, 23 bp, Homo sapiens
aaatgtatcctgataaacattaa

SEQ ID NO: 448050 - DNA, 20 bp, Homo sapiens
aaattatatgatatgcatgt

SEQ ID NO: 448051 - DNA, 21 bp, Homo sapiens
aaattatatgatatgcatgta

SEQ ID NO: 448052 - DNA, 17 bp, Homo sapiens
aaattattactttaaat

SEQ ID NO: 448053 - DNA, 18 bp, Homo sapiens
aaattattactttaaatt

SEQ ID NO: 448054 - DNA, 12 bp, Homo sapiens
aaattattctag

SEQ ID NO: 448055 - DNA, 16 bp, Homo sapiens
aaattcaacaaatgat

SEQ ID NO: 448056 - DNA, 17 bp, Homo sapiens
aaattcaacacttattt

SEQ ID NO: 448057 - DNA, 16 bp, Homo sapiens
aaattctagtctctga

SEQ ID NO: 448058 - DNA, 15 bp, Homo sapiens
aaattctataagaga

SEQ ID NO: 448059 - DNA, 17 bp, Homo sapiens
aaattctataagagaca

SEQ ID NO: 448060 - DNA, 15 bp, Homo sapiens
aaattcttgaataaa

SEQ ID NO: 448061 - DNA, 12 bp, Homo sapiens
aaattggctcct

SEQ ID NO: 448062 - DNA, 14 bp, Homo sapiens
aaattgtgccaaag

SEQ ID NO: 448063 - DNA, 16 bp, Homo sapiens
aaatttaactgcatat

SEQ ID NO: 448064 - DNA, 13 bp, Homo sapiens
aaatttttactca

SEQ ID NO: 448065 - DNA, 22 bp, Homo sapiens
aaatttttactcaggctttcta

SEQ ID NO: 448066 - DNA, 23 bp, Homo sapiens
aaatttttactcaggctttctat

SEQ ID NO: 448067 - DNA, 22 bp, Homo sapiens
aacaacttaatgttctgaataa

SEQ ID NO: 448068 - DNA, 22 bp, Homo sapiens
aacaagccaaacattcttattt

SEQ ID NO: 448069 - DNA, 15 bp, Homo sapiens
aacaaggaaggacat

SEQ ID NO: 448070 - DNA, 16 bp, Homo sapiens
aacaatgccttgttgt

SEQ ID NO: 448071 - DNA, 14 bp, Homo sapiens
aacactgcttaagg

SEQ ID NO: 448072 - DNA, 16 bp, Homo sapiens
aacactgtaatcttaa

SEQ ID NO: 448073 - DNA, 23 bp, Homo sapiens
aacacttattttctgaattcata

SEQ ID NO: 448074 - DNA, 16 bp, Homo sapiens
aacagcaattttcata

SEQ ID NO: 448075 - DNA, 13 bp, Homo sapiens
aacagccaaagaa

SEQ ID NO: 448076 - DNA, 18 bp, Homo sapiens
aacagccaaagaaactca

SEQ ID NO: 448077 - DNA, 19 bp, Homo sapiens
aacagcttgaaaactggat

SEQ ID NO: 448078 - DNA, 20 bp, Homo sapiens
aacagcttgaaaactggatt

SEQ ID NO: 448079 - DNA, 22 bp, Homo sapiens
aacagtgtggcttaaacatttt

SEQ ID NO: 448080 - DNA, 21 bp, Homo sapiens
aacagttaagacaacaggcat

SEQ ID NO: 448081 - DNA, 17 bp, Homo sapiens
aacagttggtgatttta

SEQ ID NO: 448082 - DNA, 16 bp, Homo sapiens
aacataaacttgtact

SEQ ID NO: 448083 - DNA, 21 bp, Homo sapiens
aacataatgatactgaattgt

SEQ ID NO: 448084 - DNA, 18 bp, Homo sapiens
aacataggtgctcttcct

SEQ ID NO: 448085 - DNA, 22 bp, Homo sapiens
aacatattcttgctttcacaaa

SEQ ID NO: 448086 - DNA, 14 bp, Homo sapiens
aacatcataaatag

SEQ ID NO: 448087 - DNA, 21 bp, Homo sapiens
aacatccggaacagccaaaga

SEQ ID NO: 448088 - DNA, 22 bp, Homo sapiens
aacatctgaaaagaaatgctaa

SEQ ID NO: 448089 - DNA, 13 bp, Homo sapiens
aacattaaacact

SEQ ID NO: 448090 - DNA, 16 bp, Homo sapiens
aacattaaacactgta

SEQ ID NO: 448091 - DNA, 18 bp, Homo sapiens
aacattctttaacataca

SEQ ID NO: 448092 - DNA, 23 bp, Homo sapiens
aacatttcagtgttttgcttttt

SEQ ID NO: 448093 - DNA, 18 bp, Homo sapiens
aacattttttgtttcttg

SEQ ID NO: 448094 - DNA, 16 bp, Homo sapiens
aaccagcactcccagg

SEQ ID NO: 448095 - DNA, 20 bp, Homo sapiens
aaccagcactcccagggccc

SEQ ID NO: 448096 - DNA, 18 bp, Homo sapiens
aaccagctattggaacag

SEQ ID NO: 448097 - DNA, 11 bp, Homo sapiens
aacccagtgtt

SEQ ID NO: 448098 - DNA, 18 bp, Homo sapiens
aacccagtgttcagcata

SEQ ID NO: 448099 - DNA, 18 bp, Homo sapiens
aacccccacctcccggtg

SEQ ID NO: 448100 - DNA, 14 bp, Homo sapiens
aacccccctcccca

SEQ ID NO: 448101 - DNA, 16 bp, Homo sapiens
aaccctacagtatata

SEQ ID NO: 448102 - DNA, 15 bp, Homo sapiens
aaccctataaaagtg

SEQ ID NO: 448103 - DNA, 22 bp, Homo sapiens
aagttgtattttaataaagatt

SEQ ID NO: 448104 - DNA, 20 bp, Homo sapiens
aagttgttggtttatactgt

SEQ ID NO: 448105 - DNA, 19 bp, Homo sapiens
aataaaagagctttatccc

SEQ ID NO: 448106 - DNA, 17 bp, Homo sapiens
aataaacgaaacacaga

SEQ ID NO: 448107 - DNA, 14 bp, Homo sapiens
aataaactccttaa

SEQ ID NO: 448108 - DNA, 15 bp, Homo sapiens
aataaactcttcaag

SEQ ID NO: 448109 - DNA, 20 bp, Homo sapiens
aataaactcttcaaggccaa

SEQ ID NO: 448110 - DNA, 13 bp, Homo sapiens
aataaagaagaaa

SEQ ID NO: 448111 - DNA, 15 bp, Homo sapiens
aataacatattcttg

SEQ ID NO: 448112 - DNA, 18 bp, Homo sapiens
aataacatattcttgctt

SEQ ID NO: 448113 - DNA, 14 bp, Homo sapiens
aataacatctgaaa

SEQ ID NO: 448114 - DNA, 15 bp, Homo sapiens
aataacatctgaaaa

SEQ ID NO: 448115 - DNA, 21 bp, Homo sapiens
aataagagccctgagcccaga

SEQ ID NO: 448116 - DNA, 15 bp, Homo sapiens
aataatgattcaatg

SEQ ID NO: 448117 - DNA, 20 bp, Homo sapiens
aataatggaattatgtataa

SEQ ID NO: 448118 - DNA, 21 bp, Homo sapiens
aataccctagaagaaaacccg

SEQ ID NO: 448119 - DNA, 16 bp, Homo sapiens
aatactcaccaaaata

SEQ ID NO: 448120 - DNA, 18 bp, Homo sapiens
aatactgtattgttacag

SEQ ID NO: 448121 - DNA, 19 bp, Homo sapiens
aatacttttgtgtattctg

SEQ ID NO: 448122 - DNA, 15 bp, Homo sapiens
aatagcctttcttat

SEQ ID NO: 448123 - DNA, 23 bp, Homo sapiens
aatagtaaataatgattcaatgt

SEQ ID NO: 448124 - DNA, 15 bp, Homo sapiens
aatagttctatttct

SEQ ID NO: 448125 - DNA, 16 bp, Homo sapiens
aatagttctatttcta

SEQ ID NO: 448126 - DNA, 17 bp, Homo sapiens
aatagttctatttctat

SEQ ID NO: 448127 - DNA, 20 bp, Homo sapiens
aatagtttcaaatgagttta

SEQ ID NO: 448128 - DNA, 18 bp, Homo sapiens
aatatacaatttcttgaa

SEQ ID NO: 448129 - DNA, 22 bp, Homo sapiens
aatatacagtttttgtaaccat

SEQ ID NO: 448130 - DNA, 13 bp, Homo sapiens
aatatagttgaac

SEQ ID NO: 448131 - DNA, 23 bp, Homo sapiens
aatatagttgaacaagatttccc

SEQ ID NO: 448132 - DNA, 14 bp, Homo sapiens
aatatcctatactg

SEQ ID NO: 448133 - DNA, 22 bp, Homo sapiens
aatatcctatactggttatagt

SEQ ID NO: 448134 - DNA, 17 bp, Homo sapiens
aatatgacctaaatcca

SEQ ID NO: 448135 - DNA, 17 bp, Homo sapiens
aatatgaggggactgca

SEQ ID NO: 448136 - DNA, 18 bp, Homo sapiens
aatatgaggggactgcat

SEQ ID NO: 448137 - DNA, 22 bp, Homo sapiens
aatatttctaagcttatttcta

SEQ ID NO: 448138 - DNA, 15 bp, Homo sapiens
aatatttttttctag

SEQ ID NO: 448139 - DNA, 17 bp, Homo sapiens
aatatttttttctagct

SEQ ID NO: 448140 - DNA, 21 bp, Homo sapiens
aatcaatctggcttctgcatt

SEQ ID NO: 448141 - DNA, 22 bp, Homo sapiens
aatcaatttaaaggaaagttct

SEQ ID NO: 448142 - DNA, 16 bp, Homo sapiens
aatcacaattctctga

SEQ ID NO: 448143 - DNA, 22 bp, Homo sapiens
aatcacagatgggtattaaact

SEQ ID NO: 448144 - DNA, 12 bp, Homo sapiens
aatcagactctt

SEQ ID NO: 448145 - DNA, 14 bp, Homo sapiens
aatcatttatctta

SEQ ID NO: 448146 - DNA, 17 bp, Homo sapiens
aatcatttatcttatct

SEQ ID NO: 448147 - DNA, 13 bp, Homo sapiens
aatccatatcagc

SEQ ID NO: 448148 - DNA, 13 bp, Homo sapiens
aatccattttcta

SEQ ID NO: 448149 - DNA, 15 bp, Homo sapiens
cattatccttttatc

SEQ ID NO: 448150 - DNA, 17 bp, Homo sapiens
cattatggctttgtgct

SEQ ID NO: 448151 - DNA, 20 bp, Homo sapiens
cattatggctttgtgcttgt

SEQ ID NO: 448152 - DNA, 22 bp, Homo sapiens
cattcaactttagtatttttac

SEQ ID NO: 448153 - DNA, 23 bp, Homo sapiens
cattcaactttagtatttttact

SEQ ID NO: 448154 - DNA, 17 bp, Homo sapiens
cattcaagcctgtgaat

SEQ ID NO: 448155 - DNA, 20 bp, Homo sapiens
cattcccttggatgtagtct

SEQ ID NO: 448156 - DNA, 16 bp, Homo sapiens
cattctggggtggggc

SEQ ID NO: 448157 - DNA, 20 bp, Homo sapiens
cattctttaacatacatcta

SEQ ID NO: 448158 - DNA, 23 bp, Homo sapiens
cattcttttcagcttgtttctat

SEQ ID NO: 448159 - DNA, 19 bp, Homo sapiens
cattgcaaaaggttaagcc

SEQ ID NO: 448160 - DNA, 21 bp, Homo sapiens
cattggttacaaatttttact

SEQ ID NO: 448161 - DNA, 16 bp, Homo sapiens
catttaaaatggactt

SEQ ID NO: 448162 - DNA, 16 bp, Homo sapiens
catttacaacttccag

SEQ ID NO: 448163 - DNA, 23 bp, Homo sapiens
catttagtcctcaccttctgttt

SEQ ID NO: 448164 - DNA, 15 bp, Homo sapiens
catttatcttatcta

SEQ ID NO: 448165 - DNA, 20 bp, Homo sapiens
catttcctgacagaaggact

SEQ ID NO: 448166 - DNA, 21 bp, Homo sapiens
catttgatttgatatacagac

SEQ ID NO: 448167 - DNA, 17 bp, Homo sapiens
cattttctaaactgttt

SEQ ID NO: 448168 - DNA, 22 bp, Homo sapiens
ccaaacttctgaactttggaag

SEQ ID NO: 448169 - DNA, 12 bp, Homo sapiens
ccaaataacagt

SEQ ID NO: 448170 - DNA, 17 bp, Homo sapiens
ccaaatattcattttga

SEQ ID NO: 448171 - DNA, 20 bp, Homo sapiens
ccaacagacaccctccactc

SEQ ID NO: 448172 - DNA, 15 bp, Homo sapiens
ccaaccctcagagcc

SEQ ID NO: 448173 - DNA, 14 bp, Homo sapiens
ccaaccctcggagc

SEQ ID NO: 448174 - DNA, 17 bp, Homo sapiens
ccaacctcactgccctc

SEQ ID NO: 448175 - DNA, 15 bp, Homo sapiens
ccaacgggtctgtgg

SEQ ID NO: 448176 - DNA, 17 bp, Homo sapiens
ccaactctggccttggt

SEQ ID NO: 448177 - DNA, 13 bp, Homo sapiens
ccaactgagccaa

SEQ ID NO: 448178 - DNA, 15 bp, Homo sapiens
ccaactggaaggctt

SEQ ID NO: 448179 - DNA, 12 bp, Homo sapiens
ccaactttgtag

SEQ ID NO: 448180 - DNA, 21 bp, Homo sapiens
ccaagccagggttccagacag

SEQ ID NO: 448181 - DNA, 18 bp, Homo sapiens
ccaagctgctctccttca

SEQ ID NO: 448182 - DNA, 21 bp, Homo sapiens
ccaaggacactgatgggtcct

SEQ ID NO: 448183 - DNA, 20 bp, Homo sapiens
ccaagtcaaacagtgtggct

SEQ ID NO: 448184 - DNA, 15 bp, Homo sapiens
ccaagtgtgtgtgca

SEQ ID NO: 448185 - DNA, 19 bp, Homo sapiens
ccacaactaacaatgcctt

SEQ ID NO: 448186 - DNA, 17 bp, Homo sapiens
ccacaataatgaataat

SEQ ID NO: 448187 - DNA, 18 bp, Homo sapiens
ccacaccccgtctgcccc

SEQ ID NO: 448188 - DNA, 19 bp, Homo sapiens
ccacaccccgtctgcccct

SEQ ID NO: 448189 - DNA, 14 bp, Homo sapiens
ccacacctccaccc

SEQ ID NO: 448190 - DNA, 15 bp, Homo sapiens
ccacacgccggggct

SEQ ID NO: 448191 - DNA, 17 bp, Homo sapiens
ccacacgccggggctgg

SEQ ID NO: 448192 - DNA, 21 bp, Homo sapiens
ccacacgccggggctggccct

SEQ ID NO: 448193 - DNA, 20 bp, Homo sapiens
ccacacttcaggctcttctc

SEQ ID NO: 448194 - DNA, 23 bp, Homo sapiens
ccacaggcccttcctctccactg

SEQ ID NO: 448195 - DNA, 21 bp, Homo sapiens
ccacagtggggcccatggccc

SEQ ID NO: 448196 - DNA, 22 bp, Homo sapiens
ccacatccccaccctcccctct

SEQ ID NO: 448197 - DNA, 19 bp, Homo sapiens
ccaccaagggtatctgctg

SEQ ID NO: 448198 - DNA, 17 bp, Homo sapiens
ccaccacacacaccctt

SEQ ID NO: 448199 - DNA, 23 bp, Homo sapiens
ccaccaggattaatctctaaaat

SEQ ID NO: 448200 - DNA, 13 bp, Homo sapiens
ccaccatccttcc

SEQ ID NO: 448201 - DNA, 14 bp, Homo sapiens
ccaccatccttcca

SEQ ID NO: 448202 - DNA, 18 bp, Homo sapiens
ccaccatccttccatcct

SEQ ID NO: 448203 - DNA, 22 bp, Homo sapiens
ccaccatccttccatcctgagg

SEQ ID NO: 448204 - DNA, 22 bp, Homo sapiens
ccacccacaccccgtctgcccc

SEQ ID NO: 448205 - DNA, 15 bp, Homo sapiens
ccacccaccaccgct

SEQ ID NO: 448206 - DNA, 18 bp, Homo sapiens
ccacccaccaccgctccc

SEQ ID NO: 448207 - DNA, 17 bp, Homo sapiens
ccacccactagccctct

SEQ ID NO: 448208 - DNA, 13 bp, Homo sapiens
ccacccagaccct

SEQ ID NO: 448209 - DNA, 17 bp, Homo sapiens
ccacccagaccctcctt

SEQ ID NO: 448210 - DNA, 18 bp, Homo sapiens
ccacccagaggtctccct

SEQ ID NO: 448211 - DNA, 13 bp, Homo sapiens
ccaccccactgag

SEQ ID NO: 448212 - DNA, 18 bp, Homo sapiens
ccaccccgctgcctggcg

SEQ ID NO: 448213 - DNA, 19 bp, Homo sapiens
ccaccccggctccccctgc

SEQ ID NO: 448214 - DNA, 19 bp, Homo sapiens
ccacccctccccacccacc

SEQ ID NO: 448215 - DNA, 13 bp, Homo sapiens
ccacccgccccag

SEQ ID NO: 448216 - DNA, 14 bp, Homo sapiens
ccacccgccccaga

SEQ ID NO: 448217 - DNA, 15 bp, Homo sapiens
ccacccgccccagag

SEQ ID NO: 448218 - DNA, 19 bp, Homo sapiens
ccacccgccccagagactg

SEQ ID NO: 448219 - DNA, 12 bp, Homo sapiens
ccacccgcccgc

SEQ ID NO: 448220 - DNA, 18 bp, Homo sapiens
ccaccctcccctctcctg

SEQ ID NO: 448221 - DNA, 12 bp, Homo sapiens
ccaccctgggcc

SEQ ID NO: 448222 - DNA, 17 bp, Homo sapiens
ccaccctgggcctcccg

SEQ ID NO: 448223 - DNA, 13 bp, Homo sapiens
ccacctgcccagt

SEQ ID NO: 448224 - DNA, 16 bp, Homo sapiens
ccagttagcccggcca

SEQ ID NO: 448225 - DNA, 16 bp, Homo sapiens
ccagtttgggaactca

SEQ ID NO: 448226 - DNA, 19 bp, Homo sapiens
ccataagccctgagactcc

SEQ ID NO: 448227 - DNA, 12 bp, Homo sapiens
ccatagacacag

SEQ ID NO: 448228 - DNA, 13 bp, Homo sapiens
ccatagacacagt

SEQ ID NO: 448229 - DNA, 17 bp, Homo sapiens
ccatatataaattatta

SEQ ID NO: 448230 - DNA, 18 bp, Homo sapiens
ccatatataaattattac

SEQ ID NO: 448231 - DNA, 14 bp, Homo sapiens
ccatcccactgata

SEQ ID NO: 448232 - DNA, 14 bp, Homo sapiens
ccatcccctcctag

SEQ ID NO: 448233 - DNA, 18 bp, Homo sapiens
ccatcccctcctagcaca

SEQ ID NO: 448234 - DNA, 13 bp, Homo sapiens
ccatccctgggcc

SEQ ID NO: 448235 - DNA, 16 bp, Homo sapiens
ccatccctgggcccct

SEQ ID NO: 448236 - DNA, 19 bp, Homo sapiens
ccatccctgggcccctcca

SEQ ID NO: 448237 - DNA, 17 bp, Homo sapiens
ccatcctgaggaccgcc

SEQ ID NO: 448238 - DNA, 19 bp, Homo sapiens
ccatcctgaggaccgcccc

SEQ ID NO: 448239 - DNA, 18 bp, Homo sapiens
ccatccttcccgcagcac

SEQ ID NO: 448240 - DNA, 13 bp, Homo sapiens
ccatggccccagc

SEQ ID NO: 448241 - DNA, 21 bp, Homo sapiens
ccatggccccagctggctggg

SEQ ID NO: 448242 - DNA, 22 bp, Homo sapiens
ccatggtgcagtgaagaaaatg

SEQ ID NO: 448243 - DNA, 22 bp, Homo sapiens
ccatggtggtttcagaaagggc

SEQ ID NO: 448244 - DNA, 18 bp, Homo sapiens
ccatgtgcctgcaccagg

SEQ ID NO: 448245 - DNA, 19 bp, Homo sapiens
ccatgtgcctgcaccagga

SEQ ID NO: 448246 - DNA, 12 bp, Homo sapiens
ccatgtgtcccc

SEQ ID NO: 448247 - DNA, 14 bp, Homo sapiens
ccatgtgtcccctc

SEQ ID NO: 448248 - DNA, 15 bp, Homo sapiens
ccatgtgtcccctca

SEQ ID NO: 448249 - DNA, 18 bp, Homo sapiens
atttgccagacagagatc

SEQ ID NO: 448250 - DNA, 19 bp, Homo sapiens
atttgccagacagagatca

SEQ ID NO: 448251 - DNA, 22 bp, Homo sapiens
atttgccagacagagatcagaa

SEQ ID NO: 448252 - DNA, 15 bp, Homo sapiens
atttggattcacagc

SEQ ID NO: 448253 - DNA, 15 bp, Homo sapiens
atttgtcactgaata

SEQ ID NO: 448254 - DNA, 18 bp, Homo sapiens
atttgttatatcagcaga

SEQ ID NO: 448255 - DNA, 23 bp, Homo sapiens
atttgttatatcagcagacactc

SEQ ID NO: 448256 - DNA, 16 bp, Homo sapiens
attttaaaaaataaca

SEQ ID NO: 448257 - DNA, 17 bp, Homo sapiens
attttaaaaaataacat

SEQ ID NO: 448258 - DNA, 14 bp, Homo sapiens
cagacagacagacg

SEQ ID NO: 448259 - DNA, 17 bp, Homo sapiens
cagacagatctggaatg

SEQ ID NO: 448260 - DNA, 13 bp, Homo sapiens
cagacattgtatt

SEQ ID NO: 448261 - DNA, 14 bp, Homo sapiens
cagacattgtattt

SEQ ID NO: 448262 - DNA, 14 bp, Homo sapiens
cagacccctaccct

SEQ ID NO: 448263 - DNA, 13 bp, Homo sapiens
cagacccctggct

SEQ ID NO: 448264 - DNA, 15 bp, Homo sapiens
cagacccctggcttt

SEQ ID NO: 448265 - DNA, 21 bp, Homo sapiens
cagacccctggcttttcactg

SEQ ID NO: 448266 - DNA, 13 bp, Homo sapiens
cagaccctccttc

SEQ ID NO: 448267 - DNA, 14 bp, Homo sapiens
cagaccctccttcc

SEQ ID NO: 448268 - DNA, 15 bp, Homo sapiens
cagaccctccttccc

SEQ ID NO: 448269 - DNA, 17 bp, Homo sapiens
cagaccctccttcccca

SEQ ID NO: 448270 - DNA, 20 bp, Homo sapiens
cagaccctccttccccaccc

SEQ ID NO: 448271 - DNA, 21 bp, Homo sapiens
cagaccctccttccccacccc

SEQ ID NO: 448272 - DNA, 22 bp, Homo sapiens
cagacctccagattattttcta

SEQ ID NO: 448273 - DNA, 12 bp, Homo sapiens
cagacggacggg

SEQ ID NO: 448274 - DNA, 17 bp, Homo sapiens
cagacggacgggacagc

SEQ ID NO: 448275 - DNA, 21 bp, Homo sapiens
cagacggacgggacagcggcc

SEQ ID NO: 448276 - DNA, 16 bp, Homo sapiens
cagactcgagagggct

SEQ ID NO: 448277 - DNA, 17 bp, Homo sapiens
cagactcgagagggctg

SEQ ID NO: 448278 - DNA, 20 bp, Homo sapiens
cagactcgagagggctgagc

SEQ ID NO: 448279 - DNA, 21 bp, Homo sapiens
cagactcgagagggctgagcc

SEQ ID NO: 448280 - DNA, 15 bp, Homo sapiens
cagagaaggcagcag

SEQ ID NO: 448281 - DNA, 16 bp, Homo sapiens
cagagaaggcagcagg

SEQ ID NO: 448282 - DNA, 15 bp, Homo sapiens
cagagacggcagccc

SEQ ID NO: 448283 - DNA, 16 bp, Homo sapiens
cagagacggcagcccc

SEQ ID NO: 448284 - DNA, 17 bp, Homo sapiens
cagagacggcagcccca

SEQ ID NO: 448285 - DNA, 21 bp, Homo sapiens
cagagacggcagccccatcct

SEQ ID NO: 448286 - DNA, 12 bp, Homo sapiens
cagagactgccc

SEQ ID NO: 448287 - DNA, 22 bp, Homo sapiens
cagagactgcccaccctgggcc

SEQ ID NO: 448288 - DNA, 16 bp, Homo sapiens
cagagagaagcacccc

SEQ ID NO: 448289 - DNA, 13 bp, Homo sapiens
cagagagtggctc

SEQ ID NO: 448290 - DNA, 15 bp, Homo sapiens
cagagagtggctcct

SEQ ID NO: 448291 - DNA, 22 bp, Homo sapiens
cagagccacccctaaagagata

SEQ ID NO: 448292 - DNA, 16 bp, Homo sapiens
cagagccccggagcac

SEQ ID NO: 448293 - DNA, 17 bp, Homo sapiens
cagagccccggagcacc

SEQ ID NO: 448294 - DNA, 18 bp, Homo sapiens
cagagcctatggaaaggg

SEQ ID NO: 448295 - DNA, 20 bp, Homo sapiens
cagagctgagtcggctgggc

SEQ ID NO: 448296 - DNA, 15 bp, Homo sapiens
cagaggcagggccct

SEQ ID NO: 448297 - DNA, 18 bp, Homo sapiens
cagaggcagggccctggg

SEQ ID NO: 448298 - DNA, 21 bp, Homo sapiens
cagaggcagggccctggggtc

SEQ ID NO: 448299 - DNA, 17 bp, Homo sapiens
cagaggccgctctgggg

SEQ ID NO: 448300 - DNA, 14 bp, Homo sapiens
cagagggggccaga

SEQ ID NO: 448301 - DNA, 18 bp, Homo sapiens
cagagggggccagaggga

SEQ ID NO: 448302 - DNA, 19 bp, Homo sapiens
cagagggggccagagggac

SEQ ID NO: 448303 - DNA, 23 bp, Homo sapiens
cagagggggccagagggactttg

SEQ ID NO: 448304 - DNA, 11 bp, Homo sapiens
cagaggtctcc

SEQ ID NO: 448305 - DNA, 14 bp, Homo sapiens
cagaggtctcccta

SEQ ID NO: 448306 - DNA, 19 bp, Homo sapiens
cagatgacacataaatctg

SEQ ID NO: 448307 - DNA, 13 bp, Homo sapiens
cagatgcaacctc

SEQ ID NO: 448308 - DNA, 16 bp, Homo sapiens
cagatgcaacctcact

SEQ ID NO: 448309 - DNA, 19 bp, Homo sapiens
cagatgcaacctcactatg

SEQ ID NO: 448310 - DNA, 21 bp, Homo sapiens
cagatggaaagacgtttttgt

SEQ ID NO: 448311 - DNA, 16 bp, Homo sapiens
cagatgggtattaaac

SEQ ID NO: 448312 - DNA, 17 bp, Homo sapiens
cagatgggtattaaact

SEQ ID NO: 448313 - DNA, 23 bp, Homo sapiens
cagatgggttttgttaggggtgg

SEQ ID NO: 448314 - DNA, 19 bp, Homo sapiens
cagattattttctatattt

SEQ ID NO: 448315 - DNA, 23 bp, Homo sapiens
cagattattttctatatttggat

SEQ ID NO: 448316 - DNA, 15 bp, Homo sapiens
cagattccacaggac

SEQ ID NO: 448317 - DNA, 10 bp, Homo sapiens
cagcaaccct

SEQ ID NO: 448318 - DNA, 17 bp, Homo sapiens
cagcaaggggctctgcc

SEQ ID NO: 448319 - DNA, 17 bp, Homo sapiens
cagcaccagcctgagcc

SEQ ID NO: 448320 - DNA, 18 bp, Homo sapiens
cagcaccctcccccgcag

SEQ ID NO: 448321 - DNA, 19 bp, Homo sapiens
cagcaccctcccccgcagc

SEQ ID NO: 448322 - DNA, 14 bp, Homo sapiens
cagcaccctctcct

SEQ ID NO: 448323 - DNA, 16 bp, Homo sapiens
cagcaccctctcctgg

SEQ ID NO: 448324 - DNA, 23 bp, Homo sapiens
cagcaccgtggtgtgaggccccc

SEQ ID NO: 448325 - DNA, 18 bp, Homo sapiens
cagcactaaggccgtgtc

SEQ ID NO: 448326 - DNA, 19 bp, Homo sapiens
cagcactaaggccgtgtct

SEQ ID NO: 448327 - DNA, 12 bp, Homo sapiens
cagcactcccag

SEQ ID NO: 448328 - DNA, 17 bp, Homo sapiens
cagcactcccagggccc

SEQ ID NO: 448329 - DNA, 21 bp, Homo sapiens
cagcactcccagggcccgagc

SEQ ID NO: 448330 - DNA, 21 bp, Homo sapiens
cagcagccccccagcactaag

SEQ ID NO: 448331 - DNA, 15 bp, Homo sapiens
cagcaggggggttgg

SEQ ID NO: 448332 - DNA, 19 bp, Homo sapiens
cagcaggggggttgggttc

SEQ ID NO: 448333 - DNA, 17 bp, Homo sapiens
cagcagtaccatcccac

SEQ ID NO: 448334 - DNA, 18 bp, Homo sapiens
cagcagtacttgctcaat

SEQ ID NO: 448335 - DNA, 19 bp, Homo sapiens
cagcagtgctgggcccagc

SEQ ID NO: 448336 - DNA, 21 bp, Homo sapiens
cagcatatgtgccataaacag

SEQ ID NO: 448337 - DNA, 20 bp, Homo sapiens
cagccaaagaaactcagaag

SEQ ID NO: 448338 - DNA, 12 bp, Homo sapiens
cagccaatttca

SEQ ID NO: 448339 - DNA, 13 bp, Homo sapiens
cagccaatttcaa

SEQ ID NO: 448340 - DNA, 20 bp, Homo sapiens
cagccaatttcaaagaaaac

SEQ ID NO: 448341 - DNA, 16 bp, Homo sapiens
cagccagccgccctgg

SEQ ID NO: 448342 - DNA, 17 bp, Homo sapiens
cagcccagaacgggcct

SEQ ID NO: 448343 - DNA, 14 bp, Homo sapiens
cagccccccagcac

SEQ ID NO: 448344 - DNA, 16 bp, Homo sapiens
atattgtttttatata

SEQ ID NO: 448345 - DNA, 19 bp, Homo sapiens
atatttattattttcatat

SEQ ID NO: 448346 - DNA, 18 bp, Homo sapiens
atatttttttctagctat

SEQ ID NO: 448347 - DNA, 15 bp, Homo sapiens
atcaagacaagtgtt

SEQ ID NO: 448348 - DNA, 15 bp, Homo sapiens
atcaatacttttgtg

SEQ ID NO: 448349 - DNA, 23 bp, Homo sapiens
atcaatacttttgtgtattctgt

SEQ ID NO: 448350 - DNA, 21 bp, Homo sapiens
atcaatctggcttctgcatta

SEQ ID NO: 448351 - DNA, 14 bp, Homo sapiens
atcaatttaaagga

SEQ ID NO: 448352 - DNA, 12 bp, Homo sapiens
atcacaaaatca

SEQ ID NO: 448353 - DNA, 23 bp, Homo sapiens
atcactttgagcctgggaaataa

SEQ ID NO: 448354 - DNA, 18 bp, Homo sapiens
atcagaactcctttctaa

SEQ ID NO: 448355 - DNA, 21 bp, Homo sapiens
atcagaactcctttctaagga

SEQ ID NO: 448356 - DNA, 13 bp, Homo sapiens
atcagacagatct

SEQ ID NO: 448357 - DNA, 16 bp, Homo sapiens
atcagcattcaaaata

SEQ ID NO: 448358 - DNA, 14 bp, Homo sapiens
atcatcaatacttt

SEQ ID NO: 448359 - DNA, 18 bp, Homo sapiens
atcattgccctcttcaag

SEQ ID NO: 448360 - DNA, 23 bp, Homo sapiens
atcattgctgctgtagcaacaga

SEQ ID NO: 448361 - DNA, 19 bp, Homo sapiens
atccaaaatagtcatgttt

SEQ ID NO: 448362 - DNA, 15 bp, Homo sapiens
atgcgcaatgtggca

SEQ ID NO: 448363 - DNA, 16 bp, Homo sapiens
atgcgcaatgtggcat

SEQ ID NO: 448364 - DNA, 15 bp, Homo sapiens
atgctaatgtaatca

SEQ ID NO: 448365 - DNA, 19 bp, Homo sapiens
atgctgactgtactcctcc

SEQ ID NO: 448366 - DNA, 15 bp, Homo sapiens
atgctgctgtgaatt

SEQ ID NO: 448367 - DNA, 15 bp, Homo sapiens
atgctggccagcacc

SEQ ID NO: 448368 - DNA, 22 bp, Homo sapiens
atggaaacacgagatcagtagt

SEQ ID NO: 448369 - DNA, 17 bp, Homo sapiens
atggaaccttccctcca

SEQ ID NO: 448370 - DNA, 18 bp, Homo sapiens
atggaaccttccctccaa

SEQ ID NO: 448371 - DNA, 19 bp, Homo sapiens
atggaaccttccctccaaa

SEQ ID NO: 448372 - DNA, 18 bp, Homo sapiens
atggagactgtctcaaga

SEQ ID NO: 448373 - DNA, 13 bp, Homo sapiens
atggatatttttg

SEQ ID NO: 448374 - DNA, 18 bp, Homo sapiens
atggattcacttctattt

SEQ ID NO: 448375 - DNA, 12 bp, Homo sapiens
atggccccagct

SEQ ID NO: 448376 - DNA, 17 bp, Homo sapiens
atggccccagctggctg

SEQ ID NO: 448377 - DNA, 18 bp, Homo sapiens
atggcttgtagggtgagg

SEQ ID NO: 448378 - DNA, 11 bp, Homo sapiens
atgggaccagg

SEQ ID NO: 448379 - DNA, 14 bp, Homo sapiens
atgggccaagccag

SEQ ID NO: 448380 - DNA, 16 bp, Homo sapiens
atgggggatgggccag

SEQ ID NO: 448381 - DNA, 14 bp, Homo sapiens
atgggtattaaact

SEQ ID NO: 448382 - DNA, 22 bp, Homo sapiens
atgggtattaaacttgtcagaa

SEQ ID NO: 448383 - DNA, 14 bp, Homo sapiens
atgggtcctgctgc

SEQ ID NO: 448384 - DNA, 16 bp, Homo sapiens
atgggtgaaaccacat

SEQ ID NO: 448385 - DNA, 18 bp, Homo sapiens
atgggttgaacaagccac

SEQ ID NO: 448386 - DNA, 23 bp, Homo sapiens
atggtagaaattttatctcttct

SEQ ID NO: 448387 - DNA, 22 bp, Homo sapiens
atggtatgctggccagcaccct

SEQ ID NO: 448388 - DNA, 15 bp, Homo sapiens
atggtgatactccaa

SEQ ID NO: 448389 - DNA, 18 bp, Homo sapiens
atggtgatactccaaggt

SEQ ID NO: 448390 - DNA, 14 bp, Homo sapiens
atggtggtttcaga

SEQ ID NO: 448391 - DNA, 19 bp, Homo sapiens
atggtggtttcagaaaggg

SEQ ID NO: 448392 - DNA, 20 bp, Homo sapiens
atggtttttatttctcgggt

SEQ ID NO: 448393 - DNA, 22 bp, Homo sapiens
atgtaacagcaattttcataat

SEQ ID NO: 448394 - DNA, 12 bp, Homo sapiens
atgtaagaagaa

SEQ ID NO: 448395 - DNA, 13 bp, Homo sapiens
atgtaagaagaaa

SEQ ID NO: 448396 - DNA, 17 bp, Homo sapiens
atgtaatcatttatctt

SEQ ID NO: 448397 - DNA, 14 bp, Homo sapiens
atgtagaactgttc

SEQ ID NO: 448398 - DNA, 17 bp, Homo sapiens
atgtagaactgttcatt

SEQ ID NO: 448399 - DNA, 14 bp, Homo sapiens
atgtagcatataaa

SEQ ID NO: 448400 - DNA, 23 bp, Homo sapiens
atgtataacaagccaaacattct

SEQ ID NO: 448401 - DNA, 12 bp, Homo sapiens
atgtattatgca

SEQ ID NO: 448402 - DNA, 17 bp, Homo sapiens
atgtcatactctgtgta

SEQ ID NO: 448403 - DNA, 21 bp, Homo sapiens
atgtcatactctgtgtaatct

SEQ ID NO: 448404 - DNA, 22 bp, Homo sapiens
atgtcatactctgtgtaatctc

SEQ ID NO: 448405 - DNA, 16 bp, Homo sapiens
atgtccccattctata

SEQ ID NO: 448406 - DNA, 12 bp, Homo sapiens
atgtctactgct

SEQ ID NO: 448407 - DNA, 14 bp, Homo sapiens
atgtcttgagatgt

SEQ ID NO: 448408 - DNA, 16 bp, Homo sapiens
atgtcttgagatgtat

SEQ ID NO: 448409 - DNA, 14 bp, Homo sapiens
atgtgaaataaaga

SEQ ID NO: 448410 - DNA, 19 bp, Homo sapiens
atgtgattggcagcttcaa

SEQ ID NO: 448411 - DNA, 15 bp, Homo sapiens
atgtgcctgcaccag

SEQ ID NO: 448412 - DNA, 15 bp, Homo sapiens
atgtgctttcatcca

SEQ ID NO: 448413 - DNA, 20 bp, Homo sapiens
atgtgcttttccatctaaaa

SEQ ID NO: 448414 - DNA, 21 bp, Homo sapiens
atgtgcttttccatctaaaat

SEQ ID NO: 448415 - DNA, 17 bp, Homo sapiens
atgtggcttcttcaact

SEQ ID NO: 448416 - DNA, 17 bp, Homo sapiens
atgtgtccatgtgaaat

SEQ ID NO: 448417 - DNA, 21 bp, Homo sapiens
atgtgtccatgtgaaatttac

SEQ ID NO: 448418 - DNA, 16 bp, Homo sapiens
atgtgtggctcattct

SEQ ID NO: 448419 - DNA, 20 bp, Homo sapiens
atgtgtggctcattcttttc

SEQ ID NO: 448420 - DNA, 14 bp, Homo sapiens
atgtgttgcaaatt

SEQ ID NO: 448421 - DNA, 19 bp, Homo sapiens
atgtgttgcaaattattct

SEQ ID NO: 448422 - DNA, 18 bp, Homo sapiens
atgttaaacgtcacagca

SEQ ID NO: 448423 - DNA, 19 bp, Homo sapiens
atgttaaacgtcacagcag

SEQ ID NO: 448424 - DNA, 13 bp, Homo sapiens
atgttaagctctt

SEQ ID NO: 448425 - DNA, 15 bp, Homo sapiens
atgttaagctcttta

SEQ ID NO: 448426 - DNA, 13 bp, Homo sapiens
atgttatttttgg

SEQ ID NO: 448427 - DNA, 17 bp, Homo sapiens
atgttccgttcatctga

SEQ ID NO: 448428 - DNA, 20 bp, Homo sapiens
atgttccgttcatctgagga

SEQ ID NO: 448429 - DNA, 20 bp, Homo sapiens
atgttgttcaaatgcatttt

SEQ ID NO: 448430 - DNA, 20 bp, Homo sapiens
atgtttaagaaatgagaaat

SEQ ID NO: 448431 - DNA, 23 bp, Homo sapiens
atgtttacctcactggtgcattt

SEQ ID NO: 448432 - DNA, 21 bp, Homo sapiens
atgtttctgcagtattctgta

SEQ ID NO: 448433 - DNA, 22 bp, Homo sapiens
atgtttgttttcaaaatacttc

SEQ ID NO: 448434 - DNA, 18 bp, Homo sapiens
atgttttacaatggctgg

SEQ ID NO: 448435 - DNA, 14 bp, Homo sapiens
atgttttgaatgat

SEQ ID NO: 448436 - DNA, 13 bp, Homo sapiens
attaaacttcagc

SEQ ID NO: 448437 - DNA, 14 bp, Homo sapiens
attaaacttcagca

SEQ ID NO: 448438 - DNA, 16 bp, Homo sapiens
attaaacttcagcaac

SEQ ID NO: 448439 - DNA, 21 bp, Homo sapiens
attaactctgcatagacaaag

SEQ ID NO: 448440 - DNA, 14 bp, Homo sapiens
attaatctctaaaa

SEQ ID NO: 448441 - DNA, 16 bp, Homo sapiens
attactattaactctg

SEQ ID NO: 448442 - DNA, 18 bp, Homo sapiens
attactttaaattatatg

SEQ ID NO: 448443 - DNA, 13 bp, Homo sapiens
attacttttgaaa

SEQ ID NO: 448444 - DNA, 19 bp, Homo sapiens
attacttttgaaaaaggat

SEQ ID NO: 448445 - DNA, 15 bp, Homo sapiens
attagactgaattta

SEQ ID NO: 448446 - DNA, 17 bp, Homo sapiens
attataatgcatctaaa

SEQ ID NO: 448447 - DNA, 18 bp, Homo sapiens
attataatgcatctaaac

SEQ ID NO: 448448 - DNA, 17 bp, Homo sapiens
attatatacaaagctgt

SEQ ID NO: 448449 - DNA, 14 bp, Homo sapiens
attatatgatatgc

SEQ ID NO: 448450 - DNA, 23 bp, Homo sapiens
attatctgggttttagaaattct

SEQ ID NO: 448451 - DNA, 14 bp, Homo sapiens
attattactttaaa

SEQ ID NO: 448452 - DNA, 12 bp, Homo sapiens
attattctagtc

SEQ ID NO: 448453 - DNA, 13 bp, Homo sapiens
attattgaatgtt

SEQ ID NO: 448454 - DNA, 16 bp, Homo sapiens
attattgaatgttata

SEQ ID NO: 448455 - DNA, 20 bp, Homo sapiens
attattgaatgttatatcat

SEQ ID NO: 448456 - DNA, 22 bp, Homo sapiens
attattgaatgttatatcatca

SEQ ID NO: 448457 - DNA, 13 bp, Homo sapiens
attattttctata

SEQ ID NO: 448458 - DNA, 16 bp, Homo sapiens
attcaaatgcatgata

SEQ ID NO: 448459 - DNA, 18 bp, Homo sapiens
attcaaatgcatgatatt

SEQ ID NO: 448460 - DNA, 17 bp, Homo sapiens
agcacccccagcctccc

SEQ ID NO: 448461 - DNA, 18 bp, Homo sapiens
agcacccccagcctcccc

SEQ ID NO: 448462 - DNA, 20 bp, Homo sapiens
agcacccccagcctccccca

SEQ ID NO: 448463 - DNA, 13 bp, Homo sapiens
agcaccctctcct

SEQ ID NO: 448464 - DNA, 14 bp, Homo sapiens
agcaccctctcctg

SEQ ID NO: 448465 - DNA, 22 bp, Homo sapiens
agcaccgtggtgtgaggccccc

SEQ ID NO: 448466 - DNA, 16 bp, Homo sapiens
agcactagaatgagaa

SEQ ID NO: 448467 - DNA, 18 bp, Homo sapiens
agcactagaatgagaaat

SEQ ID NO: 448468 - DNA, 18 bp, Homo sapiens
agcagagacggcagcccc

SEQ ID NO: 448469 - DNA, 13 bp, Homo sapiens
agcagattccaca

SEQ ID NO: 448470 - DNA, 17 bp, Homo sapiens
agcagattccacaggac

SEQ ID NO: 448471 - DNA, 13 bp, Homo sapiens
agcagccccccag

SEQ ID NO: 448472 - DNA, 17 bp, Homo sapiens
agcagccccccagcact

SEQ ID NO: 448473 - DNA, 18 bp, Homo sapiens
agcagccccccagcacta

SEQ ID NO: 448474 - DNA, 20 bp, Homo sapiens
agcaggggggttgggttcca

SEQ ID NO: 448475 - DNA, 23 bp, Homo sapiens
agcaggggggttgggttccagac

SEQ ID NO: 448476 - DNA, 15 bp, Homo sapiens
agcagtaccatccca

SEQ ID NO: 448477 - DNA, 19 bp, Homo sapiens
agcagtaccatcccactga

SEQ ID NO: 448478 - DNA, 15 bp, Homo sapiens
agcagtacttgctca

SEQ ID NO: 448479 - DNA, 20 bp, Homo sapiens
agcagtacttgctcaataaa

SEQ ID NO: 448480 - DNA, 14 bp, Homo sapiens
agcagtgctgggcc

SEQ ID NO: 448481 - DNA, 16 bp, Homo sapiens
agcagtgctgggccca

SEQ ID NO: 448482 - DNA, 19 bp, Homo sapiens
agcagtgctgggcccagcc

SEQ ID NO: 448483 - DNA, 20 bp, Homo sapiens
agcagtgctgggcccagccg

SEQ ID NO: 448484 - DNA, 15 bp, Homo sapiens
agcagtggggagcgg

SEQ ID NO: 448485 - DNA, 16 bp, Homo sapiens
agcatagttctgcaat

SEQ ID NO: 448486 - DNA, 15 bp, Homo sapiens
agcatataaatgttt

SEQ ID NO: 448487 - DNA, 18 bp, Homo sapiens
agcatataaatgtttata

SEQ ID NO: 448488 - DNA, 18 bp, Homo sapiens
agcattatccttttatct

SEQ ID NO: 448489 - DNA, 13 bp, Homo sapiens
agcattcaaaata

SEQ ID NO: 448490 - DNA, 23 bp, Homo sapiens
agggaaatcaatttaaaggaaag

SEQ ID NO: 448491 - DNA, 14 bp, Homo sapiens
agggaaatccaact

SEQ ID NO: 448492 - DNA, 21 bp, Homo sapiens
agggaagcccacccgccccag

SEQ ID NO: 448493 - DNA, 22 bp, Homo sapiens
agggaagcccacccgccccaga

SEQ ID NO: 448494 - DNA, 21 bp, Homo sapiens
agggaatccatatcagctctg

SEQ ID NO: 448495 - DNA, 12 bp, Homo sapiens
agggagaaggat

SEQ ID NO: 448496 - DNA, 17 bp, Homo sapiens
agggaggggagaaagga

SEQ ID NO: 448497 - DNA, 20 bp, Homo sapiens
agggatgggggatgggccag

SEQ ID NO: 448498 - DNA, 16 bp, Homo sapiens
agggcactggtggccc

SEQ ID NO: 448499 - DNA, 17 bp, Homo sapiens
agggcactggtggcccg

SEQ ID NO: 448500 - DNA, 15 bp, Homo sapiens
agggcagcccctccc

SEQ ID NO: 448501 - DNA, 17 bp, Homo sapiens
agggcagcccctcccca

SEQ ID NO: 448502 - DNA, 14 bp, Homo sapiens
agggcaggagctgc

SEQ ID NO: 448503 - DNA, 18 bp, Homo sapiens
agggcagggttctagaag

SEQ ID NO: 448504 - DNA, 17 bp, Homo sapiens
agggcatggccaggtgg

SEQ ID NO: 448505 - DNA, 20 bp, Homo sapiens
agggccctggggtctctgag

SEQ ID NO: 448506 - DNA, 23 bp, Homo sapiens
agggccctggggtctctgagcag

SEQ ID NO: 448507 - DNA, 18 bp, Homo sapiens
agggccgcagggcgctcc

SEQ ID NO: 448508 - DNA, 14 bp, Homo sapiens
agggctgacaaggc

SEQ ID NO: 448509 - DNA, 14 bp, Homo sapiens
agggctgagcccct

SEQ ID NO: 448510 - DNA, 15 bp, Homo sapiens
agggctgagcccctc

SEQ ID NO: 448511 - DNA, 17 bp, Homo sapiens
agggcttctaccagaga

SEQ ID NO: 448512 - DNA, 21 bp, Homo sapiens
aggggacagatcttgagcaag

SEQ ID NO: 448513 - DNA, 23 bp, Homo sapiens
aggggatctaaaaggaggacagg

SEQ ID NO: 448514 - DNA, 11 bp, Homo sapiens
aggggctctgc

SEQ ID NO: 448515 - DNA, 15 bp, Homo sapiens
aggggcttggagcag

SEQ ID NO: 448516 - DNA, 16 bp, Homo sapiens
aggggcttggagcaga

SEQ ID NO: 448517 - DNA, 19 bp, Homo sapiens
aggggcttggagcagagac

SEQ ID NO: 448518 - DNA, 15 bp, Homo sapiens
aggggtcagcagggg

SEQ ID NO: 448519 - DNA, 22 bp, Homo sapiens
aggggtcagcaggggggttggg

SEQ ID NO: 448520 - DNA, 15 bp, Homo sapiens
aggggtgagacagtg

SEQ ID NO: 448521 - DNA, 17 bp, Homo sapiens
aggggtgggggagaatg

SEQ ID NO: 448522 - DNA, 18 bp, Homo sapiens
agggtgcaggcgcgcacc

SEQ ID NO: 448523 - DNA, 18 bp, Homo sapiens
agggtgctccctcctcag

SEQ ID NO: 448524 - DNA, 22 bp, Homo sapiens
agggtgggcgtgacttcagact

SEQ ID NO: 448525 - DNA, 21 bp, Homo sapiens
agggttaaagaaaggcagaga

SEQ ID NO: 448526 - DNA, 14 bp, Homo sapiens
agggttctagaagg

SEQ ID NO: 448527 - DNA, 15 bp, Homo sapiens
agggttctagaaggg

SEQ ID NO: 448528 - DNA, 23 bp, Homo sapiens
agggtttggaagaaagggagaag

SEQ ID NO: 448529 - DNA, 22 bp, Homo sapiens
aggtaatggatatgaaagagaa

SEQ ID NO: 448530 - DNA, 17 bp, Homo sapiens
aggtacctttccaccca

SEQ ID NO: 448531 - DNA, 22 bp, Homo sapiens
aggtacctttccacccagaccc

SEQ ID NO: 448532 - DNA, 23 bp, Homo sapiens
aggtacctttccacccagaccct

SEQ ID NO: 448533 - DNA, 17 bp, Homo sapiens
aggtcctgcccatgtgt

SEQ ID NO: 448534 - DNA, 17 bp, Homo sapiens
aggtctcaccttcgcct

SEQ ID NO: 448535 - DNA, 13 bp, Homo sapiens
aggtctccacccc

SEQ ID NO: 448536 - DNA, 14 bp, Homo sapiens
aggtctccacccct

SEQ ID NO: 448537 - DNA, 23 bp, Homo sapiens
aggtctccacccctcaagccagg

SEQ ID NO: 448538 - DNA, 21 bp, Homo sapiens
aggtctccccatgtgcctgca

SEQ ID NO: 448539 - DNA, 18 bp, Homo sapiens
aggtctgaaggcctccat

SEQ ID NO: 448540 - DNA, 21 bp, Homo sapiens
aggtctgaaggcctccatttg

SEQ ID NO: 448541 - DNA, 11 bp, Homo sapiens
aggtgaataac

SEQ ID NO: 448542 - DNA, 16 bp, Homo sapiens
aggtgcccagtcttga

SEQ ID NO: 448543 - DNA, 18 bp, Homo sapiens
aggtgcccagtcttgagt

SEQ ID NO: 448544 - DNA, 20 bp, Homo sapiens
aggtgcccagtcttgagtgg

SEQ ID NO: 448545 - DNA, 22 bp, Homo sapiens
aggtgcggaccggagcggctga

SEQ ID NO: 448546 - DNA, 15 bp, Homo sapiens
aggtggattcatgtc

SEQ ID NO: 448547 - DNA, 17 bp, Homo sapiens
aggtggtcttggagagg

SEQ ID NO: 448548 - DNA, 19 bp, Homo sapiens
aggtggtcttggagaggag

SEQ ID NO: 448549 - DNA, 21 bp, Homo sapiens
aggtggtcttggagaggaggt

SEQ ID NO: 448550 - DNA, 15 bp, Homo sapiens
aggtgtggagtggag

SEQ ID NO: 448551 - DNA, 16 bp, Homo sapiens
aggtgtggagtggagg

SEQ ID NO: 448552 - DNA, 14 bp, Homo sapiens
aggttcctcctagg

SEQ ID NO: 448553 - DNA, 13 bp, Homo sapiens
aggttcttgctgc

SEQ ID NO: 448554 - DNA, 15 bp, Homo sapiens
agtaaataaactctt

SEQ ID NO: 448555 - DNA, 23 bp, Homo sapiens
agtaaataaactcttcaaggcca

SEQ ID NO: 448556 - DNA, 20 bp, Homo sapiens
agtaaataatgattcaatgt

SEQ ID NO: 448557 - DNA, 17 bp, Homo sapiens
agtaaatcccacgacat

SEQ ID NO: 448558 - DNA, 20 bp, Homo sapiens
agtaaccaggccccagcctc

SEQ ID NO: 448559 - DNA, 20 bp, Homo sapiens
agtaacctctacaggcattt

SEQ ID NO: 448560 - DNA, 18 bp, Homo sapiens
agtaagctgctctattgt

SEQ ID NO: 448561 - DNA, 17 bp, Homo sapiens
agtacagggcaggagct

SEQ ID NO: 448562 - DNA, 20 bp, Homo sapiens
agtacagggcaggagctgct

SEQ ID NO: 448563 - DNA, 18 bp, Homo sapiens
agtaccatcccactgata

SEQ ID NO: 448564 - DNA, 23 bp, Homo sapiens
agtagcccacaataatgaataat

SEQ ID NO: 448565 - DNA, 21 bp, Homo sapiens
agtagctgttttgaataacat

SEQ ID NO: 448566 - DNA, 21 bp, Homo sapiens
agtaggctgtattttctttta

SEQ ID NO: 448567 - DNA, 20 bp, Homo sapiens
agtaggtgggtcttggattg

SEQ ID NO: 448568 - DNA, 14 bp, Homo sapiens
agtagtgcctgtga

SEQ ID NO: 448569 - DNA, 15 bp, Homo sapiens
agtatataagctttt

SEQ ID NO: 448570 - DNA, 17 bp, Homo sapiens
agtatataagctttttt

SEQ ID NO: 448571 - DNA, 16 bp, Homo sapiens
agtatatttatttcta

SEQ ID NO: 448572 - DNA, 18 bp, Homo sapiens
agtattgacttctttttg

SEQ ID NO: 448573 - DNA, 13 bp, Homo sapiens
agtcaactgctgt

SEQ ID NO: 448574 - DNA, 16 bp, Homo sapiens
agtcaactgctgtttt

SEQ ID NO: 448575 - DNA, 21 bp, Homo sapiens
agtcacagccgtttgaatata

SEQ ID NO: 448576 - DNA, 13 bp, Homo sapiens
agtcactgcacag

SEQ ID NO: 448577 - DNA, 13 bp, Homo sapiens
agtcatctcaaac

SEQ ID NO: 448578 - DNA, 12 bp, Homo sapiens
agtccactttcc

SEQ ID NO: 448579 - DNA, 16 bp, Homo sapiens
agtccactttcctctc

SEQ ID NO: 448580 - DNA, 20 bp, Homo sapiens
agtccactttcctctctctc

SEQ ID NO: 448581 - DNA, 13 bp, Homo sapiens
agtccagctcccc

SEQ ID NO: 448582 - DNA, 12 bp, Homo sapiens
agtccccccacc

SEQ ID NO: 448583 - DNA, 13 bp, Homo sapiens
agtccccccaccc

SEQ ID NO: 448584 - DNA, 14 bp, Homo sapiens
agtccccccacccc

SEQ ID NO: 448585 - DNA, 16 bp, Homo sapiens
agtccccccacccctc

SEQ ID NO: 448586 - DNA, 20 bp, Homo sapiens
agtccccccacccctcccca

SEQ ID NO: 448587 - DNA, 18 bp, Homo sapiens
actctttagttgatttaa

SEQ ID NO: 448588 - DNA, 13 bp, Homo sapiens
actgaactcagga

SEQ ID NO: 448589 - DNA, 21 bp, Homo sapiens
actgaattgttatgtaaacat

SEQ ID NO: 448590 - DNA, 21 bp, Homo sapiens
actgacagatgaccgcaataa

SEQ ID NO: 448591 - DNA, 18 bp, Homo sapiens
actgagagctgctccttt

SEQ ID NO: 448592 - DNA, 13 bp, Homo sapiens
actgagccaaaaa

SEQ ID NO: 448593 - DNA, 20 bp, Homo sapiens
actgatatcacgggcccgct

SEQ ID NO: 448594 - DNA, 22 bp, Homo sapiens
actgatatcacgggcccgctca

SEQ ID NO: 448595 - DNA, 13 bp, Homo sapiens
actgcatgcaagc

SEQ ID NO: 448596 - DNA, 18 bp, Homo sapiens
actgcatgcaagctcagg

SEQ ID NO: 448597 - DNA, 16 bp, Homo sapiens
actgccattagactga

SEQ ID NO: 448598 - DNA, 11 bp, Homo sapiens
actgcccaccc

SEQ ID NO: 448599 - DNA, 17 bp, Homo sapiens
actgcccaccctgggcc

SEQ ID NO: 448600 - DNA, 21 bp, Homo sapiens
actgcccaccctgggcctccc

SEQ ID NO: 448601 - DNA, 20 bp, Homo sapiens
actgcccccctcctttccaa

SEQ ID NO: 448602 - DNA, 12 bp, Homo sapiens
actgctggctgc

SEQ ID NO: 448603 - DNA, 14 bp, Homo sapiens
actgctggctgcct

SEQ ID NO: 448604 - DNA, 15 bp, Homo sapiens
actgctggctgcctt

SEQ ID NO: 448605 - DNA, 15 bp, Homo sapiens
actgctgttttatgt

SEQ ID NO: 448606 - DNA, 15 bp, Homo sapiens
actggagttcacttt

SEQ ID NO: 448607 - DNA, 19 bp, Homo sapiens
actggcccacccctcttcc

SEQ ID NO: 448608 - DNA, 14 bp, Homo sapiens
actgtaatcttaaa

SEQ ID NO: 448609 - DNA, 18 bp, Homo sapiens
actgtaatcttaaaagtg

SEQ ID NO: 448610 - DNA, 13 bp, Homo sapiens
actgtactcctcc

SEQ ID NO: 448611 - DNA, 15 bp, Homo sapiens
actgtactcctccca

SEQ ID NO: 448612 - DNA, 17 bp, Homo sapiens
actgtatctaaaaaata

SEQ ID NO: 448613 - DNA, 22 bp, Homo sapiens
actgtatctaaaaaataactgt

SEQ ID NO: 448614 - DNA, 23 bp, Homo sapiens
actgtattgggacgctggtaact

SEQ ID NO: 448615 - DNA, 16 bp, Homo sapiens
actgtcttcaaccctg

SEQ ID NO: 448616 - DNA, 19 bp, Homo sapiens
actgtcttcaaccctgccc

SEQ ID NO: 448617 - DNA, 12 bp, Homo sapiens
actgttctaact

SEQ ID NO: 448618 - DNA, 18 bp, Homo sapiens
actgtttgtaatatacag

SEQ ID NO: 448619 - DNA, 21 bp, Homo sapiens
actgttttgtgcggtgtgtct

SEQ ID NO: 448620 - DNA, 14 bp, Homo sapiens
acttaaaagaacat

SEQ ID NO: 448621 - DNA, 13 bp, Homo sapiens
acttacactgaaa

SEQ ID NO: 448622 - DNA, 14 bp, Homo sapiens
acttatgctgctgt

SEQ ID NO: 448623 - DNA, 16 bp, Homo sapiens
acttatgctgctgtga

SEQ ID NO: 448624 - DNA, 18 bp, Homo sapiens
accagcatagttctgcaa

SEQ ID NO: 448625 - DNA, 15 bp, Homo sapiens
accagctatctgtca

SEQ ID NO: 448626 - DNA, 17 bp, Homo sapiens
accagctatctgtcatc

SEQ ID NO: 448627 - DNA, 17 bp, Homo sapiens
accaggccccagcctcc

SEQ ID NO: 448628 - DNA, 21 bp, Homo sapiens
accaggccccagcctccaggc

SEQ ID NO: 448629 - DNA, 20 bp, Homo sapiens
accaggttacctcactttta

SEQ ID NO: 448630 - DNA, 19 bp, Homo sapiens
accatatgattgaaaagaa

SEQ ID NO: 448631 - DNA, 18 bp, Homo sapiens
accatcccctcctagcac

SEQ ID NO: 448632 - DNA, 12 bp, Homo sapiens
accatccttcca

SEQ ID NO: 448633 - DNA, 20 bp, Homo sapiens
accattaagaacaaggaatt

SEQ ID NO: 448634 - DNA, 19 bp, Homo sapiens
accattatggctttgtgct

SEQ ID NO: 448635 - DNA, 12 bp, Homo sapiens
accattccccat

SEQ ID NO: 448636 - DNA, 22 bp, Homo sapiens
accatttatctactatttgaaa

SEQ ID NO: 448637 - DNA, 19 bp, Homo sapiens
acccaaggtggtcttggag

SEQ ID NO: 448638 - DNA, 21 bp, Homo sapiens
acccacaccccgtctgcccct

SEQ ID NO: 448639 - DNA, 13 bp, Homo sapiens
acccaccctctgg

SEQ ID NO: 448640 - DNA, 14 bp, Homo sapiens
acccaccctctggt

SEQ ID NO: 448641 - DNA, 16 bp, Homo sapiens
acccaccctctggtcc

SEQ ID NO: 448642 - DNA, 17 bp, Homo sapiens
acccactaagtaacctc

SEQ ID NO: 448643 - DNA, 15 bp, Homo sapiens
acccactagccctct

SEQ ID NO: 448644 - DNA, 21 bp, Homo sapiens
acccactagccctctttctct

SEQ ID NO: 448645 - DNA, 24 bp, Homo sapiens
acccactagccctctttctctctg

SEQ ID NO: 448646 - DNA, 16 bp, Homo sapiens
acccagaccctccttc

SEQ ID NO: 448647 - DNA, 15 bp, Homo sapiens
acccagtgggacaga

SEQ ID NO: 448648 - DNA, 13 bp, Homo sapiens
accccaccacaca

SEQ ID NO: 448649 - DNA, 19 bp, Homo sapiens
accccactgagagctgctc

SEQ ID NO: 448650 - DNA, 21 bp, Homo sapiens
accccactgagagctgctcct

SEQ ID NO: 448651 - DNA, 19 bp, Homo sapiens
accccacttatgctgctgt

SEQ ID NO: 448652 - DNA, 22 bp, Homo sapiens
accccacttatgctgctgtgaa

SEQ ID NO: 448653 - DNA, 20 bp, Homo sapiens
accccataagccctgagact

SEQ ID NO: 448654 - DNA, 14 bp, Homo sapiens
acccccacctcccg

SEQ ID NO: 448655 - DNA, 13 bp, Homo sapiens
acccccagcctcc

SEQ ID NO: 448656 - DNA, 14 bp, Homo sapiens
acccccagcctccc

SEQ ID NO: 448657 - DNA, 17 bp, Homo sapiens
acccccagcctccccca

SEQ ID NO: 448658 - DNA, 18 bp, Homo sapiens
acccccagcctcccccag

SEQ ID NO: 448659 - DNA, 14 bp, Homo sapiens
accccgctgcctgg

SEQ ID NO: 448660 - DNA, 21 bp, Homo sapiens
accccgctgcctggcgggcag

SEQ ID NO: 448661 - DNA, 21 bp, Homo sapiens
accccggctccccctgccagc

SEQ ID NO: 448662 - DNA, 22 bp, Homo sapiens
accccggctccccctgccagca

SEQ ID NO: 448663 - DNA, 19 bp, Homo sapiens
accccgtcccggccccgcg

SEQ ID NO: 448664 - DNA, 18 bp, Homo sapiens
accccgtccctttccctg

SEQ ID NO: 448665 - DNA, 20 bp, Homo sapiens
accccgtccctttccctgca

SEQ ID NO: 448666 - DNA, 16 bp, Homo sapiens
accccgtctgcccctt

SEQ ID NO: 448667 - DNA, 12 bp, Homo sapiens
acccctccccac

SEQ ID NO: 448668 - DNA, 13 bp, Homo sapiens
acccctcttcccc

SEQ ID NO: 448669 - DNA, 18 bp, Homo sapiens
acccctcttcccccttcc

SEQ ID NO: 448670 - DNA, 22 bp, Homo sapiens
acccctcttcccccttcccctg

SEQ ID NO: 448671 - DNA, 20 bp, Homo sapiens
acccctggcttttcactgct

SEQ ID NO: 448672 - DNA, 18 bp, Homo sapiens
acccgccccagagactgc

SEQ ID NO: 448673 - DNA, 21 bp, Homo sapiens
acccgccccagagactgccca

SEQ ID NO: 448674 - DNA, 22 bp, Homo sapiens
acccgccccagagactgcccac

SEQ ID NO: 448675 - DNA, 14 bp, Homo sapiens
acccgcccgccccc

SEQ ID NO: 448676 - DNA, 22 bp, Homo sapiens
accctacagtatataagctttt

SEQ ID NO: 448677 - DNA, 21 bp, Homo sapiens
accctaggtctccacccctca

SEQ ID NO: 448678 - DNA, 24 bp, Homo sapiens
accctaggtctccacccctcaagc

SEQ ID NO: 448679 - DNA, 17 bp, Homo sapiens
accctagtgatttttgg

SEQ ID NO: 448680 - DNA, 16 bp, Homo sapiens
accctccactctgagg

SEQ ID NO: 448681 - DNA, 13 bp, Homo sapiens
accctcccccgca

SEQ ID NO: 448682 - DNA, 14 bp, Homo sapiens
accctcccccgcag

SEQ ID NO: 448683 - DNA, 15 bp, Homo sapiens
accctcccccgcagc

SEQ ID NO: 448684 - DNA, 15 bp, Homo sapiens
accctcccctctcct

SEQ ID NO: 448685 - DNA, 14 bp, Homo sapiens
accctccctgtccc

SEQ ID NO: 448686 - DNA, 14 bp, Homo sapiens
accctcggagcccc

SEQ ID NO: 448687 - DNA, 15 bp, Homo sapiens
accctcggagccccc

SEQ ID NO: 448688 - DNA, 22 bp, Homo sapiens
accctcggagccccccactcag

SEQ ID NO: 448689 - DNA, 23 bp, Homo sapiens
accctcggagccccccactcagt

SEQ ID NO: 448690 - DNA, 14 bp, Homo sapiens
accctctggtcctt

SEQ ID NO: 448691 - DNA, 17 bp, Homo sapiens
accctctggtccttctg

SEQ ID NO: 448692 - DNA, 18 bp, Homo sapiens
accctctggtccttctga

SEQ ID NO: 448693 - DNA, 20 bp, Homo sapiens
accctcttctcagctccact

SEQ ID NO: 448694 - DNA, 16 bp, Homo sapiens
accctgccctgcacct

SEQ ID NO: 448695 - DNA, 15 bp, Homo sapiens
accctgggcctcccg

SEQ ID NO: 448696 - DNA, 10 bp, Homo sapiens
acccttcccc

SEQ ID NO: 448697 - DNA, 13 bp, Homo sapiens
acccttccccact

SEQ ID NO: 448698 - DNA, 16 bp, Homo sapiens
acccttccccactccc

SEQ ID NO: 448699 - DNA, 17 bp, Homo sapiens
accgagtctcttctcca

SEQ ID NO: 448700 - DNA, 24 bp, Homo sapiens
accgagtctcttctccactggatg

SEQ ID NO: 448701 - DNA, 15 bp, Homo sapiens
accgcaatatgggag

SEQ ID NO: 448702 - DNA, 13 bp, Homo sapiens
accgccaccccac

SEQ ID NO: 448703 - DNA, 15 bp, Homo sapiens
accgccaccccactg

SEQ ID NO: 448704 - DNA, 20 bp, Homo sapiens
accgccaccccactgagagc

SEQ ID NO: 448705 - DNA, 18 bp, Homo sapiens
accgcccaacccccacct

SEQ ID NO: 448706 - DNA, 19 bp, Homo sapiens
accgcccaacccccacctc

SEQ ID NO: 448707 - DNA, 12 bp, Homo sapiens
accgcccaccca

SEQ ID NO: 448708 - DNA, 16 bp, Homo sapiens
accgcccacccacacc

SEQ ID NO: 448709 - DNA, 23 bp, Homo sapiens
accgccccaaccctcggagcccc

SEQ ID NO: 448710 - DNA, 16 bp, Homo sapiens
accggcccgccacctt

SEQ ID NO: 448711 - DNA, 20 bp, Homo sapiens
accgggagcctccccctcag

SEQ ID NO: 448712 - DNA, 22 bp, Homo sapiens
accgtggtgagcatacagagtg

SEQ ID NO: 448713 - DNA, 18 bp, Homo sapiens
accgtggtgtgaggcccc

SEQ ID NO: 448714 - DNA, 20 bp, Homo sapiens
accgtggtgtgaggcccccg

SEQ ID NO: 448715 - DNA, 22 bp, Homo sapiens
accgtggtgtgaggcccccgga

SEQ ID NO: 448716 - DNA, 19 bp, Homo sapiens
acctaaatccattttctaa

SEQ ID NO: 448717 - DNA, 20 bp, Homo sapiens
acctaaatccattttctaaa

SEQ ID NO: 448718 - DNA, 19 bp, Homo sapiens
acctaagagccacaataag

SEQ ID NO: 448719 - DNA, 14 bp, Homo sapiens
acctacatctgaaa

SEQ ID NO: 448720 - DNA, 16 bp, Homo sapiens
acctacatctgaaatc

SEQ ID NO: 448721 - DNA, 14 bp, Homo sapiens
agactctctcctct

SEQ ID NO: 448722 - DNA, 21 bp, Homo sapiens
agactctctcctctctctccc

SEQ ID NO: 448723 - DNA, 22 bp, Homo sapiens
agactctctcctctctctccct

SEQ ID NO: 448724 - DNA, 12 bp, Homo sapiens
agactgaattta

SEQ ID NO: 448725 - DNA, 14 bp, Homo sapiens
agactgcccaccct

SEQ ID NO: 448726 - DNA, 15 bp, Homo sapiens
agactgcccaccctg

SEQ ID NO: 448727 - DNA, 16 bp, Homo sapiens
agactgcccaccctgg

SEQ ID NO: 448728 - DNA, 19 bp, Homo sapiens
agactgcccaccctgggcc

SEQ ID NO: 448729 - DNA, 22 bp, Homo sapiens
agactgcccaccctgggcctcc

SEQ ID NO: 448730 - DNA, 18 bp, Homo sapiens
acttaaaagaacatagga

SEQ ID NO: 448731 - DNA, 20 bp, Homo sapiens
acttaaaagaacataggaat

SEQ ID NO: 448732 - DNA, 18 bp, Homo sapiens
acttaaactttgtcactt

SEQ ID NO: 448733 - DNA, 22 bp, Homo sapiens
acttaaactttgtcacttctgc

SEQ ID NO: 448734 - DNA, 17 bp, Homo sapiens
acttaagcatttaggaa

SEQ ID NO: 448735 - DNA, 20 bp, Homo sapiens
acttaaggggggatgtcttg

SEQ ID NO: 448736 - DNA, 22 bp, Homo sapiens
acttactgtcagagaatatgac

SEQ ID NO: 448737 - DNA, 16 bp, Homo sapiens
acttagaaattgcatt

SEQ ID NO: 448738 - DNA, 14 bp, Homo sapiens
acttatctccagcc

SEQ ID NO: 448739 - DNA, 13 bp, Homo sapiens
acttatgctgctg

SEQ ID NO: 448740 - DNA, 15 bp, Homo sapiens
acttatgctgctgtg

SEQ ID NO: 448741 - DNA, 20 bp, Homo sapiens
acttatgctgctgtgaattt

SEQ ID NO: 448742 - DNA, 14 bp, Homo sapiens
acttattttctgaa

SEQ ID NO: 448743 - DNA, 12 bp, Homo sapiens
acttcacactga

SEQ ID NO: 448744 - DNA, 20 bp, Homo sapiens
acttcagactctctcctctc

SEQ ID NO: 448745 - DNA, 9 bp, Homo sapiens
acttcagca

SEQ ID NO: 448746 - DNA, 14 bp, Homo sapiens
acttcaggctcttc

SEQ ID NO: 448747 - DNA, 20 bp, Homo sapiens
acttcaggctcttctccttt

SEQ ID NO: 448748 - DNA, 21 bp, Homo sapiens
acttccagatttgagctgcct

SEQ ID NO: 448749 - DNA, 22 bp, Homo sapiens
acttccagatttgagctgcctg

SEQ ID NO: 448750 - DNA, 15 bp, Homo sapiens
acttctcaaatgcta

SEQ ID NO: 448751 - DNA, 16 bp, Homo sapiens
acttctgctgtacaga

SEQ ID NO: 448752 - DNA, 17 bp, Homo sapiens
acttcttcatccataga

SEQ ID NO: 448753 - DNA, 18 bp, Homo sapiens
acttcttcatccatagac

SEQ ID NO: 448754 - DNA, 22 bp, Homo sapiens
acttcttcatccatagacacag

SEQ ID NO: 448755 - DNA, 15 bp, Homo sapiens
acttctttttcatta

SEQ ID NO: 448756 - DNA, 18 bp, Homo sapiens
acttgactataaaaactg

SEQ ID NO: 448757 - DNA, 14 bp, Homo sapiens
acttgctcaataaa

SEQ ID NO: 448758 - DNA, 21 bp, Homo sapiens
acttggataggagcttccaga

SEQ ID NO: 448759 - DNA, 19 bp, Homo sapiens
acttgtacttacactgaaa

SEQ ID NO: 448760 - DNA, 16 bp, Homo sapiens
acttgtgttcaatctg

SEQ ID NO: 448761 - DNA, 14 bp, Homo sapiens
actttaaattatat

SEQ ID NO: 448762 - DNA, 14 bp, Homo sapiens
actttcctctctct

SEQ ID NO: 448763 - DNA, 19 bp, Homo sapiens
acttttcatttttgctttt

SEQ ID NO: 448764 - DNA, 19 bp, Homo sapiens
acttttgaaaaaggatcat

SEQ ID NO: 448765 - DNA, 17 bp, Homo sapiens
acttttgtgtattctgt

SEQ ID NO: 448766 - DNA, 12 bp, Homo sapiens
agaaaaaaggac

SEQ ID NO: 448767 - DNA, 17 bp, Homo sapiens
agaaaaaggaaacaagc

SEQ ID NO: 448768 - DNA, 20 bp, Homo sapiens
agaaaacagaccagcatagt

SEQ ID NO: 448769 - DNA, 14 bp, Homo sapiens
agaaaatgctttct

SEQ ID NO: 448770 - DNA, 18 bp, Homo sapiens
agaaagggcagcccctcc

SEQ ID NO: 448771 - DNA, 19 bp, Homo sapiens
agaaagggcagcccctccc

SEQ ID NO: 448772 - DNA, 16 bp, Homo sapiens
agaaatgagaaattgt

SEQ ID NO: 448773 - DNA, 16 bp, Homo sapiens
agaaatggctttccac

SEQ ID NO: 448774 - DNA, 19 bp, Homo sapiens
agaaatgtggatgctcttt

SEQ ID NO: 448775 - DNA, 23 bp, Homo sapiens
agaaatgttggttacatgaatga

SEQ ID NO: 448776 - DNA, 11 bp, Homo sapiens
agaaattctat

SEQ ID NO: 448777 - DNA, 22 bp, Homo sapiens
agaaattctataagagacaaag

SEQ ID NO: 448778 - DNA, 20 bp, Homo sapiens
agaaattgcatttcctgaca

SEQ ID NO: 448779 - DNA, 14 bp, Homo sapiens
agaaattgtgccaa

SEQ ID NO: 448780 - DNA, 15 bp, Homo sapiens
agaaattgtgccaaa

SEQ ID NO: 448781 - DNA, 20 bp, Homo sapiens
agaacagtgttgaaattgga

SEQ ID NO: 448782 - DNA, 16 bp, Homo sapiens
agaaccaacgggtctg

SEQ ID NO: 448783 - DNA, 17 bp, Homo sapiens
agaaccaacgggtctgt

SEQ ID NO: 448784 - DNA, 19 bp, Homo sapiens
agaaccaacgggtctgtgg

SEQ ID NO: 448785 - DNA, 21 bp, Homo sapiens
agaaccagatcgtacttgaaa

SEQ ID NO: 448786 - DNA, 14 bp, Homo sapiens
agaaccagcactcc

SEQ ID NO: 448787 - DNA, 22 bp, Homo sapiens
agaaccagcactcccagggccc

SEQ ID NO: 448788 - DNA, 14 bp, Homo sapiens
agaacccccctccc

SEQ ID NO: 448789 - DNA, 16 bp, Homo sapiens
agaacccccctcccca

SEQ ID NO: 448790 - DNA, 19 bp, Homo sapiens
agaacccccctccccaagg

SEQ ID NO: 448791 - DNA, 14 bp, Homo sapiens
agaagaaaataacc

SEQ ID NO: 448792 - DNA, 11 bp, Homo sapiens
agaagaaactg

SEQ ID NO: 448793 - DNA, 13 bp, Homo sapiens
agaagaaactgct

SEQ ID NO: 448794 - DNA, 12 bp, Homo sapiens
agaagattctaa

SEQ ID NO: 448795 - DNA, 23 bp, Homo sapiens
agaaggattcttttttcaatgta

SEQ ID NO: 448796 - DNA, 19 bp, Homo sapiens
agaaggcctgccccccttc

SEQ ID NO: 448797 - DNA, 22 bp, Homo sapiens
agaaggcctgccccccttccca

SEQ ID NO: 448798 - DNA, 13 bp, Homo sapiens
agaaggggcgagg

SEQ ID NO: 448799 - DNA, 14 bp, Homo sapiens
agaaggggcgaggc

SEQ ID NO: 448800 - DNA, 17 bp, Homo sapiens
agaagtgggattcagga

SEQ ID NO: 448801 - DNA, 12 bp, Homo sapiens
agaagtttcttc

SEQ ID NO: 448802 - DNA, 19 bp, Homo sapiens
agaatatcctatactggtt

SEQ ID NO: 448803 - DNA, 21 bp, Homo sapiens
agaatctaactggtggacatg

SEQ ID NO: 448804 - DNA, 19 bp, Homo sapiens
agaatggtgggctccagag

SEQ ID NO: 448805 - DNA, 21 bp, Homo sapiens
agaattaggtaatggatatga

SEQ ID NO: 448806 - DNA, 22 bp, Homo sapiens
agaattaggtaatggatatgaa

SEQ ID NO: 448807 - DNA, 19 bp, Homo sapiens
agaattgaaccgtcaatgt

SEQ ID NO: 448808 - DNA, 20 bp, Homo sapiens
agaattgaaccgtcaatgtg

SEQ ID NO: 448809 - DNA, 21 bp, Homo sapiens
agaattgaaccgtcaatgtga

SEQ ID NO: 448810 - DNA, 18 bp, Homo sapiens
agacaacaggcattttct

SEQ ID NO: 448811 - DNA, 17 bp, Homo sapiens
agacactccagtttgcc

SEQ ID NO: 448812 - DNA, 20 bp, Homo sapiens
agacagagtggatctggagt

SEQ ID NO: 448813 - DNA, 13 bp, Homo sapiens
agacagggtgggg

SEQ ID NO: 448814 - DNA, 12 bp, Homo sapiens
agacagtggggg

SEQ ID NO: 448815 - DNA, 19 bp, Homo sapiens
agacagtgggggtgcctgg

SEQ ID NO: 448816 - DNA, 14 bp, Homo sapiens
agacattgtatttt

SEQ ID NO: 448817 - DNA, 21 bp, Homo sapiens
agaccatttagtcctcacctt

SEQ ID NO: 448818 - DNA, 19 bp, Homo sapiens
agacccctaccctttccca

SEQ ID NO: 448819 - DNA, 14 bp, Homo sapiens
agacccctggcttt

SEQ ID NO: 448820 - DNA, 16 bp, Homo sapiens
agaccctccttcccca

SEQ ID NO: 448821 - DNA, 22 bp, Homo sapiens
agaccctccttccccaccccat

SEQ ID NO: 448822 - DNA, 12 bp, Homo sapiens
agaccctgtctt

SEQ ID NO: 448823 - DNA, 21 bp, Homo sapiens
agacctccagattattttcta

SEQ ID NO: 448824 - DNA, 15 bp, Homo sapiens
agacggacgggacag

SEQ ID NO: 448825 - DNA, 16 bp, Homo sapiens
agacgggctgagagga

SEQ ID NO: 448826 - DNA, 18 bp, Homo sapiens
agactactggcctctgtg

SEQ ID NO: 448827 - DNA, 16 bp, Homo sapiens
agactcccgcctttga

SEQ ID NO: 448828 - DNA, 17 bp, Homo sapiens
accctaggtctccaccc

SEQ ID NO: 448829 - DNA, 19 bp, Homo sapiens
accctaggtctccacccct

SEQ ID NO: 448830 - DNA, 20 bp, Homo sapiens
accctaggtctccacccctc

SEQ ID NO: 448831 - DNA, 18 bp, Homo sapiens
accctcagagccacccct

SEQ ID NO: 448832 - DNA, 17 bp, Homo sapiens
accctccactctgaggt

SEQ ID NO: 448833 - DNA, 21 bp, Homo sapiens
accctccactctgaggtctca

SEQ ID NO: 448834 - DNA, 16 bp, Homo sapiens
accctcccctctcctg

SEQ ID NO: 448835 - DNA, 13 bp, Homo sapiens
accctcccctctt

SEQ ID NO: 448836 - DNA, 10 bp, Homo sapiens
accctccctg

SEQ ID NO: 448837 - DNA, 13 bp, Homo sapiens
accctccctgtcc

SEQ ID NO: 448838 - DNA, 18 bp, Homo sapiens
accctccctgtcccctga

SEQ ID NO: 448839 - DNA, 19 bp, Homo sapiens
accctccttccccacccca

SEQ ID NO: 448840 - DNA, 12 bp, Homo sapiens
accctcggagcc

SEQ ID NO: 448841 - DNA, 14 bp, Homo sapiens
accctctcctgggg

SEQ ID NO: 448842 - DNA, 22 bp, Homo sapiens
accctctcctgggggtggcagg

SEQ ID NO: 448843 - DNA, 15 bp, Homo sapiens
accctctggtccttc

SEQ ID NO: 448844 - DNA, 19 bp, Homo sapiens
accctcttctcagctccac

SEQ ID NO: 448845 - DNA, 12 bp, Homo sapiens
accctgccctgc

SEQ ID NO: 448846 - DNA, 13 bp, Homo sapiens
accctgccctgca

SEQ ID NO: 448847 - DNA, 15 bp, Homo sapiens
acccttggcctgtcc

SEQ ID NO: 448848 - DNA, 23 bp, Homo sapiens
accctttcttttgaatcaatctg

SEQ ID NO: 448849 - DNA, 13 bp, Homo sapiens
accgagacccacc

SEQ ID NO: 448850 - DNA, 18 bp, Homo sapiens
accgagtctcttctccac

SEQ ID NO: 448851 - DNA, 20 bp, Homo sapiens
accgagtctcttctccactg

SEQ ID NO: 448852 - DNA, 12 bp, Homo sapiens
accgccacccca

SEQ ID NO: 448853 - DNA, 16 bp, Homo sapiens
accgcccaacccccac

SEQ ID NO: 448854 - DNA, 18 bp, Homo sapiens
accgcccacccacacccc

SEQ ID NO: 448855 - DNA, 15 bp, Homo sapiens
accggagcggctgag

SEQ ID NO: 448856 - DNA, 15 bp, Homo sapiens
accgggagcctcccc

SEQ ID NO: 448857 - DNA, 17 bp, Homo sapiens
acctaaatccattttct

SEQ ID NO: 448858 - DNA, 12 bp, Homo sapiens
acctacatctga

SEQ ID NO: 448859 - DNA, 14 bp, Homo sapiens
acctcactgccctc

SEQ ID NO: 448860 - DNA, 16 bp, Homo sapiens
acctcactgccctccc

SEQ ID NO: 448861 - DNA, 19 bp, Homo sapiens
acctcactggtgcatttaa

SEQ ID NO: 448862 - DNA, 11 bp, Homo sapiens
acctccacccg

SEQ ID NO: 448863 - DNA, 14 bp, Homo sapiens
acctccacccgtcc

SEQ ID NO: 448864 - DNA, 14 bp, Homo sapiens
acctccagattatt

SEQ ID NO: 448865 - DNA, 20 bp, Homo sapiens
acctccagattattttctat

SEQ ID NO: 448866 - DNA, 16 bp, Homo sapiens
acctcctgcaataaaa

SEQ ID NO: 448867 - DNA, 17 bp, Homo sapiens
acctctacaggcattta

SEQ ID NO: 448868 - DNA, 14 bp, Homo sapiens
acctctcagatccc

SEQ ID NO: 448869 - DNA, 17 bp, Homo sapiens
acctctcagatccctcg

SEQ ID NO: 448870 - DNA, 22 bp, Homo sapiens
acctgaagagcgctcctctgcc

SEQ ID NO: 448871 - DNA, 16 bp, Homo sapiens
acctgacgatcttccc

SEQ ID NO: 448872 - DNA, 19 bp, Homo sapiens
acctgcccagttagcccgg

SEQ ID NO: 448873 - DNA, 22 bp, Homo sapiens
acctgcccagttagcccggcca

SEQ ID NO: 448874 - DNA, 12 bp, Homo sapiens
acctggtggcac

SEQ ID NO: 448875 - DNA, 13 bp, Homo sapiens
acctgtgctgctg

SEQ ID NO: 448876 - DNA, 14 bp, Homo sapiens
acctgtgctgctgc

SEQ ID NO: 448877 - DNA, 12 bp, Homo sapiens
acctgtgctttc

SEQ ID NO: 448878 - DNA, 22 bp, Homo sapiens
acctgtgctttcatgtttaaga

SEQ ID NO: 448879 - DNA, 14 bp, Homo sapiens
accttcgcctttgc

SEQ ID NO: 448880 - DNA, 15 bp, Homo sapiens
accttctgtggctca

SEQ ID NO: 448881 - DNA, 16 bp, Homo sapiens
accttctgtggctcac

SEQ ID NO: 448882 - DNA, 14 bp, Homo sapiens
acctttatttatta

SEQ ID NO: 448883 - DNA, 23 bp, Homo sapiens
acctttatttattaaacttcagc

SEQ ID NO: 448884 - DNA, 21 bp, Homo sapiens
acctttccgctgtcgccccag

SEQ ID NO: 448885 - DNA, 14 bp, Homo sapiens
acctttctgaggag

SEQ ID NO: 448886 - DNA, 15 bp, Homo sapiens
acgaaggctgcccct

SEQ ID NO: 448887 - DNA, 21 bp, Homo sapiens
acgacctacatctgaaatcta

SEQ ID NO: 448888 - DNA, 17 bp, Homo sapiens
acgcagagccccggagc

SEQ ID NO: 448889 - DNA, 18 bp, Homo sapiens
acgcatgaagaacagtgc

SEQ ID NO: 448890 - DNA, 20 bp, Homo sapiens
acgccggggctggccctgcc

SEQ ID NO: 448891 - DNA, 21 bp, Homo sapiens
acgccggggctggccctgccc

SEQ ID NO: 448892 - DNA, 15 bp, Homo sapiens
acgcctcctggccag

SEQ ID NO: 448893 - DNA, 16 bp, Homo sapiens
acgctgacagcctcct

SEQ ID NO: 448894 - DNA, 14 bp, Homo sapiens
acggaagtggcctg

SEQ ID NO: 448895 - DNA, 21 bp, Homo sapiens
acggaagtggcctgagaagag

SEQ ID NO: 448896 - DNA, 21 bp, Homo sapiens
acggacgggacagcggcccgg

SEQ ID NO: 448897 - DNA, 11 bp, Homo sapiens
acggcagcccc

SEQ ID NO: 448898 - DNA, 21 bp, Homo sapiens
acggccgtccctgacttccca

SEQ ID NO: 448899 - DNA, 14 bp, Homo sapiens
acgggacagcggcc

SEQ ID NO: 448900 - DNA, 21 bp, Homo sapiens
acgggacagcggcccggccca

SEQ ID NO: 448901 - DNA, 22 bp, Homo sapiens
acgggcccgctcaacctctcag

SEQ ID NO: 448902 - DNA, 12 bp, Homo sapiens
acgggcctcccc

SEQ ID NO: 448903 - DNA, 15 bp, Homo sapiens
acggggcagagctga

SEQ ID NO: 448904 - DNA, 18 bp, Homo sapiens
acgtctgtgagtctgtcc

SEQ ID NO: 448905 - DNA, 20 bp, Homo sapiens
acgtctgtgagtctgtcctt

SEQ ID NO: 448906 - DNA, 19 bp, Homo sapiens
acgtttttgtgctgtgggc

SEQ ID NO: 448907 - DNA, 13 bp, Homo sapiens
actaaaattcaac

SEQ ID NO: 448908 - DNA, 19 bp, Homo sapiens
actaaaattcaacaaatga

SEQ ID NO: 448909 - DNA, 14 bp, Homo sapiens
actaacaatgcctt

SEQ ID NO: 448910 - DNA, 20 bp, Homo sapiens
actaagaataaataaagaag

SEQ ID NO: 448911 - DNA, 24 bp, Homo sapiens
actaatggccaagtgtacatttga

SEQ ID NO: 448912 - DNA, 23 bp, Homo sapiens
actacataattaaattttaatgt

SEQ ID NO: 448913 - DNA, 18 bp, Homo sapiens
actagccctctttctctc

SEQ ID NO: 448914 - DNA, 21 bp, Homo sapiens
actagccctctttctctctgt

SEQ ID NO: 448915 - DNA, 15 bp, Homo sapiens
actatcggttcaagt

SEQ ID NO: 448916 - DNA, 19 bp, Homo sapiens
actatcggttcaagttgat

SEQ ID NO: 448917 - DNA, 20 bp, Homo sapiens
actatggtatgctggccagc

SEQ ID NO: 448918 - DNA, 20 bp, Homo sapiens
actatttgaaaaaagaagag

SEQ ID NO: 448919 - DNA, 21 bp, Homo sapiens
actcaaagaggccagtacttt

SEQ ID NO: 448920 - DNA, 19 bp, Homo sapiens
actcaatgtggaaaaaata

SEQ ID NO: 448921 - DNA, 13 bp, Homo sapiens
actcacaaaaggc

SEQ ID NO: 448922 - DNA, 14 bp, Homo sapiens
actcaccaaaatat

SEQ ID NO: 448923 - DNA, 17 bp, Homo sapiens
actcaccaaaatatagt

SEQ ID NO: 448924 - DNA, 16 bp, Homo sapiens
actcagccttaagaaa

SEQ ID NO: 448925 - DNA, 14 bp, Homo sapiens
actcaggctttcta

SEQ ID NO: 448926 - DNA, 14 bp, Homo sapiens
actcagtaggtctg

SEQ ID NO: 448927 - DNA, 18 bp, Homo sapiens
actcataaaggtttttgt

SEQ ID NO: 448928 - DNA, 14 bp, Homo sapiens
actcatctgttatc

SEQ ID NO: 448929 - DNA, 23 bp, Homo sapiens
actcatctgttatcctgctagct

SEQ ID NO: 448930 - DNA, 20 bp, Homo sapiens
actccaaggtggcatagcca

SEQ ID NO: 448931 - DNA, 13 bp, Homo sapiens
actccactcccct

SEQ ID NO: 448932 - DNA, 13 bp, Homo sapiens
actccagacccct

SEQ ID NO: 448933 - DNA, 20 bp, Homo sapiens
actccagggttaaagaaagg

SEQ ID NO: 448934 - DNA, 12 bp, Homo sapiens
actcccagggcc

SEQ ID NO: 448935 - DNA, 14 bp, Homo sapiens
actcccagggcccg

SEQ ID NO: 448936 - DNA, 22 bp, Homo sapiens
actccccgcccgccctcctctg

SEQ ID NO: 448937 - DNA, 22 bp, Homo sapiens
actccctgtgggggtggccatc

SEQ ID NO: 448938 - DNA, 18 bp, Homo sapiens
actccctttgtggacttt

SEQ ID NO: 448939 - DNA, 21 bp, Homo sapiens
actccctttgtggactttatt

SEQ ID NO: 448940 - DNA, 15 bp, Homo sapiens
actccgcccagcctc

SEQ ID NO: 448941 - DNA, 16 bp, Homo sapiens
actccgcccagcctct

SEQ ID NO: 448942 - DNA, 24 bp, Homo sapiens
actcctttctaaggagcactagaa

SEQ ID NO: 448943 - DNA, 21 bp, Homo sapiens
actcgagagggctgagcccct

SEQ ID NO: 448944 - DNA, 22 bp, Homo sapiens
actcgagagggctgagcccctc

SEQ ID NO: 448945 - DNA, 23 bp, Homo sapiens
actcgagagggctgagcccctcc

SEQ ID NO: 448946 - DNA, 18 bp, Homo sapiens
actctacccccaacacca

SEQ ID NO: 448947 - DNA, 14 bp, Homo sapiens
actctctcctctct

SEQ ID NO: 448948 - DNA, 15 bp, Homo sapiens
actctctcctctctc

SEQ ID NO: 448949 - DNA, 22 bp, Homo sapiens
actctctcctctctctccctcc

SEQ ID NO: 448950 - DNA, 18 bp, Homo sapiens
actctgagctgctaggaa

SEQ ID NO: 448951 - DNA, 13 bp, Homo sapiens
actctgaggtctc

SEQ ID NO: 448952 - DNA, 22 bp, Homo sapiens
actctgcatagacaaaggcctt

SEQ ID NO: 448953 - DNA, 21 bp, Homo sapiens
actctggccttggttcctcca

SEQ ID NO: 448954 - DNA, 15 bp, Homo sapiens
actcttcaaggccaa

SEQ ID NO: 448955 - DNA, 15 bp, Homo sapiens
actcttcagagaaat

SEQ ID NO: 448956 - DNA, 16 bp, Homo sapiens
actgaactcaggatgg

SEQ ID NO: 448957 - DNA, 14 bp, Homo sapiens
actgaatttaacta

SEQ ID NO: 448958 - DNA, 19 bp, Homo sapiens
actgagagctgctcctttg

SEQ ID NO: 448959 - DNA, 16 bp, Homo sapiens
actgatatcacgggcc

SEQ ID NO: 448960 - DNA, 18 bp, Homo sapiens
actgatatcacgggcccg

SEQ ID NO: 448961 - DNA, 15 bp, Homo sapiens
actgatgggtcctgc

SEQ ID NO: 448962 - DNA, 18 bp, Homo sapiens
actgatgggtcctgctgc

SEQ ID NO: 448963 - DNA, 22 bp, Homo sapiens
actgcacagtgcatctcagccc

SEQ ID NO: 448964 - DNA, 21 bp, Homo sapiens
actgcagaatacagtaagctg

SEQ ID NO: 448965 - DNA, 19 bp, Homo sapiens
actgcatatagataattat

SEQ ID NO: 448966 - DNA, 23 bp, Homo sapiens
actgcatatcctggtgtctagtt

SEQ ID NO: 448967 - DNA, 19 bp, Homo sapiens
actgccattagactgaatt

SEQ ID NO: 448968 - DNA, 13 bp, Homo sapiens
actgcccaccctg

SEQ ID NO: 448969 - DNA, 16 bp, Homo sapiens
actgcccaccctgggc

SEQ ID NO: 448970 - DNA, 12 bp, Homo sapiens
actgctgtttta

SEQ ID NO: 448971 - DNA, 19 bp, Homo sapiens
actgctgttttatgtcata

SEQ ID NO: 448972 - DNA, 21 bp, Homo sapiens
actgcttaaggaaaagagaaa

SEQ ID NO: 448973 - DNA, 20 bp, Homo sapiens
actgcttggatccatacaaa

SEQ ID NO: 448974 - DNA, 20 bp, Homo sapiens
actggaaggctttattcttc

SEQ ID NO: 448975 - DNA, 22 bp, Homo sapiens
actggagataccagagactctg

SEQ ID NO: 448976 - DNA, 11 bp, Homo sapiens
actggagttca

SEQ ID NO: 448977 - DNA, 15 bp, Homo sapiens
actggcccacccctc

SEQ ID NO: 448978 - DNA, 20 bp, Homo sapiens
actggcccacccctcttccc

SEQ ID NO: 448979 - DNA, 12 bp, Homo sapiens
actggccccagg

SEQ ID NO: 448980 - DNA, 21 bp, Homo sapiens
actgggaaataagcaaaaaac

SEQ ID NO: 448981 - DNA, 21 bp, Homo sapiens
actggtggcccgacagcctgg

SEQ ID NO: 448982 - DNA, 22 bp, Homo sapiens
actggtggcccgacagcctggc

SEQ ID NO: 448983 - DNA, 23 bp, Homo sapiens
actggtggcccgacagcctggca

SEQ ID NO: 448984 - DNA, 19 bp, Homo sapiens
actggttatagttgatatg

SEQ ID NO: 448985 - DNA, 23 bp, Homo sapiens
actggttatagttgatatgtaac

SEQ ID NO: 448986 - DNA, 14 bp, Homo sapiens
actggtttgtttct

SEQ ID NO: 448987 - DNA, 14 bp, Homo sapiens
actgtactcctccc

SEQ ID NO: 448988 - DNA, 21 bp, Homo sapiens
actgtatagtttaaagggagg

SEQ ID NO: 448989 - DNA, 23 bp, Homo sapiens
actgtctcaagagggcactggtg

SEQ ID NO: 448990 - DNA, 17 bp, Homo sapiens
actgtcttcaaccctgc

SEQ ID NO: 448991 - DNA, 13 bp, Homo sapiens
actgtgcactata

SEQ ID NO: 448992 - DNA, 17 bp, Homo sapiens
actgttaacccagtgtt

SEQ ID NO: 448993 - DNA, 19 bp, Homo sapiens
actgttaacccagtgttca

SEQ ID NO: 448994 - DNA, 14 bp, Homo sapiens
actgtttcttctca

SEQ ID NO: 448995 - DNA, 12 bp, Homo sapiens
actgtttgtaat

SEQ ID NO: 448996 - DNA, 17 bp, Homo sapiens
actgtttgtaatataca

SEQ ID NO: 448997 - DNA, 20 bp, Homo sapiens
actgtttgtaatatacagtt

SEQ ID NO: 448998 - DNA, 12 bp, Homo sapiens
acttaaaagaac

SEQ ID NO: 448999 - DNA, 19 bp, Homo sapiens
aagtaccaactgagccaaa

SEQ ID NO: 449000 - DNA, 18 bp, Homo sapiens
aagtatatttatttctag

SEQ ID NO: 449001 - DNA, 18 bp, Homo sapiens
aagtcaaacagtgtggct

SEQ ID NO: 449002 - DNA, 18 bp, Homo sapiens
aagtcacagccgtttgaa

SEQ ID NO: 449003 - DNA, 12 bp, Homo sapiens
aagtcactgcac

SEQ ID NO: 449004 - DNA, 22 bp, Homo sapiens
aagtcactgcacagtgcatctc

SEQ ID NO: 449005 - DNA, 21 bp, Homo sapiens
aagtctccccgcagccctctc

SEQ ID NO: 449006 - DNA, 22 bp, Homo sapiens
aagtctccccgcagccctctcc

SEQ ID NO: 449007 - DNA, 23 bp, Homo sapiens
aagtctccccgcagccctctcca

SEQ ID NO: 449008 - DNA, 12 bp, Homo sapiens
aagtgtacattt

SEQ ID NO: 449009 - DNA, 16 bp, Homo sapiens
aagtgtgtgtgcaatg

SEQ ID NO: 449010 - DNA, 16 bp, Homo sapiens
aagttctattatctgg

SEQ ID NO: 449011 - DNA, 17 bp, Homo sapiens
aataaactcttcaaggc

SEQ ID NO: 449012 - DNA, 19 bp, Homo sapiens
aataaagaagaaaataacc

SEQ ID NO: 449013 - DNA, 14 bp, Homo sapiens
aataaataaagaag

SEQ ID NO: 449014 - DNA, 17 bp, Homo sapiens
aataaataaagaagaaa

SEQ ID NO: 449015 - DNA, 12 bp, Homo sapiens
aataaatctaaa

SEQ ID NO: 449016 - DNA, 16 bp, Homo sapiens
aataacagagctggat

SEQ ID NO: 449017 - DNA, 20 bp, Homo sapiens
aataaccaaatgcaatgtga

SEQ ID NO: 449018 - DNA, 14 bp, Homo sapiens
aataactgttagaa

SEQ ID NO: 449019 - DNA, 13 bp, Homo sapiens
aataagtaatatc

SEQ ID NO: 449020 - DNA, 19 bp, Homo sapiens
aataatgattcaatgtgaa

SEQ ID NO: 449021 - DNA, 21 bp, Homo sapiens
aatacagtaagctgctctatt

SEQ ID NO: 449022 - DNA, 18 bp, Homo sapiens
aatactcaccaaaatata

SEQ ID NO: 449023 - DNA, 22 bp, Homo sapiens
aatactcaccaaaatatagtta

SEQ ID NO: 449024 - DNA, 12 bp, Homo sapiens
aatactgtattg

SEQ ID NO: 449025 - DNA, 21 bp, Homo sapiens
aatacttttgtgtattctgtg

SEQ ID NO: 449026 - DNA, 14 bp, Homo sapiens
aatagcctcacctt

SEQ ID NO: 449027 - DNA, 13 bp, Homo sapiens
aatagtcatgttt

SEQ ID NO: 449028 - DNA, 15 bp, Homo sapiens
aatagtcatgtttct

SEQ ID NO: 449029 - DNA, 18 bp, Homo sapiens
aatagtcatgtttctgca

SEQ ID NO: 449030 - DNA, 20 bp, Homo sapiens
aatagttctatttctatctg

SEQ ID NO: 449031 - DNA, 22 bp, Homo sapiens
aatatacatagtctttgtttac

SEQ ID NO: 449032 - DNA, 14 bp, Homo sapiens
aatatactgcatat

SEQ ID NO: 449033 - DNA, 12 bp, Homo sapiens
aatatagttaat

SEQ ID NO: 449034 - DNA, 21 bp, Homo sapiens
aatatagttaattgtggcttt

SEQ ID NO: 449035 - DNA, 22 bp, Homo sapiens
aatatagttaattgtggcttta

SEQ ID NO: 449036 - DNA, 16 bp, Homo sapiens
aatatagttgaacaag

SEQ ID NO: 449037 - DNA, 22 bp, Homo sapiens
aatatagttgaacaagatttcc

SEQ ID NO: 449038 - DNA, 14 bp, Homo sapiens
aatatctttcagtt

SEQ ID NO: 449039 - DNA, 17 bp, Homo sapiens
aatatcttttcttctcc

SEQ ID NO: 449040 - DNA, 21 bp, Homo sapiens
aatatgattctcctctcccaa

SEQ ID NO: 449041 - DNA, 15 bp, Homo sapiens
aatatttctaagctt

SEQ ID NO: 449042 - DNA, 21 bp, Homo sapiens
aatatttctaagcttatttct

SEQ ID NO: 449043 - DNA, 19 bp, Homo sapiens
aatatttttttctagctat

SEQ ID NO: 449044 - DNA, 23 bp, Homo sapiens
aatcacagatgggtattaaactt

SEQ ID NO: 449045 - DNA, 12 bp, Homo sapiens
aatcagcattct

SEQ ID NO: 449046 - DNA, 18 bp, Homo sapiens
aatcagcattctcactcc

SEQ ID NO: 449047 - DNA, 19 bp, Homo sapiens
aatcatttatcttatctag

SEQ ID NO: 449048 - DNA, 20 bp, Homo sapiens
aatccaaaatagtcatgttt

SEQ ID NO: 449049 - DNA, 14 bp, Homo sapiens
aatccaactccagg

SEQ ID NO: 449050 - DNA, 15 bp, Homo sapiens
aatccatatcagctc

SEQ ID NO: 449051 - DNA, 22 bp, Homo sapiens
aatccattttctaaactgtttt

SEQ ID NO: 449052 - DNA, 16 bp, Homo sapiens
aatctctaaaattcta

SEQ ID NO: 449053 - DNA, 18 bp, Homo sapiens
aatctctaaaattctagt

SEQ ID NO: 449054 - DNA, 14 bp, Homo sapiens
aatctgtctgattc

SEQ ID NO: 449055 - DNA, 16 bp, Homo sapiens
aatgagcagttagaaa

SEQ ID NO: 449056 - DNA, 17 bp, Homo sapiens
aatgagtaaataaactc

SEQ ID NO: 449057 - DNA, 17 bp, Homo sapiens
aatgattcaatgtgaat

SEQ ID NO: 449058 - DNA, 13 bp, Homo sapiens
aatgattccaaat

SEQ ID NO: 449059 - DNA, 14 bp, Homo sapiens
aatgattccaaata

SEQ ID NO: 449060 - DNA, 24 bp, Homo sapiens
aatgcacatttgtcactgaataat

SEQ ID NO: 449061 - DNA, 18 bp, Homo sapiens
aatgcatacaataaaaga

SEQ ID NO: 449062 - DNA, 22 bp, Homo sapiens
aatgcatacaataaaagagctt

SEQ ID NO: 449063 - DNA, 14 bp, Homo sapiens
aatgctttctcatg

SEQ ID NO: 449064 - DNA, 19 bp, Homo sapiens
aatgctttgtgtgattgaa

SEQ ID NO: 449065 - DNA, 17 bp, Homo sapiens
aatggatatgaaagaga

SEQ ID NO: 449066 - DNA, 19 bp, Homo sapiens
aatggatatgaaagagaaa

SEQ ID NO: 449067 - DNA, 16 bp, Homo sapiens
aatgggtagcaacagg

SEQ ID NO: 449068 - DNA, 17 bp, Homo sapiens
aatggtgggctccagag

SEQ ID NO: 449069 - DNA, 18 bp, Homo sapiens
aatggtgggctccagagt

SEQ ID NO: 449070 - DNA, 14 bp, Homo sapiens
aatgtaaaattcat

SEQ ID NO: 449071 - DNA, 20 bp, Homo sapiens
aatgtgaaataaagagttct

SEQ ID NO: 449072 - DNA, 14 bp, Homo sapiens
aatgtgaattttaa

SEQ ID NO: 449073 - DNA, 18 bp, Homo sapiens
aatgtgagctataatgtt

SEQ ID NO: 449074 - DNA, 17 bp, Homo sapiens
aatgtgccaaaatgtca

SEQ ID NO: 449075 - DNA, 14 bp, Homo sapiens
aatgtgcttttcca

SEQ ID NO: 449076 - DNA, 21 bp, Homo sapiens
aatgtgcttttccatctaaaa

SEQ ID NO: 449077 - DNA, 22 bp, Homo sapiens
aatgttaaggacttctgcagct

SEQ ID NO: 449078 - DNA, 17 bp, Homo sapiens
aatgttccgttcatctg

SEQ ID NO: 449079 - DNA, 20 bp, Homo sapiens
aattacttttgaaaaaggat

SEQ ID NO: 449080 - DNA, 17 bp, Homo sapiens
aattataatgcatctaa

SEQ ID NO: 449081 - DNA, 17 bp, Homo sapiens
aattatatgatatgcat

SEQ ID NO: 449082 - DNA, 18 bp, Homo sapiens
aattatccaggatgtgtg

SEQ ID NO: 449083 - DNA, 13 bp, Homo sapiens
aattattacttta

SEQ ID NO: 449084 - DNA, 16 bp, Homo sapiens
aattattactttaaat

SEQ ID NO: 449085 - DNA, 18 bp, Homo sapiens
aattattactttaaatta

SEQ ID NO: 449086 - DNA, 22 bp, Homo sapiens
aattattactttaaattatatg

SEQ ID NO: 449087 - DNA, 18 bp, Homo sapiens
aattattctagtcaactg

SEQ ID NO: 449088 - DNA, 22 bp, Homo sapiens
aattattctagtcaactgctgt

SEQ ID NO: 449089 - DNA, 15 bp, Homo sapiens
aattcaacaaatgat

SEQ ID NO: 449090 - DNA, 17 bp, Homo sapiens
aattcaacacttatttt

SEQ ID NO: 449091 - DNA, 13 bp, Homo sapiens
aattcaactctgt

SEQ ID NO: 449092 - DNA, 17 bp, Homo sapiens
aattcataaaaataacc

SEQ ID NO: 449093 - DNA, 19 bp, Homo sapiens
aattcatagcatcctgatt

SEQ ID NO: 449094 - DNA, 15 bp, Homo sapiens
aattcttgcactgta

SEQ ID NO: 449095 - DNA, 16 bp, Homo sapiens
aattcttgccaagcaa

SEQ ID NO: 449096 - DNA, 19 bp, Homo sapiens
aattgaaccgtcaatgtga

SEQ ID NO: 449097 - DNA, 22 bp, Homo sapiens
aattgaaccgtcaatgtgaaat

SEQ ID NO: 449098 - DNA, 23 bp, Homo sapiens
aattgctcctgcatgcaactaat

SEQ ID NO: 449099 - DNA, 12 bp, Homo sapiens
aattgtgccaaa

SEQ ID NO: 449100 - DNA, 22 bp, Homo sapiens
aattgtgccaaagatagcagaa

SEQ ID NO: 449101 - DNA, 22 bp, Homo sapiens
aattgttatgtaaacatcataa

SEQ ID NO: 449102 - DNA, 16 bp, Homo sapiens
aatttaatatactgca

SEQ ID NO: 449103 - DNA, 16 bp, Homo sapiens
aatttatttcatccag

SEQ ID NO: 449104 - DNA, 15 bp, Homo sapiens
aatttcaaaatgcat

SEQ ID NO: 449105 - DNA, 12 bp, Homo sapiens
aatttcaaagaa

SEQ ID NO: 449106 - DNA, 19 bp, Homo sapiens
aatttcataaattggctcc

SEQ ID NO: 449107 - DNA, 20 bp, Homo sapiens
aatttcataaattggctcct

SEQ ID NO: 449108 - DNA, 20 bp, Homo sapiens
aatttcttactaaacatttt

SEQ ID NO: 449109 - DNA, 21 bp, Homo sapiens
aatttcttactaaacattttg

SEQ ID NO: 449110 - DNA, 15 bp, Homo sapiens
aattttaaaaaataa

SEQ ID NO: 449111 - DNA, 20 bp, Homo sapiens
aattttaaaaaataacatat

SEQ ID NO: 449112 - DNA, 13 bp, Homo sapiens
aatttttactcag

SEQ ID NO: 449113 - DNA, 15 bp, Homo sapiens
acaaaatatttctaa

SEQ ID NO: 449114 - DNA, 19 bp, Homo sapiens
acaaaatatttctaagctt

SEQ ID NO: 449115 - DNA, 18 bp, Homo sapiens
acaaacgtaatttgttat

SEQ ID NO: 449116 - DNA, 15 bp, Homo sapiens
acaaactcaaaatct

SEQ ID NO: 449117 - DNA, 15 bp, Homo sapiens
acaaaggccttaaca

SEQ ID NO: 449118 - DNA, 20 bp, Homo sapiens
acaaatatgattctcctctc

SEQ ID NO: 449119 - DNA, 13 bp, Homo sapiens
acaaatatttcac

SEQ ID NO: 449120 - DNA, 20 bp, Homo sapiens
acaaatcaccttaactccct

SEQ ID NO: 449121 - DNA, 17 bp, Homo sapiens
acaaatttttactcagg

SEQ ID NO: 449122 - DNA, 20 bp, Homo sapiens
acaaatttttactcaggctt

SEQ ID NO: 449123 - DNA, 21 bp, Homo sapiens
acaaccactgggatcagctgg

SEQ ID NO: 449124 - DNA, 14 bp, Homo sapiens
acaaccatagaact

SEQ ID NO: 449125 - DNA, 17 bp, Homo sapiens
acaacttccagatttga

SEQ ID NO: 449126 - DNA, 19 bp, Homo sapiens
acaagatttccctaaaaat

SEQ ID NO: 449127 - DNA, 21 bp, Homo sapiens
acaagccaaacattcttattt

SEQ ID NO: 449128 - DNA, 15 bp, Homo sapiens
acaaggagtgcccgc

SEQ ID NO: 449129 - DNA, 12 bp, Homo sapiens
acaataaaagag

SEQ ID NO: 449130 - DNA, 13 bp, Homo sapiens
acaatattcctat

SEQ ID NO: 449131 - DNA, 22 bp, Homo sapiens
acaatggcaagcatagtcgcct

SEQ ID NO: 449132 - DNA, 19 bp, Homo sapiens
acaatttcaaaatgcatgt

SEQ ID NO: 449133 - DNA, 19 bp, Homo sapiens
acaattttcactttttctg

SEQ ID NO: 449134 - DNA, 13 bp, Homo sapiens
acacacccttccc

SEQ ID NO: 449135 - DNA, 16 bp, Homo sapiens
acacagaactcagcct

SEQ ID NO: 449136 - DNA, 13 bp, Homo sapiens
acacataaatctg

SEQ ID NO: 449137 - DNA, 17 bp, Homo sapiens
acaccccgctcacgctg

SEQ ID NO: 449138 - DNA, 15 bp, Homo sapiens
acaccccgtctgccc

SEQ ID NO: 449139 - DNA, 15 bp, Homo sapiens
acaccctccactctg

SEQ ID NO: 449140 - DNA, 11 bp, Homo sapiens
acacccttccc

SEQ ID NO: 449141 - DNA, 13 bp, Homo sapiens
acacccttcccca

SEQ ID NO: 449142 - DNA, 17 bp, Homo sapiens
acacccttccccactcc

SEQ ID NO: 449143 - DNA, 13 bp, Homo sapiens
acacctccacccg

SEQ ID NO: 449144 - DNA, 19 bp, Homo sapiens
acacgccggggctggccct

SEQ ID NO: 449145 - DNA, 20 bp, Homo sapiens
acactagtagctgttttgaa

SEQ ID NO: 449146 - DNA, 22 bp, Homo sapiens
acactagtagctgttttgaata

SEQ ID NO: 449147 - DNA, 22 bp, Homo sapiens
acactctcttcttactgtattt

SEQ ID NO: 449148 - DNA, 13 bp, Homo sapiens
acactgaaatcca

SEQ ID NO: 449149 - DNA, 14 bp, Homo sapiens
acactgaaatccaa

SEQ ID NO: 449150 - DNA, 16 bp, Homo sapiens
acactgatgggtcctg

SEQ ID NO: 449151 - DNA, 22 bp, Homo sapiens
acactgcttaaggaaaagagaa

SEQ ID NO: 449152 - DNA, 14 bp, Homo sapiens
acactgtatctaaa

SEQ ID NO: 449153 - DNA, 15 bp, Homo sapiens
acactgtatctaaaa

SEQ ID NO: 449154 - DNA, 23 bp, Homo sapiens
acactgtatctaaaaaataactg

SEQ ID NO: 449155 - DNA, 18 bp, Homo sapiens
acacttattttctgaatt

SEQ ID NO: 449156 - DNA, 22 bp, Homo sapiens
acacttcaggctcttctccttt

SEQ ID NO: 449157 - DNA, 23 bp, Homo sapiens
acacttgggtaattaaaaataaa

SEQ ID NO: 449158 - DNA, 15 bp, Homo sapiens
acagaaccagcactc

SEQ ID NO: 449159 - DNA, 19 bp, Homo sapiens
acagaaccagcactcccag

SEQ ID NO: 449160 - DNA, 13 bp, Homo sapiens
acagacaccctcc

SEQ ID NO: 449161 - DNA, 21 bp, Homo sapiens
acagacaccctccactctgag

SEQ ID NO: 449162 - DNA, 22 bp, Homo sapiens
acagacaccctccactctgagg

SEQ ID NO: 449163 - DNA, 22 bp, Homo sapiens
aacccccctccccaaggaagaa

SEQ ID NO: 449164 - DNA, 15 bp, Homo sapiens
aaccctacagtatat

SEQ ID NO: 449165 - DNA, 19 bp, Homo sapiens
aaccctcagagccacccct

SEQ ID NO: 449166 - DNA, 15 bp, Homo sapiens
aaccctcggagcccc

SEQ ID NO: 449167 - DNA, 14 bp, Homo sapiens
aaccctgccctgca

SEQ ID NO: 449168 - DNA, 13 bp, Homo sapiens
aaccgtcaatgtg

SEQ ID NO: 449169 - DNA, 23 bp, Homo sapiens
aaccgtcaatgtgaaataaagag

SEQ ID NO: 449170 - DNA, 17 bp, Homo sapiens
aacctcgttgacatgca

SEQ ID NO: 449171 - DNA, 19 bp, Homo sapiens
aacctctcagatccctcgg

SEQ ID NO: 449172 - DNA, 17 bp, Homo sapiens
aacctggtggcaccaga

SEQ ID NO: 449173 - DNA, 21 bp, Homo sapiens
aacctggtggcaccagatgca

SEQ ID NO: 449174 - DNA, 17 bp, Homo sapiens
aacctgtgctttcatgt

SEQ ID NO: 449175 - DNA, 23 bp, Homo sapiens
aacctttccgctgtcgccccagg

SEQ ID NO: 449176 - DNA, 11 bp, Homo sapiens
aacgcagccct

SEQ ID NO: 449177 - DNA, 12 bp, Homo sapiens
aacgcagccctg

SEQ ID NO: 449178 - DNA, 16 bp, Homo sapiens
aacgcagccctgcttt

SEQ ID NO: 449179 - DNA, 14 bp, Homo sapiens
aacgggcctccccg

SEQ ID NO: 449180 - DNA, 20 bp, Homo sapiens
aactaaaattcaacaaatga

SEQ ID NO: 449181 - DNA, 21 bp, Homo sapiens
aactactaagaataaataaag

SEQ ID NO: 449182 - DNA, 22 bp, Homo sapiens
aactccagggttaaagaaaggc

SEQ ID NO: 449183 - DNA, 11 bp, Homo sapiens
aactctgcata

SEQ ID NO: 449184 - DNA, 12 bp, Homo sapiens
aactctgcatag

SEQ ID NO: 449185 - DNA, 10 bp, Homo sapiens
aactctggcc

SEQ ID NO: 449186 - DNA, 23 bp, Homo sapiens
aactctggccttggttcctccag

SEQ ID NO: 449187 - DNA, 15 bp, Homo sapiens
aactcttcaaggcca

SEQ ID NO: 449188 - DNA, 11 bp, Homo sapiens
aactgcagttt

SEQ ID NO: 449189 - DNA, 16 bp, Homo sapiens
aactgccgctggaggc

SEQ ID NO: 449190 - DNA, 15 bp, Homo sapiens
aactgctgttttatg

SEQ ID NO: 449191 - DNA, 20 bp, Homo sapiens
aactggaaggctttattctt

SEQ ID NO: 449192 - DNA, 13 bp, Homo sapiens
aactggccccagg

SEQ ID NO: 449193 - DNA, 22 bp, Homo sapiens
aactggccccaggcggaggggc

SEQ ID NO: 449194 - DNA, 13 bp, Homo sapiens
aactgttttcatg

SEQ ID NO: 449195 - DNA, 16 bp, Homo sapiens
aacttatctccagcca

SEQ ID NO: 449196 - DNA, 11 bp, Homo sapiens
aacttcagcaa

SEQ ID NO: 449197 - DNA, 22 bp, Homo sapiens
aacttcagcaaccctacagtat

SEQ ID NO: 449198 - DNA, 21 bp, Homo sapiens
aactttttctaagctgtttct

SEQ ID NO: 449199 - DNA, 12 bp, Homo sapiens
aagaaaaagata

SEQ ID NO: 449200 - DNA, 12 bp, Homo sapiens
aagaaaaaggaa

SEQ ID NO: 449201 - DNA, 18 bp, Homo sapiens
aagaaaaaggaaacaagc

SEQ ID NO: 449202 - DNA, 16 bp, Homo sapiens
aagaaaacccgaggga

SEQ ID NO: 449203 - DNA, 19 bp, Homo sapiens
aagaaagctatatatgaat

SEQ ID NO: 449204 - DNA, 13 bp, Homo sapiens
aagaaaggcagag

SEQ ID NO: 449205 - DNA, 17 bp, Homo sapiens
aagaaagggagaaggat

SEQ ID NO: 449206 - DNA, 14 bp, Homo sapiens
aagaaagtctatgc

SEQ ID NO: 449207 - DNA, 13 bp, Homo sapiens
aagaaatgctaat

SEQ ID NO: 449208 - DNA, 20 bp, Homo sapiens
aagaaatgctaatgtaatca

SEQ ID NO: 449209 - DNA, 17 bp, Homo sapiens
aagaaatggctttccac

SEQ ID NO: 449210 - DNA, 18 bp, Homo sapiens
aagaacagaattgctcct

SEQ ID NO: 449211 - DNA, 16 bp, Homo sapiens
aagaacccccctcccc

SEQ ID NO: 449212 - DNA, 22 bp, Homo sapiens
aagaacccccctccccaaggaa

SEQ ID NO: 449213 - DNA, 21 bp, Homo sapiens
aagaagaaagtctatgcttag

SEQ ID NO: 449214 - DNA, 13 bp, Homo sapiens
aagaagattctaa

SEQ ID NO: 449215 - DNA, 19 bp, Homo sapiens
aagaataaataaagaagaa

SEQ ID NO: 449216 - DNA, 15 bp, Homo sapiens
aagaatagcttatct

SEQ ID NO: 449217 - DNA, 18 bp, Homo sapiens
aagagaaaatgctttctc

SEQ ID NO: 449218 - DNA, 20 bp, Homo sapiens
aagagccctgagcccagaaa

SEQ ID NO: 449219 - DNA, 18 bp, Homo sapiens
aagagcgctcctctgcct

SEQ ID NO: 449220 - DNA, 20 bp, Homo sapiens
aagagcgctcctctgccttg

SEQ ID NO: 449221 - DNA, 14 bp, Homo sapiens
aagagctcaggaga

SEQ ID NO: 449222 - DNA, 19 bp, Homo sapiens
aagagctcaggagaaggcc

SEQ ID NO: 449223 - DNA, 21 bp, Homo sapiens
aagagctcaggagaaggcctg

SEQ ID NO: 449224 - DNA, 22 bp, Homo sapiens
aagagcttcccctaacctgggt

SEQ ID NO: 449225 - DNA, 16 bp, Homo sapiens
aagaggccagtacttt

SEQ ID NO: 449226 - DNA, 18 bp, Homo sapiens
aagatgttaattactttt

SEQ ID NO: 449227 - DNA, 11 bp, Homo sapiens
aagattctaaa

SEQ ID NO: 449228 - DNA, 12 bp, Homo sapiens
aagatttattat

SEQ ID NO: 449229 - DNA, 18 bp, Homo sapiens
acaggaaagccctccccc

SEQ ID NO: 449230 - DNA, 17 bp, Homo sapiens
acaggacacgaaggctg

SEQ ID NO: 449231 - DNA, 17 bp, Homo sapiens
acaggattctcttctca

SEQ ID NO: 449232 - DNA, 20 bp, Homo sapiens
acagggagggaacagacctc

SEQ ID NO: 449233 - DNA, 14 bp, Homo sapiens
acagtatataagct

SEQ ID NO: 449234 - DNA, 18 bp, Homo sapiens
acagtctcattacagatt

SEQ ID NO: 449235 - DNA, 21 bp, Homo sapiens
acagtgtggcttaaacatttt

SEQ ID NO: 449236 - DNA, 12 bp, Homo sapiens
acagttttgtct

SEQ ID NO: 449237 - DNA, 21 bp, Homo sapiens
acagtttttgtaaccatatga

SEQ ID NO: 449238 - DNA, 23 bp, Homo sapiens
acataaacttgtacttacactga

SEQ ID NO: 449239 - DNA, 18 bp, Homo sapiens
acataaagtaataactgt

SEQ ID NO: 449240 - DNA, 19 bp, Homo sapiens
acataaagtaataactgtt

SEQ ID NO: 449241 - DNA, 22 bp, Homo sapiens
acataaatctgtctgattctat

SEQ ID NO: 449242 - DNA, 22 bp, Homo sapiens
acataagctggtatcagtggtt

SEQ ID NO: 449243 - DNA, 11 bp, Homo sapiens
acataggaatt

SEQ ID NO: 449244 - DNA, 17 bp, Homo sapiens
acatagtctttgtttac

SEQ ID NO: 449245 - DNA, 21 bp, Homo sapiens
acatagtgatggttcccctgt

SEQ ID NO: 449246 - DNA, 23 bp, Homo sapiens
acatattcttgctttcacaaata

SEQ ID NO: 449247 - DNA, 16 bp, Homo sapiens
acatccggaacagcca

SEQ ID NO: 449248 - DNA, 21 bp, Homo sapiens
acatccggaacagccaaagaa

SEQ ID NO: 449249 - DNA, 11 bp, Homo sapiens
acatctgaaaa

SEQ ID NO: 449250 - DNA, 12 bp, Homo sapiens
acatctgtatat

SEQ ID NO: 449251 - DNA, 22 bp, Homo sapiens
acatctgtatatcagctctaaa

SEQ ID NO: 449252 - DNA, 16 bp, Homo sapiens
acatcttttaactgcc

SEQ ID NO: 449253 - DNA, 19 bp, Homo sapiens
acatggattgattaaaagc

SEQ ID NO: 449254 - DNA, 14 bp, Homo sapiens
acattaaaataact

SEQ ID NO: 449255 - DNA, 21 bp, Homo sapiens
acattaaacactgtaatctta

SEQ ID NO: 449256 - DNA, 18 bp, Homo sapiens
acatttgtcactgaataa

SEQ ID NO: 449257 - DNA, 19 bp, Homo sapiens
acattttttgtttcttggt

SEQ ID NO: 449258 - DNA, 15 bp, Homo sapiens
accaaccctcagagc

SEQ ID NO: 449259 - DNA, 22 bp, Homo sapiens
accaactaagttgtattttaat

SEQ ID NO: 449260 - DNA, 16 bp, Homo sapiens
accaagccgtggcttc

SEQ ID NO: 449261 - DNA, 17 bp, Homo sapiens
accaagccgtggcttcc

SEQ ID NO: 449262 - DNA, 21 bp, Homo sapiens
accaagctgctctccttcact

SEQ ID NO: 449263 - DNA, 20 bp, Homo sapiens
accacaactaacaatgcctt

SEQ ID NO: 449264 - DNA, 13 bp, Homo sapiens
accacacacaccc

SEQ ID NO: 449265 - DNA, 20 bp, Homo sapiens
accacacacacccttcccca

SEQ ID NO: 449266 - DNA, 19 bp, Homo sapiens
accacatggggttttggag

SEQ ID NO: 449267 - DNA, 13 bp, Homo sapiens
accaccgctcccg

SEQ ID NO: 449268 - DNA, 23 bp, Homo sapiens
accacgattccaacccaggtctg

SEQ ID NO: 449269 - DNA, 18 bp, Homo sapiens
accacggcgtttttttac

SEQ ID NO: 449270 - DNA, 19 bp, Homo sapiens
accacggcgtttttttaca

SEQ ID NO: 449271 - DNA, 23 bp, Homo sapiens
accacggggtcgggggaggagca

SEQ ID NO: 449272 - DNA, 13 bp, Homo sapiens
accagagagaaag

SEQ ID NO: 449273 - DNA, 14 bp, Homo sapiens
accagcactcccag

SEQ ID NO: 449274 - DNA, 19 bp, Homo sapiens
accagcactcccagggccc

SEQ ID NO: 449275 - DNA, 15 bp, Homo sapiens
accagcctgagccac

SEQ ID NO: 449276 - DNA, 23 bp, Homo sapiens
accagcctgagccacagtggggc

SEQ ID NO: 449277 - DNA, 18 bp, Homo sapiens
accagctattggaacaga

SEQ ID NO: 449278 - DNA, 11 bp, Homo sapiens
accaggagaca

SEQ ID NO: 449279 - DNA, 12 bp, Homo sapiens
accaggagacag

SEQ ID NO: 449280 - DNA, 13 bp, Homo sapiens
accatagaactgt

SEQ ID NO: 449281 - DNA, 14 bp, Homo sapiens
accatagaactgtc

SEQ ID NO: 449282 - DNA, 18 bp, Homo sapiens
accatatgattgaaaaga

SEQ ID NO: 449283 - DNA, 21 bp, Homo sapiens
accatctggagtcttcctgta

SEQ ID NO: 449284 - DNA, 14 bp, Homo sapiens
accatgttgccaat

SEQ ID NO: 449285 - DNA, 18 bp, Homo sapiens
acccaaaacacacaattt

SEQ ID NO: 449286 - DNA, 18 bp, Homo sapiens
acccaaggtggtcttgga

SEQ ID NO: 449287 - DNA, 18 bp, Homo sapiens
acccaattttaaaaaata

SEQ ID NO: 449288 - DNA, 22 bp, Homo sapiens
acccaattttaaaaaataacat

SEQ ID NO: 449289 - DNA, 23 bp, Homo sapiens
acccacaccccgtctgccccttg

SEQ ID NO: 449290 - DNA, 20 bp, Homo sapiens
acccactagccctctttctc

SEQ ID NO: 449291 - DNA, 13 bp, Homo sapiens
acccagaccctcc

SEQ ID NO: 449292 - DNA, 17 bp, Homo sapiens
acccagaccctccttcc

SEQ ID NO: 449293 - DNA, 18 bp, Homo sapiens
acccagaccctccttccc

SEQ ID NO: 449294 - DNA, 22 bp, Homo sapiens
acccagaccctccttccccacc

SEQ ID NO: 449295 - DNA, 14 bp, Homo sapiens
acccagaggtctcc

SEQ ID NO: 449296 - DNA, 15 bp, Homo sapiens
accccacacgccggg

SEQ ID NO: 449297 - DNA, 23 bp, Homo sapiens
accccacacgccggggctggccc

SEQ ID NO: 449298 - DNA, 23 bp, Homo sapiens
accccaccacacacacccttccc

SEQ ID NO: 449299 - DNA, 20 bp, Homo sapiens
accccacttatgctgctgtg

SEQ ID NO: 449300 - DNA, 24 bp, Homo sapiens
cgcagccctgctttgggctgccct

SEQ ID NO: 449301 - DNA, 18 bp, Homo sapiens
cgcagccgcgctctgccc

SEQ ID NO: 449302 - DNA, 21 bp, Homo sapiens
cgcagccgcgctctgcccctc

SEQ ID NO: 449303 - DNA, 22 bp, Homo sapiens
cgcagccgcgctctgcccctcc

SEQ ID NO: 449304 - DNA, 14 bp, Homo sapiens
cgcagcggggtagg

SEQ ID NO: 449305 - DNA, 21 bp, Homo sapiens
cgcagggcgctccggcagagg

SEQ ID NO: 449306 - DNA, 23 bp, Homo sapiens
cgcatagtgtgctcggacacagt

SEQ ID NO: 449307 - DNA, 13 bp, Homo sapiens
cgccaccccactg

SEQ ID NO: 449308 - DNA, 17 bp, Homo sapiens
cgcccaccccgctgcct

SEQ ID NO: 449309 - DNA, 11 bp, Homo sapiens
cgcccacctgc

SEQ ID NO: 449310 - DNA, 13 bp, Homo sapiens
cgcccacctgccc

SEQ ID NO: 449311 - DNA, 14 bp, Homo sapiens
cgcccacctgccca

SEQ ID NO: 449312 - DNA, 18 bp, Homo sapiens
cgcccacctgcccagtta

SEQ ID NO: 449313 - DNA, 16 bp, Homo sapiens
cgccccaaccctcgga

SEQ ID NO: 449314 - DNA, 11 bp, Homo sapiens
cgccccagaga

SEQ ID NO: 449315 - DNA, 17 bp, Homo sapiens
cgccccagagactgccc

SEQ ID NO: 449316 - DNA, 19 bp, Homo sapiens
cgccccagagactgcccac

SEQ ID NO: 449317 - DNA, 12 bp, Homo sapiens
cgccccaggccc

SEQ ID NO: 449318 - DNA, 22 bp, Homo sapiens
gacggggcagagctgagtcggc

SEQ ID NO: 449319 - DNA, 23 bp, Homo sapiens
gacgtcatcggaggctgggcccc

SEQ ID NO: 449320 - DNA, 20 bp, Homo sapiens
gacgtttttgtgctgtgggc

SEQ ID NO: 449321 - DNA, 23 bp, Homo sapiens
gacgtttttgtgctgtgggcagc

SEQ ID NO: 449322 - DNA, 15 bp, Homo sapiens
gactcactcataaag

SEQ ID NO: 449323 - DNA, 12 bp, Homo sapiens
gactccctgtgg

SEQ ID NO: 449324 - DNA, 13 bp, Homo sapiens
gactccctgtggg

SEQ ID NO: 449325 - DNA, 14 bp, Homo sapiens
gactccctgtgggg

SEQ ID NO: 449326 - DNA, 16 bp, Homo sapiens
gactcgagagggctga

SEQ ID NO: 449327 - DNA, 18 bp, Homo sapiens
gactcgagagggctgagc

SEQ ID NO: 449328 - DNA, 20 bp, Homo sapiens
gactcgagagggctgagccc

SEQ ID NO: 449329 - DNA, 21 bp, Homo sapiens
gactctctcctctctctccct

SEQ ID NO: 449330 - DNA, 19 bp, Homo sapiens
gactctgctgctcatggga

SEQ ID NO: 449331 - DNA, 15 bp, Homo sapiens
gactgaatttaacta

SEQ ID NO: 449332 - DNA, 13 bp, Homo sapiens
gactgcatgcaag

SEQ ID NO: 449333 - DNA, 14 bp, Homo sapiens
gactggccactgaa

SEQ ID NO: 449334 - DNA, 13 bp, Homo sapiens
gactggcccaccc

SEQ ID NO: 449335 - DNA, 17 bp, Homo sapiens
gactggcccacccctct

SEQ ID NO: 449336 - DNA, 21 bp, Homo sapiens
gactggcccacccctcttccc

SEQ ID NO: 449337 - DNA, 22 bp, Homo sapiens
gactgtctcaagagggcactgg

SEQ ID NO: 449338 - DNA, 18 bp, Homo sapiens
gactgtcttcaaccctgc

SEQ ID NO: 449339 - DNA, 19 bp, Homo sapiens
gactgtcttcaaccctgcc

SEQ ID NO: 449340 - DNA, 20 bp, Homo sapiens
gactgtcttcaaccctgccc

SEQ ID NO: 449341 - DNA, 15 bp, Homo sapiens
gacttcagactctct

SEQ ID NO: 449342 - DNA, 19 bp, Homo sapiens
gacttcagactctctcctc

SEQ ID NO: 449343 - DNA, 22 bp, Homo sapiens
gacttcagactctctcctctct

SEQ ID NO: 449344 - DNA, 21 bp, Homo sapiens
gacttcccagctggcagcgcc

SEQ ID NO: 449345 - DNA, 23 bp, Homo sapiens
gacttcccagctggcagcgcctc

SEQ ID NO: 449346 - DNA, 24 bp, Homo sapiens
gacttcccagctggcagcgcctcc

SEQ ID NO: 449347 - DNA, 19 bp, Homo sapiens
gacttgtagggatgccttt

SEQ ID NO: 449348 - DNA, 12 bp, Homo sapiens
gactttatttaa

SEQ ID NO: 449349 - DNA, 19 bp, Homo sapiens
gactttatttaatttcata

SEQ ID NO: 449350 - DNA, 22 bp, Homo sapiens
gactttatttaatttcataaat

SEQ ID NO: 449351 - DNA, 21 bp, Homo sapiens
gagaaacccaagtggaatcat

SEQ ID NO: 449352 - DNA, 13 bp, Homo sapiens
gagaaaggaacat

SEQ ID NO: 449353 - DNA, 15 bp, Homo sapiens
gagaagcaccccacc

SEQ ID NO: 449354 - DNA, 22 bp, Homo sapiens
gagaaggacccggaggggcctg

SEQ ID NO: 449355 - DNA, 19 bp, Homo sapiens
gagacagtgggggtgcctg

SEQ ID NO: 449356 - DNA, 20 bp, Homo sapiens
gagacagtgggggtgcctgg

SEQ ID NO: 449357 - DNA, 13 bp, Homo sapiens
gagacccaccatc

SEQ ID NO: 449358 - DNA, 19 bp, Homo sapiens
gagacccaccatccttcca

SEQ ID NO: 449359 - DNA, 16 bp, Homo sapiens
gagacctcagggatgg

SEQ ID NO: 449360 - DNA, 17 bp, Homo sapiens
gagactcccgcctttga

SEQ ID NO: 449361 - DNA, 11 bp, Homo sapiens
gagactgccca

SEQ ID NO: 449362 - DNA, 12 bp, Homo sapiens
gagactgcccac

SEQ ID NO: 449363 - DNA, 15 bp, Homo sapiens
gagactgcccaccct

SEQ ID NO: 449364 - DNA, 19 bp, Homo sapiens
gagactgcccaccctgggc

SEQ ID NO: 449365 - DNA, 21 bp, Homo sapiens
gagactgcccaccctgggcct

SEQ ID NO: 449366 - DNA, 22 bp, Homo sapiens
gagactgtctcaagagggcact

SEQ ID NO: 449367 - DNA, 15 bp, Homo sapiens
gagagaagcacccca

SEQ ID NO: 449368 - DNA, 13 bp, Homo sapiens
gagagcgccaccc

SEQ ID NO: 449369 - DNA, 15 bp, Homo sapiens
gagagcgccacccgc

SEQ ID NO: 449370 - DNA, 20 bp, Homo sapiens
gagaggaggtgtggagtgga

SEQ ID NO: 449371 - DNA, 22 bp, Homo sapiens
gagaggaggtgtggagtggagg

SEQ ID NO: 449372 - DNA, 12 bp, Homo sapiens
gagaggcggcct

SEQ ID NO: 449373 - DNA, 13 bp, Homo sapiens
gagaggcggcctc

SEQ ID NO: 449374 - DNA, 15 bp, Homo sapiens
gagaggcggcctcgt

SEQ ID NO: 449375 - DNA, 11 bp, Homo sapiens
gagagggctga

SEQ ID NO: 449376 - DNA, 12 bp, Homo sapiens
gagagggctgag

SEQ ID NO: 449377 - DNA, 13 bp, Homo sapiens
gagagggctgagc

SEQ ID NO: 449378 - DNA, 15 bp, Homo sapiens
gagagggctgagccc

SEQ ID NO: 449379 - DNA, 16 bp, Homo sapiens
gagagggctgagcccc

SEQ ID NO: 449380 - DNA, 17 bp, Homo sapiens
gagagggctgagcccct

SEQ ID NO: 449381 - DNA, 20 bp, Homo sapiens
gagagggctgagcccctcct

SEQ ID NO: 449382 - DNA, 22 bp, Homo sapiens
gagagggctgagcccctcctct

SEQ ID NO: 449383 - DNA, 13 bp, Homo sapiens
gagaggggtgaga

SEQ ID NO: 449384 - DNA, 17 bp, Homo sapiens
gagagtgaatacactgg

SEQ ID NO: 449385 - DNA, 21 bp, Homo sapiens
gagagtggctcctcccggtgc

SEQ ID NO: 449386 - DNA, 11 bp, Homo sapiens
gagatcagcat

SEQ ID NO: 449387 - DNA, 20 bp, Homo sapiens
gagatgtgtccatgtgaaat

SEQ ID NO: 449388 - DNA, 13 bp, Homo sapiens
gagattggctttg

SEQ ID NO: 449389 - DNA, 17 bp, Homo sapiens
gagattgggggggcttg

SEQ ID NO: 449390 - DNA, 20 bp, Homo sapiens
gagcaaactgaagcccacag

SEQ ID NO: 449391 - DNA, 17 bp, Homo sapiens
gagcaaagatggcttcc

SEQ ID NO: 449392 - DNA, 15 bp, Homo sapiens
gagcaccacggggtc

SEQ ID NO: 449393 - DNA, 17 bp, Homo sapiens
gagcaccacggggtcgg

SEQ ID NO: 449394 - DNA, 11 bp, Homo sapiens
gagcaccccca

SEQ ID NO: 449395 - DNA, 18 bp, Homo sapiens
gagcactagaatgagaaa

SEQ ID NO: 449396 - DNA, 13 bp, Homo sapiens
gagcagtggggag

SEQ ID NO: 449397 - DNA, 16 bp, Homo sapiens
gagcagtggggagcgg

SEQ ID NO: 449398 - DNA, 16 bp, Homo sapiens
gagcattctggggtgg

SEQ ID NO: 449399 - DNA, 14 bp, Homo sapiens
gagccacagtgggg

SEQ ID NO: 449400 - DNA, 18 bp, Homo sapiens
gagccacagtggggccca

SEQ ID NO: 449401 - DNA, 22 bp, Homo sapiens
gagccacagtggggcccatggc

SEQ ID NO: 449402 - DNA, 12 bp, Homo sapiens
gagcccactcct

SEQ ID NO: 449403 - DNA, 15 bp, Homo sapiens
gagcccagaaaaaag

SEQ ID NO: 449404 - DNA, 17 bp, Homo sapiens
gagcccagaaaaaagga

SEQ ID NO: 449405 - DNA, 20 bp, Homo sapiens
gagccccccgtgttcacaca

SEQ ID NO: 449406 - DNA, 18 bp, Homo sapiens
gagcccctatcctgcacc

SEQ ID NO: 449407 - DNA, 15 bp, Homo sapiens
gagcccctcctctcc

SEQ ID NO: 449408 - DNA, 18 bp, Homo sapiens
gagcccctcctctcctcg

SEQ ID NO: 449409 - DNA, 18 bp, Homo sapiens
gagcccgaatttctcact

SEQ ID NO: 449410 - DNA, 20 bp, Homo sapiens
gagccctgagcccagaaaaa

SEQ ID NO: 449411 - DNA, 17 bp, Homo sapiens
gagccctgccctcactc

SEQ ID NO: 449412 - DNA, 23 bp, Homo sapiens
gagccctgccctcactccactcc

SEQ ID NO: 449413 - DNA, 16 bp, Homo sapiens
gagcctatggaaaggg

SEQ ID NO: 449414 - DNA, 23 bp, Homo sapiens
gagcctatggaaagggtgtggct

SEQ ID NO: 449415 - DNA, 12 bp, Homo sapiens
gagcctccccct

SEQ ID NO: 449416 - DNA, 16 bp, Homo sapiens
gagcctccccctcaga

SEQ ID NO: 449417 - DNA, 12 bp, Homo sapiens
gagcgccacccg

SEQ ID NO: 449418 - DNA, 22 bp, Homo sapiens
gagcgccacccgcccgcccccg

SEQ ID NO: 449419 - DNA, 23 bp, Homo sapiens
gagcgccacccgcccgcccccgc

SEQ ID NO: 449420 - DNA, 16 bp, Homo sapiens
gagcgcgtgccttccc

SEQ ID NO: 449421 - DNA, 17 bp, Homo sapiens
gagcgcgtgccttcccc

SEQ ID NO: 449422 - DNA, 14 bp, Homo sapiens
gagcgctcctctgc

SEQ ID NO: 449423 - DNA, 21 bp, Homo sapiens
gagcgctcctctgccttggac

SEQ ID NO: 449424 - DNA, 20 bp, Homo sapiens
gagcgggggctaactggccc

SEQ ID NO: 449425 - DNA, 20 bp, Homo sapiens
gagctcaaggatcagagtaa

SEQ ID NO: 449426 - DNA, 13 bp, Homo sapiens
gagctcaggagaa

SEQ ID NO: 449427 - DNA, 15 bp, Homo sapiens
gagctcaggagaagg

SEQ ID NO: 449428 - DNA, 16 bp, Homo sapiens
gagctcaggagaaggc

SEQ ID NO: 449429 - DNA, 19 bp, Homo sapiens
gagctcagtacagggcagg

SEQ ID NO: 449430 - DNA, 15 bp, Homo sapiens
gagctccaccctccc

SEQ ID NO: 449431 - DNA, 18 bp, Homo sapiens
gagctccaccctcccctc

SEQ ID NO: 449432 - DNA, 19 bp, Homo sapiens
gagctgcagccccccagag

SEQ ID NO: 449433 - DNA, 11 bp, Homo sapiens
gagcttctcct

SEQ ID NO: 449434 - DNA, 19 bp, Homo sapiens
gagcttgattctaaagggg

SEQ ID NO: 449435 - DNA, 22 bp, Homo sapiens
gagcttgattctaaaggggaca

SEQ ID NO: 449436 - DNA, 18 bp, Homo sapiens
gaggaatgtgcttttcca

SEQ ID NO: 449437 - DNA, 13 bp, Homo sapiens
gaggacagggagg

SEQ ID NO: 449438 - DNA, 14 bp, Homo sapiens
gaggacctgggggg

SEQ ID NO: 449439 - DNA, 15 bp, Homo sapiens
ctaggctccctgagg

SEQ ID NO: 449440 - DNA, 16 bp, Homo sapiens
ctaggctccctgaggt

SEQ ID NO: 449441 - DNA, 13 bp, Homo sapiens
ctaggtctccacc

SEQ ID NO: 449442 - DNA, 18 bp, Homo sapiens
ctagtcaactgctgtttt

SEQ ID NO: 449443 - DNA, 19 bp, Homo sapiens
ctagtgatacactgtatct

SEQ ID NO: 449444 - DNA, 18 bp, Homo sapiens
ctagttctttgcattcgt

SEQ ID NO: 449445 - DNA, 12 bp, Homo sapiens
ctagtttgcata

SEQ ID NO: 449446 - DNA, 14 bp, Homo sapiens
ctataaaagtgata

SEQ ID NO: 449447 - DNA, 22 bp, Homo sapiens
ctataaattcaacacttatttt

SEQ ID NO: 449448 - DNA, 19 bp, Homo sapiens
ctccaggaggactgttcta

SEQ ID NO: 449449 - DNA, 11 bp, Homo sapiens
ctccaggctgg

SEQ ID NO: 449450 - DNA, 19 bp, Homo sapiens
ctccaggctggggcctggc

SEQ ID NO: 449451 - DNA, 22 bp, Homo sapiens
ctccatagttctgactcctgaa

SEQ ID NO: 449452 - DNA, 20 bp, Homo sapiens
ctcccaggcgccccttcccc

SEQ ID NO: 449453 - DNA, 13 bp, Homo sapiens
ctcccagggcccg

SEQ ID NO: 449454 - DNA, 15 bp, Homo sapiens
ctcccagggcccgag

SEQ ID NO: 449455 - DNA, 16 bp, Homo sapiens
ctcccagggcccgagc

SEQ ID NO: 449456 - DNA, 19 bp, Homo sapiens
ctcccagggcccgagcgcg

SEQ ID NO: 449457 - DNA, 23 bp, Homo sapiens
ctcccatgggggctccagacatt

SEQ ID NO: 449458 - DNA, 12 bp, Homo sapiens
ctccccacccac

SEQ ID NO: 449459 - DNA, 14 bp, Homo sapiens
ctccccacccacca

SEQ ID NO: 449460 - DNA, 20 bp, Homo sapiens
ctccccatatataaattatt

SEQ ID NO: 449461 - DNA, 21 bp, Homo sapiens
ctccccatgtgcctgcaccag

SEQ ID NO: 449462 - DNA, 13 bp, Homo sapiens
ctcccccaggctg

SEQ ID NO: 449463 - DNA, 22 bp, Homo sapiens
ctcccccaggctgcgcctgccc

SEQ ID NO: 449464 - DNA, 15 bp, Homo sapiens
ctcccccgcagacag

SEQ ID NO: 449465 - DNA, 16 bp, Homo sapiens
ctccccctgccagcaa

SEQ ID NO: 449466 - DNA, 15 bp, Homo sapiens
ctccccgcagccctc

SEQ ID NO: 449467 - DNA, 13 bp, Homo sapiens
ctcccctccagac

SEQ ID NO: 449468 - DNA, 20 bp, Homo sapiens
ctcccctccagacccctacc

SEQ ID NO: 449469 - DNA, 14 bp, Homo sapiens
ctcccctctcctga

SEQ ID NO: 449470 - DNA, 15 bp, Homo sapiens
ctcccctctcctgag

SEQ ID NO: 449471 - DNA, 16 bp, Homo sapiens
ctcccgccgcctcggg

SEQ ID NO: 449472 - DNA, 20 bp, Homo sapiens
ctcccgcgggaagccagccc

SEQ ID NO: 449473 - DNA, 22 bp, Homo sapiens
ctcccgtccgtccgcccgccca

SEQ ID NO: 449474 - DNA, 23 bp, Homo sapiens
ctccctataccgagacccaccat

SEQ ID NO: 449475 - DNA, 20 bp, Homo sapiens
ctccctccacacctccaccc

SEQ ID NO: 449476 - DNA, 14 bp, Homo sapiens
ctccctccactcct

SEQ ID NO: 449477 - DNA, 16 bp, Homo sapiens
ctccctccactcctcc

SEQ ID NO: 449478 - DNA, 13 bp, Homo sapiens
ctccctccctcca

SEQ ID NO: 449479 - DNA, 14 bp, Homo sapiens
ctccctccctccac

SEQ ID NO: 449480 - DNA, 20 bp, Homo sapiens
ctccctccttccttcttgct

SEQ ID NO: 449481 - DNA, 20 bp, Homo sapiens
ctccctcggccccacccacc

SEQ ID NO: 449482 - DNA, 16 bp, Homo sapiens
ctccctgactccctgt

SEQ ID NO: 449483 - DNA, 17 bp, Homo sapiens
ctccctgactccctgtg

SEQ ID NO: 449484 - DNA, 18 bp, Homo sapiens
ctccctgactccctgtgg

SEQ ID NO: 449485 - DNA, 20 bp, Homo sapiens
ctccctgactccctgtgggg

SEQ ID NO: 449486 - DNA, 20 bp, Homo sapiens
ctccctgcccctcccttcaa

SEQ ID NO: 449487 - DNA, 21 bp, Homo sapiens
ctccctgcccctcccttcaac

SEQ ID NO: 449488 - DNA, 14 bp, Homo sapiens
ctccctgtcccctg

SEQ ID NO: 449489 - DNA, 17 bp, Homo sapiens
ctccctgtgggggtggc

SEQ ID NO: 449490 - DNA, 12 bp, Homo sapiens
ctcccttcaacc

SEQ ID NO: 449491 - DNA, 21 bp, Homo sapiens
ctcccttggttgttccttttt

SEQ ID NO: 449492 - DNA, 17 bp, Homo sapiens
ctccctttgtggacttt

SEQ ID NO: 449493 - DNA, 18 bp, Homo sapiens
ctccctttgtggacttta

SEQ ID NO: 449494 - DNA, 19 bp, Homo sapiens
ctccctttgtggactttat

SEQ ID NO: 449495 - DNA, 23 bp, Homo sapiens
ctccgagaagctctcgagggaag

SEQ ID NO: 449496 - DNA, 14 bp, Homo sapiens
ctccggcagaggca

SEQ ID NO: 449497 - DNA, 17 bp, Homo sapiens
ctccggcagaggcaggg

SEQ ID NO: 449498 - DNA, 18 bp, Homo sapiens
ctccggcagaggcagggc

SEQ ID NO: 449499 - DNA, 21 bp, Homo sapiens
ctccggcagaggcagggccct

SEQ ID NO: 449500 - DNA, 22 bp, Homo sapiens
ctccgggtgcgtgaccggcccg

SEQ ID NO: 449501 - DNA, 17 bp, Homo sapiens
ctccgggtgtggcctca

SEQ ID NO: 449502 - DNA, 18 bp, Homo sapiens
ctccgggtgtggcctcag

SEQ ID NO: 449503 - DNA, 21 bp, Homo sapiens
ctcctagcacaaggagtgccc

SEQ ID NO: 449504 - DNA, 23 bp, Homo sapiens
ctcctaggcgctcagaggccgct

SEQ ID NO: 449505 - DNA, 13 bp, Homo sapiens
ctcctaggctccc

SEQ ID NO: 449506 - DNA, 14 bp, Homo sapiens
ctcctaggctccct

SEQ ID NO: 449507 - DNA, 15 bp, Homo sapiens
ctcctaggctccctg

SEQ ID NO: 449508 - DNA, 16 bp, Homo sapiens
ctcctaggctccctga

SEQ ID NO: 449509 - DNA, 18 bp, Homo sapiens
ctcctaggctccctgagg

SEQ ID NO: 449510 - DNA, 20 bp, Homo sapiens
ctcctaggctccctgaggta

SEQ ID NO: 449511 - DNA, 14 bp, Homo sapiens
ctcctcccggtgcc

SEQ ID NO: 449512 - DNA, 16 bp, Homo sapiens
ctcctcgggcgcctgc

SEQ ID NO: 449513 - DNA, 18 bp, Homo sapiens
ctcctcgtccggcctgca

SEQ ID NO: 449514 - DNA, 20 bp, Homo sapiens
ctcctcgtccggcctgcagc

SEQ ID NO: 449515 - DNA, 21 bp, Homo sapiens
ctcctctcctcgtccggcctg

SEQ ID NO: 449516 - DNA, 20 bp, Homo sapiens
ctcctctctctccctccact

SEQ ID NO: 449517 - DNA, 22 bp, Homo sapiens
ctcctctctctccctccactcc

SEQ ID NO: 449518 - DNA, 13 bp, Homo sapiens
ctcctctgcagcc

SEQ ID NO: 449519 - DNA, 18 bp, Homo sapiens
ctcctctgcagcctgagc

SEQ ID NO: 449520 - DNA, 20 bp, Homo sapiens
ctcctctgcagcctgagctc

SEQ ID NO: 449521 - DNA, 12 bp, Homo sapiens
ctcctctgcccc

SEQ ID NO: 449522 - DNA, 13 bp, Homo sapiens
ctcctctgccccc

SEQ ID NO: 449523 - DNA, 14 bp, Homo sapiens
ctcctctgccccct

SEQ ID NO: 449524 - DNA, 15 bp, Homo sapiens
ctcctctgccccctc

SEQ ID NO: 449525 - DNA, 16 bp, Homo sapiens
ctcctctgccccctcc

SEQ ID NO: 449526 - DNA, 22 bp, Homo sapiens
ctcctctgccccctcccccgca

SEQ ID NO: 449527 - DNA, 15 bp, Homo sapiens
ctcctctgccttgga

SEQ ID NO: 449528 - DNA, 18 bp, Homo sapiens
ctcctctgccttggacac

SEQ ID NO: 449529 - DNA, 13 bp, Homo sapiens
ctcctctgctcca

SEQ ID NO: 449530 - DNA, 24 bp, Homo sapiens
ctcctctgctccaacagacaccct

SEQ ID NO: 449531 - DNA, 13 bp, Homo sapiens
ctcctgagcctgt

SEQ ID NO: 449532 - DNA, 13 bp, Homo sapiens
ctcctgccctcgt

SEQ ID NO: 449533 - DNA, 22 bp, Homo sapiens
ctcctgccctcgtctccctggc

SEQ ID NO: 449534 - DNA, 12 bp, Homo sapiens
ctcctggccaga

SEQ ID NO: 449535 - DNA, 15 bp, Homo sapiens
ctcctggccagacgc

SEQ ID NO: 449536 - DNA, 17 bp, Homo sapiens
ctccttcactctgacag

SEQ ID NO: 449537 - DNA, 13 bp, Homo sapiens
ctccttccccacc

SEQ ID NO: 449538 - DNA, 20 bp, Homo sapiens
cctcactgccctccctcggc

SEQ ID NO: 449539 - DNA, 23 bp, Homo sapiens
cctcactgccctccctcggcccc

SEQ ID NO: 449540 - DNA, 16 bp, Homo sapiens
cctcactggtgcattt

SEQ ID NO: 449541 - DNA, 14 bp, Homo sapiens
cctcagatgatctc

SEQ ID NO: 449542 - DNA, 23 bp, Homo sapiens
cctcagggatggcccagctgatc

SEQ ID NO: 449543 - DNA, 15 bp, Homo sapiens
cctcaggtgaataac

SEQ ID NO: 449544 - DNA, 15 bp, Homo sapiens
cctcagttcaacctg

SEQ ID NO: 449545 - DNA, 16 bp, Homo sapiens
cctcagttcaacctgg

SEQ ID NO: 449546 - DNA, 22 bp, Homo sapiens
cctcagttcaacctggtggcac

SEQ ID NO: 449547 - DNA, 13 bp, Homo sapiens
cctccacccgtcc

SEQ ID NO: 449548 - DNA, 15 bp, Homo sapiens
cctccacccgtcctg

SEQ ID NO: 449549 - DNA, 17 bp, Homo sapiens
cctccacgcctcctggc

SEQ ID NO: 449550 - DNA, 12 bp, Homo sapiens
cctccactcctc

SEQ ID NO: 449551 - DNA, 15 bp, Homo sapiens
cctccactcctccca

SEQ ID NO: 449552 - DNA, 11 bp, Homo sapiens
cctccactctg

SEQ ID NO: 449553 - DNA, 12 bp, Homo sapiens
cctccactctga

SEQ ID NO: 449554 - DNA, 20 bp, Homo sapiens
cctccactctgaggtctcac

SEQ ID NO: 449555 - DNA, 13 bp, Homo sapiens
cctccagacccct

SEQ ID NO: 449556 - DNA, 15 bp, Homo sapiens
cctccagacccctac

SEQ ID NO: 449557 - DNA, 17 bp, Homo sapiens
cctccagacccctaccc

SEQ ID NO: 449558 - DNA, 22 bp, Homo sapiens
cctccagcaatgcctgcctgaa

SEQ ID NO: 449559 - DNA, 15 bp, Homo sapiens
cctccaggctggggc

SEQ ID NO: 449560 - DNA, 17 bp, Homo sapiens
cctccaggctggggcct

SEQ ID NO: 449561 - DNA, 13 bp, Homo sapiens
cctcccccaggct

SEQ ID NO: 449562 - DNA, 14 bp, Homo sapiens
cctcccccaggctg

SEQ ID NO: 449563 - DNA, 18 bp, Homo sapiens
cctcccccaggctgcgcc

SEQ ID NO: 449564 - DNA, 22 bp, Homo sapiens
cctcccccaggctgcgcctgcc

SEQ ID NO: 449565 - DNA, 16 bp, Homo sapiens
cctcccccgcagacag

SEQ ID NO: 449566 - DNA, 18 bp, Homo sapiens
cctccccgggggtccccg

SEQ ID NO: 449567 - DNA, 22 bp, Homo sapiens
cctcccctcttcttgcggcacc

SEQ ID NO: 449568 - DNA, 14 bp, Homo sapiens
cctcccgccgcctc

SEQ ID NO: 449569 - DNA, 15 bp, Homo sapiens
cctccctccctccac

SEQ ID NO: 449570 - DNA, 21 bp, Homo sapiens
cctccctgactccctgtgggg

SEQ ID NO: 449571 - DNA, 18 bp, Homo sapiens
cctccctgcccctccctt

SEQ ID NO: 449572 - DNA, 22 bp, Homo sapiens
cctccctgcccctcccttcaac

SEQ ID NO: 449573 - DNA, 12 bp, Homo sapiens
cctccctgtccc

SEQ ID NO: 449574 - DNA, 20 bp, Homo sapiens
cctccctgtcccctgaggtt

SEQ ID NO: 449575 - DNA, 14 bp, Homo sapiens
cctccgtccccagg

SEQ ID NO: 449576 - DNA, 22 bp, Homo sapiens
cctcctagcacaaggagtgccc

SEQ ID NO: 449577 - DNA, 14 bp, Homo sapiens
cctcctaggcgctc

SEQ ID NO: 449578 - DNA, 19 bp, Homo sapiens
cctcctaggcgctcagagg

SEQ ID NO: 449579 - DNA, 21 bp, Homo sapiens
cctcctaggcgctcagaggcc

SEQ ID NO: 449580 - DNA, 15 bp, Homo sapiens
cctcctaggctccct

SEQ ID NO: 449581 - DNA, 16 bp, Homo sapiens
cctcctaggctccctg

SEQ ID NO: 449582 - DNA, 15 bp, Homo sapiens
cctcctcgggcgcct

SEQ ID NO: 449583 - DNA, 19 bp, Homo sapiens
cctcctcgggcgcctgcgc

SEQ ID NO: 449584 - DNA, 11 bp, Homo sapiens
cctcctctgcc

SEQ ID NO: 449585 - DNA, 14 bp, Homo sapiens
cctcctctgccccc

SEQ ID NO: 449586 - DNA, 12 bp, Homo sapiens
cctcctggccag

SEQ ID NO: 449587 - DNA, 13 bp, Homo sapiens
cctcctggccaga

SEQ ID NO: 449588 - DNA, 16 bp, Homo sapiens
cctcctggccagacgc

SEQ ID NO: 449589 - DNA, 17 bp, Homo sapiens
cctcctggccagacgct

SEQ ID NO: 449590 - DNA, 21 bp, Homo sapiens
cctccttcactccctgtcata

SEQ ID NO: 449591 - DNA, 14 bp, Homo sapiens
cctccttctcccct

SEQ ID NO: 449592 - DNA, 15 bp, Homo sapiens
cctcctttccaaata

SEQ ID NO: 449593 - DNA, 16 bp, Homo sapiens
cctcgagtccccccac

SEQ ID NO: 449594 - DNA, 13 bp, Homo sapiens
cctcggagccccc

SEQ ID NO: 449595 - DNA, 21 bp, Homo sapiens
cccgccccagagactgcccac

SEQ ID NO: 449596 - DNA, 15 bp, Homo sapiens
cccgcccccgccctc

SEQ ID NO: 449597 - DNA, 11 bp, Homo sapiens
cccgccctcgc

SEQ ID NO: 449598 - DNA, 18 bp, Homo sapiens
cccgccgcctcgggccgc

SEQ ID NO: 449599 - DNA, 18 bp, Homo sapiens
cccgccggttggccggct

SEQ ID NO: 449600 - DNA, 15 bp, Homo sapiens
cccgccttcaggttc

SEQ ID NO: 449601 - DNA, 20 bp, Homo sapiens
cccgccttcaggttcctcct

SEQ ID NO: 449602 - DNA, 22 bp, Homo sapiens
cccgccttcaggttcctcctag

SEQ ID NO: 449603 - DNA, 16 bp, Homo sapiens
cccgcgcgtgccccca

SEQ ID NO: 449604 - DNA, 18 bp, Homo sapiens
cccgctcaacctctcaga

SEQ ID NO: 449605 - DNA, 23 bp, Homo sapiens
cccgctcacgctgacagcctcct

SEQ ID NO: 449606 - DNA, 13 bp, Homo sapiens
cccgctcagccct

SEQ ID NO: 449607 - DNA, 14 bp, Homo sapiens
cccgctcagccctc

SEQ ID NO: 449608 - DNA, 15 bp, Homo sapiens
cccggacgctggctc

SEQ ID NO: 449609 - DNA, 14 bp, Homo sapiens
cccggagctcaagg

SEQ ID NO: 449610 - DNA, 15 bp, Homo sapiens
cccggaggcgcccac

SEQ ID NO: 449611 - DNA, 20 bp, Homo sapiens
cccggaggcgcccacctgcc

SEQ ID NO: 449612 - DNA, 21 bp, Homo sapiens
cccggaggcgcccacctgccc

SEQ ID NO: 449613 - DNA, 17 bp, Homo sapiens
cccggccaaggacactg

SEQ ID NO: 449614 - DNA, 13 bp, Homo sapiens
cccggcccacgca

SEQ ID NO: 449615 - DNA, 19 bp, Homo sapiens
cccggcccacgcagagccc

SEQ ID NO: 449616 - DNA, 20 bp, Homo sapiens
cccggcctccaggctggggc

SEQ ID NO: 449617 - DNA, 17 bp, Homo sapiens
cccggctccccctgcca

SEQ ID NO: 449618 - DNA, 18 bp, Homo sapiens
cccggctccccctgccag

SEQ ID NO: 449619 - DNA, 20 bp, Homo sapiens
cccggctccccctgccagca

SEQ ID NO: 449620 - DNA, 17 bp, Homo sapiens
cccgggggtccccggac

SEQ ID NO: 449621 - DNA, 16 bp, Homo sapiens
cccgtccctttccctg

SEQ ID NO: 449622 - DNA, 14 bp, Homo sapiens
cccgtccgtccgcc

SEQ ID NO: 449623 - DNA, 14 bp, Homo sapiens
cccgtctgcccctt

SEQ ID NO: 449624 - DNA, 13 bp, Homo sapiens
ccctacagtatat

SEQ ID NO: 449625 - DNA, 19 bp, Homo sapiens
ccctacagtatataagctt

SEQ ID NO: 449626 - DNA, 14 bp, Homo sapiens
ccctaccctcttct

SEQ ID NO: 449627 - DNA, 21 bp, Homo sapiens
ccctaccgagtctcttctcca

SEQ ID NO: 449628 - DNA, 22 bp, Homo sapiens
ccctagaagaaaacccgaggga

SEQ ID NO: 449629 - DNA, 16 bp, Homo sapiens
ccctaggtctccaccc

SEQ ID NO: 449630 - DNA, 17 bp, Homo sapiens
ccctataccgagaccca

SEQ ID NO: 449631 - DNA, 17 bp, Homo sapiens
ccctatcctgcaccctc

SEQ ID NO: 449632 - DNA, 23 bp, Homo sapiens
ccctcaagccaggagaccctgtc

SEQ ID NO: 449633 - DNA, 16 bp, Homo sapiens
ccctcactccactccc

SEQ ID NO: 449634 - DNA, 23 bp, Homo sapiens
ccctcactctgtcagccagccgc

SEQ ID NO: 449635 - DNA, 13 bp, Homo sapiens
ccctcagagccac

SEQ ID NO: 449636 - DNA, 13 bp, Homo sapiens
ccctcatccacta

SEQ ID NO: 449637 - DNA, 19 bp, Homo sapiens
ccgagcgcgtgccttcccc

SEQ ID NO: 449638 - DNA, 16 bp, Homo sapiens
ccgaggcccccctctg

SEQ ID NO: 449639 - DNA, 17 bp, Homo sapiens
ccgaggcccccctctgc

SEQ ID NO: 449640 - DNA, 23 bp, Homo sapiens
ccgaggcccccctctgcctttga

SEQ ID NO: 449641 - DNA, 18 bp, Homo sapiens
ccgagtctcttctccact

SEQ ID NO: 449642 - DNA, 18 bp, Homo sapiens
ccgcagcaccagcctgag

SEQ ID NO: 449643 - DNA, 17 bp, Homo sapiens
ccgcagccctctccacc

SEQ ID NO: 449644 - DNA, 23 bp, Homo sapiens
ccgcagggcgctccggcagaggc

SEQ ID NO: 449645 - DNA, 11 bp, Homo sapiens
ccgccacccca

SEQ ID NO: 449646 - DNA, 18 bp, Homo sapiens
ccgcccaacccccacctc

SEQ ID NO: 449647 - DNA, 12 bp, Homo sapiens
ccgcccaccccg

SEQ ID NO: 449648 - DNA, 10 bp, Homo sapiens
ccgccccaga

SEQ ID NO: 449649 - DNA, 15 bp, Homo sapiens
ccgccccagagactg

SEQ ID NO: 449650 - DNA, 17 bp, Homo sapiens
ccgcccccgccctcgct

SEQ ID NO: 449651 - DNA, 12 bp, Homo sapiens
ccgcccgccccc

SEQ ID NO: 449652 - DNA, 16 bp, Homo sapiens
ccgccctcctctgccc

SEQ ID NO: 449653 - DNA, 22 bp, Homo sapiens
ccgccggttggccggctggccg

SEQ ID NO: 449654 - DNA, 15 bp, Homo sapiens
ccgcctcctccagac

SEQ ID NO: 449655 - DNA, 16 bp, Homo sapiens
ccgcctcctccagact

SEQ ID NO: 449656 - DNA, 16 bp, Homo sapiens
ccgcctcgggccgcct

SEQ ID NO: 449657 - DNA, 22 bp, Homo sapiens
ccgccttcaggttcctcctagg

SEQ ID NO: 449658 - DNA, 15 bp, Homo sapiens
ccgcgcgtgccccca

SEQ ID NO: 449659 - DNA, 17 bp, Homo sapiens
ccgcgctctgcccctcc

SEQ ID NO: 449660 - DNA, 17 bp, Homo sapiens
ccgcgggaagccagccc

SEQ ID NO: 449661 - DNA, 13 bp, Homo sapiens
ccgctcagccctc

SEQ ID NO: 449662 - DNA, 19 bp, Homo sapiens
ccgctcagccctccctgcc

SEQ ID NO: 449663 - DNA, 21 bp, Homo sapiens
ccgctcagccctccctgcccc

SEQ ID NO: 449664 - DNA, 18 bp, Homo sapiens
ccgctctggatcctgcac

SEQ ID NO: 449665 - DNA, 15 bp, Homo sapiens
ccgctgcaccacggc

SEQ ID NO: 449666 - DNA, 19 bp, Homo sapiens
ccgctgcctggcgggcagc

SEQ ID NO: 449667 - DNA, 23 bp, Homo sapiens
ccgctgcctggcgggcagcccct

SEQ ID NO: 449668 - DNA, 15 bp, Homo sapiens
ccgctgtcgccccag

SEQ ID NO: 449669 - DNA, 17 bp, Homo sapiens
ccggaacagccaaagaa

SEQ ID NO: 449670 - DNA, 20 bp, Homo sapiens
ccggaacagccaaagaaact

SEQ ID NO: 449671 - DNA, 14 bp, Homo sapiens
ccggacgctggctc

SEQ ID NO: 449672 - DNA, 20 bp, Homo sapiens
ccggagcggctgaggacggg

SEQ ID NO: 449673 - DNA, 16 bp, Homo sapiens
ccggaggcgcccacct

SEQ ID NO: 449674 - DNA, 16 bp, Homo sapiens
ccggaggggcctggca

SEQ ID NO: 449675 - DNA, 19 bp, Homo sapiens
ccggccaaggacactgatg

SEQ ID NO: 449676 - DNA, 20 bp, Homo sapiens
ccggcccacgcagagccccg

SEQ ID NO: 449677 - DNA, 12 bp, Homo sapiens
ccggcctgcagc

SEQ ID NO: 449678 - DNA, 15 bp, Homo sapiens
ccggcctgcagccca

SEQ ID NO: 449679 - DNA, 16 bp, Homo sapiens
ccggcctgcagcccag

SEQ ID NO: 449680 - DNA, 15 bp, Homo sapiens
ccgggagcctccccc

SEQ ID NO: 449681 - DNA, 13 bp, Homo sapiens
ccggggctggccc

SEQ ID NO: 449682 - DNA, 16 bp, Homo sapiens
ccggggctggccctgc

SEQ ID NO: 449683 - DNA, 18 bp, Homo sapiens
ccggggctggccctgccc

SEQ ID NO: 449684 - DNA, 22 bp, Homo sapiens
ccggggctggccctgccctccc

SEQ ID NO: 449685 - DNA, 18 bp, Homo sapiens
ccggggtggggtgcctga

SEQ ID NO: 449686 - DNA, 21 bp, Homo sapiens
ccggggtggggtgcctgagcc

SEQ ID NO: 449687 - DNA, 22 bp, Homo sapiens
ccgggtgcgtgaccggcccgcc

SEQ ID NO: 449688 - DNA, 16 bp, Homo sapiens
ccgggtgtggcctcag

SEQ ID NO: 449689 - DNA, 20 bp, Homo sapiens
ccgggtgtggcctcagccct

SEQ ID NO: 449690 - DNA, 13 bp, Homo sapiens
ccggtccaccccg

SEQ ID NO: 449691 - DNA, 15 bp, Homo sapiens
ccgtccctttccctg

SEQ ID NO: 449692 - DNA, 15 bp, Homo sapiens
ccgtccgcccgccca

SEQ ID NO: 449693 - DNA, 18 bp, Homo sapiens
ccgtccgcccgcccaccc

SEQ ID NO: 449694 - DNA, 18 bp, Homo sapiens
catccaactggaaggctt

SEQ ID NO: 449695 - DNA, 23 bp, Homo sapiens
catccaactggaaggctttattc

SEQ ID NO: 449696 - DNA, 20 bp, Homo sapiens
catccaccccggctccccct

SEQ ID NO: 449697 - DNA, 17 bp, Homo sapiens
catccaccgccacccca

SEQ ID NO: 449698 - DNA, 15 bp, Homo sapiens
catccagtttgttct

SEQ ID NO: 449699 - DNA, 21 bp, Homo sapiens
catccagtttgttctccgggt

SEQ ID NO: 449700 - DNA, 16 bp, Homo sapiens
catccatagacacagt

SEQ ID NO: 449701 - DNA, 19 bp, Homo sapiens
catccatagacacagtatt

SEQ ID NO: 449702 - DNA, 24 bp, Homo sapiens
catccccaccctcccctctcctga

SEQ ID NO: 449703 - DNA, 12 bp, Homo sapiens
catccctgggcc

SEQ ID NO: 449704 - DNA, 18 bp, Homo sapiens
catccggaacagccaaag

SEQ ID NO: 449705 - DNA, 19 bp, Homo sapiens
catccggaacagccaaaga

SEQ ID NO: 449706 - DNA, 20 bp, Homo sapiens
catccggaacagccaaagaa

SEQ ID NO: 449707 - DNA, 21 bp, Homo sapiens
catccggaacagccaaagaaa

SEQ ID NO: 449708 - DNA, 20 bp, Homo sapiens
catcctgattattgaatgtt

SEQ ID NO: 449709 - DNA, 19 bp, Homo sapiens
catccttccatcctgagga

SEQ ID NO: 449710 - DNA, 15 bp, Homo sapiens
catccttcccgcagc

SEQ ID NO: 449711 - DNA, 17 bp, Homo sapiens
catccttcccgcagcac

SEQ ID NO: 449712 - DNA, 17 bp, Homo sapiens
catcggaggctgggccc

SEQ ID NO: 449713 - DNA, 23 bp, Homo sapiens
catcggaggctgggcccctggga

SEQ ID NO: 449714 - DNA, 13 bp, Homo sapiens
catctcagcccac

SEQ ID NO: 449715 - DNA, 13 bp, Homo sapiens
catctctctgggg

SEQ ID NO: 449716 - DNA, 14 bp, Homo sapiens
catctctctggggc

SEQ ID NO: 449717 - DNA, 20 bp, Homo sapiens
catctctctggggccctggg

SEQ ID NO: 449718 - DNA, 21 bp, Homo sapiens
catctctctggggccctgggc

SEQ ID NO: 449719 - DNA, 13 bp, Homo sapiens
catctgaggagtc

SEQ ID NO: 449720 - DNA, 21 bp, Homo sapiens
catgaagttgtaagaaaagct

SEQ ID NO: 449721 - DNA, 14 bp, Homo sapiens
catgcataacacac

SEQ ID NO: 449722 - DNA, 17 bp, Homo sapiens
catggatgattcttttc

SEQ ID NO: 449723 - DNA, 16 bp, Homo sapiens
catggatttcctttga

SEQ ID NO: 449724 - DNA, 14 bp, Homo sapiens
catggccaggtggc

SEQ ID NO: 449725 - DNA, 15 bp, Homo sapiens
catggccaggtggcc

SEQ ID NO: 449726 - DNA, 18 bp, Homo sapiens
catggccccagctggctg

SEQ ID NO: 449727 - DNA, 12 bp, Homo sapiens
catgggaagaac

SEQ ID NO: 449728 - DNA, 13 bp, Homo sapiens
catgggagaacct

SEQ ID NO: 449729 - DNA, 21 bp, Homo sapiens
catggtttttgctctacttta

SEQ ID NO: 449730 - DNA, 22 bp, Homo sapiens
catggtttttgctctactttat

SEQ ID NO: 449731 - DNA, 16 bp, Homo sapiens
catgtagcatataaat

SEQ ID NO: 449732 - DNA, 23 bp, Homo sapiens
catgtccctaccgagtctcttct

SEQ ID NO: 449733 - DNA, 12 bp, Homo sapiens
catgtctactgc

SEQ ID NO: 449734 - DNA, 20 bp, Homo sapiens
catgtgattggcagcttcaa

SEQ ID NO: 449735 - DNA, 22 bp, Homo sapiens
catgtgcctgcaccaggagaca

SEQ ID NO: 449736 - DNA, 11 bp, Homo sapiens
catgtgctgca

SEQ ID NO: 449737 - DNA, 20 bp, Homo sapiens
catgtgtcccctcactctgt

SEQ ID NO: 449738 - DNA, 17 bp, Homo sapiens
catgtgttgcaaattat

SEQ ID NO: 449739 - DNA, 17 bp, Homo sapiens
catgtttaagaaatgag

SEQ ID NO: 449740 - DNA, 19 bp, Homo sapiens
catgttttttaggaatcag

SEQ ID NO: 449741 - DNA, 17 bp, Homo sapiens
cattaaacactgtaatc

SEQ ID NO: 449742 - DNA, 21 bp, Homo sapiens
cattaaacactgtaatcttaa

SEQ ID NO: 449743 - DNA, 17 bp, Homo sapiens
cattaagaacaaggaat

SEQ ID NO: 449744 - DNA, 18 bp, Homo sapiens
cattactattaactctgc

SEQ ID NO: 449745 - DNA, 22 bp, Homo sapiens
cattagactgaatttaactact

SEQ ID NO: 449746 - DNA, 13 bp, Homo sapiens
cattcaaaatagt

SEQ ID NO: 449747 - DNA, 15 bp, Homo sapiens
cattcatactcaaag

SEQ ID NO: 449748 - DNA, 17 bp, Homo sapiens
attctcattttgctttt

SEQ ID NO: 449749 - DNA, 14 bp, Homo sapiens
attctcctctccca

SEQ ID NO: 449750 - DNA, 12 bp, Homo sapiens
attctcttctca

SEQ ID NO: 449751 - DNA, 20 bp, Homo sapiens
attctgctaatttatgaaga

SEQ ID NO: 449752 - DNA, 19 bp, Homo sapiens
attctgtggattctatatt

SEQ ID NO: 449753 - DNA, 17 bp, Homo sapiens
attcttaccctttcttt

SEQ ID NO: 449754 - DNA, 17 bp, Homo sapiens
attcttgcactgtatcc

SEQ ID NO: 449755 - DNA, 18 bp, Homo sapiens
attcttttcagcttgttt

SEQ ID NO: 449756 - DNA, 20 bp, Homo sapiens
attcttttcagcttgtttct

SEQ ID NO: 449757 - DNA, 23 bp, Homo sapiens
attcttttcagcttgtttctata

SEQ ID NO: 449758 - DNA, 15 bp, Homo sapiens
attcttttttcaatg

SEQ ID NO: 449759 - DNA, 19 bp, Homo sapiens
attcttttttcaatgtact

SEQ ID NO: 449760 - DNA, 16 bp, Homo sapiens
attgaaccgtcaatgt

SEQ ID NO: 449761 - DNA, 17 bp, Homo sapiens
attgcatttcctgacag

SEQ ID NO: 449762 - DNA, 22 bp, Homo sapiens
attgctcctgcatgcaactaat

SEQ ID NO: 449763 - DNA, 17 bp, Homo sapiens
attggcagcttcaaaac

SEQ ID NO: 449764 - DNA, 20 bp, Homo sapiens
attggcagcttcaaaacaga

SEQ ID NO: 449765 - DNA, 12 bp, Homo sapiens
attggcttgttt

SEQ ID NO: 449766 - DNA, 16 bp, Homo sapiens
attggttacaaatttt

SEQ ID NO: 449767 - DNA, 19 bp, Homo sapiens
attgtaagttgttggttta

SEQ ID NO: 449768 - DNA, 16 bp, Homo sapiens
attgtagcatttcttg

SEQ ID NO: 449769 - DNA, 18 bp, Homo sapiens
attgtagcatttcttgat

SEQ ID NO: 449770 - DNA, 16 bp, Homo sapiens
attgtttttatatatt

SEQ ID NO: 449771 - DNA, 17 bp, Homo sapiens
attgtttttatatatta

SEQ ID NO: 449772 - DNA, 14 bp, Homo sapiens
atttaaaatggact

SEQ ID NO: 449773 - DNA, 17 bp, Homo sapiens
atttaactgcatataga

SEQ ID NO: 449774 - DNA, 15 bp, Homo sapiens
atttaagccccctct

SEQ ID NO: 449775 - DNA, 14 bp, Homo sapiens
atttaatatactgc

SEQ ID NO: 449776 - DNA, 15 bp, Homo sapiens
atttaatttcataaa

SEQ ID NO: 449777 - DNA, 20 bp, Homo sapiens
atttaatttcataaattggc

SEQ ID NO: 449778 - DNA, 21 bp, Homo sapiens
atttacaacttccagatttga

SEQ ID NO: 449779 - DNA, 14 bp, Homo sapiens
atttatctactatt

SEQ ID NO: 449780 - DNA, 14 bp, Homo sapiens
atttatctgtctga

SEQ ID NO: 449781 - DNA, 14 bp, Homo sapiens
atttatcttatcta

SEQ ID NO: 449782 - DNA, 14 bp, Homo sapiens
atttattaaacttc

SEQ ID NO: 449783 - DNA, 15 bp, Homo sapiens
atttattaaacttca

SEQ ID NO: 449784 - DNA, 19 bp, Homo sapiens
atttattaaacttcagcaa

SEQ ID NO: 449785 - DNA, 15 bp, Homo sapiens
atttattattttcat

SEQ ID NO: 449786 - DNA, 16 bp, Homo sapiens
atttcaaaatgcatgt

SEQ ID NO: 449787 - DNA, 18 bp, Homo sapiens
atttcaaaatgcatgtga

SEQ ID NO: 449788 - DNA, 19 bp, Homo sapiens
atttcaaaatgcatgtgat

SEQ ID NO: 449789 - DNA, 15 bp, Homo sapiens
atttcataaattggc

SEQ ID NO: 449790 - DNA, 20 bp, Homo sapiens
atttcataaattggctcctt

SEQ ID NO: 449791 - DNA, 22 bp, Homo sapiens
atttcataaattggctcctttc

SEQ ID NO: 449792 - DNA, 15 bp, Homo sapiens
atttcatattgagat

SEQ ID NO: 449793 - DNA, 23 bp, Homo sapiens
atttccaacaaacttactgtcag

SEQ ID NO: 449794 - DNA, 18 bp, Homo sapiens
atttctaagcttatttct

SEQ ID NO: 449795 - DNA, 23 bp, Homo sapiens
atttctagcaaacagatgtttgt

SEQ ID NO: 449796 - DNA, 15 bp, Homo sapiens
atttctttgattgtg

SEQ ID NO: 449797 - DNA, 15 bp, Homo sapiens
atttgaaaaaagaag

SEQ ID NO: 449798 - DNA, 16 bp, Homo sapiens
atttgaaaaaagaaga

SEQ ID NO: 449799 - DNA, 14 bp, Homo sapiens
atttgagagaagcc

SEQ ID NO: 449800 - DNA, 15 bp, Homo sapiens
atttgagagaagcca

SEQ ID NO: 449801 - DNA, 18 bp, Homo sapiens
atttgagctgcctggagg

SEQ ID NO: 449802 - DNA, 17 bp, Homo sapiens
atttgatatacagacct

SEQ ID NO: 449803 - DNA, 19 bp, Homo sapiens
atttgatttgatatacaga

SEQ ID NO: 449804 - DNA, 13 bp, Homo sapiens
atttgcaaatgca

SEQ ID NO: 449805 - DNA, 18 bp, Homo sapiens
atttgccaaaaactaaaa

SEQ ID NO: 449806 - DNA, 15 bp, Homo sapiens
atttgccgatttcct

SEQ ID NO: 449807 - DNA, 17 bp, Homo sapiens
atttgccgatttcctaa

SEQ ID NO: 449808 - DNA, 22 bp, Homo sapiens
atttgccgatttcctaagctgt

SEQ ID NO: 449809 - DNA, 13 bp, Homo sapiens
atttggattcaca

SEQ ID NO: 449810 - DNA, 22 bp, Homo sapiens
attttaaaaaataacatattct

SEQ ID NO: 449811 - DNA, 14 bp, Homo sapiens
attttaaaatgcaa

SEQ ID NO: 449812 - DNA, 15 bp, Homo sapiens
attttaatgtaaaat

SEQ ID NO: 449813 - DNA, 19 bp, Homo sapiens
attttaatgtaaaattcat

SEQ ID NO: 449814 - DNA, 18 bp, Homo sapiens
attttcaacgcagccctg

SEQ ID NO: 449815 - DNA, 16 bp, Homo sapiens
attttcactttttctg

SEQ ID NO: 449816 - DNA, 14 bp, Homo sapiens
attttcataataaa

SEQ ID NO: 449817 - DNA, 19 bp, Homo sapiens
attttctgaattcataaaa

SEQ ID NO: 449818 - DNA, 19 bp, Homo sapiens
attttcttttatatctgta

SEQ ID NO: 449819 - DNA, 15 bp, Homo sapiens
attttgtctggctgt

SEQ ID NO: 449820 - DNA, 21 bp, Homo sapiens
atttttactcaggctttctat

SEQ ID NO: 449821 - DNA, 21 bp, Homo sapiens
atttttctcacctagctgctc

SEQ ID NO: 449822 - DNA, 14 bp, Homo sapiens
attttttcctacca

SEQ ID NO: 449823 - DNA, 20 bp, Homo sapiens
caaaaaatgtgagctataat

SEQ ID NO: 449824 - DNA, 11 bp, Homo sapiens
caaaacagaac

SEQ ID NO: 449825 - DNA, 19 bp, Homo sapiens
caaaactatcggttcaagt

SEQ ID NO: 449826 - DNA, 20 bp, Homo sapiens
caaaactatcggttcaagtt

SEQ ID NO: 449827 - DNA, 15 bp, Homo sapiens
caaaatagttctatt

SEQ ID NO: 449828 - DNA, 20 bp, Homo sapiens
caaaatagttctatttctat

SEQ ID NO: 449829 - DNA, 24 bp, Homo sapiens
caaaatagttctatttctatctgc

SEQ ID NO: 449830 - DNA, 13 bp, Homo sapiens
caaaatatttcta

SEQ ID NO: 449831 - DNA, 22 bp, Homo sapiens
caaaatatttctaagcttattt

SEQ ID NO: 449832 - DNA, 12 bp, Homo sapiens
caaaatgcatgt

SEQ ID NO: 449833 - DNA, 15 bp, Homo sapiens
caaaatgcatgtgat

SEQ ID NO: 449834 - DNA, 19 bp, Homo sapiens
caaacactgcttaaggaaa

SEQ ID NO: 449835 - DNA, 10 bp, Homo sapiens
caaacattta

SEQ ID NO: 449836 - DNA, 22 bp, Homo sapiens
cacacgccggggctggccctgc

SEQ ID NO: 449837 - DNA, 13 bp, Homo sapiens
cacactctgcctt

SEQ ID NO: 449838 - DNA, 18 bp, Homo sapiens
cacacttcaggctcttct

SEQ ID NO: 449839 - DNA, 20 bp, Homo sapiens
cacacttcaggctcttctcc

SEQ ID NO: 449840 - DNA, 15 bp, Homo sapiens
cacagcagcccccca

SEQ ID NO: 449841 - DNA, 19 bp, Homo sapiens
cacagcagtacttgctcaa

SEQ ID NO: 449842 - DNA, 23 bp, Homo sapiens
cacagcctttgcgctctgggttt

SEQ ID NO: 449843 - DNA, 17 bp, Homo sapiens
cacaggacacgaaggct

SEQ ID NO: 449844 - DNA, 15 bp, Homo sapiens
cacaggcccttcctc

SEQ ID NO: 449845 - DNA, 14 bp, Homo sapiens
cacagtgcatctca

SEQ ID NO: 449846 - DNA, 14 bp, Homo sapiens
cacagtggggccca

SEQ ID NO: 449847 - DNA, 17 bp, Homo sapiens
cacagtggggcccatgg

SEQ ID NO: 449848 - DNA, 20 bp, Homo sapiens
cacagtggggcccatggccc

SEQ ID NO: 449849 - DNA, 14 bp, Homo sapiens
cacagtttgcaatc

SEQ ID NO: 449850 - DNA, 22 bp, Homo sapiens
cacagtttgcaatcttatgttg

SEQ ID NO: 449851 - DNA, 13 bp, Homo sapiens
cacataaatctgt

SEQ ID NO: 449852 - DNA, 15 bp, Homo sapiens
cacataaatctgtct

SEQ ID NO: 449853 - DNA, 20 bp, Homo sapiens
cacataaatctgtctgattc

SEQ ID NO: 449854 - DNA, 20 bp, Homo sapiens
cacatccccaccctcccctc

SEQ ID NO: 449855 - DNA, 23 bp, Homo sapiens
cacatccccaccctcccctctcc

SEQ ID NO: 449856 - DNA, 15 bp, Homo sapiens
caccaagggtatctg

SEQ ID NO: 449857 - DNA, 23 bp, Homo sapiens
caccacaactaacaatgccttgt

SEQ ID NO: 449858 - DNA, 15 bp, Homo sapiens
caccacacacaccct

SEQ ID NO: 449859 - DNA, 20 bp, Homo sapiens
caccacacacacccttcccc

SEQ ID NO: 449860 - DNA, 16 bp, Homo sapiens
caccacggcgtttttt

SEQ ID NO: 449861 - DNA, 13 bp, Homo sapiens
caccagcctgagc

SEQ ID NO: 449862 - DNA, 14 bp, Homo sapiens
caccagcctgagcc

SEQ ID NO: 449863 - DNA, 22 bp, Homo sapiens
caccagcctgagccacagtggg

SEQ ID NO: 449864 - DNA, 14 bp, Homo sapiens
caccagctatctgt

SEQ ID NO: 449865 - DNA, 23 bp, Homo sapiens
caccatccttccatcctgaggac

SEQ ID NO: 449866 - DNA, 21 bp, Homo sapiens
caccatctggagtcttcctgt

SEQ ID NO: 449867 - DNA, 13 bp, Homo sapiens
cacccaccaccgc

SEQ ID NO: 449868 - DNA, 14 bp, Homo sapiens
cacccaccctctgg

SEQ ID NO: 449869 - DNA, 15 bp, Homo sapiens
cacccaccctctggt

SEQ ID NO: 449870 - DNA, 16 bp, Homo sapiens
cacccactagccctct

SEQ ID NO: 449871 - DNA, 22 bp, Homo sapiens
cacccactagccctctttctct

SEQ ID NO: 449872 - DNA, 14 bp, Homo sapiens
cacccagaccctcc

SEQ ID NO: 449873 - DNA, 15 bp, Homo sapiens
cacccagaccctcct

SEQ ID NO: 449874 - DNA, 17 bp, Homo sapiens
cacccagaggtctccct

SEQ ID NO: 449875 - DNA, 19 bp, Homo sapiens
caccccactgagagctgct

SEQ ID NO: 449876 - DNA, 18 bp, Homo sapiens
caccccataagccctgag

SEQ ID NO: 449877 - DNA, 21 bp, Homo sapiens
caccccataagccctgagact

SEQ ID NO: 449878 - DNA, 11 bp, Homo sapiens
cacccccagcc

SEQ ID NO: 449879 - DNA, 12 bp, Homo sapiens
cacccccagcct

SEQ ID NO: 449880 - DNA, 20 bp, Homo sapiens
cacccccagcctcccccagg

SEQ ID NO: 449881 - DNA, 23 bp, Homo sapiens
caccccgctcacgctgacagcct

SEQ ID NO: 449882 - DNA, 16 bp, Homo sapiens
caccccgctgcctggc

SEQ ID NO: 449883 - DNA, 21 bp, Homo sapiens
caccccggctccccctgccag

SEQ ID NO: 449884 - DNA, 18 bp, Homo sapiens
caccccgtcccggccccg

SEQ ID NO: 449885 - DNA, 16 bp, Homo sapiens
caccccgtctgcccct

SEQ ID NO: 449886 - DNA, 18 bp, Homo sapiens
cacccctcaagccaggag

SEQ ID NO: 449887 - DNA, 16 bp, Homo sapiens
cacccctcttccccct

SEQ ID NO: 449888 - DNA, 19 bp, Homo sapiens
cacccctcttcccccttcc

SEQ ID NO: 449889 - DNA, 20 bp, Homo sapiens
cacccctcttcccccttccc

SEQ ID NO: 449890 - DNA, 17 bp, Homo sapiens
caccccttgcccaacca

SEQ ID NO: 449891 - DNA, 14 bp, Homo sapiens
cacccgccccagag

SEQ ID NO: 449892 - DNA, 15 bp, Homo sapiens
cacccgccccagaga

SEQ ID NO: 449893 - DNA, 19 bp, Homo sapiens
cacccgccccagagactgc

SEQ ID NO: 449894 - DNA, 21 bp, Homo sapiens
cacccgccccagagactgccc

SEQ ID NO: 449895 - DNA, 23 bp, Homo sapiens
cacccgccccagagactgcccac

SEQ ID NO: 449896 - DNA, 14 bp, Homo sapiens
cacccgcccgcccc

SEQ ID NO: 449897 - DNA, 18 bp, Homo sapiens
cacccgcccgcccccgcc

SEQ ID NO: 449898 - DNA, 19 bp, Homo sapiens
caccctccactctgaggtc

SEQ ID NO: 449899 - DNA, 22 bp, Homo sapiens
caccctccactctgaggtctca

SEQ ID NO: 449900 - DNA, 14 bp, Homo sapiens
caccctcccctctc

SEQ ID NO: 449901 - DNA, 23 bp, Homo sapiens
caccctctgctatgtctgtgatg

SEQ ID NO: 449902 - DNA, 16 bp, Homo sapiens
caccctctggtccttc

SEQ ID NO: 449903 - DNA, 15 bp, Homo sapiens
caccctgggcctccc

SEQ ID NO: 449904 - DNA, 12 bp, Homo sapiens
cacccttcccca

SEQ ID NO: 449905 - DNA, 13 bp, Homo sapiens
cacccttccccac

SEQ ID NO: 449906 - DNA, 15 bp, Homo sapiens
caccgccaccccact

SEQ ID NO: 449907 - DNA, 22 bp, Homo sapiens
caccgcccaacccccacctccc

SEQ ID NO: 449908 - DNA, 16 bp, Homo sapiens
caccgcccacccacac

SEQ ID NO: 449909 - DNA, 15 bp, Homo sapiens
caccgggagcctccc

SEQ ID NO: 449910 - DNA, 21 bp, Homo sapiens
caccgggagcctccccctcag

SEQ ID NO: 449911 - DNA, 17 bp, Homo sapiens
caccgtggtgtgaggcc

SEQ ID NO: 449912 - DNA, 23 bp, Homo sapiens
caccgtggtgtgaggcccccgga

SEQ ID NO: 449913 - DNA, 14 bp, Homo sapiens
cacctccacccgtc

SEQ ID NO: 449914 - DNA, 18 bp, Homo sapiens
cacctcttatgcacacct

SEQ ID NO: 449915 - DNA, 16 bp, Homo sapiens
cacctgtgctgctgca

SEQ ID NO: 449916 - DNA, 21 bp, Homo sapiens
cacctgtgctgctgcaccaac

SEQ ID NO: 449917 - DNA, 20 bp, Homo sapiens
caccttgggcacgggagagc

SEQ ID NO: 449918 - DNA, 22 bp, Homo sapiens
caccttgtacagaaccagcact

SEQ ID NO: 449919 - DNA, 11 bp, Homo sapiens
cacgcagagcc

SEQ ID NO: 449920 - DNA, 12 bp, Homo sapiens
cacgcagagccc

SEQ ID NO: 449921 - DNA, 15 bp, Homo sapiens
cacgcagagccccgg

SEQ ID NO: 449922 - DNA, 18 bp, Homo sapiens
cacgcagagccccggagc

SEQ ID NO: 449923 - DNA, 16 bp, Homo sapiens
cacgccggggctggcc

SEQ ID NO: 449924 - DNA, 20 bp, Homo sapiens
cacgccggggctggccctgc

SEQ ID NO: 449925 - DNA, 21 bp, Homo sapiens
cacgccggggctggccctgcc

SEQ ID NO: 449926 - DNA, 14 bp, Homo sapiens
cacgcctcctggcc

SEQ ID NO: 449927 - DNA, 16 bp, Homo sapiens
cacgcctcctggccag

SEQ ID NO: 449928 - DNA, 12 bp, Homo sapiens
cacgctcctgcc

SEQ ID NO: 449929 - DNA, 14 bp, Homo sapiens
cacgctgacagcct

SEQ ID NO: 449930 - DNA, 21 bp, Homo sapiens
cacgctgacagcctcctaggc

SEQ ID NO: 449931 - DNA, 18 bp, Homo sapiens
cacgctgtcctctcgagc

SEQ ID NO: 449932 - DNA, 13 bp, Homo sapiens
cacggccgtccct

SEQ ID NO: 449933 - DNA, 16 bp, Homo sapiens
cacggccgtccctgac

SEQ ID NO: 449934 - DNA, 22 bp, Homo sapiens
cacgggagagcgccacccgccc

SEQ ID NO: 449935 - DNA, 20 bp, Homo sapiens
cacgggcccgctcaacctct

SEQ ID NO: 449936 - DNA, 21 bp, Homo sapiens
cacgtctgtgagtctgtcctt

SEQ ID NO: 449937 - DNA, 23 bp, Homo sapiens
cactaaggccgtgtctctgagga

SEQ ID NO: 449938 - DNA, 18 bp, Homo sapiens
cactaatggccaagtgta

SEQ ID NO: 449939 - DNA, 15 bp, Homo sapiens
cactagccctctttc

SEQ ID NO: 449940 - DNA, 16 bp, Homo sapiens
cactagccctctttct

SEQ ID NO: 449941 - DNA, 22 bp, Homo sapiens
cactagccctctttctctctgt

SEQ ID NO: 449942 - DNA, 20 bp, Homo sapiens
cactagtagctgttttgaat

SEQ ID NO: 449943 - DNA, 14 bp, Homo sapiens
cactccactcccct

SEQ ID NO: 449944 - DNA, 14 bp, Homo sapiens
cactccagacccct

SEQ ID NO: 449945 - DNA, 18 bp, Homo sapiens
cactcccagggcccgagc

SEQ ID NO: 449946 - DNA, 18 bp, Homo sapiens
cactccctttgtggactt

SEQ ID NO: 449947 - DNA, 21 bp, Homo sapiens
cactccctttgtggactttat

SEQ ID NO: 449948 - DNA, 23 bp, Homo sapiens
cactccctttgtggactttattt

SEQ ID NO: 449949 - DNA, 19 bp, Homo sapiens
cactctgaagtcccttcct

SEQ ID NO: 449950 - DNA, 13 bp, Homo sapiens
cactctgaggtct

SEQ ID NO: 449951 - DNA, 14 bp, Homo sapiens
cactctgaggtctc

SEQ ID NO: 449952 - DNA, 15 bp, Homo sapiens
cactctgaggtctca

SEQ ID NO: 449953 - DNA, 18 bp, Homo sapiens
cactctgccttcctgagt

SEQ ID NO: 449954 - DNA, 17 bp, Homo sapiens
cactgagagctgctcct

SEQ ID NO: 449955 - DNA, 18 bp, Homo sapiens
cactgatatcacgggccc

SEQ ID NO: 449956 - DNA, 19 bp, Homo sapiens
cactgatgggtcctgctgc

SEQ ID NO: 449957 - DNA, 20 bp, Homo sapiens
cactgatgggtcctgctgct

SEQ ID NO: 449958 - DNA, 22 bp, Homo sapiens
cactgatgggtcctgctgctcg

SEQ ID NO: 449959 - DNA, 21 bp, Homo sapiens
cactgccattagactgaattt

SEQ ID NO: 449960 - DNA, 20 bp, Homo sapiens
cactgccttcgatacaccgg

SEQ ID NO: 449961 - DNA, 22 bp, Homo sapiens
cactgccttcgatacaccgggc

SEQ ID NO: 449962 - DNA, 22 bp, Homo sapiens
cactggtggcccgacagcctgg

SEQ ID NO: 449963 - DNA, 22 bp, Homo sapiens
cactgtatctaaaaaataactg

SEQ ID NO: 449964 - DNA, 14 bp, Homo sapiens
cacttaaactttgt

SEQ ID NO: 449965 - DNA, 16 bp, Homo sapiens
cacttatgctgctgtg

SEQ ID NO: 449966 - DNA, 17 bp, Homo sapiens
cacttatgctgctgtga

SEQ ID NO: 449967 - DNA, 22 bp, Homo sapiens
cacttattatgaggctattaaa

SEQ ID NO: 449968 - DNA, 15 bp, Homo sapiens
cacttcaggctcttc

SEQ ID NO: 449969 - DNA, 20 bp, Homo sapiens
cacttgctagtgatacactg

SEQ ID NO: 449970 - DNA, 12 bp, Homo sapiens
cactttcctctc

SEQ ID NO: 449971 - DNA, 18 bp, Homo sapiens
cactttgagcctgggaaa

SEQ ID NO: 449972 - DNA, 14 bp, Homo sapiens
cacttttttataaa

SEQ ID NO: 449973 - DNA, 13 bp, Homo sapiens
cagaaaaaaggac

SEQ ID NO: 449974 - DNA, 16 bp, Homo sapiens
cagaaagggcagcccc

SEQ ID NO: 449975 - DNA, 18 bp, Homo sapiens
cagaaagggcagcccctc

SEQ ID NO: 449976 - DNA, 22 bp, Homo sapiens
cagaaagggcagcccctcccca

SEQ ID NO: 449977 - DNA, 19 bp, Homo sapiens
cagaacaaaagataaaact

SEQ ID NO: 449978 - DNA, 17 bp, Homo sapiens
cagaaccagcactccca

SEQ ID NO: 449979 - DNA, 23 bp, Homo sapiens
cagaaccagcactcccagggccc

SEQ ID NO: 449980 - DNA, 14 bp, Homo sapiens
cagaacgggcctcc

SEQ ID NO: 449981 - DNA, 17 bp, Homo sapiens
cagaacgggcctccccg

SEQ ID NO: 449982 - DNA, 18 bp, Homo sapiens
cagaacgggttctcccat

SEQ ID NO: 449983 - DNA, 15 bp, Homo sapiens
cagaactcagcctta

SEQ ID NO: 449984 - DNA, 16 bp, Homo sapiens
cagaactcctttctaa

SEQ ID NO: 449985 - DNA, 20 bp, Homo sapiens
cagaagagtcccggagctca

SEQ ID NO: 449986 - DNA, 23 bp, Homo sapiens
cagaatacagtaagctgctctat

SEQ ID NO: 449987 - DNA, 22 bp, Homo sapiens
cagaattgaaccgtcaatgtga

SEQ ID NO: 449988 - DNA, 21 bp, Homo sapiens
cagacaccctccactctgagg

SEQ ID NO: 449989 - DNA, 17 bp, Homo sapiens
cagacagagatcagaat

SEQ ID NO: 449990 - DNA, 21 bp, Homo sapiens
cagaccagcatagttctgcaa

SEQ ID NO: 449991 - DNA, 16 bp, Homo sapiens
cagacccctggctttt

SEQ ID NO: 449992 - DNA, 19 bp, Homo sapiens
cagaccctccttccccacc

SEQ ID NO: 449993 - DNA, 22 bp, Homo sapiens
cagaccctccttccccacccca

SEQ ID NO: 449994 - DNA, 23 bp, Homo sapiens
cagaccctccttccccaccccat

SEQ ID NO: 449995 - DNA, 17 bp, Homo sapiens
cagaccgatccttccca

SEQ ID NO: 449996 - DNA, 14 bp, Homo sapiens
cagagactgcccac

SEQ ID NO: 449997 - DNA, 15 bp, Homo sapiens
cagagactgcccacc

SEQ ID NO: 449998 - DNA, 16 bp, Homo sapiens
cagagactgcccaccc

SEQ ID NO: 449999 - DNA, 17 bp, Homo sapiens
cagagactgcccaccct

SEQ ID NO: 450000 - DNA, 18 bp, Homo sapiens
cagagactgcccaccctg

SEQ ID NO: 450001 - DNA, 24 bp, Homo sapiens
cagagactgcccaccctgggcctc

SEQ ID NO: 450002 - DNA, 19 bp, Homo sapiens
cagagagaagcaccccacc

SEQ ID NO: 450003 - DNA, 18 bp, Homo sapiens
cagagagtggctcctccc

SEQ ID NO: 450004 - DNA, 15 bp, Homo sapiens
cagagatgtattatg

SEQ ID NO: 450005 - DNA, 18 bp, Homo sapiens
cagagctgagtcggctgg

SEQ ID NO: 450006 - DNA, 13 bp, Homo sapiens
atctaaaaaataa

SEQ ID NO: 450007 - DNA, 15 bp, Homo sapiens
atctaaaaaataact

SEQ ID NO: 450008 - DNA, 16 bp, Homo sapiens
atctaaaaaataactg

SEQ ID NO: 450009 - DNA, 15 bp, Homo sapiens
atctactacagagtg

SEQ ID NO: 450010 - DNA, 22 bp, Homo sapiens
atctactatttgaaaaaagaag

SEQ ID NO: 450011 - DNA, 16 bp, Homo sapiens
agccaaggaagttggt

SEQ ID NO: 450012 - DNA, 16 bp, Homo sapiens
agccaatttcaaagaa

SEQ ID NO: 450013 - DNA, 14 bp, Homo sapiens
agccacgctgtcct

SEQ ID NO: 450014 - DNA, 15 bp, Homo sapiens
agccacgctgtcctc

SEQ ID NO: 450015 - DNA, 18 bp, Homo sapiens
agccacgttgcagaaaaa

SEQ ID NO: 450016 - DNA, 21 bp, Homo sapiens
agccagccgccctgggctgtc

SEQ ID NO: 450017 - DNA, 11 bp, Homo sapiens
agccaggagac

SEQ ID NO: 450018 - DNA, 15 bp, Homo sapiens
cagcctcccccaggc

SEQ ID NO: 450019 - DNA, 22 bp, Homo sapiens
cagcctcccccaggctgcgcct

SEQ ID NO: 450020 - DNA, 12 bp, Homo sapiens
cagcctcctagg

SEQ ID NO: 450021 - DNA, 13 bp, Homo sapiens
cagcctcctaggc

SEQ ID NO: 450022 - DNA, 18 bp, Homo sapiens
cagcctcctaggctccct

SEQ ID NO: 450023 - DNA, 15 bp, Homo sapiens
cagcctgagccacag

SEQ ID NO: 450024 - DNA, 17 bp, Homo sapiens
cagcctgagctccaccc

SEQ ID NO: 450025 - DNA, 18 bp, Homo sapiens
cagcctgagctccaccct

SEQ ID NO: 450026 - DNA, 20 bp, Homo sapiens
cagcctggtgttgttcttcc

SEQ ID NO: 450027 - DNA, 12 bp, Homo sapiens
cagcgcctcccg

SEQ ID NO: 450028 - DNA, 17 bp, Homo sapiens
cagcgcctcccgccgcc

SEQ ID NO: 450029 - DNA, 18 bp, Homo sapiens
cagcggcccggcccacgc

SEQ ID NO: 450030 - DNA, 15 bp, Homo sapiens
cagctaacaagtagc

SEQ ID NO: 450031 - DNA, 18 bp, Homo sapiens
cagctaggttaataggag

SEQ ID NO: 450032 - DNA, 22 bp, Homo sapiens
cagctatctgtcatctctctgg

SEQ ID NO: 450033 - DNA, 14 bp, Homo sapiens
cagctccactctga

SEQ ID NO: 450034 - DNA, 20 bp, Homo sapiens
cagctgagcattctcatttt

SEQ ID NO: 450035 - DNA, 16 bp, Homo sapiens
cagctggcagcgcctc

SEQ ID NO: 450036 - DNA, 18 bp, Homo sapiens
cagctggcagcgcctccc

SEQ ID NO: 450037 - DNA, 14 bp, Homo sapiens
cagctggctgggtc

SEQ ID NO: 450038 - DNA, 23 bp, Homo sapiens
cagctggctgggtcgcccctcct

SEQ ID NO: 450039 - DNA, 12 bp, Homo sapiens
cagcttcaaaac

SEQ ID NO: 450040 - DNA, 15 bp, Homo sapiens
cagcttcaaaacaga

SEQ ID NO: 450041 - DNA, 16 bp, Homo sapiens
cagcttcaaaacagaa

SEQ ID NO: 450042 - DNA, 17 bp, Homo sapiens
cagcttgaaaactggat

SEQ ID NO: 450043 - DNA, 22 bp, Homo sapiens
cagctttgggatctatatacat

SEQ ID NO: 450044 - DNA, 15 bp, Homo sapiens
caggaaagccctccc

SEQ ID NO: 450045 - DNA, 19 bp, Homo sapiens
caggaaagccctccccctt

SEQ ID NO: 450046 - DNA, 17 bp, Homo sapiens
caggaagagatgctcta

SEQ ID NO: 450047 - DNA, 20 bp, Homo sapiens
caggaatgggccaagccagg

SEQ ID NO: 450048 - DNA, 15 bp, Homo sapiens
caggactaacaactg

SEQ ID NO: 450049 - DNA, 13 bp, Homo sapiens
caggagctgctgt

SEQ ID NO: 450050 - DNA, 13 bp, Homo sapiens
caggaggacctgg

SEQ ID NO: 450051 - DNA, 23 bp, Homo sapiens
caggatgggaagaaaaaggaaac

SEQ ID NO: 450052 - DNA, 14 bp, Homo sapiens
caggccaactgccc

SEQ ID NO: 450053 - DNA, 14 bp, Homo sapiens
caggccagcgtgga

SEQ ID NO: 450054 - DNA, 15 bp, Homo sapiens
caggcgccccttccc

SEQ ID NO: 450055 - DNA, 17 bp, Homo sapiens
caggcgccccttccccc

SEQ ID NO: 450056 - DNA, 13 bp, Homo sapiens
caggcgcgcaccg

SEQ ID NO: 450057 - DNA, 21 bp, Homo sapiens
caggcgcgcaccgcccaaccc

SEQ ID NO: 450058 - DNA, 23 bp, Homo sapiens
caggcgcgcaccgcccaaccccc

SEQ ID NO: 450059 - DNA, 19 bp, Homo sapiens
caggcggaggggcttggag

SEQ ID NO: 450060 - DNA, 21 bp, Homo sapiens
caggcggaggggcttggagca

SEQ ID NO: 450061 - DNA, 23 bp, Homo sapiens
caggcggaggggcttggagcaga

SEQ ID NO: 450062 - DNA, 15 bp, Homo sapiens
caggctcttctcctt

SEQ ID NO: 450063 - DNA, 11 bp, Homo sapiens
caggctggggc

SEQ ID NO: 450064 - DNA, 17 bp, Homo sapiens
caggctggggcctggcc

SEQ ID NO: 450065 - DNA, 18 bp, Homo sapiens
caggctggggcctggcct

SEQ ID NO: 450066 - DNA, 17 bp, Homo sapiens
cagggacccccgaggcc

SEQ ID NO: 450067 - DNA, 20 bp, Homo sapiens
cagggatggcccagctgatc

SEQ ID NO: 450068 - DNA, 21 bp, Homo sapiens
cagggatgggggatgggccag

SEQ ID NO: 450069 - DNA, 16 bp, Homo sapiens
cagggcaggagctgct

SEQ ID NO: 450070 - DNA, 19 bp, Homo sapiens
cagggcccgagcgcgtgcc

SEQ ID NO: 450071 - DNA, 17 bp, Homo sapiens
cagggccctggggtctc

SEQ ID NO: 450072 - DNA, 21 bp, Homo sapiens
cagggccctggggtctctgag

SEQ ID NO: 450073 - DNA, 14 bp, Homo sapiens
cagggccgcagggc

SEQ ID NO: 450074 - DNA, 15 bp, Homo sapiens
cagggccgcagggcg

SEQ ID NO: 450075 - DNA, 16 bp, Homo sapiens
cagggccgcagggcgc

SEQ ID NO: 450076 - DNA, 19 bp, Homo sapiens
cagggccgcagggcgctcc

SEQ ID NO: 450077 - DNA, 15 bp, Homo sapiens
cagggcgctccggca

SEQ ID NO: 450078 - DNA, 22 bp, Homo sapiens
cagggcgctccggcagaggcag

SEQ ID NO: 450079 - DNA, 13 bp, Homo sapiens
caggggggttggg

SEQ ID NO: 450080 - DNA, 22 bp, Homo sapiens
caggggggttgggttccagaca

SEQ ID NO: 450081 - DNA, 15 bp, Homo sapiens
cagggtgttggaaga

SEQ ID NO: 450082 - DNA, 21 bp, Homo sapiens
cagggttaaagaaaggcagag

SEQ ID NO: 450083 - DNA, 22 bp, Homo sapiens
cagggtttacccagtgggacag

SEQ ID NO: 450084 - DNA, 21 bp, Homo sapiens
caggtattttcatcaagtagc

SEQ ID NO: 450085 - DNA, 23 bp, Homo sapiens
caggtcctgcccatgtgtcccct

SEQ ID NO: 450086 - DNA, 21 bp, Homo sapiens
caggtggccactccagacccc

SEQ ID NO: 450087 - DNA, 13 bp, Homo sapiens
caggttcctccta

SEQ ID NO: 450088 - DNA, 23 bp, Homo sapiens
caggttgtctgaagtcactgcac

SEQ ID NO: 450089 - DNA, 21 bp, Homo sapiens
cagtacagggcaggagctgct

SEQ ID NO: 450090 - DNA, 13 bp, Homo sapiens
cagtaccatccca

SEQ ID NO: 450091 - DNA, 22 bp, Homo sapiens
cagtaggtctgaaggcctccat

SEQ ID NO: 450092 - DNA, 15 bp, Homo sapiens
cagtagtgcctgtga

SEQ ID NO: 450093 - DNA, 15 bp, Homo sapiens
cagtatataagcttt

SEQ ID NO: 450094 - DNA, 11 bp, Homo sapiens
cagtattctgt

SEQ ID NO: 450095 - DNA, 23 bp, Homo sapiens
cagtattgacgacctacatctga

SEQ ID NO: 450096 - DNA, 12 bp, Homo sapiens
cagtcatgtgtg

SEQ ID NO: 450097 - DNA, 21 bp, Homo sapiens
cagtctttgggggattcaaat

SEQ ID NO: 450098 - DNA, 18 bp, Homo sapiens
cagtgaagcccaggagga

SEQ ID NO: 450099 - DNA, 22 bp, Homo sapiens
ttaatgttctgaataatttctt

SEQ ID NO: 450100 - DNA, 13 bp, Homo sapiens
ttaatttatttca

SEQ ID NO: 450101 - DNA, 14 bp, Homo sapiens
ttaatttcataaat

SEQ ID NO: 450102 - DNA, 17 bp, Homo sapiens
ttaatttcataaattgg

SEQ ID NO: 450103 - DNA, 20 bp, Homo sapiens
ttacaaatttttactcaggc

SEQ ID NO: 450104 - DNA, 17 bp, Homo sapiens
ttacactgaaatccaaa

SEQ ID NO: 450105 - DNA, 21 bp, Homo sapiens
ttacatcctctgcttgtcatt

SEQ ID NO: 450106 - DNA, 20 bp, Homo sapiens
ttacatgagttcaaatactt

SEQ ID NO: 450107 - DNA, 21 bp, Homo sapiens
ttacatgagttcaaatacttt

SEQ ID NO: 450108 - DNA, 21 bp, Homo sapiens
ttacctaagagccacaataag

SEQ ID NO: 450109 - DNA, 19 bp, Homo sapiens
ttacctcactggtgcattt

SEQ ID NO: 450110 - DNA, 12 bp, Homo sapiens
ttactattaact

SEQ ID NO: 450111 - DNA, 21 bp, Homo sapiens
ttactattaactctgcataga

SEQ ID NO: 450112 - DNA, 15 bp, Homo sapiens
ttactgatgtgtgca

SEQ ID NO: 450113 - DNA, 22 bp, Homo sapiens
ttactgatgtgtgcaacctttt

SEQ ID NO: 450114 - DNA, 23 bp, Homo sapiens
ttactgtatttgggatatgagtt

SEQ ID NO: 450115 - DNA, 16 bp, Homo sapiens
ttactgttcttattgt

SEQ ID NO: 450116 - DNA, 13 bp, Homo sapiens
ttagaatggggct

SEQ ID NO: 450117 - DNA, 12 bp, Homo sapiens
ttagagaataag

SEQ ID NO: 450118 - DNA, 16 bp, Homo sapiens
ttagcagtttgctttg

SEQ ID NO: 450119 - DNA, 22 bp, Homo sapiens
ttataaaaccatcaaaaatatt

SEQ ID NO: 450120 - DNA, 21 bp, Homo sapiens
ttataatcaagacaagtgttt

SEQ ID NO: 450121 - DNA, 18 bp, Homo sapiens
ttataggaaataaatcta

SEQ ID NO: 450122 - DNA, 15 bp, Homo sapiens
ttatagtctgtactt

SEQ ID NO: 450123 - DNA, 15 bp, Homo sapiens
ttatatattataagt

SEQ ID NO: 450124 - DNA, 21 bp, Homo sapiens
ttatcagaactcctttctaag

SEQ ID NO: 450125 - DNA, 16 bp, Homo sapiens
ttatccttttatctca

SEQ ID NO: 450126 - DNA, 17 bp, Homo sapiens
ttatctagcaagaagat

SEQ ID NO: 450127 - DNA, 23 bp, Homo sapiens
ttatctccagccaatttcaaaga

SEQ ID NO: 450128 - DNA, 16 bp, Homo sapiens
ttatctgggttttaga

SEQ ID NO: 450129 - DNA, 13 bp, Homo sapiens
ttatgaagatagt

SEQ ID NO: 450130 - DNA, 22 bp, Homo sapiens
ttatgaagttaacagtctcatt

SEQ ID NO: 450131 - DNA, 13 bp, Homo sapiens
ttatgcaaagtac

SEQ ID NO: 450132 - DNA, 15 bp, Homo sapiens
ttatggctttgtgct

SEQ ID NO: 450133 - DNA, 14 bp, Homo sapiens
ttatgtaagaagaa

SEQ ID NO: 450134 - DNA, 18 bp, Homo sapiens
ttatgtaagaagaaactg

SEQ ID NO: 450135 - DNA, 12 bp, Homo sapiens
ttattaaacttc

SEQ ID NO: 450136 - DNA, 18 bp, Homo sapiens
ttattactttaaattata

SEQ ID NO: 450137 - DNA, 18 bp, Homo sapiens
ttattattttcatataat

SEQ ID NO: 450138 - DNA, 19 bp, Homo sapiens
ttattattttcatataatt

SEQ ID NO: 450139 - DNA, 11 bp, Homo sapiens
ttattctagtc

SEQ ID NO: 450140 - DNA, 12 bp, Homo sapiens
ttattgaataac

SEQ ID NO: 450141 - DNA, 19 bp, Homo sapiens
ttattgggcaagtgattga

SEQ ID NO: 450142 - DNA, 20 bp, Homo sapiens
ttattgggcaagtgattgaa

SEQ ID NO: 450143 - DNA, 13 bp, Homo sapiens
ttatttgatctgg

SEQ ID NO: 450144 - DNA, 15 bp, Homo sapiens
ttcaaaatagttcta

SEQ ID NO: 450145 - DNA, 21 bp, Homo sapiens
ttcaaacagttccataccaag

SEQ ID NO: 450146 - DNA, 20 bp, Homo sapiens
ttcaaagaacccccctcccc

SEQ ID NO: 450147 - DNA, 13 bp, Homo sapiens
ttcaaatgcatga

SEQ ID NO: 450148 - DNA, 15 bp, Homo sapiens
ttcaacacttatttt

SEQ ID NO: 450149 - DNA, 17 bp, Homo sapiens
ttcaacacttattttct

SEQ ID NO: 450150 - DNA, 20 bp, Homo sapiens
ttcaaccattccccatggga

SEQ ID NO: 450151 - DNA, 15 bp, Homo sapiens
ttcaacgcagccctg

SEQ ID NO: 450152 - DNA, 19 bp, Homo sapiens
ttcaatcattttgggaaat

SEQ ID NO: 450153 - DNA, 15 bp, Homo sapiens
ttcaatctgtgaagc

SEQ ID NO: 450154 - DNA, 23 bp, Homo sapiens
ttcaatctgtgaagcctttatct

SEQ ID NO: 450155 - DNA, 16 bp, Homo sapiens
ttcaatgcatacaata

SEQ ID NO: 450156 - DNA, 21 bp, Homo sapiens
ttcaatgcatacaataaaaga

SEQ ID NO: 450157 - DNA, 13 bp, Homo sapiens
ttcacaaatatag

SEQ ID NO: 450158 - DNA, 13 bp, Homo sapiens
ttcacatctgtat

SEQ ID NO: 450159 - DNA, 17 bp, Homo sapiens
ttcaccatgttgccaat

SEQ ID NO: 450160 - DNA, 19 bp, Homo sapiens
ttcactgctggctgcctta

SEQ ID NO: 450161 - DNA, 16 bp, Homo sapiens
ttcacttaaactttgt

SEQ ID NO: 450162 - DNA, 15 bp, Homo sapiens
ttcacttctatttat

SEQ ID NO: 450163 - DNA, 19 bp, Homo sapiens
ttcagaaagggcagcccct

SEQ ID NO: 450164 - DNA, 17 bp, Homo sapiens
ttcagactctctcctct

SEQ ID NO: 450165 - DNA, 20 bp, Homo sapiens
ttcagactctctcctctctc

SEQ ID NO: 450166 - DNA, 19 bp, Homo sapiens
ttcagcttgtttctatact

SEQ ID NO: 450167 - DNA, 21 bp, Homo sapiens
ttcagcttgtttctatactgt

SEQ ID NO: 450168 - DNA, 16 bp, Homo sapiens
ttcaggctcttctcct

SEQ ID NO: 450169 - DNA, 15 bp, Homo sapiens
ttcaggttcctccta

SEQ ID NO: 450170 - DNA, 17 bp, Homo sapiens
ttcagttattaaatgat

SEQ ID NO: 450171 - DNA, 13 bp, Homo sapiens
ttcataaaaataa

SEQ ID NO: 450172 - DNA, 21 bp, Homo sapiens
ttcataaattggctcctttcc

SEQ ID NO: 450173 - DNA, 15 bp, Homo sapiens
ttcatactcaaagag

SEQ ID NO: 450174 - DNA, 23 bp, Homo sapiens
ttcatccagtttgttctccgggt

SEQ ID NO: 450175 - DNA, 18 bp, Homo sapiens
ttcatctgaggagtccaa

SEQ ID NO: 450176 - DNA, 17 bp, Homo sapiens
ttcatgtgttgcaaatt

SEQ ID NO: 450177 - DNA, 22 bp, Homo sapiens
ttcatgtgttgcaaattattct

SEQ ID NO: 450178 - DNA, 21 bp, Homo sapiens
ttcatttacaacttccagatt

SEQ ID NO: 450179 - DNA, 20 bp, Homo sapiens
ttccaacaaacttactgtca

SEQ ID NO: 450180 - DNA, 21 bp, Homo sapiens
ttccaagtgtgtgtgcaatgt

SEQ ID NO: 450181 - DNA, 20 bp, Homo sapiens
ttccaataccctagaagaaa

SEQ ID NO: 450182 - DNA, 15 bp, Homo sapiens
ttccacccagaccct

SEQ ID NO: 450183 - DNA, 17 bp, Homo sapiens
ttccagacagagtggat

SEQ ID NO: 450184 - DNA, 22 bp, Homo sapiens
ttccagagggggccagagggac

SEQ ID NO: 450185 - DNA, 17 bp, Homo sapiens
ttccatgggttgaacaa

SEQ ID NO: 450186 - DNA, 19 bp, Homo sapiens
ttcccacccactagccctc

SEQ ID NO: 450187 - DNA, 12 bp, Homo sapiens
ttcccaccccta

SEQ ID NO: 450188 - DNA, 14 bp, Homo sapiens
ttcccatcaccaga

SEQ ID NO: 450189 - DNA, 23 bp, Homo sapiens
ttccccaccccataagccctgag

SEQ ID NO: 450190 - DNA, 16 bp, Homo sapiens
ttccccactcccgtga

SEQ ID NO: 450191 - DNA, 11 bp, Homo sapiens
ttccccatggg

SEQ ID NO: 450192 - DNA, 19 bp, Homo sapiens
ttccccctccaatcccacc

SEQ ID NO: 450193 - DNA, 11 bp, Homo sapiens
ttcccccttcc

SEQ ID NO: 450194 - DNA, 17 bp, Homo sapiens
ttcccctgttcactcta

SEQ ID NO: 450195 - DNA, 19 bp, Homo sapiens
ttccccttctgtgtcacag

SEQ ID NO: 450196 - DNA, 21 bp, Homo sapiens
ttcccgctcagccctccctgc

SEQ ID NO: 450197 - DNA, 19 bp, Homo sapiens
ttgggggattcaaatgcat

SEQ ID NO: 450198 - DNA, 16 bp, Homo sapiens
ttggggtagagaggac

SEQ ID NO: 450199 - DNA, 12 bp, Homo sapiens
ttgggttccaga

SEQ ID NO: 450200 - DNA, 15 bp, Homo sapiens
ttgggttccagacag

SEQ ID NO: 450201 - DNA, 15 bp, Homo sapiens
ttgtaatatacagtt

SEQ ID NO: 450202 - DNA, 19 bp, Homo sapiens
ttgtacttacactgaaatc

SEQ ID NO: 450203 - DNA, 16 bp, Homo sapiens
ttgtagggatgccttt

SEQ ID NO: 450204 - DNA, 15 bp, Homo sapiens
ttgtagggtgaggcg

SEQ ID NO: 450205 - DNA, 23 bp, Homo sapiens
ttgtatagttttataaaactcag

SEQ ID NO: 450206 - DNA, 15 bp, Homo sapiens
ttgtattcctgcctt

SEQ ID NO: 450207 - DNA, 11 bp, Homo sapiens
ttgtattttaa

SEQ ID NO: 450208 - DNA, 13 bp, Homo sapiens
ttgtcacttctgc

SEQ ID NO: 450209 - DNA, 20 bp, Homo sapiens
ttgtcacttctgctgtacag

SEQ ID NO: 450210 - DNA, 17 bp, Homo sapiens
ttgtctgaagtcactgc

SEQ ID NO: 450211 - DNA, 21 bp, Homo sapiens
ttgtctggctgtggcccctcc

SEQ ID NO: 450212 - DNA, 22 bp, Homo sapiens
ttgtctggctgtggcccctcct

SEQ ID NO: 450213 - DNA, 22 bp, Homo sapiens
ttgtgacaggaaagccctcccc

SEQ ID NO: 450214 - DNA, 21 bp, Homo sapiens
ttgtgcggtgtgtctccagct

SEQ ID NO: 450215 - DNA, 22 bp, Homo sapiens
ttgtgctgtgggcagcaccctc

SEQ ID NO: 450216 - DNA, 13 bp, Homo sapiens
ttgtgtgattgaa

SEQ ID NO: 450217 - DNA, 19 bp, Homo sapiens
ttgtgtgggtttactctgt

SEQ ID NO: 450218 - DNA, 17 bp, Homo sapiens
ttgtgtggtattcaact

SEQ ID NO: 450219 - DNA, 17 bp, Homo sapiens
ttgttaggggtggggga

SEQ ID NO: 450220 - DNA, 18 bp, Homo sapiens
ttgttatatcagcagaca

SEQ ID NO: 450221 - DNA, 23 bp, Homo sapiens
ttgttattgggcaagtgattgaa

SEQ ID NO: 450222 - DNA, 21 bp, Homo sapiens
ttgttcaaagaacccccctcc

SEQ ID NO: 450223 - DNA, 22 bp, Homo sapiens
ttgttcaaagaacccccctccc

SEQ ID NO: 450224 - DNA, 20 bp, Homo sapiens
ttgttgctcagcaaggggct

SEQ ID NO: 450225 - DNA, 15 bp, Homo sapiens
ttgttgtattcctgc

SEQ ID NO: 450226 - DNA, 17 bp, Homo sapiens
ttgttgtattcctgcct

SEQ ID NO: 450227 - DNA, 15 bp, Homo sapiens
ttgtttacatgagtt

SEQ ID NO: 450228 - DNA, 16 bp, Homo sapiens
ttgtttttatatatta

SEQ ID NO: 450229 - DNA, 19 bp, Homo sapiens
ttgttttttttttccactt

SEQ ID NO: 450230 - DNA, 14 bp, Homo sapiens
tttaaaaaataaca

SEQ ID NO: 450231 - DNA, 20 bp, Homo sapiens
tttaaaagtatataataaaa

SEQ ID NO: 450232 - DNA, 19 bp, Homo sapiens
tttaaaatggacttttgtt

SEQ ID NO: 450233 - DNA, 21 bp, Homo sapiens
tttaaagggagccatgctctt

SEQ ID NO: 450234 - DNA, 17 bp, Homo sapiens
tttaaagtacctgtagt

SEQ ID NO: 450235 - DNA, 19 bp, Homo sapiens
tttaaatgattccaaataa

SEQ ID NO: 450236 - DNA, 12 bp, Homo sapiens
tttaaattatat

SEQ ID NO: 450237 - DNA, 16 bp, Homo sapiens
tttaaattatatgata

SEQ ID NO: 450238 - DNA, 17 bp, Homo sapiens
tttaagaaatgagaaat

SEQ ID NO: 450239 - DNA, 18 bp, Homo sapiens
tttaagaaatgagaaatt

SEQ ID NO: 450240 - DNA, 14 bp, Homo sapiens
tttaagccccctct

SEQ ID NO: 450241 - DNA, 14 bp, Homo sapiens
tttaatttatttca

SEQ ID NO: 450242 - DNA, 14 bp, Homo sapiens
tttacagttactgc

SEQ ID NO: 450243 - DNA, 20 bp, Homo sapiens
tttacctcactggtgcattt

SEQ ID NO: 450244 - DNA, 21 bp, Homo sapiens
tttactacataattaaatttt

SEQ ID NO: 450245 - DNA, 19 bp, Homo sapiens
tttactcaggctttctatt

SEQ ID NO: 450246 - DNA, 15 bp, Homo sapiens
tttagaaattctata

SEQ ID NO: 450247 - DNA, 23 bp, Homo sapiens
tttatctgtctgagccctgccct

SEQ ID NO: 450248 - DNA, 19 bp, Homo sapiens
tttattaaaatactgtttt

SEQ ID NO: 450249 - DNA, 22 bp, Homo sapiens
tttattaaaatactgttttgga

SEQ ID NO: 450250 - DNA, 18 bp, Homo sapiens
tttattaaacttcagcaa

SEQ ID NO: 450251 - DNA, 19 bp, Homo sapiens
tttatttaatttcataaat

SEQ ID NO: 450252 - DNA, 14 bp, Homo sapiens
tttatttgtttact

SEQ ID NO: 450253 - DNA, 16 bp, Homo sapiens
tttcaaagaaaacaga

SEQ ID NO: 450254 - DNA, 16 bp, Homo sapiens
tttcaacgcagccctg

SEQ ID NO: 450255 - DNA, 20 bp, Homo sapiens
tttcaacgcagccctgcttt

SEQ ID NO: 450256 - DNA, 14 bp, Homo sapiens
tttcacatatttgt

SEQ ID NO: 450257 - DNA, 15 bp, Homo sapiens
tttcacatctgtata

SEQ ID NO: 450258 - DNA, 19 bp, Homo sapiens
tttcacttaaactttgtca

SEQ ID NO: 450259 - DNA, 18 bp, Homo sapiens
tttcagcttgtttctata

SEQ ID NO: 450260 - DNA, 19 bp, Homo sapiens
tttcagtgttttgcttttt

SEQ ID NO: 450261 - DNA, 14 bp, Homo sapiens
tttcataaattggc

SEQ ID NO: 450262 - DNA, 17 bp, Homo sapiens
tttcataaattggctcc

SEQ ID NO: 450263 - DNA, 23 bp, Homo sapiens
tttcatgtgttgcaaattattct

SEQ ID NO: 450264 - DNA, 20 bp, Homo sapiens
tttccaagtttattgccctc

SEQ ID NO: 450265 - DNA, 22 bp, Homo sapiens
tttccaccaagggtatctgctg

SEQ ID NO: 450266 - DNA, 19 bp, Homo sapiens
tttccccaattatcctcct

SEQ ID NO: 450267 - DNA, 23 bp, Homo sapiens
tttcctctctctctctctctctg

SEQ ID NO: 450268 - DNA, 20 bp, Homo sapiens
tttcgacgcttaacctttcc

SEQ ID NO: 450269 - DNA, 14 bp, Homo sapiens
tttctaaactgttt

SEQ ID NO: 450270 - DNA, 15 bp, Homo sapiens
tttctaaactgtttt

SEQ ID NO: 450271 - DNA, 21 bp, Homo sapiens
tttctaaactgttttcatgtg

SEQ ID NO: 450272 - DNA, 14 bp, Homo sapiens
tttctaagctgttt

SEQ ID NO: 450273 - DNA, 22 bp, Homo sapiens
tttctagctataacaactctat

SEQ ID NO: 450274 - DNA, 14 bp, Homo sapiens
tttctatactgttt

SEQ ID NO: 450275 - DNA, 14 bp, Homo sapiens
tttctatatttgga

SEQ ID NO: 450276 - DNA, 18 bp, Homo sapiens
tttctatggattcacttc

SEQ ID NO: 450277 - DNA, 14 bp, Homo sapiens
tttctcactccctt

SEQ ID NO: 450278 - DNA, 24 bp, Homo sapiens
tttctcactccctttgtggacttt

SEQ ID NO: 450279 - DNA, 18 bp, Homo sapiens
tttctcctccccaaggac

SEQ ID NO: 450280 - DNA, 11 bp, Homo sapiens
tttctctctgt

SEQ ID NO: 450281 - DNA, 19 bp, Homo sapiens
tttctgtctttatgtaaga

SEQ ID NO: 450282 - DNA, 14 bp, Homo sapiens
tttctttctatgta

SEQ ID NO: 450283 - DNA, 19 bp, Homo sapiens
tttgaatatattttatctt

SEQ ID NO: 450284 - DNA, 18 bp, Homo sapiens
tttgagagaagccacgct

SEQ ID NO: 450285 - DNA, 17 bp, Homo sapiens
tttgagcttctcctctg

SEQ ID NO: 450286 - DNA, 18 bp, Homo sapiens
tttgagcttctcctctgc

SEQ ID NO: 450287 - DNA, 16 bp, Homo sapiens
tttgatatacagacct

SEQ ID NO: 450288 - DNA, 13 bp, Homo sapiens
tttgcaagaacca

SEQ ID NO: 450289 - DNA, 22 bp, Homo sapiens
tttgcagacatattttcttaca

SEQ ID NO: 450290 - DNA, 12 bp, Homo sapiens
tttgcatgcagg

SEQ ID NO: 450291 - DNA, 16 bp, Homo sapiens
tttgcgctctgggttt

SEQ ID NO: 450292 - DNA, 13 bp, Homo sapiens
tttggaagaaagg

SEQ ID NO: 450293 - DNA, 21 bp, Homo sapiens
tttggcattatctctttctct

SEQ ID NO: 450294 - DNA, 18 bp, Homo sapiens
tttggggcttatcagaac

SEQ ID NO: 450295 - DNA, 18 bp, Homo sapiens
tttgtaactattcttcag

SEQ ID NO: 450296 - DNA, 12 bp, Homo sapiens
tttgtatcctcc

SEQ ID NO: 450297 - DNA, 12 bp, Homo sapiens
tttgtcacttct

SEQ ID NO: 450298 - DNA, 17 bp, Homo sapiens
tttgtcacttctgctgt

SEQ ID NO: 450299 - DNA, 15 bp, Homo sapiens
tttgtgcttgttctt

SEQ ID NO: 450300 - DNA, 18 bp, Homo sapiens
tttgtgcttgttcttcct

SEQ ID NO: 450301 - DNA, 12 bp, Homo sapiens
tttgtgtattct

SEQ ID NO: 450302 - DNA, 15 bp, Homo sapiens
tttgtgtattctgtg

SEQ ID NO: 450303 - DNA, 22 bp, Homo sapiens
tttgtgtattctgtggattcta

SEQ ID NO: 450304 - DNA, 14 bp, Homo sapiens
ttttaaaaaataac

SEQ ID NO: 450305 - DNA, 21 bp, Homo sapiens
ttttaaaaaataacatattct

SEQ ID NO: 450306 - DNA, 23 bp, Homo sapiens
ttttaaaaaataacatattcttg

SEQ ID NO: 450307 - DNA, 18 bp, Homo sapiens
ttttaaaatgcaaatatt

SEQ ID NO: 450308 - DNA, 19 bp, Homo sapiens
ttttaaatgattccaaata

SEQ ID NO: 450309 - DNA, 16 bp, Homo sapiens
ttttaactttttctaa

SEQ ID NO: 450310 - DNA, 12 bp, Homo sapiens
ttttaagaaaca

SEQ ID NO: 450311 - DNA, 13 bp, Homo sapiens
ttttaataaaagt

SEQ ID NO: 450312 - DNA, 16 bp, Homo sapiens
ttttaatctttgtgac

SEQ ID NO: 450313 - DNA, 15 bp, Homo sapiens
ttttactttgtgcaa

SEQ ID NO: 450314 - DNA, 18 bp, Homo sapiens
ttttactttgtgcaatat

SEQ ID NO: 450315 - DNA, 16 bp, Homo sapiens
ttttatgtcatactct

SEQ ID NO: 450316 - DNA, 16 bp, Homo sapiens
ttttattatcttctat

SEQ ID NO: 450317 - DNA, 21 bp, Homo sapiens
ttttatttctcgggtgcattt

SEQ ID NO: 450318 - DNA, 17 bp, Homo sapiens
ttttcaacgcagccctg

SEQ ID NO: 450319 - DNA, 19 bp, Homo sapiens
ttttcactgctggctgcct

SEQ ID NO: 450320 - DNA, 20 bp, Homo sapiens
ttttcagcttgtttctatac

SEQ ID NO: 450321 - DNA, 21 bp, Homo sapiens
ttttcagcttgtttctatact

SEQ ID NO: 450322 - DNA, 13 bp, Homo sapiens
ttttcataataaa

SEQ ID NO: 450323 - DNA, 18 bp, Homo sapiens
ttttccatctaaaatact

SEQ ID NO: 450324 - DNA, 21 bp, Homo sapiens
ttttctagctataacaactct

SEQ ID NO: 450325 - DNA, 18 bp, Homo sapiens
ttttctatgtccagcctt

SEQ ID NO: 450326 - DNA, 18 bp, Homo sapiens
ttttctttctatgtagaa

SEQ ID NO: 450327 - DNA, 17 bp, Homo sapiens
ttttcttttatatctgt

SEQ ID NO: 450328 - DNA, 22 bp, Homo sapiens
ttttgaaaaaggatcatggttt

SEQ ID NO: 450329 - DNA, 20 bp, Homo sapiens
ttttgaatcaatctggcttc

SEQ ID NO: 450330 - DNA, 20 bp, Homo sapiens
ttttgctctactttataatc

SEQ ID NO: 450331 - DNA, 12 bp, Homo sapiens
ttttgcttttta

SEQ ID NO: 450332 - DNA, 22 bp, Homo sapiens
ttttggcattatctctttctct

SEQ ID NO: 450333 - DNA, 19 bp, Homo sapiens
ttttgggggtttttaatct

SEQ ID NO: 450334 - DNA, 13 bp, Homo sapiens
ttttgtaaccata

SEQ ID NO: 450335 - DNA, 13 bp, Homo sapiens
ttttgtatcctcc

SEQ ID NO: 450336 - DNA, 13 bp, Homo sapiens
ttttgtgtattct

SEQ ID NO: 450337 - DNA, 14 bp, Homo sapiens
tttttaaattttct

SEQ ID NO: 450338 - DNA, 16 bp, Homo sapiens
tttttcaatgtactgt

SEQ ID NO: 450339 - DNA, 21 bp, Homo sapiens
tttttggatggcttaagcctg

SEQ ID NO: 450340 - DNA, 23 bp, Homo sapiens
ttttttaaatgattccaaataaa

SEQ ID NO: 450341 - DNA, 13 bp, Homo sapiens
ttttttcaatgta

SEQ ID NO: 450342 - DNA, 13 bp, Homo sapiens
ttttttccactta

SEQ ID NO: 450343 - DNA, 22 bp, Homo sapiens
ttcccgctcagccctccctgcc

SEQ ID NO: 450344 - DNA, 23 bp, Homo sapiens
ttccctgcatcccttggcccctc

SEQ ID NO: 450345 - DNA, 21 bp, Homo sapiens
ttccgtgagagtcatctcaaa

SEQ ID NO: 450346 - DNA, 18 bp, Homo sapiens
ttccgttcatctgaggag

SEQ ID NO: 450347 - DNA, 12 bp, Homo sapiens
ttcctctccact

SEQ ID NO: 450348 - DNA, 14 bp, Homo sapiens
ttcctctctctctc

SEQ ID NO: 450349 - DNA, 13 bp, Homo sapiens
ttcctgcctttga

SEQ ID NO: 450350 - DNA, 18 bp, Homo sapiens
ttcctggattttctttct

SEQ ID NO: 450351 - DNA, 19 bp, Homo sapiens
ttcctggattttctttcta

SEQ ID NO: 450352 - DNA, 22 bp, Homo sapiens
ttcctgtagtggcaaaaaagaa

SEQ ID NO: 450353 - DNA, 15 bp, Homo sapiens
ttcctgtcctgctca

SEQ ID NO: 450354 - DNA, 16 bp, Homo sapiens
ttcctgtcctgctcac

SEQ ID NO: 450355 - DNA, 21 bp, Homo sapiens
ttcctgtcctgctcacgtctg

SEQ ID NO: 450356 - DNA, 20 bp, Homo sapiens
ttcgatacaccgggcctgga

SEQ ID NO: 450357 - DNA, 21 bp, Homo sapiens
ttcgcatccaccgccacccca

SEQ ID NO: 450358 - DNA, 14 bp, Homo sapiens
ttcggcaccttccc

SEQ ID NO: 450359 - DNA, 14 bp, Homo sapiens
ttcgtcttccctgc

SEQ ID NO: 450360 - DNA, 14 bp, Homo sapiens
ttctaaactgtttt

SEQ ID NO: 450361 - DNA, 13 bp, Homo sapiens
ttctaagctgttt

SEQ ID NO: 450362 - DNA, 14 bp, Homo sapiens
ttctaagcttattt

SEQ ID NO: 450363 - DNA, 21 bp, Homo sapiens
ttctaagcttatttctaacta

SEQ ID NO: 450364 - DNA, 18 bp, Homo sapiens
ttctagctataacaactc

SEQ ID NO: 450365 - DNA, 20 bp, Homo sapiens
ttctagctataacaactcta

SEQ ID NO: 450366 - DNA, 18 bp, Homo sapiens
ttctagtcaactgctgtt

SEQ ID NO: 450367 - DNA, 21 bp, Homo sapiens
ttctagtcaactgctgtttta

SEQ ID NO: 450368 - DNA, 13 bp, Homo sapiens
ttctagtctctga

SEQ ID NO: 450369 - DNA, 15 bp, Homo sapiens
ttctagtctctgatt

SEQ ID NO: 450370 - DNA, 22 bp, Homo sapiens
ttctatggattcacttctattt

SEQ ID NO: 450371 - DNA, 17 bp, Homo sapiens
ttctatgtagaactgtt

SEQ ID NO: 450372 - DNA, 21 bp, Homo sapiens
ttctcaagcgctatccacaga

SEQ ID NO: 450373 - DNA, 22 bp, Homo sapiens
ttctcaagcgctatccacagaa

SEQ ID NO: 450374 - DNA, 14 bp, Homo sapiens
ttctcagctccact

SEQ ID NO: 450375 - DNA, 17 bp, Homo sapiens
ttctcagctccactctg

SEQ ID NO: 450376 - DNA, 14 bp, Homo sapiens
ttctcccctccaga

SEQ ID NO: 450377 - DNA, 16 bp, Homo sapiens
ttctcccctccagacc

SEQ ID NO: 450378 - DNA, 22 bp, Homo sapiens
ttctcccttaggaatatacata

SEQ ID NO: 450379 - DNA, 17 bp, Homo sapiens
ttctccgggtgtggcct

SEQ ID NO: 450380 - DNA, 21 bp, Homo sapiens
ttctccgggtgtggcctcagc

SEQ ID NO: 450381 - DNA, 17 bp, Homo sapiens
ttctcctctttctcagt

SEQ ID NO: 450382 - DNA, 12 bp, Homo sapiens
ttctcctggagc

SEQ ID NO: 450383 - DNA, 17 bp, Homo sapiens
ttctcctttcacaacct

SEQ ID NO: 450384 - DNA, 12 bp, Homo sapiens
ttctctctgtgt

SEQ ID NO: 450385 - DNA, 17 bp, Homo sapiens
ttctgaataatttctta

SEQ ID NO: 450386 - DNA, 14 bp, Homo sapiens
ttctgaccccactt

SEQ ID NO: 450387 - DNA, 23 bp, Homo sapiens
ttctgaccccacttatgctgctg

SEQ ID NO: 450388 - DNA, 16 bp, Homo sapiens
ttctgcaataacagtt

SEQ ID NO: 450389 - DNA, 12 bp, Homo sapiens
ttctgcattact

SEQ ID NO: 450390 - DNA, 16 bp, Homo sapiens
ttctgctaatttatga

SEQ ID NO: 450391 - DNA, 22 bp, Homo sapiens
ttctgtcattggttacaaattt

SEQ ID NO: 450392 - DNA, 14 bp, Homo sapiens
ttctgtggattcta

SEQ ID NO: 450393 - DNA, 21 bp, Homo sapiens
ttcttcatccatagacacagt

SEQ ID NO: 450394 - DNA, 20 bp, Homo sapiens
ttcttccctatacttcacac

SEQ ID NO: 450395 - DNA, 19 bp, Homo sapiens
ttcttgcactgtatccaag

SEQ ID NO: 450396 - DNA, 20 bp, Homo sapiens
ttcttgcactgtatccaagt

SEQ ID NO: 450397 - DNA, 19 bp, Homo sapiens
ttcttgcggcaccgcccac

SEQ ID NO: 450398 - DNA, 22 bp, Homo sapiens
ttcttgcggcaccgcccaccca

SEQ ID NO: 450399 - DNA, 14 bp, Homo sapiens
ttctttctatgtag

SEQ ID NO: 450400 - DNA, 17 bp, Homo sapiens
ttctttctatgtagaac

SEQ ID NO: 450401 - DNA, 14 bp, Homo sapiens
ttcttttatatctg

SEQ ID NO: 450402 - DNA, 17 bp, Homo sapiens
ttcttttcagcttgttt

SEQ ID NO: 450403 - DNA, 14 bp, Homo sapiens
ttgaaaagaagaaa

SEQ ID NO: 450404 - DNA, 18 bp, Homo sapiens
ttgaaaagaagaaagtct

SEQ ID NO: 450405 - DNA, 20 bp, Homo sapiens
ttgaaaagaagaaagtctat

SEQ ID NO: 450406 - DNA, 18 bp, Homo sapiens
ttgaaattggaaaggact

SEQ ID NO: 450407 - DNA, 24 bp, Homo sapiens
ttgaatctgattggacattttctt

SEQ ID NO: 450408 - DNA, 15 bp, Homo sapiens
ttgaatgttatatca

SEQ ID NO: 450409 - DNA, 22 bp, Homo sapiens
ttgacctctcacttttttataa

SEQ ID NO: 450410 - DNA, 23 bp, Homo sapiens
ttgacctgacgatcttccccctt

SEQ ID NO: 450411 - DNA, 17 bp, Homo sapiens
ttgacctttatttatta

SEQ ID NO: 450412 - DNA, 22 bp, Homo sapiens
ttgacgacctacatctgaaatc

SEQ ID NO: 450413 - DNA, 18 bp, Homo sapiens
ttgactataaaaactgcc

SEQ ID NO: 450414 - DNA, 18 bp, Homo sapiens
ttgagagaagccacgctg

SEQ ID NO: 450415 - DNA, 18 bp, Homo sapiens
ttgagcaaggcaagaagt

SEQ ID NO: 450416 - DNA, 14 bp, Homo sapiens
ttgagcttctcctc

SEQ ID NO: 450417 - DNA, 17 bp, Homo sapiens
ttgagcttctcctctgc

SEQ ID NO: 450418 - DNA, 18 bp, Homo sapiens
ttgagtccattgcaaaag

SEQ ID NO: 450419 - DNA, 12 bp, Homo sapiens
ttgatatgtaac

SEQ ID NO: 450420 - DNA, 19 bp, Homo sapiens
ttgatctggtgcgtgtggc

SEQ ID NO: 450421 - DNA, 18 bp, Homo sapiens
ttgcaaattattctagtc

SEQ ID NO: 450422 - DNA, 13 bp, Homo sapiens
ttgcacttctgtt

SEQ ID NO: 450423 - DNA, 22 bp, Homo sapiens
ttgcctcgagtccccccacccc

SEQ ID NO: 450424 - DNA, 15 bp, Homo sapiens
ttgcgctctgggttt

SEQ ID NO: 450425 - DNA, 21 bp, Homo sapiens
ttgcggcaccgcccacccaca

SEQ ID NO: 450426 - DNA, 18 bp, Homo sapiens
ttgctagtgatacactgt

SEQ ID NO: 450427 - DNA, 23 bp, Homo sapiens
ttgctagtgatacactgtatcta

SEQ ID NO: 450428 - DNA, 17 bp, Homo sapiens
ttgctgtttatatatat

SEQ ID NO: 450429 - DNA, 18 bp, Homo sapiens
ttggacattttcttcaga

SEQ ID NO: 450430 - DNA, 15 bp, Homo sapiens
ttggagaggaggtgt

SEQ ID NO: 450431 - DNA, 20 bp, Homo sapiens
ttggataggagcttccagat

SEQ ID NO: 450432 - DNA, 21 bp, Homo sapiens
ttggatggcttaagcctgtgt

SEQ ID NO: 450433 - DNA, 18 bp, Homo sapiens
ttggcattatctctttct

SEQ ID NO: 450434 - DNA, 15 bp, Homo sapiens
ttggccggctggccg

SEQ ID NO: 450435 - DNA, 18 bp, Homo sapiens
ttggctcctttcccacag

SEQ ID NO: 450436 - DNA, 15 bp, Homo sapiens
ttggctctgttgctg

SEQ ID NO: 450437 - DNA, 20 bp, Homo sapiens
ttgggacggaagtggcctga

SEQ ID NO: 450438 - DNA, 17 bp, Homo sapiens
ttgggcagtggagaggg

SEQ ID NO: 450439 - DNA, 23 bp, Homo sapiens
ttgggcagtggagaggggacttg

SEQ ID NO: 450440 - DNA, 15 bp, Homo sapiens
tggggtgcctgagcc

SEQ ID NO: 450441 - DNA, 15 bp, Homo sapiens
tgggtgaaaccacat

SEQ ID NO: 450442 - DNA, 16 bp, Homo sapiens
tgggtgaaaccacatg

SEQ ID NO: 450443 - DNA, 23 bp, Homo sapiens
tgggttgggcacggcttatacca

SEQ ID NO: 450444 - DNA, 14 bp, Homo sapiens
tgggttgttgcaga

SEQ ID NO: 450445 - DNA, 15 bp, Homo sapiens
tgggtttactctgtg

SEQ ID NO: 450446 - DNA, 13 bp, Homo sapiens
tggtaccagagcc

SEQ ID NO: 450447 - DNA, 24 bp, Homo sapiens
tggtcagtgaagcccaggaggacc

SEQ ID NO: 450448 - DNA, 19 bp, Homo sapiens
tggtccttctgaccccact

SEQ ID NO: 450449 - DNA, 17 bp, Homo sapiens
tggtctggagcccctat

SEQ ID NO: 450450 - DNA, 14 bp, Homo sapiens
tggtcttggagagg

SEQ ID NO: 450451 - DNA, 15 bp, Homo sapiens
tggtgactgtcccac

SEQ ID NO: 450452 - DNA, 18 bp, Homo sapiens
tggtgatgcctaaaggaa

SEQ ID NO: 450453 - DNA, 14 bp, Homo sapiens
tggtgcgtgtggcc

SEQ ID NO: 450454 - DNA, 19 bp, Homo sapiens
tggtgcgtgtggccctgtg

SEQ ID NO: 450455 - DNA, 13 bp, Homo sapiens
tggtgctgccaca

SEQ ID NO: 450456 - DNA, 18 bp, Homo sapiens
tggtgctgccacacttca

SEQ ID NO: 450457 - DNA, 21 bp, Homo sapiens
tggtggcaccagatgcaacct

SEQ ID NO: 450458 - DNA, 13 bp, Homo sapiens
tggtgtgaggccc

SEQ ID NO: 450459 - DNA, 14 bp, Homo sapiens
tggtgtgaggcccc

SEQ ID NO: 450460 - DNA, 20 bp, Homo sapiens
tggttcccctgttcactcta

SEQ ID NO: 450461 - DNA, 22 bp, Homo sapiens
tggtttcagaaagggcagcccc

SEQ ID NO: 450462 - DNA, 14 bp, Homo sapiens
tgtaaaattcatag

SEQ ID NO: 450463 - DNA, 15 bp, Homo sapiens
tgtaaacatcataaa

SEQ ID NO: 450464 - DNA, 20 bp, Homo sapiens
tgtaaacatcataaatagta

SEQ ID NO: 450465 - DNA, 22 bp, Homo sapiens
tgtaacagcaattttcataata

SEQ ID NO: 450466 - DNA, 15 bp, Homo sapiens
tgtaaccatatgatt

SEQ ID NO: 450467 - DNA, 15 bp, Homo sapiens
tgtaaggtttcaatg

SEQ ID NO: 450468 - DNA, 14 bp, Homo sapiens
tgtaatcatttatc

SEQ ID NO: 450469 - DNA, 21 bp, Homo sapiens
tgtaatcatttatcttatcta

SEQ ID NO: 450470 - DNA, 15 bp, Homo sapiens
tgtaatctctgatta

SEQ ID NO: 450471 - DNA, 18 bp, Homo sapiens
tgtactgatgattgtttg

SEQ ID NO: 450472 - DNA, 21 bp, Homo sapiens
tgtacttacactgaaatccaa

SEQ ID NO: 450473 - DNA, 24 bp, Homo sapiens
tgtacttcagttctcatcttgtaa

SEQ ID NO: 450474 - DNA, 15 bp, Homo sapiens
tgtacttcttcatcc

SEQ ID NO: 450475 - DNA, 22 bp, Homo sapiens
tgtacttcttcatccatagaca

SEQ ID NO: 450476 - DNA, 14 bp, Homo sapiens
tgtacttgaataat

SEQ ID NO: 450477 - DNA, 12 bp, Homo sapiens
tgtagaaatgta

SEQ ID NO: 450478 - DNA, 19 bp, Homo sapiens
tgtagaactgttcatttcc

SEQ ID NO: 450479 - DNA, 15 bp, Homo sapiens
tgtagcatataaatg

SEQ ID NO: 450480 - DNA, 22 bp, Homo sapiens
tgtatagttttataaaactcag

SEQ ID NO: 450481 - DNA, 23 bp, Homo sapiens
tgtatagttttataaaactcagt

SEQ ID NO: 450482 - DNA, 18 bp, Homo sapiens
tgtatatatttattattt

SEQ ID NO: 450483 - DNA, 13 bp, Homo sapiens
tgtatctaaaaaa

SEQ ID NO: 450484 - DNA, 15 bp, Homo sapiens
tgtatctaaaaaata

SEQ ID NO: 450485 - DNA, 16 bp, Homo sapiens
tgtatctaaaaaataa

SEQ ID NO: 450486 - DNA, 18 bp, Homo sapiens
tgtattctgtggattcta

SEQ ID NO: 450487 - DNA, 14 bp, Homo sapiens
tgtcaacttcagtt

SEQ ID NO: 450488 - DNA, 15 bp, Homo sapiens
tgtcaccagctatct

SEQ ID NO: 450489 - DNA, 11 bp, Homo sapiens
tgtcagccagc

SEQ ID NO: 450490 - DNA, 17 bp, Homo sapiens
tgtcatactctgtgtaa

SEQ ID NO: 450491 - DNA, 16 bp, Homo sapiens
tgtcatctctctgggg

SEQ ID NO: 450492 - DNA, 14 bp, Homo sapiens
tgtcattctgctaa

SEQ ID NO: 450493 - DNA, 16 bp, Homo sapiens
tgtcattctgctaatt

SEQ ID NO: 450494 - DNA, 18 bp, Homo sapiens
tgtccagaacaaaagata

SEQ ID NO: 450495 - DNA, 14 bp, Homo sapiens
tgtccatgtgaaat

SEQ ID NO: 450496 - DNA, 19 bp, Homo sapiens
tgtcccacaaaatatttct

SEQ ID NO: 450497 - DNA, 18 bp, Homo sapiens
tgtcccctcactctgtca

SEQ ID NO: 450498 - DNA, 20 bp, Homo sapiens
tgtccctaccgagtctcttc

SEQ ID NO: 450499 - DNA, 21 bp, Homo sapiens
tgtccctaccgagtctcttct

SEQ ID NO: 450500 - DNA, 13 bp, Homo sapiens
tgtcctctcgagc

SEQ ID NO: 450501 - DNA, 16 bp, Homo sapiens
tgtcgccccaggccct

SEQ ID NO: 450502 - DNA, 23 bp, Homo sapiens
tgtcgccccaggccctccctgac

SEQ ID NO: 450503 - DNA, 22 bp, Homo sapiens
tgtctagtttgcatacttcctg

SEQ ID NO: 450504 - DNA, 20 bp, Homo sapiens
tgtctcaagagggcactggt

SEQ ID NO: 450505 - DNA, 16 bp, Homo sapiens
tgtctccagctgattt

SEQ ID NO: 450506 - DNA, 16 bp, Homo sapiens
tgtctctccctaccct

SEQ ID NO: 450507 - DNA, 18 bp, Homo sapiens
tgtctgaagtcactgcac

SEQ ID NO: 450508 - DNA, 19 bp, Homo sapiens
tgtctgaagtcactgcaca

SEQ ID NO: 450509 - DNA, 15 bp, Homo sapiens
tgtctgagccctgcc

SEQ ID NO: 450510 - DNA, 21 bp, Homo sapiens
tgtctgagccctgccctcact

SEQ ID NO: 450511 - DNA, 22 bp, Homo sapiens
tgtctgagccctgccctcactc

SEQ ID NO: 450512 - DNA, 14 bp, Homo sapiens
tgtctgagctgctg

SEQ ID NO: 450513 - DNA, 15 bp, Homo sapiens
tgtctgattctatgc

SEQ ID NO: 450514 - DNA, 22 bp, Homo sapiens
tgtctgtttcaatgacctgtat

SEQ ID NO: 450515 - DNA, 18 bp, Homo sapiens
tgtcttaacctattccca

SEQ ID NO: 450516 - DNA, 18 bp, Homo sapiens
tgtcttagggaattctga

SEQ ID NO: 450517 - DNA, 13 bp, Homo sapiens
tgtctttgctgtt

SEQ ID NO: 450518 - DNA, 18 bp, Homo sapiens
tgtgacaggaaagccctc

SEQ ID NO: 450519 - DNA, 22 bp, Homo sapiens
tgtgacaggaaagccctccccc

SEQ ID NO: 450520 - DNA, 14 bp, Homo sapiens
tgtgagtctgtcct

SEQ ID NO: 450521 - DNA, 15 bp, Homo sapiens
tgtgagtctgtcctt

SEQ ID NO: 450522 - DNA, 21 bp, Homo sapiens
tgtgattggcagcttcaaaac

SEQ ID NO: 450523 - DNA, 23 bp, Homo sapiens
tgtgcaatatgaggggactgcat

SEQ ID NO: 450524 - DNA, 17 bp, Homo sapiens
tgtgccaaaatgtcaat

SEQ ID NO: 450525 - DNA, 19 bp, Homo sapiens
tgtgccaaaatgtcaattt

SEQ ID NO: 450526 - DNA, 18 bp, Homo sapiens
tgtgccaaagatagcaga

SEQ ID NO: 450527 - DNA, 19 bp, Homo sapiens
tgtgcctgcaccaggagac

SEQ ID NO: 450528 - DNA, 13 bp, Homo sapiens
tgtgcctttcact

SEQ ID NO: 450529 - DNA, 15 bp, Homo sapiens
tgtgcggtgcataca

SEQ ID NO: 450530 - DNA, 18 bp, Homo sapiens
tgtgctccagcagtgctg

SEQ ID NO: 450531 - DNA, 15 bp, Homo sapiens
tgtgctcggacacag

SEQ ID NO: 450532 - DNA, 14 bp, Homo sapiens
tgtgctgtgggcag

SEQ ID NO: 450533 - DNA, 16 bp, Homo sapiens
tgtgctgtgggcagca

SEQ ID NO: 450534 - DNA, 12 bp, Homo sapiens
tgtgcttgttct

SEQ ID NO: 450535 - DNA, 14 bp, Homo sapiens
tgtgcttgttcttc

SEQ ID NO: 450536 - DNA, 12 bp, Homo sapiens
tgtgctttcatc

SEQ ID NO: 450537 - DNA, 13 bp, Homo sapiens
tgtgctttcatgt

SEQ ID NO: 450538 - DNA, 20 bp, Homo sapiens
tgtgcttttccatctaaaat

SEQ ID NO: 450539 - DNA, 12 bp, Homo sapiens
tgtggactttat

SEQ ID NO: 450540 - DNA, 16 bp, Homo sapiens
tgtggattctatattt

SEQ ID NO: 450541 - DNA, 18 bp, Homo sapiens
tgtggattctatatttca

SEQ ID NO: 450542 - DNA, 14 bp, Homo sapiens
tgtggcattggggg

SEQ ID NO: 450543 - DNA, 16 bp, Homo sapiens
tgtggcctcagccctc

SEQ ID NO: 450544 - DNA, 10 bp, Homo sapiens
tgtggctcac

SEQ ID NO: 450545 - DNA, 17 bp, Homo sapiens
tgtggctcattcttttc

SEQ ID NO: 450546 - DNA, 15 bp, Homo sapiens
tgtggcttaaacatt

SEQ ID NO: 450547 - DNA, 12 bp, Homo sapiens
tgtggcttggaa

SEQ ID NO: 450548 - DNA, 15 bp, Homo sapiens
tgtgggactggccca

SEQ ID NO: 450549 - DNA, 20 bp, Homo sapiens
tgtgggactggcccacccct

SEQ ID NO: 450550 - DNA, 13 bp, Homo sapiens
tgtgggagtccac

SEQ ID NO: 450551 - DNA, 14 bp, Homo sapiens
tgtgggagtccact

SEQ ID NO: 450552 - DNA, 15 bp, Homo sapiens
tgtgggcagcaccct

SEQ ID NO: 450553 - DNA, 17 bp, Homo sapiens
tgtgggcagcaccctcc

SEQ ID NO: 450554 - DNA, 13 bp, Homo sapiens
tgtggggagggtg

SEQ ID NO: 450555 - DNA, 14 bp, Homo sapiens
tgtgggggtggcca

SEQ ID NO: 450556 - DNA, 20 bp, Homo sapiens
tgtgggtttactctgtgcta

SEQ ID NO: 450557 - DNA, 21 bp, Homo sapiens
tgtggtattcaactaatacat

SEQ ID NO: 450558 - DNA, 13 bp, Homo sapiens
tgtgtacttcttc

SEQ ID NO: 450559 - DNA, 21 bp, Homo sapiens
tgtgtacttcttcatccatag

SEQ ID NO: 450560 - DNA, 23 bp, Homo sapiens
tgtgtattctgtggattctatat

SEQ ID NO: 450561 - DNA, 17 bp, Homo sapiens
tgtgtcacagttcttgg

SEQ ID NO: 450562 - DNA, 13 bp, Homo sapiens
tgtgtcccctcac

SEQ ID NO: 450563 - DNA, 18 bp, Homo sapiens
tgtgtcccctcactctgt

SEQ ID NO: 450564 - DNA, 18 bp, Homo sapiens
tgtgtctccagctgattt

SEQ ID NO: 450565 - DNA, 16 bp, Homo sapiens
tgtgtgcaatgttccg

SEQ ID NO: 450566 - DNA, 14 bp, Homo sapiens
tgtgtggcaaacat

SEQ ID NO: 450567 - DNA, 21 bp, Homo sapiens
tgtgtgggtttactctgtgct

SEQ ID NO: 450568 - DNA, 22 bp, Homo sapiens
tgtgtgtccagcacctttgtaa

SEQ ID NO: 450569 - DNA, 15 bp, Homo sapiens
tgtgtgtgcaatgtt

SEQ ID NO: 450570 - DNA, 23 bp, Homo sapiens
tgtgttgatgactcactcataaa

SEQ ID NO: 450571 - DNA, 19 bp, Homo sapiens
tgtgttgcaaattattcta

SEQ ID NO: 450572 - DNA, 21 bp, Homo sapiens
tgtgttgcaaattattctagt

SEQ ID NO: 450573 - DNA, 14 bp, Homo sapiens
tgttagctgggaag

SEQ ID NO: 450574 - DNA, 19 bp, Homo sapiens
tgttataacaccatctgga

SEQ ID NO: 450575 - DNA, 22 bp, Homo sapiens
tgttatcctgctagctgtagaa

SEQ ID NO: 450576 - DNA, 21 bp, Homo sapiens
tgttcaaagaacccccctccc

SEQ ID NO: 450577 - DNA, 16 bp, Homo sapiens
tgttcaaatgcatttt

SEQ ID NO: 450578 - DNA, 15 bp, Homo sapiens
tgttcaatctgtgaa

SEQ ID NO: 450579 - DNA, 18 bp, Homo sapiens
tgttcacacacacacaat

SEQ ID NO: 450580 - DNA, 12 bp, Homo sapiens
tgttcagcatag

SEQ ID NO: 450581 - DNA, 21 bp, Homo sapiens
tgttccgttcatctgaggagt

SEQ ID NO: 450582 - DNA, 24 bp, Homo sapiens
tgttccgttcatctgaggagtcca

SEQ ID NO: 450583 - DNA, 20 bp, Homo sapiens
tgttctaactagtaatcttg

SEQ ID NO: 450584 - DNA, 21 bp, Homo sapiens
tgttctccgggtgtggcctca

SEQ ID NO: 450585 - DNA, 18 bp, Homo sapiens
tgttctgaataatttctt

SEQ ID NO: 450586 - DNA, 16 bp, Homo sapiens
tgttgaaggactacag

SEQ ID NO: 450587 - DNA, 23 bp, Homo sapiens
tgttgctcagcaaggggctctgc

SEQ ID NO: 450588 - DNA, 13 bp, Homo sapiens
tgttgctgtcctc

SEQ ID NO: 450589 - DNA, 16 bp, Homo sapiens
tgttgcttagtcactt

SEQ ID NO: 450590 - DNA, 17 bp, Homo sapiens
tgttggttacatgaatg

SEQ ID NO: 450591 - DNA, 17 bp, Homo sapiens
tgttgtattcctgcctt

SEQ ID NO: 450592 - DNA, 23 bp, Homo sapiens
tgttgttcaaatgcattttgggg

SEQ ID NO: 450593 - DNA, 23 bp, Homo sapiens
tgttgttcgatcgtttcacatct

SEQ ID NO: 450594 - DNA, 21 bp, Homo sapiens
tgtttaagaaatgagaaattg

SEQ ID NO: 450595 - DNA, 16 bp, Homo sapiens
tgtttaaggttcttgc

SEQ ID NO: 450596 - DNA, 13 bp, Homo sapiens
tgtttaccctccc

SEQ ID NO: 450597 - DNA, 15 bp, Homo sapiens
tgtttaccctccctg

SEQ ID NO: 450598 - DNA, 17 bp, Homo sapiens
tgtttacctcactggtg

SEQ ID NO: 450599 - DNA, 20 bp, Homo sapiens
tgtttacctcactggtgcat

SEQ ID NO: 450600 - DNA, 19 bp, Homo sapiens
tgtttattaaaatactgtt

SEQ ID NO: 450601 - DNA, 15 bp, Homo sapiens
tgtttcaccagtttc

SEQ ID NO: 450602 - DNA, 14 bp, Homo sapiens
tgtttgttttcaaa

SEQ ID NO: 450603 - DNA, 12 bp, Homo sapiens
tgttttatgtca

SEQ ID NO: 450604 - DNA, 12 bp, Homo sapiens
tgttttcaaaat

SEQ ID NO: 450605 - DNA, 22 bp, Homo sapiens
tgttttgtgcggtgtgtctcca

SEQ ID NO: 450606 - DNA, 12 bp, Homo sapiens
tgtttttatata

SEQ ID NO: 450607 - DNA, 19 bp, Homo sapiens
ttaaaaaaaatattctgtc

SEQ ID NO: 450608 - DNA, 14 bp, Homo sapiens
ttaaaaaaataaca

SEQ ID NO: 450609 - DNA, 14 bp, Homo sapiens
ttaaaaaataacat

SEQ ID NO: 450610 - DNA, 20 bp, Homo sapiens
ttaaaaaataacatattctt

SEQ ID NO: 450611 - DNA, 14 bp, Homo sapiens
ttaaaagaacatag

SEQ ID NO: 450612 - DNA, 14 bp, Homo sapiens
ttaaaatactgttt

SEQ ID NO: 450613 - DNA, 12 bp, Homo sapiens
ttaaaatggact

SEQ ID NO: 450614 - DNA, 17 bp, Homo sapiens
ttaaacgtcacagcagt

SEQ ID NO: 450615 - DNA, 13 bp, Homo sapiens
ttaaactcttaga

SEQ ID NO: 450616 - DNA, 15 bp, Homo sapiens
ttaaacttcagcaac

SEQ ID NO: 450617 - DNA, 21 bp, Homo sapiens
ttaaactttgtcacttctgct

SEQ ID NO: 450618 - DNA, 16 bp, Homo sapiens
ttaaagaaaggcagag

SEQ ID NO: 450619 - DNA, 12 bp, Homo sapiens
ttaaatgattcc

SEQ ID NO: 450620 - DNA, 14 bp, Homo sapiens
ttaaattatatgat

SEQ ID NO: 450621 - DNA, 17 bp, Homo sapiens
ttaaattggcttgttta

SEQ ID NO: 450622 - DNA, 13 bp, Homo sapiens
ttaacccagtgtt

SEQ ID NO: 450623 - DNA, 17 bp, Homo sapiens
ttaactactaagaataa

SEQ ID NO: 450624 - DNA, 23 bp, Homo sapiens
ttaactcatctgttatcctgcta

SEQ ID NO: 450625 - DNA, 15 bp, Homo sapiens
ttaactgcatataga

SEQ ID NO: 450626 - DNA, 15 bp, Homo sapiens
ttaacttaaaagaac

SEQ ID NO: 450627 - DNA, 21 bp, Homo sapiens
ttaagaaacacggctgatatc

SEQ ID NO: 450628 - DNA, 13 bp, Homo sapiens
ttaagaaagctat

SEQ ID NO: 450629 - DNA, 16 bp, Homo sapiens
ttaagacaacaggcat

SEQ ID NO: 450630 - DNA, 23 bp, Homo sapiens
ttaagccccctcttgagaggggt

SEQ ID NO: 450631 - DNA, 15 bp, Homo sapiens
ttaaggaaaagagaa

SEQ ID NO: 450632 - DNA, 18 bp, Homo sapiens
ttaataaagattccatgg

SEQ ID NO: 450633 - DNA, 17 bp, Homo sapiens
ttaataggaggacagaa

SEQ ID NO: 450634 - DNA, 19 bp, Homo sapiens
ttaatctctaaaattctag

SEQ ID NO: 450635 - DNA, 16 bp, Homo sapiens
ttaatgtgccaaaatg

SEQ ID NO: 450636 - DNA, 15 bp, Homo sapiens
tgccccctcccccgc

SEQ ID NO: 450637 - DNA, 13 bp, Homo sapiens
tgcccctcccttc

SEQ ID NO: 450638 - DNA, 18 bp, Homo sapiens
tgcccctccgtccccagg

SEQ ID NO: 450639 - DNA, 19 bp, Homo sapiens
tgccctcaaaatctttaga

SEQ ID NO: 450640 - DNA, 11 bp, Homo sapiens
tgccctccccc

SEQ ID NO: 450641 - DNA, 18 bp, Homo sapiens
tgccctgcaccttgggca

SEQ ID NO: 450642 - DNA, 12 bp, Homo sapiens
tgccctggtgct

SEQ ID NO: 450643 - DNA, 17 bp, Homo sapiens
tgccctggtgctgccac

SEQ ID NO: 450644 - DNA, 20 bp, Homo sapiens
tgccctggtgctgccacact

SEQ ID NO: 450645 - DNA, 17 bp, Homo sapiens
tgccgatttcctaagct

SEQ ID NO: 450646 - DNA, 16 bp, Homo sapiens
tgccgctgccgctgca

SEQ ID NO: 450647 - DNA, 20 bp, Homo sapiens
tgcctatcacctcttatgca

SEQ ID NO: 450648 - DNA, 14 bp, Homo sapiens
tgcctcgagtcccc

SEQ ID NO: 450649 - DNA, 17 bp, Homo sapiens
tgcctcgagtcccccca

SEQ ID NO: 450650 - DNA, 22 bp, Homo sapiens
tgcctcgagtccccccacccct

SEQ ID NO: 450651 - DNA, 23 bp, Homo sapiens
tgcctcgagtccccccacccctc

SEQ ID NO: 450652 - DNA, 12 bp, Homo sapiens
tgcctctgaaaa

SEQ ID NO: 450653 - DNA, 23 bp, Homo sapiens
tgcctcttaacttaaaagaacat

SEQ ID NO: 450654 - DNA, 18 bp, Homo sapiens
tgcctgaatccacctgca

SEQ ID NO: 450655 - DNA, 20 bp, Homo sapiens
tgcctgaatccacctgcagt

SEQ ID NO: 450656 - DNA, 17 bp, Homo sapiens
tgcctgcaccaggagac

SEQ ID NO: 450657 - DNA, 19 bp, Homo sapiens
tgcctgcaccaggagacag

SEQ ID NO: 450658 - DNA, 16 bp, Homo sapiens
tgcctggcgggcagcc

SEQ ID NO: 450659 - DNA, 18 bp, Homo sapiens
tgcctggcgggcagcccc

SEQ ID NO: 450660 - DNA, 22 bp, Homo sapiens
tgcctggcgggcagcccctgct

SEQ ID NO: 450661 - DNA, 18 bp, Homo sapiens
tgcctggtgcgctgtgct

SEQ ID NO: 450662 - DNA, 14 bp, Homo sapiens
tgcctgtatttcca

SEQ ID NO: 450663 - DNA, 17 bp, Homo sapiens
tgccttagaacctttct

SEQ ID NO: 450664 - DNA, 21 bp, Homo sapiens
tgccttagaacctttcttaca

SEQ ID NO: 450665 - DNA, 18 bp, Homo sapiens
tgccttcagctctacagc

SEQ ID NO: 450666 - DNA, 19 bp, Homo sapiens
tgccttgttgtattcctgc

SEQ ID NO: 450667 - DNA, 20 bp, Homo sapiens
tgcgcagccgcgctctgccc

SEQ ID NO: 450668 - DNA, 22 bp, Homo sapiens
tgcgcagccgcgctctgcccct

SEQ ID NO: 450669 - DNA, 14 bp, Homo sapiens
tgcgccctccctcc

SEQ ID NO: 450670 - DNA, 19 bp, Homo sapiens
tgcgccctccctccctcca

SEQ ID NO: 450671 - DNA, 14 bp, Homo sapiens
tgcgcctgcccgcc

SEQ ID NO: 450672 - DNA, 17 bp, Homo sapiens
tgcgcctgcccgcccgc

SEQ ID NO: 450673 - DNA, 18 bp, Homo sapiens
tgcgcctgcccgcccgcc

SEQ ID NO: 450674 - DNA, 12 bp, Homo sapiens
tgcgctagagca

SEQ ID NO: 450675 - DNA, 21 bp, Homo sapiens
tgcgctagagcattctggggt

SEQ ID NO: 450676 - DNA, 12 bp, Homo sapiens
tgcgctcctctg

SEQ ID NO: 450677 - DNA, 16 bp, Homo sapiens
tgcgctcctctgcagc

SEQ ID NO: 450678 - DNA, 13 bp, Homo sapiens
tgcggcaccgccc

SEQ ID NO: 450679 - DNA, 16 bp, Homo sapiens
tgcggcaccgcccacc

SEQ ID NO: 450680 - DNA, 17 bp, Homo sapiens
tgcggcaccgcccaccc

SEQ ID NO: 450681 - DNA, 19 bp, Homo sapiens
tgcggcaccgcccacccac

SEQ ID NO: 450682 - DNA, 18 bp, Homo sapiens
tgcggcccgtgcgcagcc

SEQ ID NO: 450683 - DNA, 16 bp, Homo sapiens
tgcggctgcccacgct

SEQ ID NO: 450684 - DNA, 23 bp, Homo sapiens
tgcgtgaccggcccgccaccttg

SEQ ID NO: 450685 - DNA, 12 bp, Homo sapiens
tgcgtgtggccc

SEQ ID NO: 450686 - DNA, 17 bp, Homo sapiens
tgcgtgtggccctgtgg

SEQ ID NO: 450687 - DNA, 19 bp, Homo sapiens
tgcgtgtggccctgtggga

SEQ ID NO: 450688 - DNA, 15 bp, Homo sapiens
tgctaatgtaatcat

SEQ ID NO: 450689 - DNA, 21 bp, Homo sapiens
tgctaatgtaatcatttatct

SEQ ID NO: 450690 - DNA, 22 bp, Homo sapiens
tgctaatgtaatcatttatctt

SEQ ID NO: 450691 - DNA, 15 bp, Homo sapiens
tgctagctgtagaaa

SEQ ID NO: 450692 - DNA, 13 bp, Homo sapiens
tgctagtgataca

SEQ ID NO: 450693 - DNA, 14 bp, Homo sapiens
tgctatgtctgtga

SEQ ID NO: 450694 - DNA, 16 bp, Homo sapiens
tgctcatgggaagaac

SEQ ID NO: 450695 - DNA, 18 bp, Homo sapiens
tgctccaacagacaccct

SEQ ID NO: 450696 - DNA, 16 bp, Homo sapiens
tgctccagcagtgctg

SEQ ID NO: 450697 - DNA, 21 bp, Homo sapiens
tgctccagcagtgctgggccc

SEQ ID NO: 450698 - DNA, 12 bp, Homo sapiens
tgctcggacaca

SEQ ID NO: 450699 - DNA, 19 bp, Homo sapiens
tgctgactgtactcctccc

SEQ ID NO: 450700 - DNA, 21 bp, Homo sapiens
tgctgagtatgttaagctctt

SEQ ID NO: 450701 - DNA, 17 bp, Homo sapiens
tgctgccccacaacaca

SEQ ID NO: 450702 - DNA, 15 bp, Homo sapiens
tgctgcctctgaaaa

SEQ ID NO: 450703 - DNA, 19 bp, Homo sapiens
tgctgctcgggaaggcctg

SEQ ID NO: 450704 - DNA, 21 bp, Homo sapiens
tgctggaccaaggtgcggacc

SEQ ID NO: 450705 - DNA, 13 bp, Homo sapiens
tgctggccagcac

SEQ ID NO: 450706 - DNA, 20 bp, Homo sapiens
tgctggccagcaccctctcc

SEQ ID NO: 450707 - DNA, 22 bp, Homo sapiens
tgctggccagcaccctctcctg

SEQ ID NO: 450708 - DNA, 15 bp, Homo sapiens
tgctggctgccttag

SEQ ID NO: 450709 - DNA, 14 bp, Homo sapiens
tgctgtgggcagca

SEQ ID NO: 450710 - DNA, 19 bp, Homo sapiens
tgctgtgggcagcaccctc

SEQ ID NO: 450711 - DNA, 21 bp, Homo sapiens
tgctgtgggcagcaccctccc

SEQ ID NO: 450712 - DNA, 15 bp, Homo sapiens
tgctgttttatgtca

SEQ ID NO: 450713 - DNA, 22 bp, Homo sapiens
tgctgttttatgtcatactctg

SEQ ID NO: 450714 - DNA, 13 bp, Homo sapiens
tgcttaaggaaaa

SEQ ID NO: 450715 - DNA, 19 bp, Homo sapiens
tgcttaaggaaaagagaaa

SEQ ID NO: 450716 - DNA, 15 bp, Homo sapiens
tgcttagtgtccctt

SEQ ID NO: 450717 - DNA, 19 bp, Homo sapiens
tgcttctcatagccccggt

SEQ ID NO: 450718 - DNA, 17 bp, Homo sapiens
tgcttgtcattctgcta

SEQ ID NO: 450719 - DNA, 19 bp, Homo sapiens
tgctttcacaaatatagtt

SEQ ID NO: 450720 - DNA, 18 bp, Homo sapiens
tgctttcatgtttaagaa

SEQ ID NO: 450721 - DNA, 20 bp, Homo sapiens
tgctttcatgtttaagaaat

SEQ ID NO: 450722 - DNA, 12 bp, Homo sapiens
tgctttctcatg

SEQ ID NO: 450723 - DNA, 14 bp, Homo sapiens
tgctttgggctgcc

SEQ ID NO: 450724 - DNA, 15 bp, Homo sapiens
tgctttgggctgccc

SEQ ID NO: 450725 - DNA, 17 bp, Homo sapiens
tgctttgtgtgattgaa

SEQ ID NO: 450726 - DNA, 14 bp, Homo sapiens
tgcttttccatcta

SEQ ID NO: 450727 - DNA, 15 bp, Homo sapiens
tggaaaaaatatttt

SEQ ID NO: 450728 - DNA, 20 bp, Homo sapiens
tggaaacaaggaaggacatt

SEQ ID NO: 450729 - DNA, 15 bp, Homo sapiens
tggaaaggactttgt

SEQ ID NO: 450730 - DNA, 17 bp, Homo sapiens
tggaaccttccctccaa

SEQ ID NO: 450731 - DNA, 14 bp, Homo sapiens
tggaattatgtata

SEQ ID NO: 450732 - DNA, 16 bp, Homo sapiens
tggaattatgtataac

SEQ ID NO: 450733 - DNA, 16 bp, Homo sapiens
tggactgcgctggacg

SEQ ID NO: 450734 - DNA, 17 bp, Homo sapiens
tggactggtggcccctg

SEQ ID NO: 450735 - DNA, 12 bp, Homo sapiens
tggactttattt

SEQ ID NO: 450736 - DNA, 16 bp, Homo sapiens
tggactttatttaatt

SEQ ID NO: 450737 - DNA, 20 bp, Homo sapiens
tggacttttgttcatgggag

SEQ ID NO: 450738 - DNA, 22 bp, Homo sapiens
tggagagctcagtacagggcag

SEQ ID NO: 450739 - DNA, 20 bp, Homo sapiens
tggagaggaggtgtggagtg

SEQ ID NO: 450740 - DNA, 14 bp, Homo sapiens
tggagaggcggcct

SEQ ID NO: 450741 - DNA, 21 bp, Homo sapiens
tggagcagagacggcagcccc

SEQ ID NO: 450742 - DNA, 22 bp, Homo sapiens
tggagcagagacggcagcccca

SEQ ID NO: 450743 - DNA, 17 bp, Homo sapiens
tggagccaatggagact

SEQ ID NO: 450744 - DNA, 19 bp, Homo sapiens
tggaggttgaataggagtt

SEQ ID NO: 450745 - DNA, 16 bp, Homo sapiens
tggagtctgaaggaga

SEQ ID NO: 450746 - DNA, 18 bp, Homo sapiens
tggagtctgaaggagagg

SEQ ID NO: 450747 - DNA, 19 bp, Homo sapiens
tggagtctgaaggagagga

SEQ ID NO: 450748 - DNA, 13 bp, Homo sapiens
tggagtggagggg

SEQ ID NO: 450749 - DNA, 19 bp, Homo sapiens
tggataggagcttccagat

SEQ ID NO: 450750 - DNA, 16 bp, Homo sapiens
tggatatgaaagagaa

SEQ ID NO: 450751 - DNA, 16 bp, Homo sapiens
tggatgattcttttcc

SEQ ID NO: 450752 - DNA, 15 bp, Homo sapiens
tggatgtgctttcat

SEQ ID NO: 450753 - DNA, 17 bp, Homo sapiens
tggattttctttctatg

SEQ ID NO: 450754 - DNA, 16 bp, Homo sapiens
tggcaaatgaaagttt

SEQ ID NO: 450755 - DNA, 14 bp, Homo sapiens
tggcaacctttgtg

SEQ ID NO: 450756 - DNA, 15 bp, Homo sapiens
tggcaagcatagtcg

SEQ ID NO: 450757 - DNA, 14 bp, Homo sapiens
tggcaccagatgca

SEQ ID NO: 450758 - DNA, 23 bp, Homo sapiens
tggcagccgtgccttcagctcta

SEQ ID NO: 450759 - DNA, 24 bp, Homo sapiens
tggcagcgcctcccgccgcctcgg

SEQ ID NO: 450760 - DNA, 22 bp, Homo sapiens
tggcaggcacacagcagccccc

SEQ ID NO: 450761 - DNA, 23 bp, Homo sapiens
tggcaggcacacagcagcccccc

SEQ ID NO: 450762 - DNA, 19 bp, Homo sapiens
tggcattatctctttctct

SEQ ID NO: 450763 - DNA, 15 bp, Homo sapiens
tggccagacgctgcc

SEQ ID NO: 450764 - DNA, 13 bp, Homo sapiens
tggccagcaccct

SEQ ID NO: 450765 - DNA, 14 bp, Homo sapiens
tggccagcaccctc

SEQ ID NO: 450766 - DNA, 20 bp, Homo sapiens
tggccagcaccctctcctgg

SEQ ID NO: 450767 - DNA, 21 bp, Homo sapiens
tggccagcaccctctcctggg

SEQ ID NO: 450768 - DNA, 15 bp, Homo sapiens
tggccaggtggccac

SEQ ID NO: 450769 - DNA, 16 bp, Homo sapiens
tggccaggtggccact

SEQ ID NO: 450770 - DNA, 17 bp, Homo sapiens
tggccaggtggccactc

SEQ ID NO: 450771 - DNA, 13 bp, Homo sapiens
tggccatccctgg

SEQ ID NO: 450772 - DNA, 15 bp, Homo sapiens
tggccatccctgggc

SEQ ID NO: 450773 - DNA, 17 bp, Homo sapiens
tggccatccctgggccc

SEQ ID NO: 450774 - DNA, 19 bp, Homo sapiens
tggccatccctgggcccct

SEQ ID NO: 450775 - DNA, 21 bp, Homo sapiens
tggccatccctgggcccctcc

SEQ ID NO: 450776 - DNA, 23 bp, Homo sapiens
tggccatccctgggcccctccac

SEQ ID NO: 450777 - DNA, 12 bp, Homo sapiens
tggcccacccct

SEQ ID NO: 450778 - DNA, 20 bp, Homo sapiens
tggcccacccctcttccccc

SEQ ID NO: 450779 - DNA, 22 bp, Homo sapiens
tggcccacccctcttccccctt

SEQ ID NO: 450780 - DNA, 12 bp, Homo sapiens
tggccccagctg

SEQ ID NO: 450781 - DNA, 12 bp, Homo sapiens
tggccccaggcg

SEQ ID NO: 450782 - DNA, 12 bp, Homo sapiens
tggccctgccct

SEQ ID NO: 450783 - DNA, 17 bp, Homo sapiens
tggccctgccctccccc

SEQ ID NO: 450784 - DNA, 19 bp, Homo sapiens
tggccctgtgggagtccac

SEQ ID NO: 450785 - DNA, 22 bp, Homo sapiens
tggccctgtgggagtccacttt

SEQ ID NO: 450786 - DNA, 14 bp, Homo sapiens
tggcctatttaagc

SEQ ID NO: 450787 - DNA, 19 bp, Homo sapiens
tggcctatttaagccccct

SEQ ID NO: 450788 - DNA, 12 bp, Homo sapiens
tggcctcagccc

SEQ ID NO: 450789 - DNA, 15 bp, Homo sapiens
tggcctcagccctca

SEQ ID NO: 450790 - DNA, 19 bp, Homo sapiens
tggccttggttcctccagc

SEQ ID NO: 450791 - DNA, 20 bp, Homo sapiens
tggccttggttcctccagca

SEQ ID NO: 450792 - DNA, 12 bp, Homo sapiens
tggcgggcagcc

SEQ ID NO: 450793 - DNA, 14 bp, Homo sapiens
tggctcctcccggt

SEQ ID NO: 450794 - DNA, 18 bp, Homo sapiens
tggctcctcccggtgccc

SEQ ID NO: 450795 - DNA, 19 bp, Homo sapiens
tggctcctcccggtgccca

SEQ ID NO: 450796 - DNA, 17 bp, Homo sapiens
tggctcctttcccacag

SEQ ID NO: 450797 - DNA, 19 bp, Homo sapiens
tggctgggtcgcccctcct

SEQ ID NO: 450798 - DNA, 19 bp, Homo sapiens
tggctgggtttgggcagtg

SEQ ID NO: 450799 - DNA, 19 bp, Homo sapiens
tggcttcccgctcagccct

SEQ ID NO: 450800 - DNA, 21 bp, Homo sapiens
tggcttcccgctcagccctcc

SEQ ID NO: 450801 - DNA, 22 bp, Homo sapiens
tggcttcccgctcagccctccc

SEQ ID NO: 450802 - DNA, 12 bp, Homo sapiens
tggctttgtgct

SEQ ID NO: 450803 - DNA, 22 bp, Homo sapiens
tggcttttcactgctggctgcc

SEQ ID NO: 450804 - DNA, 16 bp, Homo sapiens
tgggaagaaaaaggaa

SEQ ID NO: 450805 - DNA, 18 bp, Homo sapiens
tgggaagaacagaattgc

SEQ ID NO: 450806 - DNA, 11 bp, Homo sapiens
tgggacagagg

SEQ ID NO: 450807 - DNA, 18 bp, Homo sapiens
tgggacagaggagcaagg

SEQ ID NO: 450808 - DNA, 19 bp, Homo sapiens
tgggacgctggtaactgtt

SEQ ID NO: 450809 - DNA, 20 bp, Homo sapiens
tgggacggaagtggcctgag

SEQ ID NO: 450810 - DNA, 22 bp, Homo sapiens
tgggacggaagtggcctgagaa

SEQ ID NO: 450811 - DNA, 12 bp, Homo sapiens
tgggactggccc

SEQ ID NO: 450812 - DNA, 15 bp, Homo sapiens
tgggagattggcttt

SEQ ID NO: 450813 - DNA, 18 bp, Homo sapiens
tgggagtccactttcctc

SEQ ID NO: 450814 - DNA, 21 bp, Homo sapiens
tgggcacgggagagcgccacc

SEQ ID NO: 450815 - DNA, 13 bp, Homo sapiens
tgggcagcaccct

SEQ ID NO: 450816 - DNA, 18 bp, Homo sapiens
tgggcagcaccctccccc

SEQ ID NO: 450817 - DNA, 12 bp, Homo sapiens
tgggcagggccg

SEQ ID NO: 450818 - DNA, 17 bp, Homo sapiens
tgggcagtggagagggg

SEQ ID NO: 450819 - DNA, 18 bp, Homo sapiens
tgggcagtggagagggga

SEQ ID NO: 450820 - DNA, 14 bp, Homo sapiens
tgggcccagccggg

SEQ ID NO: 450821 - DNA, 13 bp, Homo sapiens
tgggcccctccac

SEQ ID NO: 450822 - DNA, 21 bp, Homo sapiens
tgggcctcccgtccgtccgcc

SEQ ID NO: 450823 - DNA, 14 bp, Homo sapiens
tgggctccagagta

SEQ ID NO: 450824 - DNA, 21 bp, Homo sapiens
tgggctgcttcacatccaccc

SEQ ID NO: 450825 - DNA, 15 bp, Homo sapiens
tggggagggtgggcg

SEQ ID NO: 450826 - DNA, 16 bp, Homo sapiens
tggggcccatggcccc

SEQ ID NO: 450827 - DNA, 15 bp, Homo sapiens
tggggccctgggcct

SEQ ID NO: 450828 - DNA, 15 bp, Homo sapiens
tgggggtggcaggca

SEQ ID NO: 450829 - DNA, 19 bp, Homo sapiens
tgggggtggccatccctgg

SEQ ID NO: 450830 - DNA, 23 bp, Homo sapiens
tgggggtggccatccctgggccc

SEQ ID NO: 450831 - DNA, 17 bp, Homo sapiens
tggggtctctgagcagt

SEQ ID NO: 450832 - DNA, 22 bp, Homo sapiens
tgagctcaatctctgcaggatg

SEQ ID NO: 450833 - DNA, 13 bp, Homo sapiens
tgagctccaccct

SEQ ID NO: 450834 - DNA, 14 bp, Homo sapiens
tgagctccaccctc

SEQ ID NO: 450835 - DNA, 12 bp, Homo sapiens
tgagcttctcct

SEQ ID NO: 450836 - DNA, 20 bp, Homo sapiens
tgagcttctcctctgctcca

SEQ ID NO: 450837 - DNA, 15 bp, Homo sapiens
tgagcttgattctaa

SEQ ID NO: 450838 - DNA, 21 bp, Homo sapiens
tgagcttgattctaaagggga

SEQ ID NO: 450839 - DNA, 22 bp, Homo sapiens
tgagcttgattctaaaggggac

SEQ ID NO: 450840 - DNA, 19 bp, Homo sapiens
tgaggaccgccccaaccct

SEQ ID NO: 450841 - DNA, 14 bp, Homo sapiens
tgaggacctttctg

SEQ ID NO: 450842 - DNA, 18 bp, Homo sapiens
tgaggacggggcagagct

SEQ ID NO: 450843 - DNA, 14 bp, Homo sapiens
tgaggcccccggag

SEQ ID NO: 450844 - DNA, 16 bp, Homo sapiens
tgaggcccccggaggc

SEQ ID NO: 450845 - DNA, 23 bp, Homo sapiens
tgaggcccccggaggcgcccacc

SEQ ID NO: 450846 - DNA, 12 bp, Homo sapiens
tgagggaagccc

SEQ ID NO: 450847 - DNA, 18 bp, Homo sapiens
tgagggaagcccacccgc

SEQ ID NO: 450848 - DNA, 21 bp, Homo sapiens
tgagggaagcccacccgcccc

SEQ ID NO: 450849 - DNA, 22 bp, Homo sapiens
tgaggtacctttccacccagac

SEQ ID NO: 450850 - DNA, 15 bp, Homo sapiens
tgaggtctcaccttc

SEQ ID NO: 450851 - DNA, 18 bp, Homo sapiens
tgagtaaataaactcttc

SEQ ID NO: 450852 - DNA, 15 bp, Homo sapiens
tgagtccagctcccc

SEQ ID NO: 450853 - DNA, 18 bp, Homo sapiens
tgagtcccttccagtcat

SEQ ID NO: 450854 - DNA, 13 bp, Homo sapiens
tgagtctgtcctt

SEQ ID NO: 450855 - DNA, 18 bp, Homo sapiens
tgagtctgtcctttccca

SEQ ID NO: 450856 - DNA, 20 bp, Homo sapiens
tgagtttaaaaaaataacat

SEQ ID NO: 450857 - DNA, 16 bp, Homo sapiens
tgataaacattaaaca

SEQ ID NO: 450858 - DNA, 16 bp, Homo sapiens
tgatacactgtatcta

SEQ ID NO: 450859 - DNA, 20 bp, Homo sapiens
tgatacactgtatctaaaaa

SEQ ID NO: 450860 - DNA, 16 bp, Homo sapiens
tgatagcactggtttg

SEQ ID NO: 450861 - DNA, 17 bp, Homo sapiens
tgatatacagacctcca

SEQ ID NO: 450862 - DNA, 11 bp, Homo sapiens
tgatatgcatg

SEQ ID NO: 450863 - DNA, 18 bp, Homo sapiens
tgatcgatgttaaacgtc

SEQ ID NO: 450864 - DNA, 16 bp, Homo sapiens
tgatgattcaatcatt

SEQ ID NO: 450865 - DNA, 13 bp, Homo sapiens
tgatgggtcctgc

SEQ ID NO: 450866 - DNA, 13 bp, Homo sapiens
tgatgtggatgaa

SEQ ID NO: 450867 - DNA, 10 bp, Homo sapiens
tgatgttata

SEQ ID NO: 450868 - DNA, 12 bp, Homo sapiens
tgattcaatgtg

SEQ ID NO: 450869 - DNA, 14 bp, Homo sapiens
tgattcaatgtgaa

SEQ ID NO: 450870 - DNA, 13 bp, Homo sapiens
tgattccaaataa

SEQ ID NO: 450871 - DNA, 14 bp, Homo sapiens
tgattccaaataaa

SEQ ID NO: 450872 - DNA, 16 bp, Homo sapiens
tgattccaaataaaac

SEQ ID NO: 450873 - DNA, 13 bp, Homo sapiens
tgattctcctctc

SEQ ID NO: 450874 - DNA, 22 bp, Homo sapiens
tgattgaatctgattggacatt

SEQ ID NO: 450875 - DNA, 23 bp, Homo sapiens
tgattggcagcttcaaaacagaa

SEQ ID NO: 450876 - DNA, 20 bp, Homo sapiens
tgatttatgatcacttggaa

SEQ ID NO: 450877 - DNA, 19 bp, Homo sapiens
tgcaaaaggttaagccata

SEQ ID NO: 450878 - DNA, 17 bp, Homo sapiens
tgcaaatagtttcaaat

SEQ ID NO: 450879 - DNA, 13 bp, Homo sapiens
tgcaaattattct

SEQ ID NO: 450880 - DNA, 15 bp, Homo sapiens
tgcaaccttttatgt

SEQ ID NO: 450881 - DNA, 12 bp, Homo sapiens
tgcaataacagt

SEQ ID NO: 450882 - DNA, 21 bp, Homo sapiens
tgcaatatgaggggactgcat

SEQ ID NO: 450883 - DNA, 22 bp, Homo sapiens
tgcaatatgaggggactgcatg

SEQ ID NO: 450884 - DNA, 16 bp, Homo sapiens
tgcaatcttatgttga

SEQ ID NO: 450885 - DNA, 20 bp, Homo sapiens
tgcaatgttccgttcatctg

SEQ ID NO: 450886 - DNA, 15 bp, Homo sapiens
tgcacagtgcatctc

SEQ ID NO: 450887 - DNA, 20 bp, Homo sapiens
tgcacagtgcatctcagccc

SEQ ID NO: 450888 - DNA, 19 bp, Homo sapiens
tgcaccaacctcactgccc

SEQ ID NO: 450889 - DNA, 10 bp, Homo sapiens
tgcaccagga

SEQ ID NO: 450890 - DNA, 20 bp, Homo sapiens
tgcaccctctgctatgtctg

SEQ ID NO: 450891 - DNA, 14 bp, Homo sapiens
tgcaccttgggcac

SEQ ID NO: 450892 - DNA, 13 bp, Homo sapiens
tgcacttctgtta

SEQ ID NO: 450893 - DNA, 21 bp, Homo sapiens
tgcagaaatgtggatgctctt

SEQ ID NO: 450894 - DNA, 13 bp, Homo sapiens
tgcaggctgtgtt

SEQ ID NO: 450895 - DNA, 18 bp, Homo sapiens
tgcagtagagagcaaaga

SEQ ID NO: 450896 - DNA, 15 bp, Homo sapiens
tgcatacaataaaag

SEQ ID NO: 450897 - DNA, 17 bp, Homo sapiens
tgcatacaataaaagag

SEQ ID NO: 450898 - DNA, 18 bp, Homo sapiens
tgcatacaataaaagagc

SEQ ID NO: 450899 - DNA, 20 bp, Homo sapiens
tgcatacaataaaagagctt

SEQ ID NO: 450900 - DNA, 18 bp, Homo sapiens
tgcatacttcctggattt

SEQ ID NO: 450901 - DNA, 13 bp, Homo sapiens
tgcatagacaaag

SEQ ID NO: 450902 - DNA, 21 bp, Homo sapiens
tgcatatcctggtgtctagtt

SEQ ID NO: 450903 - DNA, 17 bp, Homo sapiens
tgcatcatgtctctttg

SEQ ID NO: 450904 - DNA, 14 bp, Homo sapiens
tgcatctcagccca

SEQ ID NO: 450905 - DNA, 23 bp, Homo sapiens
tgcatgcaactaattcaataaaa

SEQ ID NO: 450906 - DNA, 12 bp, Homo sapiens
tgcatgtagcat

SEQ ID NO: 450907 - DNA, 15 bp, Homo sapiens
tgcatgtagcatata

SEQ ID NO: 450908 - DNA, 16 bp, Homo sapiens
tgcatgtagcatataa

SEQ ID NO: 450909 - DNA, 18 bp, Homo sapiens
tgcatgtagcatataaat

SEQ ID NO: 450910 - DNA, 14 bp, Homo sapiens
tgcatttcctgaca

SEQ ID NO: 450911 - DNA, 17 bp, Homo sapiens
tgcatttgagagaagcc

SEQ ID NO: 450912 - DNA, 22 bp, Homo sapiens
tgcatttgagagaagccacgct

SEQ ID NO: 450913 - DNA, 21 bp, Homo sapiens
tgccaaaatgtcaatttttaa

SEQ ID NO: 450914 - DNA, 17 bp, Homo sapiens
tgccaaagatagcagaa

SEQ ID NO: 450915 - DNA, 12 bp, Homo sapiens
tgccacacttca

SEQ ID NO: 450916 - DNA, 13 bp, Homo sapiens
tgccacacttcag

SEQ ID NO: 450917 - DNA, 16 bp, Homo sapiens
tgccacacttcaggct

SEQ ID NO: 450918 - DNA, 21 bp, Homo sapiens
tgccatggatgattcttttcc

SEQ ID NO: 450919 - DNA, 14 bp, Homo sapiens
tgccattttgtctg

SEQ ID NO: 450920 - DNA, 14 bp, Homo sapiens
tgcccaccctgggc

SEQ ID NO: 450921 - DNA, 15 bp, Homo sapiens
tgcccaccctgggcc

SEQ ID NO: 450922 - DNA, 19 bp, Homo sapiens
tgcccaccctgggcctccc

SEQ ID NO: 450923 - DNA, 20 bp, Homo sapiens
tgcccaccctgggcctcccg

SEQ ID NO: 450924 - DNA, 16 bp, Homo sapiens
tgcccaggaaaataac

SEQ ID NO: 450925 - DNA, 11 bp, Homo sapiens
tgcccccagcg

SEQ ID NO: 450926 - DNA, 13 bp, Homo sapiens
tgccccccttccc

SEQ ID NO: 450927 - DNA, 15 bp, Homo sapiens
tgccccccttcccac

SEQ ID NO: 450928 - DNA, 20 bp, Homo sapiens
tgccccccttcccaccccta

SEQ ID NO: 450929 - DNA, 11 bp, Homo sapiens
tgccccctccc

SEQ ID NO: 450930 - DNA, 14 bp, Homo sapiens
tgccccctcccccg

SEQ ID NO: 450931 - DNA, 19 bp, Homo sapiens
tcttcaaccctgccctgca

SEQ ID NO: 450932 - DNA, 12 bp, Homo sapiens
tcttcaaggcca

SEQ ID NO: 450933 - DNA, 17 bp, Homo sapiens
tcttccaagttcattca

SEQ ID NO: 450934 - DNA, 14 bp, Homo sapiens
tcttcccccttccc

SEQ ID NO: 450935 - DNA, 14 bp, Homo sapiens
tcttcctcttacct

SEQ ID NO: 450936 - DNA, 19 bp, Homo sapiens
tcttccttttgtatcctcc

SEQ ID NO: 450937 - DNA, 13 bp, Homo sapiens
tcttctccactgg

SEQ ID NO: 450938 - DNA, 22 bp, Homo sapiens
tcttgagatgtattatgcaaag

SEQ ID NO: 450939 - DNA, 15 bp, Homo sapiens
tcttgagtgggcccc

SEQ ID NO: 450940 - DNA, 21 bp, Homo sapiens
tcttgagtgggccccctctct

SEQ ID NO: 450941 - DNA, 19 bp, Homo sapiens
tcttgatgaaacaaaaata

SEQ ID NO: 450942 - DNA, 20 bp, Homo sapiens
tcttgcggcaccgcccaccc

SEQ ID NO: 450943 - DNA, 21 bp, Homo sapiens
tcttgcggcaccgcccaccca

SEQ ID NO: 450944 - DNA, 16 bp, Homo sapiens
tctttaacatacatct

SEQ ID NO: 450945 - DNA, 21 bp, Homo sapiens
tctttagtgatgcaataaaca

SEQ ID NO: 450946 - DNA, 21 bp, Homo sapiens
tctttatgtaagaagaaactg

SEQ ID NO: 450947 - DNA, 13 bp, Homo sapiens
tctttctctctgt

SEQ ID NO: 450948 - DNA, 17 bp, Homo sapiens
tctttctctctgtgtgg

SEQ ID NO: 450949 - DNA, 16 bp, Homo sapiens
tctttgcattcgtcct

SEQ ID NO: 450950 - DNA, 15 bp, Homo sapiens
tctttggagagctca

SEQ ID NO: 450951 - DNA, 21 bp, Homo sapiens
tctttgggggattcaaatgca

SEQ ID NO: 450952 - DNA, 22 bp, Homo sapiens
tctttgggggattcaaatgcat

SEQ ID NO: 450953 - DNA, 23 bp, Homo sapiens
tctttgtgacaggaaagccctcc

SEQ ID NO: 450954 - DNA, 15 bp, Homo sapiens
tctttgtttacatga

SEQ ID NO: 450955 - DNA, 17 bp, Homo sapiens
tctttgtttacatgagt

SEQ ID NO: 450956 - DNA, 18 bp, Homo sapiens
tcttttcagcttgtttct

SEQ ID NO: 450957 - DNA, 16 bp, Homo sapiens
tcttttgaatcaatct

SEQ ID NO: 450958 - DNA, 17 bp, Homo sapiens
tcttttttttttcgtct

SEQ ID NO: 450959 - DNA, 15 bp, Homo sapiens
tgaaaagaaatgcta

SEQ ID NO: 450960 - DNA, 18 bp, Homo sapiens
tgaaagagaaaatgcttt

SEQ ID NO: 450961 - DNA, 14 bp, Homo sapiens
tgaaatccaaaata

SEQ ID NO: 450962 - DNA, 15 bp, Homo sapiens
tgaaatccaaaatag

SEQ ID NO: 450963 - DNA, 20 bp, Homo sapiens
tgaaatctacaacataatga

SEQ ID NO: 450964 - DNA, 18 bp, Homo sapiens
tgaacaagatttccctaa

SEQ ID NO: 450965 - DNA, 18 bp, Homo sapiens
tgaacatcttttaactgc

SEQ ID NO: 450966 - DNA, 15 bp, Homo sapiens
tgaaccgtcaatgtg

SEQ ID NO: 450967 - DNA, 13 bp, Homo sapiens
tgaagagcgctcc

SEQ ID NO: 450968 - DNA, 19 bp, Homo sapiens
tgaagagcgctcctctgcc

SEQ ID NO: 450969 - DNA, 20 bp, Homo sapiens
tgaagagcgctcctctgcct

SEQ ID NO: 450970 - DNA, 23 bp, Homo sapiens
tgaagataaatccaactctgact

SEQ ID NO: 450971 - DNA, 13 bp, Homo sapiens
tgaagcccaggag

SEQ ID NO: 450972 - DNA, 13 bp, Homo sapiens
tgaaggagaggag

SEQ ID NO: 450973 - DNA, 14 bp, Homo sapiens
tgaaggcctccatt

SEQ ID NO: 450974 - DNA, 15 bp, Homo sapiens
tgaagtcactgcaca

SEQ ID NO: 450975 - DNA, 19 bp, Homo sapiens
tgaagtcccttcctgtcct

SEQ ID NO: 450976 - DNA, 20 bp, Homo sapiens
tgaagtcccttcctgtcctg

SEQ ID NO: 450977 - DNA, 13 bp, Homo sapiens
tgaataacatagg

SEQ ID NO: 450978 - DNA, 14 bp, Homo sapiens
tgaataacataggt

SEQ ID NO: 450979 - DNA, 14 bp, Homo sapiens
tgaataataaccac

SEQ ID NO: 450980 - DNA, 22 bp, Homo sapiens
tgaataattatgtttacctcac

SEQ ID NO: 450981 - DNA, 13 bp, Homo sapiens
tgaatacactgga

SEQ ID NO: 450982 - DNA, 22 bp, Homo sapiens
tgaataggagttctcctggagc

SEQ ID NO: 450983 - DNA, 16 bp, Homo sapiens
tgaatatattttatct

SEQ ID NO: 450984 - DNA, 17 bp, Homo sapiens
tgaatcaatctggcttc

SEQ ID NO: 450985 - DNA, 18 bp, Homo sapiens
tgaatcaatctggcttct

SEQ ID NO: 450986 - DNA, 22 bp, Homo sapiens
tgaatcaatctggcttctgcat

SEQ ID NO: 450987 - DNA, 13 bp, Homo sapiens
tgaatccacctgc

SEQ ID NO: 450988 - DNA, 23 bp, Homo sapiens
tgaatctgattggacattttctt

SEQ ID NO: 450989 - DNA, 16 bp, Homo sapiens
tgaatgcaaaaagata

SEQ ID NO: 450990 - DNA, 17 bp, Homo sapiens
tgaatgtccccattcta

SEQ ID NO: 450991 - DNA, 19 bp, Homo sapiens
tgaatgtccccattctata

SEQ ID NO: 450992 - DNA, 16 bp, Homo sapiens
tgaatgttatatcatc

SEQ ID NO: 450993 - DNA, 22 bp, Homo sapiens
tgaattatccacatgaaaataa

SEQ ID NO: 450994 - DNA, 20 bp, Homo sapiens
tgaattgttatgtaaacatc

SEQ ID NO: 450995 - DNA, 18 bp, Homo sapiens
tgaattttaaaatgcaaa

SEQ ID NO: 450996 - DNA, 17 bp, Homo sapiens
tgacacataaatctgtc

SEQ ID NO: 450997 - DNA, 18 bp, Homo sapiens
tgacacataaatctgtct

SEQ ID NO: 450998 - DNA, 22 bp, Homo sapiens
tgacacataaatctgtctgatt

SEQ ID NO: 450999 - DNA, 14 bp, Homo sapiens
tgacagcctcctag

SEQ ID NO: 451000 - DNA, 18 bp, Homo sapiens
tgacaggaaagccctccc

SEQ ID NO: 451001 - DNA, 18 bp, Homo sapiens
tgacatgcacagtttgca

SEQ ID NO: 451002 - DNA, 13 bp, Homo sapiens
tgaccccacacgc

SEQ ID NO: 451003 - DNA, 21 bp, Homo sapiens
tgaccggcccgccaccttgta

SEQ ID NO: 451004 - DNA, 21 bp, Homo sapiens
tgacctctcacttttttataa

SEQ ID NO: 451005 - DNA, 17 bp, Homo sapiens
tgacgatcttccccctt

SEQ ID NO: 451006 - DNA, 17 bp, Homo sapiens
tgactataaaaactgcc

SEQ ID NO: 451007 - DNA, 15 bp, Homo sapiens
tgactccctgtgggg

SEQ ID NO: 451008 - DNA, 16 bp, Homo sapiens
tgactccctgtggggg

SEQ ID NO: 451009 - DNA, 16 bp, Homo sapiens
tgactgagaagatgtt

SEQ ID NO: 451010 - DNA, 22 bp, Homo sapiens
tgactgtactcctcccaggcgc

SEQ ID NO: 451011 - DNA, 16 bp, Homo sapiens
tgactgtcccaccggg

SEQ ID NO: 451012 - DNA, 20 bp, Homo sapiens
tgacttcagactctctcctc

SEQ ID NO: 451013 - DNA, 22 bp, Homo sapiens
tgacttcccagctggcagcgcc

SEQ ID NO: 451014 - DNA, 16 bp, Homo sapiens
tgactttttcagagtt

SEQ ID NO: 451015 - DNA, 20 bp, Homo sapiens
tgagaaatcatgttgttcga

SEQ ID NO: 451016 - DNA, 17 bp, Homo sapiens
tgagaaattgtgccaaa

SEQ ID NO: 451017 - DNA, 21 bp, Homo sapiens
tgagagcctttggtgaataac

SEQ ID NO: 451018 - DNA, 14 bp, Homo sapiens
tgagagtcatctca

SEQ ID NO: 451019 - DNA, 16 bp, Homo sapiens
tgagatcagcattcaa

SEQ ID NO: 451020 - DNA, 16 bp, Homo sapiens
tgagccacagtggggc

SEQ ID NO: 451021 - DNA, 19 bp, Homo sapiens
tgagccacagtggggccca

SEQ ID NO: 451022 - DNA, 17 bp, Homo sapiens
tgagcccctcctctcct

SEQ ID NO: 451023 - DNA, 17 bp, Homo sapiens
tgagccctgccctcact

SEQ ID NO: 451024 - DNA, 11 bp, Homo sapiens
tgagcctgtct

SEQ ID NO: 451025 - DNA, 13 bp, Homo sapiens
tgagcctgtctct

SEQ ID NO: 451026 - DNA, 18 bp, Homo sapiens
tgagctataatgtttccc

SEQ ID NO: 451027 - DNA, 16 bp, Homo sapiens
gcctcagccctcagaa

SEQ ID NO: 451028 - DNA, 22 bp, Homo sapiens
gcctcagttcaacctggtggca

SEQ ID NO: 451029 - DNA, 21 bp, Homo sapiens
gcctccaggctggggcctggc

SEQ ID NO: 451030 - DNA, 13 bp, Homo sapiens
gcctccatttgta

SEQ ID NO: 451031 - DNA, 15 bp, Homo sapiens
gcctcccccaggctg

SEQ ID NO: 451032 - DNA, 23 bp, Homo sapiens
gcctcccccaggctgcgcctgcc

SEQ ID NO: 451033 - DNA, 22 bp, Homo sapiens
gcctccccctcagatgatctct

SEQ ID NO: 451034 - DNA, 18 bp, Homo sapiens
gcctccccgggggtcccc

SEQ ID NO: 451035 - DNA, 15 bp, Homo sapiens
gcctcccgccgcctc

SEQ ID NO: 451036 - DNA, 16 bp, Homo sapiens
gcctcccgtccgtccg

SEQ ID NO: 451037 - DNA, 16 bp, Homo sapiens
gcctcctaggctccct

SEQ ID NO: 451038 - DNA, 18 bp, Homo sapiens
gcctcctaggctccctga

SEQ ID NO: 451039 - DNA, 11 bp, Homo sapiens
gcctcctggcc

SEQ ID NO: 451040 - DNA, 15 bp, Homo sapiens
gcctcctggccagac

SEQ ID NO: 451041 - DNA, 13 bp, Homo sapiens
gcctccttcttca

SEQ ID NO: 451042 - DNA, 17 bp, Homo sapiens
gcctcgagtccccccac

SEQ ID NO: 451043 - DNA, 15 bp, Homo sapiens
gcctcgggccgcctc

SEQ ID NO: 451044 - DNA, 17 bp, Homo sapiens
gcctcgggccgcctcct

SEQ ID NO: 451045 - DNA, 18 bp, Homo sapiens
gcctcgggccgcctcctc

SEQ ID NO: 451046 - DNA, 19 bp, Homo sapiens
gcctctccccgctctggat

SEQ ID NO: 451047 - DNA, 22 bp, Homo sapiens
gcctcttaacttaaaagaacat

SEQ ID NO: 451048 - DNA, 17 bp, Homo sapiens
gcctgagccacagtggg

SEQ ID NO: 451049 - DNA, 18 bp, Homo sapiens
gcctgagccacagtgggg

SEQ ID NO: 451050 - DNA, 14 bp, Homo sapiens
gcctgagggaagcc

SEQ ID NO: 451051 - DNA, 18 bp, Homo sapiens
gcctgagggaagcccacc

SEQ ID NO: 451052 - DNA, 20 bp, Homo sapiens
gcctgagggaagcccacccg

SEQ ID NO: 451053 - DNA, 12 bp, Homo sapiens
gcctgcaccagg

SEQ ID NO: 451054 - DNA, 14 bp, Homo sapiens
gcctgcaccaggag

SEQ ID NO: 451055 - DNA, 13 bp, Homo sapiens
gcctgcagcccag

SEQ ID NO: 451056 - DNA, 14 bp, Homo sapiens
gcctgccccccttc

SEQ ID NO: 451057 - DNA, 22 bp, Homo sapiens
gcctgccccccttcccacccct

SEQ ID NO: 451058 - DNA, 13 bp, Homo sapiens
gcctgcccgcccg

SEQ ID NO: 451059 - DNA, 14 bp, Homo sapiens
gcctgcgcgtgcgg

SEQ ID NO: 451060 - DNA, 16 bp, Homo sapiens
gcctgcgctcctctgc

SEQ ID NO: 451061 - DNA, 22 bp, Homo sapiens
gcctgcgctcctctgcagcctg

SEQ ID NO: 451062 - DNA, 12 bp, Homo sapiens
gcctggcagccg

SEQ ID NO: 451063 - DNA, 16 bp, Homo sapiens
gcctggcctatttaag

SEQ ID NO: 451064 - DNA, 17 bp, Homo sapiens
gcctggcgggcagcccc

SEQ ID NO: 451065 - DNA, 19 bp, Homo sapiens
gcctggcgggcagcccctg

SEQ ID NO: 451066 - DNA, 21 bp, Homo sapiens
gcctggcgggcagcccctgct

SEQ ID NO: 451067 - DNA, 22 bp, Homo sapiens
gcctggcgggcagcccctgctg

SEQ ID NO: 451068 - DNA, 23 bp, Homo sapiens
gcctggcgggcagcccctgctgg

SEQ ID NO: 451069 - DNA, 21 bp, Homo sapiens
gcctggtgcgctgtgctccag

SEQ ID NO: 451070 - DNA, 23 bp, Homo sapiens
gcctggtgcgctgtgctccagca

SEQ ID NO: 451071 - DNA, 23 bp, Homo sapiens
gccttaagaaagctatatatgaa

SEQ ID NO: 451072 - DNA, 17 bp, Homo sapiens
gccttagaacctttctt

SEQ ID NO: 451073 - DNA, 17 bp, Homo sapiens
gccttcaggttcctcct

SEQ ID NO: 451074 - DNA, 18 bp, Homo sapiens
gccttcgatacaccgggc

SEQ ID NO: 451075 - DNA, 15 bp, Homo sapiens
gccttggttcctcca

SEQ ID NO: 451076 - DNA, 16 bp, Homo sapiens
gccttggttcctccag

SEQ ID NO: 451077 - DNA, 18 bp, Homo sapiens
gcctttagcgtgtaaatg

SEQ ID NO: 451078 - DNA, 19 bp, Homo sapiens
gcctttgcgctctgggttt

SEQ ID NO: 451079 - DNA, 19 bp, Homo sapiens
gcgaggctttaagcgaggc

SEQ ID NO: 451080 - DNA, 14 bp, Homo sapiens
gcgcaccgcccaac

SEQ ID NO: 451081 - DNA, 23 bp, Homo sapiens
gcgcagccgcgctctgcccctcc

SEQ ID NO: 451082 - DNA, 18 bp, Homo sapiens
tgggggatgggccagggt

SEQ ID NO: 451083 - DNA, 16 bp, Homo sapiens
tgggggattcaaatgc

SEQ ID NO: 451084 - DNA, 18 bp, Homo sapiens
tgggggattcaaatgcat

SEQ ID NO: 451085 - DNA, 17 bp, Homo sapiens
tggggggccgggcaggt

SEQ ID NO: 451086 - DNA, 14 bp, Homo sapiens
tgggggtggcaggc

SEQ ID NO: 451087 - DNA, 14 bp, Homo sapiens
tgggggtggccatc

SEQ ID NO: 451088 - DNA, 21 bp, Homo sapiens
tgggggtggccatccctgggc

SEQ ID NO: 451089 - DNA, 12 bp, Homo sapiens
tgggggttttta

SEQ ID NO: 451090 - DNA, 20 bp, Homo sapiens
tggggtaagttgaagggaaa

SEQ ID NO: 451091 - DNA, 13 bp, Homo sapiens
tggggtagagagg

SEQ ID NO: 451092 - DNA, 14 bp, Homo sapiens
tggggtagagagga

SEQ ID NO: 451093 - DNA, 16 bp, Homo sapiens
tggggtagagaggaca

SEQ ID NO: 451094 - DNA, 15 bp, Homo sapiens
tggggtctctgagca

SEQ ID NO: 451095 - DNA, 22 bp, Homo sapiens
tggggtctctgagcagtgggga

SEQ ID NO: 451096 - DNA, 17 bp, Homo sapiens
tggggtgcctgagcccg

SEQ ID NO: 451097 - DNA, 17 bp, Homo sapiens
tggggtggggcttggaa

SEQ ID NO: 451098 - DNA, 19 bp, Homo sapiens
tggggtggggcttggaagg

SEQ ID NO: 451099 - DNA, 22 bp, Homo sapiens
tgggtattaaacttgtcagaat

SEQ ID NO: 451100 - DNA, 13 bp, Homo sapiens
tgggtcgcccctc

SEQ ID NO: 451101 - DNA, 22 bp, Homo sapiens
tgggtcttgttttttttttcca

SEQ ID NO: 451102 - DNA, 21 bp, Homo sapiens
tgggtttgggcagtggagagg

SEQ ID NO: 451103 - DNA, 22 bp, Homo sapiens
tggtaatttaagattccagaga

SEQ ID NO: 451104 - DNA, 18 bp, Homo sapiens
tggtatgctggccagcac

SEQ ID NO: 451105 - DNA, 19 bp, Homo sapiens
tggtatgctggccagcacc

SEQ ID NO: 451106 - DNA, 15 bp, Homo sapiens
tggtctggagcccct

SEQ ID NO: 451107 - DNA, 16 bp, Homo sapiens
tggtctggagccccta

SEQ ID NO: 451108 - DNA, 11 bp, Homo sapiens
tggtcttggag

SEQ ID NO: 451109 - DNA, 18 bp, Homo sapiens
tggtcttggagaggaggt

SEQ ID NO: 451110 - DNA, 13 bp, Homo sapiens
tggtgactgtccc

SEQ ID NO: 451111 - DNA, 14 bp, Homo sapiens
tggtgactgtccca

SEQ ID NO: 451112 - DNA, 19 bp, Homo sapiens
tggtgactgtcccaccggg

SEQ ID NO: 451113 - DNA, 12 bp, Homo sapiens
tggtgcagtgaa

SEQ ID NO: 451114 - DNA, 16 bp, Homo sapiens
tggtgcatttaaaatg

SEQ ID NO: 451115 - DNA, 18 bp, Homo sapiens
tggtgcatttaaaatgga

SEQ ID NO: 451116 - DNA, 16 bp, Homo sapiens
tggtggcaccagatgc

SEQ ID NO: 451117 - DNA, 19 bp, Homo sapiens
tggtggcccgacagcctgg

SEQ ID NO: 451118 - DNA, 14 bp, Homo sapiens
tggtggtttcagaa

SEQ ID NO: 451119 - DNA, 20 bp, Homo sapiens
tggtgtgaggcccccggagg

SEQ ID NO: 451120 - DNA, 15 bp, Homo sapiens
tggttacaaattttt

SEQ ID NO: 451121 - DNA, 12 bp, Homo sapiens
tggttacatgaa

SEQ ID NO: 451122 - DNA, 18 bp, Homo sapiens
tggttcccctgttcactc

SEQ ID NO: 451123 - DNA, 15 bp, Homo sapiens
tggttggaggcctgg

SEQ ID NO: 451124 - DNA, 23 bp, Homo sapiens
tggttggaggcctggtctggagc

SEQ ID NO: 451125 - DNA, 17 bp, Homo sapiens
tgtaaacatcataaata

SEQ ID NO: 451126 - DNA, 15 bp, Homo sapiens
tgtaaataatgctta

SEQ ID NO: 451127 - DNA, 20 bp, Homo sapiens
tgtaaatttaactgcatata

SEQ ID NO: 451128 - DNA, 17 bp, Homo sapiens
tgtaacagttggtgatt

SEQ ID NO: 451129 - DNA, 16 bp, Homo sapiens
tgtaagaagaaactgc

SEQ ID NO: 451130 - DNA, 16 bp, Homo sapiens
tgtaatagcctcacct

SEQ ID NO: 451131 - DNA, 20 bp, Homo sapiens
tgtaatcacactctcttctt

SEQ ID NO: 451132 - DNA, 23 bp, Homo sapiens
tgtaatcacactctcttcttact

SEQ ID NO: 451133 - DNA, 14 bp, Homo sapiens
tgtaatcttaaaag

SEQ ID NO: 451134 - DNA, 18 bp, Homo sapiens
tgtaatcttaaaagtgta

SEQ ID NO: 451135 - DNA, 24 bp, Homo sapiens
tgtacatttgatttgatatacaga

SEQ ID NO: 451136 - DNA, 17 bp, Homo sapiens
tgtaccgaaacaccccg

SEQ ID NO: 451137 - DNA, 12 bp, Homo sapiens
tgtactcctccc

SEQ ID NO: 451138 - DNA, 23 bp, Homo sapiens
tgtacttacactgaaatccaaaa

SEQ ID NO: 451139 - DNA, 18 bp, Homo sapiens
tgtagaaacacagcctat

SEQ ID NO: 451140 - DNA, 18 bp, Homo sapiens
tgtagcatttcttgatgt

SEQ ID NO: 451141 - DNA, 15 bp, Homo sapiens
tgtagctagaatatc

SEQ ID NO: 451142 - DNA, 18 bp, Homo sapiens
tgtagtggcaaaaaagaa

SEQ ID NO: 451143 - DNA, 19 bp, Homo sapiens
tgtagtggcaaaaaagaac

SEQ ID NO: 451144 - DNA, 20 bp, Homo sapiens
tgtagtggcaaaaaagaaca

SEQ ID NO: 451145 - DNA, 15 bp, Homo sapiens
tgtataaaaaagaaa

SEQ ID NO: 451146 - DNA, 21 bp, Homo sapiens
tgtataaaaaagaaaacttgt

SEQ ID NO: 451147 - DNA, 22 bp, Homo sapiens
tgtatatatttattattttcat

SEQ ID NO: 451148 - DNA, 23 bp, Homo sapiens
tgtatatatttattattttcata

SEQ ID NO: 451149 - DNA, 14 bp, Homo sapiens
tgtatatcagctct

SEQ ID NO: 451150 - DNA, 16 bp, Homo sapiens
tgtatatcagctctaa

SEQ ID NO: 451151 - DNA, 23 bp, Homo sapiens
tgtatatcagctctaaagcagag

SEQ ID NO: 451152 - DNA, 21 bp, Homo sapiens
tgtatccaagttatttgatct

SEQ ID NO: 451153 - DNA, 19 bp, Homo sapiens
tgtatcctccattgtatct

SEQ ID NO: 451154 - DNA, 14 bp, Homo sapiens
tgtatgcactttgt

SEQ ID NO: 451155 - DNA, 15 bp, Homo sapiens
tgtattatgcaaagt

SEQ ID NO: 451156 - DNA, 18 bp, Homo sapiens
gcatccaccgccacccca

SEQ ID NO: 451157 - DNA, 13 bp, Homo sapiens
gcatcccttggcc

SEQ ID NO: 451158 - DNA, 22 bp, Homo sapiens
gcatctctccccatatataaat

SEQ ID NO: 451159 - DNA, 17 bp, Homo sapiens
gcatctgagtccagctc

SEQ ID NO: 451160 - DNA, 18 bp, Homo sapiens
gcatctgagtccagctcc

SEQ ID NO: 451161 - DNA, 19 bp, Homo sapiens
gcatctgagtccagctccc

SEQ ID NO: 451162 - DNA, 13 bp, Homo sapiens
gcatgaagataaa

SEQ ID NO: 451163 - DNA, 12 bp, Homo sapiens
gcatgatattgt

SEQ ID NO: 451164 - DNA, 13 bp, Homo sapiens
gcatggccaggtg

SEQ ID NO: 451165 - DNA, 17 bp, Homo sapiens
gcatggccaggtggcca

SEQ ID NO: 451166 - DNA, 20 bp, Homo sapiens
gcatgtgattggcagcttca

SEQ ID NO: 451167 - DNA, 22 bp, Homo sapiens
gcatgtgattggcagcttcaaa

SEQ ID NO: 451168 - DNA, 13 bp, Homo sapiens
gcattctcactcc

SEQ ID NO: 451169 - DNA, 18 bp, Homo sapiens
gcattctcactcctacct

SEQ ID NO: 451170 - DNA, 19 bp, Homo sapiens
gcattctggggtggggctt

SEQ ID NO: 451171 - DNA, 22 bp, Homo sapiens
gcattctggggtggggcttgga

SEQ ID NO: 451172 - DNA, 18 bp, Homo sapiens
gcattggggggccgggca

SEQ ID NO: 451173 - DNA, 12 bp, Homo sapiens
gcatttaaaatg

SEQ ID NO: 451174 - DNA, 21 bp, Homo sapiens
gcatttcttgatgttgcttag

SEQ ID NO: 451175 - DNA, 20 bp, Homo sapiens
gccaaagaaactcagaagag

SEQ ID NO: 451176 - DNA, 15 bp, Homo sapiens
gccaaagatagcaga

SEQ ID NO: 451177 - DNA, 19 bp, Homo sapiens
gccaagccagggttccaga

SEQ ID NO: 451178 - DNA, 22 bp, Homo sapiens
gccaagccagggttccagacag

SEQ ID NO: 451179 - DNA, 22 bp, Homo sapiens
gccaatttcaaagaaaacagac

SEQ ID NO: 451180 - DNA, 15 bp, Homo sapiens
gccacagtggggccc

SEQ ID NO: 451181 - DNA, 16 bp, Homo sapiens
gccacagtggggccca

SEQ ID NO: 451182 - DNA, 20 bp, Homo sapiens
gccacagtggggcccatggc

SEQ ID NO: 451183 - DNA, 12 bp, Homo sapiens
gccaccccactg

SEQ ID NO: 451184 - DNA, 21 bp, Homo sapiens
gccaccccactgagagctgct

SEQ ID NO: 451185 - DNA, 17 bp, Homo sapiens
gccacccgcccgccccc

SEQ ID NO: 451186 - DNA, 13 bp, Homo sapiens
gccacccttggcc

SEQ ID NO: 451187 - DNA, 19 bp, Homo sapiens
gccaccttgtacagaacca

SEQ ID NO: 451188 - DNA, 18 bp, Homo sapiens
gccacgctgtcctctcga

SEQ ID NO: 451189 - DNA, 21 bp, Homo sapiens
gccacgctgtcctctcgagcc

SEQ ID NO: 451190 - DNA, 18 bp, Homo sapiens
gccacgttgcagaaaaag

SEQ ID NO: 451191 - DNA, 19 bp, Homo sapiens
gccactccagacccctggc

SEQ ID NO: 451192 - DNA, 20 bp, Homo sapiens
gccactccagacccctggct

SEQ ID NO: 451193 - DNA, 21 bp, Homo sapiens
gccactccagacccctggctt

SEQ ID NO: 451194 - DNA, 22 bp, Homo sapiens
gccactccagacccctggcttt

SEQ ID NO: 451195 - DNA, 17 bp, Homo sapiens
gccagacagagatcaga

SEQ ID NO: 451196 - DNA, 19 bp, Homo sapiens
gccagacgctgccgctgcc

SEQ ID NO: 451197 - DNA, 17 bp, Homo sapiens
gccagcaccctctcctg

SEQ ID NO: 451198 - DNA, 19 bp, Homo sapiens
gccagcaccctctcctggg

SEQ ID NO: 451199 - DNA, 15 bp, Homo sapiens
gccagccgccctggg

SEQ ID NO: 451200 - DNA, 16 bp, Homo sapiens
gccagccgccctgggc

SEQ ID NO: 451201 - DNA, 18 bp, Homo sapiens
gccagccgccctgggctg

SEQ ID NO: 451202 - DNA, 11 bp, Homo sapiens
gccaggagacc

SEQ ID NO: 451203 - DNA, 17 bp, Homo sapiens
gccaggagaccctgtct

SEQ ID NO: 451204 - DNA, 13 bp, Homo sapiens
gccagggcgcact

SEQ ID NO: 451205 - DNA, 13 bp, Homo sapiens
gccagggttccag

SEQ ID NO: 451206 - DNA, 13 bp, Homo sapiens
gccatccctgggc

SEQ ID NO: 451207 - DNA, 14 bp, Homo sapiens
gccatccctgggcc

SEQ ID NO: 451208 - DNA, 21 bp, Homo sapiens
gccatccctgggcccctccac

SEQ ID NO: 451209 - DNA, 11 bp, Homo sapiens
gccatgctctt

SEQ ID NO: 451210 - DNA, 22 bp, Homo sapiens
gccattcatttacaacttccag

SEQ ID NO: 451211 - DNA, 20 bp, Homo sapiens
gccattttgtctggctgtgg

SEQ ID NO: 451212 - DNA, 21 bp, Homo sapiens
gcccaaataacagtggcaagc

SEQ ID NO: 451213 - DNA, 16 bp, Homo sapiens
gcccaacccccacctc

SEQ ID NO: 451214 - DNA, 19 bp, Homo sapiens
gcccaacccccacctcccg

SEQ ID NO: 451215 - DNA, 21 bp, Homo sapiens
gcccacaataatgaataatca

SEQ ID NO: 451216 - DNA, 20 bp, Homo sapiens
gcccacatagtgatggttcc

SEQ ID NO: 451217 - DNA, 17 bp, Homo sapiens
gcccacccacaccccgt

SEQ ID NO: 451218 - DNA, 21 bp, Homo sapiens
gcccacccacaccccgtctgc

SEQ ID NO: 451219 - DNA, 19 bp, Homo sapiens
gcccaccccgctgcctggc

SEQ ID NO: 451220 - DNA, 20 bp, Homo sapiens
gcccaccccgctgcctggcg

SEQ ID NO: 451221 - DNA, 22 bp, Homo sapiens
tgtcccaccgggagcctccccc

SEQ ID NO: 451222 - DNA, 14 bp, Homo sapiens
tgtccccattctat

SEQ ID NO: 451223 - DNA, 22 bp, Homo sapiens
tgtccccattctataaattcaa

SEQ ID NO: 451224 - DNA, 16 bp, Homo sapiens
tgtcctctcgagccca

SEQ ID NO: 451225 - DNA, 12 bp, Homo sapiens
tgtcctgctcac

SEQ ID NO: 451226 - DNA, 17 bp, Homo sapiens
tgtcctgctcacgtctg

SEQ ID NO: 451227 - DNA, 21 bp, Homo sapiens
tgtcctgctcacgtctgtgag

SEQ ID NO: 451228 - DNA, 21 bp, Homo sapiens
tgtcgccccaggccctccctg

SEQ ID NO: 451229 - DNA, 16 bp, Homo sapiens
tgtctagtttgcatac

SEQ ID NO: 451230 - DNA, 17 bp, Homo sapiens
tgtctcaagagggcact

SEQ ID NO: 451231 - DNA, 18 bp, Homo sapiens
tgtctcaagagggcactg

SEQ ID NO: 451232 - DNA, 23 bp, Homo sapiens
tgtctcaagagggcactggtggc

SEQ ID NO: 451233 - DNA, 19 bp, Homo sapiens
tgtctctccctaccctctt

SEQ ID NO: 451234 - DNA, 14 bp, Homo sapiens
tgtctctttgccaa

SEQ ID NO: 451235 - DNA, 19 bp, Homo sapiens
tgtctgagccctgccctca

SEQ ID NO: 451236 - DNA, 13 bp, Homo sapiens
tgtctgattctat

SEQ ID NO: 451237 - DNA, 23 bp, Homo sapiens
tgtctgtaatcacactctcttct

SEQ ID NO: 451238 - DNA, 24 bp, Homo sapiens
tgtctgtcaccagctatctgtcat

SEQ ID NO: 451239 - DNA, 18 bp, Homo sapiens
tgtcttcaaccctgccct

SEQ ID NO: 451240 - DNA, 19 bp, Homo sapiens
tgtcttcaaccctgccctg

SEQ ID NO: 451241 - DNA, 20 bp, Homo sapiens
tgtcttcaaccctgccctgc

SEQ ID NO: 451242 - DNA, 21 bp, Homo sapiens
tgtcttcaaccctgccctgca

SEQ ID NO: 451243 - DNA, 22 bp, Homo sapiens
tgtcttcaaccctgccctgcac

SEQ ID NO: 451244 - DNA, 18 bp, Homo sapiens
tgtgaaatttacagttac

SEQ ID NO: 451245 - DNA, 16 bp, Homo sapiens
tgtgaagcctttatct

SEQ ID NO: 451246 - DNA, 20 bp, Homo sapiens
tgtgaattttaaaatgcaaa

SEQ ID NO: 451247 - DNA, 21 bp, Homo sapiens
tgtgaattttaaaatgcaaat

SEQ ID NO: 451248 - DNA, 19 bp, Homo sapiens
tgtgacaggaaagccctcc

SEQ ID NO: 451249 - DNA, 23 bp, Homo sapiens
tgtgacaggaaagccctccccct

SEQ ID NO: 451250 - DNA, 16 bp, Homo sapiens
tgtgatcgtgtgttgc

SEQ ID NO: 451251 - DNA, 16 bp, Homo sapiens
tgtgatgatagcactg

SEQ ID NO: 451252 - DNA, 21 bp, Homo sapiens
tgtgatgatagcactggtttg

SEQ ID NO: 451253 - DNA, 22 bp, Homo sapiens
tgtgattggcagcttcaaaaca

SEQ ID NO: 451254 - DNA, 17 bp, Homo sapiens
tgtgcctgcaccaggag

SEQ ID NO: 451255 - DNA, 22 bp, Homo sapiens
tgtgctccagcagtgctgggcc

SEQ ID NO: 451256 - DNA, 23 bp, Homo sapiens
tgtgctccagcagtgctgggccc

SEQ ID NO: 451257 - DNA, 11 bp, Homo sapiens
tgtgctgctgc

SEQ ID NO: 451258 - DNA, 12 bp, Homo sapiens
tgtgctgtgggc

SEQ ID NO: 451259 - DNA, 13 bp, Homo sapiens
tgtgctgtgggca

SEQ ID NO: 451260 - DNA, 12 bp, Homo sapiens
tgtgctttcatg

SEQ ID NO: 451261 - DNA, 18 bp, Homo sapiens
tgtgcttttccatctaaa

SEQ ID NO: 451262 - DNA, 15 bp, Homo sapiens
tgtggaaaaaatatt

SEQ ID NO: 451263 - DNA, 10 bp, Homo sapiens
tgtggacttt

SEQ ID NO: 451264 - DNA, 22 bp, Homo sapiens
tgtggactttatttaatttcat

SEQ ID NO: 451265 - DNA, 14 bp, Homo sapiens
tgtggagtggaggg

SEQ ID NO: 451266 - DNA, 16 bp, Homo sapiens
tgtggagtggaggggt

SEQ ID NO: 451267 - DNA, 13 bp, Homo sapiens
tgtggattctata

SEQ ID NO: 451268 - DNA, 23 bp, Homo sapiens
tgtggcaaaatgttacagaatct

SEQ ID NO: 451269 - DNA, 14 bp, Homo sapiens
tgtggcaaacattt

SEQ ID NO: 451270 - DNA, 19 bp, Homo sapiens
tgtggcccctccttctccc

SEQ ID NO: 451271 - DNA, 11 bp, Homo sapiens
tgtggcctcag

SEQ ID NO: 451272 - DNA, 13 bp, Homo sapiens
tgtggcctcagcc

SEQ ID NO: 451273 - DNA, 14 bp, Homo sapiens
tgtggcttggaaca

SEQ ID NO: 451274 - DNA, 13 bp, Homo sapiens
tgtggctttatga

SEQ ID NO: 451275 - DNA, 18 bp, Homo sapiens
tgtgggactggcccaccc

SEQ ID NO: 451276 - DNA, 19 bp, Homo sapiens
tgtgggcagcaccctcccc

SEQ ID NO: 451277 - DNA, 16 bp, Homo sapiens
tgtgggggtggccatc

SEQ ID NO: 451278 - DNA, 21 bp, Homo sapiens
tgtgggggtggccatccctgg

SEQ ID NO: 451279 - DNA, 19 bp, Homo sapiens
tgtgggtttactctgtgct

SEQ ID NO: 451280 - DNA, 13 bp, Homo sapiens
tgtgtattctgtg

SEQ ID NO: 451281 - DNA, 21 bp, Homo sapiens
tgtgtattctgtggattctat

SEQ ID NO: 451282 - DNA, 23 bp, Homo sapiens
tgtgtctccagctgattttaact

SEQ ID NO: 451283 - DNA, 16 bp, Homo sapiens
tgtgtgattgaatctg

SEQ ID NO: 451284 - DNA, 23 bp, Homo sapiens
tgtgtgcaatgttccgttcatct

SEQ ID NO: 451285 - DNA, 17 bp, Homo sapiens
tgtgtggcaaacattta

SEQ ID NO: 451286 - DNA, 21 bp, Homo sapiens
tgtgtggcaaacatttaaaaa

SEQ ID NO: 451287 - DNA, 18 bp, Homo sapiens
tgtgttgcaaattattct

SEQ ID NO: 451288 - DNA, 18 bp, Homo sapiens
tgttaaacgtcacagcag

SEQ ID NO: 451289 - DNA, 15 bp, Homo sapiens
tgttaccttcacatg

SEQ ID NO: 451290 - DNA, 11 bp, Homo sapiens
tgttagaatta

SEQ ID NO: 451291 - DNA, 22 bp, Homo sapiens
tgttattgggcaagtgattgaa

SEQ ID NO: 451292 - DNA, 20 bp, Homo sapiens
tgttcaaagaacccccctcc

SEQ ID NO: 451293 - DNA, 23 bp, Homo sapiens
tgttcaaagaacccccctcccca

SEQ ID NO: 451294 - DNA, 15 bp, Homo sapiens
tgttcaaatgcattt

SEQ ID NO: 451295 - DNA, 10 bp, Homo sapiens
tgttccaagt

SEQ ID NO: 451296 - DNA, 16 bp, Homo sapiens
tgttccaagtgtgtgt

SEQ ID NO: 451297 - DNA, 23 bp, Homo sapiens
tgttctccgggtgtggcctcagc

SEQ ID NO: 451298 - DNA, 11 bp, Homo sapiens
tgtttcttggt

SEQ ID NO: 451299 - DNA, 14 bp, Homo sapiens
tgttttatgtcata

SEQ ID NO: 451300 - DNA, 22 bp, Homo sapiens
tgtttttatatattataagttg

SEQ ID NO: 451301 - DNA, 18 bp, Homo sapiens
tgttttttttttccactt

SEQ ID NO: 451302 - DNA, 22 bp, Homo sapiens
ttaaaaaaataacatctgaaaa

SEQ ID NO: 451303 - DNA, 11 bp, Homo sapiens
ttaaaaaataa

SEQ ID NO: 451304 - DNA, 19 bp, Homo sapiens
ttaaaaaataacatattct

SEQ ID NO: 451305 - DNA, 14 bp, Homo sapiens
ttaaacactgtaat

SEQ ID NO: 451306 - DNA, 15 bp, Homo sapiens
ttaaacactgtaatc

SEQ ID NO: 451307 - DNA, 17 bp, Homo sapiens
ttaaacactgtaatctt

SEQ ID NO: 451308 - DNA, 16 bp, Homo sapiens
ttaaacctgtgctttc

SEQ ID NO: 451309 - DNA, 20 bp, Homo sapiens
ttaaacctgtgctttcatgt

SEQ ID NO: 451310 - DNA, 13 bp, Homo sapiens
ttaaacttcagca

SEQ ID NO: 451311 - DNA, 16 bp, Homo sapiens
ttaaacttgtcagaat

SEQ ID NO: 451312 - DNA, 17 bp, Homo sapiens
ttaaaggaaagttctat

SEQ ID NO: 451313 - DNA, 15 bp, Homo sapiens
ttaaagtacctgtag

SEQ ID NO: 451314 - DNA, 16 bp, Homo sapiens
ttaaatgattccaaat

SEQ ID NO: 451315 - DNA, 22 bp, Homo sapiens
ttaaattatatgatatgcatgt

SEQ ID NO: 451316 - DNA, 21 bp, Homo sapiens
ttaacaaacgtaatttgttat

SEQ ID NO: 451317 - DNA, 19 bp, Homo sapiens
ttaacctttccgctgtcgc

SEQ ID NO: 451318 - DNA, 21 bp, Homo sapiens
ttaacttaaaagaacatagga

SEQ ID NO: 451319 - DNA, 15 bp, Homo sapiens
ttaacttatctccag

SEQ ID NO: 451320 - DNA, 20 bp, Homo sapiens
ttaactttttctaagctgtt

SEQ ID NO: 451321 - DNA, 14 bp, Homo sapiens
ttaagaaagctata

SEQ ID NO: 451322 - DNA, 14 bp, Homo sapiens
ttaagaaatgagaa

SEQ ID NO: 451323 - DNA, 13 bp, Homo sapiens
ttaagccccctct

SEQ ID NO: 451324 - DNA, 17 bp, Homo sapiens
ttaaggacttctgcagc

SEQ ID NO: 451325 - DNA, 12 bp, Homo sapiens
ttaatctctaaa

SEQ ID NO: 451326 - DNA, 15 bp, Homo sapiens
ttaatctctaaaatt

SEQ ID NO: 451327 - DNA, 17 bp, Homo sapiens
ttaatctctaaaattct

SEQ ID NO: 451328 - DNA, 21 bp, Homo sapiens
ttaattacttttgaaaaagga

SEQ ID NO: 451329 - DNA, 15 bp, Homo sapiens
ttaatttcataaatt

SEQ ID NO: 451330 - DNA, 16 bp, Homo sapiens
ttacaaatttttactc

SEQ ID NO: 451331 - DNA, 19 bp, Homo sapiens
ttacaaatttttactcagg

SEQ ID NO: 451332 - DNA, 13 bp, Homo sapiens
ttacaacttccag

SEQ ID NO: 451333 - DNA, 21 bp, Homo sapiens
ttacactgaaatccaaaatag

SEQ ID NO: 451334 - DNA, 19 bp, Homo sapiens
ttacagaatctaactggtg

SEQ ID NO: 451335 - DNA, 14 bp, Homo sapiens
ttacatcctctgct

SEQ ID NO: 451336 - DNA, 19 bp, Homo sapiens
ttacatgagttcaaatact

SEQ ID NO: 451337 - DNA, 21 bp, Homo sapiens
ttacccagtgggacagaggag

SEQ ID NO: 451338 - DNA, 15 bp, Homo sapiens
ttaccctccctgtcc

SEQ ID NO: 451339 - DNA, 16 bp, Homo sapiens
ttaccctccctgtccc

SEQ ID NO: 451340 - DNA, 19 bp, Homo sapiens
ttaccctccctgtcccctg

SEQ ID NO: 451341 - DNA, 14 bp, Homo sapiens
ttaccctttctttt

SEQ ID NO: 451342 - DNA, 21 bp, Homo sapiens
ttacctgtaatagcctcacct

SEQ ID NO: 451343 - DNA, 22 bp, Homo sapiens
ttacctgtaatagcctcacctt

SEQ ID NO: 451344 - DNA, 23 bp, Homo sapiens
ttaccttcacatgtcctattact

SEQ ID NO: 451345 - DNA, 23 bp, Homo sapiens
ttactacataattaaattttaat

SEQ ID NO: 451346 - DNA, 16 bp, Homo sapiens
ttactattaactctgc

SEQ ID NO: 451347 - DNA, 17 bp, Homo sapiens
ttactattaactctgca

SEQ ID NO: 451348 - DNA, 23 bp, Homo sapiens
ttactattaactctgcatagaca

SEQ ID NO: 451349 - DNA, 23 bp, Homo sapiens
ttagcccggccaaggacactgat

SEQ ID NO: 451350 - DNA, 15 bp, Homo sapiens
ttagcgttctgtttc

SEQ ID NO: 451351 - DNA, 17 bp, Homo sapiens
ttagtttaccaatcaac

SEQ ID NO: 451352 - DNA, 16 bp, Homo sapiens
ttataaattataatgc

SEQ ID NO: 451353 - DNA, 14 bp, Homo sapiens
ttatagtctgtact

SEQ ID NO: 451354 - DNA, 16 bp, Homo sapiens
ttatagtctgtacttc

SEQ ID NO: 451355 - DNA, 18 bp, Homo sapiens
ttatagtctgtacttcag

SEQ ID NO: 451356 - DNA, 19 bp, Homo sapiens
ttatatacaaagctgtcac

SEQ ID NO: 451357 - DNA, 13 bp, Homo sapiens
ttatatataaata

SEQ ID NO: 451358 - DNA, 14 bp, Homo sapiens
ttatatctgtaaat

SEQ ID NO: 451359 - DNA, 18 bp, Homo sapiens
ttatccacatgaaaataa

SEQ ID NO: 451360 - DNA, 15 bp, Homo sapiens
ttatccttttatctc

SEQ ID NO: 451361 - DNA, 23 bp, Homo sapiens
ttatctagcaagaagattctaaa

SEQ ID NO: 451362 - DNA, 21 bp, Homo sapiens
ttatctccagccaatttcaaa

SEQ ID NO: 451363 - DNA, 13 bp, Homo sapiens
ttatctcttcttc

SEQ ID NO: 451364 - DNA, 16 bp, Homo sapiens
ttatctctttctctct

SEQ ID NO: 451365 - DNA, 18 bp, Homo sapiens
ttatctctttctctcttt

SEQ ID NO: 451366 - DNA, 20 bp, Homo sapiens
ttatctgtctgagccctgcc

SEQ ID NO: 451367 - DNA, 14 bp, Homo sapiens
ttatgagctgtgag

SEQ ID NO: 451368 - DNA, 22 bp, Homo sapiens
ttatgccagggcgcactttcca

SEQ ID NO: 451369 - DNA, 14 bp, Homo sapiens
ttatgctgagtatg

SEQ ID NO: 451370 - DNA, 12 bp, Homo sapiens
ttatgctgctgt

SEQ ID NO: 451371 - DNA, 15 bp, Homo sapiens
ttatggtgatactcc

SEQ ID NO: 451372 - DNA, 13 bp, Homo sapiens
ttatgtcatactc

SEQ ID NO: 451373 - DNA, 16 bp, Homo sapiens
ttattaaaatactgtt

SEQ ID NO: 451374 - DNA, 14 bp, Homo sapiens
ttattaaacttcag

SEQ ID NO: 451375 - DNA, 17 bp, Homo sapiens
ttattaaacttcagcaa

SEQ ID NO: 451376 - DNA, 21 bp, Homo sapiens
ttattactttaaattatatga

SEQ ID NO: 451377 - DNA, 14 bp, Homo sapiens
ttattatagtctgt

SEQ ID NO: 451378 - DNA, 15 bp, Homo sapiens
ttattatagtctgta

SEQ ID NO: 451379 - DNA, 20 bp, Homo sapiens
ttattctagtcaactgctgt

SEQ ID NO: 451380 - DNA, 14 bp, Homo sapiens
ttattcttccaagt

SEQ ID NO: 451381 - DNA, 13 bp, Homo sapiens
ttattttctgaat

SEQ ID NO: 451382 - DNA, 12 bp, Homo sapiens
ttcaaaatactt

SEQ ID NO: 451383 - DNA, 17 bp, Homo sapiens
ttcaaaatagttctatt

SEQ ID NO: 451384 - DNA, 21 bp, Homo sapiens
ttcaaaatagttctatttcta

SEQ ID NO: 451385 - DNA, 12 bp, Homo sapiens
ttcaaaatgcat

SEQ ID NO: 451386 - DNA, 14 bp, Homo sapiens
ttcaaaatgcatgt

SEQ ID NO: 451387 - DNA, 19 bp, Homo sapiens
ttcaaagaacccccctccc

SEQ ID NO: 451388 - DNA, 13 bp, Homo sapiens
ttcaaatactttt

SEQ ID NO: 451389 - DNA, 16 bp, Homo sapiens
ttcaaatgcatgatat

SEQ ID NO: 451390 - DNA, 13 bp, Homo sapiens
ttcaaatgcattt

SEQ ID NO: 451391 - DNA, 14 bp, Homo sapiens
ttcaaatgcatttt

SEQ ID NO: 451392 - DNA, 11 bp, Homo sapiens
ttcaacaaatg

SEQ ID NO: 451393 - DNA, 13 bp, Homo sapiens
ttcaacaaatgat

SEQ ID NO: 451394 - DNA, 17 bp, Homo sapiens
ttcaaccattccccatg

SEQ ID NO: 451395 - DNA, 14 bp, Homo sapiens
ttcaaccctgccct

SEQ ID NO: 451396 - DNA, 16 bp, Homo sapiens
ttcaacgcagccctgc

SEQ ID NO: 451397 - DNA, 20 bp, Homo sapiens
ttcaacgcagccctgctttg

SEQ ID NO: 451398 - DNA, 11 bp, Homo sapiens
ttcaaggccaa

SEQ ID NO: 451399 - DNA, 22 bp, Homo sapiens
ttcaagtcatggggagattcct

SEQ ID NO: 451400 - DNA, 17 bp, Homo sapiens
ttcaatgacctgtattt

SEQ ID NO: 451401 - DNA, 18 bp, Homo sapiens
ttcaatgcatacaataaa

SEQ ID NO: 451402 - DNA, 17 bp, Homo sapiens
ttcaatgtactgtattg

SEQ ID NO: 451403 - DNA, 16 bp, Homo sapiens
ttcaatgtgaatttta

SEQ ID NO: 451404 - DNA, 21 bp, Homo sapiens
ttcaattgcttctgtgcaata

SEQ ID NO: 451405 - DNA, 22 bp, Homo sapiens
ttcaccagtttccaagtttatt

SEQ ID NO: 451406 - DNA, 15 bp, Homo sapiens
ttcactgctggctgc

SEQ ID NO: 451407 - DNA, 17 bp, Homo sapiens
ttcactgctggctgcct

SEQ ID NO: 451408 - DNA, 18 bp, Homo sapiens
ttcacttaaactttgtca

SEQ ID NO: 451409 - DNA, 22 bp, Homo sapiens
ttcagaaagggcagcccctccc

SEQ ID NO: 451410 - DNA, 15 bp, Homo sapiens
ttcagagttctctgt

SEQ ID NO: 451411 - DNA, 21 bp, Homo sapiens
ttcagcaaccctacagtatat

SEQ ID NO: 451412 - DNA, 19 bp, Homo sapiens
ttcagctgtttcgcatcca

SEQ ID NO: 451413 - DNA, 15 bp, Homo sapiens
ttcagcttgtttcta

SEQ ID NO: 451414 - DNA, 15 bp, Homo sapiens
ttcaggctcttctcc

SEQ ID NO: 451415 - DNA, 17 bp, Homo sapiens
ttcaggttcctcctagg

SEQ ID NO: 451416 - DNA, 14 bp, Homo sapiens
ttcagtgttttgct

SEQ ID NO: 451417 - DNA, 19 bp, Homo sapiens
ttcataaacaacttaatgt

SEQ ID NO: 451418 - DNA, 13 bp, Homo sapiens
ttcataaattggc

SEQ ID NO: 451419 - DNA, 18 bp, Homo sapiens
ttcataaattggctcctt

SEQ ID NO: 451420 - DNA, 22 bp, Homo sapiens
ttcataaattggctcctttccc

SEQ ID NO: 451421 - DNA, 14 bp, Homo sapiens
ttcataataaaagg

SEQ ID NO: 451422 - DNA, 14 bp, Homo sapiens
ttcatacattccta

SEQ ID NO: 451423 - DNA, 17 bp, Homo sapiens
ttcatagcatcctgatt

SEQ ID NO: 451424 - DNA, 13 bp, Homo sapiens
ttcatataatttg

SEQ ID NO: 451425 - DNA, 15 bp, Homo sapiens
ttcatattgagatca

SEQ ID NO: 451426 - DNA, 16 bp, Homo sapiens
ttcatccaactggaag

SEQ ID NO: 451427 - DNA, 18 bp, Homo sapiens
ttcatccatagacacagt

SEQ ID NO: 451428 - DNA, 15 bp, Homo sapiens
ttcatgggagaacct

SEQ ID NO: 451429 - DNA, 20 bp, Homo sapiens
ttcatgtccagagctcattt

SEQ ID NO: 451430 - DNA, 23 bp, Homo sapiens
ttcatgtgttgcaaattattcta

SEQ ID NO: 451431 - DNA, 16 bp, Homo sapiens
ttcatgtttaagaaat

SEQ ID NO: 451432 - DNA, 13 bp, Homo sapiens
ttccaaataaaac

SEQ ID NO: 451433 - DNA, 22 bp, Homo sapiens
ttccaaataaaacttgagccca

SEQ ID NO: 451434 - DNA, 17 bp, Homo sapiens
ttccaagtgtgtgtgca

SEQ ID NO: 451435 - DNA, 18 bp, Homo sapiens
ttccaagtgtgtgtgcaa

SEQ ID NO: 451436 - DNA, 22 bp, Homo sapiens
ttccaccaggattaatctctaa

SEQ ID NO: 451437 - DNA, 18 bp, Homo sapiens
ttccacccagaccctcct

SEQ ID NO: 451438 - DNA, 20 bp, Homo sapiens
ttccacccagaccctccttc

SEQ ID NO: 451439 - DNA, 22 bp, Homo sapiens
ttccacccagaccctccttccc

SEQ ID NO: 451440 - DNA, 21 bp, Homo sapiens
ttccacttagaaattgcattt

SEQ ID NO: 451441 - DNA, 18 bp, Homo sapiens
ttccagagagtggctcct

SEQ ID NO: 451442 - DNA, 20 bp, Homo sapiens
ttccagagagtggctcctcc

SEQ ID NO: 451443 - DNA, 14 bp, Homo sapiens
ttccattttggaaa

SEQ ID NO: 451444 - DNA, 13 bp, Homo sapiens
ttcccagctggca

SEQ ID NO: 451445 - DNA, 18 bp, Homo sapiens
ttcccagctggcagcgcc

SEQ ID NO: 451446 - DNA, 22 bp, Homo sapiens
ttcccagctggcagcgcctccc

SEQ ID NO: 451447 - DNA, 12 bp, Homo sapiens
ttccccacccca

SEQ ID NO: 451448 - DNA, 21 bp, Homo sapiens
ttccccaccccataagccctg

SEQ ID NO: 451449 - DNA, 21 bp, Homo sapiens
ttccccagaccgatccttccc

SEQ ID NO: 451450 - DNA, 12 bp, Homo sapiens
ttcccccttccc

SEQ ID NO: 451451 - DNA, 16 bp, Homo sapiens
ttcccccttcccctgc

SEQ ID NO: 451452 - DNA, 14 bp, Homo sapiens
ttcccctgttcact

SEQ ID NO: 451453 - DNA, 13 bp, Homo sapiens
ttcccgcagcacc

SEQ ID NO: 451454 - DNA, 12 bp, Homo sapiens
ttcccgctcagc

SEQ ID NO: 451455 - DNA, 18 bp, Homo sapiens
ttcccgctcagccctccc

SEQ ID NO: 451456 - DNA, 14 bp, Homo sapiens
ttccctagttcttt

SEQ ID NO: 451457 - DNA, 13 bp, Homo sapiens
ttccctatacttc

SEQ ID NO: 451458 - DNA, 14 bp, Homo sapiens
ttccctgcatccct

SEQ ID NO: 451459 - DNA, 15 bp, Homo sapiens
ttccgtgagacacaa

SEQ ID NO: 451460 - DNA, 18 bp, Homo sapiens
ttcctaaagaaaaagata

SEQ ID NO: 451461 - DNA, 13 bp, Homo sapiens
ttcctaagctgtt

SEQ ID NO: 451462 - DNA, 15 bp, Homo sapiens
ttcctacagtaaagg

SEQ ID NO: 451463 - DNA, 23 bp, Homo sapiens
ttcctaccattatggctttgtgc

SEQ ID NO: 451464 - DNA, 17 bp, Homo sapiens
ttcctcctaggcgctca

SEQ ID NO: 451465 - DNA, 23 bp, Homo sapiens
ttcctcctaggcgctcagaggcc

SEQ ID NO: 451466 - DNA, 13 bp, Homo sapiens
ttcctctccactg

SEQ ID NO: 451467 - DNA, 14 bp, Homo sapiens
ttcctctccactgc

SEQ ID NO: 451468 - DNA, 18 bp, Homo sapiens
ttcctctccactgccttc

SEQ ID NO: 451469 - DNA, 22 bp, Homo sapiens
ttcctctctctctctctctctg

SEQ ID NO: 451470 - DNA, 23 bp, Homo sapiens
ttcctctctctctctctctctgt

SEQ ID NO: 451471 - DNA, 16 bp, Homo sapiens
ttcctcttacctgtaa

SEQ ID NO: 451472 - DNA, 14 bp, Homo sapiens
ttcctggattttct

SEQ ID NO: 451473 - DNA, 21 bp, Homo sapiens
ttcctggattttctttctatg

SEQ ID NO: 451474 - DNA, 23 bp, Homo sapiens
ttcctggattttctttctatgta

SEQ ID NO: 451475 - DNA, 13 bp, Homo sapiens
ttcctgtcctgct

SEQ ID NO: 451476 - DNA, 17 bp, Homo sapiens
ttccttgctttctcttc

SEQ ID NO: 451477 - DNA, 22 bp, Homo sapiens
ttcctttgacctctcacttttt

SEQ ID NO: 451478 - DNA, 22 bp, Homo sapiens
ttcgatcgtttcacatctgtat

SEQ ID NO: 451479 - DNA, 23 bp, Homo sapiens
ttcgatcgtttcacatctgtata

SEQ ID NO: 451480 - DNA, 15 bp, Homo sapiens
ttctaaaacattctt

SEQ ID NO: 451481 - DNA, 13 bp, Homo sapiens
ttctaaactgttt

SEQ ID NO: 451482 - DNA, 21 bp, Homo sapiens
ttctaaactgttttcatgtgt

SEQ ID NO: 451483 - DNA, 17 bp, Homo sapiens
ttctaagcttatttcta

SEQ ID NO: 451484 - DNA, 16 bp, Homo sapiens
ttctagtcaactgctg

SEQ ID NO: 451485 - DNA, 19 bp, Homo sapiens
ttctagtcaactgctgttt

SEQ ID NO: 451486 - DNA, 16 bp, Homo sapiens
ttctagtctctgattt

SEQ ID NO: 451487 - DNA, 21 bp, Homo sapiens
ttctagtggccttagaaaaca

SEQ ID NO: 451488 - DNA, 13 bp, Homo sapiens
ttctatactgttt

SEQ ID NO: 451489 - DNA, 16 bp, Homo sapiens
ttctatatttcatatt

SEQ ID NO: 451490 - DNA, 17 bp, Homo sapiens
ttctatggattcacttc

SEQ ID NO: 451491 - DNA, 18 bp, Homo sapiens
ttctcaagcgctatccac

SEQ ID NO: 451492 - DNA, 18 bp, Homo sapiens
ttctcactcctacctggt

SEQ ID NO: 451493 - DNA, 17 bp, Homo sapiens
ttctcatagccccggtg

SEQ ID NO: 451494 - DNA, 13 bp, Homo sapiens
ttctcctctccca

SEQ ID NO: 451495 - DNA, 14 bp, Homo sapiens
ttctctctgtgtgg

SEQ ID NO: 451496 - DNA, 23 bp, Homo sapiens
ttctctctgtgtggcaaacattt

SEQ ID NO: 451497 - DNA, 13 bp, Homo sapiens
ttctcttctcaga

SEQ ID NO: 451498 - DNA, 16 bp, Homo sapiens
ttctgaataatttctt

SEQ ID NO: 451499 - DNA, 14 bp, Homo sapiens
ttctgcagtattct

SEQ ID NO: 451500 - DNA, 13 bp, Homo sapiens
ttctgcattacta

SEQ ID NO: 451501 - DNA, 17 bp, Homo sapiens
ttctgctgtacagatat

SEQ ID NO: 451502 - DNA, 16 bp, Homo sapiens
ttctggggtggggctt

SEQ ID NO: 451503 - DNA, 22 bp, Homo sapiens
ttctggggtggggcttggaagg

SEQ ID NO: 451504 - DNA, 21 bp, Homo sapiens
ttctgtcctcaggtgaataac

SEQ ID NO: 451505 - DNA, 16 bp, Homo sapiens
ttctgtggattctata

SEQ ID NO: 451506 - DNA, 16 bp, Homo sapiens
ttctgtggctcacaga

SEQ ID NO: 451507 - DNA, 15 bp, Homo sapiens
ttcttactaaacatt

SEQ ID NO: 451508 - DNA, 18 bp, Homo sapiens
ttcttactaaacattttg

SEQ ID NO: 451509 - DNA, 20 bp, Homo sapiens
ttcttatattaaagaagttg

SEQ ID NO: 451510 - DNA, 22 bp, Homo sapiens
ttcttcatccatagacacagta

SEQ ID NO: 451511 - DNA, 18 bp, Homo sapiens
ttcttcctcttacctgta

SEQ ID NO: 451512 - DNA, 20 bp, Homo sapiens
ttcttccttttgtatcctcc

SEQ ID NO: 451513 - DNA, 16 bp, Homo sapiens
ttcttgatgttgctta

SEQ ID NO: 451514 - DNA, 21 bp, Homo sapiens
ttcttgcggcaccgcccaccc

SEQ ID NO: 451515 - DNA, 14 bp, Homo sapiens
ttcttgctttcaca

SEQ ID NO: 451516 - DNA, 13 bp, Homo sapiens
ttgaaaaaagaag

SEQ ID NO: 451517 - DNA, 22 bp, Homo sapiens
ttgaaaagaagaaagtctatgc

SEQ ID NO: 451518 - DNA, 20 bp, Homo sapiens
ttgaacaagatttccctaaa

SEQ ID NO: 451519 - DNA, 23 bp, Homo sapiens
ttgaaccgtcaatgtgaaataaa

SEQ ID NO: 451520 - DNA, 14 bp, Homo sapiens
ttgaagggaaatca

SEQ ID NO: 451521 - DNA, 15 bp, Homo sapiens
ttgaagggaaatcaa

SEQ ID NO: 451522 - DNA, 13 bp, Homo sapiens
ttgaataggagtt

SEQ ID NO: 451523 - DNA, 14 bp, Homo sapiens
ttgaatatatttta

SEQ ID NO: 451524 - DNA, 19 bp, Homo sapiens
ttgaatgtccccattctat

SEQ ID NO: 451525 - DNA, 11 bp, Homo sapiens
ttgacatgcac

SEQ ID NO: 451526 - DNA, 13 bp, Homo sapiens
ttgagagaagcca

SEQ ID NO: 451527 - DNA, 16 bp, Homo sapiens
ttgagtgggccccctc

SEQ ID NO: 451528 - DNA, 13 bp, Homo sapiens
ttgatatacagac

SEQ ID NO: 451529 - DNA, 15 bp, Homo sapiens
ttgatcgatgttaaa

SEQ ID NO: 451530 - DNA, 19 bp, Homo sapiens
ttgatggtagaaattttat

SEQ ID NO: 451531 - DNA, 13 bp, Homo sapiens
ttgcaaaaggtta

SEQ ID NO: 451532 - DNA, 20 bp, Homo sapiens
ttgcaaaaggttaagccata

SEQ ID NO: 451533 - DNA, 17 bp, Homo sapiens
ttgcaaattattctagt

SEQ ID NO: 451534 - DNA, 20 bp, Homo sapiens
ttgcacatggattgattaaa

SEQ ID NO: 451535 - DNA, 22 bp, Homo sapiens
ttgcacctacgggggcatctga

SEQ ID NO: 451536 - DNA, 14 bp, Homo sapiens
ttgcagcagtacca

SEQ ID NO: 451537 - DNA, 23 bp, Homo sapiens
ttgccatccttgcacttctgtta

SEQ ID NO: 451538 - DNA, 20 bp, Homo sapiens
ttgctagtgatacactgtat

SEQ ID NO: 451539 - DNA, 21 bp, Homo sapiens
ttgctagtgatacactgtatc

SEQ ID NO: 451540 - DNA, 17 bp, Homo sapiens
ttgctattgtttatagg

SEQ ID NO: 451541 - DNA, 15 bp, Homo sapiens
ttgctccttgaataa

SEQ ID NO: 451542 - DNA, 16 bp, Homo sapiens
ttgctgaagtctcccc

SEQ ID NO: 451543 - DNA, 18 bp, Homo sapiens
ttgctgaagtctccccgc

SEQ ID NO: 451544 - DNA, 16 bp, Homo sapiens
ttgctttgtatgcact

SEQ ID NO: 451545 - DNA, 21 bp, Homo sapiens
ttggaagggcgctgagggcag

SEQ ID NO: 451546 - DNA, 19 bp, Homo sapiens
ttggagcagagacggcagc

SEQ ID NO: 451547 - DNA, 22 bp, Homo sapiens
ttggatggcttaagcctgtgta

SEQ ID NO: 451548 - DNA, 11 bp, Homo sapiens
ttggcccctct

SEQ ID NO: 451549 - DNA, 13 bp, Homo sapiens
ttggccggctggc

SEQ ID NO: 451550 - DNA, 14 bp, Homo sapiens
ttggccggctggcc

SEQ ID NO: 451551 - DNA, 14 bp, Homo sapiens
ttggctcctttccc

SEQ ID NO: 451552 - DNA, 16 bp, Homo sapiens
ttggctcctttcccac

SEQ ID NO: 451553 - DNA, 15 bp, Homo sapiens
ttgggaaattcttgc

SEQ ID NO: 451554 - DNA, 20 bp, Homo sapiens
ttgggcacgggagagcgcca

SEQ ID NO: 451555 - DNA, 13 bp, Homo sapiens
ttggggggccggg

SEQ ID NO: 451556 - DNA, 20 bp, Homo sapiens
ttggggggccgggcaggtcc

SEQ ID NO: 451557 - DNA, 15 bp, Homo sapiens
ttgggggtttttaat

SEQ ID NO: 451558 - DNA, 14 bp, Homo sapiens
ttggtgactgtccc

SEQ ID NO: 451559 - DNA, 16 bp, Homo sapiens
ttggtgattttagatt

SEQ ID NO: 451560 - DNA, 15 bp, Homo sapiens
ttggttacaaatttt

SEQ ID NO: 451561 - DNA, 15 bp, Homo sapiens
ttggtttatactgta

SEQ ID NO: 451562 - DNA, 18 bp, Homo sapiens
ttgtaccgaaacaccccg

SEQ ID NO: 451563 - DNA, 13 bp, Homo sapiens
ttgtacttacact

SEQ ID NO: 451564 - DNA, 13 bp, Homo sapiens
ttgtatgtacctg

SEQ ID NO: 451565 - DNA, 21 bp, Homo sapiens
ttgtctgaagtcactgcacag

SEQ ID NO: 451566 - DNA, 21 bp, Homo sapiens
ttgtgacaggaaagccctccc

SEQ ID NO: 451567 - DNA, 14 bp, Homo sapiens
ttgtgccaaagata

SEQ ID NO: 451568 - DNA, 16 bp, Homo sapiens
ttgtgccaaagatagc

SEQ ID NO: 451569 - DNA, 19 bp, Homo sapiens
ttgtgccaaagatagcaga

SEQ ID NO: 451570 - DNA, 14 bp, Homo sapiens
ttgtgctgtgggca

SEQ ID NO: 451571 - DNA, 17 bp, Homo sapiens
ttgtgtgggtttactct

SEQ ID NO: 451572 - DNA, 21 bp, Homo sapiens
ttgtgtgggtttactctgtgc

SEQ ID NO: 451573 - DNA, 22 bp, Homo sapiens
ttgttatgtaaacatcataaat

SEQ ID NO: 451574 - DNA, 22 bp, Homo sapiens
ttgttctccgggtgtggcctca

SEQ ID NO: 451575 - DNA, 23 bp, Homo sapiens
ttgttctccgggtgtggcctcag

SEQ ID NO: 451576 - DNA, 17 bp, Homo sapiens
ttttcaatgtactgtat

SEQ ID NO: 451577 - DNA, 18 bp, Homo sapiens
ttttcaatgtactgtatt

SEQ ID NO: 451578 - DNA, 16 bp, Homo sapiens
aaatgagtttaaaaaa

SEQ ID NO: 451579 - DNA, 22 bp, Homo sapiens
aaatgagtttaaaaaaataaca

SEQ ID NO: 451580 - DNA, 12 bp, Homo sapiens
aaatgattccaa

SEQ ID NO: 451581 - DNA, 13 bp, Homo sapiens
aaatgattccaaa

SEQ ID NO: 451582 - DNA, 14 bp, Homo sapiens
aaatgattccaaat

SEQ ID NO: 451583 - DNA, 18 bp, Homo sapiens
aaatgcacatttgtcact

SEQ ID NO: 451584 - DNA, 14 bp, Homo sapiens
aaatgcatgtgatt

SEQ ID NO: 451585 - DNA, 14 bp, Homo sapiens
aaatgctttctcat

SEQ ID NO: 451586 - DNA, 14 bp, Homo sapiens
aaatggctttccac

SEQ ID NO: 451587 - DNA, 21 bp, Homo sapiens
aaatgtatatgttatttttgg

SEQ ID NO: 451588 - DNA, 13 bp, Homo sapiens
aaatgtatgtgag

SEQ ID NO: 451589 - DNA, 14 bp, Homo sapiens
aaatgtggaatgca

SEQ ID NO: 451590 - DNA, 16 bp, Homo sapiens
aaatgtggatgctctt

SEQ ID NO: 451591 - DNA, 20 bp, Homo sapiens
aaatgtttatattgttttta

SEQ ID NO: 451592 - DNA, 18 bp, Homo sapiens
aaattataatgcatctaa

SEQ ID NO: 451593 - DNA, 14 bp, Homo sapiens
aaattcaacaaatg

SEQ ID NO: 451594 - DNA, 19 bp, Homo sapiens
aaattctagtctctgattt

SEQ ID NO: 451595 - DNA, 14 bp, Homo sapiens
aaattcttgcactg

SEQ ID NO: 451596 - DNA, 15 bp, Homo sapiens
aaattcttgcactgt

SEQ ID NO: 451597 - DNA, 21 bp, Homo sapiens
aaattcttgcactgtatccaa

SEQ ID NO: 451598 - DNA, 23 bp, Homo sapiens
aaattcttgcactgtatccaagt

SEQ ID NO: 451599 - DNA, 17 bp, Homo sapiens
aaattggctcctttccc

SEQ ID NO: 451600 - DNA, 18 bp, Homo sapiens
aaattggctcctttccca

SEQ ID NO: 451601 - DNA, 22 bp, Homo sapiens
aaattggctcctttcccacagt

SEQ ID NO: 451602 - DNA, 18 bp, Homo sapiens
aaattgtgccaaagatag

SEQ ID NO: 451603 - DNA, 20 bp, Homo sapiens
aaatttaatatactgcatat

SEQ ID NO: 451604 - DNA, 20 bp, Homo sapiens
aaattttatctcttcttcct

SEQ ID NO: 451605 - DNA, 14 bp, Homo sapiens
aaatttttactcag

SEQ ID NO: 451606 - DNA, 21 bp, Homo sapiens
aacaaacagaaacgagatttg

SEQ ID NO: 451607 - DNA, 18 bp, Homo sapiens
aacaaacgtaatttgtta

SEQ ID NO: 451608 - DNA, 19 bp, Homo sapiens
aacaaacttactgtcagag

SEQ ID NO: 451609 - DNA, 13 bp, Homo sapiens
aacaactctattt

SEQ ID NO: 451610 - DNA, 19 bp, Homo sapiens
aacaatgccttgttgtatt

SEQ ID NO: 451611 - DNA, 18 bp, Homo sapiens
aacactagtagctgtttt

SEQ ID NO: 451612 - DNA, 20 bp, Homo sapiens
aacactgcttaaggaaaaga

SEQ ID NO: 451613 - DNA, 17 bp, Homo sapiens
aacacttattttctgaa

SEQ ID NO: 451614 - DNA, 18 bp, Homo sapiens
aacacttattttctgaat

SEQ ID NO: 451615 - DNA, 20 bp, Homo sapiens
aacagaaacgagatttgcca

SEQ ID NO: 451616 - DNA, 14 bp, Homo sapiens
aacagaccagcata

SEQ ID NO: 451617 - DNA, 18 bp, Homo sapiens
aacagacctcggctgtgt

SEQ ID NO: 451618 - DNA, 17 bp, Homo sapiens
aacagcatgtctactgc

SEQ ID NO: 451619 - DNA, 24 bp, Homo sapiens
aacagctaggttaataggaggaca

SEQ ID NO: 451620 - DNA, 18 bp, Homo sapiens
aacagcttgaaaactgga

SEQ ID NO: 451621 - DNA, 21 bp, Homo sapiens
aacagtctcattacagattta

SEQ ID NO: 451622 - DNA, 17 bp, Homo sapiens
aacataatgatactgaa

SEQ ID NO: 451623 - DNA, 12 bp, Homo sapiens
aacatacatcta

SEQ ID NO: 451624 - DNA, 23 bp, Homo sapiens
aacatacatctaagtcagtttca

SEQ ID NO: 451625 - DNA, 16 bp, Homo sapiens
aacataggtgctcttc

SEQ ID NO: 451626 - DNA, 20 bp, Homo sapiens
aacatccggaacagccaaag

SEQ ID NO: 451627 - DNA, 12 bp, Homo sapiens
aacatctgaaaa

SEQ ID NO: 451628 - DNA, 17 bp, Homo sapiens
aacatttcagtgttttg

SEQ ID NO: 451629 - DNA, 20 bp, Homo sapiens
aacattttttgtttcttggt

SEQ ID NO: 451630 - DNA, 16 bp, Homo sapiens
aaccaagccgtggctt

SEQ ID NO: 451631 - DNA, 15 bp, Homo sapiens
aaccagagagaaaga

SEQ ID NO: 451632 - DNA, 17 bp, Homo sapiens
aaccagcactcccaggg

SEQ ID NO: 451633 - DNA, 18 bp, Homo sapiens
aaccagcactcccagggc

SEQ ID NO: 451634 - DNA, 17 bp, Homo sapiens
aaccaggccccagcctc

SEQ ID NO: 451635 - DNA, 22 bp, Homo sapiens
aaccaggccccagcctccaggc

SEQ ID NO: 451636 - DNA, 16 bp, Homo sapiens
aaccatagaactgtcc

SEQ ID NO: 451637 - DNA, 13 bp, Homo sapiens
aacccaaaagatt

SEQ ID NO: 451638 - DNA, 17 bp, Homo sapiens
aacccaagtggaatcat

SEQ ID NO: 451639 - DNA, 15 bp, Homo sapiens
aaccctgccctgcac

SEQ ID NO: 451640 - DNA, 15 bp, Homo sapiens
aaccgtcaatgtgaa

SEQ ID NO: 451641 - DNA, 17 bp, Homo sapiens
aaccgtcaatgtgaaat

SEQ ID NO: 451642 - DNA, 16 bp, Homo sapiens
aacctggtggcaccag

SEQ ID NO: 451643 - DNA, 16 bp, Homo sapiens
aacctgtgctttcatg

SEQ ID NO: 451644 - DNA, 13 bp, Homo sapiens
aaccttccctcca

SEQ ID NO: 451645 - DNA, 20 bp, Homo sapiens
aacgggtctgtgggactggc

SEQ ID NO: 451646 - DNA, 17 bp, Homo sapiens
aacgtccttccacttca

SEQ ID NO: 451647 - DNA, 14 bp, Homo sapiens
aactactaagaata

SEQ ID NO: 451648 - DNA, 21 bp, Homo sapiens
aactcagccttaagaaagcta

SEQ ID NO: 451649 - DNA, 16 bp, Homo sapiens
aactccgcccagcctc

SEQ ID NO: 451650 - DNA, 17 bp, Homo sapiens
aactccgcccagcctct

SEQ ID NO: 451651 - DNA, 15 bp, Homo sapiens
aactctattttttac

SEQ ID NO: 451652 - DNA, 19 bp, Homo sapiens
aactctgtgtcccagcacc

SEQ ID NO: 451653 - DNA, 16 bp, Homo sapiens
aactcttcaaggccaa

SEQ ID NO: 451654 - DNA, 14 bp, Homo sapiens
aactggccccaggc

SEQ ID NO: 451655 - DNA, 23 bp, Homo sapiens
aactggccccaggcggaggggct

SEQ ID NO: 451656 - DNA, 15 bp, Homo sapiens
aacttaaaagaacat

SEQ ID NO: 451657 - DNA, 23 bp, Homo sapiens
aacttaaaagaacataggaattt

SEQ ID NO: 451658 - DNA, 17 bp, Homo sapiens
aacttaaacctgtgctt

SEQ ID NO: 451659 - DNA, 20 bp, Homo sapiens
aacttactgtcagagaatat

SEQ ID NO: 451660 - DNA, 17 bp, Homo sapiens
aacttatctccagccaa

SEQ ID NO: 451661 - DNA, 18 bp, Homo sapiens
aacttctgaactttggaa

SEQ ID NO: 451662 - DNA, 12 bp, Homo sapiens
aacttgagccca

SEQ ID NO: 451663 - DNA, 10 bp, Homo sapiens
aactttgtca

SEQ ID NO: 451664 - DNA, 18 bp, Homo sapiens
aactttttctaagctgtt

SEQ ID NO: 451665 - DNA, 22 bp, Homo sapiens
agccgtggcttcccgctcagcc

SEQ ID NO: 451666 - DNA, 20 bp, Homo sapiens
agccgtttgaatatatttta

SEQ ID NO: 451667 - DNA, 21 bp, Homo sapiens
agccgtttgaatatattttat

SEQ ID NO: 451668 - DNA, 16 bp, Homo sapiens
agcctcccccaggctg

SEQ ID NO: 451669 - DNA, 22 bp, Homo sapiens
agcctcccccaggctgcgcctg

SEQ ID NO: 451670 - DNA, 13 bp, Homo sapiens
agcctccccctca

SEQ ID NO: 451671 - DNA, 14 bp, Homo sapiens
agcctccccctcag

SEQ ID NO: 451672 - DNA, 20 bp, Homo sapiens
agcctcctaggctccctgag

SEQ ID NO: 451673 - DNA, 11 bp, Homo sapiens
agcctgagcca

SEQ ID NO: 451674 - DNA, 14 bp, Homo sapiens
agcctgagccacag

SEQ ID NO: 451675 - DNA, 17 bp, Homo sapiens
agcctggcacagggcag

SEQ ID NO: 451676 - DNA, 18 bp, Homo sapiens
agccttaagaaagctata

SEQ ID NO: 451677 - DNA, 17 bp, Homo sapiens
agccttaagtcttactg

SEQ ID NO: 451678 - DNA, 22 bp, Homo sapiens
agccttaagtcttactgttttg

SEQ ID NO: 451679 - DNA, 14 bp, Homo sapiens
agcgccacccgccc

SEQ ID NO: 451680 - DNA, 20 bp, Homo sapiens
agcgcctcccgccgcctcgg

SEQ ID NO: 451681 - DNA, 15 bp, Homo sapiens
agcgcgtgccttccc

SEQ ID NO: 451682 - DNA, 16 bp, Homo sapiens
agcgcgtgccttcccc

SEQ ID NO: 451683 - DNA, 19 bp, Homo sapiens
agcggcccggcccacgcag

SEQ ID NO: 451684 - DNA, 21 bp, Homo sapiens
agcggcccggcccacgcagag

SEQ ID NO: 451685 - DNA, 15 bp, Homo sapiens
agcggctgaggacgg

SEQ ID NO: 451686 - DNA, 20 bp, Homo sapiens
agcggctgaggacggggcag

SEQ ID NO: 451687 - DNA, 17 bp, Homo sapiens
agtgcatctcagcccac

SEQ ID NO: 451688 - DNA, 16 bp, Homo sapiens
agtgcatttattgcct

SEQ ID NO: 451689 - DNA, 19 bp, Homo sapiens
agtgctatctcatgacaac

SEQ ID NO: 451690 - DNA, 13 bp, Homo sapiens
agtggatctggag

SEQ ID NO: 451691 - DNA, 22 bp, Homo sapiens
agtggcaaaaaagaacagtgtt

SEQ ID NO: 451692 - DNA, 12 bp, Homo sapiens
agtggcaagcta

SEQ ID NO: 451693 - DNA, 20 bp, Homo sapiens
agtggccacactctgccttc

SEQ ID NO: 451694 - DNA, 15 bp, Homo sapiens
agtggcctgagaaga

SEQ ID NO: 451695 - DNA, 16 bp, Homo sapiens
agtggcctgagaagag

SEQ ID NO: 451696 - DNA, 21 bp, Homo sapiens
agtgggacagggcatggccag

SEQ ID NO: 451697 - DNA, 16 bp, Homo sapiens
agtgggccccctctct

SEQ ID NO: 451698 - DNA, 18 bp, Homo sapiens
agtggggcccatggcccc

SEQ ID NO: 451699 - DNA, 21 bp, Homo sapiens
agtggggcccatggccccagc

SEQ ID NO: 451700 - DNA, 15 bp, Homo sapiens
agtgggggtgcctgg

SEQ ID NO: 451701 - DNA, 17 bp, Homo sapiens
agtggttcgggggaaat

SEQ ID NO: 451702 - DNA, 14 bp, Homo sapiens
agtgtcctgatttg

SEQ ID NO: 451703 - DNA, 19 bp, Homo sapiens
agtgtggcttaaacatttt

SEQ ID NO: 451704 - DNA, 17 bp, Homo sapiens
agtgtgtacttcttcat

SEQ ID NO: 451705 - DNA, 17 bp, Homo sapiens
agtgtgtgtgcaatgtt

SEQ ID NO: 451706 - DNA, 21 bp, Homo sapiens
agttaaaaaaaaaacagcctg

SEQ ID NO: 451707 - DNA, 18 bp, Homo sapiens
agttaagacaacaggcat

SEQ ID NO: 451708 - DNA, 14 bp, Homo sapiens
agttaatgtgccaa

SEQ ID NO: 451709 - DNA, 13 bp, Homo sapiens
agttagcccggcc

SEQ ID NO: 451710 - DNA, 21 bp, Homo sapiens
agttagcccggccaaggacac

SEQ ID NO: 451711 - DNA, 18 bp, Homo sapiens
agttatttgatctggtgc

SEQ ID NO: 451712 - DNA, 22 bp, Homo sapiens
agttcaacctggtggcaccaga

SEQ ID NO: 451713 - DNA, 23 bp, Homo sapiens
agttcctgggtttagctgtgaaa

SEQ ID NO: 451714 - DNA, 16 bp, Homo sapiens
agttctattatctggg

SEQ ID NO: 451715 - DNA, 16 bp, Homo sapiens
agttctccttgtactt

SEQ ID NO: 451716 - DNA, 19 bp, Homo sapiens
agttgaacaagatttccct

SEQ ID NO: 451717 - DNA, 20 bp, Homo sapiens
agttgacctttatttattaa

SEQ ID NO: 451718 - DNA, 23 bp, Homo sapiens
agttgacctttatttattaaact

SEQ ID NO: 451719 - DNA, 18 bp, Homo sapiens
agttgatttaaactctta

SEQ ID NO: 451720 - DNA, 21 bp, Homo sapiens
agtttattatagtctgtactt

SEQ ID NO: 451721 - DNA, 15 bp, Homo sapiens
agttttataaaactc

SEQ ID NO: 451722 - DNA, 19 bp, Homo sapiens
ataaaaaagaaaacttgtg

SEQ ID NO: 451723 - DNA, 17 bp, Homo sapiens
ataaaactcagttaaaa

SEQ ID NO: 451724 - DNA, 13 bp, Homo sapiens
ataaaagagcttt

SEQ ID NO: 451725 - DNA, 17 bp, Homo sapiens
ataaaaggcattcatct

SEQ ID NO: 451726 - DNA, 16 bp, Homo sapiens
ataaacaacttaatgt

SEQ ID NO: 451727 - DNA, 18 bp, Homo sapiens
ataaacattaaacactgt

SEQ ID NO: 451728 - DNA, 15 bp, Homo sapiens
ataaactcttcaagg

SEQ ID NO: 451729 - DNA, 19 bp, Homo sapiens
ataaactcttcaaggccaa

SEQ ID NO: 451730 - DNA, 14 bp, Homo sapiens
ataaacttgtactt

SEQ ID NO: 451731 - DNA, 17 bp, Homo sapiens
ataaagaagaaaataac

SEQ ID NO: 451732 - DNA, 12 bp, Homo sapiens
ataaagacacct

SEQ ID NO: 451733 - DNA, 11 bp, Homo sapiens
ataaaggtcat

SEQ ID NO: 451734 - DNA, 14 bp, Homo sapiens
ataaaggtcatatt

SEQ ID NO: 451735 - DNA, 20 bp, Homo sapiens
ataaataaagaagaaaataa

SEQ ID NO: 451736 - DNA, 22 bp, Homo sapiens
ataaataaagaagaaaataacc

SEQ ID NO: 451737 - DNA, 15 bp, Homo sapiens
ataaattattacttt

SEQ ID NO: 451738 - DNA, 14 bp, Homo sapiens
ataaattggctcct

SEQ ID NO: 451739 - DNA, 18 bp, Homo sapiens
ataaattggctcctttcc

SEQ ID NO: 451740 - DNA, 23 bp, Homo sapiens
ataaattggctcctttcccacag

SEQ ID NO: 451741 - DNA, 22 bp, Homo sapiens
ataacaagccaaacattcttat

SEQ ID NO: 451742 - DNA, 22 bp, Homo sapiens
ataacagagaatcttgattaaa

SEQ ID NO: 451743 - DNA, 16 bp, Homo sapiens
ataacagcttgaaaac

SEQ ID NO: 451744 - DNA, 20 bp, Homo sapiens
ataacatattcttgctttca

SEQ ID NO: 451745 - DNA, 21 bp, Homo sapiens
ataacatctgaaaagaaatgc

SEQ ID NO: 451746 - DNA, 20 bp, Homo sapiens
ataactaagcaagtatattt

SEQ ID NO: 451747 - DNA, 17 bp, Homo sapiens
ataagagacaaagtttg

SEQ ID NO: 451748 - DNA, 20 bp, Homo sapiens
ataagagccctgagcccaga

SEQ ID NO: 451749 - DNA, 16 bp, Homo sapiens
ataagattatatacaa

SEQ ID NO: 451750 - DNA, 13 bp, Homo sapiens
ataagtgctcagt

SEQ ID NO: 451751 - DNA, 15 bp, Homo sapiens
ataagttgaccttta

SEQ ID NO: 451752 - DNA, 23 bp, Homo sapiens
ataataagagccctgagcccaga

SEQ ID NO: 451753 - DNA, 18 bp, Homo sapiens
ataatatcctgaataact

SEQ ID NO: 451754 - DNA, 18 bp, Homo sapiens
ataatcaagacaagtgtt

SEQ ID NO: 451755 - DNA, 12 bp, Homo sapiens
ataatgaatgag

SEQ ID NO: 451756 - DNA, 16 bp, Homo sapiens
ataatgattcaatgtg

SEQ ID NO: 451757 - DNA, 18 bp, Homo sapiens
ataatgattcaatgtgaa

SEQ ID NO: 451758 - DNA, 21 bp, Homo sapiens
ataatgcctttttggttttgt

SEQ ID NO: 451759 - DNA, 22 bp, Homo sapiens
ataatgcttaacataaacttgt

SEQ ID NO: 451760 - DNA, 16 bp, Homo sapiens
ataatggctaactttt

SEQ ID NO: 451761 - DNA, 23 bp, Homo sapiens
ataatgtttccctcaagaacaaa

SEQ ID NO: 451762 - DNA, 19 bp, Homo sapiens
ataattaaattttaatgta

SEQ ID NO: 451763 - DNA, 23 bp, Homo sapiens
ataatttgccagacagagatcag

SEQ ID NO: 451764 - DNA, 13 bp, Homo sapiens
atacaaagctgtc

SEQ ID NO: 451765 - DNA, 20 bp, Homo sapiens
atacaaagctgtcactcaca

SEQ ID NO: 451766 - DNA, 11 bp, Homo sapiens
atacaataaaa

SEQ ID NO: 451767 - DNA, 13 bp, Homo sapiens
atacaataaaaga

SEQ ID NO: 451768 - DNA, 20 bp, Homo sapiens
atacaataaaagagctttat

SEQ ID NO: 451769 - DNA, 18 bp, Homo sapiens
atacaccgggcctggaga

SEQ ID NO: 451770 - DNA, 11 bp, Homo sapiens
atacactggaa

SEQ ID NO: 451771 - DNA, 16 bp, Homo sapiens
atacactgtatctaaa

SEQ ID NO: 451772 - DNA, 23 bp, Homo sapiens
atacactgtatctaaaaaataac

SEQ ID NO: 451773 - DNA, 15 bp, Homo sapiens
atacagacctccaga

SEQ ID NO: 451774 - DNA, 20 bp, Homo sapiens
atacagacctccagattatt

SEQ ID NO: 451775 - DNA, 17 bp, Homo sapiens
atacatagtctttgttt

SEQ ID NO: 451776 - DNA, 18 bp, Homo sapiens
atacatggtttaaagtca

SEQ ID NO: 451777 - DNA, 17 bp, Homo sapiens
atacattaaaataacta

SEQ ID NO: 451778 - DNA, 21 bp, Homo sapiens
ataccatttatctactatttg

SEQ ID NO: 451779 - DNA, 11 bp, Homo sapiens
ataccctagaa

SEQ ID NO: 451780 - DNA, 16 bp, Homo sapiens
ataccctaggtctcca

SEQ ID NO: 451781 - DNA, 18 bp, Homo sapiens
ataccctaggtctccacc

SEQ ID NO: 451782 - DNA, 16 bp, Homo sapiens
ataccgagacccacca

SEQ ID NO: 451783 - DNA, 18 bp, Homo sapiens
ataccgagacccaccatc

SEQ ID NO: 451784 - DNA, 23 bp, Homo sapiens
aggcgtgggatccagagagaagc

SEQ ID NO: 451785 - DNA, 14 bp, Homo sapiens
aggctccctgaggt

SEQ ID NO: 451786 - DNA, 13 bp, Homo sapiens
aggctgcccctgt

SEQ ID NO: 451787 - DNA, 16 bp, Homo sapiens
aggctgggcccctggg

SEQ ID NO: 451788 - DNA, 14 bp, Homo sapiens
aggctggggcctgg

SEQ ID NO: 451789 - DNA, 22 bp, Homo sapiens
aggctggggcctggcctattta

SEQ ID NO: 451790 - DNA, 19 bp, Homo sapiens
aggctttattcttccaagt

SEQ ID NO: 451791 - DNA, 12 bp, Homo sapiens
aggctttctatt

SEQ ID NO: 451792 - DNA, 15 bp, Homo sapiens
agggaaatcaattta

SEQ ID NO: 451793 - DNA, 18 bp, Homo sapiens
agggaacagacctcggct

SEQ ID NO: 451794 - DNA, 23 bp, Homo sapiens
agggaagaaaactatcctgcggg

SEQ ID NO: 451795 - DNA, 15 bp, Homo sapiens
agggaagcccacccg

SEQ ID NO: 451796 - DNA, 18 bp, Homo sapiens
agggaagcccacccgccc

SEQ ID NO: 451797 - DNA, 19 bp, Homo sapiens
agggaagcccacccgcccc

SEQ ID NO: 451798 - DNA, 16 bp, Homo sapiens
agggacccccgaggcc

SEQ ID NO: 451799 - DNA, 23 bp, Homo sapiens
agggacccccgaggcccccctct

SEQ ID NO: 451800 - DNA, 24 bp, Homo sapiens
agggacccccgaggcccccctctg

SEQ ID NO: 451801 - DNA, 16 bp, Homo sapiens
agggagccatgctctt

SEQ ID NO: 451802 - DNA, 16 bp, Homo sapiens
agggatgggggatggg

SEQ ID NO: 451803 - DNA, 13 bp, Homo sapiens
agggcagcccctc

SEQ ID NO: 451804 - DNA, 15 bp, Homo sapiens
agagacggcagcccc

SEQ ID NO: 451805 - DNA, 21 bp, Homo sapiens
agagacggcagccccatcctt

SEQ ID NO: 451806 - DNA, 13 bp, Homo sapiens
agagactgcccac

SEQ ID NO: 451807 - DNA, 14 bp, Homo sapiens
agagactgcccacc

SEQ ID NO: 451808 - DNA, 20 bp, Homo sapiens
agagactgcccaccctgggc

SEQ ID NO: 451809 - DNA, 21 bp, Homo sapiens
agagactgcccaccctgggcc

SEQ ID NO: 451810 - DNA, 18 bp, Homo sapiens
agagaggacagtttagga

SEQ ID NO: 451811 - DNA, 14 bp, Homo sapiens
agagagtggctcct

SEQ ID NO: 451812 - DNA, 16 bp, Homo sapiens
agagagtggctcctcc

SEQ ID NO: 451813 - DNA, 17 bp, Homo sapiens
agagagtggctcctccc

SEQ ID NO: 451814 - DNA, 13 bp, Homo sapiens
agagatgtgtcca

SEQ ID NO: 451815 - DNA, 13 bp, Homo sapiens
agagattgggggg

SEQ ID NO: 451816 - DNA, 19 bp, Homo sapiens
agagattgggggggcttgg

SEQ ID NO: 451817 - DNA, 17 bp, Homo sapiens
agagcaaagatggcttc

SEQ ID NO: 451818 - DNA, 18 bp, Homo sapiens
agagcaaagatggcttcc

SEQ ID NO: 451819 - DNA, 10 bp, Homo sapiens
agagccacaa

SEQ ID NO: 451820 - DNA, 17 bp, Homo sapiens
agagcgccacccgcccg

SEQ ID NO: 451821 - DNA, 20 bp, Homo sapiens
agagcgccacccgcccgccc

SEQ ID NO: 451822 - DNA, 16 bp, Homo sapiens
agagcgctcctctgcc

SEQ ID NO: 451823 - DNA, 23 bp, Homo sapiens
agagctatatatatatatatatg

SEQ ID NO: 451824 - DNA, 15 bp, Homo sapiens
agagctcagtacagg

SEQ ID NO: 451825 - DNA, 18 bp, Homo sapiens
agagctcagtacagggca

SEQ ID NO: 451826 - DNA, 19 bp, Homo sapiens
agagctcagtacagggcag

SEQ ID NO: 451827 - DNA, 17 bp, Homo sapiens
agagctgagtcggctgg

SEQ ID NO: 451828 - DNA, 20 bp, Homo sapiens
agagctgagtcggctgggca

SEQ ID NO: 451829 - DNA, 21 bp, Homo sapiens
agagctgagtcggctgggcag

SEQ ID NO: 451830 - DNA, 16 bp, Homo sapiens
agagctgctcctttgg

SEQ ID NO: 451831 - DNA, 23 bp, Homo sapiens
agagcttcccctaacctgggttg

SEQ ID NO: 451832 - DNA, 23 bp, Homo sapiens
agaggacagtttaggacccaagg

SEQ ID NO: 451833 - DNA, 14 bp, Homo sapiens
agaggcagggccct

SEQ ID NO: 451834 - DNA, 13 bp, Homo sapiens
agaggccgctctg

SEQ ID NO: 451835 - DNA, 12 bp, Homo sapiens
agaggcggcctc

SEQ ID NO: 451836 - DNA, 21 bp, Homo sapiens
agagggcactcccaggcccct

SEQ ID NO: 451837 - DNA, 20 bp, Homo sapiens
agagggctgagcccctcctc

SEQ ID NO: 451838 - DNA, 22 bp, Homo sapiens
agaggggacttggataggagct

SEQ ID NO: 451839 - DNA, 21 bp, Homo sapiens
agagtcgagtgatatggcttg

SEQ ID NO: 451840 - DNA, 22 bp, Homo sapiens
agagtggatctggagtctgaag

SEQ ID NO: 451841 - DNA, 19 bp, Homo sapiens
agagtggctcctcccggtg

SEQ ID NO: 451842 - DNA, 23 bp, Homo sapiens
agagtggctcctcccggtgccca

SEQ ID NO: 451843 - DNA, 23 bp, Homo sapiens
agagtgtcctgatttgtgttaag

SEQ ID NO: 451844 - DNA, 14 bp, Homo sapiens
agagtgttataaca

SEQ ID NO: 451845 - DNA, 20 bp, Homo sapiens
agataagtgctcagtattga

SEQ ID NO: 451846 - DNA, 20 bp, Homo sapiens
agataattatccaggatgtg

SEQ ID NO: 451847 - DNA, 16 bp, Homo sapiens
agatcagcattcaaaa

SEQ ID NO: 451848 - DNA, 17 bp, Homo sapiens
agatcagcattcaaaat

SEQ ID NO: 451849 - DNA, 18 bp, Homo sapiens
agatcagcattcaaaata

SEQ ID NO: 451850 - DNA, 17 bp, Homo sapiens
agatcccaagtcaaaca

SEQ ID NO: 451851 - DNA, 12 bp, Homo sapiens
agatcttgagca

SEQ ID NO: 451852 - DNA, 16 bp, Homo sapiens
agatgactggaaacaa

SEQ ID NO: 451853 - DNA, 17 bp, Homo sapiens
agatgagaaaacaggct

SEQ ID NO: 451854 - DNA, 15 bp, Homo sapiens
agatgatctctccac

SEQ ID NO: 451855 - DNA, 22 bp, Homo sapiens
agatgatctctccacggtagca

SEQ ID NO: 451856 - DNA, 16 bp, Homo sapiens
agatgcaacctcacta

SEQ ID NO: 451857 - DNA, 19 bp, Homo sapiens
agatgcaacctcactatgg

SEQ ID NO: 451858 - DNA, 11 bp, Homo sapiens
agatgccaagg

SEQ ID NO: 451859 - DNA, 12 bp, Homo sapiens
agatgccaaggg

SEQ ID NO: 451860 - DNA, 19 bp, Homo sapiens
agatggcgcatagtgtgct

SEQ ID NO: 451861 - DNA, 21 bp, Homo sapiens
agatggcttccgtgagacaca

SEQ ID NO: 451862 - DNA, 18 bp, Homo sapiens
agatgggcagtaaacagg

SEQ ID NO: 451863 - DNA, 21 bp, Homo sapiens
agatgtattatgcaaagtacc

SEQ ID NO: 451864 - DNA, 22 bp, Homo sapiens
agatgtgtccatgtgaaattta

SEQ ID NO: 451865 - DNA, 18 bp, Homo sapiens
agattatatacaaagctg

SEQ ID NO: 451866 - DNA, 16 bp, Homo sapiens
agattattttctatat

SEQ ID NO: 451867 - DNA, 23 bp, Homo sapiens
agattccacaggacacgaaggct

SEQ ID NO: 451868 - DNA, 17 bp, Homo sapiens
agattccattttggaaa

SEQ ID NO: 451869 - DNA, 17 bp, Homo sapiens
agattctattaaaagcc

SEQ ID NO: 451870 - DNA, 18 bp, Homo sapiens
agattggctttgccttta

SEQ ID NO: 451871 - DNA, 18 bp, Homo sapiens
agatttccctaaaaattc

SEQ ID NO: 451872 - DNA, 16 bp, Homo sapiens
agcaaccctacagtat

SEQ ID NO: 451873 - DNA, 17 bp, Homo sapiens
agcaaccctacagtata

SEQ ID NO: 451874 - DNA, 20 bp, Homo sapiens
agcaaccctacagtatataa

SEQ ID NO: 451875 - DNA, 17 bp, Homo sapiens
agcaaggcaagaagtgg

SEQ ID NO: 451876 - DNA, 22 bp, Homo sapiens
agcaaggcaagaagtgggattc

SEQ ID NO: 451877 - DNA, 16 bp, Homo sapiens
agcaaggggctctgcc

SEQ ID NO: 451878 - DNA, 14 bp, Homo sapiens
agcaatgcctgcct

SEQ ID NO: 451879 - DNA, 16 bp, Homo sapiens
agcacaaggagtgccc

SEQ ID NO: 451880 - DNA, 17 bp, Homo sapiens
agcacaaggagtgcccg

SEQ ID NO: 451881 - DNA, 19 bp, Homo sapiens
agcacactgagtttgaaca

SEQ ID NO: 451882 - DNA, 22 bp, Homo sapiens
agcaccacggggtcgggggagg

SEQ ID NO: 451883 - DNA, 16 bp, Homo sapiens
agcaccagcctgagcc

SEQ ID NO: 451884 - DNA, 21 bp, Homo sapiens
agcaccagcctgagccacagt

SEQ ID NO: 451885 - DNA, 12 bp, Homo sapiens
agcacccccagc

SEQ ID NO: 451886 - DNA, 13 bp, Homo sapiens
agcacccccagcc

SEQ ID NO: 451887 - DNA, 16 bp, Homo sapiens
agcacccccagcctcc

SEQ ID NO: 451888 - DNA, 22 bp, Homo sapiens
agcacccccagcctcccccagg

SEQ ID NO: 451889 - DNA, 14 bp, Homo sapiens
agcaccctcccccg

SEQ ID NO: 451890 - DNA, 18 bp, Homo sapiens
agcaccctcccccgcagc

SEQ ID NO: 451891 - DNA, 15 bp, Homo sapiens
agcaccctctcctgg

SEQ ID NO: 451892 - DNA, 18 bp, Homo sapiens
agcaccctctcctggggg

SEQ ID NO: 451893 - DNA, 19 bp, Homo sapiens
agcaccctctcctgggggt

SEQ ID NO: 451894 - DNA, 19 bp, Homo sapiens
agcaccgtggtgtgaggcc

SEQ ID NO: 451895 - DNA, 21 bp, Homo sapiens
agcaccgtggtgtgaggcccc

SEQ ID NO: 451896 - DNA, 19 bp, Homo sapiens
ctgaaggcctccatttgta

SEQ ID NO: 451897 - DNA, 14 bp, Homo sapiens
ctgaagtcactgca

SEQ ID NO: 451898 - DNA, 22 bp, Homo sapiens
ctgaagtcactgcacagtgcat

SEQ ID NO: 451899 - DNA, 14 bp, Homo sapiens
ctgaagtctccccg

SEQ ID NO: 451900 - DNA, 17 bp, Homo sapiens
ctgaagtctccccgcag

SEQ ID NO: 451901 - DNA, 15 bp, Homo sapiens
ctgaataatttctta

SEQ ID NO: 451902 - DNA, 17 bp, Homo sapiens
atactcaccaaaatata

SEQ ID NO: 451903 - DNA, 18 bp, Homo sapiens
atactctgtgtaatctct

SEQ ID NO: 451904 - DNA, 22 bp, Homo sapiens
atactctgtgtaatctctgatt

SEQ ID NO: 451905 - DNA, 23 bp, Homo sapiens
atactctgtgtaatctctgatta

SEQ ID NO: 451906 - DNA, 19 bp, Homo sapiens
atactgaattgttatgtaa

SEQ ID NO: 451907 - DNA, 22 bp, Homo sapiens
atactggaaataacctgtgaat

SEQ ID NO: 451908 - DNA, 21 bp, Homo sapiens
atactggttatagttgatatg

SEQ ID NO: 451909 - DNA, 18 bp, Homo sapiens
atactgtataagtaacac

SEQ ID NO: 451910 - DNA, 13 bp, Homo sapiens
atactgtttgtaa

SEQ ID NO: 451911 - DNA, 18 bp, Homo sapiens
atactgtttgtaatatac

SEQ ID NO: 451912 - DNA, 21 bp, Homo sapiens
atacttcacactgaactcagg

SEQ ID NO: 451913 - DNA, 14 bp, Homo sapiens
atacttcctggatt

SEQ ID NO: 451914 - DNA, 17 bp, Homo sapiens
atacttctttttcatta

SEQ ID NO: 451915 - DNA, 20 bp, Homo sapiens
atacttttgtgtattctgtg

SEQ ID NO: 451916 - DNA, 22 bp, Homo sapiens
atacttttgtgtattctgtgga

SEQ ID NO: 451917 - DNA, 22 bp, Homo sapiens
atagcactggtttgtttctcaa

SEQ ID NO: 451918 - DNA, 12 bp, Homo sapiens
atagcagaagag

SEQ ID NO: 451919 - DNA, 15 bp, Homo sapiens
ataggagcttccaga

SEQ ID NO: 451920 - DNA, 20 bp, Homo sapiens
ataggagcttccagatgggt

SEQ ID NO: 451921 - DNA, 16 bp, Homo sapiens
ataggagttctcctgg

SEQ ID NO: 451922 - DNA, 19 bp, Homo sapiens
atagtcatgtttctgcagt

SEQ ID NO: 451923 - DNA, 19 bp, Homo sapiens
atagtgtgctcggacacag

SEQ ID NO: 451924 - DNA, 20 bp, Homo sapiens
atagttaattgtggctttat

SEQ ID NO: 451925 - DNA, 19 bp, Homo sapiens
atagttaccgatggtgtcc

SEQ ID NO: 451926 - DNA, 14 bp, Homo sapiens
atagttctatttct

SEQ ID NO: 451927 - DNA, 16 bp, Homo sapiens
atagttctatttctat

SEQ ID NO: 451928 - DNA, 14 bp, Homo sapiens
atagttgatatgta

SEQ ID NO: 451929 - DNA, 17 bp, Homo sapiens
atagtttattatagtct

SEQ ID NO: 451930 - DNA, 16 bp, Homo sapiens
atataaatgtttatat

SEQ ID NO: 451931 - DNA, 13 bp, Homo sapiens
atataagcttttt

SEQ ID NO: 451932 - DNA, 17 bp, Homo sapiens
atatacagtttttgtaa

SEQ ID NO: 451933 - DNA, 23 bp, Homo sapiens
atatagttgaacaagatttccct

SEQ ID NO: 451934 - DNA, 15 bp, Homo sapiens
atatatatgagtgaa

SEQ ID NO: 451935 - DNA, 12 bp, Homo sapiens
atatatatgtat

SEQ ID NO: 451936 - DNA, 13 bp, Homo sapiens
atatattataagt

SEQ ID NO: 451937 - DNA, 15 bp, Homo sapiens
atatcagcagacact

SEQ ID NO: 451938 - DNA, 17 bp, Homo sapiens
atatcatcaatactttt

SEQ ID NO: 451939 - DNA, 16 bp, Homo sapiens
atatcctatactggtt

SEQ ID NO: 451940 - DNA, 19 bp, Homo sapiens
atatcctggtgtctagttt

SEQ ID NO: 451941 - DNA, 17 bp, Homo sapiens
atatcgagagtttctat

SEQ ID NO: 451942 - DNA, 19 bp, Homo sapiens
atatctatttatctgtctg

SEQ ID NO: 451943 - DNA, 20 bp, Homo sapiens
atatctatttatctgtctga

SEQ ID NO: 451944 - DNA, 17 bp, Homo sapiens
atatctgtaaatttaac

SEQ ID NO: 451945 - DNA, 14 bp, Homo sapiens
atatgaaagagaaa

SEQ ID NO: 451946 - DNA, 18 bp, Homo sapiens
atatgacaatttcaaaat

SEQ ID NO: 451947 - DNA, 19 bp, Homo sapiens
atatgacaatttcaaaatg

SEQ ID NO: 451948 - DNA, 23 bp, Homo sapiens
atatgacctaaatccattttcta

SEQ ID NO: 451949 - DNA, 19 bp, Homo sapiens
atatgaggggactgcatgc

SEQ ID NO: 451950 - DNA, 15 bp, Homo sapiens
atatgatatgcatgt

SEQ ID NO: 451951 - DNA, 23 bp, Homo sapiens
atatgatatgcatgtagcatata

SEQ ID NO: 451952 - DNA, 18 bp, Homo sapiens
atatgattctcctctccc

SEQ ID NO: 451953 - DNA, 11 bp, Homo sapiens
atatgcatgta

SEQ ID NO: 451954 - DNA, 15 bp, Homo sapiens
atatgcatgtagcat

SEQ ID NO: 451955 - DNA, 19 bp, Homo sapiens
atatggaaccttccctcca

SEQ ID NO: 451956 - DNA, 20 bp, Homo sapiens
atatggaaccttccctccaa

SEQ ID NO: 451957 - DNA, 13 bp, Homo sapiens
atatgtttaatat

SEQ ID NO: 451958 - DNA, 16 bp, Homo sapiens
atattataagttgacc

SEQ ID NO: 451959 - DNA, 11 bp, Homo sapiens
atattatatat

SEQ ID NO: 451960 - DNA, 12 bp, Homo sapiens
atattatatata

SEQ ID NO: 451961 - DNA, 22 bp, Homo sapiens
atattcatgaaagctgaaagaa

SEQ ID NO: 451962 - DNA, 24 bp, Homo sapiens
atattgctattgtttataggaaat

SEQ ID NO: 451963 - DNA, 17 bp, Homo sapiens
atatttattattttcat

SEQ ID NO: 451964 - DNA, 12 bp, Homo sapiens
atatttcactta

SEQ ID NO: 451965 - DNA, 19 bp, Homo sapiens
atatttgtagctagaatat

SEQ ID NO: 451966 - DNA, 19 bp, Homo sapiens
atattttcaacgcagccct

SEQ ID NO: 451967 - DNA, 16 bp, Homo sapiens
atattttcccatggaa

SEQ ID NO: 451968 - DNA, 12 bp, Homo sapiens
atatttttgaat

SEQ ID NO: 451969 - DNA, 17 bp, Homo sapiens
atatttttttctagcta

SEQ ID NO: 451970 - DNA, 16 bp, Homo sapiens
atcaaaaatattccat

SEQ ID NO: 451971 - DNA, 18 bp, Homo sapiens
atcaatacttttgtgtat

SEQ ID NO: 451972 - DNA, 21 bp, Homo sapiens
atcacagatgggtattaaact

SEQ ID NO: 451973 - DNA, 16 bp, Homo sapiens
atcactgcacctcttt

SEQ ID NO: 451974 - DNA, 20 bp, Homo sapiens
atcactttgagcctgggaaa

SEQ ID NO: 451975 - DNA, 17 bp, Homo sapiens
attctatatttcatatt

SEQ ID NO: 451976 - DNA, 16 bp, Homo sapiens
attctatgcctgtatt

SEQ ID NO: 451977 - DNA, 17 bp, Homo sapiens
attctatgcctgtattt

SEQ ID NO: 451978 - DNA, 15 bp, Homo sapiens
attctattaaaagcc

SEQ ID NO: 451979 - DNA, 18 bp, Homo sapiens
attctggggtggggcttg

SEQ ID NO: 451980 - DNA, 19 bp, Homo sapiens
attctgtagccaacttaaa

SEQ ID NO: 451981 - DNA, 16 bp, Homo sapiens
attctgtccccaaaat

SEQ ID NO: 451982 - DNA, 15 bp, Homo sapiens
attctgtggattcta

SEQ ID NO: 451983 - DNA, 17 bp, Homo sapiens
attctgtggattctata

SEQ ID NO: 451984 - DNA, 13 bp, Homo sapiens
attcttgaataaa

SEQ ID NO: 451985 - DNA, 20 bp, Homo sapiens
attcttgcactgtatccaag

SEQ ID NO: 451986 - DNA, 22 bp, Homo sapiens
attcttgcactgtatccaagtt

SEQ ID NO: 451987 - DNA, 20 bp, Homo sapiens
attctttaacatacatctaa

SEQ ID NO: 451988 - DNA, 21 bp, Homo sapiens
attcttttcagcttgtttcta

SEQ ID NO: 451989 - DNA, 22 bp, Homo sapiens
attcttttcagcttgtttctat

SEQ ID NO: 451990 - DNA, 17 bp, Homo sapiens
attcttttttcaatgta

SEQ ID NO: 451991 - DNA, 21 bp, Homo sapiens
attgaaaatagtaaatgcttt

SEQ ID NO: 451992 - DNA, 13 bp, Homo sapiens
attgaaagggagg

SEQ ID NO: 451993 - DNA, 14 bp, Homo sapiens
attgaatctgattg

SEQ ID NO: 451994 - DNA, 23 bp, Homo sapiens
attgaatctgattggacattttc

SEQ ID NO: 451995 - DNA, 14 bp, Homo sapiens
attgaatgttatat

SEQ ID NO: 451996 - DNA, 21 bp, Homo sapiens
attgaatgttatatcatcaat

SEQ ID NO: 451997 - DNA, 22 bp, Homo sapiens
attgacgacctacatctgaaat

SEQ ID NO: 451998 - DNA, 15 bp, Homo sapiens
attgcaaaaggttaa

SEQ ID NO: 451999 - DNA, 21 bp, Homo sapiens
attgcaaaaggttaagccata

SEQ ID NO: 452000 - DNA, 19 bp, Homo sapiens
attgctattgtttatagga

SEQ ID NO: 452001 - DNA, 17 bp, Homo sapiens
attggacattttcttca

SEQ ID NO: 452002 - DNA, 16 bp, Homo sapiens
attggcagcttcaaaa

SEQ ID NO: 452003 - DNA, 15 bp, Homo sapiens
attggcatggatttc

SEQ ID NO: 452004 - DNA, 14 bp, Homo sapiens
attggctcctttcc

SEQ ID NO: 452005 - DNA, 20 bp, Homo sapiens
attgtattttactttgtgca

SEQ ID NO: 452006 - DNA, 21 bp, Homo sapiens
attgtattttactttgtgcaa

SEQ ID NO: 452007 - DNA, 11 bp, Homo sapiens
attgtgccaaa

SEQ ID NO: 452008 - DNA, 16 bp, Homo sapiens
attgtgccaaagatag

SEQ ID NO: 452009 - DNA, 19 bp, Homo sapiens
attgtgtattatgttgttc

SEQ ID NO: 452010 - DNA, 12 bp, Homo sapiens
attgttatgtaa

SEQ ID NO: 452011 - DNA, 16 bp, Homo sapiens
atttaaaggaaagttc

SEQ ID NO: 452012 - DNA, 21 bp, Homo sapiens
atttaaaggaaagttctatta

SEQ ID NO: 452013 - DNA, 15 bp, Homo sapiens
atttaactgcatata

SEQ ID NO: 452014 - DNA, 13 bp, Homo sapiens
atttaatttcata

SEQ ID NO: 452015 - DNA, 16 bp, Homo sapiens
atttaatttcataaat

SEQ ID NO: 452016 - DNA, 17 bp, Homo sapiens
atttaatttcataaatt

SEQ ID NO: 452017 - DNA, 16 bp, Homo sapiens
atttacagttactgcc

SEQ ID NO: 452018 - DNA, 17 bp, Homo sapiens
atttacagttactgcct

SEQ ID NO: 452019 - DNA, 21 bp, Homo sapiens
atttatcttccatatgctctt

SEQ ID NO: 452020 - DNA, 12 bp, Homo sapiens
atttatttctag

SEQ ID NO: 452021 - DNA, 20 bp, Homo sapiens
atttcaaaatgcatgtgatt

SEQ ID NO: 452022 - DNA, 20 bp, Homo sapiens
atttcaaagaaaacagacca

SEQ ID NO: 452023 - DNA, 18 bp, Homo sapiens
atttcataaacaacttaa

SEQ ID NO: 452024 - DNA, 23 bp, Homo sapiens
atttcatccagtttgttctccgg

SEQ ID NO: 452025 - DNA, 21 bp, Homo sapiens
atttccaccaagggtatctgc

SEQ ID NO: 452026 - DNA, 23 bp, Homo sapiens
atttccgtgagagtcatctcaaa

SEQ ID NO: 452027 - DNA, 13 bp, Homo sapiens
atttctatctgca

SEQ ID NO: 452028 - DNA, 14 bp, Homo sapiens
atttctatctgcaa

SEQ ID NO: 452029 - DNA, 16 bp, Homo sapiens
atttctatctgcaaat

SEQ ID NO: 452030 - DNA, 18 bp, Homo sapiens
atttctattttgcagcag

SEQ ID NO: 452031 - DNA, 15 bp, Homo sapiens
atttctcctctttct

SEQ ID NO: 452032 - DNA, 20 bp, Homo sapiens
atttcttactaaacattttg

SEQ ID NO: 452033 - DNA, 14 bp, Homo sapiens
atttctttgattgt

SEQ ID NO: 452034 - DNA, 18 bp, Homo sapiens
atttgatatacagacctc

SEQ ID NO: 452035 - DNA, 20 bp, Homo sapiens
atttgatatacagacctcca

SEQ ID NO: 452036 - DNA, 22 bp, Homo sapiens
atttgatatacagacctccaga

SEQ ID NO: 452037 - DNA, 23 bp, Homo sapiens
atttgatatacagacctccagat

SEQ ID NO: 452038 - DNA, 17 bp, Homo sapiens
atttgccagacagagat

SEQ ID NO: 452039 - DNA, 23 bp, Homo sapiens
atttgccagacagagatcagaat

SEQ ID NO: 452040 - DNA, 20 bp, Homo sapiens
atttgccgatttcctaagct

SEQ ID NO: 452041 - DNA, 18 bp, Homo sapiens
atttgtagctagaatatc

SEQ ID NO: 452042 - DNA, 21 bp, Homo sapiens
atttgtccatgtgcaaacgct

SEQ ID NO: 452043 - DNA, 22 bp, Homo sapiens
atttgttatatcagcagacact

SEQ ID NO: 452044 - DNA, 14 bp, Homo sapiens
attttaaaaaataa

SEQ ID NO: 452045 - DNA, 19 bp, Homo sapiens
attttaaaatgcaaatatt

SEQ ID NO: 452046 - DNA, 12 bp, Homo sapiens
attttaatgtaa

SEQ ID NO: 452047 - DNA, 20 bp, Homo sapiens
attttaatgtaaaattcata

SEQ ID NO: 452048 - DNA, 15 bp, Homo sapiens
attttactttgtgca

SEQ ID NO: 452049 - DNA, 18 bp, Homo sapiens
attttactttgtgcaata

SEQ ID NO: 452050 - DNA, 16 bp, Homo sapiens
attttagacaaccata

SEQ ID NO: 452051 - DNA, 19 bp, Homo sapiens
attttagatttctttgatt

SEQ ID NO: 452052 - DNA, 13 bp, Homo sapiens
attttctaaactg

SEQ ID NO: 452053 - DNA, 16 bp, Homo sapiens
attttctaaactgttt

SEQ ID NO: 452054 - DNA, 12 bp, Homo sapiens
attttctttcta

SEQ ID NO: 452055 - DNA, 16 bp, Homo sapiens
attttcttttatatct

SEQ ID NO: 452056 - DNA, 22 bp, Homo sapiens
attttcttttatatctgtaaat

SEQ ID NO: 452057 - DNA, 22 bp, Homo sapiens
attttgagacaccaataaaagt

SEQ ID NO: 452058 - DNA, 19 bp, Homo sapiens
atttttaacttatctccag

SEQ ID NO: 452059 - DNA, 14 bp, Homo sapiens
atttttactcaggc

SEQ ID NO: 452060 - DNA, 15 bp, Homo sapiens
atttttactcaggct

SEQ ID NO: 452061 - DNA, 18 bp, Homo sapiens
atttttactcaggctttc

SEQ ID NO: 452062 - DNA, 20 bp, Homo sapiens
atttttactcaggctttcta

SEQ ID NO: 452063 - DNA, 15 bp, Homo sapiens
attttttactacata

SEQ ID NO: 452064 - DNA, 23 bp, Homo sapiens
attttttactacataattaaatt

SEQ ID NO: 452065 - DNA, 11 bp, Homo sapiens
caaaaaagaac

SEQ ID NO: 452066 - DNA, 16 bp, Homo sapiens
caaaaggttaagccat

SEQ ID NO: 452067 - DNA, 17 bp, Homo sapiens
caaaaggttaagccata

SEQ ID NO: 452068 - DNA, 14 bp, Homo sapiens
caaaatacttcttt

SEQ ID NO: 452069 - DNA, 15 bp, Homo sapiens
caaaatagtcatgtt

SEQ ID NO: 452070 - DNA, 17 bp, Homo sapiens
caaaatagttctatttc

SEQ ID NO: 452071 - DNA, 23 bp, Homo sapiens
caaaatagttctatttctatctg

SEQ ID NO: 452072 - DNA, 17 bp, Homo sapiens
atccctgggcccctcca

SEQ ID NO: 452073 - DNA, 21 bp, Homo sapiens
atccctgggcccctccacgcc

SEQ ID NO: 452074 - DNA, 16 bp, Homo sapiens
atccggaacagccaaa

SEQ ID NO: 452075 - DNA, 23 bp, Homo sapiens
atccggaacagccaaagaaactc

SEQ ID NO: 452076 - DNA, 23 bp, Homo sapiens
atcctctgcttgtcattctgcta

SEQ ID NO: 452077 - DNA, 12 bp, Homo sapiens
atcctgaataac

SEQ ID NO: 452078 - DNA, 19 bp, Homo sapiens
atcctgaggaccgccccaa

SEQ ID NO: 452079 - DNA, 19 bp, Homo sapiens
atcctgattattgaatgtt

SEQ ID NO: 452080 - DNA, 15 bp, Homo sapiens
atcctgctagctgta

SEQ ID NO: 452081 - DNA, 16 bp, Homo sapiens
atcctgctagctgtag

SEQ ID NO: 452082 - DNA, 23 bp, Homo sapiens
atcctgtaaggtctgtaaatcag

SEQ ID NO: 452083 - DNA, 13 bp, Homo sapiens
atccttccatcct

SEQ ID NO: 452084 - DNA, 18 bp, Homo sapiens
atccttccatcctgagga

SEQ ID NO: 452085 - DNA, 19 bp, Homo sapiens
atccttccatcctgaggac

SEQ ID NO: 452086 - DNA, 22 bp, Homo sapiens
atccttcccgcagcaccagcct

SEQ ID NO: 452087 - DNA, 23 bp, Homo sapiens
atccttcccgcagcaccagcctg

SEQ ID NO: 452088 - DNA, 24 bp, Homo sapiens
atccttcccgcagcaccagcctga

SEQ ID NO: 452089 - DNA, 18 bp, Homo sapiens
atccttgcacttctgtta

SEQ ID NO: 452090 - DNA, 17 bp, Homo sapiens
atcggttcaagttgatg

SEQ ID NO: 452091 - DNA, 18 bp, Homo sapiens
atcgtttcacatctgtat

SEQ ID NO: 452092 - DNA, 23 bp, Homo sapiens
atctaagtcagtttcacatattt

SEQ ID NO: 452093 - DNA, 15 bp, Homo sapiens
atctagcaagaagat

SEQ ID NO: 452094 - DNA, 21 bp, Homo sapiens
atctagcaagaagattctaaa

SEQ ID NO: 452095 - DNA, 18 bp, Homo sapiens
atctcacagatcttcaac

SEQ ID NO: 452096 - DNA, 20 bp, Homo sapiens
atctcatgtctgtttaatac

SEQ ID NO: 452097 - DNA, 17 bp, Homo sapiens
atctccagccaatttca

SEQ ID NO: 452098 - DNA, 16 bp, Homo sapiens
atctctaaaattctag

SEQ ID NO: 452099 - DNA, 18 bp, Homo sapiens
atctctccccatatataa

SEQ ID NO: 452100 - DNA, 22 bp, Homo sapiens
atctctctggggccctgggcct

SEQ ID NO: 452101 - DNA, 21 bp, Homo sapiens
atctctgctttgtttccttct

SEQ ID NO: 452102 - DNA, 13 bp, Homo sapiens
atctctttctctc

SEQ ID NO: 452103 - DNA, 23 bp, Homo sapiens
atctctttctctctttccatctc

SEQ ID NO: 452104 - DNA, 19 bp, Homo sapiens
atctgaaaagaaatgctaa

SEQ ID NO: 452105 - DNA, 13 bp, Homo sapiens
atctgaaatctac

SEQ ID NO: 452106 - DNA, 15 bp, Homo sapiens
atctgaggagtccaa

SEQ ID NO: 452107 - DNA, 21 bp, Homo sapiens
atctgctgcctctgaaaatat

SEQ ID NO: 452108 - DNA, 21 bp, Homo sapiens
atctggagtctgaaggagagg

SEQ ID NO: 452109 - DNA, 23 bp, Homo sapiens
atctggagtctgaaggagaggag

SEQ ID NO: 452110 - DNA, 19 bp, Homo sapiens
atctggcttctgcattact

SEQ ID NO: 452111 - DNA, 22 bp, Homo sapiens
atctgggttttagaaattctat

SEQ ID NO: 452112 - DNA, 13 bp, Homo sapiens
atctggtgcgtgt

SEQ ID NO: 452113 - DNA, 21 bp, Homo sapiens
atctgtaaatttaactgcata

SEQ ID NO: 452114 - DNA, 15 bp, Homo sapiens
atctgtatatcagct

SEQ ID NO: 452115 - DNA, 16 bp, Homo sapiens
atctgtatatcagctc

SEQ ID NO: 452116 - DNA, 21 bp, Homo sapiens
atctgtatatcagctctaaag

SEQ ID NO: 452117 - DNA, 14 bp, Homo sapiens
atctgtctgagccc

SEQ ID NO: 452118 - DNA, 16 bp, Homo sapiens
atctgtctgagccctg

SEQ ID NO: 452119 - DNA, 22 bp, Homo sapiens
atctgtctgagccctgccctca

SEQ ID NO: 452120 - DNA, 16 bp, Homo sapiens
atctgtctgattctat

SEQ ID NO: 452121 - DNA, 22 bp, Homo sapiens
atctgttatcctgctagctgta

SEQ ID NO: 452122 - DNA, 21 bp, Homo sapiens
atcttatgttgatcgatgtta

SEQ ID NO: 452123 - DNA, 18 bp, Homo sapiens
atcttggtagtacatttt

SEQ ID NO: 452124 - DNA, 12 bp, Homo sapiens
atcttgtaaata

SEQ ID NO: 452125 - DNA, 20 bp, Homo sapiens
atctttgagggctgacaagg

SEQ ID NO: 452126 - DNA, 14 bp, Homo sapiens
atctttgtgacagg

SEQ ID NO: 452127 - DNA, 17 bp, Homo sapiens
atgaaaaaaagggaaaa

SEQ ID NO: 452128 - DNA, 12 bp, Homo sapiens
atgaaagagaaa

SEQ ID NO: 452129 - DNA, 18 bp, Homo sapiens
atgaagttgtaagaaaag

SEQ ID NO: 452130 - DNA, 15 bp, Homo sapiens
atgaataattatgtt

SEQ ID NO: 452131 - DNA, 23 bp, Homo sapiens
atgaataattatgtttacctcac

SEQ ID NO: 452132 - DNA, 21 bp, Homo sapiens
atgaatgagcagttagaaata

SEQ ID NO: 452133 - DNA, 17 bp, Homo sapiens
atgacaatttcaaaatg

SEQ ID NO: 452134 - DNA, 23 bp, Homo sapiens
atgacaatttcaaaatgcatgtg

SEQ ID NO: 452135 - DNA, 13 bp, Homo sapiens
atgacctaaatcc

SEQ ID NO: 452136 - DNA, 21 bp, Homo sapiens
atgacctaaatccattttcta

SEQ ID NO: 452137 - DNA, 15 bp, Homo sapiens
atgactggaaacaag

SEQ ID NO: 452138 - DNA, 12 bp, Homo sapiens
atgagaaattgt

SEQ ID NO: 452139 - DNA, 17 bp, Homo sapiens
atgagaaattgtgccaa

SEQ ID NO: 452140 - DNA, 15 bp, Homo sapiens
atgagctgtgagaag

SEQ ID NO: 452141 - DNA, 16 bp, Homo sapiens
atgaggggactgcatg

SEQ ID NO: 452142 - DNA, 18 bp, Homo sapiens
caagccgtggcttcccgc

SEQ ID NO: 452143 - DNA, 16 bp, Homo sapiens
caagcctgtgaataaa

SEQ ID NO: 452144 - DNA, 22 bp, Homo sapiens
caaggaatgaattttttcctac

SEQ ID NO: 452145 - DNA, 16 bp, Homo sapiens
caaggagtgcccgcct

SEQ ID NO: 452146 - DNA, 14 bp, Homo sapiens
caaggcaagaagtg

SEQ ID NO: 452147 - DNA, 19 bp, Homo sapiens
caagggtatctgctgcctc

SEQ ID NO: 452148 - DNA, 21 bp, Homo sapiens
caaggtgcggaccggagcggc

SEQ ID NO: 452149 - DNA, 22 bp, Homo sapiens
caaggtggtcttggagaggagg

SEQ ID NO: 452150 - DNA, 19 bp, Homo sapiens
caagtcaaacagtgtggct

SEQ ID NO: 452151 - DNA, 19 bp, Homo sapiens
caagtgattgaaaatagta

SEQ ID NO: 452152 - DNA, 14 bp, Homo sapiens
caagtgtgtgtgca

SEQ ID NO: 452153 - DNA, 17 bp, Homo sapiens
caagtgtgtgtgcaatg

SEQ ID NO: 452154 - DNA, 22 bp, Homo sapiens
caagtgtttattaaaatactgt

SEQ ID NO: 452155 - DNA, 12 bp, Homo sapiens
caagtttttggt

SEQ ID NO: 452156 - DNA, 14 bp, Homo sapiens
caataaaagagctt

SEQ ID NO: 452157 - DNA, 16 bp, Homo sapiens
caataaaagagcttta

SEQ ID NO: 452158 - DNA, 17 bp, Homo sapiens
caataaaagagctttat

SEQ ID NO: 452159 - DNA, 13 bp, Homo sapiens
caataaaggtcat

SEQ ID NO: 452160 - DNA, 14 bp, Homo sapiens
caatacattaaaat

SEQ ID NO: 452161 - DNA, 23 bp, Homo sapiens
caataccctagaagaaaacccga

SEQ ID NO: 452162 - DNA, 17 bp, Homo sapiens
caatacttttgtgtatt

SEQ ID NO: 452163 - DNA, 21 bp, Homo sapiens
caatacttttgtgtattctgt

SEQ ID NO: 452164 - DNA, 20 bp, Homo sapiens
caatatgaggggactgcatg

SEQ ID NO: 452165 - DNA, 21 bp, Homo sapiens
caatatgaggggactgcatgc

SEQ ID NO: 452166 - DNA, 22 bp, Homo sapiens
caatatgaggggactgcatgca

SEQ ID NO: 452167 - DNA, 22 bp, Homo sapiens
caatatgggaggaacaaagaca

SEQ ID NO: 452168 - DNA, 16 bp, Homo sapiens
caatcattttgggaaa

SEQ ID NO: 452169 - DNA, 22 bp, Homo sapiens
caatcccaccaaccctcagagc

SEQ ID NO: 452170 - DNA, 15 bp, Homo sapiens
caatcttatgttgat

SEQ ID NO: 452171 - DNA, 17 bp, Homo sapiens
caatgcatacaataaaa

SEQ ID NO: 452172 - DNA, 14 bp, Homo sapiens
caatgcctgcctga

SEQ ID NO: 452173 - DNA, 15 bp, Homo sapiens
caatgccttgttgta

SEQ ID NO: 452174 - DNA, 14 bp, Homo sapiens
caatgtactgtatt

SEQ ID NO: 452175 - DNA, 16 bp, Homo sapiens
caatgtgaaataaaga

SEQ ID NO: 452176 - DNA, 16 bp, Homo sapiens
caattgtcatttataa

SEQ ID NO: 452177 - DNA, 17 bp, Homo sapiens
caattgtcatttataaa

SEQ ID NO: 452178 - DNA, 15 bp, Homo sapiens
caatttaaaggaaag

SEQ ID NO: 452179 - DNA, 19 bp, Homo sapiens
caggcccttcctctccact

SEQ ID NO: 452180 - DNA, 14 bp, Homo sapiens
caggcgcgcaccgc

SEQ ID NO: 452181 - DNA, 15 bp, Homo sapiens
caggcgcgcaccgcc

SEQ ID NO: 452182 - DNA, 16 bp, Homo sapiens
caggcgcgcaccgccc

SEQ ID NO: 452183 - DNA, 19 bp, Homo sapiens
caggcgcgcaccgcccaac

SEQ ID NO: 452184 - DNA, 22 bp, Homo sapiens
caggcgcgcaccgcccaacccc

SEQ ID NO: 452185 - DNA, 13 bp, Homo sapiens
caggcggaggggc

SEQ ID NO: 452186 - DNA, 20 bp, Homo sapiens
caggcggaggggcttggagc

SEQ ID NO: 452187 - DNA, 15 bp, Homo sapiens
caggctcctgtgata

SEQ ID NO: 452188 - DNA, 12 bp, Homo sapiens
caggctcttctc

SEQ ID NO: 452189 - DNA, 14 bp, Homo sapiens
caggctcttctcct

SEQ ID NO: 452190 - DNA, 14 bp, Homo sapiens
caggctgcgcctgc

SEQ ID NO: 452191 - DNA, 15 bp, Homo sapiens
caggctgcgcctgcc

SEQ ID NO: 452192 - DNA, 14 bp, Homo sapiens
caggctggggcctg

SEQ ID NO: 452193 - DNA, 16 bp, Homo sapiens
caggctggggcctggc

SEQ ID NO: 452194 - DNA, 19 bp, Homo sapiens
cagggacccccgaggcccc

SEQ ID NO: 452195 - DNA, 20 bp, Homo sapiens
cagggacccccgaggccccc

SEQ ID NO: 452196 - DNA, 13 bp, Homo sapiens
cagggatggggga

SEQ ID NO: 452197 - DNA, 17 bp, Homo sapiens
cagggcaggagctgctg

SEQ ID NO: 452198 - DNA, 20 bp, Homo sapiens
cagggcatggccaggtggcc

SEQ ID NO: 452199 - DNA, 23 bp, Homo sapiens
cagggccctggggtctctgagca

SEQ ID NO: 452200 - DNA, 18 bp, Homo sapiens
cagggccgcagggcgctc

SEQ ID NO: 452201 - DNA, 21 bp, Homo sapiens
cagggcgctccggcagaggca

SEQ ID NO: 452202 - DNA, 21 bp, Homo sapiens
caggggggttgggttccagac

SEQ ID NO: 452203 - DNA, 23 bp, Homo sapiens
caggggggttgggttccagacag

SEQ ID NO: 452204 - DNA, 17 bp, Homo sapiens
cagggtgcaggcgcgca

SEQ ID NO: 452205 - DNA, 19 bp, Homo sapiens
cagggtgcaggcgcgcacc

SEQ ID NO: 452206 - DNA, 13 bp, Homo sapiens
cagggtggggctt

SEQ ID NO: 452207 - DNA, 16 bp, Homo sapiens
cagggtggggcttaga

SEQ ID NO: 452208 - DNA, 13 bp, Homo sapiens
cagggttccagac

SEQ ID NO: 452209 - DNA, 14 bp, Homo sapiens
cagggttccagaca

SEQ ID NO: 452210 - DNA, 15 bp, Homo sapiens
cagggttccagacag

SEQ ID NO: 452211 - DNA, 17 bp, Homo sapiens
cagggttccagacaggg

SEQ ID NO: 452212 - DNA, 20 bp, Homo sapiens
cagggttccagacagggtgg

SEQ ID NO: 452213 - DNA, 17 bp, Homo sapiens
cagggttctagaagggg

SEQ ID NO: 452214 - DNA, 17 bp, Homo sapiens
cagggtttacccagtgg

SEQ ID NO: 452215 - DNA, 12 bp, Homo sapiens
caggtgaataac

SEQ ID NO: 452216 - DNA, 16 bp, Homo sapiens
caggtggccactccag

SEQ ID NO: 452217 - DNA, 19 bp, Homo sapiens
caggtggccactccagacc

SEQ ID NO: 452218 - DNA, 17 bp, Homo sapiens
caggttcctcctaggcg

SEQ ID NO: 452219 - DNA, 22 bp, Homo sapiens
caggttgtctgaagtcactgca

SEQ ID NO: 452220 - DNA, 18 bp, Homo sapiens
cagtacacccaattttaa

SEQ ID NO: 452221 - DNA, 13 bp, Homo sapiens
cagtacagggcag

SEQ ID NO: 452222 - DNA, 20 bp, Homo sapiens
cagtacagggcaggagctgc

SEQ ID NO: 452223 - DNA, 17 bp, Homo sapiens
cagtacttgctcaataa

SEQ ID NO: 452224 - DNA, 18 bp, Homo sapiens
cagtaggtctgaaggcct

SEQ ID NO: 452225 - DNA, 20 bp, Homo sapiens
cagtaggtctgaaggcctcc

SEQ ID NO: 452226 - DNA, 17 bp, Homo sapiens
cagtagtgcctgtgatc

SEQ ID NO: 452227 - DNA, 18 bp, Homo sapiens
cagtagtgcctgtgatcg

SEQ ID NO: 452228 - DNA, 13 bp, Homo sapiens
cagtattctgtag

SEQ ID NO: 452229 - DNA, 19 bp, Homo sapiens
cagtattctgtagccaact

SEQ ID NO: 452230 - DNA, 15 bp, Homo sapiens
cagtattgacttctt

SEQ ID NO: 452231 - DNA, 17 bp, Homo sapiens
cagtcggagcctcactc

SEQ ID NO: 452232 - DNA, 22 bp, Homo sapiens
cagtctcattacagatttagtt

SEQ ID NO: 452233 - DNA, 15 bp, Homo sapiens
cagtcttgagtgggc

SEQ ID NO: 452234 - DNA, 18 bp, Homo sapiens
cagtctttggagagctca

SEQ ID NO: 452235 - DNA, 22 bp, Homo sapiens
cagtgaagcccaggaggacctg

SEQ ID NO: 452236 - DNA, 12 bp, Homo sapiens
cagtgcatctca

SEQ ID NO: 452237 - DNA, 15 bp, Homo sapiens
cagtgcatctcagcc

SEQ ID NO: 452238 - DNA, 17 bp, Homo sapiens
cagtgcatctcagccca

SEQ ID NO: 452239 - DNA, 18 bp, Homo sapiens
cagtgcatctcagcccac

SEQ ID NO: 452240 - DNA, 12 bp, Homo sapiens
cagtgctgggcc

SEQ ID NO: 452241 - DNA, 14 bp, Homo sapiens
cagtgctgggccca

SEQ ID NO: 452242 - DNA, 16 bp, Homo sapiens
cagtgctgggcccagc

SEQ ID NO: 452243 - DNA, 18 bp, Homo sapiens
cagtgctgggcccagccg

SEQ ID NO: 452244 - DNA, 12 bp, Homo sapiens
cagtggagaggg

SEQ ID NO: 452245 - DNA, 14 bp, Homo sapiens
cagtggagagggga

SEQ ID NO: 452246 - DNA, 19 bp, Homo sapiens
cagtgggacagggcatggc

SEQ ID NO: 452247 - DNA, 20 bp, Homo sapiens
cagtggggcccatggcccca

SEQ ID NO: 452248 - DNA, 19 bp, Homo sapiens
cagtgggggtgcctggtgc

SEQ ID NO: 452249 - DNA, 18 bp, Homo sapiens
cagtgtggcttaaacatt

SEQ ID NO: 452250 - DNA, 15 bp, Homo sapiens
cagtgtgtacttctt

SEQ ID NO: 452251 - DNA, 18 bp, Homo sapiens
cagtgttcagcatagagc

SEQ ID NO: 452252 - DNA, 21 bp, Homo sapiens
cagtgttcagcatagagctat

SEQ ID NO: 452253 - DNA, 21 bp, Homo sapiens
cagtgttgaaattggaaagga

SEQ ID NO: 452254 - DNA, 22 bp, Homo sapiens
cagttagaaatacattatgctt

SEQ ID NO: 452255 - DNA, 21 bp, Homo sapiens
cagttcaacctggtggcacca

SEQ ID NO: 452256 - DNA, 16 bp, Homo sapiens
cagttctcatcttgta

SEQ ID NO: 452257 - DNA, 21 bp, Homo sapiens
cagttctcatcttgtaaataa

SEQ ID NO: 452258 - DNA, 23 bp, Homo sapiens
cagttcttggtgactgtcccacc

SEQ ID NO: 452259 - DNA, 23 bp, Homo sapiens
cagttggtgattttagatttctt

SEQ ID NO: 452260 - DNA, 11 bp, Homo sapiens
cagtttccaag

SEQ ID NO: 452261 - DNA, 22 bp, Homo sapiens
cagtttgcaatcttatgttgat

SEQ ID NO: 452262 - DNA, 11 bp, Homo sapiens
cagtttgccca

SEQ ID NO: 452263 - DNA, 12 bp, Homo sapiens
cagtttgctttg

SEQ ID NO: 452264 - DNA, 16 bp, Homo sapiens
cagtttgttctccggg

SEQ ID NO: 452265 - DNA, 13 bp, Homo sapiens
cataaaaataacc

SEQ ID NO: 452266 - DNA, 18 bp, Homo sapiens
cataaatctgtctgattc

SEQ ID NO: 452267 - DNA, 21 bp, Homo sapiens
cataaatctgtctgattctat

SEQ ID NO: 452268 - DNA, 18 bp, Homo sapiens
cataaattggctcctttc

SEQ ID NO: 452269 - DNA, 19 bp, Homo sapiens
cataaattggctcctttcc

SEQ ID NO: 452270 - DNA, 14 bp, Homo sapiens
cataagccctgaga

SEQ ID NO: 452271 - DNA, 21 bp, Homo sapiens
cataagccctgagactcccgc

SEQ ID NO: 452272 - DNA, 15 bp, Homo sapiens
cataataaaaggcat

SEQ ID NO: 452273 - DNA, 16 bp, Homo sapiens
cataatgatactgaat

SEQ ID NO: 452274 - DNA, 18 bp, Homo sapiens
catacaataaaagagctt

SEQ ID NO: 452275 - DNA, 20 bp, Homo sapiens
catacaataaaagagcttta

SEQ ID NO: 452276 - DNA, 23 bp, Homo sapiens
catactcaaagaggccagtactt

SEQ ID NO: 452277 - DNA, 14 bp, Homo sapiens
catactctgtgtaa

SEQ ID NO: 452278 - DNA, 16 bp, Homo sapiens
catacttcctggattt

SEQ ID NO: 452279 - DNA, 21 bp, Homo sapiens
catagaactgtcccacaaaat

SEQ ID NO: 452280 - DNA, 16 bp, Homo sapiens
catagacaaaggcctt

SEQ ID NO: 452281 - DNA, 21 bp, Homo sapiens
catagacaaaggccttaacaa

SEQ ID NO: 452282 - DNA, 15 bp, Homo sapiens
catagacaagtgttt

SEQ ID NO: 452283 - DNA, 11 bp, Homo sapiens
catagacacag

SEQ ID NO: 452284 - DNA, 12 bp, Homo sapiens
catagacacagt

SEQ ID NO: 452285 - DNA, 22 bp, Homo sapiens
catagacacagtattgacttct

SEQ ID NO: 452286 - DNA, 15 bp, Homo sapiens
catagcatcctgatt

SEQ ID NO: 452287 - DNA, 15 bp, Homo sapiens
catagccattcattt

SEQ ID NO: 452288 - DNA, 19 bp, Homo sapiens
catagccattcatttacaa

SEQ ID NO: 452289 - DNA, 16 bp, Homo sapiens
catagggtttggaaga

SEQ ID NO: 452290 - DNA, 18 bp, Homo sapiens
catagtctttgtttacat

SEQ ID NO: 452291 - DNA, 22 bp, Homo sapiens
catagtctttgtttacatgagt

SEQ ID NO: 452292 - DNA, 18 bp, Homo sapiens
catagtgatggttcccct

SEQ ID NO: 452293 - DNA, 19 bp, Homo sapiens
catagtgtgctcggacaca

SEQ ID NO: 452294 - DNA, 18 bp, Homo sapiens
catagttctgcaataaca

SEQ ID NO: 452295 - DNA, 15 bp, Homo sapiens
catataaatgtttat

SEQ ID NO: 452296 - DNA, 23 bp, Homo sapiens
catatatgagggagtatgacgtt

SEQ ID NO: 452297 - DNA, 15 bp, Homo sapiens
catatcagctctgca

SEQ ID NO: 452298 - DNA, 17 bp, Homo sapiens
catatgacaatttcaaa

SEQ ID NO: 452299 - DNA, 17 bp, Homo sapiens
catatgattgaaaagaa

SEQ ID NO: 452300 - DNA, 12 bp, Homo sapiens
catattcttgct

SEQ ID NO: 452301 - DNA, 11 bp, Homo sapiens
catcaaagact

SEQ ID NO: 452302 - DNA, 21 bp, Homo sapiens
catcatgtctctttgccaagg

SEQ ID NO: 452303 - DNA, 20 bp, Homo sapiens
catccaccgccaccccactg

SEQ ID NO: 452304 - DNA, 16 bp, Homo sapiens
catcccctcctagcac

SEQ ID NO: 452305 - DNA, 13 bp, Homo sapiens
catccctgggccc

SEQ ID NO: 452306 - DNA, 13 bp, Homo sapiens
catcccttggccc

SEQ ID NO: 452307 - DNA, 19 bp, Homo sapiens
catcccttggcccctctct

SEQ ID NO: 452308 - DNA, 12 bp, Homo sapiens
catcctgaggac

SEQ ID NO: 452309 - DNA, 15 bp, Homo sapiens
catccttccatcctg

SEQ ID NO: 452310 - DNA, 19 bp, Homo sapiens
catccttcccgcagcacca

SEQ ID NO: 452311 - DNA, 20 bp, Homo sapiens
catccttcccgcagcaccag

SEQ ID NO: 452312 - DNA, 12 bp, Homo sapiens
catctaaaccac

SEQ ID NO: 452313 - DNA, 20 bp, Homo sapiens
catctctccccatatataaa

SEQ ID NO: 452314 - DNA, 14 bp, Homo sapiens
catctgaaaagaaa

SEQ ID NO: 452315 - DNA, 15 bp, Homo sapiens
catctgaaaagaaat

SEQ ID NO: 452316 - DNA, 12 bp, Homo sapiens
catctgaaatct

SEQ ID NO: 452317 - DNA, 17 bp, Homo sapiens
catctgaggagtccaaa

SEQ ID NO: 452318 - DNA, 18 bp, Homo sapiens
catctgtatatcagctct

SEQ ID NO: 452319 - DNA, 19 bp, Homo sapiens
catctgtatatcagctcta

SEQ ID NO: 452320 - DNA, 17 bp, Homo sapiens
catctgttatcctgcta

SEQ ID NO: 452321 - DNA, 14 bp, Homo sapiens
catgatattgtatg

SEQ ID NO: 452322 - DNA, 12 bp, Homo sapiens
catgatctgtat

SEQ ID NO: 452323 - DNA, 15 bp, Homo sapiens
catgcatagacaagt

SEQ ID NO: 452324 - DNA, 23 bp, Homo sapiens
catgcggctgcccacgctcctgc

SEQ ID NO: 452325 - DNA, 16 bp, Homo sapiens
catggatgattctttt

SEQ ID NO: 452326 - DNA, 20 bp, Homo sapiens
catggatgattcttttccca

SEQ ID NO: 452327 - DNA, 13 bp, Homo sapiens
catggccaggtgg

SEQ ID NO: 452328 - DNA, 14 bp, Homo sapiens
catggccccagctg

SEQ ID NO: 452329 - DNA, 17 bp, Homo sapiens
catggccccagctggct

SEQ ID NO: 452330 - DNA, 15 bp, Homo sapiens
catggtttaaagtca

SEQ ID NO: 452331 - DNA, 12 bp, Homo sapiens
catgtagcatat

SEQ ID NO: 452332 - DNA, 15 bp, Homo sapiens
catgtagcatataaa

SEQ ID NO: 452333 - DNA, 17 bp, Homo sapiens
catgtagcatataaatg

SEQ ID NO: 452334 - DNA, 20 bp, Homo sapiens
catgtagcatataaatgttt

SEQ ID NO: 452335 - DNA, 15 bp, Homo sapiens
catgtctctttgcca

SEQ ID NO: 452336 - DNA, 21 bp, Homo sapiens
catgtctctttgccaagggag

SEQ ID NO: 452337 - DNA, 16 bp, Homo sapiens
catgtgcctgcaccag

SEQ ID NO: 452338 - DNA, 21 bp, Homo sapiens
catgtgcctgcaccaggagac

SEQ ID NO: 452339 - DNA, 14 bp, Homo sapiens
catgtgtcccctca

SEQ ID NO: 452340 - DNA, 16 bp, Homo sapiens
catgtgtcccctcact

SEQ ID NO: 452341 - DNA, 17 bp, Homo sapiens
catgtgtcccctcactc

SEQ ID NO: 452342 - DNA, 12 bp, Homo sapiens
catgtttaagaa

SEQ ID NO: 452343 - DNA, 18 bp, Homo sapiens
catgtttaagaaatgaga

SEQ ID NO: 452344 - DNA, 22 bp, Homo sapiens
catgttttgaatgattgaagat

SEQ ID NO: 452345 - DNA, 17 bp, Homo sapiens
cattacatcctctgctt

SEQ ID NO: 452346 - DNA, 22 bp, Homo sapiens
cattacatcctctgcttgtcat

SEQ ID NO: 452347 - DNA, 23 bp, Homo sapiens
cattacatcctctgcttgtcatt

SEQ ID NO: 452348 - DNA, 20 bp, Homo sapiens
cattactattaactctgcat

SEQ ID NO: 452349 - DNA, 16 bp, Homo sapiens
cattagactgaattta

SEQ ID NO: 452350 - DNA, 17 bp, Homo sapiens
cattagcagtttgcttt

SEQ ID NO: 452351 - DNA, 23 bp, Homo sapiens
cattatccttttatctcacaaat

SEQ ID NO: 452352 - DNA, 16 bp, Homo sapiens
cattcaaaatagttct

SEQ ID NO: 452353 - DNA, 18 bp, Homo sapiens
cattcaaaatagttctat

SEQ ID NO: 452354 - DNA, 18 bp, Homo sapiens
cattcaagcctgtgaata

SEQ ID NO: 452355 - DNA, 13 bp, Homo sapiens
cattccccatggg

SEQ ID NO: 452356 - DNA, 22 bp, Homo sapiens
cattcttttcagcttgtttcta

SEQ ID NO: 452357 - DNA, 18 bp, Homo sapiens
catttacaacttccagat

SEQ ID NO: 452358 - DNA, 15 bp, Homo sapiens
catttagtcctcacc

SEQ ID NO: 452359 - DNA, 15 bp, Homo sapiens
catttatctactatt

SEQ ID NO: 452360 - DNA, 22 bp, Homo sapiens
catttccaccaagggtatctgc

SEQ ID NO: 452361 - DNA, 23 bp, Homo sapiens
catttccaccaagggtatctgct

SEQ ID NO: 452362 - DNA, 23 bp, Homo sapiens
catttccgtgagagtcatctcaa

SEQ ID NO: 452363 - DNA, 13 bp, Homo sapiens
catttcctgacag

SEQ ID NO: 452364 - DNA, 15 bp, Homo sapiens
catttgagagaagcc

SEQ ID NO: 452365 - DNA, 14 bp, Homo sapiens
catttgatttgata

SEQ ID NO: 452366 - DNA, 15 bp, Homo sapiens
cattttgtctggctg

SEQ ID NO: 452367 - DNA, 21 bp, Homo sapiens
cattttgtctggctgtggccc

SEQ ID NO: 452368 - DNA, 19 bp, Homo sapiens
ccaaaaaatgtgagctata

SEQ ID NO: 452369 - DNA, 15 bp, Homo sapiens
ccaaaatgtggaatg

SEQ ID NO: 452370 - DNA, 16 bp, Homo sapiens
ccaaacattcttattt

SEQ ID NO: 452371 - DNA, 11 bp, Homo sapiens
ccaaagaaact

SEQ ID NO: 452372 - DNA, 12 bp, Homo sapiens
ccaaagaaactc

SEQ ID NO: 452373 - DNA, 16 bp, Homo sapiens
ccaacaccaccccttg

SEQ ID NO: 452374 - DNA, 12 bp, Homo sapiens
ccaacagacacc

SEQ ID NO: 452375 - DNA, 16 bp, Homo sapiens
ccaacccccacctccc

SEQ ID NO: 452376 - DNA, 17 bp, Homo sapiens
ccaacccccacctcccg

SEQ ID NO: 452377 - DNA, 18 bp, Homo sapiens
ccaacccccacctcccgg

SEQ ID NO: 452378 - DNA, 14 bp, Homo sapiens
ccaaccctcagagc

SEQ ID NO: 452379 - DNA, 16 bp, Homo sapiens
ccaacctcactgccct

SEQ ID NO: 452380 - DNA, 21 bp, Homo sapiens
ccaacgggtctgtgggactgg

SEQ ID NO: 452381 - DNA, 19 bp, Homo sapiens
ccaactccgcccagcctct

SEQ ID NO: 452382 - DNA, 21 bp, Homo sapiens
ccaactccgcccagcctctcc

SEQ ID NO: 452383 - DNA, 14 bp, Homo sapiens
ccaactgagccaaa

SEQ ID NO: 452384 - DNA, 21 bp, Homo sapiens
ccaactggaaggctttattct

SEQ ID NO: 452385 - DNA, 15 bp, Homo sapiens
ccaacttaaacctgt

SEQ ID NO: 452386 - DNA, 16 bp, Homo sapiens
ccaagatgagctgcag

SEQ ID NO: 452387 - DNA, 19 bp, Homo sapiens
ccaagatgagctgcagccc

SEQ ID NO: 452388 - DNA, 19 bp, Homo sapiens
ccaagccagggttccagac

SEQ ID NO: 452389 - DNA, 20 bp, Homo sapiens
ccaagccagggttccagaca

SEQ ID NO: 452390 - DNA, 22 bp, Homo sapiens
ccaagccagggttccagacagg

SEQ ID NO: 452391 - DNA, 13 bp, Homo sapiens
ccaagccgtggct

SEQ ID NO: 452392 - DNA, 15 bp, Homo sapiens
ccaaggacactgatg

SEQ ID NO: 452393 - DNA, 24 bp, Homo sapiens
ccaagtaaccaggccccagcctcc

SEQ ID NO: 452394 - DNA, 19 bp, Homo sapiens
ccaagtcaaacagtgtggc

SEQ ID NO: 452395 - DNA, 17 bp, Homo sapiens
ccaagtgtgtgtgcaat

SEQ ID NO: 452396 - DNA, 22 bp, Homo sapiens
ccaagttatttgatctggtgcg

SEQ ID NO: 452397 - DNA, 20 bp, Homo sapiens
ccaagttcattcatactcaa

SEQ ID NO: 452398 - DNA, 20 bp, Homo sapiens
ccaatcaacagcatgtctac

SEQ ID NO: 452399 - DNA, 23 bp, Homo sapiens
ccaatcaacagcatgtctactgc

SEQ ID NO: 452400 - DNA, 15 bp, Homo sapiens
ccacacacacccttc

SEQ ID NO: 452401 - DNA, 21 bp, Homo sapiens
ccacacacacccttccccact

SEQ ID NO: 452402 - DNA, 19 bp, Homo sapiens
ccacacgccggggctggcc

SEQ ID NO: 452403 - DNA, 23 bp, Homo sapiens
ccacacgccggggctggccctgc

SEQ ID NO: 452404 - DNA, 21 bp, Homo sapiens
ccacacttcaggctcttctcc

SEQ ID NO: 452405 - DNA, 18 bp, Homo sapiens
ccacaggacacgaaggct

SEQ ID NO: 452406 - DNA, 18 bp, Homo sapiens
ccacaggcccttcctctc

SEQ ID NO: 452407 - DNA, 22 bp, Homo sapiens
ccacaggcccttcctctccact

SEQ ID NO: 452408 - DNA, 15 bp, Homo sapiens
ccacagtggggccca

SEQ ID NO: 452409 - DNA, 22 bp, Homo sapiens
ccacagtggggcccatggcccc

SEQ ID NO: 452410 - DNA, 21 bp, Homo sapiens
ccacatagtgatggttcccct

SEQ ID NO: 452411 - DNA, 23 bp, Homo sapiens
ccacatagtgatggttcccctgt

SEQ ID NO: 452412 - DNA, 13 bp, Homo sapiens
ccacattctgtcc

SEQ ID NO: 452413 - DNA, 15 bp, Homo sapiens
ccaccaaccctcaga

SEQ ID NO: 452414 - DNA, 11 bp, Homo sapiens
ccaccaccgct

SEQ ID NO: 452415 - DNA, 21 bp, Homo sapiens
ccaccatccttccatcctgag

SEQ ID NO: 452416 - DNA, 21 bp, Homo sapiens
ccacccacaccccgtctgccc

SEQ ID NO: 452417 - DNA, 23 bp, Homo sapiens
ccacccacaccccgtctgcccct

SEQ ID NO: 452418 - DNA, 16 bp, Homo sapiens
ccacccactagccctc

SEQ ID NO: 452419 - DNA, 14 bp, Homo sapiens
ccacccagaccctc

SEQ ID NO: 452420 - DNA, 13 bp, Homo sapiens
ccacccagaggtc

SEQ ID NO: 452421 - DNA, 23 bp, Homo sapiens
ccaccccactgagagctgctcct

SEQ ID NO: 452422 - DNA, 13 bp, Homo sapiens
ccaccccgctgcc

SEQ ID NO: 452423 - DNA, 14 bp, Homo sapiens
ccaccccgctgcct

SEQ ID NO: 452424 - DNA, 15 bp, Homo sapiens
ccaccccgctgcctg

SEQ ID NO: 452425 - DNA, 17 bp, Homo sapiens
ccaccccggctccccct

SEQ ID NO: 452426 - DNA, 12 bp, Homo sapiens
ccaccccgtccc

SEQ ID NO: 452427 - DNA, 15 bp, Homo sapiens
ccaccccgtcccggc

SEQ ID NO: 452428 - DNA, 22 bp, Homo sapiens
ccaccccgtcccggccccgcgc

SEQ ID NO: 452429 - DNA, 18 bp, Homo sapiens
ccacccctcaagccagga

SEQ ID NO: 452430 - DNA, 13 bp, Homo sapiens
ccacccctcttcc

SEQ ID NO: 452431 - DNA, 16 bp, Homo sapiens
ccacccctcttccccc

SEQ ID NO: 452432 - DNA, 12 bp, Homo sapiens
ccaccccttgcc

SEQ ID NO: 452433 - DNA, 17 bp, Homo sapiens
ccacccgccccagagac

SEQ ID NO: 452434 - DNA, 23 bp, Homo sapiens
ccacccgccccagagactgccca

SEQ ID NO: 452435 - DNA, 14 bp, Homo sapiens
ccaccctctggtcc

SEQ ID NO: 452436 - DNA, 14 bp, Homo sapiens
ccaccgccacccca

SEQ ID NO: 452437 - DNA, 15 bp, Homo sapiens
ccaccgccaccccac

SEQ ID NO: 452438 - DNA, 14 bp, Homo sapiens
ccaccgggagcctc

SEQ ID NO: 452439 - DNA, 17 bp, Homo sapiens
ccaccgggagcctcccc

SEQ ID NO: 452440 - DNA, 20 bp, Homo sapiens
ccaccgggagcctccccctc

SEQ ID NO: 452441 - DNA, 13 bp, Homo sapiens
ccacctgcagtta

SEQ ID NO: 452442 - DNA, 15 bp, Homo sapiens
ccacctgcccagtta

SEQ ID NO: 452443 - DNA, 12 bp, Homo sapiens
ccacctgtgctg

SEQ ID NO: 452444 - DNA, 15 bp, Homo sapiens
ccacctgtgctgctg

SEQ ID NO: 452445 - DNA, 17 bp, Homo sapiens
ccacctgtgctgctgca

SEQ ID NO: 452446 - DNA, 15 bp, Homo sapiens
ccacgcagagccccg

SEQ ID NO: 452447 - DNA, 16 bp, Homo sapiens
ccacgcctcctggcca

SEQ ID NO: 452448 - DNA, 14 bp, Homo sapiens
ccacgctcctgccc

SEQ ID NO: 452449 - DNA, 13 bp, Homo sapiens
ccacgctgtcctc

SEQ ID NO: 452450 - DNA, 14 bp, Homo sapiens
ccacgctgtcctct

SEQ ID NO: 452451 - DNA, 21 bp, Homo sapiens
ccacgctgtcctctcgagccc

SEQ ID NO: 452452 - DNA, 17 bp, Homo sapiens
ccacggccgtccctgac

SEQ ID NO: 452453 - DNA, 22 bp, Homo sapiens
ccacgttgcagaaaaagagctt

SEQ ID NO: 452454 - DNA, 13 bp, Homo sapiens
ccactagccctct

SEQ ID NO: 452455 - DNA, 19 bp, Homo sapiens
ccactagccctctttctct

SEQ ID NO: 452456 - DNA, 22 bp, Homo sapiens
ccactagccctctttctctctg

SEQ ID NO: 452457 - DNA, 17 bp, Homo sapiens
ccactaggtgcccagtc

SEQ ID NO: 452458 - DNA, 21 bp, Homo sapiens
ccactaggtgcccagtcttga

SEQ ID NO: 452459 - DNA, 21 bp, Homo sapiens
ccactcagtaggtctgaaggc

SEQ ID NO: 452460 - DNA, 24 bp, Homo sapiens
ccactcagtaggtctgaaggcctc

SEQ ID NO: 452461 - DNA, 21 bp, Homo sapiens
ccactccagacccctggcttt

SEQ ID NO: 452462 - DNA, 22 bp, Homo sapiens
ccactccagacccctggctttt

SEQ ID NO: 452463 - DNA, 13 bp, Homo sapiens
ccactcccctcat

SEQ ID NO: 452464 - DNA, 23 bp, Homo sapiens
ccactctgaagtcccttcctgtc

SEQ ID NO: 452465 - DNA, 19 bp, Homo sapiens
ccactctgaggtctcacct

SEQ ID NO: 452466 - DNA, 22 bp, Homo sapiens
ccactgatatcacgggcccgct

SEQ ID NO: 452467 - DNA, 15 bp, Homo sapiens
ccacttatgctgctg

SEQ ID NO: 452468 - DNA, 16 bp, Homo sapiens
ccacttatgctgctgt

SEQ ID NO: 452469 - DNA, 17 bp, Homo sapiens
ccactttcctctctctc

SEQ ID NO: 452470 - DNA, 14 bp, Homo sapiens
ccagaaaaaaggac

SEQ ID NO: 452471 - DNA, 15 bp, Homo sapiens
ccagaacaaaagata

SEQ ID NO: 452472 - DNA, 13 bp, Homo sapiens
ccagaacgggcct

SEQ ID NO: 452473 - DNA, 16 bp, Homo sapiens
ccagaacgggcctccc

SEQ ID NO: 452474 - DNA, 20 bp, Homo sapiens
ccagaacgggcctccccggg

SEQ ID NO: 452475 - DNA, 14 bp, Homo sapiens
ccagacagagatca

SEQ ID NO: 452476 - DNA, 15 bp, Homo sapiens
ccagacagagatcag

SEQ ID NO: 452477 - DNA, 17 bp, Homo sapiens
ccagacagggtggggct

SEQ ID NO: 452478 - DNA, 14 bp, Homo sapiens
ccagacattgtatt

SEQ ID NO: 452479 - DNA, 16 bp, Homo sapiens
ccagacccctggcttt

SEQ ID NO: 452480 - DNA, 12 bp, Homo sapiens
ccagaccctcct

SEQ ID NO: 452481 - DNA, 15 bp, Homo sapiens
ccagaccctccttcc

SEQ ID NO: 452482 - DNA, 16 bp, Homo sapiens
ccagaccctccttccc

SEQ ID NO: 452483 - DNA, 14 bp, Homo sapiens
ccagagactgccca

SEQ ID NO: 452484 - DNA, 19 bp, Homo sapiens
ccagagactgcccaccctg

SEQ ID NO: 452485 - DNA, 22 bp, Homo sapiens
ccagagactgcccaccctgggc

SEQ ID NO: 452486 - DNA, 23 bp, Homo sapiens
ccagagagaaagaagatttatta

SEQ ID NO: 452487 - DNA, 16 bp, Homo sapiens
ccagagagtggctcct

SEQ ID NO: 452488 - DNA, 13 bp, Homo sapiens
ccagaggtctccc

SEQ ID NO: 452489 - DNA, 15 bp, Homo sapiens
ccagaggtctcccta

SEQ ID NO: 452490 - DNA, 18 bp, Homo sapiens
ccagagtaggtgggtctt

SEQ ID NO: 452491 - DNA, 20 bp, Homo sapiens
ccagatgacacataaatctg

SEQ ID NO: 452492 - DNA, 17 bp, Homo sapiens
ccagatgcaacctcact

SEQ ID NO: 452493 - DNA, 17 bp, Homo sapiens
ccagcaatgcctgcctg

SEQ ID NO: 452494 - DNA, 12 bp, Homo sapiens
ccagcaccctct

SEQ ID NO: 452495 - DNA, 20 bp, Homo sapiens
ccagcactaaggccgtgtct

SEQ ID NO: 452496 - DNA, 13 bp, Homo sapiens
ccagcactcccag

SEQ ID NO: 452497 - DNA, 14 bp, Homo sapiens
ccagcagtgctggg

SEQ ID NO: 452498 - DNA, 17 bp, Homo sapiens
ccagcagtgctgggccc

SEQ ID NO: 452499 - DNA, 20 bp, Homo sapiens
ccagcagtgctgggcccagc

SEQ ID NO: 452500 - DNA, 22 bp, Homo sapiens
ccagcagtgctgggcccagccg

SEQ ID NO: 452501 - DNA, 18 bp, Homo sapiens
ccagcatagttctgcaat

SEQ ID NO: 452502 - DNA, 16 bp, Homo sapiens
ccagccgccctgggct

SEQ ID NO: 452503 - DNA, 17 bp, Homo sapiens
ccagccgccctgggctg

SEQ ID NO: 452504 - DNA, 14 bp, Homo sapiens
ccagccggggtggg

SEQ ID NO: 452505 - DNA, 13 bp, Homo sapiens
ccagcctccccca

SEQ ID NO: 452506 - DNA, 15 bp, Homo sapiens
ccagcctcccccagg

SEQ ID NO: 452507 - DNA, 16 bp, Homo sapiens
ccagcctcccccaggc

SEQ ID NO: 452508 - DNA, 18 bp, Homo sapiens
ccagcctcccccaggctg

SEQ ID NO: 452509 - DNA, 23 bp, Homo sapiens
ccagcctcccccaggctgcgcct

SEQ ID NO: 452510 - DNA, 13 bp, Homo sapiens
ccagcctgagcca

SEQ ID NO: 452511 - DNA, 14 bp, Homo sapiens
ccagcctgagccac

SEQ ID NO: 452512 - DNA, 16 bp, Homo sapiens
ccagcctgagccacag

SEQ ID NO: 452513 - DNA, 14 bp, Homo sapiens
ccagctatctgtca

SEQ ID NO: 452514 - DNA, 15 bp, Homo sapiens
ccagctatctgtcat

SEQ ID NO: 452515 - DNA, 13 bp, Homo sapiens
ccagctggctggg

SEQ ID NO: 452516 - DNA, 23 bp, Homo sapiens
ccagctggctgggtcgcccctcc

SEQ ID NO: 452517 - DNA, 12 bp, Homo sapiens
ccaggagaccct

SEQ ID NO: 452518 - DNA, 13 bp, Homo sapiens
ccaggaggacctg

SEQ ID NO: 452519 - DNA, 15 bp, Homo sapiens
ccaggccccagcctc

SEQ ID NO: 452520 - DNA, 17 bp, Homo sapiens
ccaggccccagcctcca

SEQ ID NO: 452521 - DNA, 17 bp, Homo sapiens
ccaggccctccctgact

SEQ ID NO: 452522 - DNA, 22 bp, Homo sapiens
ccaggcggaggggcttggagca

SEQ ID NO: 452523 - DNA, 23 bp, Homo sapiens
ccaggcggaggggcttggagcag

SEQ ID NO: 452524 - DNA, 24 bp, Homo sapiens
ccaggcggaggggcttggagcaga

SEQ ID NO: 452525 - DNA, 14 bp, Homo sapiens
ccaggctgcgcctg

SEQ ID NO: 452526 - DNA, 17 bp, Homo sapiens
ccaggctgcgcctgccc

SEQ ID NO: 452527 - DNA, 18 bp, Homo sapiens
ccaggctgcgcctgcccg

SEQ ID NO: 452528 - DNA, 20 bp, Homo sapiens
ccaggctgcgcctgcccgcc

SEQ ID NO: 452529 - DNA, 19 bp, Homo sapiens
ccaggctggggcctggcct

SEQ ID NO: 452530 - DNA, 22 bp, Homo sapiens
ccagggacccccgaggcccccc

SEQ ID NO: 452531 - DNA, 17 bp, Homo sapiens
ccagggatgggggatgg

SEQ ID NO: 452532 - DNA, 22 bp, Homo sapiens
ccagggcccgagcgcgtgcctt

SEQ ID NO: 452533 - DNA, 18 bp, Homo sapiens
ccagggttaaagaaaggc

SEQ ID NO: 452534 - DNA, 19 bp, Homo sapiens
ccaggtggggccggggact

SEQ ID NO: 452535 - DNA, 12 bp, Homo sapiens
ccagtgggacag

SEQ ID NO: 452536 - DNA, 17 bp, Homo sapiens
ccagtgggacagaggag

SEQ ID NO: 452537 - DNA, 19 bp, Homo sapiens
ccagttagcccggccaagg

SEQ ID NO: 452538 - DNA, 21 bp, Homo sapiens
ccagttagcccggccaaggac

SEQ ID NO: 452539 - DNA, 18 bp, Homo sapiens
ccagtttgggaactcatc

SEQ ID NO: 452540 - DNA, 15 bp, Homo sapiens
ccataagccctgaga

SEQ ID NO: 452541 - DNA, 16 bp, Homo sapiens
ccataagccctgagac

SEQ ID NO: 452542 - DNA, 14 bp, Homo sapiens
ccatatataaatta

SEQ ID NO: 452543 - DNA, 22 bp, Homo sapiens
ccatatataaattattacttta

SEQ ID NO: 452544 - DNA, 23 bp, Homo sapiens
ccatatgacaatttcaaaatgca

SEQ ID NO: 452545 - DNA, 17 bp, Homo sapiens
ccatatgattgaaaaga

SEQ ID NO: 452546 - DNA, 12 bp, Homo sapiens
ccatccctgggc

SEQ ID NO: 452547 - DNA, 17 bp, Homo sapiens
ccatccctgggcccctc

SEQ ID NO: 452548 - DNA, 13 bp, Homo sapiens
ccatccttccatc

SEQ ID NO: 452549 - DNA, 17 bp, Homo sapiens
ccatccttcccgcagca

SEQ ID NO: 452550 - DNA, 21 bp, Homo sapiens
ccatccttcccgcagcaccag

SEQ ID NO: 452551 - DNA, 16 bp, Homo sapiens
ccatgctcagaaatgt

SEQ ID NO: 452552 - DNA, 14 bp, Homo sapiens
ccatggccccagct

SEQ ID NO: 452553 - DNA, 21 bp, Homo sapiens
ccatggtggtttcagaaaggg

SEQ ID NO: 452554 - DNA, 20 bp, Homo sapiens
ccatgtgcaaacgctgtatt

SEQ ID NO: 452555 - DNA, 15 bp, Homo sapiens
ccatgtgcctgcacc

SEQ ID NO: 452556 - DNA, 20 bp, Homo sapiens
ccatgtgcctgcaccaggag

SEQ ID NO: 452557 - DNA, 13 bp, Homo sapiens
ccatgtgtcccct

SEQ ID NO: 452558 - DNA, 18 bp, Homo sapiens
ccatgtgtcccctcactc

SEQ ID NO: 452559 - DNA, 16 bp, Homo sapiens
ccattcatttacaact

SEQ ID NO: 452560 - DNA, 18 bp, Homo sapiens
ccatttagtcctcacctt

SEQ ID NO: 452561 - DNA, 14 bp, Homo sapiens
ccatttatctacta

SEQ ID NO: 452562 - DNA, 21 bp, Homo sapiens
ccatttgtaccgaaacacccc

SEQ ID NO: 452563 - DNA, 21 bp, Homo sapiens
ccattttgtctggctgtggcc

SEQ ID NO: 452564 - DNA, 15 bp, Homo sapiens
cccaacccccacctc

SEQ ID NO: 452565 - DNA, 14 bp, Homo sapiens
cccaaccctcggag

SEQ ID NO: 452566 - DNA, 16 bp, Homo sapiens
cccaactccgcccagc

SEQ ID NO: 452567 - DNA, 14 bp, Homo sapiens
cccaactctggcct

SEQ ID NO: 452568 - DNA, 21 bp, Homo sapiens
cccaagaatagatgctgactg

SEQ ID NO: 452569 - DNA, 18 bp, Homo sapiens
cccaaggtggtcttggag

SEQ ID NO: 452570 - DNA, 19 bp, Homo sapiens
cccaattatcctccttcac

SEQ ID NO: 452571 - DNA, 19 bp, Homo sapiens
cccacaccccgtctgcccc

SEQ ID NO: 452572 - DNA, 16 bp, Homo sapiens
cccacacgccggggct

SEQ ID NO: 452573 - DNA, 19 bp, Homo sapiens
cccacacgccggggctggc

SEQ ID NO: 452574 - DNA, 18 bp, Homo sapiens
cccacaggcccttcctct

SEQ ID NO: 452575 - DNA, 19 bp, Homo sapiens
cccaccatccttccatcct

SEQ ID NO: 452576 - DNA, 13 bp, Homo sapiens
cccacccacaccc

SEQ ID NO: 452577 - DNA, 13 bp, Homo sapiens
cccaccccataag

SEQ ID NO: 452578 - DNA, 22 bp, Homo sapiens
cccaccccataagccctgagac

SEQ ID NO: 452579 - DNA, 22 bp, Homo sapiens
cccaccccgctgcctggcgggc

SEQ ID NO: 452580 - DNA, 18 bp, Homo sapiens
cccacccctcttccccct

SEQ ID NO: 452581 - DNA, 17 bp, Homo sapiens
cccacccgccccagaga

SEQ ID NO: 452582 - DNA, 21 bp, Homo sapiens
cccaccctctggtccttctga

SEQ ID NO: 452583 - DNA, 21 bp, Homo sapiens
cccaccgggagcctccccctc

SEQ ID NO: 452584 - DNA, 17 bp, Homo sapiens
cccacgcagagccccgg

SEQ ID NO: 452585 - DNA, 18 bp, Homo sapiens
cccacgcagagccccgga

SEQ ID NO: 452586 - DNA, 19 bp, Homo sapiens
cccacgcagagccccggag

SEQ ID NO: 452587 - DNA, 13 bp, Homo sapiens
cccactagccctc

SEQ ID NO: 452588 - DNA, 15 bp, Homo sapiens
cccactagccctctt

SEQ ID NO: 452589 - DNA, 12 bp, Homo sapiens
cccactcccgtg

SEQ ID NO: 452590 - DNA, 15 bp, Homo sapiens
cccacttatgctgct

SEQ ID NO: 452591 - DNA, 15 bp, Homo sapiens
cccagaacgggcctc

SEQ ID NO: 452592 - DNA, 13 bp, Homo sapiens
cccagaccctcct

SEQ ID NO: 452593 - DNA, 17 bp, Homo sapiens
cccagagactgcccacc

SEQ ID NO: 452594 - DNA, 21 bp, Homo sapiens
cccagagactgcccaccctgg

SEQ ID NO: 452595 - DNA, 15 bp, Homo sapiens
cccagcacctggcac

SEQ ID NO: 452596 - DNA, 20 bp, Homo sapiens
cccagcactaaggccgtgtc

SEQ ID NO: 452597 - DNA, 21 bp, Homo sapiens
cccagcactaaggccgtgtct

SEQ ID NO: 452598 - DNA, 15 bp, Homo sapiens
cccagccggggtggg

SEQ ID NO: 452599 - DNA, 22 bp, Homo sapiens
cccagccggggtggggtgcctg

SEQ ID NO: 452600 - DNA, 11 bp, Homo sapiens
cccagcctccc

SEQ ID NO: 452601 - DNA, 18 bp, Homo sapiens
cccagcctcccccaggct

SEQ ID NO: 452602 - DNA, 23 bp, Homo sapiens
cccagcctcccccaggctgcgcc

SEQ ID NO: 452603 - DNA, 16 bp, Homo sapiens
cccagctggcagcgcc

SEQ ID NO: 452604 - DNA, 12 bp, Homo sapiens
cccagctggctg

SEQ ID NO: 452605 - DNA, 16 bp, Homo sapiens
cccagctggctgggtc

SEQ ID NO: 452606 - DNA, 23 bp, Homo sapiens
cccagctggctgggtcgcccctc

SEQ ID NO: 452607 - DNA, 13 bp, Homo sapiens
cccaggaggacct

SEQ ID NO: 452608 - DNA, 13 bp, Homo sapiens
cccaggccctccc

SEQ ID NO: 452609 - DNA, 18 bp, Homo sapiens
cccaggcggaggggcttg

SEQ ID NO: 452610 - DNA, 19 bp, Homo sapiens
cccaggctgcgcctgcccg

SEQ ID NO: 452611 - DNA, 20 bp, Homo sapiens
cccaggctgcgcctgcccgc

SEQ ID NO: 452612 - DNA, 14 bp, Homo sapiens
cccagggcccgagc

SEQ ID NO: 452613 - DNA, 16 bp, Homo sapiens
cccagggtgcaggcgc

SEQ ID NO: 452614 - DNA, 17 bp, Homo sapiens
cccagtcttgagtgggc

SEQ ID NO: 452615 - DNA, 16 bp, Homo sapiens
cccagtgggacagagg

SEQ ID NO: 452616 - DNA, 20 bp, Homo sapiens
cccataagccctgagactcc

SEQ ID NO: 452617 - DNA, 19 bp, Homo sapiens
cccatatataaattattac

SEQ ID NO: 452618 - DNA, 18 bp, Homo sapiens
cccatgcataacacacta

SEQ ID NO: 452619 - DNA, 20 bp, Homo sapiens
cccatgtgtcccctcactct

SEQ ID NO: 452620 - DNA, 22 bp, Homo sapiens
cccatgtgtcccctcactctgt

SEQ ID NO: 452621 - DNA, 21 bp, Homo sapiens
ccccaagatgagctgcagccc

SEQ ID NO: 452622 - DNA, 14 bp, Homo sapiens
ccccacacgccggg

SEQ ID NO: 452623 - DNA, 22 bp, Homo sapiens
ccccacccaccaccgctcccgc

SEQ ID NO: 452624 - DNA, 18 bp, Homo sapiens
ccccacccggcggcggcc

SEQ ID NO: 452625 - DNA, 15 bp, Homo sapiens
ccccacggccgtccc

SEQ ID NO: 452626 - DNA, 13 bp, Homo sapiens
ccccactgagagc

SEQ ID NO: 452627 - DNA, 18 bp, Homo sapiens
ccccagaccgatccttcc

SEQ ID NO: 452628 - DNA, 16 bp, Homo sapiens
ccccagagactgccca

SEQ ID NO: 452629 - DNA, 22 bp, Homo sapiens
ccccagcactaaggccgtgtct

SEQ ID NO: 452630 - DNA, 11 bp, Homo sapiens
ccccagcctcc

SEQ ID NO: 452631 - DNA, 13 bp, Homo sapiens
ccccagcctcccc

SEQ ID NO: 452632 - DNA, 23 bp, Homo sapiens
ccccagcctcccccaggctgcgc

SEQ ID NO: 452633 - DNA, 11 bp, Homo sapiens
ccccagcctgg

SEQ ID NO: 452634 - DNA, 22 bp, Homo sapiens
ccccagctggctgggtcgcccc

SEQ ID NO: 452635 - DNA, 16 bp, Homo sapiens
ccccaggccctccctg

SEQ ID NO: 452636 - DNA, 15 bp, Homo sapiens
ccccaggctgcgcct

SEQ ID NO: 452637 - DNA, 19 bp, Homo sapiens
ccccaggctgcgcctgccc

SEQ ID NO: 452638 - DNA, 19 bp, Homo sapiens
ccccagttaatgtgccaaa

SEQ ID NO: 452639 - DNA, 21 bp, Homo sapiens
ccccataagccctgagactcc

SEQ ID NO: 452640 - DNA, 17 bp, Homo sapiens
ccccatatataaattat

SEQ ID NO: 452641 - DNA, 18 bp, Homo sapiens
ccccatgtgcctgcacca

SEQ ID NO: 452642 - DNA, 18 bp, Homo sapiens
cccccacccctccccacc

SEQ ID NO: 452643 - DNA, 16 bp, Homo sapiens
cccccagcctccccca

SEQ ID NO: 452644 - DNA, 12 bp, Homo sapiens
cccccaggctgc

SEQ ID NO: 452645 - DNA, 14 bp, Homo sapiens
cccccaggctgcgc

SEQ ID NO: 452646 - DNA, 15 bp, Homo sapiens
cccccaggctgcgcc

SEQ ID NO: 452647 - DNA, 21 bp, Homo sapiens
ccccccaagatgagctgcagc

SEQ ID NO: 452648 - DNA, 19 bp, Homo sapiens
cccccgaggcccccctctg

SEQ ID NO: 452649 - DNA, 18 bp, Homo sapiens
cccccgccctcgctccgg

SEQ ID NO: 452650 - DNA, 15 bp, Homo sapiens
cccccggaggcgccc

SEQ ID NO: 452651 - DNA, 17 bp, Homo sapiens
cccccggaggcgcccac

SEQ ID NO: 452652 - DNA, 18 bp, Homo sapiens
cccccggaggcgcccacc

SEQ ID NO: 452653 - DNA, 19 bp, Homo sapiens
cccccggaggcgcccacct

SEQ ID NO: 452654 - DNA, 20 bp, Homo sapiens
cccccggaggcgcccacctg

SEQ ID NO: 452655 - DNA, 21 bp, Homo sapiens
cccccggaggcgcccacctgc

SEQ ID NO: 452656 - DNA, 15 bp, Homo sapiens
cccccggcctccagg

SEQ ID NO: 452657 - DNA, 10 bp, Homo sapiens
ccccctctct

SEQ ID NO: 452658 - DNA, 21 bp, Homo sapiens
ccccctctcttaccccgtccc

SEQ ID NO: 452659 - DNA, 16 bp, Homo sapiens
ccccctctgcctttga

SEQ ID NO: 452660 - DNA, 22 bp, Homo sapiens
ccccctctgcctttgagcttct

SEQ ID NO: 452661 - DNA, 17 bp, Homo sapiens
ccccgaggcccccctct

SEQ ID NO: 452662 - DNA, 16 bp, Homo sapiens
ccccgcagacagacag

SEQ ID NO: 452663 - DNA, 12 bp, Homo sapiens
ccccgcagccct

SEQ ID NO: 452664 - DNA, 14 bp, Homo sapiens
ccccgcagccctct

SEQ ID NO: 452665 - DNA, 23 bp, Homo sapiens
ccccgcagccctctccacccaga

SEQ ID NO: 452666 - DNA, 12 bp, Homo sapiens
ccccgctcacgc

SEQ ID NO: 452667 - DNA, 12 bp, Homo sapiens
ccccgctgcctg

SEQ ID NO: 452668 - DNA, 20 bp, Homo sapiens
ccccgctgcctggcgggcag

SEQ ID NO: 452669 - DNA, 21 bp, Homo sapiens
ccccgctgcctggcgggcagc

SEQ ID NO: 452670 - DNA, 17 bp, Homo sapiens
ccccggaggcgcccacc

SEQ ID NO: 452671 - DNA, 20 bp, Homo sapiens
ccccggaggcgcccacctgc

SEQ ID NO: 452672 - DNA, 22 bp, Homo sapiens
ccccggaggcgcccacctgccc

SEQ ID NO: 452673 - DNA, 20 bp, Homo sapiens
ccccggcctccaggctgggg

SEQ ID NO: 452674 - DNA, 12 bp, Homo sapiens
ccccgtctgccc

SEQ ID NO: 452675 - DNA, 14 bp, Homo sapiens
ccccgtctgcccct

SEQ ID NO: 452676 - DNA, 14 bp, Homo sapiens
ccccgtgcggcccg

SEQ ID NO: 452677 - DNA, 16 bp, Homo sapiens
cccctataccctaggt

SEQ ID NO: 452678 - DNA, 13 bp, Homo sapiens
cccctatcctgca

SEQ ID NO: 452679 - DNA, 16 bp, Homo sapiens
cccctatcctgcaccc

SEQ ID NO: 452680 - DNA, 21 bp, Homo sapiens
cccctcaagccaggagaccct

SEQ ID NO: 452681 - DNA, 23 bp, Homo sapiens
cccctccaatcccaccaaccctc

SEQ ID NO: 452682 - DNA, 14 bp, Homo sapiens
cccctccagacccc

SEQ ID NO: 452683 - DNA, 15 bp, Homo sapiens
cccctcccttcaacc

SEQ ID NO: 452684 - DNA, 18 bp, Homo sapiens
cccctccgtccccagggt

SEQ ID NO: 452685 - DNA, 11 bp, Homo sapiens
cccctcctctc

SEQ ID NO: 452686 - DNA, 16 bp, Homo sapiens
cccctccttctcccct

SEQ ID NO: 452687 - DNA, 17 bp, Homo sapiens
cccctctgcctttgagc

SEQ ID NO: 452688 - DNA, 18 bp, Homo sapiens
cccctggcttttcactgc

SEQ ID NO: 452689 - DNA, 20 bp, Homo sapiens
cccctggcttttcactgctg

SEQ ID NO: 452690 - DNA, 22 bp, Homo sapiens
cccctggcttttcactgctggc

SEQ ID NO: 452691 - DNA, 12 bp, Homo sapiens
ccccttccccct

SEQ ID NO: 452692 - DNA, 15 bp, Homo sapiens
cccgacagcctggca

SEQ ID NO: 452693 - DNA, 18 bp, Homo sapiens
cccgacagcctggcacag

SEQ ID NO: 452694 - DNA, 18 bp, Homo sapiens
cccgagcgcgtgccttcc

SEQ ID NO: 452695 - DNA, 19 bp, Homo sapiens
cccgagcgcgtgccttccc

SEQ ID NO: 452696 - DNA, 17 bp, Homo sapiens
cccgaggcccccctctg

SEQ ID NO: 452697 - DNA, 12 bp, Homo sapiens
cccgcagcacca

SEQ ID NO: 452698 - DNA, 14 bp, Homo sapiens
cccgcagcaccagc

SEQ ID NO: 452699 - DNA, 16 bp, Homo sapiens
cccgcagcaccagcct

SEQ ID NO: 452700 - DNA, 21 bp, Homo sapiens
cccgcagcaccagcctgagcc

SEQ ID NO: 452701 - DNA, 13 bp, Homo sapiens
cccgcccaccccg

SEQ ID NO: 452702 - DNA, 11 bp, Homo sapiens
cccgccccaga

SEQ ID NO: 452703 - DNA, 15 bp, Homo sapiens
cccgccccagagact

SEQ ID NO: 452704 - DNA, 18 bp, Homo sapiens
cccgccccagagactgcc

SEQ ID NO: 452705 - DNA, 20 bp, Homo sapiens
cccgccccagagactgccca

SEQ ID NO: 452706 - DNA, 16 bp, Homo sapiens
cccgccctcctctgcc

SEQ ID NO: 452707 - DNA, 17 bp, Homo sapiens
cccgccctcctctgccc

SEQ ID NO: 452708 - DNA, 21 bp, Homo sapiens
cccgccctcctctgccccctc

SEQ ID NO: 452709 - DNA, 19 bp, Homo sapiens
cccgcgcgtgcccccagcg

SEQ ID NO: 452710 - DNA, 17 bp, Homo sapiens
cccgcgtcttcagctgt

SEQ ID NO: 452711 - DNA, 23 bp, Homo sapiens
cccgctcaacctctcagatccct

SEQ ID NO: 452712 - DNA, 12 bp, Homo sapiens
cccgctcagccc

SEQ ID NO: 452713 - DNA, 15 bp, Homo sapiens
cccgctcagccctcc

SEQ ID NO: 452714 - DNA, 15 bp, Homo sapiens
cccgctgcctggcgg

SEQ ID NO: 452715 - DNA, 20 bp, Homo sapiens
cccgctgcctggcgggcagc

SEQ ID NO: 452716 - DNA, 22 bp, Homo sapiens
cccggaggcgcccacctgccca

SEQ ID NO: 452717 - DNA, 17 bp, Homo sapiens
cccggaggggcctggca

SEQ ID NO: 452718 - DNA, 15 bp, Homo sapiens
cccggcccacgcaga

SEQ ID NO: 452719 - DNA, 18 bp, Homo sapiens
cccggcccacgcagagcc

SEQ ID NO: 452720 - DNA, 13 bp, Homo sapiens
cccggccccgcgc

SEQ ID NO: 452721 - DNA, 14 bp, Homo sapiens
cccggcctccaggc

SEQ ID NO: 452722 - DNA, 15 bp, Homo sapiens
cccggcctccaggct

SEQ ID NO: 452723 - DNA, 16 bp, Homo sapiens
cccggcctccaggctg

SEQ ID NO: 452724 - DNA, 22 bp, Homo sapiens
cccgggacccccggcctccagg

SEQ ID NO: 452725 - DNA, 16 bp, Homo sapiens
cccggtgtatgcagtg

SEQ ID NO: 452726 - DNA, 18 bp, Homo sapiens
cccgtccctttccctgca

SEQ ID NO: 452727 - DNA, 19 bp, Homo sapiens
cccgtccctttccctgcat

SEQ ID NO: 452728 - DNA, 18 bp, Homo sapiens
cccgtccgtccgcccgcc

SEQ ID NO: 452729 - DNA, 22 bp, Homo sapiens
cccgtgcgcagccgcgctctgc

SEQ ID NO: 452730 - DNA, 23 bp, Homo sapiens
ccctacttaggaaatactcagca

SEQ ID NO: 452731 - DNA, 13 bp, Homo sapiens
ccctagttctttg

SEQ ID NO: 452732 - DNA, 21 bp, Homo sapiens
ccctataccgagacccaccat

SEQ ID NO: 452733 - DNA, 13 bp, Homo sapiens
ccctcactccact

SEQ ID NO: 452734 - DNA, 22 bp, Homo sapiens
ccctcactccactcccctcatc

SEQ ID NO: 452735 - DNA, 12 bp, Homo sapiens
ccctccactcct

SEQ ID NO: 452736 - DNA, 22 bp, Homo sapiens
ccctccactcctcccaactctg

SEQ ID NO: 452737 - DNA, 13 bp, Homo sapiens
ccctccagacccc

SEQ ID NO: 452738 - DNA, 19 bp, Homo sapiens
ccctccccacccaccaccg

SEQ ID NO: 452739 - DNA, 23 bp, Homo sapiens
ccctcccccacggccgtccctga

SEQ ID NO: 452740 - DNA, 15 bp, Homo sapiens
ccctcccccgcagac

SEQ ID NO: 452741 - DNA, 15 bp, Homo sapiens
ccctcccccttcccc

SEQ ID NO: 452742 - DNA, 17 bp, Homo sapiens
ccctcccctctcctgag

SEQ ID NO: 452743 - DNA, 13 bp, Homo sapiens
ccctccctccaca

SEQ ID NO: 452744 - DNA, 15 bp, Homo sapiens
ccctccctccctcca

SEQ ID NO: 452745 - DNA, 11 bp, Homo sapiens
ccctccctgtc

SEQ ID NO: 452746 - DNA, 16 bp, Homo sapiens
ccctccctgtcccctg

SEQ ID NO: 452747 - DNA, 13 bp, Homo sapiens
ccctccttcccca

SEQ ID NO: 452748 - DNA, 14 bp, Homo sapiens
ccctccttccccac

SEQ ID NO: 452749 - DNA, 22 bp, Homo sapiens
ccctccttctcccctccagacc

SEQ ID NO: 452750 - DNA, 23 bp, Homo sapiens
ccctccttctcccctccagaccc

SEQ ID NO: 452751 - DNA, 14 bp, Homo sapiens
ccctcggagccccc

SEQ ID NO: 452752 - DNA, 16 bp, Homo sapiens
ccctcggagcccccca

SEQ ID NO: 452753 - DNA, 21 bp, Homo sapiens
ccctcggagccccccactcag

SEQ ID NO: 452754 - DNA, 17 bp, Homo sapiens
ccctcgtctccctggcc

SEQ ID NO: 452755 - DNA, 18 bp, Homo sapiens
ccctctccacccagaggt

SEQ ID NO: 452756 - DNA, 12 bp, Homo sapiens
ccctctcctggg

SEQ ID NO: 452757 - DNA, 19 bp, Homo sapiens
ccctctgctatgtctgtga

SEQ ID NO: 452758 - DNA, 22 bp, Homo sapiens
ccctctggtccttctgacccca

SEQ ID NO: 452759 - DNA, 13 bp, Homo sapiens
ccctcttccccct

SEQ ID NO: 452760 - DNA, 14 bp, Homo sapiens
ccctcttccccctt

SEQ ID NO: 452761 - DNA, 15 bp, Homo sapiens
ccctcttcccccttc

SEQ ID NO: 452762 - DNA, 15 bp, Homo sapiens
ccctcttctcagctc

SEQ ID NO: 452763 - DNA, 17 bp, Homo sapiens
ccctcttctcagctcca

SEQ ID NO: 452764 - DNA, 18 bp, Homo sapiens
ccctcttctcagctccac

SEQ ID NO: 452765 - DNA, 11 bp, Homo sapiens
ccctcttgaga

SEQ ID NO: 452766 - DNA, 15 bp, Homo sapiens
ccggcccgccacctt

SEQ ID NO: 452767 - DNA, 16 bp, Homo sapiens
ccggcctccaggctgg

SEQ ID NO: 452768 - DNA, 17 bp, Homo sapiens
ccggcctccaggctggg

SEQ ID NO: 452769 - DNA, 13 bp, Homo sapiens
ccggcctgcagcc

SEQ ID NO: 452770 - DNA, 17 bp, Homo sapiens
ccggctccccctgccag

SEQ ID NO: 452771 - DNA, 18 bp, Homo sapiens
ccggctccccctgccagc

SEQ ID NO: 452772 - DNA, 16 bp, Homo sapiens
ccggctggccggtcca

SEQ ID NO: 452773 - DNA, 21 bp, Homo sapiens
ccggctggccggtccaccccg

SEQ ID NO: 452774 - DNA, 18 bp, Homo sapiens
ccgggagcctccccctca

SEQ ID NO: 452775 - DNA, 20 bp, Homo sapiens
ccgggagcctccccctcaga

SEQ ID NO: 452776 - DNA, 22 bp, Homo sapiens
ccgggagcctccccctcagatg

SEQ ID NO: 452777 - DNA, 16 bp, Homo sapiens
ccgggcaggtcctgcc

SEQ ID NO: 452778 - DNA, 21 bp, Homo sapiens
ccgggcaggtcctgcccatgt

SEQ ID NO: 452779 - DNA, 19 bp, Homo sapiens
ccgggcctggagaactaga

SEQ ID NO: 452780 - DNA, 19 bp, Homo sapiens
ccggggactggccactgaa

SEQ ID NO: 452781 - DNA, 12 bp, Homo sapiens
ccggggctggcc

SEQ ID NO: 452782 - DNA, 14 bp, Homo sapiens
ccggggctggccct

SEQ ID NO: 452783 - DNA, 17 bp, Homo sapiens
ccggggctggccctgcc

SEQ ID NO: 452784 - DNA, 20 bp, Homo sapiens
ccggggtggggtgcctgagc

SEQ ID NO: 452785 - DNA, 14 bp, Homo sapiens
ccgggtgtggcctc

SEQ ID NO: 452786 - DNA, 15 bp, Homo sapiens
ccgggtgtggcctca

SEQ ID NO: 452787 - DNA, 21 bp, Homo sapiens
ccgggtgtggcctcagccctc

SEQ ID NO: 452788 - DNA, 22 bp, Homo sapiens
ccgggtgtggcctcagccctca

SEQ ID NO: 452789 - DNA, 19 bp, Homo sapiens
ccggttggccggctggccg

SEQ ID NO: 452790 - DNA, 13 bp, Homo sapiens
ccgtcccggcccc

SEQ ID NO: 452791 - DNA, 15 bp, Homo sapiens
ccgtcccggccccgc

SEQ ID NO: 452792 - DNA, 22 bp, Homo sapiens
ccgtccctgacttcccagctgg

SEQ ID NO: 452793 - DNA, 13 bp, Homo sapiens
ccgtccgcccgcc

SEQ ID NO: 452794 - DNA, 24 bp, Homo sapiens
ccgtcctggggtggttggaggcct

SEQ ID NO: 452795 - DNA, 17 bp, Homo sapiens
ccgtgccttcagctcta

SEQ ID NO: 452796 - DNA, 20 bp, Homo sapiens
ccgtgcggcccgtgcgcagc

SEQ ID NO: 452797 - DNA, 11 bp, Homo sapiens
ccgtggcttcc

SEQ ID NO: 452798 - DNA, 14 bp, Homo sapiens
ccgtggtgtgaggc

SEQ ID NO: 452799 - DNA, 16 bp, Homo sapiens
ccgtgtctctgaggac

SEQ ID NO: 452800 - DNA, 11 bp, Homo sapiens
ccgtgttcaca

SEQ ID NO: 452801 - DNA, 23 bp, Homo sapiens
ccgttagggaaatccaactccag

SEQ ID NO: 452802 - DNA, 12 bp, Homo sapiens
cctaaagagata

SEQ ID NO: 452803 - DNA, 16 bp, Homo sapiens
cctaaatccattttct

SEQ ID NO: 452804 - DNA, 14 bp, Homo sapiens
cctaacctgggttg

SEQ ID NO: 452805 - DNA, 16 bp, Homo sapiens
cctaccctcttctcag

SEQ ID NO: 452806 - DNA, 22 bp, Homo sapiens
cctaccgagtctcttctccact

SEQ ID NO: 452807 - DNA, 14 bp, Homo sapiens
cctagaagaaaacc

SEQ ID NO: 452808 - DNA, 16 bp, Homo sapiens
cctagaagaaaacccg

SEQ ID NO: 452809 - DNA, 22 bp, Homo sapiens
cctagcacaaggagtgcccgcc

SEQ ID NO: 452810 - DNA, 18 bp, Homo sapiens
cctaggcgctcagaggcc

SEQ ID NO: 452811 - DNA, 21 bp, Homo sapiens
cctaggcgctcagaggccgct

SEQ ID NO: 452812 - DNA, 17 bp, Homo sapiens
cctaggtctccacccct

SEQ ID NO: 452813 - DNA, 18 bp, Homo sapiens
cctaggtctccacccctc

SEQ ID NO: 452814 - DNA, 21 bp, Homo sapiens
cctaggtctccacccctcaag

SEQ ID NO: 452815 - DNA, 22 bp, Homo sapiens
cctattctattgcagttataga

SEQ ID NO: 452816 - DNA, 11 bp, Homo sapiens
cctatttaagc

SEQ ID NO: 452817 - DNA, 21 bp, Homo sapiens
cctcactatggtatgctggcc

SEQ ID NO: 452818 - DNA, 23 bp, Homo sapiens
cctcactatggtatgctggccag

SEQ ID NO: 452819 - DNA, 24 bp, Homo sapiens
cctcactatggtatgctggccagc

SEQ ID NO: 452820 - DNA, 18 bp, Homo sapiens
cctcactccactcccctc

SEQ ID NO: 452821 - DNA, 14 bp, Homo sapiens
cctcactctgtcag

SEQ ID NO: 452822 - DNA, 17 bp, Homo sapiens
cctcactctgtcagcca

SEQ ID NO: 452823 - DNA, 18 bp, Homo sapiens
cctcactctgtcagccag

SEQ ID NO: 452824 - DNA, 14 bp, Homo sapiens
cctcactgccctcc

SEQ ID NO: 452825 - DNA, 12 bp, Homo sapiens
cctcagccctca

SEQ ID NO: 452826 - DNA, 16 bp, Homo sapiens
cctcatttgtccatgt

SEQ ID NO: 452827 - DNA, 22 bp, Homo sapiens
cctccaatcccaccaaccctca

SEQ ID NO: 452828 - DNA, 23 bp, Homo sapiens
cctccaatcccaccaaccctcag

SEQ ID NO: 452829 - DNA, 13 bp, Homo sapiens
cctccacacctcc

SEQ ID NO: 452830 - DNA, 17 bp, Homo sapiens
cctccacacctccaccc

SEQ ID NO: 452831 - DNA, 18 bp, Homo sapiens
cctccacacctccacccg

SEQ ID NO: 452832 - DNA, 14 bp, Homo sapiens
cctccacccgtcct

SEQ ID NO: 452833 - DNA, 19 bp, Homo sapiens
cctccacgcctcctggcca

SEQ ID NO: 452834 - DNA, 21 bp, Homo sapiens
cctccacgcctcctggccaga

SEQ ID NO: 452835 - DNA, 13 bp, Homo sapiens
cctccactcctcc

SEQ ID NO: 452836 - DNA, 14 bp, Homo sapiens
cctccactctgagg

SEQ ID NO: 452837 - DNA, 15 bp, Homo sapiens
cctccactctgaggt

SEQ ID NO: 452838 - DNA, 22 bp, Homo sapiens
cctccagacccctaccctttcc

SEQ ID NO: 452839 - DNA, 21 bp, Homo sapiens
cctccagactcgagagggctg

SEQ ID NO: 452840 - DNA, 22 bp, Homo sapiens
cctccagactcgagagggctga

SEQ ID NO: 452841 - DNA, 17 bp, Homo sapiens
cctccagattattttct

SEQ ID NO: 452842 - DNA, 17 bp, Homo sapiens
cctccagcaatgcctgc

SEQ ID NO: 452843 - DNA, 22 bp, Homo sapiens
cctccaggaggactgttctaac

SEQ ID NO: 452844 - DNA, 12 bp, Homo sapiens
cctccaggctgg

SEQ ID NO: 452845 - DNA, 22 bp, Homo sapiens
cctccaggctggggcctggcct

SEQ ID NO: 452846 - DNA, 17 bp, Homo sapiens
cctcccaactctggcct

SEQ ID NO: 452847 - DNA, 15 bp, Homo sapiens
cctccccaaggaaga

SEQ ID NO: 452848 - DNA, 13 bp, Homo sapiens
cctccccacccac

SEQ ID NO: 452849 - DNA, 22 bp, Homo sapiens
cctccccatggtgcagtgaaga

SEQ ID NO: 452850 - DNA, 12 bp, Homo sapiens
cctcccccaggc

SEQ ID NO: 452851 - DNA, 21 bp, Homo sapiens
cctcccccaggctgcgcctgc

SEQ ID NO: 452852 - DNA, 23 bp, Homo sapiens
cctcccccaggctgcgcctgccc

SEQ ID NO: 452853 - DNA, 12 bp, Homo sapiens
cctcccctctcc

SEQ ID NO: 452854 - DNA, 13 bp, Homo sapiens
cctcccgccgcct

SEQ ID NO: 452855 - DNA, 15 bp, Homo sapiens
cctccctccacacct

SEQ ID NO: 452856 - DNA, 18 bp, Homo sapiens
cctccctgactccctgtg

SEQ ID NO: 452857 - DNA, 21 bp, Homo sapiens
cctccctgcccctcccttcaa

SEQ ID NO: 452858 - DNA, 13 bp, Homo sapiens
cctccgtccccag

SEQ ID NO: 452859 - DNA, 15 bp, Homo sapiens
cctccgtccccaggg

SEQ ID NO: 452860 - DNA, 16 bp, Homo sapiens
cctccgtccccagggt

SEQ ID NO: 452861 - DNA, 13 bp, Homo sapiens
cctcctaggctcc

SEQ ID NO: 452862 - DNA, 14 bp, Homo sapiens
cctcctaggctccc

SEQ ID NO: 452863 - DNA, 18 bp, Homo sapiens
cctcctaggctccctgag

SEQ ID NO: 452864 - DNA, 19 bp, Homo sapiens
ctccctccttccttcttgc

SEQ ID NO: 452865 - DNA, 15 bp, Homo sapiens
ctccctcggccccac

SEQ ID NO: 452866 - DNA, 20 bp, Homo sapiens
ctccctgaggtacctttcca

SEQ ID NO: 452867 - DNA, 23 bp, Homo sapiens
ctccctgaggtacctttccaccc

SEQ ID NO: 452868 - DNA, 17 bp, Homo sapiens
ctccctgcccctccctt

SEQ ID NO: 452869 - DNA, 18 bp, Homo sapiens
ctccctgcccctcccttc

SEQ ID NO: 452870 - DNA, 23 bp, Homo sapiens
ctccctgtgggggtggccatccc

SEQ ID NO: 452871 - DNA, 18 bp, Homo sapiens
ctcccttcaaccattccc

SEQ ID NO: 452872 - DNA, 19 bp, Homo sapiens
ctcccttcaaccattcccc

SEQ ID NO: 452873 - DNA, 21 bp, Homo sapiens
ctcccttcaaccattccccat

SEQ ID NO: 452874 - DNA, 22 bp, Homo sapiens
ctcccttcaaccattccccatg

SEQ ID NO: 452875 - DNA, 15 bp, Homo sapiens
ctccgcccagcctct

SEQ ID NO: 452876 - DNA, 17 bp, Homo sapiens
ctccgcccagcctctcc

SEQ ID NO: 452877 - DNA, 20 bp, Homo sapiens
ctccggcagaggcagggccc

SEQ ID NO: 452878 - DNA, 23 bp, Homo sapiens
ctccggcagaggcagggccctgg

SEQ ID NO: 452879 - DNA, 15 bp, Homo sapiens
ctccgggtgtggcct

SEQ ID NO: 452880 - DNA, 19 bp, Homo sapiens
ctccgggtgtggcctcagc

SEQ ID NO: 452881 - DNA, 15 bp, Homo sapiens
ccctctttctctctg

SEQ ID NO: 452882 - DNA, 22 bp, Homo sapiens
ccctctttctctctgtgtggca

SEQ ID NO: 452883 - DNA, 18 bp, Homo sapiens
ccctgactccctgtgggg

SEQ ID NO: 452884 - DNA, 17 bp, Homo sapiens
ccctgacttcccagctg

SEQ ID NO: 452885 - DNA, 20 bp, Homo sapiens
ccctgacttcccagctggca

SEQ ID NO: 452886 - DNA, 22 bp, Homo sapiens
ccctgacttcccagctggcagc

SEQ ID NO: 452887 - DNA, 22 bp, Homo sapiens
ccctgaggtacctttccaccca

SEQ ID NO: 452888 - DNA, 14 bp, Homo sapiens
ccctgcatcccttg

SEQ ID NO: 452889 - DNA, 17 bp, Homo sapiens
ccctgcatcccttggcc

SEQ ID NO: 452890 - DNA, 11 bp, Homo sapiens
ccctgccagca

SEQ ID NO: 452891 - DNA, 17 bp, Homo sapiens
ccctgcccctcccttca

SEQ ID NO: 452892 - DNA, 19 bp, Homo sapiens
ccctgcccctcccttcaac

SEQ ID NO: 452893 - DNA, 13 bp, Homo sapiens
ccctgccctcact

SEQ ID NO: 452894 - DNA, 14 bp, Homo sapiens
ccctgccctcactc

SEQ ID NO: 452895 - DNA, 12 bp, Homo sapiens
ccctgccctccc

SEQ ID NO: 452896 - DNA, 16 bp, Homo sapiens
ccctgccctcccccac

SEQ ID NO: 452897 - DNA, 16 bp, Homo sapiens
ccctgcgccctccctc

SEQ ID NO: 452898 - DNA, 17 bp, Homo sapiens
ccctgcgccctccctcc

SEQ ID NO: 452899 - DNA, 22 bp, Homo sapiens
ccctgcgccctccctccctcca

SEQ ID NO: 452900 - DNA, 19 bp, Homo sapiens
ccctgctttgggctgccct

SEQ ID NO: 452901 - DNA, 20 bp, Homo sapiens
ccctggctcccacaggccct

SEQ ID NO: 452902 - DNA, 14 bp, Homo sapiens
ccctgggcccctcc

SEQ ID NO: 452903 - DNA, 14 bp, Homo sapiens
ccctgggcctcagt

SEQ ID NO: 452904 - DNA, 16 bp, Homo sapiens
ccctgggctgtctgtc

SEQ ID NO: 452905 - DNA, 18 bp, Homo sapiens
ccctgggctgtctgtcac

SEQ ID NO: 452906 - DNA, 14 bp, Homo sapiens
ccctggggtctctg

SEQ ID NO: 452907 - DNA, 15 bp, Homo sapiens
ccctggggtctctga

SEQ ID NO: 452908 - DNA, 19 bp, Homo sapiens
ccctggggtctctgagcag

SEQ ID NO: 452909 - DNA, 13 bp, Homo sapiens
ccctggtgctgcc

SEQ ID NO: 452910 - DNA, 12 bp, Homo sapiens
ccctgtcccctg

SEQ ID NO: 452911 - DNA, 23 bp, Homo sapiens
ccctgtctttgctgtttatatat

SEQ ID NO: 452912 - DNA, 12 bp, Homo sapiens
ccctgtgggagt

SEQ ID NO: 452913 - DNA, 12 bp, Homo sapiens
ccctgtgggggt

SEQ ID NO: 452914 - DNA, 22 bp, Homo sapiens
ccctgttcactctacttagcat

SEQ ID NO: 452915 - DNA, 18 bp, Homo sapiens
cccttcaaccattcccca

SEQ ID NO: 452916 - DNA, 20 bp, Homo sapiens
cccttcccctgcgccctccc

SEQ ID NO: 452917 - DNA, 13 bp, Homo sapiens
cccttccccttct

SEQ ID NO: 452918 - DNA, 16 bp, Homo sapiens
cccttcctctccactg

SEQ ID NO: 452919 - DNA, 17 bp, Homo sapiens
cccttcctctccactgc

SEQ ID NO: 452920 - DNA, 20 bp, Homo sapiens
cccttcctctccactgcctt

SEQ ID NO: 452921 - DNA, 21 bp, Homo sapiens
cccttcctctccactgccttc

SEQ ID NO: 452922 - DNA, 13 bp, Homo sapiens
cccttggcccctc

SEQ ID NO: 452923 - DNA, 18 bp, Homo sapiens
ccctttcccaaacccttc

SEQ ID NO: 452924 - DNA, 13 bp, Homo sapiens
ccctttccctgca

SEQ ID NO: 452925 - DNA, 21 bp, Homo sapiens
ccctttgtggactttatttaa

SEQ ID NO: 452926 - DNA, 13 bp, Homo sapiens
ccgaaacaccccg

SEQ ID NO: 452927 - DNA, 17 bp, Homo sapiens
ccgagcgcgtgccttcc

SEQ ID NO: 452928 - DNA, 13 bp, Homo sapiens
ccgaggcccccct

SEQ ID NO: 452929 - DNA, 18 bp, Homo sapiens
ccgaggcccccctctgcc

SEQ ID NO: 452930 - DNA, 20 bp, Homo sapiens
ccgaggcccccctctgcctt

SEQ ID NO: 452931 - DNA, 16 bp, Homo sapiens
ccgagtctcttctcca

SEQ ID NO: 452932 - DNA, 19 bp, Homo sapiens
ccgagtctcttctccactg

SEQ ID NO: 452933 - DNA, 20 bp, Homo sapiens
ccgagtctcttctccactgg

SEQ ID NO: 452934 - DNA, 21 bp, Homo sapiens
ccgagtctcttctccactgga

SEQ ID NO: 452935 - DNA, 15 bp, Homo sapiens
ccgcaaccacttgct

SEQ ID NO: 452936 - DNA, 19 bp, Homo sapiens
ccgcagcaccagcctgagc

SEQ ID NO: 452937 - DNA, 20 bp, Homo sapiens
ccgcagcaccagcctgagcc

SEQ ID NO: 452938 - DNA, 21 bp, Homo sapiens
ccgcagcaccagcctgagcca

SEQ ID NO: 452939 - DNA, 22 bp, Homo sapiens
ccgcagcaccagcctgagccac

SEQ ID NO: 452940 - DNA, 15 bp, Homo sapiens
ccgcagccctctcca

SEQ ID NO: 452941 - DNA, 16 bp, Homo sapiens
ccgcagccctctccac

SEQ ID NO: 452942 - DNA, 22 bp, Homo sapiens
ccgcagccctctccacccagag

SEQ ID NO: 452943 - DNA, 14 bp, Homo sapiens
ccgccaccccactg

SEQ ID NO: 452944 - DNA, 14 bp, Homo sapiens
ccgcccagcctctc

SEQ ID NO: 452945 - DNA, 23 bp, Homo sapiens
ccgccccaaccctcggagccccc

SEQ ID NO: 452946 - DNA, 12 bp, Homo sapiens
ccgccccagaga

SEQ ID NO: 452947 - DNA, 20 bp, Homo sapiens
ccgccccagagactgcccac

SEQ ID NO: 452948 - DNA, 21 bp, Homo sapiens
ccgccccagagactgcccacc

SEQ ID NO: 452949 - DNA, 14 bp, Homo sapiens
ccgcccccgccctc

SEQ ID NO: 452950 - DNA, 11 bp, Homo sapiens
ccgcccgccct

SEQ ID NO: 452951 - DNA, 20 bp, Homo sapiens
ccgccctgggctgtctgtca

SEQ ID NO: 452952 - DNA, 11 bp, Homo sapiens
ccgcctcctcc

SEQ ID NO: 452953 - DNA, 14 bp, Homo sapiens
ccgcctcctccaga

SEQ ID NO: 452954 - DNA, 23 bp, Homo sapiens
ccgccttgagtgacatgcggctg

SEQ ID NO: 452955 - DNA, 13 bp, Homo sapiens
ccgcgctctgccc

SEQ ID NO: 452956 - DNA, 15 bp, Homo sapiens
ccgcgctctgcccct

SEQ ID NO: 452957 - DNA, 20 bp, Homo sapiens
ccgcgctctgcccctccgtc

SEQ ID NO: 452958 - DNA, 16 bp, Homo sapiens
ccgctcaacctctcag

SEQ ID NO: 452959 - DNA, 22 bp, Homo sapiens
ccgctctggggggttgcctcga

SEQ ID NO: 452960 - DNA, 15 bp, Homo sapiens
ccgctgccgctgcac

SEQ ID NO: 452961 - DNA, 13 bp, Homo sapiens
ccgctgcctggcg

SEQ ID NO: 452962 - DNA, 22 bp, Homo sapiens
ccgctgcctggcgggcagcccc

SEQ ID NO: 452963 - DNA, 16 bp, Homo sapiens
ccgctgtcgccccagg

SEQ ID NO: 452964 - DNA, 18 bp, Homo sapiens
ccgctgtcgccccaggcc

SEQ ID NO: 452965 - DNA, 22 bp, Homo sapiens
ccgctgtcgccccaggccctcc

SEQ ID NO: 452966 - DNA, 21 bp, Homo sapiens
ccggaacagccaaagaaactc

SEQ ID NO: 452967 - DNA, 22 bp, Homo sapiens
ccggaacagccaaagaaactca

SEQ ID NO: 452968 - DNA, 13 bp, Homo sapiens
ccggacgctggct

SEQ ID NO: 452969 - DNA, 18 bp, Homo sapiens
ccggacgctggctcggga

SEQ ID NO: 452970 - DNA, 16 bp, Homo sapiens
ccggagcggctgagga

SEQ ID NO: 452971 - DNA, 15 bp, Homo sapiens
ccggaggcgcccacc

SEQ ID NO: 452972 - DNA, 20 bp, Homo sapiens
ccggaggcgcccacctgccc

SEQ ID NO: 452973 - DNA, 15 bp, Homo sapiens
ccggcagaggcaggg

SEQ ID NO: 452974 - DNA, 17 bp, Homo sapiens
ccggcagaggcagggcc

SEQ ID NO: 452975 - DNA, 18 bp, Homo sapiens
ccggcagaggcagggccc

SEQ ID NO: 452976 - DNA, 16 bp, Homo sapiens
ccggccaaggacactg

SEQ ID NO: 452977 - DNA, 16 bp, Homo sapiens
ccggcccacgcagagc

SEQ ID NO: 452978 - DNA, 22 bp, Homo sapiens
ccggcccacgcagagccccgga

SEQ ID NO: 452979 - DNA, 19 bp, Homo sapiens
cctcctaggctccctgagg

SEQ ID NO: 452980 - DNA, 21 bp, Homo sapiens
cctcctaggctccctgaggta

SEQ ID NO: 452981 - DNA, 20 bp, Homo sapiens
cctcctcagtctttggggga

SEQ ID NO: 452982 - DNA, 14 bp, Homo sapiens
cctcctcgggcgcc

SEQ ID NO: 452983 - DNA, 17 bp, Homo sapiens
cctcctcgggcgcctgc

SEQ ID NO: 452984 - DNA, 15 bp, Homo sapiens
cctcctctcctcgtc

SEQ ID NO: 452985 - DNA, 12 bp, Homo sapiens
cctcctctgccc

SEQ ID NO: 452986 - DNA, 15 bp, Homo sapiens
cctcctctgccccct

SEQ ID NO: 452987 - DNA, 20 bp, Homo sapiens
cctcctctgccccctccccc

SEQ ID NO: 452988 - DNA, 11 bp, Homo sapiens
cctcctggcca

SEQ ID NO: 452989 - DNA, 22 bp, Homo sapiens
cctcctggccagacgctgccgc

SEQ ID NO: 452990 - DNA, 11 bp, Homo sapiens
cctccttcccc

SEQ ID NO: 452991 - DNA, 17 bp, Homo sapiens
cctccttccccacccca

SEQ ID NO: 452992 - DNA, 21 bp, Homo sapiens
cctccttccccaccccataag

SEQ ID NO: 452993 - DNA, 15 bp, Homo sapiens
cctccttctcccctc

SEQ ID NO: 452994 - DNA, 18 bp, Homo sapiens
cctccttctcccctccag

SEQ ID NO: 452995 - DNA, 20 bp, Homo sapiens
cctccttctcccctccagac

SEQ ID NO: 452996 - DNA, 12 bp, Homo sapiens
cctcctttccaa

SEQ ID NO: 452997 - DNA, 17 bp, Homo sapiens
cctcgagtccccccacc

SEQ ID NO: 452998 - DNA, 20 bp, Homo sapiens
cctcgagtccccccacccct

SEQ ID NO: 452999 - DNA, 14 bp, Homo sapiens
cctcggctgtgtgg

SEQ ID NO: 453000 - DNA, 19 bp, Homo sapiens
cctcggctgtgtggggagg

SEQ ID NO: 453001 - DNA, 17 bp, Homo sapiens
cctcgggccgcctcctc

SEQ ID NO: 453002 - DNA, 18 bp, Homo sapiens
cctcgggccgcctcctcc

SEQ ID NO: 453003 - DNA, 17 bp, Homo sapiens
cctcgggcgcctgcgct

SEQ ID NO: 453004 - DNA, 18 bp, Homo sapiens
cctcgtctccctggccac

SEQ ID NO: 453005 - DNA, 14 bp, Homo sapiens
cctctcagatccct

SEQ ID NO: 453006 - DNA, 19 bp, Homo sapiens
cctctcagatccctcggtc

SEQ ID NO: 453007 - DNA, 18 bp, Homo sapiens
cctctccacccagaggtc

SEQ ID NO: 453008 - DNA, 21 bp, Homo sapiens
cctctccacccagaggtctcc

SEQ ID NO: 453009 - DNA, 22 bp, Homo sapiens
cctctccacccagaggtctccc

SEQ ID NO: 453010 - DNA, 14 bp, Homo sapiens
cctctccactgcct

SEQ ID NO: 453011 - DNA, 20 bp, Homo sapiens
cctctcctcgtccggcctgc

SEQ ID NO: 453012 - DNA, 12 bp, Homo sapiens
cctctcctgggg

SEQ ID NO: 453013 - DNA, 22 bp, Homo sapiens
cctctcctgggggtggcaggca

SEQ ID NO: 453014 - DNA, 13 bp, Homo sapiens
cctctctctccct

SEQ ID NO: 453015 - DNA, 15 bp, Homo sapiens
cctctctctccctcc

SEQ ID NO: 453016 - DNA, 16 bp, Homo sapiens
cctctctctccctcca

SEQ ID NO: 453017 - DNA, 21 bp, Homo sapiens
cctctctctccctccactcct

SEQ ID NO: 453018 - DNA, 22 bp, Homo sapiens
cctctctctctctctctctgtt

SEQ ID NO: 453019 - DNA, 18 bp, Homo sapiens
cctctctgtttaccctcc

SEQ ID NO: 453020 - DNA, 20 bp, Homo sapiens
cctctctgtttaccctccct

SEQ ID NO: 453021 - DNA, 21 bp, Homo sapiens
cctctctgtttaccctccctg

SEQ ID NO: 453022 - DNA, 12 bp, Homo sapiens
cctctgcagcct

SEQ ID NO: 453023 - DNA, 13 bp, Homo sapiens
cctctgcagcctg

SEQ ID NO: 453024 - DNA, 15 bp, Homo sapiens
cctctgccccctccc

SEQ ID NO: 453025 - DNA, 16 bp, Homo sapiens
cctctgccccctcccc

SEQ ID NO: 453026 - DNA, 14 bp, Homo sapiens
cctctgcctttgag

SEQ ID NO: 453027 - DNA, 15 bp, Homo sapiens
cctctgcctttgagc

SEQ ID NO: 453028 - DNA, 17 bp, Homo sapiens
cctctgcctttgagctt

SEQ ID NO: 453029 - DNA, 17 bp, Homo sapiens
cctctgctatgtctgtg

SEQ ID NO: 453030 - DNA, 19 bp, Homo sapiens
cctctgctccaacagacac

SEQ ID NO: 453031 - DNA, 23 bp, Homo sapiens
cctctgctccaacagacaccctc

SEQ ID NO: 453032 - DNA, 12 bp, Homo sapiens
cctcttccccct

SEQ ID NO: 453033 - DNA, 20 bp, Homo sapiens
cctcttcccccttcccctgc

SEQ ID NO: 453034 - DNA, 21 bp, Homo sapiens
cctcttcccccttcccctgcg

SEQ ID NO: 453035 - DNA, 17 bp, Homo sapiens
cctctttctctctgtgt

SEQ ID NO: 453036 - DNA, 19 bp, Homo sapiens
cctctttctctctgtgtgg

SEQ ID NO: 453037 - DNA, 21 bp, Homo sapiens
cctgaagagcgctcctctgcc

SEQ ID NO: 453038 - DNA, 10 bp, Homo sapiens
cctgaataac

SEQ ID NO: 453039 - DNA, 15 bp, Homo sapiens
cctgactccctgtgg

SEQ ID NO: 453040 - DNA, 21 bp, Homo sapiens
cctgactccctgtgggggtgg

SEQ ID NO: 453041 - DNA, 13 bp, Homo sapiens
cctgacttcccag

SEQ ID NO: 453042 - DNA, 18 bp, Homo sapiens
cctgacttcccagctggc

SEQ ID NO: 453043 - DNA, 16 bp, Homo sapiens
cctgagactcccgcct

SEQ ID NO: 453044 - DNA, 18 bp, Homo sapiens
cctgagcccgaatttctc

SEQ ID NO: 453045 - DNA, 16 bp, Homo sapiens
cctgagcctgtctctc

SEQ ID NO: 453046 - DNA, 17 bp, Homo sapiens
cctgagctccaccctcc

SEQ ID NO: 453047 - DNA, 16 bp, Homo sapiens
cctgaggacctttctg

SEQ ID NO: 453048 - DNA, 12 bp, Homo sapiens
cctgagggaagc

SEQ ID NO: 453049 - DNA, 13 bp, Homo sapiens
cctgagggaagcc

SEQ ID NO: 453050 - DNA, 12 bp, Homo sapiens
cctgcaccagga

SEQ ID NO: 453051 - DNA, 12 bp, Homo sapiens
cctgcaccctct

SEQ ID NO: 453052 - DNA, 13 bp, Homo sapiens
cctgcaccctctg

SEQ ID NO: 453053 - DNA, 17 bp, Homo sapiens
cctgcaccctctgctat

SEQ ID NO: 453054 - DNA, 16 bp, Homo sapiens
cctgcagcccagaacg

SEQ ID NO: 453055 - DNA, 18 bp, Homo sapiens
cctgcatcccttggcccc

SEQ ID NO: 453056 - DNA, 23 bp, Homo sapiens
cctgcatcccttggcccctctct

SEQ ID NO: 453057 - DNA, 13 bp, Homo sapiens
cctgcccagtctt

SEQ ID NO: 453058 - DNA, 16 bp, Homo sapiens
cctgcccatgtgtccc

SEQ ID NO: 453059 - DNA, 13 bp, Homo sapiens
cctgccccccttc

SEQ ID NO: 453060 - DNA, 15 bp, Homo sapiens
cctgcccctcccttc

SEQ ID NO: 453061 - DNA, 15 bp, Homo sapiens
cctgccctcactcca

SEQ ID NO: 453062 - DNA, 16 bp, Homo sapiens
cctgccctcactccac

SEQ ID NO: 453063 - DNA, 14 bp, Homo sapiens
cctgccctccccca

SEQ ID NO: 453064 - DNA, 22 bp, Homo sapiens
cctgccctcgtctccctggcca

SEQ ID NO: 453065 - DNA, 14 bp, Homo sapiens
cctgccctgcacct

SEQ ID NO: 453066 - DNA, 22 bp, Homo sapiens
cctgccttggggaaggtctccc

SEQ ID NO: 453067 - DNA, 17 bp, Homo sapiens
cctgcgccctccctccc

SEQ ID NO: 453068 - DNA, 13 bp, Homo sapiens
cctgcgctcctct

SEQ ID NO: 453069 - DNA, 17 bp, Homo sapiens
cctgcgctcctctgcag

SEQ ID NO: 453070 - DNA, 19 bp, Homo sapiens
cctgcgctcctctgcagcc

SEQ ID NO: 453071 - DNA, 16 bp, Homo sapiens
cctgctagctgtagaa

SEQ ID NO: 453072 - DNA, 16 bp, Homo sapiens
cctgctcacgtctgtg

SEQ ID NO: 453073 - DNA, 19 bp, Homo sapiens
cctgctgctcgggaaggcc

SEQ ID NO: 453074 - DNA, 20 bp, Homo sapiens
cctgctttgggctgccctgg

SEQ ID NO: 453075 - DNA, 21 bp, Homo sapiens
cctgctttgggctgccctggt

SEQ ID NO: 453076 - DNA, 22 bp, Homo sapiens
cctgctttgggctgccctggtg

SEQ ID NO: 453077 - DNA, 20 bp, Homo sapiens
ctccgggtgtggcctcagcc

SEQ ID NO: 453078 - DNA, 22 bp, Homo sapiens
ctccgggtgtggcctcagccct

SEQ ID NO: 453079 - DNA, 23 bp, Homo sapiens
ctccgggtgtggcctcagccctc

SEQ ID NO: 453080 - DNA, 13 bp, Homo sapiens
ctccgtccccagg

SEQ ID NO: 453081 - DNA, 14 bp, Homo sapiens
ctccgtccccaggg

SEQ ID NO: 453082 - DNA, 13 bp, Homo sapiens
ctcctacctggta

SEQ ID NO: 453083 - DNA, 22 bp, Homo sapiens
ctcctagcacaaggagtgcccg

SEQ ID NO: 453084 - DNA, 16 bp, Homo sapiens
ctcctaggcgctcaga

SEQ ID NO: 453085 - DNA, 19 bp, Homo sapiens
ctcctaggcgctcagaggc

SEQ ID NO: 453086 - DNA, 20 bp, Homo sapiens
ctcctaggcgctcagaggcc

SEQ ID NO: 453087 - DNA, 21 bp, Homo sapiens
ctcctaggcgctcagaggccg

SEQ ID NO: 453088 - DNA, 12 bp, Homo sapiens
ctcctaggctcc

SEQ ID NO: 453089 - DNA, 14 bp, Homo sapiens
ctcctccagactcg

SEQ ID NO: 453090 - DNA, 18 bp, Homo sapiens
ctcctcccaactctggcc

SEQ ID NO: 453091 - DNA, 17 bp, Homo sapiens
ctcctcccaggcgcccc

SEQ ID NO: 453092 - DNA, 23 bp, Homo sapiens
ctcctcccaggcgccccttcccc

SEQ ID NO: 453093 - DNA, 17 bp, Homo sapiens
ctcctcccggtgcccaa

SEQ ID NO: 453094 - DNA, 21 bp, Homo sapiens
ctcctcgggcgcctgcgctcc

SEQ ID NO: 453095 - DNA, 17 bp, Homo sapiens
ctcctcgtccggcctgc

SEQ ID NO: 453096 - DNA, 21 bp, Homo sapiens
ctcctcgtccggcctgcagcc

SEQ ID NO: 453097 - DNA, 22 bp, Homo sapiens
ctcctcgtccggcctgcagccc

SEQ ID NO: 453098 - DNA, 18 bp, Homo sapiens
ctcctctctctccctcca

SEQ ID NO: 453099 - DNA, 13 bp, Homo sapiens
ctcctctgccttg

SEQ ID NO: 453100 - DNA, 21 bp, Homo sapiens
ctcctctgctccaacagacac

SEQ ID NO: 453101 - DNA, 17 bp, Homo sapiens
ctcctgagcctgtctct

SEQ ID NO: 453102 - DNA, 18 bp, Homo sapiens
ctcctgagcctgtctctc

SEQ ID NO: 453103 - DNA, 23 bp, Homo sapiens
ctcctggccagacgctgccgctg

SEQ ID NO: 453104 - DNA, 24 bp, Homo sapiens
ctcctgggggtggcaggcacacag

SEQ ID NO: 453105 - DNA, 16 bp, Homo sapiens
ctccttcactctgaca

SEQ ID NO: 453106 - DNA, 14 bp, Homo sapiens
ctccttccccaccc

SEQ ID NO: 453107 - DNA, 10 bp, Homo sapiens
ctccttctcc

SEQ ID NO: 453108 - DNA, 12 bp, Homo sapiens
ctccttctcccc

SEQ ID NO: 453109 - DNA, 17 bp, Homo sapiens
ctccttctcccctccag

SEQ ID NO: 453110 - DNA, 13 bp, Homo sapiens
ctccttgtacttg

SEQ ID NO: 453111 - DNA, 17 bp, Homo sapiens
ctcctttcacaaccttc

SEQ ID NO: 453112 - DNA, 20 bp, Homo sapiens
ctcctttcacaaccttctgt

SEQ ID NO: 453113 - DNA, 11 bp, Homo sapiens
ctcctttccca

SEQ ID NO: 453114 - DNA, 12 bp, Homo sapiens
ctcctttcccac

SEQ ID NO: 453115 - DNA, 16 bp, Homo sapiens
ctcgagagggctgagc

SEQ ID NO: 453116 - DNA, 18 bp, Homo sapiens
ctcgagagggctgagccc

SEQ ID NO: 453117 - DNA, 19 bp, Homo sapiens
ctcgagagggctgagcccc

SEQ ID NO: 453118 - DNA, 21 bp, Homo sapiens
ctcgagagggctgagcccctc

SEQ ID NO: 453119 - DNA, 23 bp, Homo sapiens
ctcgagagggctgagcccctcct

SEQ ID NO: 453120 - DNA, 15 bp, Homo sapiens
ctcgagcccagatgg

SEQ ID NO: 453121 - DNA, 17 bp, Homo sapiens
ctcgagtccccccaccc

SEQ ID NO: 453122 - DNA, 20 bp, Homo sapiens
ctcgagtccccccacccctc

SEQ ID NO: 453123 - DNA, 15 bp, Homo sapiens
ctcggagccccccac

SEQ ID NO: 453124 - DNA, 17 bp, Homo sapiens
ctcggagccccccactc

SEQ ID NO: 453125 - DNA, 24 bp, Homo sapiens
ctcggccccacccaccctctggtc

SEQ ID NO: 453126 - DNA, 23 bp, Homo sapiens
ctcgggaaggcctgagggaagcc

SEQ ID NO: 453127 - DNA, 17 bp, Homo sapiens
ctcgggccgcctcctcc

SEQ ID NO: 453128 - DNA, 20 bp, Homo sapiens
ctcgggccgcctcctccaga

SEQ ID NO: 453129 - DNA, 21 bp, Homo sapiens
ctcgggccgcctcctccagac

SEQ ID NO: 453130 - DNA, 22 bp, Homo sapiens
ctcgggccgcctcctccagact

SEQ ID NO: 453131 - DNA, 14 bp, Homo sapiens
ctcgggtgcatttg

SEQ ID NO: 453132 - DNA, 14 bp, Homo sapiens
ctcggtcagcaccg

SEQ ID NO: 453133 - DNA, 17 bp, Homo sapiens
ctcgtccggcctgcagc

SEQ ID NO: 453134 - DNA, 16 bp, Homo sapiens
ctctaaaattctagtc

SEQ ID NO: 453135 - DNA, 20 bp, Homo sapiens
ctctaagaaatggctttcca

SEQ ID NO: 453136 - DNA, 18 bp, Homo sapiens
ctctacccccaacaccac

SEQ ID NO: 453137 - DNA, 21 bp, Homo sapiens
ctctcaatagcaaaagtgatg

SEQ ID NO: 453138 - DNA, 13 bp, Homo sapiens
ctctcagatccct

SEQ ID NO: 453139 - DNA, 13 bp, Homo sapiens
ctctccacccaga

SEQ ID NO: 453140 - DNA, 17 bp, Homo sapiens
ctctccacccagaggtc

SEQ ID NO: 453141 - DNA, 18 bp, Homo sapiens
ctctccacccagaggtct

SEQ ID NO: 453142 - DNA, 23 bp, Homo sapiens
ctctccacggtagcacttgacct

SEQ ID NO: 453143 - DNA, 12 bp, Homo sapiens
ctctccactgcc

SEQ ID NO: 453144 - DNA, 22 bp, Homo sapiens
ctctccccatatataaattatt

SEQ ID NO: 453145 - DNA, 15 bp, Homo sapiens
ctctccctccactcc

SEQ ID NO: 453146 - DNA, 19 bp, Homo sapiens
ctctccctccactcctccc

SEQ ID NO: 453147 - DNA, 20 bp, Homo sapiens
ctctcctcgtccggcctgca

SEQ ID NO: 453148 - DNA, 22 bp, Homo sapiens
ctctcctcgtccggcctgcagc

SEQ ID NO: 453149 - DNA, 15 bp, Homo sapiens
ctctcctctctctcc

SEQ ID NO: 453150 - DNA, 20 bp, Homo sapiens
ctctcctctctctccctcca

SEQ ID NO: 453151 - DNA, 21 bp, Homo sapiens
ctctcctctctctccctccac

SEQ ID NO: 453152 - DNA, 20 bp, Homo sapiens
ctctcctgagcctgtctctc

SEQ ID NO: 453153 - DNA, 19 bp, Homo sapiens
ctctcctgggggtggcagg

SEQ ID NO: 453154 - DNA, 23 bp, Homo sapiens
ctctcctgggggtggcaggcaca

SEQ ID NO: 453155 - DNA, 17 bp, Homo sapiens
ctctccttcactctgac

SEQ ID NO: 453156 - DNA, 12 bp, Homo sapiens
ctctcgagccca

SEQ ID NO: 453157 - DNA, 14 bp, Homo sapiens
ctctctccctccac

SEQ ID NO: 453158 - DNA, 19 bp, Homo sapiens
ctctctccctccactcctc

SEQ ID NO: 453159 - DNA, 9 bp, Homo sapiens
ctctctctc

SEQ ID NO: 453160 - DNA, 16 bp, Homo sapiens
ctctctctccctccac

SEQ ID NO: 453161 - DNA, 13 bp, Homo sapiens
ctctctctctctc

SEQ ID NO: 453162 - DNA, 15 bp, Homo sapiens
ctctctctctctgtt

SEQ ID NO: 453163 - DNA, 16 bp, Homo sapiens
ctctctctctctgttc

SEQ ID NO: 453164 - DNA, 12 bp, Homo sapiens
ctctctctctgt

SEQ ID NO: 453165 - DNA, 14 bp, Homo sapiens
ctctctctgttcca

SEQ ID NO: 453166 - DNA, 22 bp, Homo sapiens
ctctctggggccctgggcctca

SEQ ID NO: 453167 - DNA, 23 bp, Homo sapiens
ctctctggggccctgggcctcag

SEQ ID NO: 453168 - DNA, 13 bp, Homo sapiens
ctctctgtgtggc

SEQ ID NO: 453169 - DNA, 14 bp, Homo sapiens
ctctctgtgtggca

SEQ ID NO: 453170 - DNA, 16 bp, Homo sapiens
ctctctgtgtggcaaa

SEQ ID NO: 453171 - DNA, 22 bp, Homo sapiens
ctctctgtgtggcaaacattta

SEQ ID NO: 453172 - DNA, 20 bp, Homo sapiens
ctctctgtttaccctccctg

SEQ ID NO: 453173 - DNA, 16 bp, Homo sapiens
ctctcttaccccgtcc

SEQ ID NO: 453174 - DNA, 17 bp, Homo sapiens
ctcttaacttaaaagaa

SEQ ID NO: 453175 - DNA, 19 bp, Homo sapiens
ctcttctcagctccactct

SEQ ID NO: 453176 - DNA, 19 bp, Homo sapiens
ctcttctccactggatgga

SEQ ID NO: 453177 - DNA, 13 bp, Homo sapiens
ctcttctcctttc

SEQ ID NO: 453178 - DNA, 20 bp, Homo sapiens
ctcttcttccttttgtatcc

SEQ ID NO: 453179 - DNA, 17 bp, Homo sapiens
ctctttatgactgtttt

SEQ ID NO: 453180 - DNA, 15 bp, Homo sapiens
ctctttctcattctt

SEQ ID NO: 453181 - DNA, 11 bp, Homo sapiens
ctgaaaatatt

SEQ ID NO: 453182 - DNA, 19 bp, Homo sapiens
ctgaaaatatttttttcta

SEQ ID NO: 453183 - DNA, 13 bp, Homo sapiens
ctgaaataaaact

SEQ ID NO: 453184 - DNA, 15 bp, Homo sapiens
ctgaactcaggatgg

SEQ ID NO: 453185 - DNA, 20 bp, Homo sapiens
ctgaagagcgctcctctgcc

SEQ ID NO: 453186 - DNA, 21 bp, Homo sapiens
ctgaagagcgctcctctgcct

SEQ ID NO: 453187 - DNA, 22 bp, Homo sapiens
ctgaagagcgctcctctgcctt

SEQ ID NO: 453188 - DNA, 15 bp, Homo sapiens
ctgaaggagaggagt

SEQ ID NO: 453189 - DNA, 12 bp, Homo sapiens
ctgaaggcctcc

SEQ ID NO: 453190 - DNA, 15 bp, Homo sapiens
ctgaagtcactgcac

SEQ ID NO: 453191 - DNA, 16 bp, Homo sapiens
ctgaagtcactgcaca

SEQ ID NO: 453192 - DNA, 13 bp, Homo sapiens
ctgaagtcccttc

SEQ ID NO: 453193 - DNA, 15 bp, Homo sapiens
ctgaagtcccttcct

SEQ ID NO: 453194 - DNA, 17 bp, Homo sapiens
ctgaagtcccttcctgt

SEQ ID NO: 453195 - DNA, 20 bp, Homo sapiens
ctgaagtcccttcctgtcct

SEQ ID NO: 453196 - DNA, 13 bp, Homo sapiens
ctgaagtctcccc

SEQ ID NO: 453197 - DNA, 23 bp, Homo sapiens
ctgaagtctccccgcagccctct

SEQ ID NO: 453198 - DNA, 22 bp, Homo sapiens
ctgaataatggaattatgtata

SEQ ID NO: 453199 - DNA, 15 bp, Homo sapiens
ctgaattgttatgta

SEQ ID NO: 453200 - DNA, 16 bp, Homo sapiens
ctgaattgttatgtaa

SEQ ID NO: 453201 - DNA, 23 bp, Homo sapiens
ctgaattgttatgtaaacatcat

SEQ ID NO: 453202 - DNA, 15 bp, Homo sapiens
ctgaatttaactact

SEQ ID NO: 453203 - DNA, 12 bp, Homo sapiens
ctgacagcctcc

SEQ ID NO: 453204 - DNA, 17 bp, Homo sapiens
ctgacagcctcctaggc

SEQ ID NO: 453205 - DNA, 20 bp, Homo sapiens
ctgacagcctcctaggctcc

SEQ ID NO: 453206 - DNA, 15 bp, Homo sapiens
ctgactccctgtggg

SEQ ID NO: 453207 - DNA, 15 bp, Homo sapiens
ctgacttcccagctg

SEQ ID NO: 453208 - DNA, 19 bp, Homo sapiens
ctgacttcccagctggcag

SEQ ID NO: 453209 - DNA, 14 bp, Homo sapiens
ctgagagctgctcc

SEQ ID NO: 453210 - DNA, 16 bp, Homo sapiens
ctgagccacagtgggg

SEQ ID NO: 453211 - DNA, 20 bp, Homo sapiens
ctgagccacagtggggccca

SEQ ID NO: 453212 - DNA, 13 bp, Homo sapiens
ctgagcccctcct

SEQ ID NO: 453213 - DNA, 12 bp, Homo sapiens
ctgagccctgcc

SEQ ID NO: 453214 - DNA, 19 bp, Homo sapiens
ctgagccctgccctcactc

SEQ ID NO: 453215 - DNA, 12 bp, Homo sapiens
ctgagcctgtct

SEQ ID NO: 453216 - DNA, 17 bp, Homo sapiens
ctgagctccaccctccc

SEQ ID NO: 453217 - DNA, 20 bp, Homo sapiens
ctgagctccaccctcccctc

SEQ ID NO: 453218 - DNA, 20 bp, Homo sapiens
ctgaggaagttttgcatgca

SEQ ID NO: 453219 - DNA, 20 bp, Homo sapiens
ctgaggaccgccccaaccct

SEQ ID NO: 453220 - DNA, 19 bp, Homo sapiens
ctgaggacctttctgagga

SEQ ID NO: 453221 - DNA, 13 bp, Homo sapiens
ctgaggacggggc

SEQ ID NO: 453222 - DNA, 21 bp, Homo sapiens
ctgaggacggggcagagctga

SEQ ID NO: 453223 - DNA, 17 bp, Homo sapiens
ctgagggaagcccaccc

SEQ ID NO: 453224 - DNA, 19 bp, Homo sapiens
ctgagggaagcccacccgc

SEQ ID NO: 453225 - DNA, 22 bp, Homo sapiens
ctgagggaagcccacccgcccc

SEQ ID NO: 453226 - DNA, 13 bp, Homo sapiens
ctgagggcagggt

SEQ ID NO: 453227 - DNA, 19 bp, Homo sapiens
ctgaggtacctttccaccc

SEQ ID NO: 453228 - DNA, 21 bp, Homo sapiens
ctgaggtacctttccacccag

SEQ ID NO: 453229 - DNA, 22 bp, Homo sapiens
ctgaggtacctttccacccaga

SEQ ID NO: 453230 - DNA, 14 bp, Homo sapiens
ctgaggtctcacct

SEQ ID NO: 453231 - DNA, 16 bp, Homo sapiens
ctgagtccagctcccc

SEQ ID NO: 453232 - DNA, 17 bp, Homo sapiens
ctgagtcggctgggcag

SEQ ID NO: 453233 - DNA, 18 bp, Homo sapiens
ctgagtcggctgggcagg

SEQ ID NO: 453234 - DNA, 22 bp, Homo sapiens
ctgagtcggctgggcagggccg

SEQ ID NO: 453235 - DNA, 21 bp, Homo sapiens
ctgagtgaatgagtaaataaa

SEQ ID NO: 453236 - DNA, 17 bp, Homo sapiens
ctgataaacattaaaca

SEQ ID NO: 453237 - DNA, 15 bp, Homo sapiens
ctgcatgcaagctca

SEQ ID NO: 453238 - DNA, 17 bp, Homo sapiens
ctgcatgcaagctcagg

SEQ ID NO: 453239 - DNA, 21 bp, Homo sapiens
ctgccattagactgaatttaa

SEQ ID NO: 453240 - DNA, 14 bp, Homo sapiens
ctgcccaccctggg

SEQ ID NO: 453241 - DNA, 16 bp, Homo sapiens
ctgcccaccctgggcc

SEQ ID NO: 453242 - DNA, 17 bp, Homo sapiens
ctgcccaccctgggcct

SEQ ID NO: 453243 - DNA, 20 bp, Homo sapiens
ctgcccaccctgggcctccc

SEQ ID NO: 453244 - DNA, 23 bp, Homo sapiens
ctgcccaccctgggcctcccgtc

SEQ ID NO: 453245 - DNA, 15 bp, Homo sapiens
ctgcccacgctcctg

SEQ ID NO: 453246 - DNA, 21 bp, Homo sapiens
ctgcccagtctttggagagct

SEQ ID NO: 453247 - DNA, 15 bp, Homo sapiens
ctgccccacaacaca

SEQ ID NO: 453248 - DNA, 12 bp, Homo sapiens
ctgccccccttc

SEQ ID NO: 453249 - DNA, 22 bp, Homo sapiens
ctgccccccttcccacccctat

SEQ ID NO: 453250 - DNA, 12 bp, Homo sapiens
ctgccccctccc

SEQ ID NO: 453251 - DNA, 15 bp, Homo sapiens
ctgccccctcccccg

SEQ ID NO: 453252 - DNA, 16 bp, Homo sapiens
ctgccccctcccccgc

SEQ ID NO: 453253 - DNA, 18 bp, Homo sapiens
ctgccccctcccccgcag

SEQ ID NO: 453254 - DNA, 23 bp, Homo sapiens
ctgccccctcccccgcagacaga

SEQ ID NO: 453255 - DNA, 18 bp, Homo sapiens
ctgcccctccgtccccag

SEQ ID NO: 453256 - DNA, 19 bp, Homo sapiens
ctgcccctccgtccccagg

SEQ ID NO: 453257 - DNA, 21 bp, Homo sapiens
ctgcccctccgtccccagggt

SEQ ID NO: 453258 - DNA, 15 bp, Homo sapiens
ctgcccctgtaaggt

SEQ ID NO: 453259 - DNA, 20 bp, Homo sapiens
ctgccccttgaccccacacg

SEQ ID NO: 453260 - DNA, 13 bp, Homo sapiens
ctgccctccccca

SEQ ID NO: 453261 - DNA, 14 bp, Homo sapiens
ctgccctcccccac

SEQ ID NO: 453262 - DNA, 17 bp, Homo sapiens
ctgccctcccccacggc

SEQ ID NO: 453263 - DNA, 20 bp, Homo sapiens
ctgccctccctcggccccac

SEQ ID NO: 453264 - DNA, 19 bp, Homo sapiens
ctgccctgcaccttgggca

SEQ ID NO: 453265 - DNA, 20 bp, Homo sapiens
ctgccctgcaccttgggcac

SEQ ID NO: 453266 - DNA, 12 bp, Homo sapiens
ctgccctggtgc

SEQ ID NO: 453267 - DNA, 23 bp, Homo sapiens
ctgccctggtgctgccacacttc

SEQ ID NO: 453268 - DNA, 20 bp, Homo sapiens
ctgccgctgccgctgcacca

SEQ ID NO: 453269 - DNA, 14 bp, Homo sapiens
ctgccgctggaggc

SEQ ID NO: 453270 - DNA, 16 bp, Homo sapiens
ctgcctctgaaaatat

SEQ ID NO: 453271 - DNA, 18 bp, Homo sapiens
ctgcctctgaaaatattt

SEQ ID NO: 453272 - DNA, 19 bp, Homo sapiens
ctgcctggcgggcagcccc

SEQ ID NO: 453273 - DNA, 23 bp, Homo sapiens
ctgcgccctccctccctccacac

SEQ ID NO: 453274 - DNA, 12 bp, Homo sapiens
ctgcgcctgccc

SEQ ID NO: 453275 - DNA, 15 bp, Homo sapiens
ctgcgcctgcccgcc

SEQ ID NO: 453276 - DNA, 14 bp, Homo sapiens
ctgcgctcctctgc

SEQ ID NO: 453277 - DNA, 15 bp, Homo sapiens
ctgcgctcctctgca

SEQ ID NO: 453278 - DNA, 22 bp, Homo sapiens
ctgcgctcctctgcagcctgag

SEQ ID NO: 453279 - DNA, 14 bp, Homo sapiens
ctgcgggttttaat

SEQ ID NO: 453280 - DNA, 16 bp, Homo sapiens
ctgctagctgtagaaa

SEQ ID NO: 453281 - DNA, 15 bp, Homo sapiens
ctgctatgtctgtga

SEQ ID NO: 453282 - DNA, 17 bp, Homo sapiens
ctgctcacgtctgtgag

SEQ ID NO: 453283 - DNA, 14 bp, Homo sapiens
ctgctcgggaaggc

SEQ ID NO: 453284 - DNA, 21 bp, Homo sapiens
ctgctctccttcactctgaca

SEQ ID NO: 453285 - DNA, 16 bp, Homo sapiens
ctgctgcaccaacctc

SEQ ID NO: 453286 - DNA, 18 bp, Homo sapiens
ctgctgctcgggaaggcc

SEQ ID NO: 453287 - DNA, 12 bp, Homo sapiens
ctgctggctgcc

SEQ ID NO: 453288 - DNA, 13 bp, Homo sapiens
ctgctgtgaattt

SEQ ID NO: 453289 - DNA, 13 bp, Homo sapiens
ctgcttaaggaaa

SEQ ID NO: 453290 - DNA, 17 bp, Homo sapiens
ctgcttagtgtccctta

SEQ ID NO: 453291 - DNA, 15 bp, Homo sapiens
ctgcttcacatccac

SEQ ID NO: 453292 - DNA, 16 bp, Homo sapiens
ctgctttgggctgccc

SEQ ID NO: 453293 - DNA, 17 bp, Homo sapiens
ctgctttgggctgccct

SEQ ID NO: 453294 - DNA, 21 bp, Homo sapiens
ctgctttgggctgccctggtg

SEQ ID NO: 453295 - DNA, 22 bp, Homo sapiens
ctgctttgggctgccctggtgc

SEQ ID NO: 453296 - DNA, 23 bp, Homo sapiens
ctgctttggggcttatcagaact

SEQ ID NO: 453297 - DNA, 19 bp, Homo sapiens
ctggacgatagcttggagg

SEQ ID NO: 453298 - DNA, 21 bp, Homo sapiens
ctggacgatagcttggaggga

SEQ ID NO: 453299 - DNA, 14 bp, Homo sapiens
ctggagaactagag

SEQ ID NO: 453300 - DNA, 22 bp, Homo sapiens
ctggagcccctatcctgcaccc

SEQ ID NO: 453301 - DNA, 20 bp, Homo sapiens
ctggaggccaccaagctgct

SEQ ID NO: 453302 - DNA, 17 bp, Homo sapiens
ctggagtctgaaggaga

SEQ ID NO: 453303 - DNA, 18 bp, Homo sapiens
ctggagtctgaaggagag

SEQ ID NO: 453304 - DNA, 21 bp, Homo sapiens
ctggatggaggaaaaccaagc

SEQ ID NO: 453305 - DNA, 16 bp, Homo sapiens
ctggatgtgctttcat

SEQ ID NO: 453306 - DNA, 17 bp, Homo sapiens
ctggattttctttctat

SEQ ID NO: 453307 - DNA, 19 bp, Homo sapiens
ctggattttctttctatgt

SEQ ID NO: 453308 - DNA, 20 bp, Homo sapiens
ctggattttctttctatgta

SEQ ID NO: 453309 - DNA, 17 bp, Homo sapiens
ctggcacagggcagtgg

SEQ ID NO: 453310 - DNA, 21 bp, Homo sapiens
ctggcagccgtgccttcagct

SEQ ID NO: 453311 - DNA, 21 bp, Homo sapiens
ctggcagcgcctcccgccgcc

SEQ ID NO: 453312 - DNA, 13 bp, Homo sapiens
ctggccagacgct

SEQ ID NO: 453313 - DNA, 14 bp, Homo sapiens
ctggccagacgctg

SEQ ID NO: 453314 - DNA, 12 bp, Homo sapiens
ctggccagcacc

SEQ ID NO: 453315 - DNA, 16 bp, Homo sapiens
ctggccagcaccctct

SEQ ID NO: 453316 - DNA, 21 bp, Homo sapiens
ctggccagcaccctctcctgg

SEQ ID NO: 453317 - DNA, 23 bp, Homo sapiens
ctggccagcaccctctcctgggg

SEQ ID NO: 453318 - DNA, 19 bp, Homo sapiens
ctggcccacccctcttccc

SEQ ID NO: 453319 - DNA, 13 bp, Homo sapiens
ctggccccaggcg

SEQ ID NO: 453320 - DNA, 15 bp, Homo sapiens
ctggccccaggcgga

SEQ ID NO: 453321 - DNA, 13 bp, Homo sapiens
ctggcctatttaa

SEQ ID NO: 453322 - DNA, 20 bp, Homo sapiens
ctggccttggttcctccagc

SEQ ID NO: 453323 - DNA, 16 bp, Homo sapiens
ctggcgggcagcccct

SEQ ID NO: 453324 - DNA, 21 bp, Homo sapiens
ctggcgggcagcccctgctgg

SEQ ID NO: 453325 - DNA, 17 bp, Homo sapiens
ctggctacgacttggga

SEQ ID NO: 453326 - DNA, 15 bp, Homo sapiens
ctggctcccacaggc

SEQ ID NO: 453327 - DNA, 19 bp, Homo sapiens
ctggctcccacaggccctt

SEQ ID NO: 453328 - DNA, 19 bp, Homo sapiens
ctggctgggtcgcccctcc

SEQ ID NO: 453329 - DNA, 21 bp, Homo sapiens
ctggctgggtcgcccctcctc

SEQ ID NO: 453330 - DNA, 14 bp, Homo sapiens
ctggctgtggcccc

SEQ ID NO: 453331 - DNA, 15 bp, Homo sapiens
ctggcttttcactgc

SEQ ID NO: 453332 - DNA, 19 bp, Homo sapiens
ctggcttttcactgctggc

SEQ ID NO: 453333 - DNA, 23 bp, Homo sapiens
ctggcttttcactgctggctgcc

SEQ ID NO: 453334 - DNA, 20 bp, Homo sapiens
ctgggatgggaccagggatg

SEQ ID NO: 453335 - DNA, 12 bp, Homo sapiens
ctgggcagggcc

SEQ ID NO: 453336 - DNA, 15 bp, Homo sapiens
ctgggcagggccgca

SEQ ID NO: 453337 - DNA, 17 bp, Homo sapiens
ctgggcccctccacgcc

SEQ ID NO: 453338 - DNA, 17 bp, Homo sapiens
ctgggcccctgggatgg

SEQ ID NO: 453339 - DNA, 21 bp, Homo sapiens
ctgggcctcagttcaacctgg

SEQ ID NO: 453340 - DNA, 14 bp, Homo sapiens
ctgggcctcccgtc

SEQ ID NO: 453341 - DNA, 13 bp, Homo sapiens
ctgggctgtctgt

SEQ ID NO: 453342 - DNA, 17 bp, Homo sapiens
ctgggctgtctgtcacc

SEQ ID NO: 453343 - DNA, 20 bp, Homo sapiens
ctgggctgtctgtcaccagc

SEQ ID NO: 453344 - DNA, 21 bp, Homo sapiens
ctgggctgtctgtcaccagct

SEQ ID NO: 453345 - DNA, 14 bp, Homo sapiens
ctggggccctgggc

SEQ ID NO: 453346 - DNA, 14 bp, Homo sapiens
ctggggcctggcct

SEQ ID NO: 453347 - DNA, 15 bp, Homo sapiens
ctggggcctggccta

SEQ ID NO: 453348 - DNA, 21 bp, Homo sapiens
ctggggcctggcctatttaag

SEQ ID NO: 453349 - DNA, 19 bp, Homo sapiens
ctggggggggcaagagctc

SEQ ID NO: 453350 - DNA, 16 bp, Homo sapiens
ctgggggtggcaggca

SEQ ID NO: 453351 - DNA, 13 bp, Homo sapiens
ctggggtggggct

SEQ ID NO: 453352 - DNA, 14 bp, Homo sapiens
ctggggtggggctt

SEQ ID NO: 453353 - DNA, 18 bp, Homo sapiens
ctggggtggggcttggaa

SEQ ID NO: 453354 - DNA, 16 bp, Homo sapiens
ctgggtcagcttgaat

SEQ ID NO: 453355 - DNA, 15 bp, Homo sapiens
ctgggttgttgcaga

SEQ ID NO: 453356 - DNA, 23 bp, Homo sapiens
ctgggttgttgcagagtaaatcc

SEQ ID NO: 453357 - DNA, 18 bp, Homo sapiens
ctgggtttgggcagtgga

SEQ ID NO: 453358 - DNA, 19 bp, Homo sapiens
ctgggtttgggcagtggag

SEQ ID NO: 453359 - DNA, 20 bp, Homo sapiens
ctgggtttgggcagtggaga

SEQ ID NO: 453360 - DNA, 17 bp, Homo sapiens
ctgggttttagaaattc

SEQ ID NO: 453361 - DNA, 22 bp, Homo sapiens
ctggtcagtgaagcccaggagg

SEQ ID NO: 453362 - DNA, 23 bp, Homo sapiens
ctggtcagtgaagcccaggagga

SEQ ID NO: 453363 - DNA, 14 bp, Homo sapiens
ctggtctggagccc

SEQ ID NO: 453364 - DNA, 17 bp, Homo sapiens
ctggtctggagccccta

SEQ ID NO: 453365 - DNA, 22 bp, Homo sapiens
ctggtgctgccacacttcaggc

SEQ ID NO: 453366 - DNA, 23 bp, Homo sapiens
ctggttatagttgatatgtaaca

SEQ ID NO: 453367 - DNA, 23 bp, Homo sapiens
ctgtaaaatacatggtatctctt

SEQ ID NO: 453368 - DNA, 16 bp, Homo sapiens
ctgtaaatttaactgc

SEQ ID NO: 453369 - DNA, 17 bp, Homo sapiens
ctgtatctaaaaaataa

SEQ ID NO: 453370 - DNA, 20 bp, Homo sapiens
ctgtatctaaaaaataactg

SEQ ID NO: 453371 - DNA, 12 bp, Homo sapiens
ctgtatttccaa

SEQ ID NO: 453372 - DNA, 11 bp, Homo sapiens
ctgtattttct

SEQ ID NO: 453373 - DNA, 15 bp, Homo sapiens
ctgtattttctttta

SEQ ID NO: 453374 - DNA, 21 bp, Homo sapiens
ctgtattttcttttatatctg

SEQ ID NO: 453375 - DNA, 12 bp, Homo sapiens
ctgtcagccagc

SEQ ID NO: 453376 - DNA, 16 bp, Homo sapiens
ctgtcagccagccgcc

SEQ ID NO: 453377 - DNA, 17 bp, Homo sapiens
ctgtcagccagccgccc

SEQ ID NO: 453378 - DNA, 18 bp, Homo sapiens
ctgtcagccagccgccct

SEQ ID NO: 453379 - DNA, 19 bp, Homo sapiens
ctgtcagccagccgccctg

SEQ ID NO: 453380 - DNA, 20 bp, Homo sapiens
ctgtcagccagccgccctgg

SEQ ID NO: 453381 - DNA, 23 bp, Homo sapiens
ctgtcagccagccgccctgggct

SEQ ID NO: 453382 - DNA, 22 bp, Homo sapiens
ctgtcattggttacaaattttt

SEQ ID NO: 453383 - DNA, 19 bp, Homo sapiens
ctgtccacctgtgctgctg

SEQ ID NO: 453384 - DNA, 17 bp, Homo sapiens
ctgtcccacaaaatatt

SEQ ID NO: 453385 - DNA, 19 bp, Homo sapiens
ctgtcccaccgggagcctc

SEQ ID NO: 453386 - DNA, 21 bp, Homo sapiens
ctgtcccaccgggagcctccc

SEQ ID NO: 453387 - DNA, 13 bp, Homo sapiens
ctgtcctctcgag

SEQ ID NO: 453388 - DNA, 17 bp, Homo sapiens
ctgtcctctcgagccca

SEQ ID NO: 453389 - DNA, 19 bp, Homo sapiens
ctgtcctctcgagcccaga

SEQ ID NO: 453390 - DNA, 12 bp, Homo sapiens
ctgtcctgctca

SEQ ID NO: 453391 - DNA, 15 bp, Homo sapiens
ctgtcgccccaggcc

SEQ ID NO: 453392 - DNA, 17 bp, Homo sapiens
ctgtcgccccaggccct

SEQ ID NO: 453393 - DNA, 18 bp, Homo sapiens
ctgtctcaagagggcact

SEQ ID NO: 453394 - DNA, 23 bp, Homo sapiens
ctgtctcaagagggcactggtgg

SEQ ID NO: 453395 - DNA, 17 bp, Homo sapiens
ctgtctctccctaccct

SEQ ID NO: 453396 - DNA, 14 bp, Homo sapiens
ctgtctgagccctg

SEQ ID NO: 453397 - DNA, 16 bp, Homo sapiens
ctgtctgagccctgcc

SEQ ID NO: 453398 - DNA, 20 bp, Homo sapiens
ctgtctgagccctgccctca

SEQ ID NO: 453399 - DNA, 16 bp, Homo sapiens
ctgtctgattctatgc

SEQ ID NO: 453400 - DNA, 19 bp, Homo sapiens
ctgtcttcaaccctgccct

SEQ ID NO: 453401 - DNA, 22 bp, Homo sapiens
ctgtcttcaaccctgccctgca

SEQ ID NO: 453402 - DNA, 23 bp, Homo sapiens
ctgtctttgctgtttatatatat

SEQ ID NO: 453403 - DNA, 17 bp, Homo sapiens
ctgtgaagcctttatct

SEQ ID NO: 453404 - DNA, 16 bp, Homo sapiens
ctgtgagtctgtcctt

SEQ ID NO: 453405 - DNA, 23 bp, Homo sapiens
ctgtgatgtcagtagtgcctgtg

SEQ ID NO: 453406 - DNA, 11 bp, Homo sapiens
ctgtgcaataa

SEQ ID NO: 453407 - DNA, 15 bp, Homo sapiens
ctgtgctaagttgtc

SEQ ID NO: 453408 - DNA, 20 bp, Homo sapiens
ctgtgctaagttgtcttaca

SEQ ID NO: 453409 - DNA, 13 bp, Homo sapiens
ctgtggattctat

SEQ ID NO: 453410 - DNA, 13 bp, Homo sapiens
ctgtggcccctcc

SEQ ID NO: 453411 - DNA, 23 bp, Homo sapiens
ctgtggcccctccttctcccctc

SEQ ID NO: 453412 - DNA, 16 bp, Homo sapiens
ctgtgggactggccca

SEQ ID NO: 453413 - DNA, 22 bp, Homo sapiens
ctgtgggactggcccacccctc

SEQ ID NO: 453414 - DNA, 13 bp, Homo sapiens
ctgtgggagtcca

SEQ ID NO: 453415 - DNA, 15 bp, Homo sapiens
ctgtgggagtccact

SEQ ID NO: 453416 - DNA, 23 bp, Homo sapiens
ctgtgggagtccactttcctctc

SEQ ID NO: 453417 - DNA, 11 bp, Homo sapiens
ctgtgggcagc

SEQ ID NO: 453418 - DNA, 12 bp, Homo sapiens
ctgtgggcagca

SEQ ID NO: 453419 - DNA, 16 bp, Homo sapiens
ctgtgggcagcaccct

SEQ ID NO: 453420 - DNA, 17 bp, Homo sapiens
ctgtgggcagcaccctc

SEQ ID NO: 453421 - DNA, 19 bp, Homo sapiens
ctgtgggcagcaccctccc

SEQ ID NO: 453422 - DNA, 21 bp, Homo sapiens
ctgtgggggtggccatccctg

SEQ ID NO: 453423 - DNA, 23 bp, Homo sapiens
ctgtgggggtggccatccctggg

SEQ ID NO: 453424 - DNA, 16 bp, Homo sapiens
ctgtgtaatctctgat

SEQ ID NO: 453425 - DNA, 15 bp, Homo sapiens
ctgtgtcccagcacc

SEQ ID NO: 453426 - DNA, 13 bp, Homo sapiens
ctgtgtggcaaac

SEQ ID NO: 453427 - DNA, 17 bp, Homo sapiens
ctgtgtggcaaacattt

SEQ ID NO: 453428 - DNA, 18 bp, Homo sapiens
ctgtgtggcaaacattta

SEQ ID NO: 453429 - DNA, 22 bp, Homo sapiens
ctgtgtggcaaacatttaaaaa

SEQ ID NO: 453430 - DNA, 13 bp, Homo sapiens
ctgtgtggggagg

SEQ ID NO: 453431 - DNA, 13 bp, Homo sapiens
ctgttcactctac

SEQ ID NO: 453432 - DNA, 16 bp, Homo sapiens
ctgttccaagtgtgtg

SEQ ID NO: 453433 - DNA, 20 bp, Homo sapiens
ctgttccaagtgtgtgtgca

SEQ ID NO: 453434 - DNA, 21 bp, Homo sapiens
ctgttccaagtgtgtgtgcaa

SEQ ID NO: 453435 - DNA, 18 bp, Homo sapiens
ctgttgctgtcctccagg

SEQ ID NO: 453436 - DNA, 17 bp, Homo sapiens
ctgtttaccctccctgt

SEQ ID NO: 453437 - DNA, 19 bp, Homo sapiens
ctgtttaccctccctgtcc

SEQ ID NO: 453438 - DNA, 19 bp, Homo sapiens
ctgtttcaatgacctgtat

SEQ ID NO: 453439 - DNA, 15 bp, Homo sapiens
ctgttttatgtcata

SEQ ID NO: 453440 - DNA, 14 bp, Homo sapiens
ctgttttggaatgt

SEQ ID NO: 453441 - DNA, 16 bp, Homo sapiens
cttaaaagaacatagg

SEQ ID NO: 453442 - DNA, 23 bp, Homo sapiens
cttaaacattttttgtttcttgg

SEQ ID NO: 453443 - DNA, 15 bp, Homo sapiens
cttaaactttgtcac

SEQ ID NO: 453444 - DNA, 19 bp, Homo sapiens
cttaaactttgtcacttct

SEQ ID NO: 453445 - DNA, 22 bp, Homo sapiens
cttaacaaacgtaatttgttat

SEQ ID NO: 453446 - DNA, 14 bp, Homo sapiens
cttaacttaaaaga

SEQ ID NO: 453447 - DNA, 16 bp, Homo sapiens
cttaacttaaaagaac

SEQ ID NO: 453448 - DNA, 19 bp, Homo sapiens
cttaagaaagctatatatg

SEQ ID NO: 453449 - DNA, 22 bp, Homo sapiens
cttaagaaagctatatatgaat

SEQ ID NO: 453450 - DNA, 18 bp, Homo sapiens
cttaatggaaacacgaga

SEQ ID NO: 453451 - DNA, 17 bp, Homo sapiens
cttacagacagaatata

SEQ ID NO: 453452 - DNA, 22 bp, Homo sapiens
cttacattagcagtttgctttg

SEQ ID NO: 453453 - DNA, 19 bp, Homo sapiens
cttaccccgtccctttccc

SEQ ID NO: 453454 - DNA, 20 bp, Homo sapiens
cttaccccgtccctttccct

SEQ ID NO: 453455 - DNA, 12 bp, Homo sapiens
cttatagaaagt

SEQ ID NO: 453456 - DNA, 22 bp, Homo sapiens
cttatctccagccaatttcaaa

SEQ ID NO: 453457 - DNA, 16 bp, Homo sapiens
cttatgctgctgtgaa

SEQ ID NO: 453458 - DNA, 13 bp, Homo sapiens
cttcaaggccaag

SEQ ID NO: 453459 - DNA, 12 bp, Homo sapiens
cttcagactctc

SEQ ID NO: 453460 - DNA, 17 bp, Homo sapiens
cttcagactctctcctc

SEQ ID NO: 453461 - DNA, 21 bp, Homo sapiens
cttcagcaaccctacagtata

SEQ ID NO: 453462 - DNA, 15 bp, Homo sapiens
cttcaggctcttctc

SEQ ID NO: 453463 - DNA, 20 bp, Homo sapiens
cttcagggttctaacctttc

SEQ ID NO: 453464 - DNA, 18 bp, Homo sapiens
cttcaggttcctcctagg

SEQ ID NO: 453465 - DNA, 23 bp, Homo sapiens
cttcatacaaaggacagtacaca

SEQ ID NO: 453466 - DNA, 21 bp, Homo sapiens
cttcatccatagacacagtat

SEQ ID NO: 453467 - DNA, 10 bp, Homo sapiens
cttccagatg

SEQ ID NO: 453468 - DNA, 23 bp, Homo sapiens
cttccagatttgagctgcctgga

SEQ ID NO: 453469 - DNA, 15 bp, Homo sapiens
cttccatatgctctt

SEQ ID NO: 453470 - DNA, 21 bp, Homo sapiens
cttcccaacgtactcctcaga

SEQ ID NO: 453471 - DNA, 21 bp, Homo sapiens
cttcccagctggcagcgcctc

SEQ ID NO: 453472 - DNA, 13 bp, Homo sapiens
cttccccacccca

SEQ ID NO: 453473 - DNA, 15 bp, Homo sapiens
cttccccaccccata

SEQ ID NO: 453474 - DNA, 12 bp, Homo sapiens
cttcccccttcc

SEQ ID NO: 453475 - DNA, 14 bp, Homo sapiens
cttcccccttcccc

SEQ ID NO: 453476 - DNA, 15 bp, Homo sapiens
cttcccccttcccct

SEQ ID NO: 453477 - DNA, 16 bp, Homo sapiens
cttccccgtgcggccc

SEQ ID NO: 453478 - DNA, 18 bp, Homo sapiens
cttccccgtgcggcccgt

SEQ ID NO: 453479 - DNA, 20 bp, Homo sapiens
cttcccctgaggacctttct

SEQ ID NO: 453480 - DNA, 13 bp, Homo sapiens
cttccctgcttca

SEQ ID NO: 453481 - DNA, 16 bp, Homo sapiens
cttcctctccactgcc

SEQ ID NO: 453482 - DNA, 16 bp, Homo sapiens
cttcctgtcctgctca

SEQ ID NO: 453483 - DNA, 17 bp, Homo sapiens
cttcctgtcctgctcac

SEQ ID NO: 453484 - DNA, 20 bp, Homo sapiens
cttctcagctccactctgaa

SEQ ID NO: 453485 - DNA, 22 bp, Homo sapiens
cttctcagctccactctgaagt

SEQ ID NO: 453486 - DNA, 17 bp, Homo sapiens
cttctccactggatgga

SEQ ID NO: 453487 - DNA, 12 bp, Homo sapiens
cttctcccctcc

SEQ ID NO: 453488 - DNA, 20 bp, Homo sapiens
cttctcccctccagacccct

SEQ ID NO: 453489 - DNA, 20 bp, Homo sapiens
cttctcctttcacaaccttc

SEQ ID NO: 453490 - DNA, 22 bp, Homo sapiens
cttctgaccccacttatgctgc

SEQ ID NO: 453491 - DNA, 15 bp, Homo sapiens
cttctgtggctcaca

SEQ ID NO: 453492 - DNA, 20 bp, Homo sapiens
cttcttatattaaagaagtt

SEQ ID NO: 453493 - DNA, 21 bp, Homo sapiens
cttcttcatccatagacacag

SEQ ID NO: 453494 - DNA, 23 bp, Homo sapiens
cttcttcatccatagacacagta

SEQ ID NO: 453495 - DNA, 19 bp, Homo sapiens
cttcttgcggcaccgccca

SEQ ID NO: 453496 - DNA, 17 bp, Homo sapiens
gaaattgtgccaaagat

SEQ ID NO: 453497 - DNA, 18 bp, Homo sapiens
gaaatttacagttactgc

SEQ ID NO: 453498 - DNA, 20 bp, Homo sapiens
gaaatttacagttactgcct

SEQ ID NO: 453499 - DNA, 14 bp, Homo sapiens
gaacagccaaagaa

SEQ ID NO: 453500 - DNA, 15 bp, Homo sapiens
gaacagccaaagaaa

SEQ ID NO: 453501 - DNA, 17 bp, Homo sapiens
gaacagccaaagaaact

SEQ ID NO: 453502 - DNA, 19 bp, Homo sapiens
gaacagccaaagaaactca

SEQ ID NO: 453503 - DNA, 18 bp, Homo sapiens
gaaccaacgggtctgtgg

SEQ ID NO: 453504 - DNA, 21 bp, Homo sapiens
gaaccaacgggtctgtgggac

SEQ ID NO: 453505 - DNA, 15 bp, Homo sapiens
gaaccagcactccca

SEQ ID NO: 453506 - DNA, 17 bp, Homo sapiens
gaaccagcactcccagg

SEQ ID NO: 453507 - DNA, 19 bp, Homo sapiens
gaaccagcactcccagggc

SEQ ID NO: 453508 - DNA, 14 bp, Homo sapiens
gaacccccctcccc

SEQ ID NO: 453509 - DNA, 21 bp, Homo sapiens
gaacccccctccccaaggaag

SEQ ID NO: 453510 - DNA, 13 bp, Homo sapiens
gaaccgtcaatgt

SEQ ID NO: 453511 - DNA, 14 bp, Homo sapiens
gaacctcatttgtc

SEQ ID NO: 453512 - DNA, 13 bp, Homo sapiens
gaacctgctcttc

SEQ ID NO: 453513 - DNA, 12 bp, Homo sapiens
gaacctttgtca

SEQ ID NO: 453514 - DNA, 19 bp, Homo sapiens
gaagaaaacccgagggaca

SEQ ID NO: 453515 - DNA, 14 bp, Homo sapiens
gaagaaaactatcc

SEQ ID NO: 453516 - DNA, 22 bp, Homo sapiens
gaagaaaactatcctgcgggtt

SEQ ID NO: 453517 - DNA, 13 bp, Homo sapiens
gaagaaaataacc

SEQ ID NO: 453518 - DNA, 14 bp, Homo sapiens
gaagagatgctcta

SEQ ID NO: 453519 - DNA, 18 bp, Homo sapiens
gaagagcgctcctctgcc

SEQ ID NO: 453520 - DNA, 21 bp, Homo sapiens
gaagagtctttgattcaccaa

SEQ ID NO: 453521 - DNA, 14 bp, Homo sapiens
gaagcccacccgcc

SEQ ID NO: 453522 - DNA, 15 bp, Homo sapiens
gaagcccacccgccc

SEQ ID NO: 453523 - DNA, 16 bp, Homo sapiens
gaagcccacccgcccc

SEQ ID NO: 453524 - DNA, 17 bp, Homo sapiens
gaagcccacccgcccca

SEQ ID NO: 453525 - DNA, 14 bp, Homo sapiens
gaagcctttatcta

SEQ ID NO: 453526 - DNA, 23 bp, Homo sapiens
gaaggacccggaggggcctggca

SEQ ID NO: 453527 - DNA, 15 bp, Homo sapiens
gaaggagaggagtgc

SEQ ID NO: 453528 - DNA, 17 bp, Homo sapiens
gaaggagaggagtgcgc

SEQ ID NO: 453529 - DNA, 21 bp, Homo sapiens
gaaggattcttttttcaatgt

SEQ ID NO: 453530 - DNA, 22 bp, Homo sapiens
gaaggattcttttttcaatgta

SEQ ID NO: 453531 - DNA, 13 bp, Homo sapiens
gaaggcctgaggg

SEQ ID NO: 453532 - DNA, 21 bp, Homo sapiens
gaaggcctgagggaagcccac

SEQ ID NO: 453533 - DNA, 16 bp, Homo sapiens
gaaggcctgcccccct

SEQ ID NO: 453534 - DNA, 17 bp, Homo sapiens
gaaggcctgcccccctt

SEQ ID NO: 453535 - DNA, 18 bp, Homo sapiens
gaaggcctgccccccttc

SEQ ID NO: 453536 - DNA, 21 bp, Homo sapiens
gaaggcctgccccccttccca

SEQ ID NO: 453537 - DNA, 14 bp, Homo sapiens
gaaggctttattct

SEQ ID NO: 453538 - DNA, 20 bp, Homo sapiens
gaagggcgctgagggcaggg

SEQ ID NO: 453539 - DNA, 22 bp, Homo sapiens
gaagtaactccccttaaaatgt

SEQ ID NO: 453540 - DNA, 15 bp, Homo sapiens
gaagtcactgcacag

SEQ ID NO: 453541 - DNA, 17 bp, Homo sapiens
gaagtcccttcctgtcc

SEQ ID NO: 453542 - DNA, 22 bp, Homo sapiens
gaagtctccccgcagccctctc

SEQ ID NO: 453543 - DNA, 20 bp, Homo sapiens
gaagtgggattcaggaatgg

SEQ ID NO: 453544 - DNA, 21 bp, Homo sapiens
gaagtgggattcaggaatggg

SEQ ID NO: 453545 - DNA, 18 bp, Homo sapiens
gaagttaacagtctcatt

SEQ ID NO: 453546 - DNA, 17 bp, Homo sapiens
gaagttgtaagaaaagc

SEQ ID NO: 453547 - DNA, 22 bp, Homo sapiens
gaataaataaagaagaaaataa

SEQ ID NO: 453548 - DNA, 16 bp, Homo sapiens
gaataacataggtgct

SEQ ID NO: 453549 - DNA, 15 bp, Homo sapiens
gaatagatgctgact

SEQ ID NO: 453550 - DNA, 21 bp, Homo sapiens
gaatatacatagtctttgttt

SEQ ID NO: 453551 - DNA, 20 bp, Homo sapiens
gaatatgacctaaatccatt

SEQ ID NO: 453552 - DNA, 18 bp, Homo sapiens
gaatcattgagaaataaa

SEQ ID NO: 453553 - DNA, 15 bp, Homo sapiens
gaatccatatcagct

SEQ ID NO: 453554 - DNA, 17 bp, Homo sapiens
gaatccatatcagctct

SEQ ID NO: 453555 - DNA, 18 bp, Homo sapiens
gaatccatatcagctctg

SEQ ID NO: 453556 - DNA, 13 bp, Homo sapiens
gaatcctttgtac

SEQ ID NO: 453557 - DNA, 22 bp, Homo sapiens
gaatctcaatgacctgttgatt

SEQ ID NO: 453558 - DNA, 17 bp, Homo sapiens
gaatgagaaatcatgtt

SEQ ID NO: 453559 - DNA, 22 bp, Homo sapiens
gaatgagtaaataaactcttca

SEQ ID NO: 453560 - DNA, 15 bp, Homo sapiens
gaatgcaaaaagata

SEQ ID NO: 453561 - DNA, 14 bp, Homo sapiens
gaatggatgctgct

SEQ ID NO: 453562 - DNA, 14 bp, Homo sapiens
gaatggctctggct

SEQ ID NO: 453563 - DNA, 22 bp, Homo sapiens
gaatggtgggctccagagtagg

SEQ ID NO: 453564 - DNA, 20 bp, Homo sapiens
gaatgtccccattctataaa

SEQ ID NO: 453565 - DNA, 15 bp, Homo sapiens
gaatgtgtcccatgc

SEQ ID NO: 453566 - DNA, 17 bp, Homo sapiens
gaatgttatatcatcaa

SEQ ID NO: 453567 - DNA, 18 bp, Homo sapiens
gaattgaaccgtcaatgt

SEQ ID NO: 453568 - DNA, 19 bp, Homo sapiens
gaattgaaccgtcaatgtg

SEQ ID NO: 453569 - DNA, 22 bp, Homo sapiens
gaattgttatgtaaacatcata

SEQ ID NO: 453570 - DNA, 13 bp, Homo sapiens
gaatttctggttt

SEQ ID NO: 453571 - DNA, 17 bp, Homo sapiens
gacaaatatttctttct

SEQ ID NO: 453572 - DNA, 21 bp, Homo sapiens
gacaatgagtggaatactaaa

SEQ ID NO: 453573 - DNA, 18 bp, Homo sapiens
gacaatttcaaaatgcat

SEQ ID NO: 453574 - DNA, 19 bp, Homo sapiens
gacaatttcaaaatgcatg

SEQ ID NO: 453575 - DNA, 20 bp, Homo sapiens
gacaatttcaaaatgcatgt

SEQ ID NO: 453576 - DNA, 16 bp, Homo sapiens
gacacagttttgtctt

SEQ ID NO: 453577 - DNA, 13 bp, Homo sapiens
gacaccatcccct

SEQ ID NO: 453578 - DNA, 18 bp, Homo sapiens
gacaccctccactctgag

SEQ ID NO: 453579 - DNA, 19 bp, Homo sapiens
gacactgatgggtcctgct

SEQ ID NO: 453580 - DNA, 22 bp, Homo sapiens
gacagaaccaacgggtctgtgg

SEQ ID NO: 453581 - DNA, 13 bp, Homo sapiens
gacagagtggatc

SEQ ID NO: 453582 - DNA, 21 bp, Homo sapiens
gacagagtggatctggagtct

SEQ ID NO: 453583 - DNA, 13 bp, Homo sapiens
gacagatcttgag

SEQ ID NO: 453584 - DNA, 19 bp, Homo sapiens
gacagatgaccgcaataat

SEQ ID NO: 453585 - DNA, 22 bp, Homo sapiens
gacagcctcctaggctccctga

SEQ ID NO: 453586 - DNA, 11 bp, Homo sapiens
gacagcctggc

SEQ ID NO: 453587 - DNA, 13 bp, Homo sapiens
gacagcctggcac

SEQ ID NO: 453588 - DNA, 13 bp, Homo sapiens
gacagcggcccgg

SEQ ID NO: 453589 - DNA, 14 bp, Homo sapiens
gacagcggcccggc

SEQ ID NO: 453590 - DNA, 17 bp, Homo sapiens
gacagcggcccggccca

SEQ ID NO: 453591 - DNA, 15 bp, Homo sapiens
gacaggaaagccctc

SEQ ID NO: 453592 - DNA, 16 bp, Homo sapiens
gacaggaaagccctcc

SEQ ID NO: 453593 - DNA, 13 bp, Homo sapiens
gacagggagggaa

SEQ ID NO: 453594 - DNA, 21 bp, Homo sapiens
gacgtcatcggaggctgggcc

SEQ ID NO: 453595 - DNA, 21 bp, Homo sapiens
gacgtttttgtgctgtgggca

SEQ ID NO: 453596 - DNA, 22 bp, Homo sapiens
gactaatgaatgcaaaaagata

SEQ ID NO: 453597 - DNA, 16 bp, Homo sapiens
gactataaaaactgcc

SEQ ID NO: 453598 - DNA, 23 bp, Homo sapiens
gactatttcaccatgttgccaat

SEQ ID NO: 453599 - DNA, 16 bp, Homo sapiens
gactccccgcccgccc

SEQ ID NO: 453600 - DNA, 18 bp, Homo sapiens
gactccgagaagctctcg

SEQ ID NO: 453601 - DNA, 24 bp, Homo sapiens
gactcgagagggctgagcccctcc

SEQ ID NO: 453602 - DNA, 17 bp, Homo sapiens
gactctgaaactataga

SEQ ID NO: 453603 - DNA, 14 bp, Homo sapiens
gactctgagctgct

SEQ ID NO: 453604 - DNA, 13 bp, Homo sapiens
gactctgctgctc

SEQ ID NO: 453605 - DNA, 14 bp, Homo sapiens
gactgcccaccctg

SEQ ID NO: 453606 - DNA, 22 bp, Homo sapiens
gactgcccaccctgggcctccc

SEQ ID NO: 453607 - DNA, 14 bp, Homo sapiens
gactggcccacccc

SEQ ID NO: 453608 - DNA, 15 bp, Homo sapiens
gactggcccacccct

SEQ ID NO: 453609 - DNA, 16 bp, Homo sapiens
gactggcccacccctc

SEQ ID NO: 453610 - DNA, 16 bp, Homo sapiens
gactgtactcctccca

SEQ ID NO: 453611 - DNA, 17 bp, Homo sapiens
gactgtactcctcccag

SEQ ID NO: 453612 - DNA, 18 bp, Homo sapiens
gactgtactcctcccagg

SEQ ID NO: 453613 - DNA, 21 bp, Homo sapiens
gactgtctcaagagggcactg

SEQ ID NO: 453614 - DNA, 23 bp, Homo sapiens
gactgtctcaagagggcactggt

SEQ ID NO: 453615 - DNA, 22 bp, Homo sapiens
gactgtcttcaaccctgccctg

SEQ ID NO: 453616 - DNA, 20 bp, Homo sapiens
gacttcagactctctcctct

SEQ ID NO: 453617 - DNA, 13 bp, Homo sapiens
gacttcccagctg

SEQ ID NO: 453618 - DNA, 14 bp, Homo sapiens
gacttcccagctgg

SEQ ID NO: 453619 - DNA, 16 bp, Homo sapiens
gacttcccagctggca

SEQ ID NO: 453620 - DNA, 17 bp, Homo sapiens
gactttaattcttctct

SEQ ID NO: 453621 - DNA, 15 bp, Homo sapiens
gactttatttaattt

SEQ ID NO: 453622 - DNA, 23 bp, Homo sapiens
gactttatttaatttcataaatt

SEQ ID NO: 453623 - DNA, 18 bp, Homo sapiens
gagaaaatgctttctcat

SEQ ID NO: 453624 - DNA, 23 bp, Homo sapiens
gagaaaggaacttttaaactgca

SEQ ID NO: 453625 - DNA, 16 bp, Homo sapiens
gagaaattgtgccaaa

SEQ ID NO: 453626 - DNA, 14 bp, Homo sapiens
gagaagccacgctg

SEQ ID NO: 453627 - DNA, 12 bp, Homo sapiens
gagaaggcctgc

SEQ ID NO: 453628 - DNA, 18 bp, Homo sapiens
gagaataagaataataat

SEQ ID NO: 453629 - DNA, 20 bp, Homo sapiens
gagacagacagagaaggcag

SEQ ID NO: 453630 - DNA, 21 bp, Homo sapiens
gagacccaccatccttccatc

SEQ ID NO: 453631 - DNA, 16 bp, Homo sapiens
gagacggcagccccat

SEQ ID NO: 453632 - DNA, 16 bp, Homo sapiens
gagactgcccaccctg

SEQ ID NO: 453633 - DNA, 22 bp, Homo sapiens
gagactgcccaccctgggcctc

SEQ ID NO: 453634 - DNA, 23 bp, Homo sapiens
gagactgtctcaagagggcactg

SEQ ID NO: 453635 - DNA, 16 bp, Homo sapiens
gagagaagccacgctg

SEQ ID NO: 453636 - DNA, 20 bp, Homo sapiens
gagagaagccacgctgtcct

SEQ ID NO: 453637 - DNA, 16 bp, Homo sapiens
gagagcgccacccgcc

SEQ ID NO: 453638 - DNA, 18 bp, Homo sapiens
gagagcgccacccgcccg

SEQ ID NO: 453639 - DNA, 19 bp, Homo sapiens
gagagctcagtacagggca

SEQ ID NO: 453640 - DNA, 19 bp, Homo sapiens
gagaggaggtgtggagtgg

SEQ ID NO: 453641 - DNA, 22 bp, Homo sapiens
gagaggggacttggataggagc

SEQ ID NO: 453642 - DNA, 18 bp, Homo sapiens
gagatcagcattcaaaat

SEQ ID NO: 453643 - DNA, 19 bp, Homo sapiens
gagattgggggggcttggg

SEQ ID NO: 453644 - DNA, 14 bp, Homo sapiens
gagcacccccagcc

SEQ ID NO: 453645 - DNA, 21 bp, Homo sapiens
gagcacccccagcctccccca

SEQ ID NO: 453646 - DNA, 19 bp, Homo sapiens
gagcagagacggcagcccc

SEQ ID NO: 453647 - DNA, 20 bp, Homo sapiens
gagcagagacggcagcccca

SEQ ID NO: 453648 - DNA, 24 bp, Homo sapiens
gagcagagacggcagccccatcct

SEQ ID NO: 453649 - DNA, 12 bp, Homo sapiens
gagcagtgggga

SEQ ID NO: 453650 - DNA, 15 bp, Homo sapiens
gagcagttagaaata

SEQ ID NO: 453651 - DNA, 15 bp, Homo sapiens
gagcatgaagataaa

SEQ ID NO: 453652 - DNA, 19 bp, Homo sapiens
gagcattctggggtggggc

SEQ ID NO: 453653 - DNA, 11 bp, Homo sapiens
gagcccactcc

SEQ ID NO: 453654 - DNA, 15 bp, Homo sapiens
gagccccccactcag

SEQ ID NO: 453655 - DNA, 18 bp, Homo sapiens
gagccccccgtgttcaca

SEQ ID NO: 453656 - DNA, 12 bp, Homo sapiens
gagcccctcctc

SEQ ID NO: 453657 - DNA, 14 bp, Homo sapiens
gagcccctcctctc

SEQ ID NO: 453658 - DNA, 22 bp, Homo sapiens
gagcccctcctctcctcgtccg

SEQ ID NO: 453659 - DNA, 14 bp, Homo sapiens
gagcctccccctca

SEQ ID NO: 453660 - DNA, 15 bp, Homo sapiens
gagcctccccctcag

SEQ ID NO: 453661 - DNA, 11 bp, Homo sapiens
gagcctgtctc

SEQ ID NO: 453662 - DNA, 15 bp, Homo sapiens
gagcctgtctctccc

SEQ ID NO: 453663 - DNA, 14 bp, Homo sapiens
gagcgccacccgcc

SEQ ID NO: 453664 - DNA, 16 bp, Homo sapiens
gagcgccacccgcccg

SEQ ID NO: 453665 - DNA, 20 bp, Homo sapiens
gagcgctcctctgccttgga

SEQ ID NO: 453666 - DNA, 14 bp, Homo sapiens
gccgctgcaccacg

SEQ ID NO: 453667 - DNA, 15 bp, Homo sapiens
gccgctgccgctgca

SEQ ID NO: 453668 - DNA, 17 bp, Homo sapiens
gccgctgccgctgcacc

SEQ ID NO: 453669 - DNA, 12 bp, Homo sapiens
gccgctggaggc

SEQ ID NO: 453670 - DNA, 16 bp, Homo sapiens
gccggctggccggtcc

SEQ ID NO: 453671 - DNA, 21 bp, Homo sapiens
gccggctggccggtccacccc

SEQ ID NO: 453672 - DNA, 19 bp, Homo sapiens
gccgggcaggtcctgccca

SEQ ID NO: 453673 - DNA, 13 bp, Homo sapiens
gccggggctggcc

SEQ ID NO: 453674 - DNA, 18 bp, Homo sapiens
gccggggtggggtgcctg

SEQ ID NO: 453675 - DNA, 20 bp, Homo sapiens
gccggttggccggctggccg

SEQ ID NO: 453676 - DNA, 15 bp, Homo sapiens
gccgtgccttcagct

SEQ ID NO: 453677 - DNA, 11 bp, Homo sapiens
gccgtggcttc

SEQ ID NO: 453678 - DNA, 13 bp, Homo sapiens
gccgtggcttccc

SEQ ID NO: 453679 - DNA, 21 bp, Homo sapiens
gccgtggcttcccgctcagcc

SEQ ID NO: 453680 - DNA, 15 bp, Homo sapiens
gccgtgtctctgagg

SEQ ID NO: 453681 - DNA, 12 bp, Homo sapiens
gcctatttaagc

SEQ ID NO: 453682 - DNA, 13 bp, Homo sapiens
gcctatttaagcc

SEQ ID NO: 453683 - DNA, 14 bp, Homo sapiens
gcctatttaagccc

SEQ ID NO: 453684 - DNA, 22 bp, Homo sapiens
gcctcaccttccctagttcttt

SEQ ID NO: 453685 - DNA, 16 bp, Homo sapiens
gcctcagttcaacctg

SEQ ID NO: 453686 - DNA, 12 bp, Homo sapiens
gcctccaggctg

SEQ ID NO: 453687 - DNA, 18 bp, Homo sapiens
gcctccaggctggggcct

SEQ ID NO: 453688 - DNA, 20 bp, Homo sapiens
gcctccaggctggggcctgg

SEQ ID NO: 453689 - DNA, 23 bp, Homo sapiens
gcctccaggctggggcctggcct

SEQ ID NO: 453690 - DNA, 14 bp, Homo sapiens
gcctcccccaggct

SEQ ID NO: 453691 - DNA, 16 bp, Homo sapiens
gcctcccccaggctgc

SEQ ID NO: 453692 - DNA, 19 bp, Homo sapiens
gcctcccccaggctgcgcc

SEQ ID NO: 453693 - DNA, 20 bp, Homo sapiens
gcctcccccaggctgcgcct

SEQ ID NO: 453694 - DNA, 13 bp, Homo sapiens
gcctccccctcag

SEQ ID NO: 453695 - DNA, 15 bp, Homo sapiens
gcctccccctcagat

SEQ ID NO: 453696 - DNA, 15 bp, Homo sapiens
gcctccccgggggtc

SEQ ID NO: 453697 - DNA, 22 bp, Homo sapiens
gcctccccgggggtccccggac

SEQ ID NO: 453698 - DNA, 13 bp, Homo sapiens
gcctcccgccgcc

SEQ ID NO: 453699 - DNA, 11 bp, Homo sapiens
gcctcctaggc

SEQ ID NO: 453700 - DNA, 14 bp, Homo sapiens
gcctcctggccaga

SEQ ID NO: 453701 - DNA, 19 bp, Homo sapiens
gcctcctggccagacgctg

SEQ ID NO: 453702 - DNA, 19 bp, Homo sapiens
gcctcgagtccccccaccc

SEQ ID NO: 453703 - DNA, 22 bp, Homo sapiens
gcctcgggccgcctcctccaga

SEQ ID NO: 453704 - DNA, 19 bp, Homo sapiens
gcctcgtgccatgatctgt

SEQ ID NO: 453705 - DNA, 13 bp, Homo sapiens
gcctgagccacag

SEQ ID NO: 453706 - DNA, 14 bp, Homo sapiens
gcctgagccacagt

SEQ ID NO: 453707 - DNA, 20 bp, Homo sapiens
gcctgagccacagtggggcc

SEQ ID NO: 453708 - DNA, 15 bp, Homo sapiens
gcctgagctccaccc

SEQ ID NO: 453709 - DNA, 18 bp, Homo sapiens
gcctgagctccaccctcc

SEQ ID NO: 453710 - DNA, 19 bp, Homo sapiens
gcctgagctccaccctccc

SEQ ID NO: 453711 - DNA, 22 bp, Homo sapiens
gcctgagggaagcccacccgcc

SEQ ID NO: 453712 - DNA, 16 bp, Homo sapiens
gcctgcaccaggagac

SEQ ID NO: 453713 - DNA, 21 bp, Homo sapiens
gcctgcaccaggagacagaca

SEQ ID NO: 453714 - DNA, 14 bp, Homo sapiens
gcctgcagcccaga

SEQ ID NO: 453715 - DNA, 16 bp, Homo sapiens
gcctgcagcccagaac

SEQ ID NO: 453716 - DNA, 12 bp, Homo sapiens
gcctgcccccct

SEQ ID NO: 453717 - DNA, 15 bp, Homo sapiens
gcctgccccccttcc

SEQ ID NO: 453718 - DNA, 16 bp, Homo sapiens
gcctgccccccttccc

SEQ ID NO: 453719 - DNA, 21 bp, Homo sapiens
gcctgccccccttcccacccc

SEQ ID NO: 453720 - DNA, 15 bp, Homo sapiens
gcctgcgctcctctg

SEQ ID NO: 453721 - DNA, 21 bp, Homo sapiens
gcctgcgctcctctgcagcct

SEQ ID NO: 453722 - DNA, 14 bp, Homo sapiens
gcctggcacagggc

SEQ ID NO: 453723 - DNA, 20 bp, Homo sapiens
gcctggcagccgtgccttca

SEQ ID NO: 453724 - DNA, 21 bp, Homo sapiens
gcctggcagccgtgccttcag

SEQ ID NO: 453725 - DNA, 22 bp, Homo sapiens
gcctggcagccgtgccttcagc

SEQ ID NO: 453726 - DNA, 14 bp, Homo sapiens
gcctggcctattta

SEQ ID NO: 453727 - DNA, 13 bp, Homo sapiens
gcctggcgggcag

SEQ ID NO: 453728 - DNA, 13 bp, Homo sapiens
gcctggtctggag

SEQ ID NO: 453729 - DNA, 14 bp, Homo sapiens
gcctggtctggagc

SEQ ID NO: 453730 - DNA, 22 bp, Homo sapiens
gcctgtgaataaaaaccctgta

SEQ ID NO: 453731 - DNA, 16 bp, Homo sapiens
gccttaagaaagctat

SEQ ID NO: 453732 - DNA, 16 bp, Homo sapiens
gccttagaacctttct

SEQ ID NO: 453733 - DNA, 13 bp, Homo sapiens
gccttcagctcta

SEQ ID NO: 453734 - DNA, 16 bp, Homo sapiens
gccttcagctctacag

SEQ ID NO: 453735 - DNA, 18 bp, Homo sapiens
gccttcaggttcctccta

SEQ ID NO: 453736 - DNA, 19 bp, Homo sapiens
gccttcaggttcctcctag

SEQ ID NO: 453737 - DNA, 15 bp, Homo sapiens
gccttccccgtgcgg

SEQ ID NO: 453738 - DNA, 22 bp, Homo sapiens
gccttccccgtgcggcccgtgc

SEQ ID NO: 453739 - DNA, 19 bp, Homo sapiens
gccttctgttttccaaagg

SEQ ID NO: 453740 - DNA, 16 bp, Homo sapiens
gccttggacaccatcc

SEQ ID NO: 453741 - DNA, 20 bp, Homo sapiens
gcctttgctgaagtctcccc

SEQ ID NO: 453742 - DNA, 17 bp, Homo sapiens
gcgcaccgcccaacccc

SEQ ID NO: 453743 - DNA, 20 bp, Homo sapiens
gcgcagccgcgctctgcccc

SEQ ID NO: 453744 - DNA, 22 bp, Homo sapiens
gcgcatagtgtgctcggacaca

SEQ ID NO: 453745 - DNA, 12 bp, Homo sapiens
gcgccacccgcc

SEQ ID NO: 453746 - DNA, 13 bp, Homo sapiens
gcgccacccgccc

SEQ ID NO: 453747 - DNA, 14 bp, Homo sapiens
gcgccacccgcccg

SEQ ID NO: 453748 - DNA, 13 bp, Homo sapiens
gcgcccacctgcc

SEQ ID NO: 453749 - DNA, 14 bp, Homo sapiens
gcgcccacctgccc

SEQ ID NO: 453750 - DNA, 13 bp, Homo sapiens
gcgccccttcccc

SEQ ID NO: 453751 - DNA, 18 bp, Homo sapiens
gcgccctccctccctcca

SEQ ID NO: 453752 - DNA, 17 bp, Homo sapiens
gcgcctgcgctcctctg

SEQ ID NO: 453753 - DNA, 20 bp, Homo sapiens
gcgcctgcgctcctctgcag

SEQ ID NO: 453754 - DNA, 21 bp, Homo sapiens
gcgcctgcgctcctctgcagc

SEQ ID NO: 453755 - DNA, 22 bp, Homo sapiens
gcgcctgcgctcctctgcagcc

SEQ ID NO: 453756 - DNA, 14 bp, Homo sapiens
gcgcgcaccgccca

SEQ ID NO: 453757 - DNA, 13 bp, Homo sapiens
gcgctcagaggcc

SEQ ID NO: 453758 - DNA, 19 bp, Homo sapiens
gcgctcctctgcagcctga

SEQ ID NO: 453759 - DNA, 16 bp, Homo sapiens
gcgctcctctgccttg

SEQ ID NO: 453760 - DNA, 23 bp, Homo sapiens
gcgctgagggcagggttctagaa

SEQ ID NO: 453761 - DNA, 22 bp, Homo sapiens
gcgctgtgctccagcagtgctg

SEQ ID NO: 453762 - DNA, 18 bp, Homo sapiens
gcggaccggagcggctga

SEQ ID NO: 453763 - DNA, 21 bp, Homo sapiens
gcggaccggagcggctgagga

SEQ ID NO: 453764 - DNA, 16 bp, Homo sapiens
gcggaggggcttggag

SEQ ID NO: 453765 - DNA, 21 bp, Homo sapiens
gcggaggggcttggagcagag

SEQ ID NO: 453766 - DNA, 13 bp, Homo sapiens
gcggcccggccca

SEQ ID NO: 453767 - DNA, 23 bp, Homo sapiens
gcggcccggcccacgcagagccc

SEQ ID NO: 453768 - DNA, 16 bp, Homo sapiens
gcggcccgtgcgcagc

SEQ ID NO: 453769 - DNA, 19 bp, Homo sapiens
gcggcggccagggaccccc

SEQ ID NO: 453770 - DNA, 22 bp, Homo sapiens
gcggctgaggacggggcagagc

SEQ ID NO: 453771 - DNA, 16 bp, Homo sapiens
gcgggcagcccctgct

SEQ ID NO: 453772 - DNA, 18 bp, Homo sapiens
gcgggcagcccctgctgg

SEQ ID NO: 453773 - DNA, 19 bp, Homo sapiens
gcgggcagcccctgctgga

SEQ ID NO: 453774 - DNA, 21 bp, Homo sapiens
gcgggcagcccctgctggacc

SEQ ID NO: 453775 - DNA, 14 bp, Homo sapiens
gcgtagttccctgg

SEQ ID NO: 453776 - DNA, 22 bp, Homo sapiens
gcgtgccttccccgtgcggccc

SEQ ID NO: 453777 - DNA, 11 bp, Homo sapiens
gcgtgtggccc

SEQ ID NO: 453778 - DNA, 16 bp, Homo sapiens
gcgtgtggccctgtgg

SEQ ID NO: 453779 - DNA, 18 bp, Homo sapiens
gcgtgtggccctgtggga

SEQ ID NO: 453780 - DNA, 21 bp, Homo sapiens
gcgtgtggccctgtgggagtc

SEQ ID NO: 453781 - DNA, 14 bp, Homo sapiens
gcgtttttttacaa

SEQ ID NO: 453782 - DNA, 13 bp, Homo sapiens
gctaacgggcgcc

SEQ ID NO: 453783 - DNA, 13 bp, Homo sapiens
gctaactggcccc

SEQ ID NO: 453784 - DNA, 14 bp, Homo sapiens
gctaactggcccca

SEQ ID NO: 453785 - DNA, 15 bp, Homo sapiens
gctaactggccccag

SEQ ID NO: 453786 - DNA, 22 bp, Homo sapiens
gctaatcagcattctcactcct

SEQ ID NO: 453787 - DNA, 15 bp, Homo sapiens
gctaatgtaatcatt

SEQ ID NO: 453788 - DNA, 15 bp, Homo sapiens
gctagagcattctgg

SEQ ID NO: 453789 - DNA, 18 bp, Homo sapiens
gctagctgtagaaatgta

SEQ ID NO: 453790 - DNA, 20 bp, Homo sapiens
gctaggttaataggaggaca

SEQ ID NO: 453791 - DNA, 23 bp, Homo sapiens
gctagtgatacactgtatctaaa

SEQ ID NO: 453792 - DNA, 23 bp, Homo sapiens
gctataacaactctattttttac

SEQ ID NO: 453793 - DNA, 22 bp, Homo sapiens
gctataatgtttccctcaagaa

SEQ ID NO: 453794 - DNA, 19 bp, Homo sapiens
gctatccacagaacctttg

SEQ ID NO: 453795 - DNA, 19 bp, Homo sapiens
gctatgcgcaatgtggcat

SEQ ID NO: 453796 - DNA, 14 bp, Homo sapiens
gctatgtctgtgat

SEQ ID NO: 453797 - DNA, 22 bp, Homo sapiens
gctattgtttataggaaataaa

SEQ ID NO: 453798 - DNA, 20 bp, Homo sapiens
gctcaacctctcagatccct

SEQ ID NO: 453799 - DNA, 15 bp, Homo sapiens
gctcacgctgacagc

SEQ ID NO: 453800 - DNA, 22 bp, Homo sapiens
gctcacgctgacagcctcctag

SEQ ID NO: 453801 - DNA, 17 bp, Homo sapiens
gctcagaggccgctctg

SEQ ID NO: 453802 - DNA, 20 bp, Homo sapiens
gctcagaggccgctctgggg

SEQ ID NO: 453803 - DNA, 11 bp, Homo sapiens
gctcaggagaa

SEQ ID NO: 453804 - DNA, 21 bp, Homo sapiens
gctcagggtgctccctcctca

SEQ ID NO: 453805 - DNA, 13 bp, Homo sapiens
gctcagtacaggg

SEQ ID NO: 453806 - DNA, 14 bp, Homo sapiens
gctcagtacagggc

SEQ ID NO: 453807 - DNA, 14 bp, Homo sapiens
gctccaacagacac

SEQ ID NO: 453808 - DNA, 18 bp, Homo sapiens
gctccaacagacaccctc

SEQ ID NO: 453809 - DNA, 14 bp, Homo sapiens
gctccaccctcccc

SEQ ID NO: 453810 - DNA, 16 bp, Homo sapiens
gctccaccctcccctc

SEQ ID NO: 453811 - DNA, 12 bp, Homo sapiens
gctccactctga

SEQ ID NO: 453812 - DNA, 19 bp, Homo sapiens
gctccagagtaggtgggtc

SEQ ID NO: 453813 - DNA, 15 bp, Homo sapiens
gctccagcagtgctg

SEQ ID NO: 453814 - DNA, 19 bp, Homo sapiens
gctccagcagtgctgggcc

SEQ ID NO: 453815 - DNA, 20 bp, Homo sapiens
gctccagcagtgctgggccc

SEQ ID NO: 453816 - DNA, 15 bp, Homo sapiens
gctcccacaggccct

SEQ ID NO: 453817 - DNA, 21 bp, Homo sapiens
gctcccacaggcccttcctct

SEQ ID NO: 453818 - DNA, 14 bp, Homo sapiens
gctccccctgccag

SEQ ID NO: 453819 - DNA, 21 bp, Homo sapiens
gctcccgcgggaagccagccc

SEQ ID NO: 453820 - DNA, 13 bp, Homo sapiens
gctccctgaggta

SEQ ID NO: 453821 - DNA, 14 bp, Homo sapiens
gctccctgaggtac

SEQ ID NO: 453822 - DNA, 22 bp, Homo sapiens
gctccctgaggtacctttccac

SEQ ID NO: 453823 - DNA, 15 bp, Homo sapiens
gctccggcagaggca

SEQ ID NO: 453824 - DNA, 19 bp, Homo sapiens
gctccggcagaggcagggc

SEQ ID NO: 453825 - DNA, 22 bp, Homo sapiens
gctccggcagaggcagggccct

SEQ ID NO: 453826 - DNA, 16 bp, Homo sapiens
gctcctcccggtgccc

SEQ ID NO: 453827 - DNA, 13 bp, Homo sapiens
gctcctctgcagc

SEQ ID NO: 453828 - DNA, 14 bp, Homo sapiens
gctccttgaataag

SEQ ID NO: 453829 - DNA, 15 bp, Homo sapiens
gctcctttcccacag

SEQ ID NO: 453830 - DNA, 15 bp, Homo sapiens
gctcgggaaggcctg

SEQ ID NO: 453831 - DNA, 18 bp, Homo sapiens
gctcgggaaggcctgagg

SEQ ID NO: 453832 - DNA, 14 bp, Homo sapiens
gctcgggactgtct

SEQ ID NO: 453833 - DNA, 13 bp, Homo sapiens
gctctactttata

SEQ ID NO: 453834 - DNA, 22 bp, Homo sapiens
gctctactttataatcaagaca

SEQ ID NO: 453835 - DNA, 11 bp, Homo sapiens
gctctgcccct

SEQ ID NO: 453836 - DNA, 18 bp, Homo sapiens
gctctgcccctccgtccc

SEQ ID NO: 453837 - DNA, 19 bp, Homo sapiens
gctgactgtactcctccca

SEQ ID NO: 453838 - DNA, 21 bp, Homo sapiens
gctgactgtactcctcccagg

SEQ ID NO: 453839 - DNA, 14 bp, Homo sapiens
gctgagaggatgaa

SEQ ID NO: 453840 - DNA, 14 bp, Homo sapiens
gctgagcccctcct

SEQ ID NO: 453841 - DNA, 21 bp, Homo sapiens
gctgagtatgttaagctcttt

SEQ ID NO: 453842 - DNA, 17 bp, Homo sapiens
gctgagtcggctgggca

SEQ ID NO: 453843 - DNA, 19 bp, Homo sapiens
gctgagtcggctgggcagg

SEQ ID NO: 453844 - DNA, 21 bp, Homo sapiens
gctgagtcggctgggcagggc

SEQ ID NO: 453845 - DNA, 16 bp, Homo sapiens
gctgatctaaggaccc

SEQ ID NO: 453846 - DNA, 22 bp, Homo sapiens
gctgcaccaacctcactgccct

SEQ ID NO: 453847 - DNA, 20 bp, Homo sapiens
gctgcaccacggcgtttttt

SEQ ID NO: 453848 - DNA, 21 bp, Homo sapiens
gctgccacacttcaggctctt

SEQ ID NO: 453849 - DNA, 22 bp, Homo sapiens
gctgccacacttcaggctcttc

SEQ ID NO: 453850 - DNA, 23 bp, Homo sapiens
gctgccacacttcaggctcttct

SEQ ID NO: 453851 - DNA, 23 bp, Homo sapiens
gctgcccacgctcctgccctcgt

SEQ ID NO: 453852 - DNA, 15 bp, Homo sapiens
gctgccctggtgctg

SEQ ID NO: 453853 - DNA, 20 bp, Homo sapiens
gctgccctggtgctgccaca

SEQ ID NO: 453854 - DNA, 13 bp, Homo sapiens
gctgccgctgcac

SEQ ID NO: 453855 - DNA, 17 bp, Homo sapiens
gctgcctctgaaaatat

SEQ ID NO: 453856 - DNA, 15 bp, Homo sapiens
gctgcctggcgggca

SEQ ID NO: 453857 - DNA, 18 bp, Homo sapiens
gctgcctggcgggcagcc

SEQ ID NO: 453858 - DNA, 15 bp, Homo sapiens
gctgcgcctgcccgc

SEQ ID NO: 453859 - DNA, 17 bp, Homo sapiens
gctgcgcctgcccgccc

SEQ ID NO: 453860 - DNA, 17 bp, Homo sapiens
gctgctcatgggaagaa

SEQ ID NO: 453861 - DNA, 15 bp, Homo sapiens
gctgctcctttgggg

SEQ ID NO: 453862 - DNA, 22 bp, Homo sapiens
gctgctcgggaaggcctgaggg

SEQ ID NO: 453863 - DNA, 13 bp, Homo sapiens
gctgctgcaccaa

SEQ ID NO: 453864 - DNA, 14 bp, Homo sapiens
ggctgggtcgcccc

SEQ ID NO: 453865 - DNA, 16 bp, Homo sapiens
ggctgtaatgtaacag

SEQ ID NO: 453866 - DNA, 13 bp, Homo sapiens
ggctgtctgtcac

SEQ ID NO: 453867 - DNA, 12 bp, Homo sapiens
ggctgtggcccc

SEQ ID NO: 453868 - DNA, 20 bp, Homo sapiens
ggcttagcgttctgtttcac

SEQ ID NO: 453869 - DNA, 16 bp, Homo sapiens
ggcttatcagaactcc

SEQ ID NO: 453870 - DNA, 14 bp, Homo sapiens
ggcttccatggtgg

SEQ ID NO: 453871 - DNA, 15 bp, Homo sapiens
ggcttcccgctcagc

SEQ ID NO: 453872 - DNA, 16 bp, Homo sapiens
ggcttcccgctcagcc

SEQ ID NO: 453873 - DNA, 17 bp, Homo sapiens
ggcttccgtgagacaca

SEQ ID NO: 453874 - DNA, 13 bp, Homo sapiens
ggcttcttcaact

SEQ ID NO: 453875 - DNA, 15 bp, Homo sapiens
ggcttggagcagaga

SEQ ID NO: 453876 - DNA, 21 bp, Homo sapiens
ggcttggggtagagaggacag

SEQ ID NO: 453877 - DNA, 13 bp, Homo sapiens
ggcttttcactgc

SEQ ID NO: 453878 - DNA, 17 bp, Homo sapiens
ggcttttcactgctggc

SEQ ID NO: 453879 - DNA, 15 bp, Homo sapiens
gggaagaaaaaggaa

SEQ ID NO: 453880 - DNA, 15 bp, Homo sapiens
gggaagcccacccgc

SEQ ID NO: 453881 - DNA, 18 bp, Homo sapiens
gggaagcccacccgcccc

SEQ ID NO: 453882 - DNA, 19 bp, Homo sapiens
gggaagcccacccgcccca

SEQ ID NO: 453883 - DNA, 20 bp, Homo sapiens
gggaagcccacccgccccag

SEQ ID NO: 453884 - DNA, 21 bp, Homo sapiens
gggaagcccacccgccccaga

SEQ ID NO: 453885 - DNA, 19 bp, Homo sapiens
gggaaggcctgagggaagc

SEQ ID NO: 453886 - DNA, 22 bp, Homo sapiens
gggaagggagcaccagatgaca

SEQ ID NO: 453887 - DNA, 12 bp, Homo sapiens
gggacagcggcc

SEQ ID NO: 453888 - DNA, 22 bp, Homo sapiens
gggacagcggcccggcccacgc

SEQ ID NO: 453889 - DNA, 21 bp, Homo sapiens
gggactggcccacccctcttc

SEQ ID NO: 453890 - DNA, 21 bp, Homo sapiens
gggactgtcttcaaccctgcc

SEQ ID NO: 453891 - DNA, 18 bp, Homo sapiens
gggagaatggctctggct

SEQ ID NO: 453892 - DNA, 17 bp, Homo sapiens
gggagagcgccacccgc

SEQ ID NO: 453893 - DNA, 18 bp, Homo sapiens
gggagagcgccacccgcc

SEQ ID NO: 453894 - DNA, 13 bp, Homo sapiens
gggagcctccccc

SEQ ID NO: 453895 - DNA, 20 bp, Homo sapiens
gggagcctccccctcagatg

SEQ ID NO: 453896 - DNA, 12 bp, Homo sapiens
gggaggagcacc

SEQ ID NO: 453897 - DNA, 21 bp, Homo sapiens
gggaggagcacccccagcctc

SEQ ID NO: 453898 - DNA, 21 bp, Homo sapiens
gggagtccactttcctctctc

SEQ ID NO: 453899 - DNA, 16 bp, Homo sapiens
gggatccagagagaag

SEQ ID NO: 453900 - DNA, 17 bp, Homo sapiens
gggattcaaatgcatga

SEQ ID NO: 453901 - DNA, 18 bp, Homo sapiens
gggcacgggagagcgcca

SEQ ID NO: 453902 - DNA, 22 bp, Homo sapiens
gggcacgggagagcgccacccg

SEQ ID NO: 453903 - DNA, 15 bp, Homo sapiens
gggcagagctgagtc

SEQ ID NO: 453904 - DNA, 13 bp, Homo sapiens
gggcagcaccctc

SEQ ID NO: 453905 - DNA, 15 bp, Homo sapiens
gggcagcaccctccc

SEQ ID NO: 453906 - DNA, 12 bp, Homo sapiens
gggcagcccctc

SEQ ID NO: 453907 - DNA, 16 bp, Homo sapiens
gggcagcccctcccca

SEQ ID NO: 453908 - DNA, 17 bp, Homo sapiens
gggcaggtcctgcccat

SEQ ID NO: 453909 - DNA, 12 bp, Homo sapiens
gggcagtggaga

SEQ ID NO: 453910 - DNA, 18 bp, Homo sapiens
gggcccatggccccagct

SEQ ID NO: 453911 - DNA, 23 bp, Homo sapiens
gggccccctctcttaccccgtcc

SEQ ID NO: 453912 - DNA, 12 bp, Homo sapiens
gggcccctccac

SEQ ID NO: 453913 - DNA, 14 bp, Homo sapiens
gggcccctccacgc

SEQ ID NO: 453914 - DNA, 14 bp, Homo sapiens
gggcccctgggatg

SEQ ID NO: 453915 - DNA, 11 bp, Homo sapiens
gggccctgggc

SEQ ID NO: 453916 - DNA, 15 bp, Homo sapiens
gggccctgggcctca

SEQ ID NO: 453917 - DNA, 17 bp, Homo sapiens
gggccgcctcctccaga

SEQ ID NO: 453918 - DNA, 18 bp, Homo sapiens
gggccgcctcctccagac

SEQ ID NO: 453919 - DNA, 20 bp, Homo sapiens
gggccgggcaggtcctgccc

SEQ ID NO: 453920 - DNA, 21 bp, Homo sapiens
gggccgggcaggtcctgccca

SEQ ID NO: 453921 - DNA, 21 bp, Homo sapiens
gggcctcccgtccgtccgccc

SEQ ID NO: 453922 - DNA, 16 bp, Homo sapiens
gggcctcgctttccca

SEQ ID NO: 453923 - DNA, 11 bp, Homo sapiens
gggcctggcct

SEQ ID NO: 453924 - DNA, 15 bp, Homo sapiens
gggcgcctgcgctcc

SEQ ID NO: 453925 - DNA, 18 bp, Homo sapiens
gggcgcctgcgctcctct

SEQ ID NO: 453926 - DNA, 15 bp, Homo sapiens
gggcgctgagggcag

SEQ ID NO: 453927 - DNA, 13 bp, Homo sapiens
gggctaactggcc

SEQ ID NO: 453928 - DNA, 15 bp, Homo sapiens
gggctaactggcccc

SEQ ID NO: 453929 - DNA, 17 bp, Homo sapiens
gggctaactggccccag

SEQ ID NO: 453930 - DNA, 18 bp, Homo sapiens
gggctaactggccccagg

SEQ ID NO: 453931 - DNA, 21 bp, Homo sapiens
gggctctgccctccctccttc

SEQ ID NO: 453932 - DNA, 17 bp, Homo sapiens
gggctgagaggatgaac

SEQ ID NO: 453933 - DNA, 20 bp, Homo sapiens
gggctgagcccctcctctcc

SEQ ID NO: 453934 - DNA, 13 bp, Homo sapiens
gggctgccctggt

SEQ ID NO: 453935 - DNA, 15 bp, Homo sapiens
gggctggccctgccc

SEQ ID NO: 453936 - DNA, 16 bp, Homo sapiens
gggctggccctgccct

SEQ ID NO: 453937 - DNA, 17 bp, Homo sapiens
gggctggccctgccctc

SEQ ID NO: 453938 - DNA, 19 bp, Homo sapiens
gggctggccctgccctccc

SEQ ID NO: 453939 - DNA, 18 bp, Homo sapiens
ggggatctaaaaggagga

SEQ ID NO: 453940 - DNA, 23 bp, Homo sapiens
ggggatctaaaaggaggacaggg

SEQ ID NO: 453941 - DNA, 13 bp, Homo sapiens
ggggatgggccag

SEQ ID NO: 453942 - DNA, 13 bp, Homo sapiens
ggggcaagagctc

SEQ ID NO: 453943 - DNA, 19 bp, Homo sapiens
ggggcaagagctcaggaga

SEQ ID NO: 453944 - DNA, 14 bp, Homo sapiens
ggggcccatggccc

SEQ ID NO: 453945 - DNA, 15 bp, Homo sapiens
ggggcccatggcccc

SEQ ID NO: 453946 - DNA, 20 bp, Homo sapiens
ggggcccatggccccagctg

SEQ ID NO: 453947 - DNA, 13 bp, Homo sapiens
ggggccctgggcc

SEQ ID NO: 453948 - DNA, 21 bp, Homo sapiens
ggggccgggcaggtcctgccc

SEQ ID NO: 453949 - DNA, 12 bp, Homo sapiens
ggggcctggcag

SEQ ID NO: 453950 - DNA, 12 bp, Homo sapiens
ggggcctggcct

SEQ ID NO: 453951 - DNA, 17 bp, Homo sapiens
ggggctaacgggcgcct

SEQ ID NO: 453952 - DNA, 17 bp, Homo sapiens
ggggctaactggcccca

SEQ ID NO: 453953 - DNA, 18 bp, Homo sapiens
ggggctaactggccccag

SEQ ID NO: 453954 - DNA, 12 bp, Homo sapiens
ggggctggccct

SEQ ID NO: 453955 - DNA, 22 bp, Homo sapiens
ggggctggccctgccctccccc

SEQ ID NO: 453956 - DNA, 13 bp, Homo sapiens
ggggcttggaagg

SEQ ID NO: 453957 - DNA, 21 bp, Homo sapiens
ggggcttggggtagagaggac

SEQ ID NO: 453958 - DNA, 14 bp, Homo sapiens
gggggaggagcacc

SEQ ID NO: 453959 - DNA, 22 bp, Homo sapiens
gggggcaagagctcaggagaag

SEQ ID NO: 453960 - DNA, 20 bp, Homo sapiens
gggggccgggcaggtcctgc

SEQ ID NO: 453961 - DNA, 16 bp, Homo sapiens
gggggctaactggccc

SEQ ID NO: 453962 - DNA, 17 bp, Homo sapiens
gggggctaactggcccc

SEQ ID NO: 453963 - DNA, 21 bp, Homo sapiens
gggggcttggggtagagagga

SEQ ID NO: 453964 - DNA, 10 bp, Homo sapiens
gggggtggca

SEQ ID NO: 453965 - DNA, 13 bp, Homo sapiens
ggggtagagagga

SEQ ID NO: 453966 - DNA, 16 bp, Homo sapiens
ggggtagagaggacag

SEQ ID NO: 453967 - DNA, 15 bp, Homo sapiens
ggggtccccggacgc

SEQ ID NO: 453968 - DNA, 22 bp, Homo sapiens
ggggtgggggagaatggctctg

SEQ ID NO: 453969 - DNA, 18 bp, Homo sapiens
ggggtggttggaggcctg

SEQ ID NO: 453970 - DNA, 12 bp, Homo sapiens
gggtccccggac

SEQ ID NO: 453971 - DNA, 23 bp, Homo sapiens
gggtccccggacgctggctcggg

SEQ ID NO: 453972 - DNA, 19 bp, Homo sapiens
gggtcgggggaggagcacc

SEQ ID NO: 453973 - DNA, 19 bp, Homo sapiens
gggtctgtgggactggccc

SEQ ID NO: 453974 - DNA, 13 bp, Homo sapiens
gggtgcctgagcc

SEQ ID NO: 453975 - DNA, 23 bp, Homo sapiens
gggtgcgtgaccggcccgccacc

SEQ ID NO: 453976 - DNA, 14 bp, Homo sapiens
gggtggggcttgga

SEQ ID NO: 453977 - DNA, 17 bp, Homo sapiens
gggtggggcttggaagg

SEQ ID NO: 453978 - DNA, 18 bp, Homo sapiens
gggtggggtgcctgagcc

SEQ ID NO: 453979 - DNA, 12 bp, Homo sapiens
gggtgtggcctc

SEQ ID NO: 453980 - DNA, 18 bp, Homo sapiens
gggtgtggcctcagccct

SEQ ID NO: 453981 - DNA, 19 bp, Homo sapiens
gggtgtggcctcagccctc

SEQ ID NO: 453982 - DNA, 14 bp, Homo sapiens
gggtgtggcttgga

SEQ ID NO: 453983 - DNA, 13 bp, Homo sapiens
gggttccagacag

SEQ ID NO: 453984 - DNA, 18 bp, Homo sapiens
gggttgggttccagacag

SEQ ID NO: 453985 - DNA, 17 bp, Homo sapiens
ggtaagttgaagggaaa

SEQ ID NO: 453986 - DNA, 19 bp, Homo sapiens
ggtaccagagcctatggaa

SEQ ID NO: 453987 - DNA, 16 bp, Homo sapiens
ggtatgctggccagca

SEQ ID NO: 453988 - DNA, 18 bp, Homo sapiens
ggtatgctggccagcacc

SEQ ID NO: 453989 - DNA, 12 bp, Homo sapiens
ggtcgcccctcc

SEQ ID NO: 453990 - DNA, 22 bp, Homo sapiens
ggtcgggggaggagcaccccca

SEQ ID NO: 453991 - DNA, 12 bp, Homo sapiens
ggtctccacccc

SEQ ID NO: 453992 - DNA, 15 bp, Homo sapiens
ggtctccacccctca

SEQ ID NO: 453993 - DNA, 17 bp, Homo sapiens
ggtctccacccctcaag

SEQ ID NO: 453994 - DNA, 19 bp, Homo sapiens
ggtctctgagcagtgggga

SEQ ID NO: 453995 - DNA, 13 bp, Homo sapiens
ggtctggagcccc

SEQ ID NO: 453996 - DNA, 16 bp, Homo sapiens
ggtctggagcccctat

SEQ ID NO: 453997 - DNA, 16 bp, Homo sapiens
ggtctgtgggactggc

SEQ ID NO: 453998 - DNA, 16 bp, Homo sapiens
ggtgactgtcccaccg

SEQ ID NO: 453999 - DNA, 23 bp, Homo sapiens
ggtgactgtcccaccgggagcct

SEQ ID NO: 454000 - DNA, 15 bp, Homo sapiens
ggtgagacagtgggg

SEQ ID NO: 454001 - DNA, 20 bp, Homo sapiens
ggtgaggcgtgggatccaga

SEQ ID NO: 454002 - DNA, 21 bp, Homo sapiens
ggtgatactccaaggtggcat

SEQ ID NO: 454003 - DNA, 22 bp, Homo sapiens
ggtgcatacacccccacctcct

SEQ ID NO: 454004 - DNA, 14 bp, Homo sapiens
ggtgcctgagcccg

SEQ ID NO: 454005 - DNA, 20 bp, Homo sapiens
ggtgcctggtgcgctgtgct

SEQ ID NO: 454006 - DNA, 21 bp, Homo sapiens
ggtgcctggtgcgctgtgctc

SEQ ID NO: 454007 - DNA, 23 bp, Homo sapiens
ggtgcgctgtgctccagcagtgc

SEQ ID NO: 454008 - DNA, 14 bp, Homo sapiens
ggtgcggaccggag

SEQ ID NO: 454009 - DNA, 16 bp, Homo sapiens
ggtgcggaccggagcg

SEQ ID NO: 454010 - DNA, 24 bp, Homo sapiens
ggtgcggaccggagcggctgagga

SEQ ID NO: 454011 - DNA, 15 bp, Homo sapiens
ggtgctccctcctca

SEQ ID NO: 454012 - DNA, 17 bp, Homo sapiens
ggtggactgcgctggac

SEQ ID NO: 454013 - DNA, 20 bp, Homo sapiens
ggtggcaggcacacagcagc

SEQ ID NO: 454014 - DNA, 22 bp, Homo sapiens
ggtggcaggcacacagcagccc

SEQ ID NO: 454015 - DNA, 16 bp, Homo sapiens
ggtggccatccctggg

SEQ ID NO: 454016 - DNA, 17 bp, Homo sapiens
ggtggcccgacagcctg

SEQ ID NO: 454017 - DNA, 18 bp, Homo sapiens
ggtggcccgacagcctgg

SEQ ID NO: 454018 - DNA, 20 bp, Homo sapiens
ggtggcccgacagcctggca

SEQ ID NO: 454019 - DNA, 14 bp, Homo sapiens
ggtggtcttggaga

SEQ ID NO: 454020 - DNA, 16 bp, Homo sapiens
ggtggtcttggagagg

SEQ ID NO: 454021 - DNA, 14 bp, Homo sapiens
ggtgtggcctcagc

SEQ ID NO: 454022 - DNA, 19 bp, Homo sapiens
ggtgtggcctcagccctca

SEQ ID NO: 454023 - DNA, 11 bp, Homo sapiens
ggtgtggcttg

SEQ ID NO: 454024 - DNA, 12 bp, Homo sapiens
ggttaaggggat

SEQ ID NO: 454025 - DNA, 15 bp, Homo sapiens
ggttacctcactttt

SEQ ID NO: 454026 - DNA, 11 bp, Homo sapiens
ggttccagaca

SEQ ID NO: 454027 - DNA, 18 bp, Homo sapiens
ggttccagacagagtgga

SEQ ID NO: 454028 - DNA, 13 bp, Homo sapiens
ggttcctccagca

SEQ ID NO: 454029 - DNA, 14 bp, Homo sapiens
ggttcctcctaggc

SEQ ID NO: 454030 - DNA, 23 bp, Homo sapiens
ggttcctcctaggcgctcagagg

SEQ ID NO: 454031 - DNA, 11 bp, Homo sapiens
ggttctagaag

SEQ ID NO: 454032 - DNA, 16 bp, Homo sapiens
ggttctagaaggggcg

SEQ ID NO: 454033 - DNA, 23 bp, Homo sapiens
ggttgggttccagacagagtgga

SEQ ID NO: 454034 - DNA, 14 bp, Homo sapiens
ggtttacccagtgg

SEQ ID NO: 454035 - DNA, 12 bp, Homo sapiens
ggtttactctgt

SEQ ID NO: 454036 - DNA, 16 bp, Homo sapiens
ggtttgggcagtggag

SEQ ID NO: 454037 - DNA, 17 bp, Homo sapiens
ggtttgggcagtggaga

SEQ ID NO: 454038 - DNA, 20 bp, Homo sapiens
ggtttgggcagtggagaggg

SEQ ID NO: 454039 - DNA, 22 bp, Homo sapiens
ggtttgggcagtggagagggga

SEQ ID NO: 454040 - DNA, 16 bp, Homo sapiens
ggtttttatttctcgg

SEQ ID NO: 454041 - DNA, 11 bp, Homo sapiens
gtaaataaact

SEQ ID NO: 454042 - DNA, 14 bp, Homo sapiens
gtaaataaactctt

SEQ ID NO: 454043 - DNA, 15 bp, Homo sapiens
gtaaataaactcttc

SEQ ID NO: 454044 - DNA, 17 bp, Homo sapiens
gtaacctctacaggcat

SEQ ID NO: 454045 - DNA, 18 bp, Homo sapiens
gtaacctctacaggcatt

SEQ ID NO: 454046 - DNA, 17 bp, Homo sapiens
gtaagttgaagggaaat

SEQ ID NO: 454047 - DNA, 15 bp, Homo sapiens
gtaatagcctcacct

SEQ ID NO: 454048 - DNA, 20 bp, Homo sapiens
gtacagaaccagcactccca

SEQ ID NO: 454049 - DNA, 22 bp, Homo sapiens
gtacatttgatttgatatacag

SEQ ID NO: 454050 - DNA, 15 bp, Homo sapiens
gtaccaactgagcca

SEQ ID NO: 454051 - DNA, 13 bp, Homo sapiens
gtaccatcccact

SEQ ID NO: 454052 - DNA, 21 bp, Homo sapiens
gtaccctcgactggcaataat

SEQ ID NO: 454053 - DNA, 21 bp, Homo sapiens
gtacctgtagtgagaaactga

SEQ ID NO: 454054 - DNA, 17 bp, Homo sapiens
gtacctttccacccaga

SEQ ID NO: 454055 - DNA, 19 bp, Homo sapiens
gtacctttccacccagacc

SEQ ID NO: 454056 - DNA, 22 bp, Homo sapiens
gtacctttccacccagaccctc

SEQ ID NO: 454057 - DNA, 17 bp, Homo sapiens
gtacttcagttctcatc

SEQ ID NO: 454058 - DNA, 22 bp, Homo sapiens
gtacttcttcatccatagacac

SEQ ID NO: 454059 - DNA, 16 bp, Homo sapiens
gtacttgctcaataaa

SEQ ID NO: 454060 - DNA, 15 bp, Homo sapiens
ggcgggcagcccctg

SEQ ID NO: 454061 - DNA, 23 bp, Homo sapiens
ggcgggcagcccctgctggacca

SEQ ID NO: 454062 - DNA, 13 bp, Homo sapiens
ggctaactggccc

SEQ ID NO: 454063 - DNA, 17 bp, Homo sapiens
ggctaactggccccagg

SEQ ID NO: 454064 - DNA, 16 bp, Homo sapiens
ggctccagacattgta

SEQ ID NO: 454065 - DNA, 19 bp, Homo sapiens
ggctcccacaggcccttcc

SEQ ID NO: 454066 - DNA, 15 bp, Homo sapiens
ggctccccctgccag

SEQ ID NO: 454067 - DNA, 12 bp, Homo sapiens
ggctcctttccc

SEQ ID NO: 454068 - DNA, 14 bp, Homo sapiens
ggctcctttcccac

SEQ ID NO: 454069 - DNA, 17 bp, Homo sapiens
ggctcctttcccacagt

SEQ ID NO: 454070 - DNA, 13 bp, Homo sapiens
ggctcttctcctt

SEQ ID NO: 454071 - DNA, 15 bp, Homo sapiens
ggctcttctcctttc

SEQ ID NO: 454072 - DNA, 15 bp, Homo sapiens
ggctgagcccctcct

SEQ ID NO: 454073 - DNA, 17 bp, Homo sapiens
ggctgaggacggggcag

SEQ ID NO: 454074 - DNA, 21 bp, Homo sapiens
ggctgaggacggggcagagct

SEQ ID NO: 454075 - DNA, 23 bp, Homo sapiens
ggctgcccctgtaaggtttcaat

SEQ ID NO: 454076 - DNA, 14 bp, Homo sapiens
ggctggccctgccc

SEQ ID NO: 454077 - DNA, 16 bp, Homo sapiens
ggctggccggtccacc

SEQ ID NO: 454078 - DNA, 18 bp, Homo sapiens
ggctggccggtccacccc

SEQ ID NO: 454079 - DNA, 14 bp, Homo sapiens
ggctgggcagggcc

SEQ ID NO: 454080 - DNA, 17 bp, Homo sapiens
ggctgggcagggccgca

SEQ ID NO: 454081 - DNA, 21 bp, Homo sapiens
gtacttgctcaataaaggtca

SEQ ID NO: 454082 - DNA, 18 bp, Homo sapiens
gtagagagcaaagatggc

SEQ ID NO: 454083 - DNA, 14 bp, Homo sapiens
gtagatgagaaaac

SEQ ID NO: 454084 - DNA, 13 bp, Homo sapiens
gtagcatataaat

SEQ ID NO: 454085 - DNA, 22 bp, Homo sapiens
gtagcccacaataatgaataat

SEQ ID NO: 454086 - DNA, 17 bp, Homo sapiens
gtaggctgtattttctt

SEQ ID NO: 454087 - DNA, 17 bp, Homo sapiens
gtagggtgaggcgtggg

SEQ ID NO: 454088 - DNA, 19 bp, Homo sapiens
gtaggttgtgatgatagca

SEQ ID NO: 454089 - DNA, 17 bp, Homo sapiens
gtataaaaaagaaaact

SEQ ID NO: 454090 - DNA, 22 bp, Homo sapiens
gtataacaagccaaacattctt

SEQ ID NO: 454091 - DNA, 17 bp, Homo sapiens
gtatagtttaaagggag

SEQ ID NO: 454092 - DNA, 20 bp, Homo sapiens
gtatagttttataaaactca

SEQ ID NO: 454093 - DNA, 12 bp, Homo sapiens
gtatataagctt

SEQ ID NO: 454094 - DNA, 20 bp, Homo sapiens
gtatcctgataaacattaaa

SEQ ID NO: 454095 - DNA, 15 bp, Homo sapiens
gtatctaaaaaataa

SEQ ID NO: 454096 - DNA, 19 bp, Homo sapiens
gtatgaataaagacaccta

SEQ ID NO: 454097 - DNA, 13 bp, Homo sapiens
gtatgctggccag

SEQ ID NO: 454098 - DNA, 14 bp, Homo sapiens
gtatgctggccagc

SEQ ID NO: 454099 - DNA, 15 bp, Homo sapiens
gtatgtggcaaaatg

SEQ ID NO: 454100 - DNA, 20 bp, Homo sapiens
gtattctgtagccaacttaa

SEQ ID NO: 454101 - DNA, 18 bp, Homo sapiens
gtattctgtggattctat

SEQ ID NO: 454102 - DNA, 17 bp, Homo sapiens
gtattttactttgtgca

SEQ ID NO: 454103 - DNA, 15 bp, Homo sapiens
gtatttttactatta

SEQ ID NO: 454104 - DNA, 15 bp, Homo sapiens
gtcaactgctgtttt

SEQ ID NO: 454105 - DNA, 19 bp, Homo sapiens
gtcaactgctgttttatgt

SEQ ID NO: 454106 - DNA, 12 bp, Homo sapiens
gtcaatgtgaaa

SEQ ID NO: 454107 - DNA, 13 bp, Homo sapiens
gtcaatgtgaaat

SEQ ID NO: 454108 - DNA, 20 bp, Homo sapiens
gtcacagcagtacttgctca

SEQ ID NO: 454109 - DNA, 18 bp, Homo sapiens
gtcaccagctatctgtca

SEQ ID NO: 454110 - DNA, 19 bp, Homo sapiens
gtcactcacaaaaggctgg

SEQ ID NO: 454111 - DNA, 23 bp, Homo sapiens
gtcactcacaaaaggctggatgt

SEQ ID NO: 454112 - DNA, 20 bp, Homo sapiens
gtcactgcacagtgcatctc

SEQ ID NO: 454113 - DNA, 23 bp, Homo sapiens
gtcactgcacagtgcatctcagc

SEQ ID NO: 454114 - DNA, 12 bp, Homo sapiens
gtcacttctgct

SEQ ID NO: 454115 - DNA, 19 bp, Homo sapiens
gtcacttctgctgtacaga

SEQ ID NO: 454116 - DNA, 21 bp, Homo sapiens
gtcagccagccgccctgggct

SEQ ID NO: 454117 - DNA, 19 bp, Homo sapiens
gtcatctcaaacactgctt

SEQ ID NO: 454118 - DNA, 15 bp, Homo sapiens
gtcatctctctgggg

SEQ ID NO: 454119 - DNA, 14 bp, Homo sapiens
gtcattctgctaat

SEQ ID NO: 454120 - DNA, 18 bp, Homo sapiens
gtcattctgctaatttat

SEQ ID NO: 454121 - DNA, 14 bp, Homo sapiens
gtcatttataaaac

SEQ ID NO: 454122 - DNA, 17 bp, Homo sapiens
gtccaccccgtcccggc

SEQ ID NO: 454123 - DNA, 18 bp, Homo sapiens
gtccaccccgtcccggcc

SEQ ID NO: 454124 - DNA, 19 bp, Homo sapiens
gtccaccccgtcccggccc

SEQ ID NO: 454125 - DNA, 17 bp, Homo sapiens
gtccacctgtgctgctg

SEQ ID NO: 454126 - DNA, 19 bp, Homo sapiens
gtccactttcctctctctc

SEQ ID NO: 454127 - DNA, 18 bp, Homo sapiens
gtccattgcaaaaggtta

SEQ ID NO: 454128 - DNA, 18 bp, Homo sapiens
gtcccaccgggagcctcc

SEQ ID NO: 454129 - DNA, 19 bp, Homo sapiens
gtcccaccgggagcctccc

SEQ ID NO: 454130 - DNA, 16 bp, Homo sapiens
gtcccagcacctggca

SEQ ID NO: 454131 - DNA, 12 bp, Homo sapiens
gtccccagggtg

SEQ ID NO: 454132 - DNA, 18 bp, Homo sapiens
gtccccggacgctggctc

SEQ ID NO: 454133 - DNA, 19 bp, Homo sapiens
gtccccggacgctggctcg

SEQ ID NO: 454134 - DNA, 16 bp, Homo sapiens
gtccctgacttcccag

SEQ ID NO: 454135 - DNA, 17 bp, Homo sapiens
gtccctgacttcccagc

SEQ ID NO: 454136 - DNA, 23 bp, Homo sapiens
gtccctgacttcccagctggcag

SEQ ID NO: 454137 - DNA, 17 bp, Homo sapiens
gtcccttacctggctta

SEQ ID NO: 454138 - DNA, 15 bp, Homo sapiens
gtcccttcctgtcct

SEQ ID NO: 454139 - DNA, 13 bp, Homo sapiens
gtccggcctgcag

SEQ ID NO: 454140 - DNA, 21 bp, Homo sapiens
gtccgtccgcccgcccacccc

SEQ ID NO: 454141 - DNA, 17 bp, Homo sapiens
gtcctcaccttctgttt

SEQ ID NO: 454142 - DNA, 20 bp, Homo sapiens
gtcctgctgctcgggaaggc

SEQ ID NO: 454143 - DNA, 13 bp, Homo sapiens
gtcctggggtggt

SEQ ID NO: 454144 - DNA, 16 bp, Homo sapiens
gtcgccccaggccctc

SEQ ID NO: 454145 - DNA, 18 bp, Homo sapiens
gtcgccccaggccctccc

SEQ ID NO: 454146 - DNA, 16 bp, Homo sapiens
gtcgcccctcctcggg

SEQ ID NO: 454147 - DNA, 20 bp, Homo sapiens
gtcgcccctcctcgggcgcc

SEQ ID NO: 454148 - DNA, 17 bp, Homo sapiens
gtcggctgggcagggcc

SEQ ID NO: 454149 - DNA, 18 bp, Homo sapiens
gtcggctgggcagggccg

SEQ ID NO: 454150 - DNA, 23 bp, Homo sapiens
gtcggctgggcagggccgcaggg

SEQ ID NO: 454151 - DNA, 15 bp, Homo sapiens
gtctcaagagggcac

SEQ ID NO: 454152 - DNA, 20 bp, Homo sapiens
gtctcagcaaattcttgaat

SEQ ID NO: 454153 - DNA, 23 bp, Homo sapiens
gtctcagcaaattcttgaataaa

SEQ ID NO: 454154 - DNA, 13 bp, Homo sapiens
gtctccacccctc

SEQ ID NO: 454155 - DNA, 14 bp, Homo sapiens
gtctccacccctca

SEQ ID NO: 454156 - DNA, 15 bp, Homo sapiens
gtctccacccctcaa

SEQ ID NO: 454157 - DNA, 13 bp, Homo sapiens
gtctccagctgat

SEQ ID NO: 454158 - DNA, 18 bp, Homo sapiens
gtctccccatgtgcctgc

SEQ ID NO: 454159 - DNA, 15 bp, Homo sapiens
gtctccccgcagccc

SEQ ID NO: 454160 - DNA, 19 bp, Homo sapiens
gtctccccgcagccctctc

SEQ ID NO: 454161 - DNA, 21 bp, Homo sapiens
gtctccccgcagccctctcca

SEQ ID NO: 454162 - DNA, 22 bp, Homo sapiens
gtctccccgcagccctctccac

SEQ ID NO: 454163 - DNA, 14 bp, Homo sapiens
gtctccctggccac

SEQ ID NO: 454164 - DNA, 13 bp, Homo sapiens
gtctctgagcagt

SEQ ID NO: 454165 - DNA, 15 bp, Homo sapiens
gtctctgagcagtgg

SEQ ID NO: 454166 - DNA, 15 bp, Homo sapiens
gtctcttcaaacagt

SEQ ID NO: 454167 - DNA, 17 bp, Homo sapiens
gtctcttctccactgga

SEQ ID NO: 454168 - DNA, 18 bp, Homo sapiens
gtctcttctccactggat

SEQ ID NO: 454169 - DNA, 15 bp, Homo sapiens
gtctgaaggagagga

SEQ ID NO: 454170 - DNA, 17 bp, Homo sapiens
gtctgaaggagaggagt

SEQ ID NO: 454171 - DNA, 14 bp, Homo sapiens
gtctgaaggcctcc

SEQ ID NO: 454172 - DNA, 15 bp, Homo sapiens
gtctgaaggcctcca

SEQ ID NO: 454173 - DNA, 19 bp, Homo sapiens
gtctgaagtcactgcacag

SEQ ID NO: 454174 - DNA, 15 bp, Homo sapiens
gtctgagccctgccc

SEQ ID NO: 454175 - DNA, 16 bp, Homo sapiens
gtctgccccttgaccc

SEQ ID NO: 454176 - DNA, 21 bp, Homo sapiens
gtctgccccttgaccccacac

SEQ ID NO: 454177 - DNA, 20 bp, Homo sapiens
gtctgtcaccagctatctgt

SEQ ID NO: 454178 - DNA, 22 bp, Homo sapiens
gtcttcaaccctgccctgcacc

SEQ ID NO: 454179 - DNA, 22 bp, Homo sapiens
gtcttgagtgggccccctctct

SEQ ID NO: 454180 - DNA, 20 bp, Homo sapiens
gtcttggagaggaggtgtgg

SEQ ID NO: 454181 - DNA, 17 bp, Homo sapiens
gtctttggagagctcag

SEQ ID NO: 454182 - DNA, 22 bp, Homo sapiens
gtgaagcctttatctatgggag

SEQ ID NO: 454183 - DNA, 13 bp, Homo sapiens
gtgaataaaaacc

SEQ ID NO: 454184 - DNA, 18 bp, Homo sapiens
gtgaataaaaaccctgta

SEQ ID NO: 454185 - DNA, 18 bp, Homo sapiens
gtgacaggaaagccctcc

SEQ ID NO: 454186 - DNA, 19 bp, Homo sapiens
gtgacaggaaagccctccc

SEQ ID NO: 454187 - DNA, 13 bp, Homo sapiens
gtgacatgcggct

SEQ ID NO: 454188 - DNA, 20 bp, Homo sapiens
gtgaccggcccgccaccttg

SEQ ID NO: 454189 - DNA, 21 bp, Homo sapiens
gtgaccggcccgccaccttgt

SEQ ID NO: 454190 - DNA, 21 bp, Homo sapiens
gtgactgtcccaccgggagcc

SEQ ID NO: 454191 - DNA, 17 bp, Homo sapiens
gtgatacactgtatcta

SEQ ID NO: 454192 - DNA, 23 bp, Homo sapiens
gtgatggttcccctgttcactct

SEQ ID NO: 454193 - DNA, 19 bp, Homo sapiens
gtgcaacggaagccaggcc

SEQ ID NO: 454194 - DNA, 14 bp, Homo sapiens
gtgcaggcgcgcac

SEQ ID NO: 454195 - DNA, 15 bp, Homo sapiens
gtgcatctcagccca

SEQ ID NO: 454196 - DNA, 24 bp, Homo sapiens
gtgcatttgagagaagccacgctg

SEQ ID NO: 454197 - DNA, 23 bp, Homo sapiens
gtgcccaagaatagatgctgact

SEQ ID NO: 454198 - DNA, 12 bp, Homo sapiens
gtgcctgagccc

SEQ ID NO: 454199 - DNA, 17 bp, Homo sapiens
gtgcctgcaccaggaga

SEQ ID NO: 454200 - DNA, 19 bp, Homo sapiens
gtgcctgcaccaggagaca

SEQ ID NO: 454201 - DNA, 19 bp, Homo sapiens
gtgcctggtgcgctgtgct

SEQ ID NO: 454202 - DNA, 15 bp, Homo sapiens
gtgccttcagctcta

SEQ ID NO: 454203 - DNA, 21 bp, Homo sapiens
gtgccttccccgtgcggcccg

SEQ ID NO: 454204 - DNA, 20 bp, Homo sapiens
gtgcgcagccgcgctctgcc

SEQ ID NO: 454205 - DNA, 22 bp, Homo sapiens
gtgcgcagccgcgctctgcccc

SEQ ID NO: 454206 - DNA, 19 bp, Homo sapiens
gtgcgctagagcattctgg

SEQ ID NO: 454207 - DNA, 13 bp, Homo sapiens
gtgcgctgtgctc

SEQ ID NO: 454208 - DNA, 18 bp, Homo sapiens
gtgcgctgtgctccagca

SEQ ID NO: 454209 - DNA, 12 bp, Homo sapiens
gtgcgtgtggcc

SEQ ID NO: 454210 - DNA, 18 bp, Homo sapiens
gtgctccagcagtgctgg

SEQ ID NO: 454211 - DNA, 20 bp, Homo sapiens
gtgctccagcagtgctgggc

SEQ ID NO: 454212 - DNA, 22 bp, Homo sapiens
gtgctcggacacagttttgtct

SEQ ID NO: 454213 - DNA, 12 bp, Homo sapiens
gtgctgtgggca

SEQ ID NO: 454214 - DNA, 15 bp, Homo sapiens
gtgctgtgggcagca

SEQ ID NO: 454215 - DNA, 19 bp, Homo sapiens
gtgctgtgggcagcaccct

SEQ ID NO: 454216 - DNA, 20 bp, Homo sapiens
gtggacaatgagtggaatac

SEQ ID NO: 454217 - DNA, 17 bp, Homo sapiens
gtggacatggctgttca

SEQ ID NO: 454218 - DNA, 14 bp, Homo sapiens
gtggactgcgctgg

SEQ ID NO: 454219 - DNA, 9 bp, Homo sapiens
gtggacttt

SEQ ID NO: 454220 - DNA, 13 bp, Homo sapiens
gtggaggggtcag

SEQ ID NO: 454221 - DNA, 13 bp, Homo sapiens
gtggcaaacattt

SEQ ID NO: 454222 - DNA, 20 bp, Homo sapiens
gtggcaccagatgcaacctc

SEQ ID NO: 454223 - DNA, 21 bp, Homo sapiens
gtggcaggcacacagcagccc

SEQ ID NO: 454224 - DNA, 21 bp, Homo sapiens
gtggccactccagacccctgg

SEQ ID NO: 454225 - DNA, 14 bp, Homo sapiens
gtggccatccctgg

SEQ ID NO: 454226 - DNA, 18 bp, Homo sapiens
gtggccatccctgggccc

SEQ ID NO: 454227 - DNA, 11 bp, Homo sapiens
gtggcccctcc

SEQ ID NO: 454228 - DNA, 17 bp, Homo sapiens
gtggcccctccttctcc

SEQ ID NO: 454229 - DNA, 19 bp, Homo sapiens
gtggcccgacagcctggca

SEQ ID NO: 454230 - DNA, 12 bp, Homo sapiens
gtggcctcagcc

SEQ ID NO: 454231 - DNA, 16 bp, Homo sapiens
gtggcctcagccctca

SEQ ID NO: 454232 - DNA, 17 bp, Homo sapiens
gtggcctcagccctcag

SEQ ID NO: 454233 - DNA, 15 bp, Homo sapiens
gtggccttagaaaac

SEQ ID NO: 454234 - DNA, 17 bp, Homo sapiens
gtggctcattcttttca

SEQ ID NO: 454235 - DNA, 12 bp, Homo sapiens
gtgggagtccac

SEQ ID NO: 454236 - DNA, 18 bp, Homo sapiens
gtgggagtccactttcct

SEQ ID NO: 454237 - DNA, 18 bp, Homo sapiens
gtgggatccagagagaag

SEQ ID NO: 454238 - DNA, 20 bp, Homo sapiens
gtgggatccagagagaagca

SEQ ID NO: 454239 - DNA, 15 bp, Homo sapiens
gtggggagggtgggc

SEQ ID NO: 454240 - DNA, 20 bp, Homo sapiens
gtggggcttagaatggggct

SEQ ID NO: 454241 - DNA, 19 bp, Homo sapiens
gtgggggagaatggctctg

SEQ ID NO: 454242 - DNA, 21 bp, Homo sapiens
gtgggggagaatggctctggc

SEQ ID NO: 454243 - DNA, 14 bp, Homo sapiens
gtgggggtggccat

SEQ ID NO: 454244 - DNA, 19 bp, Homo sapiens
gtggggtgcctgagcccga

SEQ ID NO: 454245 - DNA, 21 bp, Homo sapiens
gtgggtcttggattggtacca

SEQ ID NO: 454246 - DNA, 18 bp, Homo sapiens
gtggtgtgaggcccccgg

SEQ ID NO: 454247 - DNA, 19 bp, Homo sapiens
gtggtgtgaggcccccgga

SEQ ID NO: 454248 - DNA, 18 bp, Homo sapiens
gtggttcgggggaaatag

SEQ ID NO: 454249 - DNA, 12 bp, Homo sapiens
gtgtattctgtg

SEQ ID NO: 454250 - DNA, 22 bp, Homo sapiens
gtgtattctgtggattctatat

SEQ ID NO: 454251 - DNA, 21 bp, Homo sapiens
gtgtcccatgcataacacact

SEQ ID NO: 454252 - DNA, 21 bp, Homo sapiens
gtgtcccctcactctgtcagc

SEQ ID NO: 454253 - DNA, 12 bp, Homo sapiens
gtgtggagtgga

SEQ ID NO: 454254 - DNA, 19 bp, Homo sapiens
gtgtggagtggaggggtca

SEQ ID NO: 454255 - DNA, 11 bp, Homo sapiens
gtgtggcctca

SEQ ID NO: 454256 - DNA, 18 bp, Homo sapiens
gtgtggcttaaacatttt

SEQ ID NO: 454257 - DNA, 12 bp, Homo sapiens
gtgtggcttgga

SEQ ID NO: 454258 - DNA, 13 bp, Homo sapiens
gtgtggcttggaa

SEQ ID NO: 454259 - DNA, 14 bp, Homo sapiens
gtgtggcttggaac

SEQ ID NO: 454260 - DNA, 13 bp, Homo sapiens
gtgtgtgcaatgt

SEQ ID NO: 454261 - DNA, 15 bp, Homo sapiens
gtgttcaatctgtga

SEQ ID NO: 454262 - DNA, 14 bp, Homo sapiens
gtgttcacacacac

SEQ ID NO: 454263 - DNA, 12 bp, Homo sapiens
gtgttgcaaatt

SEQ ID NO: 454264 - DNA, 16 bp, Homo sapiens
gttaaacgtcacagca

SEQ ID NO: 454265 - DNA, 15 bp, Homo sapiens
gttaacccagtgttc

SEQ ID NO: 454266 - DNA, 17 bp, Homo sapiens
gttaagacaacaggcat

SEQ ID NO: 454267 - DNA, 18 bp, Homo sapiens
gttaagacaacaggcatt

SEQ ID NO: 454268 - DNA, 18 bp, Homo sapiens
gttaagtgactgagaaga

SEQ ID NO: 454269 - DNA, 15 bp, Homo sapiens
gttaatgtgccaaaa

SEQ ID NO: 454270 - DNA, 23 bp, Homo sapiens
gttaattacttttgaaaaaggat

SEQ ID NO: 454271 - DNA, 22 bp, Homo sapiens
gttagaattaggtaatggatat

SEQ ID NO: 454272 - DNA, 13 bp, Homo sapiens
gttagcccggcca

SEQ ID NO: 454273 - DNA, 23 bp, Homo sapiens
gttagcccggccaaggacactga

SEQ ID NO: 454274 - DNA, 15 bp, Homo sapiens
gttatatcatcaata

SEQ ID NO: 454275 - DNA, 18 bp, Homo sapiens
gttatatcatcaatactt

SEQ ID NO: 454276 - DNA, 13 bp, Homo sapiens
gttatcctgctag

SEQ ID NO: 454277 - DNA, 21 bp, Homo sapiens
gttatggcaagtttttggtaa

SEQ ID NO: 454278 - DNA, 21 bp, Homo sapiens
gttattgggcaagtgattgaa

SEQ ID NO: 454279 - DNA, 18 bp, Homo sapiens
gttcaaagaacccccctc

SEQ ID NO: 454280 - DNA, 21 bp, Homo sapiens
gttcaaagaacccccctcccc

SEQ ID NO: 454281 - DNA, 22 bp, Homo sapiens
gttcaaagaacccccctcccca

SEQ ID NO: 454282 - DNA, 22 bp, Homo sapiens
gttcaatctgtgaagcctttat

SEQ ID NO: 454283 - DNA, 14 bp, Homo sapiens
gttcatctgaggag

SEQ ID NO: 454284 - DNA, 19 bp, Homo sapiens
gttcatctgaggagtccaa

SEQ ID NO: 454285 - DNA, 21 bp, Homo sapiens
gttccaaaaataccatttatc

SEQ ID NO: 454286 - DNA, 18 bp, Homo sapiens
gttccaagtgtgtgtgca

SEQ ID NO: 454287 - DNA, 10 bp, Homo sapiens
gttccagaca

SEQ ID NO: 454288 - DNA, 11 bp, Homo sapiens
gttccagacag

SEQ ID NO: 454289 - DNA, 12 bp, Homo sapiens
gttccagacaga

SEQ ID NO: 454290 - DNA, 22 bp, Homo sapiens
gttccagacagagtggatctgg

SEQ ID NO: 454291 - DNA, 16 bp, Homo sapiens
gttccagacagggtgg

SEQ ID NO: 454292 - DNA, 14 bp, Homo sapiens
gttccattctatga

SEQ ID NO: 454293 - DNA, 15 bp, Homo sapiens
gttcccctgttcact

SEQ ID NO: 454294 - DNA, 17 bp, Homo sapiens
gttcccctgttcactct

SEQ ID NO: 454295 - DNA, 18 bp, Homo sapiens
gttcccctgttcactcta

SEQ ID NO: 454296 - DNA, 23 bp, Homo sapiens
gttccgttcatctgaggagtcca

SEQ ID NO: 454297 - DNA, 11 bp, Homo sapiens
gttcctccagc

SEQ ID NO: 454298 - DNA, 19 bp, Homo sapiens
gttcctccagcaatgcctg

SEQ ID NO: 454299 - DNA, 20 bp, Homo sapiens
gttcctcctaggcgctcaga

SEQ ID NO: 454300 - DNA, 23 bp, Homo sapiens
gttcgggggaaatagttccattc

SEQ ID NO: 454301 - DNA, 21 bp, Homo sapiens
gttctagaaggggcgaggctt

SEQ ID NO: 454302 - DNA, 15 bp, Homo sapiens
gttctatttctatct

SEQ ID NO: 454303 - DNA, 18 bp, Homo sapiens
gttctccgggtgtggcct

SEQ ID NO: 454304 - DNA, 19 bp, Homo sapiens
gttctccgggtgtggcctc

SEQ ID NO: 454305 - DNA, 16 bp, Homo sapiens
gttctccttgtacttg

SEQ ID NO: 454306 - DNA, 16 bp, Homo sapiens
gttctgcaataacagt

SEQ ID NO: 454307 - DNA, 20 bp, Homo sapiens
gttctgcaataacagtttta

SEQ ID NO: 454308 - DNA, 22 bp, Homo sapiens
gttcttggcctatgataagttc

SEQ ID NO: 454309 - DNA, 14 bp, Homo sapiens
gttcttggtgactg

SEQ ID NO: 454310 - DNA, 18 bp, Homo sapiens
gttcttggtgactgtccc

SEQ ID NO: 454311 - DNA, 11 bp, Homo sapiens
gttgaccttta

SEQ ID NO: 454312 - DNA, 21 bp, Homo sapiens
gttgacctttatttattaaac

SEQ ID NO: 454313 - DNA, 18 bp, Homo sapiens
gttgcttttgcacctacg

SEQ ID NO: 454314 - DNA, 21 bp, Homo sapiens
gttggccggctggccggtcca

SEQ ID NO: 454315 - DNA, 19 bp, Homo sapiens
gttgtattcctgcctttga

SEQ ID NO: 454316 - DNA, 22 bp, Homo sapiens
gttgtctgaagtcactgcacag

SEQ ID NO: 454317 - DNA, 21 bp, Homo sapiens
gtttaacaaaatgtatgtgag

SEQ ID NO: 454318 - DNA, 16 bp, Homo sapiens
gtttaatattccaata

SEQ ID NO: 454319 - DNA, 23 bp, Homo sapiens
gtttacatgagttcaaatacttt

SEQ ID NO: 454320 - DNA, 23 bp, Homo sapiens
gtttaccctccctgtcccctgag

SEQ ID NO: 454321 - DNA, 15 bp, Homo sapiens
gtttataggaaataa

SEQ ID NO: 454322 - DNA, 19 bp, Homo sapiens
gtttattaaaatactgttt

SEQ ID NO: 454323 - DNA, 15 bp, Homo sapiens
gtttcacatatttgt

SEQ ID NO: 454324 - DNA, 13 bp, Homo sapiens
gtttcagaaaggg

SEQ ID NO: 454325 - DNA, 13 bp, Homo sapiens
gtttctatactgt

SEQ ID NO: 454326 - DNA, 23 bp, Homo sapiens
gtttctgtcctcaggtgaataac

SEQ ID NO: 454327 - DNA, 21 bp, Homo sapiens
gtttcttgatgggagaggttc

SEQ ID NO: 454328 - DNA, 18 bp, Homo sapiens
gtttgatgactaaaagtg

SEQ ID NO: 454329 - DNA, 20 bp, Homo sapiens
gtttgctttgtatgcacttt

SEQ ID NO: 454330 - DNA, 16 bp, Homo sapiens
gtttgggcagtggaga

SEQ ID NO: 454331 - DNA, 18 bp, Homo sapiens
gtttgggcagtggagagg

SEQ ID NO: 454332 - DNA, 17 bp, Homo sapiens
gtttgttttcaaaatac

SEQ ID NO: 454333 - DNA, 18 bp, Homo sapiens
gttttacaatggctgggt

SEQ ID NO: 454334 - DNA, 19 bp, Homo sapiens
gttttatgtcatactctgt

SEQ ID NO: 454335 - DNA, 15 bp, Homo sapiens
gtttttatatattat

SEQ ID NO: 454336 - DNA, 16 bp, Homo sapiens
gtttttggatggctta

SEQ ID NO: 454337 - DNA, 14 bp, Homo sapiens
taaaaaaataacat

SEQ ID NO: 454338 - DNA, 14 bp, Homo sapiens
taaaaattccacca

SEQ ID NO: 454339 - DNA, 18 bp, Homo sapiens
taaaactcagttaaaatg

SEQ ID NO: 454340 - DNA, 15 bp, Homo sapiens
taaaagaacatagga

SEQ ID NO: 454341 - DNA, 12 bp, Homo sapiens
taaaagagcttt

SEQ ID NO: 454342 - DNA, 14 bp, Homo sapiens
taaaaggaggacag

SEQ ID NO: 454343 - DNA, 15 bp, Homo sapiens
taaaaggaggacagg

SEQ ID NO: 454344 - DNA, 19 bp, Homo sapiens
taaaatactcaccaaaata

SEQ ID NO: 454345 - DNA, 12 bp, Homo sapiens
taaaatactgtt

SEQ ID NO: 454346 - DNA, 12 bp, Homo sapiens
taaaatgcaaat

SEQ ID NO: 454347 - DNA, 17 bp, Homo sapiens
taaaatggacttttgtt

SEQ ID NO: 454348 - DNA, 13 bp, Homo sapiens
taaaattcaacaa

SEQ ID NO: 454349 - DNA, 18 bp, Homo sapiens
taaaattcaacaaatgat

SEQ ID NO: 454350 - DNA, 20 bp, Homo sapiens
taaacactgtaatcttaaaa

SEQ ID NO: 454351 - DNA, 20 bp, Homo sapiens
taaacattttttgtttcttg

SEQ ID NO: 454352 - DNA, 16 bp, Homo sapiens
taaacctgtgctttca

SEQ ID NO: 454353 - DNA, 19 bp, Homo sapiens
taaacctgtgctttcatgt

SEQ ID NO: 454354 - DNA, 15 bp, Homo sapiens
taaacgaaacacaga

SEQ ID NO: 454355 - DNA, 17 bp, Homo sapiens
taaactcttcaaggcca

SEQ ID NO: 454356 - DNA, 18 bp, Homo sapiens
taaactcttcaaggccaa

SEQ ID NO: 454357 - DNA, 16 bp, Homo sapiens
taaactgcagttttaa

SEQ ID NO: 454358 - DNA, 18 bp, Homo sapiens
taaactgttttcatgtgt

SEQ ID NO: 454359 - DNA, 20 bp, Homo sapiens
taaacttcagagttctctgt

SEQ ID NO: 454360 - DNA, 14 bp, Homo sapiens
taaacttcagcaac

SEQ ID NO: 454361 - DNA, 13 bp, Homo sapiens
taaactttgtcac

SEQ ID NO: 454362 - DNA, 14 bp, Homo sapiens
taaagaaaaagata

SEQ ID NO: 454363 - DNA, 23 bp, Homo sapiens
taaagaccatttagtcctcacct

SEQ ID NO: 454364 - DNA, 18 bp, Homo sapiens
taaagagttctccttgta

SEQ ID NO: 454365 - DNA, 20 bp, Homo sapiens
taaaggggacagatcttgag

SEQ ID NO: 454366 - DNA, 15 bp, Homo sapiens
taaagtacctgtagt

SEQ ID NO: 454367 - DNA, 22 bp, Homo sapiens
taaagtacctgtagtgagaaac

SEQ ID NO: 454368 - DNA, 13 bp, Homo sapiens
taaataaactctt

SEQ ID NO: 454369 - DNA, 18 bp, Homo sapiens
taaataatgcttaacata

SEQ ID NO: 454370 - DNA, 18 bp, Homo sapiens
taaatccattttctaaac

SEQ ID NO: 454371 - DNA, 18 bp, Homo sapiens
taaatctgtctgattcta

SEQ ID NO: 454372 - DNA, 19 bp, Homo sapiens
taaatctgtctgattctat

SEQ ID NO: 454373 - DNA, 20 bp, Homo sapiens
taaatctgtctgattctatg

SEQ ID NO: 454374 - DNA, 12 bp, Homo sapiens
taccctttccca

SEQ ID NO: 454375 - DNA, 16 bp, Homo sapiens
tacctttccacccaga

SEQ ID NO: 454376 - DNA, 17 bp, Homo sapiens
tacctttccacccagac

SEQ ID NO: 454377 - DNA, 21 bp, Homo sapiens
tacctttccacccagaccctc

SEQ ID NO: 454378 - DNA, 15 bp, Homo sapiens
tactcaaagaggcca

SEQ ID NO: 454379 - DNA, 13 bp, Homo sapiens
tactcctcagacg

SEQ ID NO: 454380 - DNA, 12 bp, Homo sapiens
tactcctcccag

SEQ ID NO: 454381 - DNA, 15 bp, Homo sapiens
tactctgtgctaagt

SEQ ID NO: 454382 - DNA, 15 bp, Homo sapiens
tactctgtgtaatct

SEQ ID NO: 454383 - DNA, 21 bp, Homo sapiens
tactgcctaggagttaatgat

SEQ ID NO: 454384 - DNA, 13 bp, Homo sapiens
tactggttatagt

SEQ ID NO: 454385 - DNA, 14 bp, Homo sapiens
tactggttatagtt

SEQ ID NO: 454386 - DNA, 20 bp, Homo sapiens
tactgtataagtaacactag

SEQ ID NO: 454387 - DNA, 16 bp, Homo sapiens
tactgtcagagaatat

SEQ ID NO: 454388 - DNA, 17 bp, Homo sapiens
tactgtttgtaatatac

SEQ ID NO: 454389 - DNA, 22 bp, Homo sapiens
tactgtttgtaatatacagttt

SEQ ID NO: 454390 - DNA, 23 bp, Homo sapiens
tactgttttgtgcggtgtgtctc

SEQ ID NO: 454391 - DNA, 15 bp, Homo sapiens
tacttaggaaatact

SEQ ID NO: 454392 - DNA, 17 bp, Homo sapiens
tactttgtgcaatatga

SEQ ID NO: 454393 - DNA, 17 bp, Homo sapiens
tacttttgaaaaaggat

SEQ ID NO: 454394 - DNA, 20 bp, Homo sapiens
tacttttgaaaaaggatcat

SEQ ID NO: 454395 - DNA, 18 bp, Homo sapiens
tacttttgtgtattctgt

SEQ ID NO: 454396 - DNA, 18 bp, Homo sapiens
tagaaatgtatcctgata

SEQ ID NO: 454397 - DNA, 23 bp, Homo sapiens
tagaaattctataagagacaaag

SEQ ID NO: 454398 - DNA, 21 bp, Homo sapiens
tagaactgtcccacaaaatat

SEQ ID NO: 454399 - DNA, 18 bp, Homo sapiens
tagaactgttcatttcca

SEQ ID NO: 454400 - DNA, 13 bp, Homo sapiens
tagaagaaaaccc

SEQ ID NO: 454401 - DNA, 20 bp, Homo sapiens
tagaatactgtattgttaca

SEQ ID NO: 454402 - DNA, 17 bp, Homo sapiens
tagaatatcctatactg

SEQ ID NO: 454403 - DNA, 18 bp, Homo sapiens
tagaatatcctatactgg

SEQ ID NO: 454404 - DNA, 13 bp, Homo sapiens
tagaatgagaaat

SEQ ID NO: 454405 - DNA, 16 bp, Homo sapiens
tagaatgagaaatcat

SEQ ID NO: 454406 - DNA, 15 bp, Homo sapiens
tagacaaaggcctta

SEQ ID NO: 454407 - DNA, 13 bp, Homo sapiens
tagacaaccatag

SEQ ID NO: 454408 - DNA, 20 bp, Homo sapiens
tagactttaattcttctctt

SEQ ID NO: 454409 - DNA, 23 bp, Homo sapiens
tagagcattctggggtggggctt

SEQ ID NO: 454410 - DNA, 14 bp, Homo sapiens
tagataattatcca

SEQ ID NO: 454411 - DNA, 20 bp, Homo sapiens
tagcatataaatgtttatat

SEQ ID NO: 454412 - DNA, 22 bp, Homo sapiens
tagcatataaatgtttatattg

SEQ ID NO: 454413 - DNA, 14 bp, Homo sapiens
tagcatcctgatta

SEQ ID NO: 454414 - DNA, 15 bp, Homo sapiens
tagcccggccaagga

SEQ ID NO: 454415 - DNA, 23 bp, Homo sapiens
tagcccggccaaggacactgatg

SEQ ID NO: 454416 - DNA, 20 bp, Homo sapiens
tagccctctttctctctgtg

SEQ ID NO: 454417 - DNA, 17 bp, Homo sapiens
taggaaataaatctaaa

SEQ ID NO: 454418 - DNA, 19 bp, Homo sapiens
taggaaataaatctaaata

SEQ ID NO: 454419 - DNA, 18 bp, Homo sapiens
taggagcttccagatggg

SEQ ID NO: 454420 - DNA, 18 bp, Homo sapiens
taggaggaatgtgctttt

SEQ ID NO: 454421 - DNA, 22 bp, Homo sapiens
taggaggaatgtgcttttccat

SEQ ID NO: 454422 - DNA, 15 bp, Homo sapiens
taggagttctcctgg

SEQ ID NO: 454423 - DNA, 12 bp, Homo sapiens
taggctgtattt

SEQ ID NO: 454424 - DNA, 19 bp, Homo sapiens
taggggtgggggagaatgg

SEQ ID NO: 454425 - DNA, 14 bp, Homo sapiens
tagggtgaggcgtg

SEQ ID NO: 454426 - DNA, 13 bp, Homo sapiens
taggtctccaccc

SEQ ID NO: 454427 - DNA, 15 bp, Homo sapiens
taggtctccacccct

SEQ ID NO: 454428 - DNA, 23 bp, Homo sapiens
taggtctccacccctcaagccag

SEQ ID NO: 454429 - DNA, 15 bp, Homo sapiens
taggtctgaaggcct

SEQ ID NO: 454430 - DNA, 16 bp, Homo sapiens
taggtctgaaggcctc

SEQ ID NO: 454431 - DNA, 19 bp, Homo sapiens
taggtgcccagtcttgagt

SEQ ID NO: 454432 - DNA, 17 bp, Homo sapiens
taggttaataggaggac

SEQ ID NO: 454433 - DNA, 20 bp, Homo sapiens
tagtaaataatgattcaatg

SEQ ID NO: 454434 - DNA, 21 bp, Homo sapiens
tagtaaataatgattcaatgt

SEQ ID NO: 454435 - DNA, 13 bp, Homo sapiens
tagtcctcacctt

SEQ ID NO: 454436 - DNA, 20 bp, Homo sapiens
tagtctgaggccccttaact

SEQ ID NO: 454437 - DNA, 24 bp, Homo sapiens
tagtctttgtttacatgagttcaa

SEQ ID NO: 454438 - DNA, 21 bp, Homo sapiens
tagtgatacactgtatctaaa

SEQ ID NO: 454439 - DNA, 13 bp, Homo sapiens
tagtgatggttcc

SEQ ID NO: 454440 - DNA, 12 bp, Homo sapiens
tagttctgcaat

SEQ ID NO: 454441 - DNA, 23 bp, Homo sapiens
tagttctgcaataacagttttaa

SEQ ID NO: 454442 - DNA, 21 bp, Homo sapiens
tataaaaaagaaaacttgtgt

SEQ ID NO: 454443 - DNA, 20 bp, Homo sapiens
tataaatgtttatattgttt

SEQ ID NO: 454444 - DNA, 18 bp, Homo sapiens
tataagggagtaggctgt

SEQ ID NO: 454445 - DNA, 12 bp, Homo sapiens
tataagttgacc

SEQ ID NO: 454446 - DNA, 14 bp, Homo sapiens
tataatatggaacc

SEQ ID NO: 454447 - DNA, 18 bp, Homo sapiens
tatacagacctccagatt

SEQ ID NO: 454448 - DNA, 21 bp, Homo sapiens
tataccctaggtctccacccc

SEQ ID NO: 454449 - DNA, 13 bp, Homo sapiens
tatactgcatatc

SEQ ID NO: 454450 - DNA, 24 bp, Homo sapiens
tatactggttatagttgatatgta

SEQ ID NO: 454451 - DNA, 22 bp, Homo sapiens
tatagaataaagcctctgtgct

SEQ ID NO: 454452 - DNA, 18 bp, Homo sapiens
tataggaaataaatctaa

SEQ ID NO: 454453 - DNA, 24 bp, Homo sapiens
tatagtctgtacttcagttctcat

SEQ ID NO: 454454 - DNA, 15 bp, Homo sapiens
tatagttgaacaaga

SEQ ID NO: 454455 - DNA, 14 bp, Homo sapiens
tatataaattatta

SEQ ID NO: 454456 - DNA, 12 bp, Homo sapiens
tatataagcttt

SEQ ID NO: 454457 - DNA, 13 bp, Homo sapiens
tatatatatatgt

SEQ ID NO: 454458 - DNA, 15 bp, Homo sapiens
tatatatatgtatat

SEQ ID NO: 454459 - DNA, 15 bp, Homo sapiens
tatatattataagtt

SEQ ID NO: 454460 - DNA, 19 bp, Homo sapiens
tatatatttattattttca

SEQ ID NO: 454461 - DNA, 18 bp, Homo sapiens
tatatcagcagacactcc

SEQ ID NO: 454462 - DNA, 12 bp, Homo sapiens
tatatcagctct

SEQ ID NO: 454463 - DNA, 13 bp, Homo sapiens
tatatctgtaaat

SEQ ID NO: 454464 - DNA, 20 bp, Homo sapiens
tatatgaataattatgttta

SEQ ID NO: 454465 - DNA, 15 bp, Homo sapiens
tatatgatatgcatg

SEQ ID NO: 454466 - DNA, 15 bp, Homo sapiens
tatatgtatatattt

SEQ ID NO: 454467 - DNA, 20 bp, Homo sapiens
tatatgtatatatttattat

SEQ ID NO: 454468 - DNA, 13 bp, Homo sapiens
tatattataagtt

SEQ ID NO: 454469 - DNA, 18 bp, Homo sapiens
tatattataagttgacct

SEQ ID NO: 454470 - DNA, 17 bp, Homo sapiens
tatattgtttttatata

SEQ ID NO: 454471 - DNA, 15 bp, Homo sapiens
tatatttattatttt

SEQ ID NO: 454472 - DNA, 14 bp, Homo sapiens
taaatgattccaaa

SEQ ID NO: 454473 - DNA, 21 bp, Homo sapiens
taaatgctttgtgtgattgaa

SEQ ID NO: 454474 - DNA, 21 bp, Homo sapiens
taaattataatgcatctaaac

SEQ ID NO: 454475 - DNA, 16 bp, Homo sapiens
taaattatatgatatg

SEQ ID NO: 454476 - DNA, 19 bp, Homo sapiens
taaattatatgatatgcat

SEQ ID NO: 454477 - DNA, 21 bp, Homo sapiens
taaattatatgatatgcatgt

SEQ ID NO: 454478 - DNA, 23 bp, Homo sapiens
taaattcaacacttattttctga

SEQ ID NO: 454479 - DNA, 16 bp, Homo sapiens
taaattttaatgtaaa

SEQ ID NO: 454480 - DNA, 17 bp, Homo sapiens
taaattttaatgtaaaa

SEQ ID NO: 454481 - DNA, 20 bp, Homo sapiens
taaattttaatgtaaaattc

SEQ ID NO: 454482 - DNA, 16 bp, Homo sapiens
taaattttctttttct

SEQ ID NO: 454483 - DNA, 17 bp, Homo sapiens
taacaatgccttgttgt

SEQ ID NO: 454484 - DNA, 23 bp, Homo sapiens
taacacaattttcactttttctg

SEQ ID NO: 454485 - DNA, 17 bp, Homo sapiens
taacactagtagctgtt

SEQ ID NO: 454486 - DNA, 19 bp, Homo sapiens
taacactagtagctgtttt

SEQ ID NO: 454487 - DNA, 22 bp, Homo sapiens
taacactagtagctgttttgaa

SEQ ID NO: 454488 - DNA, 21 bp, Homo sapiens
taacactcgactctgctgctc

SEQ ID NO: 454489 - DNA, 19 bp, Homo sapiens
taacataaacttgtactta

SEQ ID NO: 454490 - DNA, 14 bp, Homo sapiens
taacatctgaaaag

SEQ ID NO: 454491 - DNA, 14 bp, Homo sapiens
taaccaaaaaatgt

SEQ ID NO: 454492 - DNA, 16 bp, Homo sapiens
taaccaggccccagcc

SEQ ID NO: 454493 - DNA, 19 bp, Homo sapiens
taaccaggccccagcctcc

SEQ ID NO: 454494 - DNA, 20 bp, Homo sapiens
taaccatatgattgaaaaga

SEQ ID NO: 454495 - DNA, 14 bp, Homo sapiens
taacccaaaagatt

SEQ ID NO: 454496 - DNA, 13 bp, Homo sapiens
taacccagtgttc

SEQ ID NO: 454497 - DNA, 19 bp, Homo sapiens
taacctgggttgttgcaga

SEQ ID NO: 454498 - DNA, 12 bp, Homo sapiens
taacctgtgaat

SEQ ID NO: 454499 - DNA, 14 bp, Homo sapiens
taactgcatataga

SEQ ID NO: 454500 - DNA, 17 bp, Homo sapiens
taactgcatatagataa

SEQ ID NO: 454501 - DNA, 14 bp, Homo sapiens
taactggccccagg

SEQ ID NO: 454502 - DNA, 15 bp, Homo sapiens
taactggccccaggc

SEQ ID NO: 454503 - DNA, 19 bp, Homo sapiens
taactgttaacccagtgtt

SEQ ID NO: 454504 - DNA, 19 bp, Homo sapiens
taactttttctaagctgtt

SEQ ID NO: 454505 - DNA, 13 bp, Homo sapiens
taagaaagctata

SEQ ID NO: 454506 - DNA, 19 bp, Homo sapiens
taagaaagctatatatgaa

SEQ ID NO: 454507 - DNA, 17 bp, Homo sapiens
taagaaatgagaaattg

SEQ ID NO: 454508 - DNA, 17 bp, Homo sapiens
taagaaatggctttcca

SEQ ID NO: 454509 - DNA, 13 bp, Homo sapiens
taagaagaaactg

SEQ ID NO: 454510 - DNA, 15 bp, Homo sapiens
taagaagaaactgct

SEQ ID NO: 454511 - DNA, 20 bp, Homo sapiens
taagaataaataaagaagaa

SEQ ID NO: 454512 - DNA, 21 bp, Homo sapiens
taagaataaataaagaagaaa

SEQ ID NO: 454513 - DNA, 14 bp, Homo sapiens
taagacaacaggca

SEQ ID NO: 454514 - DNA, 12 bp, Homo sapiens
taagagacaaag

SEQ ID NO: 454515 - DNA, 12 bp, Homo sapiens
taagagccacaa

SEQ ID NO: 454516 - DNA, 18 bp, Homo sapiens
taagatgggcatagggtt

SEQ ID NO: 454517 - DNA, 21 bp, Homo sapiens
taagattatatacaaagctgt

SEQ ID NO: 454518 - DNA, 16 bp, Homo sapiens
taagattccattttgg

SEQ ID NO: 454519 - DNA, 16 bp, Homo sapiens
taagctgctctattgt

SEQ ID NO: 454520 - DNA, 15 bp, Homo sapiens
taagcttatttctaa

SEQ ID NO: 454521 - DNA, 16 bp, Homo sapiens
taaggccgtgtctctg

SEQ ID NO: 454522 - DNA, 20 bp, Homo sapiens
taagtaacctctacaggcat

SEQ ID NO: 454523 - DNA, 17 bp, Homo sapiens
taagtcagtttcacata

SEQ ID NO: 454524 - DNA, 21 bp, Homo sapiens
taagtcagtttcacatatttg

SEQ ID NO: 454525 - DNA, 11 bp, Homo sapiens
taagtcttact

SEQ ID NO: 454526 - DNA, 17 bp, Homo sapiens
taagttgaagggaaatc

SEQ ID NO: 454527 - DNA, 17 bp, Homo sapiens
taagttgacctttattt

SEQ ID NO: 454528 - DNA, 22 bp, Homo sapiens
taagttgttggtttatactgta

SEQ ID NO: 454529 - DNA, 13 bp, Homo sapiens
taataactgttag

SEQ ID NO: 454530 - DNA, 14 bp, Homo sapiens
taatagcctcacct

SEQ ID NO: 454531 - DNA, 23 bp, Homo sapiens
taatcatttatcttatctagcaa

SEQ ID NO: 454532 - DNA, 13 bp, Homo sapiens
taatctctaaaat

SEQ ID NO: 454533 - DNA, 11 bp, Homo sapiens
taatgaataat

SEQ ID NO: 454534 - DNA, 14 bp, Homo sapiens
taatgatactgaat

SEQ ID NO: 454535 - DNA, 15 bp, Homo sapiens
taatgattcaatgtg

SEQ ID NO: 454536 - DNA, 14 bp, Homo sapiens
taatgcctttttgg

SEQ ID NO: 454537 - DNA, 22 bp, Homo sapiens
taatggtttttatttctcgggt

SEQ ID NO: 454538 - DNA, 22 bp, Homo sapiens
taatgttctgaataatttctta

SEQ ID NO: 454539 - DNA, 15 bp, Homo sapiens
taattatgtttacct

SEQ ID NO: 454540 - DNA, 13 bp, Homo sapiens
taattcaataaaa

SEQ ID NO: 454541 - DNA, 14 bp, Homo sapiens
taattgtggcttta

SEQ ID NO: 454542 - DNA, 17 bp, Homo sapiens
taatttcataaattggc

SEQ ID NO: 454543 - DNA, 19 bp, Homo sapiens
taatttcataaattggctc

SEQ ID NO: 454544 - DNA, 14 bp, Homo sapiens
tacaaagctgtcac

SEQ ID NO: 454545 - DNA, 15 bp, Homo sapiens
tacaaatttttactc

SEQ ID NO: 454546 - DNA, 18 bp, Homo sapiens
tacaacttccagatttga

SEQ ID NO: 454547 - DNA, 15 bp, Homo sapiens
tacaataaaagagct

SEQ ID NO: 454548 - DNA, 16 bp, Homo sapiens
tacaataaaagagctt

SEQ ID NO: 454549 - DNA, 17 bp, Homo sapiens
tacaataaaagagcttt

SEQ ID NO: 454550 - DNA, 19 bp, Homo sapiens
tacaataaaagagctttat

SEQ ID NO: 454551 - DNA, 17 bp, Homo sapiens
tacaccgggcctggaga

SEQ ID NO: 454552 - DNA, 13 bp, Homo sapiens
tacactgtatcta

SEQ ID NO: 454553 - DNA, 23 bp, Homo sapiens
tacagaaccagcactcccagggc

SEQ ID NO: 454554 - DNA, 13 bp, Homo sapiens
tacatagtctttg

SEQ ID NO: 454555 - DNA, 19 bp, Homo sapiens
tacatagtctttgtttaca

SEQ ID NO: 454556 - DNA, 20 bp, Homo sapiens
tacatcctctgcttgtcatt

SEQ ID NO: 454557 - DNA, 12 bp, Homo sapiens
tacatctgaaat

SEQ ID NO: 454558 - DNA, 15 bp, Homo sapiens
tacatctgaaatcta

SEQ ID NO: 454559 - DNA, 17 bp, Homo sapiens
tacattaaaataactaa

SEQ ID NO: 454560 - DNA, 16 bp, Homo sapiens
taccaactaagttgta

SEQ ID NO: 454561 - DNA, 14 bp, Homo sapiens
taccacattctgtc

SEQ ID NO: 454562 - DNA, 14 bp, Homo sapiens
taccagagactctg

SEQ ID NO: 454563 - DNA, 15 bp, Homo sapiens
taccccgtccctttc

SEQ ID NO: 454564 - DNA, 16 bp, Homo sapiens
taccctagaagaaaac

SEQ ID NO: 454565 - DNA, 17 bp, Homo sapiens
taccctagaagaaaacc

SEQ ID NO: 454566 - DNA, 18 bp, Homo sapiens
taccctaggtctccaccc

SEQ ID NO: 454567 - DNA, 21 bp, Homo sapiens
taccctaggtctccacccctc

SEQ ID NO: 454568 - DNA, 15 bp, Homo sapiens
taccctccctgtccc

SEQ ID NO: 454569 - DNA, 19 bp, Homo sapiens
taccctcttctcagctcca

SEQ ID NO: 454570 - DNA, 13 bp, Homo sapiens
tatatttcatatt

SEQ ID NO: 454571 - DNA, 21 bp, Homo sapiens
tatcagggcccaaataacagt

SEQ ID NO: 454572 - DNA, 21 bp, Homo sapiens
tatccacagaacctttgtcaa

SEQ ID NO: 454573 - DNA, 13 bp, Homo sapiens
tatcctgaataac

SEQ ID NO: 454574 - DNA, 14 bp, Homo sapiens
tatcctgataaaca

SEQ ID NO: 454575 - DNA, 14 bp, Homo sapiens
tatcctgcaccctc

SEQ ID NO: 454576 - DNA, 16 bp, Homo sapiens
tatcctgcaccctctg

SEQ ID NO: 454577 - DNA, 20 bp, Homo sapiens
tatcctgctagctgtagaaa

SEQ ID NO: 454578 - DNA, 15 bp, Homo sapiens
tatcctggtgtctag

SEQ ID NO: 454579 - DNA, 14 bp, Homo sapiens
tatccttttatctc

SEQ ID NO: 454580 - DNA, 16 bp, Homo sapiens
tatctagcaagaagat

SEQ ID NO: 454581 - DNA, 20 bp, Homo sapiens
tatctagcaagaagattcta

SEQ ID NO: 454582 - DNA, 21 bp, Homo sapiens
tatctatttatctgtctgagc

SEQ ID NO: 454583 - DNA, 22 bp, Homo sapiens
tatctccagccaatttcaaaga

SEQ ID NO: 454584 - DNA, 20 bp, Homo sapiens
tatctgcaaatagtttcaaa

SEQ ID NO: 454585 - DNA, 21 bp, Homo sapiens
tatctgcaaatagtttcaaat

SEQ ID NO: 454586 - DNA, 18 bp, Homo sapiens
tatctgctgcctctgaaa

SEQ ID NO: 454587 - DNA, 16 bp, Homo sapiens
tatctgggttttagaa

SEQ ID NO: 454588 - DNA, 15 bp, Homo sapiens
tatctgtcatctctc

SEQ ID NO: 454589 - DNA, 15 bp, Homo sapiens
tatcttatctagcaa

SEQ ID NO: 454590 - DNA, 12 bp, Homo sapiens
tatctttcagtt

SEQ ID NO: 454591 - DNA, 15 bp, Homo sapiens
tatgaaagagaaaat

SEQ ID NO: 454592 - DNA, 17 bp, Homo sapiens
tatgaataattatgttt

SEQ ID NO: 454593 - DNA, 21 bp, Homo sapiens
tatgaataattatgtttacct

SEQ ID NO: 454594 - DNA, 17 bp, Homo sapiens
tatgacaatttcaaaat

SEQ ID NO: 454595 - DNA, 23 bp, Homo sapiens
tatgacaatttcaaaatgcatgt

SEQ ID NO: 454596 - DNA, 22 bp, Homo sapiens
tatgacctaaatccattttcta

SEQ ID NO: 454597 - DNA, 19 bp, Homo sapiens
tatgaggggactgcatgca

SEQ ID NO: 454598 - DNA, 13 bp, Homo sapiens
tatgatatgcatg

SEQ ID NO: 454599 - DNA, 16 bp, Homo sapiens
tatgatctctgctttg

SEQ ID NO: 454600 - DNA, 15 bp, Homo sapiens
tatgattgaaaagaa

SEQ ID NO: 454601 - DNA, 16 bp, Homo sapiens
tatgattgaaaagaag

SEQ ID NO: 454602 - DNA, 19 bp, Homo sapiens
tatgattgaaaagaagaaa

SEQ ID NO: 454603 - DNA, 19 bp, Homo sapiens
tatgattttccctaaaaga

SEQ ID NO: 454604 - DNA, 21 bp, Homo sapiens
tatgcacacctcccaccccct

SEQ ID NO: 454605 - DNA, 14 bp, Homo sapiens
tatgcatgtagcat

SEQ ID NO: 454606 - DNA, 21 bp, Homo sapiens
tatgcctgtatttccaacaaa

SEQ ID NO: 454607 - DNA, 12 bp, Homo sapiens
tatgctgctgtg

SEQ ID NO: 454608 - DNA, 13 bp, Homo sapiens
tatgctgctgtga

SEQ ID NO: 454609 - DNA, 23 bp, Homo sapiens
tatggaaagggtgtggcttggaa

SEQ ID NO: 454610 - DNA, 13 bp, Homo sapiens
tatggattcactt

SEQ ID NO: 454611 - DNA, 14 bp, Homo sapiens
tatggattcacttc

SEQ ID NO: 454612 - DNA, 20 bp, Homo sapiens
tatggattcacttctattta

SEQ ID NO: 454613 - DNA, 19 bp, Homo sapiens
tatggcttgtagggtgagg

SEQ ID NO: 454614 - DNA, 15 bp, Homo sapiens
tatggctttgtgctt

SEQ ID NO: 454615 - DNA, 17 bp, Homo sapiens
tatggctttgtgcttgt

SEQ ID NO: 454616 - DNA, 22 bp, Homo sapiens
tatggctttgtgcttgttcttc

SEQ ID NO: 454617 - DNA, 15 bp, Homo sapiens
tatgtagaactgttc

SEQ ID NO: 454618 - DNA, 16 bp, Homo sapiens
tatgtcatactctgtg

SEQ ID NO: 454619 - DNA, 17 bp, Homo sapiens
tatgtgccataaacaga

SEQ ID NO: 454620 - DNA, 22 bp, Homo sapiens
tattaatttagcctttaataat

SEQ ID NO: 454621 - DNA, 12 bp, Homo sapiens
tattataagttg

SEQ ID NO: 454622 - DNA, 18 bp, Homo sapiens
tattataagttgaccttt

SEQ ID NO: 454623 - DNA, 21 bp, Homo sapiens
tattatagtctgtacttcagt

SEQ ID NO: 454624 - DNA, 20 bp, Homo sapiens
tattatgaggctattaaaag

SEQ ID NO: 454625 - DNA, 18 bp, Homo sapiens
tattatggtgatactcca

SEQ ID NO: 454626 - DNA, 14 bp, Homo sapiens
tattatgttgttca

SEQ ID NO: 454627 - DNA, 15 bp, Homo sapiens
tattatttgaatgga

SEQ ID NO: 454628 - DNA, 19 bp, Homo sapiens
tattccatccatatacttt

SEQ ID NO: 454629 - DNA, 18 bp, Homo sapiens
tattctagtcaactgctg

SEQ ID NO: 454630 - DNA, 19 bp, Homo sapiens
tattctgtagccaacttaa

SEQ ID NO: 454631 - DNA, 17 bp, Homo sapiens
tattctgtggattctat

SEQ ID NO: 454632 - DNA, 18 bp, Homo sapiens
tattctgtggattctata

SEQ ID NO: 454633 - DNA, 17 bp, Homo sapiens
tattcttccaagttcat

SEQ ID NO: 454634 - DNA, 15 bp, Homo sapiens
tattgcagttataga

SEQ ID NO: 454635 - DNA, 17 bp, Homo sapiens
tattggttttaaaaaag

SEQ ID NO: 454636 - DNA, 20 bp, Homo sapiens
tattggttttaaaaaagcat

SEQ ID NO: 454637 - DNA, 14 bp, Homo sapiens
tattgtatgtacct

SEQ ID NO: 454638 - DNA, 23 bp, Homo sapiens
tattgtttttggatggcttaagc

SEQ ID NO: 454639 - DNA, 10 bp, Homo sapiens
tatttaagcc

SEQ ID NO: 454640 - DNA, 16 bp, Homo sapiens
tatttaagccccctct

SEQ ID NO: 454641 - DNA, 13 bp, Homo sapiens
tatttagtatctg

SEQ ID NO: 454642 - DNA, 14 bp, Homo sapiens
tatttatctgtctg

SEQ ID NO: 454643 - DNA, 17 bp, Homo sapiens
tatttatctgtctgagc

SEQ ID NO: 454644 - DNA, 19 bp, Homo sapiens
tatttatctgtctgagccc

SEQ ID NO: 454645 - DNA, 12 bp, Homo sapiens
tatttattaaac

SEQ ID NO: 454646 - DNA, 16 bp, Homo sapiens
tatttattaaacttca

SEQ ID NO: 454647 - DNA, 20 bp, Homo sapiens
tatttattaaacttcagcaa

SEQ ID NO: 454648 - DNA, 21 bp, Homo sapiens
tatttattaaacttcagcaac

SEQ ID NO: 454649 - DNA, 21 bp, Homo sapiens
tatttcacttaaactttgtca

SEQ ID NO: 454650 - DNA, 14 bp, Homo sapiens
tatttccaacaaac

SEQ ID NO: 454651 - DNA, 14 bp, Homo sapiens
tatttctaagctta

SEQ ID NO: 454652 - DNA, 19 bp, Homo sapiens
tatttctcgggtgcatttg

SEQ ID NO: 454653 - DNA, 22 bp, Homo sapiens
tatttgtagctagaatatccta

SEQ ID NO: 454654 - DNA, 13 bp, Homo sapiens
tattttaataaag

SEQ ID NO: 454655 - DNA, 13 bp, Homo sapiens
tattttactttgt

SEQ ID NO: 454656 - DNA, 20 bp, Homo sapiens
tattttagacaaccatagaa

SEQ ID NO: 454657 - DNA, 21 bp, Homo sapiens
tattttcaacgcagccctgct

SEQ ID NO: 454658 - DNA, 14 bp, Homo sapiens
tattttcgtttggg

SEQ ID NO: 454659 - DNA, 20 bp, Homo sapiens
tattttctgaattcataaaa

SEQ ID NO: 454660 - DNA, 12 bp, Homo sapiens
tcaaaatacttc

SEQ ID NO: 454661 - DNA, 19 bp, Homo sapiens
tcaaaatacttctttttca

SEQ ID NO: 454662 - DNA, 21 bp, Homo sapiens
tcaaaatacttctttttcatt

SEQ ID NO: 454663 - DNA, 16 bp, Homo sapiens
tcaaaatagttctatt

SEQ ID NO: 454664 - DNA, 17 bp, Homo sapiens
tcaaaatagttctattt

SEQ ID NO: 454665 - DNA, 18 bp, Homo sapiens
tcaaaatagttctatttc

SEQ ID NO: 454666 - DNA, 22 bp, Homo sapiens
tcaaaatagttctatttctatc

SEQ ID NO: 454667 - DNA, 18 bp, Homo sapiens
tcaaaatatcaagtgttg

SEQ ID NO: 454668 - DNA, 14 bp, Homo sapiens
tcaaaatgcatgtg

SEQ ID NO: 454669 - DNA, 16 bp, Homo sapiens
tcaaaatgcatgtgat

SEQ ID NO: 454670 - DNA, 15 bp, Homo sapiens
tcaaagaacccccct

SEQ ID NO: 454671 - DNA, 16 bp, Homo sapiens
tcaaatagcctttctt

SEQ ID NO: 454672 - DNA, 10 bp, Homo sapiens
tcaaatgcat

SEQ ID NO: 454673 - DNA, 20 bp, Homo sapiens
tcaaatgcatgatattgtat

SEQ ID NO: 454674 - DNA, 16 bp, Homo sapiens
tcaacacttattttct

SEQ ID NO: 454675 - DNA, 19 bp, Homo sapiens
tcaacacttattttctgaa

SEQ ID NO: 454676 - DNA, 20 bp, Homo sapiens
tcaacacttattttctgaat

SEQ ID NO: 454677 - DNA, 16 bp, Homo sapiens
tcaacagcatgtctac

SEQ ID NO: 454678 - DNA, 19 bp, Homo sapiens
tcaacctggtggcaccaga

SEQ ID NO: 454679 - DNA, 18 bp, Homo sapiens
tcaacgcagccctgcttt

SEQ ID NO: 454680 - DNA, 21 bp, Homo sapiens
tcaagagggcactggtggccc

SEQ ID NO: 454681 - DNA, 13 bp, Homo sapiens
tcaagccaggaga

SEQ ID NO: 454682 - DNA, 19 bp, Homo sapiens
tcaagccaggagaccctgt

SEQ ID NO: 454683 - DNA, 15 bp, Homo sapiens
tcaagcctgtgaata

SEQ ID NO: 454684 - DNA, 14 bp, Homo sapiens
tcaataaaggtcat

SEQ ID NO: 454685 - DNA, 15 bp, Homo sapiens
tcaatacttttgtgt

SEQ ID NO: 454686 - DNA, 22 bp, Homo sapiens
tcaatctgtgaagcctttatct

SEQ ID NO: 454687 - DNA, 14 bp, Homo sapiens
tcaatgacctgtat

SEQ ID NO: 454688 - DNA, 15 bp, Homo sapiens
tcaatgacctgtatt

SEQ ID NO: 454689 - DNA, 16 bp, Homo sapiens
tcaatgcatacaataa

SEQ ID NO: 454690 - DNA, 17 bp, Homo sapiens
tcaatgcatacaataaa

SEQ ID NO: 454691 - DNA, 14 bp, Homo sapiens
tcaatgtactgtat

SEQ ID NO: 454692 - DNA, 21 bp, Homo sapiens
tcaatgtactgtattgggacg

SEQ ID NO: 454693 - DNA, 21 bp, Homo sapiens
tcaatgtgaaataaagagttc

SEQ ID NO: 454694 - DNA, 13 bp, Homo sapiens
tcaatttaaagga

SEQ ID NO: 454695 - DNA, 17 bp, Homo sapiens
tcaatttaaaggaaagt

SEQ ID NO: 454696 - DNA, 22 bp, Homo sapiens
tcacacacacacaatggcaagc

SEQ ID NO: 454697 - DNA, 16 bp, Homo sapiens
tcacactctcttctta

SEQ ID NO: 454698 - DNA, 21 bp, Homo sapiens
tcacagaacccttggagccaa

SEQ ID NO: 454699 - DNA, 19 bp, Homo sapiens
tcacatgtcctattactga

SEQ ID NO: 454700 - DNA, 17 bp, Homo sapiens
tcaccatgttgccaatc

SEQ ID NO: 454701 - DNA, 19 bp, Homo sapiens
tcaccttccctagttcttt

SEQ ID NO: 454702 - DNA, 20 bp, Homo sapiens
tcacgattcttaccctttct

SEQ ID NO: 454703 - DNA, 22 bp, Homo sapiens
tcacgctgacagcctcctaggc

SEQ ID NO: 454704 - DNA, 14 bp, Homo sapiens
tcacgggcccgctc

SEQ ID NO: 454705 - DNA, 14 bp, Homo sapiens
tcacgtctgtgagt

SEQ ID NO: 454706 - DNA, 17 bp, Homo sapiens
tcactatggtatgctgg

SEQ ID NO: 454707 - DNA, 21 bp, Homo sapiens
tcactatggtatgctggccag

SEQ ID NO: 454708 - DNA, 12 bp, Homo sapiens
tcactcataaag

SEQ ID NO: 454709 - DNA, 14 bp, Homo sapiens
tcactccactcccc

SEQ ID NO: 454710 - DNA, 16 bp, Homo sapiens
tcactccactcccctc

SEQ ID NO: 454711 - DNA, 18 bp, Homo sapiens
tcactccactcccctcat

SEQ ID NO: 454712 - DNA, 20 bp, Homo sapiens
tcactccctttgtggacttt

SEQ ID NO: 454713 - DNA, 23 bp, Homo sapiens
tcactccctttgtggactttatt

SEQ ID NO: 454714 - DNA, 15 bp, Homo sapiens
tcactgcacagtgca

SEQ ID NO: 454715 - DNA, 13 bp, Homo sapiens
tcactgctggctg

SEQ ID NO: 454716 - DNA, 11 bp, Homo sapiens
tcactgctttg

SEQ ID NO: 454717 - DNA, 14 bp, Homo sapiens
tcactggtgcattt

SEQ ID NO: 454718 - DNA, 22 bp, Homo sapiens
tcactggtgcatttaaaatgga

SEQ ID NO: 454719 - DNA, 17 bp, Homo sapiens
tcacttaaactttgtca

SEQ ID NO: 454720 - DNA, 17 bp, Homo sapiens
tcacttctatttattta

SEQ ID NO: 454721 - DNA, 17 bp, Homo sapiens
tcacttttttataaatt

SEQ ID NO: 454722 - DNA, 21 bp, Homo sapiens
tcacttttttataaattataa

SEQ ID NO: 454723 - DNA, 19 bp, Homo sapiens
tcagaaagggcagcccctc

SEQ ID NO: 454724 - DNA, 22 bp, Homo sapiens
tcagaaagggcagcccctcccc

SEQ ID NO: 454725 - DNA, 16 bp, Homo sapiens
tcagaactcctttcta

SEQ ID NO: 454726 - DNA, 20 bp, Homo sapiens
tcagaactcctttctaagga

SEQ ID NO: 454727 - DNA, 16 bp, Homo sapiens
tcagactctctcctct

SEQ ID NO: 454728 - DNA, 20 bp, Homo sapiens
tcagactctttagttgattt

SEQ ID NO: 454729 - DNA, 17 bp, Homo sapiens
tcagagttgctttaaag

SEQ ID NO: 454730 - DNA, 17 bp, Homo sapiens
tcagatgatctctccac

SEQ ID NO: 454731 - DNA, 15 bp, Homo sapiens
tcagcaaattcttga

SEQ ID NO: 454732 - DNA, 16 bp, Homo sapiens
tcagcatagagctata

SEQ ID NO: 454733 - DNA, 17 bp, Homo sapiens
tcagccagccgccctgg

SEQ ID NO: 454734 - DNA, 19 bp, Homo sapiens
tcagccagccgccctgggc

SEQ ID NO: 454735 - DNA, 18 bp, Homo sapiens
tcagccctccctgcccct

SEQ ID NO: 454736 - DNA, 14 bp, Homo sapiens
tcagctccactctg

SEQ ID NO: 454737 - DNA, 15 bp, Homo sapiens
tcagctccactctga

SEQ ID NO: 454738 - DNA, 15 bp, Homo sapiens
tcagctctaaagcag

SEQ ID NO: 454739 - DNA, 20 bp, Homo sapiens
tcagctctaaagcagagatg

SEQ ID NO: 454740 - DNA, 14 bp, Homo sapiens
tcagcttgaatgtc

SEQ ID NO: 454741 - DNA, 16 bp, Homo sapiens
tcagcttgtttctata

SEQ ID NO: 454742 - DNA, 16 bp, Homo sapiens
tcaggaatgggccaag

SEQ ID NO: 454743 - DNA, 22 bp, Homo sapiens
tcaggagaaggcctgcccccct

SEQ ID NO: 454744 - DNA, 22 bp, Homo sapiens
tcaggatgggaagaaaaaggaa

SEQ ID NO: 454745 - DNA, 16 bp, Homo sapiens
tcaggctcttctcctt

SEQ ID NO: 454746 - DNA, 12 bp, Homo sapiens
tcaggctttcta

SEQ ID NO: 454747 - DNA, 13 bp, Homo sapiens
tcaggtgaataac

SEQ ID NO: 454748 - DNA, 17 bp, Homo sapiens
tcaggttcctcctaggc

SEQ ID NO: 454749 - DNA, 22 bp, Homo sapiens
tcaggttcctcctaggcgctca

SEQ ID NO: 454750 - DNA, 13 bp, Homo sapiens
tcagtacagggca

SEQ ID NO: 454751 - DNA, 21 bp, Homo sapiens
tcagtaggtctgaaggcctcc

SEQ ID NO: 454752 - DNA, 18 bp, Homo sapiens
tcagtagtgcctgtgatc

SEQ ID NO: 454753 - DNA, 13 bp, Homo sapiens
tcagttattaaat

SEQ ID NO: 454754 - DNA, 16 bp, Homo sapiens
tcagttctcatcttgt

SEQ ID NO: 454755 - DNA, 13 bp, Homo sapiens
tcataaaaataac

SEQ ID NO: 454756 - DNA, 14 bp, Homo sapiens
tcataaaaataacc

SEQ ID NO: 454757 - DNA, 17 bp, Homo sapiens
tcataaaaataaccaaa

SEQ ID NO: 454758 - DNA, 21 bp, Homo sapiens
tcatacaaaggacagtacaca

SEQ ID NO: 454759 - DNA, 14 bp, Homo sapiens
tcatactcaaagag

SEQ ID NO: 454760 - DNA, 13 bp, Homo sapiens
tcatactctgtgt

SEQ ID NO: 454761 - DNA, 21 bp, Homo sapiens
tcatacttgctccttgaataa

SEQ ID NO: 454762 - DNA, 15 bp, Homo sapiens
tcatataatttgcca

SEQ ID NO: 454763 - DNA, 22 bp, Homo sapiens
tcatccagtttgttctccgggt

SEQ ID NO: 454764 - DNA, 14 bp, Homo sapiens
tcatcggaggctgg

SEQ ID NO: 454765 - DNA, 17 bp, Homo sapiens
tcatctcaaacactgct

SEQ ID NO: 454766 - DNA, 20 bp, Homo sapiens
tcatctcaaacactgcttaa

SEQ ID NO: 454767 - DNA, 21 bp, Homo sapiens
tcatctctctggggccctggg

SEQ ID NO: 454768 - DNA, 13 bp, Homo sapiens
tcatcttgtaaat

SEQ ID NO: 454769 - DNA, 21 bp, Homo sapiens
tcatcttgtaaataatgctta

SEQ ID NO: 454770 - DNA, 21 bp, Homo sapiens
tcatgaatcactgcacctctt

SEQ ID NO: 454771 - DNA, 15 bp, Homo sapiens
tcatgtgttgcaaat

SEQ ID NO: 454772 - DNA, 14 bp, Homo sapiens
tcatgtttaagaaa

SEQ ID NO: 454773 - DNA, 17 bp, Homo sapiens
tcattacagatttagtt

SEQ ID NO: 454774 - DNA, 16 bp, Homo sapiens
tcattcatactcaaag

SEQ ID NO: 454775 - DNA, 23 bp, Homo sapiens
tcattcttttcagcttgtttcta

SEQ ID NO: 454776 - DNA, 18 bp, Homo sapiens
tcattgagaaataaagca

SEQ ID NO: 454777 - DNA, 12 bp, Homo sapiens
tcatttatctta

SEQ ID NO: 454778 - DNA, 22 bp, Homo sapiens
tcatttccaccaagggtatctg

SEQ ID NO: 454779 - DNA, 21 bp, Homo sapiens
tccaaaatagtcatgtttctg

SEQ ID NO: 454780 - DNA, 22 bp, Homo sapiens
tccaaataaaacttgagcccac

SEQ ID NO: 454781 - DNA, 16 bp, Homo sapiens
tccaacagacaccctc

SEQ ID NO: 454782 - DNA, 21 bp, Homo sapiens
tccaacagacaccctccactc

SEQ ID NO: 454783 - DNA, 18 bp, Homo sapiens
tccaacccaggtctgctt

SEQ ID NO: 454784 - DNA, 18 bp, Homo sapiens
tccaagtgtgtgtgcaat

SEQ ID NO: 454785 - DNA, 20 bp, Homo sapiens
tccaagtgtgtgtgcaatgt

SEQ ID NO: 454786 - DNA, 16 bp, Homo sapiens
tccaagttcattcata

SEQ ID NO: 454787 - DNA, 18 bp, Homo sapiens
tccaatcccaccaaccct

SEQ ID NO: 454788 - DNA, 21 bp, Homo sapiens
tccacacctccacccgtcctg

SEQ ID NO: 454789 - DNA, 17 bp, Homo sapiens
tccacagaacctttgtc

SEQ ID NO: 454790 - DNA, 18 bp, Homo sapiens
tccacagaacctttgtca

SEQ ID NO: 454791 - DNA, 22 bp, Homo sapiens
tccacaggacacgaaggctgcc

SEQ ID NO: 454792 - DNA, 21 bp, Homo sapiens
tccacatccccaccctcccct

SEQ ID NO: 454793 - DNA, 13 bp, Homo sapiens
tccacccagaccc

SEQ ID NO: 454794 - DNA, 13 bp, Homo sapiens
tccacccagaggt

SEQ ID NO: 454795 - DNA, 22 bp, Homo sapiens
tccaccccggctccccctgcca

SEQ ID NO: 454796 - DNA, 15 bp, Homo sapiens
tccaccgccacccca

SEQ ID NO: 454797 - DNA, 14 bp, Homo sapiens
tccacctgtgctgc

SEQ ID NO: 454798 - DNA, 20 bp, Homo sapiens
tccacgcctcctggccagac

SEQ ID NO: 454799 - DNA, 16 bp, Homo sapiens
tccactcccctcatcc

SEQ ID NO: 454800 - DNA, 9 bp, Homo sapiens
tccactcct

SEQ ID NO: 454801 - DNA, 21 bp, Homo sapiens
tccactctgaggtctcacctt

SEQ ID NO: 454802 - DNA, 23 bp, Homo sapiens
tccactctgaggtctcaccttcg

SEQ ID NO: 454803 - DNA, 13 bp, Homo sapiens
tccactttcctct

SEQ ID NO: 454804 - DNA, 15 bp, Homo sapiens
tccactttcctctct

SEQ ID NO: 454805 - DNA, 16 bp, Homo sapiens
tccagaacaaaagata

SEQ ID NO: 454806 - DNA, 21 bp, Homo sapiens
tccagaacaaaagataaaact

SEQ ID NO: 454807 - DNA, 10 bp, Homo sapiens
tccagacaga

SEQ ID NO: 454808 - DNA, 22 bp, Homo sapiens
tccagacagagtggatctggag

SEQ ID NO: 454809 - DNA, 11 bp, Homo sapiens
tccagacccct

SEQ ID NO: 454810 - DNA, 22 bp, Homo sapiens
tccagacccctaccctttccca

SEQ ID NO: 454811 - DNA, 13 bp, Homo sapiens
tccagacccctgg

SEQ ID NO: 454812 - DNA, 16 bp, Homo sapiens
tccagacccctggctt

SEQ ID NO: 454813 - DNA, 18 bp, Homo sapiens
tccagagagaagcacccc

SEQ ID NO: 454814 - DNA, 15 bp, Homo sapiens
tccagagagtggctc

SEQ ID NO: 454815 - DNA, 14 bp, Homo sapiens
tccagcaatgcctg

SEQ ID NO: 454816 - DNA, 18 bp, Homo sapiens
tccagcagtgctgggccc

SEQ ID NO: 454817 - DNA, 20 bp, Homo sapiens
tccagcagtgctgggcccag

SEQ ID NO: 454818 - DNA, 21 bp, Homo sapiens
tccagcagtgctgggcccagc

SEQ ID NO: 454819 - DNA, 23 bp, Homo sapiens
tccagcagtgctgggcccagccg

SEQ ID NO: 454820 - DNA, 18 bp, Homo sapiens
tccaggaggactgttcta

SEQ ID NO: 454821 - DNA, 21 bp, Homo sapiens
tccaggaggactgttctaact

SEQ ID NO: 454822 - DNA, 13 bp, Homo sapiens
tccaggctggggc

SEQ ID NO: 454823 - DNA, 15 bp, Homo sapiens
tccaggctggggcct

SEQ ID NO: 454824 - DNA, 16 bp, Homo sapiens
tccaggctggggcctg

SEQ ID NO: 454825 - DNA, 17 bp, Homo sapiens
tccaggctggggcctgg

SEQ ID NO: 454826 - DNA, 20 bp, Homo sapiens
tccaggctggggcctggcct

SEQ ID NO: 454827 - DNA, 19 bp, Homo sapiens
tccagtttgttctccgggt

SEQ ID NO: 454828 - DNA, 15 bp, Homo sapiens
tccatagacacagta

SEQ ID NO: 454829 - DNA, 23 bp, Homo sapiens
tccatagacacagtattgacttc

SEQ ID NO: 454830 - DNA, 15 bp, Homo sapiens
tccatatcagctctg

SEQ ID NO: 454831 - DNA, 14 bp, Homo sapiens
tccatcctgaggac

SEQ ID NO: 454832 - DNA, 13 bp, Homo sapiens
tccatggtggttt

SEQ ID NO: 454833 - DNA, 18 bp, Homo sapiens
tccatggtggtttcagaa

SEQ ID NO: 454834 - DNA, 16 bp, Homo sapiens
tccatgtgaaatttac

SEQ ID NO: 454835 - DNA, 12 bp, Homo sapiens
tccattctatga

SEQ ID NO: 454836 - DNA, 23 bp, Homo sapiens
tccatttgtaccgaaacaccccg

SEQ ID NO: 454837 - DNA, 11 bp, Homo sapiens
tccattttcta

SEQ ID NO: 454838 - DNA, 15 bp, Homo sapiens
tccattttggaaaat

SEQ ID NO: 454839 - DNA, 15 bp, Homo sapiens
tcccaactctggcct

SEQ ID NO: 454840 - DNA, 14 bp, Homo sapiens
tcccaagtcaaaca

SEQ ID NO: 454841 - DNA, 18 bp, Homo sapiens
tcccaagtcaaacagtgt

SEQ ID NO: 454842 - DNA, 20 bp, Homo sapiens
tcccaagtcaaacagtgtgg

SEQ ID NO: 454843 - DNA, 21 bp, Homo sapiens
tcccaagtcaaacagtgtggc

SEQ ID NO: 454844 - DNA, 12 bp, Homo sapiens
tcccacaaaata

SEQ ID NO: 454845 - DNA, 13 bp, Homo sapiens
tcccacaaaatat

SEQ ID NO: 454846 - DNA, 15 bp, Homo sapiens
tcccacctctttgga

SEQ ID NO: 454847 - DNA, 21 bp, Homo sapiens
tcccactgatatcacgggccc

SEQ ID NO: 454848 - DNA, 21 bp, Homo sapiens
tcccagcacctggcacaccag

SEQ ID NO: 454849 - DNA, 20 bp, Homo sapiens
tcccagctggcagcgcctcc

SEQ ID NO: 454850 - DNA, 18 bp, Homo sapiens
tcccaggcgccccttccc

SEQ ID NO: 454851 - DNA, 18 bp, Homo sapiens
tcccatgcataacacact

SEQ ID NO: 454852 - DNA, 11 bp, Homo sapiens
tccccacccca

SEQ ID NO: 454853 - DNA, 18 bp, Homo sapiens
tccccaccctcccctctc

SEQ ID NO: 454854 - DNA, 21 bp, Homo sapiens
tccccaccctcccctctcctg

SEQ ID NO: 454855 - DNA, 22 bp, Homo sapiens
tccccaccctcccctctcctga

SEQ ID NO: 454856 - DNA, 17 bp, Homo sapiens
tccccatatataaatta

SEQ ID NO: 454857 - DNA, 19 bp, Homo sapiens
tccccatatataaattatt

SEQ ID NO: 454858 - DNA, 22 bp, Homo sapiens
tccccatatataaattattact

SEQ ID NO: 454859 - DNA, 20 bp, Homo sapiens
tccccatggtgcagtgaaga

SEQ ID NO: 454860 - DNA, 22 bp, Homo sapiens
tccccatgtgcctgcaccagga

SEQ ID NO: 454861 - DNA, 17 bp, Homo sapiens
tcccccacggccgtccc

SEQ ID NO: 454862 - DNA, 20 bp, Homo sapiens
tcccccacggccgtccctga

SEQ ID NO: 454863 - DNA, 13 bp, Homo sapiens
tcccccaggctgc

SEQ ID NO: 454864 - DNA, 17 bp, Homo sapiens
tcccccaggctgcgcct

SEQ ID NO: 454865 - DNA, 19 bp, Homo sapiens
tcccccaggctgcgcctgc

SEQ ID NO: 454866 - DNA, 13 bp, Homo sapiens
tccccccacccct

SEQ ID NO: 454867 - DNA, 18 bp, Homo sapiens
tccccccacccctcccca

SEQ ID NO: 454868 - DNA, 12 bp, Homo sapiens
tccccctgccag

SEQ ID NO: 454869 - DNA, 10 bp, Homo sapiens
tcccccttcc

SEQ ID NO: 454870 - DNA, 19 bp, Homo sapiens
tcccccttcccgccttcag

SEQ ID NO: 454871 - DNA, 15 bp, Homo sapiens
tccccgcagccctct

SEQ ID NO: 454872 - DNA, 19 bp, Homo sapiens
tccccgcagccctctccac

SEQ ID NO: 454873 - DNA, 22 bp, Homo sapiens
tccccgcagccctctccaccca

SEQ ID NO: 454874 - DNA, 16 bp, Homo sapiens
tccccgcccgccctcc

SEQ ID NO: 454875 - DNA, 19 bp, Homo sapiens
tccccgcccgccctcctct

SEQ ID NO: 454876 - DNA, 23 bp, Homo sapiens
tccccgcccgccctcctctgccc

SEQ ID NO: 454877 - DNA, 17 bp, Homo sapiens
tcccctaacctgggttg

SEQ ID NO: 454878 - DNA, 22 bp, Homo sapiens
tcccctcactctgtcagccagc

SEQ ID NO: 454879 - DNA, 20 bp, Homo sapiens
tcccctgcgccctccctccc

SEQ ID NO: 454880 - DNA, 15 bp, Homo sapiens
tcccgcagcaccagc

SEQ ID NO: 454881 - DNA, 13 bp, Homo sapiens
tcccgccgcctcg

SEQ ID NO: 454882 - DNA, 22 bp, Homo sapiens
tcccgccgcctcgggccgcctc

SEQ ID NO: 454883 - DNA, 13 bp, Homo sapiens
tcccgctcagccc

SEQ ID NO: 454884 - DNA, 14 bp, Homo sapiens
tcccggagctcaag

SEQ ID NO: 454885 - DNA, 15 bp, Homo sapiens
tcccggccccgcgcg

SEQ ID NO: 454886 - DNA, 19 bp, Homo sapiens
tcccggccccgcgcgtgcc

SEQ ID NO: 454887 - DNA, 14 bp, Homo sapiens
tcccgtccgtccgc

SEQ ID NO: 454888 - DNA, 23 bp, Homo sapiens
tcccgtccgtccgcccgcccacc

SEQ ID NO: 454889 - DNA, 15 bp, Homo sapiens
tccctataccgagac

SEQ ID NO: 454890 - DNA, 18 bp, Homo sapiens
tccctataccgagaccca

SEQ ID NO: 454891 - DNA, 22 bp, Homo sapiens
tccctccacacctccacccgtc

SEQ ID NO: 454892 - DNA, 17 bp, Homo sapiens
tccctccactcctccca

SEQ ID NO: 454893 - DNA, 13 bp, Homo sapiens
tccctccctccac

SEQ ID NO: 454894 - DNA, 16 bp, Homo sapiens
tccctccctccacacc

SEQ ID NO: 454895 - DNA, 12 bp, Homo sapiens
tccctcggtcag

SEQ ID NO: 454896 - DNA, 18 bp, Homo sapiens
tccctcggtcagcaccgt

SEQ ID NO: 454897 - DNA, 17 bp, Homo sapiens
tccctgactccctgtgg

SEQ ID NO: 454898 - DNA, 21 bp, Homo sapiens
tccctgcatcccttggcccct

SEQ ID NO: 454899 - DNA, 19 bp, Homo sapiens
tccctgcccctcccttcaa

SEQ ID NO: 454900 - DNA, 20 bp, Homo sapiens
tccctgcttcacgattctta

SEQ ID NO: 454901 - DNA, 13 bp, Homo sapiens
tccctgtcatagt

SEQ ID NO: 454902 - DNA, 16 bp, Homo sapiens
tccctgtgggggtggc

SEQ ID NO: 454903 - DNA, 19 bp, Homo sapiens
tccctgtgggggtggccat

SEQ ID NO: 454904 - DNA, 23 bp, Homo sapiens
tccctgtgggggtggccatccct

SEQ ID NO: 454905 - DNA, 11 bp, Homo sapiens
tcccttcaacc

SEQ ID NO: 454906 - DNA, 22 bp, Homo sapiens
tcccttcaaccattccccatgg

SEQ ID NO: 454907 - DNA, 15 bp, Homo sapiens
tcccttcctgtcctg

SEQ ID NO: 454908 - DNA, 19 bp, Homo sapiens
tcccttcctgtcctgctca

SEQ ID NO: 454909 - DNA, 13 bp, Homo sapiens
tcccttggcccct

SEQ ID NO: 454910 - DNA, 20 bp, Homo sapiens
tccctttccctgcatccctt

SEQ ID NO: 454911 - DNA, 19 bp, Homo sapiens
tccctttgtggactttatt

SEQ ID NO: 454912 - DNA, 15 bp, Homo sapiens
tccgcccagcctctc

SEQ ID NO: 454913 - DNA, 12 bp, Homo sapiens
tccgcccgccca

SEQ ID NO: 454914 - DNA, 14 bp, Homo sapiens
tccgcccgcccacc

SEQ ID NO: 454915 - DNA, 15 bp, Homo sapiens
tccgcccgcccaccc

SEQ ID NO: 454916 - DNA, 16 bp, Homo sapiens
tccggaacagccaaag

SEQ ID NO: 454917 - DNA, 20 bp, Homo sapiens
tccggaacagccaaagaaac

SEQ ID NO: 454918 - DNA, 12 bp, Homo sapiens
tccggcagaggc

SEQ ID NO: 454919 - DNA, 14 bp, Homo sapiens
tccggcagaggcag

SEQ ID NO: 454920 - DNA, 16 bp, Homo sapiens
tccggcagaggcaggg

SEQ ID NO: 454921 - DNA, 17 bp, Homo sapiens
tccggcagaggcagggc

SEQ ID NO: 454922 - DNA, 13 bp, Homo sapiens
tccggcctgcagc

SEQ ID NO: 454923 - DNA, 22 bp, Homo sapiens
tccgggtgtggcctcagccctc

SEQ ID NO: 454924 - DNA, 15 bp, Homo sapiens
tccgtccgcccgccc

SEQ ID NO: 454925 - DNA, 17 bp, Homo sapiens
tccgtccgcccgcccac

SEQ ID NO: 454926 - DNA, 15 bp, Homo sapiens
tccgtgagacacaag

SEQ ID NO: 454927 - DNA, 16 bp, Homo sapiens
tccgtgagacacaaga

SEQ ID NO: 454928 - DNA, 22 bp, Homo sapiens
tccgttcatctgaggagtccaa

SEQ ID NO: 454929 - DNA, 23 bp, Homo sapiens
tcctaaataatatcctgaataac

SEQ ID NO: 454930 - DNA, 15 bp, Homo sapiens
tcctaccattatggc

SEQ ID NO: 454931 - DNA, 14 bp, Homo sapiens
tcctaggctccctg

SEQ ID NO: 454932 - DNA, 13 bp, Homo sapiens
tcctatactggtt

SEQ ID NO: 454933 - DNA, 19 bp, Homo sapiens
tcctattactgatgtgtgc

SEQ ID NO: 454934 - DNA, 14 bp, Homo sapiens
tcctattctattgc

SEQ ID NO: 454935 - DNA, 18 bp, Homo sapiens
tcctcaccttctgtttta

SEQ ID NO: 454936 - DNA, 16 bp, Homo sapiens
tcctcaggtgaataac

SEQ ID NO: 454937 - DNA, 12 bp, Homo sapiens
tcctccagggcg

SEQ ID NO: 454938 - DNA, 16 bp, Homo sapiens
tcctccattgtatctt

SEQ ID NO: 454939 - DNA, 21 bp, Homo sapiens
tcctcctaggcgctcagaggc

SEQ ID NO: 454940 - DNA, 22 bp, Homo sapiens
tcctcctaggcgctcagaggcc

SEQ ID NO: 454941 - DNA, 21 bp, Homo sapiens
tcctcgtccggcctgcagccc

SEQ ID NO: 454942 - DNA, 16 bp, Homo sapiens
tcctctcgagcccaga

SEQ ID NO: 454943 - DNA, 18 bp, Homo sapiens
tcctctcgagcccagatg

SEQ ID NO: 454944 - DNA, 14 bp, Homo sapiens
tcctctctctccct

SEQ ID NO: 454945 - DNA, 15 bp, Homo sapiens
tcctctctctccctc

SEQ ID NO: 454946 - DNA, 17 bp, Homo sapiens
tcctctctctccctcca

SEQ ID NO: 454947 - DNA, 17 bp, Homo sapiens
tcctctgcagcctgagc

SEQ ID NO: 454948 - DNA, 18 bp, Homo sapiens
tcctctgcagcctgagct

SEQ ID NO: 454949 - DNA, 12 bp, Homo sapiens
tcctctgccttg

SEQ ID NO: 454950 - DNA, 15 bp, Homo sapiens
tcctctgccttggac

SEQ ID NO: 454951 - DNA, 17 bp, Homo sapiens
tcctctgccttggacac

SEQ ID NO: 454952 - DNA, 16 bp, Homo sapiens
tcctctgctccaacag

SEQ ID NO: 454953 - DNA, 22 bp, Homo sapiens
tcctctgctccaacagacaccc

SEQ ID NO: 454954 - DNA, 16 bp, Homo sapiens
tcctctgcttgtcatt

SEQ ID NO: 454955 - DNA, 12 bp, Homo sapiens
tcctcttacctg

SEQ ID NO: 454956 - DNA, 12 bp, Homo sapiens
tcctgaggaccg

SEQ ID NO: 454957 - DNA, 18 bp, Homo sapiens
tcctgataaacattaaac

SEQ ID NO: 454958 - DNA, 14 bp, Homo sapiens
tcctgattattgaa

SEQ ID NO: 454959 - DNA, 21 bp, Homo sapiens
tcctgattattgaatgttata

SEQ ID NO: 454960 - DNA, 12 bp, Homo sapiens
tcctgcaccctc

SEQ ID NO: 454961 - DNA, 13 bp, Homo sapiens
ggcagaggcaggg

SEQ ID NO: 454962 - DNA, 14 bp, Homo sapiens
ggcagaggcagggc

SEQ ID NO: 454963 - DNA, 15 bp, Homo sapiens
ggcagcaccctcccc

SEQ ID NO: 454964 - DNA, 11 bp, Homo sapiens
ggcagccccat

SEQ ID NO: 454965 - DNA, 15 bp, Homo sapiens
ggcagccccatcctt

SEQ ID NO: 454966 - DNA, 13 bp, Homo sapiens
ggcagcccctccc

SEQ ID NO: 454967 - DNA, 15 bp, Homo sapiens
ggcagcccctgctgg

SEQ ID NO: 454968 - DNA, 18 bp, Homo sapiens
ggcagcccctgctggacc

SEQ ID NO: 454969 - DNA, 21 bp, Homo sapiens
ggcagcccctgctggaccaag

SEQ ID NO: 454970 - DNA, 19 bp, Homo sapiens
ggcagccgtgccttcagct

SEQ ID NO: 454971 - DNA, 21 bp, Homo sapiens
ggcagcgcctcccgccgcctc

SEQ ID NO: 454972 - DNA, 22 bp, Homo sapiens
ggcagcgcctcccgccgcctcg

SEQ ID NO: 454973 - DNA, 13 bp, Homo sapiens
ggcaggagctgct

SEQ ID NO: 454974 - DNA, 24 bp, Homo sapiens
tcgcatccaccgccaccccactga

SEQ ID NO: 454975 - DNA, 11 bp, Homo sapiens
tcggacacagt

SEQ ID NO: 454976 - DNA, 14 bp, Homo sapiens
tcggagccccccac

SEQ ID NO: 454977 - DNA, 15 bp, Homo sapiens
tcggaggctgggccc

SEQ ID NO: 454978 - DNA, 18 bp, Homo sapiens
tcggaggctgggcccctg

SEQ ID NO: 454979 - DNA, 21 bp, Homo sapiens
tcggaggctgggcccctggga

SEQ ID NO: 454980 - DNA, 14 bp, Homo sapiens
tcggcaccttcccc

SEQ ID NO: 454981 - DNA, 24 bp, Homo sapiens
tcggccccacccaccctctggtcc

SEQ ID NO: 454982 - DNA, 16 bp, Homo sapiens
tcggctgggcagggcc

SEQ ID NO: 454983 - DNA, 20 bp, Homo sapiens
tcgggaaggcctgagggaag

SEQ ID NO: 454984 - DNA, 21 bp, Homo sapiens
tcgggaaggcctgagggaagc

SEQ ID NO: 454985 - DNA, 20 bp, Homo sapiens
tcgggccgcctcctccagac

SEQ ID NO: 454986 - DNA, 22 bp, Homo sapiens
tcgggcgcctgcgctcctctgc

SEQ ID NO: 454987 - DNA, 11 bp, Homo sapiens
tcgggggagga

SEQ ID NO: 454988 - DNA, 14 bp, Homo sapiens
tcgggggaggagca

SEQ ID NO: 454989 - DNA, 21 bp, Homo sapiens
tcgggggaggagcacccccag

SEQ ID NO: 454990 - DNA, 22 bp, Homo sapiens
tcgggggaggagcacccccagc

SEQ ID NO: 454991 - DNA, 13 bp, Homo sapiens
tcggtcagcaccg

SEQ ID NO: 454992 - DNA, 19 bp, Homo sapiens
tcgtccggcctgcagccca

SEQ ID NO: 454993 - DNA, 16 bp, Homo sapiens
tcgtctccctggccac

SEQ ID NO: 454994 - DNA, 17 bp, Homo sapiens
tcgtgccatgatctgta

SEQ ID NO: 454995 - DNA, 18 bp, Homo sapiens
tcgtgccatgatctgtat

SEQ ID NO: 454996 - DNA, 16 bp, Homo sapiens
tcgtttcacatctgta

SEQ ID NO: 454997 - DNA, 17 bp, Homo sapiens
tctaaaaaataactgtg

SEQ ID NO: 454998 - DNA, 12 bp, Homo sapiens
tctaaactgttt

SEQ ID NO: 454999 - DNA, 21 bp, Homo sapiens
tctaagaaatggctttccaca

SEQ ID NO: 455000 - DNA, 18 bp, Homo sapiens
tctaagcttatttctaac

SEQ ID NO: 455001 - DNA, 15 bp, Homo sapiens
tctaattcaactctg

SEQ ID NO: 455002 - DNA, 15 bp, Homo sapiens
tctacccccaacacc

SEQ ID NO: 455003 - DNA, 16 bp, Homo sapiens
tctacccccaacacca

SEQ ID NO: 455004 - DNA, 21 bp, Homo sapiens
tctactatttgaaaaaagaag

SEQ ID NO: 455005 - DNA, 16 bp, Homo sapiens
tctagcaaacagatgt

SEQ ID NO: 455006 - DNA, 18 bp, Homo sapiens
tctagcaagaagattcta

SEQ ID NO: 455007 - DNA, 21 bp, Homo sapiens
tctagcaagaagattctaaaa

SEQ ID NO: 455008 - DNA, 21 bp, Homo sapiens
tctagctataacaactctatt

SEQ ID NO: 455009 - DNA, 15 bp, Homo sapiens
tctagtcaactgctg

SEQ ID NO: 455010 - DNA, 19 bp, Homo sapiens
tctagtcctattctattgc

SEQ ID NO: 455011 - DNA, 15 bp, Homo sapiens
tctagtttgcatact

SEQ ID NO: 455012 - DNA, 20 bp, Homo sapiens
tctagtttgcatacttcctg

SEQ ID NO: 455013 - DNA, 12 bp, Homo sapiens
tctatactgttt

SEQ ID NO: 455014 - DNA, 13 bp, Homo sapiens
tctatatttcata

SEQ ID NO: 455015 - DNA, 14 bp, Homo sapiens
tctatatttcatat

SEQ ID NO: 455016 - DNA, 16 bp, Homo sapiens
tctatggattcacttc

SEQ ID NO: 455017 - DNA, 23 bp, Homo sapiens
tctatgggagattaaaaccagag

SEQ ID NO: 455018 - DNA, 19 bp, Homo sapiens
tctatgtagaactgttcat

SEQ ID NO: 455019 - DNA, 21 bp, Homo sapiens
tctattatctgggttttagaa

SEQ ID NO: 455020 - DNA, 23 bp, Homo sapiens
tctattgcagttatagaaaatct

SEQ ID NO: 455021 - DNA, 18 bp, Homo sapiens
tctattgtagcatttctt

SEQ ID NO: 455022 - DNA, 16 bp, Homo sapiens
tctatttatctgtctg

SEQ ID NO: 455023 - DNA, 14 bp, Homo sapiens
tctattttttacta

SEQ ID NO: 455024 - DNA, 17 bp, Homo sapiens
tctcaaacactgcttaa

SEQ ID NO: 455025 - DNA, 17 bp, Homo sapiens
tctcaagagggcactgg

SEQ ID NO: 455026 - DNA, 20 bp, Homo sapiens
tctcaagcgctatccacaga

SEQ ID NO: 455027 - DNA, 15 bp, Homo sapiens
tctcactccctttgt

SEQ ID NO: 455028 - DNA, 22 bp, Homo sapiens
tctcactccctttgtggacttt

SEQ ID NO: 455029 - DNA, 23 bp, Homo sapiens
tctcactccctttgtggacttta

SEQ ID NO: 455030 - DNA, 16 bp, Homo sapiens
tctcactcctacctgg

SEQ ID NO: 455031 - DNA, 18 bp, Homo sapiens
tctcactcctacctggta

SEQ ID NO: 455032 - DNA, 15 bp, Homo sapiens
tctcacttttttata

SEQ ID NO: 455033 - DNA, 16 bp, Homo sapiens
tctcagctccactctg

SEQ ID NO: 455034 - DNA, 12 bp, Homo sapiens
tctcattcttgc

SEQ ID NO: 455035 - DNA, 20 bp, Homo sapiens
tctcattttgcttttctcta

SEQ ID NO: 455036 - DNA, 12 bp, Homo sapiens
tctccacccaga

SEQ ID NO: 455037 - DNA, 14 bp, Homo sapiens
tctccacccctcaa

SEQ ID NO: 455038 - DNA, 20 bp, Homo sapiens
tctccacccctcaagccagg

SEQ ID NO: 455039 - DNA, 20 bp, Homo sapiens
tctccagccaatttcaaaga

SEQ ID NO: 455040 - DNA, 23 bp, Homo sapiens
tctcccaaataaactccttaacc

SEQ ID NO: 455041 - DNA, 19 bp, Homo sapiens
tctctctggggccctgggc

SEQ ID NO: 455042 - DNA, 9 bp, Homo sapiens
tctctctgt

SEQ ID NO: 455043 - DNA, 10 bp, Homo sapiens
tctctctgtt

SEQ ID NO: 455044 - DNA, 15 bp, Homo sapiens
tctctgagcagtggg

SEQ ID NO: 455045 - DNA, 19 bp, Homo sapiens
tctctgagcagtggggagc

SEQ ID NO: 455046 - DNA, 14 bp, Homo sapiens
tctctgattaaatt

SEQ ID NO: 455047 - DNA, 16 bp, Homo sapiens
tctctgatttgcaaat

SEQ ID NO: 455048 - DNA, 20 bp, Homo sapiens
tctctggggccctgggcctc

SEQ ID NO: 455049 - DNA, 22 bp, Homo sapiens
tctctggggccctgggcctcag

SEQ ID NO: 455050 - DNA, 13 bp, Homo sapiens
tctctgtgtggca

SEQ ID NO: 455051 - DNA, 19 bp, Homo sapiens
tctctgtgtggcaaacatt

SEQ ID NO: 455052 - DNA, 14 bp, Homo sapiens
tctctgttccaagt

SEQ ID NO: 455053 - DNA, 18 bp, Homo sapiens
tctctgttccaagtgtgt

SEQ ID NO: 455054 - DNA, 22 bp, Homo sapiens
tctctgttccaagtgtgtgtgc

SEQ ID NO: 455055 - DNA, 17 bp, Homo sapiens
tctctgtttaccctccc

SEQ ID NO: 455056 - DNA, 14 bp, Homo sapiens
tctcttctccactg

SEQ ID NO: 455057 - DNA, 18 bp, Homo sapiens
tctgaaaagaaatgctaa

SEQ ID NO: 455058 - DNA, 19 bp, Homo sapiens
tctgaaactatagaataaa

SEQ ID NO: 455059 - DNA, 15 bp, Homo sapiens
tctgaactttggaag

SEQ ID NO: 455060 - DNA, 16 bp, Homo sapiens
tctgaactttggaagc

SEQ ID NO: 455061 - DNA, 13 bp, Homo sapiens
tctgaaggagagg

SEQ ID NO: 455062 - DNA, 15 bp, Homo sapiens
tctgaaggagaggag

SEQ ID NO: 455063 - DNA, 15 bp, Homo sapiens
tctgaaggcctccat

SEQ ID NO: 455064 - DNA, 19 bp, Homo sapiens
tctgacagtattaacatca

SEQ ID NO: 455065 - DNA, 18 bp, Homo sapiens
tctgaccccacttatgct

SEQ ID NO: 455066 - DNA, 21 bp, Homo sapiens
tctgaccccacttatgctgct

SEQ ID NO: 455067 - DNA, 17 bp, Homo sapiens
tctgagccctgccctca

SEQ ID NO: 455068 - DNA, 12 bp, Homo sapiens
tctgagctgctg

SEQ ID NO: 455069 - DNA, 23 bp, Homo sapiens
tctgaggagtaaaaagactactg

SEQ ID NO: 455070 - DNA, 13 bp, Homo sapiens
tctgaggagtcca

SEQ ID NO: 455071 - DNA, 11 bp, Homo sapiens
tctgaggtctc

SEQ ID NO: 455072 - DNA, 20 bp, Homo sapiens
tctgattggacattttcttc

SEQ ID NO: 455073 - DNA, 23 bp, Homo sapiens
tctgattggacattttcttcaga

SEQ ID NO: 455074 - DNA, 17 bp, Homo sapiens
tctgatttgcaaatgca

SEQ ID NO: 455075 - DNA, 14 bp, Homo sapiens
tctgcagcctgagc

SEQ ID NO: 455076 - DNA, 15 bp, Homo sapiens
tctgcagcctgagct

SEQ ID NO: 455077 - DNA, 24 bp, Homo sapiens
tctgcagcctgagctccaccctcc

SEQ ID NO: 455078 - DNA, 17 bp, Homo sapiens
tctgcagtattctgtag

SEQ ID NO: 455079 - DNA, 13 bp, Homo sapiens
tctgccccctccc

SEQ ID NO: 455080 - DNA, 17 bp, Homo sapiens
tctgccccttgacccca

SEQ ID NO: 455081 - DNA, 23 bp, Homo sapiens
tctgcctcttaacttaaaagaac

SEQ ID NO: 455082 - DNA, 12 bp, Homo sapiens
tctgcctttgag

SEQ ID NO: 455083 - DNA, 13 bp, Homo sapiens
tctgctatgtctg

SEQ ID NO: 455084 - DNA, 22 bp, Homo sapiens
tctgctccaacagacaccctcc

SEQ ID NO: 455085 - DNA, 23 bp, Homo sapiens
tctgctttggggcttatcagaac

SEQ ID NO: 455086 - DNA, 23 bp, Homo sapiens
tctggagcccctatcctgcaccc

SEQ ID NO: 455087 - DNA, 20 bp, Homo sapiens
tctggccttggttcctccag

SEQ ID NO: 455088 - DNA, 21 bp, Homo sapiens
tctggccttggttcctccagc

SEQ ID NO: 455089 - DNA, 21 bp, Homo sapiens
tctggctacgacttgggacgg

SEQ ID NO: 455090 - DNA, 13 bp, Homo sapiens
tctggctgtggcc

SEQ ID NO: 455091 - DNA, 14 bp, Homo sapiens
tctggctgtggccc

SEQ ID NO: 455092 - DNA, 13 bp, Homo sapiens
tctggggccctgg

SEQ ID NO: 455093 - DNA, 20 bp, Homo sapiens
tctggggccctgggcctcag

SEQ ID NO: 455094 - DNA, 19 bp, Homo sapiens
tctgggggactagaacaca

SEQ ID NO: 455095 - DNA, 18 bp, Homo sapiens
tctgggttttagaaattc

SEQ ID NO: 455096 - DNA, 11 bp, Homo sapiens
tctggtccttc

SEQ ID NO: 455097 - DNA, 15 bp, Homo sapiens
tctggtgcgtgtggc

SEQ ID NO: 455098 - DNA, 19 bp, Homo sapiens
tctggtgcgtgtggccctg

SEQ ID NO: 455099 - DNA, 15 bp, Homo sapiens
tctgtaaatttaact

SEQ ID NO: 455100 - DNA, 21 bp, Homo sapiens
tctgtaatcacactctcttct

SEQ ID NO: 455101 - DNA, 23 bp, Homo sapiens
tctgtacttcagttctcatcttg

SEQ ID NO: 455102 - DNA, 18 bp, Homo sapiens
tctgtatttaatggtttt

SEQ ID NO: 455103 - DNA, 20 bp, Homo sapiens
tctgtcaccagctatctgtc

SEQ ID NO: 455104 - DNA, 13 bp, Homo sapiens
tctgtcagccagc

SEQ ID NO: 455105 - DNA, 16 bp, Homo sapiens
tctgtcatctctctgg

SEQ ID NO: 455106 - DNA, 17 bp, Homo sapiens
tctgtcatctctctggg

SEQ ID NO: 455107 - DNA, 23 bp, Homo sapiens
tctgtccccaaaatgtggaatgc

SEQ ID NO: 455108 - DNA, 12 bp, Homo sapiens
tctgtcctttcc

SEQ ID NO: 455109 - DNA, 14 bp, Homo sapiens
tctgtcctttccca

SEQ ID NO: 455110 - DNA, 17 bp, Homo sapiens
tgacggggcctccttct

SEQ ID NO: 455111 - DNA, 18 bp, Homo sapiens
tgactgtactcctcccag

SEQ ID NO: 455112 - DNA, 17 bp, Homo sapiens
tgacttcagactctctc

SEQ ID NO: 455113 - DNA, 14 bp, Homo sapiens
tgacttcccagctg

SEQ ID NO: 455114 - DNA, 17 bp, Homo sapiens
tgacttcccagctggca

SEQ ID NO: 455115 - DNA, 14 bp, Homo sapiens
tgagaaaacaggct

SEQ ID NO: 455116 - DNA, 21 bp, Homo sapiens
tgagaaattgtgccaaagata

SEQ ID NO: 455117 - DNA, 23 bp, Homo sapiens
tgagaagatgttaattacttttg

SEQ ID NO: 455118 - DNA, 16 bp, Homo sapiens
tgagacagtgggggtg

SEQ ID NO: 455119 - DNA, 20 bp, Homo sapiens
tgagacagtgggggtgcctg

SEQ ID NO: 455120 - DNA, 18 bp, Homo sapiens
tgagactcccgcctttga

SEQ ID NO: 455121 - DNA, 16 bp, Homo sapiens
tgagagaagccacgct

SEQ ID NO: 455122 - DNA, 18 bp, Homo sapiens
tgagagctgctcctttgg

SEQ ID NO: 455123 - DNA, 14 bp, Homo sapiens
tgagaggggtgaga

SEQ ID NO: 455124 - DNA, 15 bp, Homo sapiens
tgagagtcatctcaa

SEQ ID NO: 455125 - DNA, 20 bp, Homo sapiens
tgagatcagcattcaaaata

SEQ ID NO: 455126 - DNA, 15 bp, Homo sapiens
tgagcagtggggagc

SEQ ID NO: 455127 - DNA, 21 bp, Homo sapiens
tgagcagtggggagcgggggc

SEQ ID NO: 455128 - DNA, 13 bp, Homo sapiens
tgagcccactcct

SEQ ID NO: 455129 - DNA, 19 bp, Homo sapiens
tgagcccagaaaaaaggac

SEQ ID NO: 455130 - DNA, 12 bp, Homo sapiens
tgagcccctcct

SEQ ID NO: 455131 - DNA, 14 bp, Homo sapiens
tgagcccctcctct

SEQ ID NO: 455132 - DNA, 18 bp, Homo sapiens
tgagcccgaatttctcac

SEQ ID NO: 455133 - DNA, 14 bp, Homo sapiens
tgagcctgtctctc

SEQ ID NO: 455134 - DNA, 20 bp, Homo sapiens
tgagctccaccctcccctct

SEQ ID NO: 455135 - DNA, 11 bp, Homo sapiens
tgcccaccctg

SEQ ID NO: 455136 - DNA, 19 bp, Homo sapiens
tgcccatgtgtcccctcac

SEQ ID NO: 455137 - DNA, 14 bp, Homo sapiens
tgccccccttccca

SEQ ID NO: 455138 - DNA, 18 bp, Homo sapiens
tgccccccttcccacccc

SEQ ID NO: 455139 - DNA, 19 bp, Homo sapiens
tgccccccttcccacccct

SEQ ID NO: 455140 - DNA, 18 bp, Homo sapiens
tgccccctcccccgcaga

SEQ ID NO: 455141 - DNA, 21 bp, Homo sapiens
tgccccctcccccgcagacag

SEQ ID NO: 455142 - DNA, 16 bp, Homo sapiens
tgcccctcccttcaac

SEQ ID NO: 455143 - DNA, 19 bp, Homo sapiens
tgcccctccgtccccaggg

SEQ ID NO: 455144 - DNA, 20 bp, Homo sapiens
tgcccctccgtccccagggt

SEQ ID NO: 455145 - DNA, 22 bp, Homo sapiens
tgcccctgtaaggtttcaatgc

SEQ ID NO: 455146 - DNA, 18 bp, Homo sapiens
tgccccttgaccccacac

SEQ ID NO: 455147 - DNA, 15 bp, Homo sapiens
tgccctcactccact

SEQ ID NO: 455148 - DNA, 16 bp, Homo sapiens
tgccctcactccactc

SEQ ID NO: 455149 - DNA, 12 bp, Homo sapiens
tgccctccccca

SEQ ID NO: 455150 - DNA, 15 bp, Homo sapiens
tgccctcccccacgg

SEQ ID NO: 455151 - DNA, 16 bp, Homo sapiens
tgccctgcaccttggg

SEQ ID NO: 455152 - DNA, 16 bp, Homo sapiens
tgccctggtgctgcca

SEQ ID NO: 455153 - DNA, 18 bp, Homo sapiens
tgccctggtgctgccaca

SEQ ID NO: 455154 - DNA, 12 bp, Homo sapiens
tgccgctgcacc

SEQ ID NO: 455155 - DNA, 15 bp, Homo sapiens
tgccgctgcaccacg

SEQ ID NO: 455156 - DNA, 21 bp, Homo sapiens
tgcctcttaacttaaaagaac

SEQ ID NO: 455157 - DNA, 22 bp, Homo sapiens
tgcctcttaacttaaaagaaca

SEQ ID NO: 455158 - DNA, 13 bp, Homo sapiens
tgcctggcgggca

SEQ ID NO: 455159 - DNA, 14 bp, Homo sapiens
tgcctggcgggcag

SEQ ID NO: 455160 - DNA, 15 bp, Homo sapiens
tgcctggcgggcagc

SEQ ID NO: 455161 - DNA, 17 bp, Homo sapiens
tgcctggcgggcagccc

SEQ ID NO: 455162 - DNA, 19 bp, Homo sapiens
tgcctggcgggcagcccct

SEQ ID NO: 455163 - DNA, 23 bp, Homo sapiens
tgcctggcgggcagcccctgctg

SEQ ID NO: 455164 - DNA, 11 bp, Homo sapiens
tgcctggtgcg

SEQ ID NO: 455165 - DNA, 24 bp, Homo sapiens
tgcctggtgcgctgtgctccagca

SEQ ID NO: 455166 - DNA, 20 bp, Homo sapiens
tgccttacagacagaatata

SEQ ID NO: 455167 - DNA, 12 bp, Homo sapiens
tgccttcctgag

SEQ ID NO: 455168 - DNA, 23 bp, Homo sapiens
tgccttgttgtattcctgccttt

SEQ ID NO: 455169 - DNA, 15 bp, Homo sapiens
tgcctttgagcttct

SEQ ID NO: 455170 - DNA, 19 bp, Homo sapiens
tgcctttgagcttctcctc

SEQ ID NO: 455171 - DNA, 15 bp, Homo sapiens
tgcgccctccctccc

SEQ ID NO: 455172 - DNA, 22 bp, Homo sapiens
tgcgctagagcattctggggtg

SEQ ID NO: 455173 - DNA, 15 bp, Homo sapiens
tgcgctcctctgcag

SEQ ID NO: 455174 - DNA, 19 bp, Homo sapiens
tgcgctcctctgcagcctg

SEQ ID NO: 455175 - DNA, 23 bp, Homo sapiens
tgcgctcctctgcagcctgagct

SEQ ID NO: 455176 - DNA, 14 bp, Homo sapiens
tgcgctctgggttt

SEQ ID NO: 455177 - DNA, 19 bp, Homo sapiens
tgcggaccggagcggctga

SEQ ID NO: 455178 - DNA, 22 bp, Homo sapiens
tgcggaccggagcggctgagga

SEQ ID NO: 455179 - DNA, 23 bp, Homo sapiens
tgcggcccgtgcgcagccgcgct

SEQ ID NO: 455180 - DNA, 21 bp, Homo sapiens
tgcgtgtggccctgtgggagt

SEQ ID NO: 455181 - DNA, 20 bp, Homo sapiens
tgctacagagagtgaataca

SEQ ID NO: 455182 - DNA, 13 bp, Homo sapiens
tgctactcagtat

SEQ ID NO: 455183 - DNA, 16 bp, Homo sapiens
tgctagctgtagaaat

SEQ ID NO: 455184 - DNA, 20 bp, Homo sapiens
tgctaggaacctcatttgtc

SEQ ID NO: 455185 - DNA, 13 bp, Homo sapiens
tgctatgtctgtg

SEQ ID NO: 455186 - DNA, 17 bp, Homo sapiens
tgctatgtctgtgatgt

SEQ ID NO: 455187 - DNA, 16 bp, Homo sapiens
tgctcaataaaggtca

SEQ ID NO: 455188 - DNA, 20 bp, Homo sapiens
tgctcagaaatgttggttac

SEQ ID NO: 455189 - DNA, 17 bp, Homo sapiens
tgctccaacagacaccc

SEQ ID NO: 455190 - DNA, 19 bp, Homo sapiens
tgctccaacagacaccctc

SEQ ID NO: 455191 - DNA, 20 bp, Homo sapiens
tgctccaacagacaccctcc

SEQ ID NO: 455192 - DNA, 21 bp, Homo sapiens
tgctccaacagacaccctcca

SEQ ID NO: 455193 - DNA, 12 bp, Homo sapiens
tgctccagcagt

SEQ ID NO: 455194 - DNA, 18 bp, Homo sapiens
tgctccagcagtgctggg

SEQ ID NO: 455195 - DNA, 14 bp, Homo sapiens
tgctcctgcatgca

SEQ ID NO: 455196 - DNA, 19 bp, Homo sapiens
tgctcctgcatgcaactaa

SEQ ID NO: 455197 - DNA, 15 bp, Homo sapiens
tgctccttgaataag

SEQ ID NO: 455198 - DNA, 14 bp, Homo sapiens
tgctcggacacagt

SEQ ID NO: 455199 - DNA, 12 bp, Homo sapiens
tgctctattgta

SEQ ID NO: 455200 - DNA, 21 bp, Homo sapiens
tgctctattgtagcatttctt

SEQ ID NO: 455201 - DNA, 15 bp, Homo sapiens
tgctctccttcactc

SEQ ID NO: 455202 - DNA, 21 bp, Homo sapiens
tgctctccttcactctgacag

SEQ ID NO: 455203 - DNA, 17 bp, Homo sapiens
tgctcttcctcatctca

SEQ ID NO: 455204 - DNA, 14 bp, Homo sapiens
tgctcttttcccag

SEQ ID NO: 455205 - DNA, 14 bp, Homo sapiens
tgctgactgtactc

SEQ ID NO: 455206 - DNA, 16 bp, Homo sapiens
tgctgactgtactcct

SEQ ID NO: 455207 - DNA, 22 bp, Homo sapiens
tgctgagagacctcagggatgg

SEQ ID NO: 455208 - DNA, 14 bp, Homo sapiens
tgctgcctctgaaa

SEQ ID NO: 455209 - DNA, 17 bp, Homo sapiens
tgctgctcgggaaggcc

SEQ ID NO: 455210 - DNA, 20 bp, Homo sapiens
tgctgctcgggaaggcctga

SEQ ID NO: 455211 - DNA, 12 bp, Homo sapiens
tgctggccagca

SEQ ID NO: 455212 - DNA, 21 bp, Homo sapiens
tgctggctgccttagaacctt

SEQ ID NO: 455213 - DNA, 12 bp, Homo sapiens
tgctgggcccag

SEQ ID NO: 455214 - DNA, 14 bp, Homo sapiens
tgctgggcccagcc

SEQ ID NO: 455215 - DNA, 15 bp, Homo sapiens
tgctgggcccagccg

SEQ ID NO: 455216 - DNA, 10 bp, Homo sapiens
tgctgtgggc

SEQ ID NO: 455217 - DNA, 12 bp, Homo sapiens
tgctgttttatg

SEQ ID NO: 455218 - DNA, 20 bp, Homo sapiens
tgcttagtgtcccttacctg

SEQ ID NO: 455219 - DNA, 19 bp, Homo sapiens
tgttcaaagaacccccctc

SEQ ID NO: 455220 - DNA, 16 bp, Homo sapiens
tgttccgttcatctga

SEQ ID NO: 455221 - DNA, 20 bp, Homo sapiens
tgttctccgggtgtggcctc

SEQ ID NO: 455222 - DNA, 22 bp, Homo sapiens
tgttctccgggtgtggcctcag

SEQ ID NO: 455223 - DNA, 22 bp, Homo sapiens
tgttgatcgatgttaaacgtca

SEQ ID NO: 455224 - DNA, 16 bp, Homo sapiens
tgttgcaaattattct

SEQ ID NO: 455225 - DNA, 20 bp, Homo sapiens
tgttgcaaattattctagtc

SEQ ID NO: 455226 - DNA, 19 bp, Homo sapiens
tgttgcagttaattcttgc

SEQ ID NO: 455227 - DNA, 19 bp, Homo sapiens
tgtttaccctccctgtccc

SEQ ID NO: 455228 - DNA, 22 bp, Homo sapiens
tgtttacctcactggtgcattt

SEQ ID NO: 455229 - DNA, 23 bp, Homo sapiens
tgtttacctcactggtgcattta

SEQ ID NO: 455230 - DNA, 19 bp, Homo sapiens
tgtttctgcagtattctgt

SEQ ID NO: 455231 - DNA, 12 bp, Homo sapiens
tgtttcttctca

SEQ ID NO: 455232 - DNA, 18 bp, Homo sapiens
tgttttatgtcatactct

SEQ ID NO: 455233 - DNA, 21 bp, Homo sapiens
tgttttatgtcatactctgtg

SEQ ID NO: 455234 - DNA, 21 bp, Homo sapiens
tgttttccccaattatcctcc

SEQ ID NO: 455235 - DNA, 17 bp, Homo sapiens
tgtttttggatggctta

SEQ ID NO: 455236 - DNA, 18 bp, Homo sapiens
ttaaaaaaaatattctgt

SEQ ID NO: 455237 - DNA, 20 bp, Homo sapiens
ttaaaaaaaatattctgtca

SEQ ID NO: 455238 - DNA, 21 bp, Homo sapiens
ttaaaaaaaatattctgtcat

SEQ ID NO: 455239 - DNA, 15 bp, Homo sapiens
ttaaaaaaataacat

SEQ ID NO: 455240 - DNA, 19 bp, Homo sapiens
ttaaaaaaataacatctga

SEQ ID NO: 455241 - DNA, 13 bp, Homo sapiens
ttaaaatactgtt

SEQ ID NO: 455242 - DNA, 18 bp, Homo sapiens
ttaaaatcagactcttta

SEQ ID NO: 455243 - DNA, 16 bp, Homo sapiens
ttaaacactgtaatct

SEQ ID NO: 455244 - DNA, 11 bp, Homo sapiens
ttaaacatttt

SEQ ID NO: 455245 - DNA, 12 bp, Homo sapiens
ttaaacttcagc

SEQ ID NO: 455246 - DNA, 14 bp, Homo sapiens
ttaaactttgtcac

SEQ ID NO: 455247 - DNA, 19 bp, Homo sapiens
ttaaactttgtcacttctg

SEQ ID NO: 455248 - DNA, 22 bp, Homo sapiens
ttaaagtacctgtagtgagaaa

SEQ ID NO: 455249 - DNA, 13 bp, Homo sapiens
ttaaatgattcca

SEQ ID NO: 455250 - DNA, 17 bp, Homo sapiens
ttaaatgattccaaata

SEQ ID NO: 455251 - DNA, 16 bp, Homo sapiens
ttaaatttaatatact

SEQ ID NO: 455252 - DNA, 21 bp, Homo sapiens
ttaaatttaatatactgcata

SEQ ID NO: 455253 - DNA, 18 bp, Homo sapiens
ttaaattttaatgtaaaa

SEQ ID NO: 455254 - DNA, 19 bp, Homo sapiens
ttaacataaacttgtactt

SEQ ID NO: 455255 - DNA, 15 bp, Homo sapiens
ttaacatacatctaa

SEQ ID NO: 455256 - DNA, 15 bp, Homo sapiens
ttaacatcaaagact

SEQ ID NO: 455257 - DNA, 23 bp, Homo sapiens
ttaacatcaaagactccgagaag

SEQ ID NO: 455258 - DNA, 22 bp, Homo sapiens
ttaacccagtgttcagcataga

SEQ ID NO: 455259 - DNA, 12 bp, Homo sapiens
ttaactctgcat

SEQ ID NO: 455260 - DNA, 15 bp, Homo sapiens
ttaagaaagctatat

SEQ ID NO: 455261 - DNA, 23 bp, Homo sapiens
ttaagaaatgagaaattgtgcca

SEQ ID NO: 455262 - DNA, 16 bp, Homo sapiens
ttaaggggatctaaaa

SEQ ID NO: 455263 - DNA, 18 bp, Homo sapiens
ttaatctctaaaattcta

SEQ ID NO: 455264 - DNA, 20 bp, Homo sapiens
ttaatctctaaaattctagt

SEQ ID NO: 455265 - DNA, 18 bp, Homo sapiens
ttaatctttgtgacagga

SEQ ID NO: 455266 - DNA, 12 bp, Homo sapiens
ttaatggttttt

SEQ ID NO: 455267 - DNA, 13 bp, Homo sapiens
ttaatgtaaaatt

SEQ ID NO: 455268 - DNA, 23 bp, Homo sapiens
ttaatgttctgaataatttctta

SEQ ID NO: 455269 - DNA, 15 bp, Homo sapiens
ttaattgtggcttta

SEQ ID NO: 455270 - DNA, 18 bp, Homo sapiens
ttaatttcataaattggc

SEQ ID NO: 455271 - DNA, 15 bp, Homo sapiens
ttacaacattcaact

SEQ ID NO: 455272 - DNA, 13 bp, Homo sapiens
ttacactgaaatc

SEQ ID NO: 455273 - DNA, 18 bp, Homo sapiens
ttacactgaaatccaaaa

SEQ ID NO: 455274 - DNA, 11 bp, Homo sapiens
ttacagctgaa

SEQ ID NO: 455275 - DNA, 22 bp, Homo sapiens
ttaccccgtccctttccctgca

SEQ ID NO: 455276 - DNA, 17 bp, Homo sapiens
ttaccctccctgtcccc

SEQ ID NO: 455277 - DNA, 17 bp, Homo sapiens
ttacctcactggtgcat

SEQ ID NO: 455278 - DNA, 20 bp, Homo sapiens
ttacctgtaatagcctcacc

SEQ ID NO: 455279 - DNA, 21 bp, Homo sapiens
ttactaaacattttgttattg

SEQ ID NO: 455280 - DNA, 16 bp, Homo sapiens
ttactcaggctttcta

SEQ ID NO: 455281 - DNA, 23 bp, Homo sapiens
ttactctgtgctaagttgtctta

SEQ ID NO: 455282 - DNA, 14 bp, Homo sapiens
ttactgtcagagaa

SEQ ID NO: 455283 - DNA, 18 bp, Homo sapiens
ttactttgtgcaatatga

SEQ ID NO: 455284 - DNA, 15 bp, Homo sapiens
ttacttttgaaaaag

SEQ ID NO: 455285 - DNA, 14 bp, Homo sapiens
ttagatttctttga

SEQ ID NO: 455286 - DNA, 22 bp, Homo sapiens
ttagctgggaagaatgtattcg

SEQ ID NO: 455287 - DNA, 20 bp, Homo sapiens
ttaggaatatacatagtctt

SEQ ID NO: 455288 - DNA, 22 bp, Homo sapiens
ttaggcccgccaaacttctgaa

SEQ ID NO: 455289 - DNA, 21 bp, Homo sapiens
ttaggtaatggatatgaaaga

SEQ ID NO: 455290 - DNA, 13 bp, Homo sapiens
ttagtcctcacct

SEQ ID NO: 455291 - DNA, 17 bp, Homo sapiens
ttataagttgaccttta

SEQ ID NO: 455292 - DNA, 16 bp, Homo sapiens
ttataatgcatctaaa

SEQ ID NO: 455293 - DNA, 17 bp, Homo sapiens
ttataatgcatctaaac

SEQ ID NO: 455294 - DNA, 14 bp, Homo sapiens
ttatatataaatat

SEQ ID NO: 455295 - DNA, 13 bp, Homo sapiens
ttatatattataa

SEQ ID NO: 455296 - DNA, 18 bp, Homo sapiens
ttatatcatcaatacttt

SEQ ID NO: 455297 - DNA, 15 bp, Homo sapiens
ttatatgatatgcat

SEQ ID NO: 455298 - DNA, 18 bp, Homo sapiens
ttatatgatatgcatgta

SEQ ID NO: 455299 - DNA, 23 bp, Homo sapiens
ttatattgtttttatatattata

SEQ ID NO: 455300 - DNA, 20 bp, Homo sapiens
ttatcagaactcctttctaa

SEQ ID NO: 455301 - DNA, 21 bp, Homo sapiens
ttatcagggcccaaataacag

SEQ ID NO: 455302 - DNA, 22 bp, Homo sapiens
ttatcagggcccaaataacagt

SEQ ID NO: 455303 - DNA, 14 bp, Homo sapiens
ttatctagcaagaa

SEQ ID NO: 455304 - DNA, 21 bp, Homo sapiens
ttatctagcaagaagattcta

SEQ ID NO: 455305 - DNA, 13 bp, Homo sapiens
ttatctccagcca

SEQ ID NO: 455306 - DNA, 19 bp, Homo sapiens
tctgtgaagcctttatcta

SEQ ID NO: 455307 - DNA, 22 bp, Homo sapiens
tctgtgagtctgtcctttccca

SEQ ID NO: 455308 - DNA, 17 bp, Homo sapiens
tctgtgctaagttgtct

SEQ ID NO: 455309 - DNA, 16 bp, Homo sapiens
tctgtggattctatat

SEQ ID NO: 455310 - DNA, 13 bp, Homo sapiens
tctgtgggactgg

SEQ ID NO: 455311 - DNA, 21 bp, Homo sapiens
tctgtgggactggcccacccc

SEQ ID NO: 455312 - DNA, 11 bp, Homo sapiens
tctgtgtggca

SEQ ID NO: 455313 - DNA, 14 bp, Homo sapiens
tctgttatcctgct

SEQ ID NO: 455314 - DNA, 18 bp, Homo sapiens
tctgttccaagtgtgtgt

SEQ ID NO: 455315 - DNA, 20 bp, Homo sapiens
tcttaaaatgtttcaaatgg

SEQ ID NO: 455316 - DNA, 19 bp, Homo sapiens
tcttaacttaaaagaacat

SEQ ID NO: 455317 - DNA, 14 bp, Homo sapiens
tcttactgtatttg

SEQ ID NO: 455318 - DNA, 16 bp, Homo sapiens
tcttactgttttgtgc

SEQ ID NO: 455319 - DNA, 17 bp, Homo sapiens
tcttactgttttgtgcg

SEQ ID NO: 455320 - DNA, 17 bp, Homo sapiens
tcttatattaaagaagt

SEQ ID NO: 455321 - DNA, 18 bp, Homo sapiens
tcttatctagcaagaaga

SEQ ID NO: 455322 - DNA, 12 bp, Homo sapiens
tcttatgttgat

SEQ ID NO: 455323 - DNA, 17 bp, Homo sapiens
tcttcaaccctgccctg

SEQ ID NO: 455324 - DNA, 14 bp, Homo sapiens
tcttcagagaaatc

SEQ ID NO: 455325 - DNA, 14 bp, Homo sapiens
tcttcatacaaagg

SEQ ID NO: 455326 - DNA, 15 bp, Homo sapiens
tcttcatccatagac

SEQ ID NO: 455327 - DNA, 19 bp, Homo sapiens
tcttcatccatagacacag

SEQ ID NO: 455328 - DNA, 20 bp, Homo sapiens
tcttcatccatagacacagt

SEQ ID NO: 455329 - DNA, 13 bp, Homo sapiens
tcttcccccttcc

SEQ ID NO: 455330 - DNA, 20 bp, Homo sapiens
tcttctcagctccactctga

SEQ ID NO: 455331 - DNA, 23 bp, Homo sapiens
tcttcttgcggcaccgcccaccc

SEQ ID NO: 455332 - DNA, 16 bp, Homo sapiens
ttattctagtcaactg

SEQ ID NO: 455333 - DNA, 22 bp, Homo sapiens
ttattcttccaagttcattcat

SEQ ID NO: 455334 - DNA, 15 bp, Homo sapiens
ttatttaatttcata

SEQ ID NO: 455335 - DNA, 19 bp, Homo sapiens
ttatttaatttcataaatt

SEQ ID NO: 455336 - DNA, 15 bp, Homo sapiens
ttatttattaaactt

SEQ ID NO: 455337 - DNA, 16 bp, Homo sapiens
ttatttattaaacttc

SEQ ID NO: 455338 - DNA, 13 bp, Homo sapiens
ttatttattatta

SEQ ID NO: 455339 - DNA, 14 bp, Homo sapiens
ttatttcatccagt

SEQ ID NO: 455340 - DNA, 13 bp, Homo sapiens
ttatttctaacta

SEQ ID NO: 455341 - DNA, 14 bp, Homo sapiens
ttattttctgaatt

SEQ ID NO: 455342 - DNA, 16 bp, Homo sapiens
ttcaaaatacttcttt

SEQ ID NO: 455343 - DNA, 18 bp, Homo sapiens
ttcaaaatagttctattt

SEQ ID NO: 455344 - DNA, 22 bp, Homo sapiens
ttcaaaatagttctatttctat

SEQ ID NO: 455345 - DNA, 18 bp, Homo sapiens
ttcaaagaaaacagacca

SEQ ID NO: 455346 - DNA, 18 bp, Homo sapiens
ttcaaagaacccccctcc

SEQ ID NO: 455347 - DNA, 21 bp, Homo sapiens
ttcaaagaacccccctcccca

SEQ ID NO: 455348 - DNA, 15 bp, Homo sapiens
ttcaaatacttttgg

SEQ ID NO: 455349 - DNA, 11 bp, Homo sapiens
ttcaaatgcat

SEQ ID NO: 455350 - DNA, 12 bp, Homo sapiens
ttcaaatgcatg

SEQ ID NO: 455351 - DNA, 14 bp, Homo sapiens
ttcaaatgcatgat

SEQ ID NO: 455352 - DNA, 21 bp, Homo sapiens
ttcaaatgcatgatattgtat

SEQ ID NO: 455353 - DNA, 23 bp, Homo sapiens
ttcaaatgcatgatattgtatgt

SEQ ID NO: 455354 - DNA, 19 bp, Homo sapiens
ttcaaatggtttaacaaaa

SEQ ID NO: 455355 - DNA, 15 bp, Homo sapiens
ttcaaccattcccca

SEQ ID NO: 455356 - DNA, 17 bp, Homo sapiens
ttcaaccctgccctgca

SEQ ID NO: 455357 - DNA, 19 bp, Homo sapiens
ttcaacctggtggcaccag

SEQ ID NO: 455358 - DNA, 13 bp, Homo sapiens
ttcaacgcagccc

SEQ ID NO: 455359 - DNA, 15 bp, Homo sapiens
ttcaatgtactgtat

SEQ ID NO: 455360 - DNA, 16 bp, Homo sapiens
ttcaatgtactgtatt

SEQ ID NO: 455361 - DNA, 14 bp, Homo sapiens
ttcacaaatatagt

SEQ ID NO: 455362 - DNA, 22 bp, Homo sapiens
ttcacacacacacaatggcaag

SEQ ID NO: 455363 - DNA, 17 bp, Homo sapiens
ttcacatatttgtagct

SEQ ID NO: 455364 - DNA, 16 bp, Homo sapiens
ttcactgctggctgcc

SEQ ID NO: 455365 - DNA, 19 bp, Homo sapiens
ttcacttaaactttgtcac

SEQ ID NO: 455366 - DNA, 20 bp, Homo sapiens
ttcagaaagggcagcccctc

SEQ ID NO: 455367 - DNA, 15 bp, Homo sapiens
ttcagactctctcct

SEQ ID NO: 455368 - DNA, 24 bp, Homo sapiens
ttcagactctctcctctctctccc

SEQ ID NO: 455369 - DNA, 19 bp, Homo sapiens
ttcagagagctaaattaca

SEQ ID NO: 455370 - DNA, 14 bp, Homo sapiens
ttcagcaaccctac

SEQ ID NO: 455371 - DNA, 23 bp, Homo sapiens
ttcagcaaccctacagtatataa

SEQ ID NO: 455372 - DNA, 18 bp, Homo sapiens
ttcaggttcctcctaggc

SEQ ID NO: 455373 - DNA, 18 bp, Homo sapiens
ttcagttattaaatgata

SEQ ID NO: 455374 - DNA, 13 bp, Homo sapiens
ttcagttctcatc

SEQ ID NO: 455375 - DNA, 11 bp, Homo sapiens
ttcataaattg

SEQ ID NO: 455376 - DNA, 12 bp, Homo sapiens
ttcataaattgg

SEQ ID NO: 455377 - DNA, 19 bp, Homo sapiens
ttcataaattggctccttt

SEQ ID NO: 455378 - DNA, 13 bp, Homo sapiens
ttcatcaagtagc

SEQ ID NO: 455379 - DNA, 21 bp, Homo sapiens
ttcatcaagtagcgttggaga

SEQ ID NO: 455380 - DNA, 15 bp, Homo sapiens
ttcatctgaggagtc

SEQ ID NO: 455381 - DNA, 18 bp, Homo sapiens
ttcatgtttaagaaatga

SEQ ID NO: 455382 - DNA, 17 bp, Homo sapiens
ttcattaaacaaacaga

SEQ ID NO: 455383 - DNA, 19 bp, Homo sapiens
ttcattacatcctctgctt

SEQ ID NO: 455384 - DNA, 20 bp, Homo sapiens
ttcatttacaacttccagat

SEQ ID NO: 455385 - DNA, 11 bp, Homo sapiens
ttccaaataaa

SEQ ID NO: 455386 - DNA, 17 bp, Homo sapiens
ttccaaataaaacttga

SEQ ID NO: 455387 - DNA, 12 bp, Homo sapiens
ttccaagtgtgt

SEQ ID NO: 455388 - DNA, 23 bp, Homo sapiens
ttccaccgctggagctcctacat

SEQ ID NO: 455389 - DNA, 17 bp, Homo sapiens
ttccacttccagagggg

SEQ ID NO: 455390 - DNA, 10 bp, Homo sapiens
ttccagacag

SEQ ID NO: 455391 - DNA, 17 bp, Homo sapiens
ttccagagagtggctcc

SEQ ID NO: 455392 - DNA, 19 bp, Homo sapiens
ttccagagagtggctcctc

SEQ ID NO: 455393 - DNA, 13 bp, Homo sapiens
ttccatcctgagg

SEQ ID NO: 455394 - DNA, 23 bp, Homo sapiens
ttccatcctgaggaccgccccaa

SEQ ID NO: 455395 - DNA, 12 bp, Homo sapiens
ttccatctaaaa

SEQ ID NO: 455396 - DNA, 19 bp, Homo sapiens
ttccatctcccttggttgt

SEQ ID NO: 455397 - DNA, 21 bp, Homo sapiens
ttccatgggttgaacaagcca

SEQ ID NO: 455398 - DNA, 15 bp, Homo sapiens
ttccattctatgact

SEQ ID NO: 455399 - DNA, 15 bp, Homo sapiens
ttcccccttcccctg

SEQ ID NO: 455400 - DNA, 17 bp, Homo sapiens
ttcccccttcccctgcg

SEQ ID NO: 455401 - DNA, 16 bp, Homo sapiens
ttcccctgcgccctcc

SEQ ID NO: 455402 - DNA, 19 bp, Homo sapiens
ttcccctgcgccctccctc

SEQ ID NO: 455403 - DNA, 20 bp, Homo sapiens
ttcccctgcgccctccctcc

SEQ ID NO: 455404 - DNA, 14 bp, Homo sapiens
ttcccgcagcacca

SEQ ID NO: 455405 - DNA, 19 bp, Homo sapiens
ttcccgcagcaccagcctg

SEQ ID NO: 455406 - DNA, 21 bp, Homo sapiens
ttcccgccttcaggttcctcc

SEQ ID NO: 455407 - DNA, 23 bp, Homo sapiens
ttcccgccttcaggttcctccta

SEQ ID NO: 455408 - DNA, 14 bp, Homo sapiens
ttcccgctcagccc

SEQ ID NO: 455409 - DNA, 16 bp, Homo sapiens
ttcccgctcagccctc

SEQ ID NO: 455410 - DNA, 17 bp, Homo sapiens
ttcccttggatgtagtc

SEQ ID NO: 455411 - DNA, 16 bp, Homo sapiens
ttccgttcatctgagg

SEQ ID NO: 455412 - DNA, 19 bp, Homo sapiens
ttccgttcatctgaggagt

SEQ ID NO: 455413 - DNA, 22 bp, Homo sapiens
ttcctccagcccagtcttacat

SEQ ID NO: 455414 - DNA, 19 bp, Homo sapiens
ttcctcctaggcgctcaga

SEQ ID NO: 455415 - DNA, 21 bp, Homo sapiens
ttcctcctaggcgctcagagg

SEQ ID NO: 455416 - DNA, 19 bp, Homo sapiens
ttcctcctcagtcttctca

SEQ ID NO: 455417 - DNA, 15 bp, Homo sapiens
ttctatgcctgtatt

SEQ ID NO: 455418 - DNA, 16 bp, Homo sapiens
ttctatgcctgtattt

SEQ ID NO: 455419 - DNA, 16 bp, Homo sapiens
ttctatgtagaactgt

SEQ ID NO: 455420 - DNA, 18 bp, Homo sapiens
ttctattgcagttataga

SEQ ID NO: 455421 - DNA, 14 bp, Homo sapiens
ttctatttctatct

SEQ ID NO: 455422 - DNA, 15 bp, Homo sapiens
ttctatttctatctg

SEQ ID NO: 455423 - DNA, 16 bp, Homo sapiens
ttctatttctatctgc

SEQ ID NO: 455424 - DNA, 16 bp, Homo sapiens
ttctcaaatgctactc

SEQ ID NO: 455425 - DNA, 19 bp, Homo sapiens
ttctcaaatgctactcagt

SEQ ID NO: 455426 - DNA, 20 bp, Homo sapiens
ttctcaaatgctactcagta

SEQ ID NO: 455427 - DNA, 16 bp, Homo sapiens
ttctcagctccactct

SEQ ID NO: 455428 - DNA, 18 bp, Homo sapiens
ttctcagctccactctga

SEQ ID NO: 455429 - DNA, 21 bp, Homo sapiens
ttctcagctccactctgaagt

SEQ ID NO: 455430 - DNA, 12 bp, Homo sapiens
ttctcatcttgt

SEQ ID NO: 455431 - DNA, 15 bp, Homo sapiens
ttctcccctccagac

SEQ ID NO: 455432 - DNA, 16 bp, Homo sapiens
ttctccttgtacttga

SEQ ID NO: 455433 - DNA, 18 bp, Homo sapiens
ttctccttgtacttgaat

SEQ ID NO: 455434 - DNA, 13 bp, Homo sapiens
ttctctctgtgtg

SEQ ID NO: 455435 - DNA, 16 bp, Homo sapiens
ttctctctgtgtggca

SEQ ID NO: 455436 - DNA, 14 bp, Homo sapiens
ttctgcaataacag

SEQ ID NO: 455437 - DNA, 18 bp, Homo sapiens
ttctgcaataacagtttt

SEQ ID NO: 455438 - DNA, 19 bp, Homo sapiens
ttctgcaataacagtttta

SEQ ID NO: 455439 - DNA, 18 bp, Homo sapiens
ttctgcagtattctgtag

SEQ ID NO: 455440 - DNA, 21 bp, Homo sapiens
ttctgcattactattaactct

SEQ ID NO: 455441 - DNA, 23 bp, Homo sapiens
ttctgcattactattaactctgc

SEQ ID NO: 455442 - DNA, 15 bp, Homo sapiens
ttctgtggattctat

SEQ ID NO: 455443 - DNA, 22 bp, Homo sapiens
ttctgtgtcacagttcttggtg

SEQ ID NO: 455444 - DNA, 19 bp, Homo sapiens
ttcttgctttcacaaatat

SEQ ID NO: 455445 - DNA, 14 bp, Homo sapiens
ttctttaaacactc

SEQ ID NO: 455446 - DNA, 19 bp, Homo sapiens
ttctttaacatacatctaa

SEQ ID NO: 455447 - DNA, 19 bp, Homo sapiens
ttcttttatatctgtaaat

SEQ ID NO: 455448 - DNA, 22 bp, Homo sapiens
ttcttttcagcttgtttctata

SEQ ID NO: 455449 - DNA, 18 bp, Homo sapiens
ttctttttggcattatct

SEQ ID NO: 455450 - DNA, 22 bp, Homo sapiens
ttcttttttcaatgtactgtat

SEQ ID NO: 455451 - DNA, 12 bp, Homo sapiens
ttgaaaaaggat

SEQ ID NO: 455452 - DNA, 12 bp, Homo sapiens
ttgaaaactgga

SEQ ID NO: 455453 - DNA, 13 bp, Homo sapiens
ttgaaaagaagaa

SEQ ID NO: 455454 - DNA, 19 bp, Homo sapiens
ttgaaaagaagaaagtcta

SEQ ID NO: 455455 - DNA, 23 bp, Homo sapiens
ttgaaaagaagaaagtctatgct

SEQ ID NO: 455456 - DNA, 16 bp, Homo sapiens
ttgaaccgtcaatgtg

SEQ ID NO: 455457 - DNA, 13 bp, Homo sapiens
ttgaaggactaca

SEQ ID NO: 455458 - DNA, 22 bp, Homo sapiens
ttgaataaactccccagcgtat

SEQ ID NO: 455459 - DNA, 21 bp, Homo sapiens
ttgaatatattttatcttggt

SEQ ID NO: 455460 - DNA, 21 bp, Homo sapiens
ttgaatgtccccattctataa

SEQ ID NO: 455461 - DNA, 23 bp, Homo sapiens
ttgaattatccacatgaaaataa

SEQ ID NO: 455462 - DNA, 19 bp, Homo sapiens
ttgacctgacgatcttccc

SEQ ID NO: 455463 - DNA, 21 bp, Homo sapiens
ttgacctttatttattaaact

SEQ ID NO: 455464 - DNA, 23 bp, Homo sapiens
ttgagagaagccacgctgtcctc

SEQ ID NO: 455465 - DNA, 23 bp, Homo sapiens
ttgagcaaggcaagaagtgggat

SEQ ID NO: 455466 - DNA, 18 bp, Homo sapiens
ttgagcttctcctctgct

SEQ ID NO: 455467 - DNA, 15 bp, Homo sapiens
ttgagtgggccccct

SEQ ID NO: 455468 - DNA, 15 bp, Homo sapiens
ttgatatacagacct

SEQ ID NO: 455469 - DNA, 16 bp, Homo sapiens
ttgcaatcttatgttg

SEQ ID NO: 455470 - DNA, 19 bp, Homo sapiens
ttgcacttctgttatcagg

SEQ ID NO: 455471 - DNA, 17 bp, Homo sapiens
ttgccagacagagatca

SEQ ID NO: 455472 - DNA, 22 bp, Homo sapiens
ttgcctgcctggaaacagcctg

SEQ ID NO: 455473 - DNA, 13 bp, Homo sapiens
ttgcgctctgggt

SEQ ID NO: 455474 - DNA, 16 bp, Homo sapiens
ttgctattgtttatag

SEQ ID NO: 455475 - DNA, 15 bp, Homo sapiens
ttgctcaataaaggt

SEQ ID NO: 455476 - DNA, 19 bp, Homo sapiens
ttgctcaataaaggtcata

SEQ ID NO: 455477 - DNA, 13 bp, Homo sapiens
ttgctgtcctcca

SEQ ID NO: 455478 - DNA, 15 bp, Homo sapiens
ttgctgtcctccagg

SEQ ID NO: 455479 - DNA, 13 bp, Homo sapiens
ttggagacataca

SEQ ID NO: 455480 - DNA, 23 bp, Homo sapiens
ttggagagctcagtacagggcag

SEQ ID NO: 455481 - DNA, 12 bp, Homo sapiens
ttggagaggagg

SEQ ID NO: 455482 - DNA, 22 bp, Homo sapiens
ttggagcagagacggcagcccc

SEQ ID NO: 455483 - DNA, 12 bp, Homo sapiens
ttggagggatgg

SEQ ID NO: 455484 - DNA, 16 bp, Homo sapiens
ttggaggttgaatagg

SEQ ID NO: 455485 - DNA, 20 bp, Homo sapiens
ttggattggtaccagagcct

SEQ ID NO: 455486 - DNA, 17 bp, Homo sapiens
ttggcagcttcaaaaca

SEQ ID NO: 455487 - DNA, 15 bp, Homo sapiens
ttggctcctttccca

SEQ ID NO: 455488 - DNA, 18 bp, Homo sapiens
ttggctgtaatgtaacag

SEQ ID NO: 455489 - DNA, 21 bp, Homo sapiens
ttgggaaattcttgcactgta

SEQ ID NO: 455490 - DNA, 15 bp, Homo sapiens
ttgggaactcatcaa

SEQ ID NO: 455491 - DNA, 15 bp, Homo sapiens
ttggggtagagagga

SEQ ID NO: 455492 - DNA, 13 bp, Homo sapiens
ttgggttccagac

SEQ ID NO: 455493 - DNA, 15 bp, Homo sapiens
ttggtgactgtccca

SEQ ID NO: 455494 - DNA, 23 bp, Homo sapiens
ttggttacaaatttttactcagg

SEQ ID NO: 455495 - DNA, 20 bp, Homo sapiens
ttgtaaccatatgattgaaa

SEQ ID NO: 455496 - DNA, 13 bp, Homo sapiens
ttgtaagaaaagc

SEQ ID NO: 455497 - DNA, 19 bp, Homo sapiens
ttgtaatatacagtttttg

SEQ ID NO: 455498 - DNA, 18 bp, Homo sapiens
ttgtacttacactgaaat

SEQ ID NO: 455499 - DNA, 14 bp, Homo sapiens
ttgtagctagaata

SEQ ID NO: 455500 - DNA, 17 bp, Homo sapiens
ttgtgctgtgggcagca

SEQ ID NO: 455501 - DNA, 21 bp, Homo sapiens
ttgtgctgtgggcagcaccct

SEQ ID NO: 455502 - DNA, 15 bp, Homo sapiens
ttgtgcttgttcttc

SEQ ID NO: 455503 - DNA, 12 bp, Homo sapiens
ttgtggacttta

SEQ ID NO: 455504 - DNA, 13 bp, Homo sapiens
ttgtggactttat

SEQ ID NO: 455505 - DNA, 14 bp, Homo sapiens
ttgtggctttatga

SEQ ID NO: 455506 - DNA, 14 bp, Homo sapiens
ttgtgttcaatctg

SEQ ID NO: 455507 - DNA, 13 bp, Homo sapiens
ttgttaggggtgg

SEQ ID NO: 455508 - DNA, 22 bp, Homo sapiens
ttgttaggggtgggggagaatg

SEQ ID NO: 455509 - DNA, 20 bp, Homo sapiens
ttgttcaaagaacccccctc

SEQ ID NO: 455510 - DNA, 15 bp, Homo sapiens
ttgttcaaatgcatt

SEQ ID NO: 455511 - DNA, 14 bp, Homo sapiens
ttgttcctttttct

SEQ ID NO: 455512 - DNA, 13 bp, Homo sapiens
ttgtttaaaagca

SEQ ID NO: 455513 - DNA, 16 bp, Homo sapiens
ttgtttctatactgtt

SEQ ID NO: 455514 - DNA, 22 bp, Homo sapiens
ttgtttttatatattataagtt

SEQ ID NO: 455515 - DNA, 18 bp, Homo sapiens
ttgttttttttttccact

SEQ ID NO: 455516 - DNA, 16 bp, Homo sapiens
tttaaatcagatacct

SEQ ID NO: 455517 - DNA, 18 bp, Homo sapiens
tttaaatgattccaaata

SEQ ID NO: 455518 - DNA, 14 bp, Homo sapiens
tttaaatttgttat

SEQ ID NO: 455519 - DNA, 15 bp, Homo sapiens
tttaacatacatcta

SEQ ID NO: 455520 - DNA, 15 bp, Homo sapiens
tttaatatactgcat

SEQ ID NO: 455521 - DNA, 14 bp, Homo sapiens
tttaatttcataaa

SEQ ID NO: 455522 - DNA, 15 bp, Homo sapiens
tttaatttcataaat

SEQ ID NO: 455523 - DNA, 17 bp, Homo sapiens
tttacccagtgggacag

SEQ ID NO: 455524 - DNA, 15 bp, Homo sapiens
tttactttgtgcaat

SEQ ID NO: 455525 - DNA, 20 bp, Homo sapiens
tttactttgtgcaatatgag

SEQ ID NO: 455526 - DNA, 23 bp, Homo sapiens
tttagacaaccatagaactgtcc

SEQ ID NO: 455527 - DNA, 13 bp, Homo sapiens
tttatactgtata

SEQ ID NO: 455528 - DNA, 23 bp, Homo sapiens
tttatatattataagttgacctt

SEQ ID NO: 455529 - DNA, 20 bp, Homo sapiens
tttatattgtttttatatat

SEQ ID NO: 455530 - DNA, 18 bp, Homo sapiens
tttatcttggtagtacat

SEQ ID NO: 455531 - DNA, 19 bp, Homo sapiens
tttatgtaagaagaaactg

SEQ ID NO: 455532 - DNA, 15 bp, Homo sapiens
tttcaaaatgcatgt

SEQ ID NO: 455533 - DNA, 19 bp, Homo sapiens
tttcaatgcatacaataaa

SEQ ID NO: 455534 - DNA, 16 bp, Homo sapiens
tttcacaaccttctgt

SEQ ID NO: 455535 - DNA, 14 bp, Homo sapiens
tttcactgctggct

SEQ ID NO: 455536 - DNA, 17 bp, Homo sapiens
tttcacttaaactttgt

SEQ ID NO: 455537 - DNA, 19 bp, Homo sapiens
tttcagaaagggcagcccc

SEQ ID NO: 455538 - DNA, 22 bp, Homo sapiens
tttcagaaagggcagcccctcc

SEQ ID NO: 455539 - DNA, 16 bp, Homo sapiens
tttcagcttgtttcta

SEQ ID NO: 455540 - DNA, 19 bp, Homo sapiens
tttcagcttgtttctatac

SEQ ID NO: 455541 - DNA, 13 bp, Homo sapiens
tttcatcaagtag

SEQ ID NO: 455542 - DNA, 20 bp, Homo sapiens
tttcatgtgttgcaaattat

SEQ ID NO: 455543 - DNA, 15 bp, Homo sapiens
tttcatgtttaagaa

SEQ ID NO: 455544 - DNA, 18 bp, Homo sapiens
tttccacatccccaccct

SEQ ID NO: 455545 - DNA, 23 bp, Homo sapiens
tttccaccaagggtatctgctgc

SEQ ID NO: 455546 - DNA, 22 bp, Homo sapiens
tttccacccagaccctccttcc

SEQ ID NO: 455547 - DNA, 11 bp, Homo sapiens
tttcccacagt

SEQ ID NO: 455548 - DNA, 22 bp, Homo sapiens
tttcccacccactagccctctt

SEQ ID NO: 455549 - DNA, 20 bp, Homo sapiens
tttccgtgagagtcatctca

SEQ ID NO: 455550 - DNA, 12 bp, Homo sapiens
tttcctctctct

SEQ ID NO: 455551 - DNA, 14 bp, Homo sapiens
tttcctctctctct

SEQ ID NO: 455552 - DNA, 24 bp, Homo sapiens
tttcctctctctctctctctctgt

SEQ ID NO: 455553 - DNA, 21 bp, Homo sapiens
tttcctttgacctctcacttt

SEQ ID NO: 455554 - DNA, 18 bp, Homo sapiens
tttctaaactgttttcat

SEQ ID NO: 455555 - DNA, 18 bp, Homo sapiens
tttctaagctttcttaca

SEQ ID NO: 455556 - DNA, 20 bp, Homo sapiens
tttctatggattcacttcta

SEQ ID NO: 455557 - DNA, 23 bp, Homo sapiens
tttctcgggtgcatttgagagaa

SEQ ID NO: 455558 - DNA, 22 bp, Homo sapiens
tttctgaattcataaaaataac

SEQ ID NO: 455559 - DNA, 18 bp, Homo sapiens
tttctgcagtattctgta

SEQ ID NO: 455560 - DNA, 19 bp, Homo sapiens
tttctgcagtattctgtag

SEQ ID NO: 455561 - DNA, 22 bp, Homo sapiens
tttctgtcctcaggtgaataac

SEQ ID NO: 455562 - DNA, 22 bp, Homo sapiens
tttctgtctttatgtaagaaga

SEQ ID NO: 455563 - DNA, 14 bp, Homo sapiens
tttcttttatatct

SEQ ID NO: 455564 - DNA, 16 bp, Homo sapiens
tttcttttatatctgt

SEQ ID NO: 455565 - DNA, 19 bp, Homo sapiens
tttcttttttttttcgtct

SEQ ID NO: 455566 - DNA, 16 bp, Homo sapiens
tttgaaaaaagaagag

SEQ ID NO: 455567 - DNA, 21 bp, Homo sapiens
tttgacctctcacttttttat

SEQ ID NO: 455568 - DNA, 23 bp, Homo sapiens
tttgagagcctttggtgaataac

SEQ ID NO: 455569 - DNA, 16 bp, Homo sapiens
tttgagcctgggaaat

SEQ ID NO: 455570 - DNA, 21 bp, Homo sapiens
tttgatctggtgcgtgtggcc

SEQ ID NO: 455571 - DNA, 15 bp, Homo sapiens
tttgcaatcttatgt

SEQ ID NO: 455572 - DNA, 19 bp, Homo sapiens
tttgcaatcttatgttgat

SEQ ID NO: 455573 - DNA, 17 bp, Homo sapiens
tttgctgaagtctcccc

SEQ ID NO: 455574 - DNA, 22 bp, Homo sapiens
tttgggggattcaaatgcatga

SEQ ID NO: 455575 - DNA, 15 bp, Homo sapiens
tttgtaaccatatga

SEQ ID NO: 455576 - DNA, 14 bp, Homo sapiens
tttgtaatatacag

SEQ ID NO: 455577 - DNA, 18 bp, Homo sapiens
tttgtaatatacagtttt

SEQ ID NO: 455578 - DNA, 13 bp, Homo sapiens
tttgtcacttctg

SEQ ID NO: 455579 - DNA, 16 bp, Homo sapiens
aattaggtaatggata

SEQ ID NO: 455580 - DNA, 15 bp, Homo sapiens
aattataatgcatct

SEQ ID NO: 455581 - DNA, 18 bp, Homo sapiens
aattatatgatatgcatg

SEQ ID NO: 455582 - DNA, 23 bp, Homo sapiens
aattattactttaaattatatga

SEQ ID NO: 455583 - DNA, 14 bp, Homo sapiens
aattcataaaaata

SEQ ID NO: 455584 - DNA, 17 bp, Homo sapiens
aattctagtctctgatt

SEQ ID NO: 455585 - DNA, 22 bp, Homo sapiens
aattcttgcactgtatccaagt

SEQ ID NO: 455586 - DNA, 18 bp, Homo sapiens
aattggctcctttcccac

SEQ ID NO: 455587 - DNA, 20 bp, Homo sapiens
aattggctcctttcccacag

SEQ ID NO: 455588 - DNA, 21 bp, Homo sapiens
aattggctcctttcccacagt

SEQ ID NO: 455589 - DNA, 13 bp, Homo sapiens
aattggcttgttt

SEQ ID NO: 455590 - DNA, 17 bp, Homo sapiens
aattgttatgtaaacat

SEQ ID NO: 455591 - DNA, 14 bp, Homo sapiens
aattgtttaaaagc

SEQ ID NO: 455592 - DNA, 15 bp, Homo sapiens
aatttaactgcatat

SEQ ID NO: 455593 - DNA, 18 bp, Homo sapiens
aatttaactgcatataga

SEQ ID NO: 455594 - DNA, 22 bp, Homo sapiens
aatttaactgcatatagataat

SEQ ID NO: 455595 - DNA, 15 bp, Homo sapiens
aatttaatatactgc

SEQ ID NO: 455596 - DNA, 14 bp, Homo sapiens
aatttcaaaatgca

SEQ ID NO: 455597 - DNA, 16 bp, Homo sapiens
aatttcaaaatgcatg

SEQ ID NO: 455598 - DNA, 19 bp, Homo sapiens
aatttcaaaatgcatgtga

SEQ ID NO: 455599 - DNA, 22 bp, Homo sapiens
aatttcaaagaaaacagaccag

SEQ ID NO: 455600 - DNA, 16 bp, Homo sapiens
aatttcaaagtatgtt

SEQ ID NO: 455601 - DNA, 12 bp, Homo sapiens
aatttcataaat

SEQ ID NO: 455602 - DNA, 13 bp, Homo sapiens
aatttcataaatt

SEQ ID NO: 455603 - DNA, 16 bp, Homo sapiens
aatttcataaattggc

SEQ ID NO: 455604 - DNA, 18 bp, Homo sapiens
aatttctggtttgcctga

SEQ ID NO: 455605 - DNA, 19 bp, Homo sapiens
aatttctttgtcattcaag

SEQ ID NO: 455606 - DNA, 22 bp, Homo sapiens
aatttttactcaggctttctat

SEQ ID NO: 455607 - DNA, 21 bp, Homo sapiens
aattttttttttaaatgattc

SEQ ID NO: 455608 - DNA, 17 bp, Homo sapiens
acaaaaggctggatgtg

SEQ ID NO: 455609 - DNA, 19 bp, Homo sapiens
acaaactcaaaatctggga

SEQ ID NO: 455610 - DNA, 15 bp, Homo sapiens
acaaacttactgtca

SEQ ID NO: 455611 - DNA, 18 bp, Homo sapiens
acaaagtttggaagtaca

SEQ ID NO: 455612 - DNA, 19 bp, Homo sapiens
acaaataagtaatatcttt

SEQ ID NO: 455613 - DNA, 16 bp, Homo sapiens
acaaatatagttgaac

SEQ ID NO: 455614 - DNA, 15 bp, Homo sapiens
acaaatttttactca

SEQ ID NO: 455615 - DNA, 18 bp, Homo sapiens
acaaatttttactcaggc

SEQ ID NO: 455616 - DNA, 18 bp, Homo sapiens
acaaccactgggatcagc

SEQ ID NO: 455617 - DNA, 16 bp, Homo sapiens
acaaccatagaactgt

SEQ ID NO: 455618 - DNA, 18 bp, Homo sapiens
acaaccttctgtggctca

SEQ ID NO: 455619 - DNA, 18 bp, Homo sapiens
acaactaacaatgccttg

SEQ ID NO: 455620 - DNA, 12 bp, Homo sapiens
acaacttccaga

SEQ ID NO: 455621 - DNA, 14 bp, Homo sapiens
acaacttccagatt

SEQ ID NO: 455622 - DNA, 11 bp, Homo sapiens
acaataaaaga

SEQ ID NO: 455623 - DNA, 15 bp, Homo sapiens
acaataaaagagctt

SEQ ID NO: 455624 - DNA, 16 bp, Homo sapiens
acaataaaagagcttt

SEQ ID NO: 455625 - DNA, 12 bp, Homo sapiens
acaataaacgaa

SEQ ID NO: 455626 - DNA, 18 bp, Homo sapiens
acaataaacgaaacacag

SEQ ID NO: 455627 - DNA, 23 bp, Homo sapiens
acaataaacgaaacacagaactc

SEQ ID NO: 455628 - DNA, 16 bp, Homo sapiens
acaatttcaaaatgca

SEQ ID NO: 455629 - DNA, 12 bp, Homo sapiens
aaccctcagagc

SEQ ID NO: 455630 - DNA, 18 bp, Homo sapiens
aaccctcggagcccccca

SEQ ID NO: 455631 - DNA, 17 bp, Homo sapiens
aaccctgccctgcacct

SEQ ID NO: 455632 - DNA, 23 bp, Homo sapiens
aacctcactatggtatgctggcc

SEQ ID NO: 455633 - DNA, 15 bp, Homo sapiens
aacctctacaggcat

SEQ ID NO: 455634 - DNA, 16 bp, Homo sapiens
aacctctacaggcatt

SEQ ID NO: 455635 - DNA, 18 bp, Homo sapiens
aacctgggttgttgcaga

SEQ ID NO: 455636 - DNA, 18 bp, Homo sapiens
aacctttccgctgtcgcc

SEQ ID NO: 455637 - DNA, 12 bp, Homo sapiens
aacctttgtcaa

SEQ ID NO: 455638 - DNA, 15 bp, Homo sapiens
aactaagcaagtata

SEQ ID NO: 455639 - DNA, 16 bp, Homo sapiens
aactaagttgtatttt

SEQ ID NO: 455640 - DNA, 17 bp, Homo sapiens
aactaagttgtatttta

SEQ ID NO: 455641 - DNA, 17 bp, Homo sapiens
aactaccacattctgtc

SEQ ID NO: 455642 - DNA, 17 bp, Homo sapiens
aactatcggttcaagtt

SEQ ID NO: 455643 - DNA, 23 bp, Homo sapiens
aactattaggaggaatgtgcttt

SEQ ID NO: 455644 - DNA, 13 bp, Homo sapiens
aactcagccttaa

SEQ ID NO: 455645 - DNA, 17 bp, Homo sapiens
aactcatctgttatcct

SEQ ID NO: 455646 - DNA, 18 bp, Homo sapiens
aactctgcatagacaaag

SEQ ID NO: 455647 - DNA, 23 bp, Homo sapiens
aactgcatcgatccccagcctgg

SEQ ID NO: 455648 - DNA, 19 bp, Homo sapiens
aactgcccccctcctttcc

SEQ ID NO: 455649 - DNA, 19 bp, Homo sapiens
aactgctgttttatgtcat

SEQ ID NO: 455650 - DNA, 18 bp, Homo sapiens
aactggaaggctttattc

SEQ ID NO: 455651 - DNA, 14 bp, Homo sapiens
aactggattatcta

SEQ ID NO: 455652 - DNA, 17 bp, Homo sapiens
aactgtcccacaaaata

SEQ ID NO: 455653 - DNA, 19 bp, Homo sapiens
aactgttaacccagtgttc

SEQ ID NO: 455654 - DNA, 13 bp, Homo sapiens
aacttaaaagaac

SEQ ID NO: 455655 - DNA, 14 bp, Homo sapiens
aacttaaaagaaca

SEQ ID NO: 455656 - DNA, 15 bp, Homo sapiens
aacttcagcaaccct

SEQ ID NO: 455657 - DNA, 19 bp, Homo sapiens
aacttctgaactttggaag

SEQ ID NO: 455658 - DNA, 12 bp, Homo sapiens
aacttgtactta

SEQ ID NO: 455659 - DNA, 15 bp, Homo sapiens
aactttcacctcaga

SEQ ID NO: 455660 - DNA, 17 bp, Homo sapiens
aactttcacctcagatt

SEQ ID NO: 455661 - DNA, 21 bp, Homo sapiens
aactttcacctcagattttct

SEQ ID NO: 455662 - DNA, 20 bp, Homo sapiens
aactttgtcacttctgctgt

SEQ ID NO: 455663 - DNA, 12 bp, Homo sapiens
aagaaaataacc

SEQ ID NO: 455664 - DNA, 12 bp, Homo sapiens
aagaaatgagaa

SEQ ID NO: 455665 - DNA, 13 bp, Homo sapiens
aagaaatgagaaa

SEQ ID NO: 455666 - DNA, 21 bp, Homo sapiens
aagaacccccctccccaagga

SEQ ID NO: 455667 - DNA, 21 bp, Homo sapiens
aagaataaataaagaagaaaa

SEQ ID NO: 455668 - DNA, 19 bp, Homo sapiens
aagacaaatatttctttct

SEQ ID NO: 455669 - DNA, 14 bp, Homo sapiens
aagacaacaggcat

SEQ ID NO: 455670 - DNA, 22 bp, Homo sapiens
aagaccatttagtcctcacctt

SEQ ID NO: 455671 - DNA, 12 bp, Homo sapiens
aagacgtttttg

SEQ ID NO: 455672 - DNA, 21 bp, Homo sapiens
aagacgtttttgtgctgtggg

SEQ ID NO: 455673 - DNA, 22 bp, Homo sapiens
ccgagcgcgtgccttccccgtg

SEQ ID NO: 455674 - DNA, 14 bp, Homo sapiens
ccgaggcccccctc

SEQ ID NO: 455675 - DNA, 14 bp, Homo sapiens
ccgagtctcttctc

SEQ ID NO: 455676 - DNA, 22 bp, Homo sapiens
ccgagtctcttctccactggat

SEQ ID NO: 455677 - DNA, 12 bp, Homo sapiens
ccgcagcaccag

SEQ ID NO: 455678 - DNA, 15 bp, Homo sapiens
ccgcagcaccagcct

SEQ ID NO: 455679 - DNA, 17 bp, Homo sapiens
ccgcagcaccagcctga

SEQ ID NO: 455680 - DNA, 21 bp, Homo sapiens
ccgcagccctctccacccaga

SEQ ID NO: 455681 - DNA, 23 bp, Homo sapiens
ccgcagccctctccacccagagg

SEQ ID NO: 455682 - DNA, 17 bp, Homo sapiens
ccgcagggcgctccggc

SEQ ID NO: 455683 - DNA, 15 bp, Homo sapiens
ccgccaccccactga

SEQ ID NO: 455684 - DNA, 19 bp, Homo sapiens
ccgccaccccactgagagc

SEQ ID NO: 455685 - DNA, 16 bp, Homo sapiens
ccgcccaccccgctgc

SEQ ID NO: 455686 - DNA, 18 bp, Homo sapiens
ccgcccaccccgctgcct

SEQ ID NO: 455687 - DNA, 13 bp, Homo sapiens
ccgccccaaccct

SEQ ID NO: 455688 - DNA, 17 bp, Homo sapiens
ccgccccaaccctcgga

SEQ ID NO: 455689 - DNA, 13 bp, Homo sapiens
ccgccccagagac

SEQ ID NO: 455690 - DNA, 14 bp, Homo sapiens
ccgccccagagact

SEQ ID NO: 455691 - DNA, 22 bp, Homo sapiens
ccgccccagagactgcccaccc

SEQ ID NO: 455692 - DNA, 14 bp, Homo sapiens
ccgcccgcccaccc

SEQ ID NO: 455693 - DNA, 14 bp, Homo sapiens
ccgcccgcccccgc

SEQ ID NO: 455694 - DNA, 15 bp, Homo sapiens
ccgcccgcccccgcc

SEQ ID NO: 455695 - DNA, 11 bp, Homo sapiens
ccgccctcctc

SEQ ID NO: 455696 - DNA, 13 bp, Homo sapiens
ccgccctcctctg

SEQ ID NO: 455697 - DNA, 14 bp, Homo sapiens
ccgccctcctctgc

SEQ ID NO: 455698 - DNA, 17 bp, Homo sapiens
ccgccctcctctgcccc

SEQ ID NO: 455699 - DNA, 13 bp, Homo sapiens
ccgccctcgctcc

SEQ ID NO: 455700 - DNA, 18 bp, Homo sapiens
ccgccctgggctgtctgt

SEQ ID NO: 455701 - DNA, 15 bp, Homo sapiens
ccgccgcctcgggcc

SEQ ID NO: 455702 - DNA, 16 bp, Homo sapiens
ccgccggttggccggc

SEQ ID NO: 455703 - DNA, 21 bp, Homo sapiens
ccgccggttggccggctggcc

SEQ ID NO: 455704 - DNA, 13 bp, Homo sapiens
ccgcctcctccag

SEQ ID NO: 455705 - DNA, 18 bp, Homo sapiens
ccgcctcgggccgcctcc

SEQ ID NO: 455706 - DNA, 20 bp, Homo sapiens
ccgcctcgggccgcctcctc

SEQ ID NO: 455707 - DNA, 21 bp, Homo sapiens
ccgccttcaggttcctcctag

SEQ ID NO: 455708 - DNA, 18 bp, Homo sapiens
ccgcgcgtgcccccagcg

SEQ ID NO: 455709 - DNA, 19 bp, Homo sapiens
cccggaggcgcccacctgc

SEQ ID NO: 455710 - DNA, 23 bp, Homo sapiens
cccggaggcgcccacctgcccag

SEQ ID NO: 455711 - DNA, 19 bp, Homo sapiens
cccggcggcggccagggac

SEQ ID NO: 455712 - DNA, 16 bp, Homo sapiens
cccgggggtccccgga

SEQ ID NO: 455713 - DNA, 17 bp, Homo sapiens
cccgtccgtccgcccgc

SEQ ID NO: 455714 - DNA, 12 bp, Homo sapiens
cccgtctgcccc

SEQ ID NO: 455715 - DNA, 22 bp, Homo sapiens
cccgtgcggcccgtgcgcagcc

SEQ ID NO: 455716 - DNA, 17 bp, Homo sapiens
cccgtgttcacacacac

SEQ ID NO: 455717 - DNA, 23 bp, Homo sapiens
cccgttgtgtgggtttactctgt

SEQ ID NO: 455718 - DNA, 15 bp, Homo sapiens
ccctacagtatataa

SEQ ID NO: 455719 - DNA, 14 bp, Homo sapiens
ccctagaagaaaac

SEQ ID NO: 455720 - DNA, 15 bp, Homo sapiens
ccctagaagaaaacc

SEQ ID NO: 455721 - DNA, 21 bp, Homo sapiens
ccctaggtctccacccctcaa

SEQ ID NO: 455722 - DNA, 16 bp, Homo sapiens
ccctagtgatttttgg

SEQ ID NO: 455723 - DNA, 21 bp, Homo sapiens
ccctataccctaggtctccac

SEQ ID NO: 455724 - DNA, 20 bp, Homo sapiens
ccctatcctgcaccctctgc

SEQ ID NO: 455725 - DNA, 21 bp, Homo sapiens
ccctcaagccaggagaccctg

SEQ ID NO: 455726 - DNA, 22 bp, Homo sapiens
ccctcaagccaggagaccctgt

SEQ ID NO: 455727 - DNA, 14 bp, Homo sapiens
ccctcactccactc

SEQ ID NO: 455728 - DNA, 21 bp, Homo sapiens
ccctcactccactcccctcat

SEQ ID NO: 455729 - DNA, 15 bp, Homo sapiens
ccctcactctgtcag

SEQ ID NO: 455730 - DNA, 18 bp, Homo sapiens
ccctcagatgatctctcc

SEQ ID NO: 455731 - DNA, 22 bp, Homo sapiens
ccctcagatgatctctccacgg

SEQ ID NO: 455732 - DNA, 13 bp, Homo sapiens
ccctccacacctc

SEQ ID NO: 455733 - DNA, 13 bp, Homo sapiens
ccctccactcctc

SEQ ID NO: 455734 - DNA, 16 bp, Homo sapiens
ccctccactctgaggt

SEQ ID NO: 455735 - DNA, 10 bp, Homo sapiens
ccctccagac

SEQ ID NO: 455736 - DNA, 16 bp, Homo sapiens
ccctccagacccctac

SEQ ID NO: 455737 - DNA, 17 bp, Homo sapiens
ccctccagacccctacc

SEQ ID NO: 455738 - DNA, 16 bp, Homo sapiens
ccctccccaaggaaga

SEQ ID NO: 455739 - DNA, 13 bp, Homo sapiens
ccctcccccgcag

SEQ ID NO: 455740 - DNA, 18 bp, Homo sapiens
ccctcccccgcagacaga

SEQ ID NO: 455741 - DNA, 20 bp, Homo sapiens
ccatgtgtcccctcactctg

SEQ ID NO: 455742 - DNA, 22 bp, Homo sapiens
ccatgtgtcccctcactctgtc

SEQ ID NO: 455743 - DNA, 18 bp, Homo sapiens
ccattatggctttgtgct

SEQ ID NO: 455744 - DNA, 22 bp, Homo sapiens
ccattctatgactcttgtctcc

SEQ ID NO: 455745 - DNA, 22 bp, Homo sapiens
ccattgcaaaaggttaagccat

SEQ ID NO: 455746 - DNA, 22 bp, Homo sapiens
ccatttagtcctcaccttctgt

SEQ ID NO: 455747 - DNA, 22 bp, Homo sapiens
ccatttgtaccgaaacaccccg

SEQ ID NO: 455748 - DNA, 12 bp, Homo sapiens
ccattttggaaa

SEQ ID NO: 455749 - DNA, 14 bp, Homo sapiens
ccattttggaaaat

SEQ ID NO: 455750 - DNA, 13 bp, Homo sapiens
cccaacaccaccc

SEQ ID NO: 455751 - DNA, 19 bp, Homo sapiens
cccaacccccacctcccgg

SEQ ID NO: 455752 - DNA, 18 bp, Homo sapiens
cccaagatgagctgcagc

SEQ ID NO: 455753 - DNA, 19 bp, Homo sapiens
cccaagatgagctgcagcc

SEQ ID NO: 455754 - DNA, 23 bp, Homo sapiens
cccaaggtggtcttggagaggag

SEQ ID NO: 455755 - DNA, 21 bp, Homo sapiens
cccaagtcaaacagtgtggct

SEQ ID NO: 455756 - DNA, 17 bp, Homo sapiens
cccacacgccggggctg

SEQ ID NO: 455757 - DNA, 20 bp, Homo sapiens
cccacacgccggggctggcc

SEQ ID NO: 455758 - DNA, 21 bp, Homo sapiens
cccacacgccggggctggccc

SEQ ID NO: 455759 - DNA, 22 bp, Homo sapiens
cccacacgccggggctggccct

SEQ ID NO: 455760 - DNA, 17 bp, Homo sapiens
cccaccacacacaccct

SEQ ID NO: 455761 - DNA, 14 bp, Homo sapiens
cccaccatccttcc

SEQ ID NO: 455762 - DNA, 21 bp, Homo sapiens
cccaccatccttccatcctga

SEQ ID NO: 455763 - DNA, 21 bp, Homo sapiens
cccacccacaccccgtctgcc

SEQ ID NO: 455764 - DNA, 13 bp, Homo sapiens
cccacccaccacc

SEQ ID NO: 455765 - DNA, 21 bp, Homo sapiens
cccaccccataagccctgaga

SEQ ID NO: 455766 - DNA, 16 bp, Homo sapiens
cccaccccgctgcctg

SEQ ID NO: 455767 - DNA, 22 bp, Homo sapiens
cccacccctcttcccccttccc

SEQ ID NO: 455768 - DNA, 23 bp, Homo sapiens
cccacccggcggcggccagggac

SEQ ID NO: 455769 - DNA, 19 bp, Homo sapiens
cccaccctgggcctcccgt

SEQ ID NO: 455770 - DNA, 23 bp, Homo sapiens
cccaccgggagcctccccctcag

SEQ ID NO: 455771 - DNA, 12 bp, Homo sapiens
cccacctgccca

SEQ ID NO: 455772 - DNA, 12 bp, Homo sapiens
cccacgcagagc

SEQ ID NO: 455773 - DNA, 14 bp, Homo sapiens
cccacgcagagccc

SEQ ID NO: 455774 - DNA, 16 bp, Homo sapiens
cccacgcagagccccg

SEQ ID NO: 455775 - DNA, 21 bp, Homo sapiens
cccacgcagagccccggagca

SEQ ID NO: 455776 - DNA, 13 bp, Homo sapiens
cccacgctcctgc

SEQ ID NO: 455777 - DNA, 22 bp, Homo sapiens
cccacgctcctgccctcgtctc

SEQ ID NO: 455778 - DNA, 19 bp, Homo sapiens
cccacggccgtccctgact

SEQ ID NO: 455779 - DNA, 14 bp, Homo sapiens
cccactagccctct

SEQ ID NO: 455780 - DNA, 21 bp, Homo sapiens
cccactgagagctgctccttt

SEQ ID NO: 455781 - DNA, 22 bp, Homo sapiens
cccactgagagctgctcctttg

SEQ ID NO: 455782 - DNA, 19 bp, Homo sapiens
cccacttatgctgctgtga

SEQ ID NO: 455783 - DNA, 20 bp, Homo sapiens
cccacttatgctgctgtgaa

SEQ ID NO: 455784 - DNA, 13 bp, Homo sapiens
cccagaacgggcc

SEQ ID NO: 455785 - DNA, 17 bp, Homo sapiens
cccagaacgggcctccc

SEQ ID NO: 455786 - DNA, 12 bp, Homo sapiens
cccagaccctcc

SEQ ID NO: 455787 - DNA, 15 bp, Homo sapiens
cccagagactgccca

SEQ ID NO: 455788 - DNA, 20 bp, Homo sapiens
cccagagactgcccaccctg

SEQ ID NO: 455789 - DNA, 22 bp, Homo sapiens
cccagagactgcccaccctggg

SEQ ID NO: 455790 - DNA, 23 bp, Homo sapiens
cccagagactgcccaccctgggc

SEQ ID NO: 455791 - DNA, 15 bp, Homo sapiens
cccagaggtctccct

SEQ ID NO: 455792 - DNA, 16 bp, Homo sapiens
cccagaggtctcccta

SEQ ID NO: 455793 - DNA, 16 bp, Homo sapiens
cccagcacctggcaca

SEQ ID NO: 455794 - DNA, 14 bp, Homo sapiens
cccagccggggtgg

SEQ ID NO: 455795 - DNA, 22 bp, Homo sapiens
cccagcctctccccgctctgga

SEQ ID NO: 455796 - DNA, 21 bp, Homo sapiens
cccagctgatctaaggacccc

SEQ ID NO: 455797 - DNA, 13 bp, Homo sapiens
cccagctggcagc

SEQ ID NO: 455798 - DNA, 18 bp, Homo sapiens
cccagctggcagcgcctc

SEQ ID NO: 455799 - DNA, 19 bp, Homo sapiens
cccaggaggacctgggggg

SEQ ID NO: 455800 - DNA, 15 bp, Homo sapiens
cccaggccctccctg

SEQ ID NO: 455801 - DNA, 13 bp, Homo sapiens
cccaggctgcgcc

SEQ ID NO: 455802 - DNA, 14 bp, Homo sapiens
cccaggctgcgcct

SEQ ID NO: 455803 - DNA, 21 bp, Homo sapiens
cccagggggaagatgccaagg

SEQ ID NO: 455804 - DNA, 20 bp, Homo sapiens
cccagtctttggagagctca

SEQ ID NO: 455805 - DNA, 19 bp, Homo sapiens
cccagttagcccggccaag

SEQ ID NO: 455806 - DNA, 22 bp, Homo sapiens
cccagtttgggaactcatcaaa

SEQ ID NO: 455807 - DNA, 15 bp, Homo sapiens
cccataagccctgag

SEQ ID NO: 455808 - DNA, 16 bp, Homo sapiens
cccataagccctgaga

SEQ ID NO: 455809 - DNA, 18 bp, Homo sapiens
cccatatataaattatta

SEQ ID NO: 455810 - DNA, 19 bp, Homo sapiens
cccatggccccagctggct

SEQ ID NO: 455811 - DNA, 14 bp, Homo sapiens
cccatggtgcagtg

SEQ ID NO: 455812 - DNA, 17 bp, Homo sapiens
ccccaaggaagaacaaa

SEQ ID NO: 455813 - DNA, 19 bp, Homo sapiens
ccccacacgccggggctgg

SEQ ID NO: 455814 - DNA, 20 bp, Homo sapiens
ccccacacgccggggctggc

SEQ ID NO: 455815 - DNA, 17 bp, Homo sapiens
ccccaccacacacaccc

SEQ ID NO: 455816 - DNA, 16 bp, Homo sapiens
ccccacccaccaccgc

SEQ ID NO: 455817 - DNA, 13 bp, Homo sapiens
ccccacctcctgc

SEQ ID NO: 455818 - DNA, 18 bp, Homo sapiens
ccccacggccgtccctga

SEQ ID NO: 455819 - DNA, 20 bp, Homo sapiens
ccccactgagagctgctcct

SEQ ID NO: 455820 - DNA, 16 bp, Homo sapiens
ccccacttatgctgct

SEQ ID NO: 455821 - DNA, 18 bp, Homo sapiens
ccccacttatgctgctgt

SEQ ID NO: 455822 - DNA, 19 bp, Homo sapiens
ccccacttatgctgctgtg

SEQ ID NO: 455823 - DNA, 21 bp, Homo sapiens
ccccagagactgcccaccctg

SEQ ID NO: 455824 - DNA, 22 bp, Homo sapiens
ccccagagactgcccaccctgg

SEQ ID NO: 455825 - DNA, 10 bp, Homo sapiens
ccccagcctc

SEQ ID NO: 455826 - DNA, 15 bp, Homo sapiens
ccccagcctccaggc

SEQ ID NO: 455827 - DNA, 12 bp, Homo sapiens
ccccagcctccc

SEQ ID NO: 455828 - DNA, 15 bp, Homo sapiens
ccccaggccctccct

SEQ ID NO: 455829 - DNA, 21 bp, Homo sapiens
ccccaggcggaggggcttgga

SEQ ID NO: 455830 - DNA, 18 bp, Homo sapiens
ccccaggctgcgcctgcc

SEQ ID NO: 455831 - DNA, 22 bp, Homo sapiens
ccccaggctgcgcctgcccgcc

SEQ ID NO: 455832 - DNA, 20 bp, Homo sapiens
ccccagttaatgtgccaaaa

SEQ ID NO: 455833 - DNA, 19 bp, Homo sapiens
ccccataagccctgagact

SEQ ID NO: 455834 - DNA, 13 bp, Homo sapiens
ccccatccttccc

SEQ ID NO: 455835 - DNA, 14 bp, Homo sapiens
ccccatgtgcctgc

SEQ ID NO: 455836 - DNA, 14 bp, Homo sapiens
cccccaacaccacc

SEQ ID NO: 455837 - DNA, 18 bp, Homo sapiens
cccccagagagagctctg

SEQ ID NO: 455838 - DNA, 17 bp, Homo sapiens
ccagaacgggcctcccc

SEQ ID NO: 455839 - DNA, 18 bp, Homo sapiens
ccagaacgggcctccccg

SEQ ID NO: 455840 - DNA, 14 bp, Homo sapiens
ccagaagagtcttt

SEQ ID NO: 455841 - DNA, 16 bp, Homo sapiens
ccagaagtgccatgct

SEQ ID NO: 455842 - DNA, 18 bp, Homo sapiens
ccagacagagatcagaat

SEQ ID NO: 455843 - DNA, 18 bp, Homo sapiens
ccagacccctggcttttc

SEQ ID NO: 455844 - DNA, 13 bp, Homo sapiens
ccagaccctcctt

SEQ ID NO: 455845 - DNA, 14 bp, Homo sapiens
ccagaccctccttc

SEQ ID NO: 455846 - DNA, 18 bp, Homo sapiens
ccagaccgatccttccca

SEQ ID NO: 455847 - DNA, 24 bp, Homo sapiens
ccagacgctgccgctgccgctgca

SEQ ID NO: 455848 - DNA, 20 bp, Homo sapiens
ccagactcgagagggctgag

SEQ ID NO: 455849 - DNA, 22 bp, Homo sapiens
ccagactcgagagggctgagcc

SEQ ID NO: 455850 - DNA, 23 bp, Homo sapiens
ccagactcgagagggctgagccc

SEQ ID NO: 455851 - DNA, 13 bp, Homo sapiens
ccagactctgccc

SEQ ID NO: 455852 - DNA, 17 bp, Homo sapiens
ccagagactgcccaccc

SEQ ID NO: 455853 - DNA, 18 bp, Homo sapiens
ccagagactgcccaccct

SEQ ID NO: 455854 - DNA, 21 bp, Homo sapiens
ccagagactgcccaccctggg

SEQ ID NO: 455855 - DNA, 12 bp, Homo sapiens
ccagagagaagc

SEQ ID NO: 455856 - DNA, 19 bp, Homo sapiens
ccagagagaagcaccccac

SEQ ID NO: 455857 - DNA, 14 bp, Homo sapiens
ccagagagtggctc

SEQ ID NO: 455858 - DNA, 18 bp, Homo sapiens
ccagagagtggctcctcc

SEQ ID NO: 455859 - DNA, 22 bp, Homo sapiens
ccagagctcatttcggggtcag

SEQ ID NO: 455860 - DNA, 15 bp, Homo sapiens
ccagagggggccaga

SEQ ID NO: 455861 - DNA, 16 bp, Homo sapiens
ccagaggtctccctat

SEQ ID NO: 455862 - DNA, 14 bp, Homo sapiens
ccagatgcaacctc

SEQ ID NO: 455863 - DNA, 18 bp, Homo sapiens
ccagattattttctatat

SEQ ID NO: 455864 - DNA, 20 bp, Homo sapiens
ccagcaccctctcctggggg

SEQ ID NO: 455865 - DNA, 23 bp, Homo sapiens
ccagcaccctctcctgggggtgg

SEQ ID NO: 455866 - DNA, 15 bp, Homo sapiens
ccagcactcccaggg

SEQ ID NO: 455867 - DNA, 16 bp, Homo sapiens
ccagcactcccagggc

SEQ ID NO: 455868 - DNA, 22 bp, Homo sapiens
ccagcactcccagggcccgagc

SEQ ID NO: 455869 - DNA, 18 bp, Homo sapiens
ccagcagtgctgggccca

SEQ ID NO: 455870 - DNA, 14 bp, Homo sapiens
ccagcatagttctg

SEQ ID NO: 455871 - DNA, 17 bp, Homo sapiens
ccagcatagttctgcaa

SEQ ID NO: 455872 - DNA, 20 bp, Homo sapiens
ccagcatagttctgcaataa

SEQ ID NO: 455873 - DNA, 16 bp, Homo sapiens
ccagcctccaggcccc

SEQ ID NO: 455874 - DNA, 19 bp, Homo sapiens
ccagcctccaggcccccaa

SEQ ID NO: 455875 - DNA, 14 bp, Homo sapiens
ccagcctcccccag

SEQ ID NO: 455876 - DNA, 22 bp, Homo sapiens
ccagcctcccccaggctgcgcc

SEQ ID NO: 455877 - DNA, 23 bp, Homo sapiens
ccagcctctccccgctctggatc

SEQ ID NO: 455878 - DNA, 19 bp, Homo sapiens
ccagcctgagccacagtgg

SEQ ID NO: 455879 - DNA, 16 bp, Homo sapiens
ccagctccccccaaga

SEQ ID NO: 455880 - DNA, 12 bp, Homo sapiens
ccagctggcagc

SEQ ID NO: 455881 - DNA, 14 bp, Homo sapiens
ccagctggcagcgc

SEQ ID NO: 455882 - DNA, 15 bp, Homo sapiens
ccagctggcagcgcc

SEQ ID NO: 455883 - DNA, 18 bp, Homo sapiens
ccagctggcagcgcctcc

SEQ ID NO: 455884 - DNA, 20 bp, Homo sapiens
ccagctggcagcgcctcccg

SEQ ID NO: 455885 - DNA, 20 bp, Homo sapiens
ccagctggctgggtcgcccc

SEQ ID NO: 455886 - DNA, 16 bp, Homo sapiens
ccaggagacagacaga

SEQ ID NO: 455887 - DNA, 13 bp, Homo sapiens
ccaggagaccctg

SEQ ID NO: 455888 - DNA, 17 bp, Homo sapiens
ccaggagaccctgtctt

SEQ ID NO: 455889 - DNA, 14 bp, Homo sapiens
ccaggaggacctgg

SEQ ID NO: 455890 - DNA, 20 bp, Homo sapiens
ccaggattaatctctaaaat

SEQ ID NO: 455891 - DNA, 16 bp, Homo sapiens
ccaggccaactgcccc

SEQ ID NO: 455892 - DNA, 18 bp, Homo sapiens
ccaggccccagcctccag

SEQ ID NO: 455893 - DNA, 16 bp, Homo sapiens
ccaggcccctgccccc

SEQ ID NO: 455894 - DNA, 16 bp, Homo sapiens
ccaggctgcgcctgcc

SEQ ID NO: 455895 - DNA, 14 bp, Homo sapiens
ccaggctggggcct

SEQ ID NO: 455896 - DNA, 16 bp, Homo sapiens
ccaggctggggcctgg

SEQ ID NO: 455897 - DNA, 17 bp, Homo sapiens
ccaggctggggcctggc

SEQ ID NO: 455898 - DNA, 23 bp, Homo sapiens
ccaggctggggcctggcctattt

SEQ ID NO: 455899 - DNA, 18 bp, Homo sapiens
ccagggacccccgaggcc

SEQ ID NO: 455900 - DNA, 20 bp, Homo sapiens
ccagggacccccgaggcccc

SEQ ID NO: 455901 - DNA, 22 bp, Homo sapiens
ccagggatgggggatgggccag

SEQ ID NO: 455902 - DNA, 20 bp, Homo sapiens
ccagggggaagatgccaagg

SEQ ID NO: 455903 - DNA, 20 bp, Homo sapiens
ccagggttaaagaaaggcag

SEQ ID NO: 455904 - DNA, 15 bp, Homo sapiens
ccagggttccagaca

SEQ ID NO: 455905 - DNA, 16 bp, Homo sapiens
ccagggttccagacag

SEQ ID NO: 455906 - DNA, 17 bp, Homo sapiens
ccagggtttacccagtg

SEQ ID NO: 455907 - DNA, 12 bp, Homo sapiens
ccaggttacctc

SEQ ID NO: 455908 - DNA, 22 bp, Homo sapiens
ccagtcttgagtgggccccctc

SEQ ID NO: 455909 - DNA, 20 bp, Homo sapiens
ccagtctttggagagctcag

SEQ ID NO: 455910 - DNA, 16 bp, Homo sapiens
ccagtgggacagagga

SEQ ID NO: 455911 - DNA, 17 bp, Homo sapiens
cagtgctgggcccagcc

SEQ ID NO: 455912 - DNA, 10 bp, Homo sapiens
cagtggaaga

SEQ ID NO: 455913 - DNA, 13 bp, Homo sapiens
cagtggagagggg

SEQ ID NO: 455914 - DNA, 18 bp, Homo sapiens
cagtggagaggggacttg

SEQ ID NO: 455915 - DNA, 19 bp, Homo sapiens
cagtggagaggggacttgg

SEQ ID NO: 455916 - DNA, 13 bp, Homo sapiens
cagtgggacagag

SEQ ID NO: 455917 - DNA, 16 bp, Homo sapiens
cagtgggacagggcat

SEQ ID NO: 455918 - DNA, 15 bp, Homo sapiens
cagtggggcccatgg

SEQ ID NO: 455919 - DNA, 17 bp, Homo sapiens
cagtggggcccatggcc

SEQ ID NO: 455920 - DNA, 19 bp, Homo sapiens
cagtggggcccatggcccc

SEQ ID NO: 455921 - DNA, 23 bp, Homo sapiens
cagtggggcccatggccccagct

SEQ ID NO: 455922 - DNA, 16 bp, Homo sapiens
cagtgggggtgcctgg

SEQ ID NO: 455923 - DNA, 20 bp, Homo sapiens
cagtgtggcttaaacatttt

SEQ ID NO: 455924 - DNA, 15 bp, Homo sapiens
cagttaatgtgccaa

SEQ ID NO: 455925 - DNA, 17 bp, Homo sapiens
cagttaatgtgccaaaa

SEQ ID NO: 455926 - DNA, 16 bp, Homo sapiens
cagttcaacctggtgg

SEQ ID NO: 455927 - DNA, 23 bp, Homo sapiens
cagttcaacctggtggcaccaga

SEQ ID NO: 455928 - DNA, 17 bp, Homo sapiens
caaggtggtcttggaga

SEQ ID NO: 455929 - DNA, 20 bp, Homo sapiens
caaggtggtcttggagagga

SEQ ID NO: 455930 - DNA, 20 bp, Homo sapiens
caagtaaccaggccccagcc

SEQ ID NO: 455931 - DNA, 23 bp, Homo sapiens
caagtaaccaggccccagcctcc

SEQ ID NO: 455932 - DNA, 14 bp, Homo sapiens
caagtagcacactg

SEQ ID NO: 455933 - DNA, 18 bp, Homo sapiens
caagtatatttatttcta

SEQ ID NO: 455934 - DNA, 14 bp, Homo sapiens
caagtgtacatttg

SEQ ID NO: 455935 - DNA, 15 bp, Homo sapiens
caagtgtacatttga

SEQ ID NO: 455936 - DNA, 23 bp, Homo sapiens
caagtgtacatttgatttgatat

SEQ ID NO: 455937 - DNA, 19 bp, Homo sapiens
caagtgtgtgtgcaatgtt

SEQ ID NO: 455938 - DNA, 16 bp, Homo sapiens
caagttcattcatact

SEQ ID NO: 455939 - DNA, 21 bp, Homo sapiens
caagtttattgccctcaaaat

SEQ ID NO: 455940 - DNA, 20 bp, Homo sapiens
caagtttttggtaatgatga

SEQ ID NO: 455941 - DNA, 14 bp, Homo sapiens
caataacagtttta

SEQ ID NO: 455942 - DNA, 19 bp, Homo sapiens
caatcaacagcatgtctac

SEQ ID NO: 455943 - DNA, 22 bp, Homo sapiens
caatcattttgggaaattcttg

SEQ ID NO: 455944 - DNA, 16 bp, Homo sapiens
caatgcatacaataaa

SEQ ID NO: 455945 - DNA, 19 bp, Homo sapiens
caatgcatacaataaaaga

SEQ ID NO: 455946 - DNA, 21 bp, Homo sapiens
caatgcatacaataaaagagc

SEQ ID NO: 455947 - DNA, 23 bp, Homo sapiens
caatgcatacaataaaagagctt

SEQ ID NO: 455948 - DNA, 15 bp, Homo sapiens
caatgcctgcctgaa

SEQ ID NO: 455949 - DNA, 21 bp, Homo sapiens
caatggctgggtttgggcagt

SEQ ID NO: 455950 - DNA, 18 bp, Homo sapiens
caatgtggaaaaaatatt

SEQ ID NO: 455951 - DNA, 18 bp, Homo sapiens
caatgttccgttcatctg

SEQ ID NO: 455952 - DNA, 23 bp, Homo sapiens
caatttatcttccatatgctctt

SEQ ID NO: 455953 - DNA, 12 bp, Homo sapiens
caatttcaaaat

SEQ ID NO: 455954 - DNA, 21 bp, Homo sapiens
caatttcaaaatgcatgtgat

SEQ ID NO: 455955 - DNA, 18 bp, Homo sapiens
caatttcaaagaaaacag

SEQ ID NO: 455956 - DNA, 19 bp, Homo sapiens
caatttcaaagaaaacaga

SEQ ID NO: 455957 - DNA, 21 bp, Homo sapiens
caatttttaacttatctccag

SEQ ID NO: 455958 - DNA, 14 bp, Homo sapiens
cacaaaatatttct

SEQ ID NO: 455959 - DNA, 15 bp, Homo sapiens
cacaaaatatttcta

SEQ ID NO: 455960 - DNA, 18 bp, Homo sapiens
cacaaccttctgtggctc

SEQ ID NO: 455961 - DNA, 17 bp, Homo sapiens
cacaactaacaatgcct

SEQ ID NO: 455962 - DNA, 13 bp, Homo sapiens
cacaatggcaagc

SEQ ID NO: 455963 - DNA, 15 bp, Homo sapiens
cacacacccttcccc

SEQ ID NO: 455964 - DNA, 21 bp, Homo sapiens
cacacagcagccccccagcac

SEQ ID NO: 455965 - DNA, 14 bp, Homo sapiens
cacaccccgtctgc

SEQ ID NO: 455966 - DNA, 17 bp, Homo sapiens
cacaccccgtctgcccc

SEQ ID NO: 455967 - DNA, 20 bp, Homo sapiens
cacaccccgtctgccccttg

SEQ ID NO: 455968 - DNA, 18 bp, Homo sapiens
cacacccttccccactcc

SEQ ID NO: 455969 - DNA, 13 bp, Homo sapiens
cacacctccaccc

SEQ ID NO: 455970 - DNA, 14 bp, Homo sapiens
cacacctccacccg

SEQ ID NO: 455971 - DNA, 14 bp, Homo sapiens
cacactctcttctt

SEQ ID NO: 455972 - DNA, 17 bp, Homo sapiens
cacactgagtttgaaca

SEQ ID NO: 455973 - DNA, 19 bp, Homo sapiens
cacagatgggtattaaact

SEQ ID NO: 455974 - DNA, 20 bp, Homo sapiens
cacagatgggtattaaactt

SEQ ID NO: 455975 - DNA, 12 bp, Homo sapiens
cacagcagcccc

SEQ ID NO: 455976 - DNA, 18 bp, Homo sapiens
cacagcagccccccagca

SEQ ID NO: 455977 - DNA, 22 bp, Homo sapiens
cacagcagtacttgctcaataa

SEQ ID NO: 455978 - DNA, 20 bp, Homo sapiens
cacagcctttgcgctctggg

SEQ ID NO: 455979 - DNA, 21 bp, Homo sapiens
cacagcctttgcgctctgggt

SEQ ID NO: 455980 - DNA, 18 bp, Homo sapiens
cacaggcccttcctctcc

SEQ ID NO: 455981 - DNA, 19 bp, Homo sapiens
cacaggcccttcctctcca

SEQ ID NO: 455982 - DNA, 15 bp, Homo sapiens
cacagggtgttggaa

SEQ ID NO: 455983 - DNA, 18 bp, Homo sapiens
cacagtgcatctcagccc

SEQ ID NO: 455984 - DNA, 22 bp, Homo sapiens
cacagttcttggtgactgtccc

SEQ ID NO: 455985 - DNA, 23 bp, Homo sapiens
cacagtttgcaatcttatgttga

SEQ ID NO: 455986 - DNA, 13 bp, Homo sapiens
cacagttttgtct

SEQ ID NO: 455987 - DNA, 21 bp, Homo sapiens
cacatagtgatggttcccctg

SEQ ID NO: 455988 - DNA, 14 bp, Homo sapiens
cacatctgtatatc

SEQ ID NO: 455989 - DNA, 13 bp, Homo sapiens
caccaaccctcag

SEQ ID NO: 455990 - DNA, 17 bp, Homo sapiens
caccaagggtatctgct

SEQ ID NO: 455991 - DNA, 14 bp, Homo sapiens
caccacaactaaca

SEQ ID NO: 455992 - DNA, 19 bp, Homo sapiens
caccacacacacccttccc

SEQ ID NO: 455993 - DNA, 20 bp, Homo sapiens
caccacggcgtttttttaca

SEQ ID NO: 455994 - DNA, 16 bp, Homo sapiens
caccagaagtgccatg

SEQ ID NO: 455995 - DNA, 11 bp, Homo sapiens
caccagcctga

SEQ ID NO: 455996 - DNA, 15 bp, Homo sapiens
caccagcctgagcca

SEQ ID NO: 455997 - DNA, 14 bp, Homo sapiens
caccaggagacaga

SEQ ID NO: 455998 - DNA, 15 bp, Homo sapiens
caccatccttccatc

SEQ ID NO: 455999 - DNA, 18 bp, Homo sapiens
caccatccttccatcctg

SEQ ID NO: 456000 - DNA, 15 bp, Homo sapiens
cacccaattttaaaa

SEQ ID NO: 456001 - DNA, 23 bp, Homo sapiens
cacccaattttaaaaaataacat

SEQ ID NO: 456002 - DNA, 14 bp, Homo sapiens
cacccaccaccgct

SEQ ID NO: 456003 - DNA, 15 bp, Homo sapiens
cacccaccaccgctc

SEQ ID NO: 456004 - DNA, 13 bp, Homo sapiens
cacccaccctctg

SEQ ID NO: 456005 - DNA, 14 bp, Homo sapiens
cacccactagccct

SEQ ID NO: 456006 - DNA, 20 bp, Homo sapiens
cacccactagccctctttct

SEQ ID NO: 456007 - DNA, 18 bp, Homo sapiens
cacccagaccctccttcc

SEQ ID NO: 456008 - DNA, 22 bp, Homo sapiens
cacccagaccctccttccccac

SEQ ID NO: 456009 - DNA, 15 bp, Homo sapiens
caccccactgagagc

SEQ ID NO: 456010 - DNA, 17 bp, Homo sapiens
caccccataagccctga

SEQ ID NO: 456011 - DNA, 14 bp, Homo sapiens
cacccccagcctcc

SEQ ID NO: 456012 - DNA, 16 bp, Homo sapiens
cacccccagcctcccc

SEQ ID NO: 456013 - DNA, 12 bp, Homo sapiens
caccccgctcac

SEQ ID NO: 456014 - DNA, 13 bp, Homo sapiens
caccccgctgcct

SEQ ID NO: 456015 - DNA, 17 bp, Homo sapiens
caccccgctgcctggcg

SEQ ID NO: 456016 - DNA, 22 bp, Homo sapiens
caccccggctccccctgccagc

SEQ ID NO: 456017 - DNA, 15 bp, Homo sapiens
cacccctaaagagat

SEQ ID NO: 456018 - DNA, 19 bp, Homo sapiens
cacccctcaagccaggaga

SEQ ID NO: 456019 - DNA, 12 bp, Homo sapiens
cacccctcccca

SEQ ID NO: 456020 - DNA, 17 bp, Homo sapiens
acagggcaggagctgct

SEQ ID NO: 456021 - DNA, 19 bp, Homo sapiens
acagggcaggagctgctgt

SEQ ID NO: 456022 - DNA, 22 bp, Homo sapiens
acagggcaggagctgctgtggt

SEQ ID NO: 456023 - DNA, 16 bp, Homo sapiens
acagggtgttggaaga

SEQ ID NO: 456024 - DNA, 17 bp, Homo sapiens
acagtaaagaccattta

SEQ ID NO: 456025 - DNA, 14 bp, Homo sapiens
acagtaagctgctc

SEQ ID NO: 456026 - DNA, 15 bp, Homo sapiens
acagtatataagctt

SEQ ID NO: 456027 - DNA, 19 bp, Homo sapiens
acagtctcattacagattt

SEQ ID NO: 456028 - DNA, 20 bp, Homo sapiens
acagtctcattacagattta

SEQ ID NO: 456029 - DNA, 15 bp, Homo sapiens
acagtgcatctcagc

SEQ ID NO: 456030 - DNA, 15 bp, Homo sapiens
acagtggcaagctac

SEQ ID NO: 456031 - DNA, 20 bp, Homo sapiens
acagtggcaagctaccaact

SEQ ID NO: 456032 - DNA, 21 bp, Homo sapiens
acagtggggcccatggcccca

SEQ ID NO: 456033 - DNA, 10 bp, Homo sapiens
acagtggggg

SEQ ID NO: 456034 - DNA, 23 bp, Homo sapiens
acagtgggggtgcctggtgcgct

SEQ ID NO: 456035 - DNA, 19 bp, Homo sapiens
acagttcttggtgactgtc

SEQ ID NO: 456036 - DNA, 14 bp, Homo sapiens
acataaatctgtct

SEQ ID NO: 456037 - DNA, 20 bp, Homo sapiens
acataaatctgtctgattct

SEQ ID NO: 456038 - DNA, 16 bp, Homo sapiens
acatagtgatggttcc

SEQ ID NO: 456039 - DNA, 21 bp, Homo sapiens
acatattcttgctttcacaaa

SEQ ID NO: 456040 - DNA, 23 bp, Homo sapiens
acatccccaccctcccctctcct

SEQ ID NO: 456041 - DNA, 14 bp, Homo sapiens
acatctgaaatcta

SEQ ID NO: 456042 - DNA, 18 bp, Homo sapiens
acatctgtatatcagctc

SEQ ID NO: 456043 - DNA, 20 bp, Homo sapiens
acatctgtatatcagctcta

SEQ ID NO: 456044 - DNA, 15 bp, Homo sapiens
acatgagtaaagcag

SEQ ID NO: 456045 - DNA, 16 bp, Homo sapiens
acattaaacactgtaa

SEQ ID NO: 456046 - DNA, 20 bp, Homo sapiens
acattaaacactgtaatctt

SEQ ID NO: 456047 - DNA, 19 bp, Homo sapiens
acattgtattttactttgt

SEQ ID NO: 456048 - DNA, 22 bp, Homo sapiens
acattgtattttactttgtgca

SEQ ID NO: 456049 - DNA, 14 bp, Homo sapiens
acatttcagtgttt

SEQ ID NO: 456050 - DNA, 21 bp, Homo sapiens
acatttgatttgatatacaga

SEQ ID NO: 456051 - DNA, 22 bp, Homo sapiens
acatttgggagactgagcttga

SEQ ID NO: 456052 - DNA, 14 bp, Homo sapiens
acatttgtcactga

SEQ ID NO: 456053 - DNA, 21 bp, Homo sapiens
acattttttgtttcttggtgt

SEQ ID NO: 456054 - DNA, 14 bp, Homo sapiens
accaaaaaatgtga

SEQ ID NO: 456055 - DNA, 14 bp, Homo sapiens
accaacgggtctgt

SEQ ID NO: 456056 - DNA, 23 bp, Homo sapiens
accaacgggtctgtgggactggc

SEQ ID NO: 456057 - DNA, 15 bp, Homo sapiens
accaactaagttgta

SEQ ID NO: 456058 - DNA, 13 bp, Homo sapiens
accaactgagcca

SEQ ID NO: 456059 - DNA, 15 bp, Homo sapiens
accaactgagccaaa

SEQ ID NO: 456060 - DNA, 17 bp, Homo sapiens
accaagaaaaccagtgg

SEQ ID NO: 456061 - DNA, 14 bp, Homo sapiens
accaagccgtggct

SEQ ID NO: 456062 - DNA, 18 bp, Homo sapiens
accaagccgtggcttccc

SEQ ID NO: 456063 - DNA, 18 bp, Homo sapiens
accaagggtatctgctgc

SEQ ID NO: 456064 - DNA, 20 bp, Homo sapiens
accaatcaacagcatgtcta

SEQ ID NO: 456065 - DNA, 15 bp, Homo sapiens
accaattgtttcttg

SEQ ID NO: 456066 - DNA, 20 bp, Homo sapiens
accagatgacacataaatct

SEQ ID NO: 456067 - DNA, 21 bp, Homo sapiens
accagatgacacataaatctg

SEQ ID NO: 456068 - DNA, 12 bp, Homo sapiens
accagcactccc

SEQ ID NO: 456069 - DNA, 13 bp, Homo sapiens
accagcactccca

SEQ ID NO: 456070 - DNA, 17 bp, Homo sapiens
accagcactcccagggc

SEQ ID NO: 456071 - DNA, 18 bp, Homo sapiens
accagcactcccagggcc

SEQ ID NO: 456072 - DNA, 24 bp, Homo sapiens
attttaaaatgcaaatattgctat

SEQ ID NO: 456073 - DNA, 21 bp, Homo sapiens
attttagacaaccatagaact

SEQ ID NO: 456074 - DNA, 13 bp, Homo sapiens
attttatctcttc

SEQ ID NO: 456075 - DNA, 20 bp, Homo sapiens
attttcaacgcagccctgct

SEQ ID NO: 456076 - DNA, 14 bp, Homo sapiens
attttcatcaagta

SEQ ID NO: 456077 - DNA, 14 bp, Homo sapiens
attttctaaactgt

SEQ ID NO: 456078 - DNA, 22 bp, Homo sapiens
attttctactccacctcttcct

SEQ ID NO: 456079 - DNA, 13 bp, Homo sapiens
attttctttctat

SEQ ID NO: 456080 - DNA, 14 bp, Homo sapiens
attttctttctatg

SEQ ID NO: 456081 - DNA, 21 bp, Homo sapiens
attttctttctatgtagaact

SEQ ID NO: 456082 - DNA, 21 bp, Homo sapiens
attttcttttatatctgtaaa

SEQ ID NO: 456083 - DNA, 15 bp, Homo sapiens
attttgccagactta

SEQ ID NO: 456084 - DNA, 22 bp, Homo sapiens
attttgggggtttttaatcttt

SEQ ID NO: 456085 - DNA, 12 bp, Homo sapiens
attttgtctggc

SEQ ID NO: 456086 - DNA, 23 bp, Homo sapiens
atttttactcaggctttctattg

SEQ ID NO: 456087 - DNA, 15 bp, Homo sapiens
atttttttctagcta

SEQ ID NO: 456088 - DNA, 22 bp, Homo sapiens
atttttttctagctataacaac

SEQ ID NO: 456089 - DNA, 23 bp, Homo sapiens
attttttttttaaatgattccaa

SEQ ID NO: 456090 - DNA, 14 bp, Homo sapiens
caaaaacaataaac

SEQ ID NO: 456091 - DNA, 18 bp, Homo sapiens
caaaaacaataaacgaaa

SEQ ID NO: 456092 - DNA, 18 bp, Homo sapiens
caaaaggttaagccatat

SEQ ID NO: 456093 - DNA, 18 bp, Homo sapiens
caaaatagtcatgtttct

SEQ ID NO: 456094 - DNA, 19 bp, Homo sapiens
caaaatagtcatgtttctg

SEQ ID NO: 456095 - DNA, 22 bp, Homo sapiens
caaaatagtcatgtttctgcag

SEQ ID NO: 456096 - DNA, 13 bp, Homo sapiens
caaaatagttcta

SEQ ID NO: 456097 - DNA, 19 bp, Homo sapiens
caaaatagttctatttcta

SEQ ID NO: 456098 - DNA, 17 bp, Homo sapiens
caaaatatttctaagct

SEQ ID NO: 456099 - DNA, 20 bp, Homo sapiens
caaacactgcttaaggaaaa

SEQ ID NO: 456100 - DNA, 23 bp, Homo sapiens
caaacagaaacgagatttgccaa

SEQ ID NO: 456101 - DNA, 15 bp, Homo sapiens
caaacattcttattt

SEQ ID NO: 456102 - DNA, 16 bp, Homo sapiens
caaacattcttatttt

SEQ ID NO: 456103 - DNA, 18 bp, Homo sapiens
caaacgtaatttgttata

SEQ ID NO: 456104 - DNA, 22 bp, Homo sapiens
caaacttctgaactttggaagc

SEQ ID NO: 456105 - DNA, 18 bp, Homo sapiens
caaagaaactcagaagag

SEQ ID NO: 456106 - DNA, 18 bp, Homo sapiens
caaagaggccagtacttt

SEQ ID NO: 456107 - DNA, 18 bp, Homo sapiens
caaagctgtcactcacaa

SEQ ID NO: 456108 - DNA, 16 bp, Homo sapiens
caaagtaccaactgag

SEQ ID NO: 456109 - DNA, 21 bp, Homo sapiens
caaagtaccaactgagccaaa

SEQ ID NO: 456110 - DNA, 13 bp, Homo sapiens
caaagtttggaag

SEQ ID NO: 456111 - DNA, 19 bp, Homo sapiens
caaatatagttgaacaaga

SEQ ID NO: 456112 - DNA, 21 bp, Homo sapiens
caaatatgattctcctctccc

SEQ ID NO: 456113 - DNA, 22 bp, Homo sapiens
caaatatgattctcctctccca

SEQ ID NO: 456114 - DNA, 23 bp, Homo sapiens
caaatattgctattgtttatagg

SEQ ID NO: 456115 - DNA, 15 bp, Homo sapiens
caaatatttcactta

SEQ ID NO: 456116 - DNA, 21 bp, Homo sapiens
caaatgagtttaaaaaaataa

SEQ ID NO: 456117 - DNA, 23 bp, Homo sapiens
caaatgagtttaaaaaaataaca

SEQ ID NO: 456118 - DNA, 13 bp, Homo sapiens
caaattattctag

SEQ ID NO: 456119 - DNA, 16 bp, Homo sapiens
caaattattctagtca

SEQ ID NO: 456120 - DNA, 13 bp, Homo sapiens
caacaccacccct

SEQ ID NO: 456121 - DNA, 15 bp, Homo sapiens
caacacttattttct

SEQ ID NO: 456122 - DNA, 21 bp, Homo sapiens
caacagacaccctccactctg

SEQ ID NO: 456123 - DNA, 19 bp, Homo sapiens
caacagcatgtctactgct

SEQ ID NO: 456124 - DNA, 14 bp, Homo sapiens
caacataatgatac

SEQ ID NO: 456125 - DNA, 14 bp, Homo sapiens
caaccattccccat

SEQ ID NO: 456126 - DNA, 15 bp, Homo sapiens
caacccccacctccc

SEQ ID NO: 456127 - DNA, 19 bp, Homo sapiens
caacccccacctcccggtg

SEQ ID NO: 456128 - DNA, 13 bp, Homo sapiens
caaccctgccctg

SEQ ID NO: 456129 - DNA, 16 bp, Homo sapiens
caaccctgccctgcac

SEQ ID NO: 456130 - DNA, 15 bp, Homo sapiens
caacctcactgccct

SEQ ID NO: 456131 - DNA, 14 bp, Homo sapiens
caacctggtggcac

SEQ ID NO: 456132 - DNA, 15 bp, Homo sapiens
caacctggtggcacc

SEQ ID NO: 456133 - DNA, 17 bp, Homo sapiens
caacctggtggcaccag

SEQ ID NO: 456134 - DNA, 17 bp, Homo sapiens
caaccttctgtggctca

SEQ ID NO: 456135 - DNA, 20 bp, Homo sapiens
caaccttctgtggctcacag

SEQ ID NO: 456136 - DNA, 12 bp, Homo sapiens
caacgcagccct

SEQ ID NO: 456137 - DNA, 16 bp, Homo sapiens
caacggaagccaggcc

SEQ ID NO: 456138 - DNA, 16 bp, Homo sapiens
caactaacaatgcctt

SEQ ID NO: 456139 - DNA, 17 bp, Homo sapiens
caactaacaatgccttg

SEQ ID NO: 456140 - DNA, 23 bp, Homo sapiens
caactccagggttaaagaaaggc

SEQ ID NO: 456141 - DNA, 22 bp, Homo sapiens
caactctggccttggttcctcc

SEQ ID NO: 456142 - DNA, 15 bp, Homo sapiens
caactgagccaaaaa

SEQ ID NO: 456143 - DNA, 17 bp, Homo sapiens
caactgagccaaaaaca

SEQ ID NO: 456144 - DNA, 22 bp, Homo sapiens
caactgagccaaaaacaataaa

SEQ ID NO: 456145 - DNA, 14 bp, Homo sapiens
caactgctgtttta

SEQ ID NO: 456146 - DNA, 15 bp, Homo sapiens
caacttaatgttctg

SEQ ID NO: 456147 - DNA, 17 bp, Homo sapiens
caacttttcatttttgc

SEQ ID NO: 456148 - DNA, 19 bp, Homo sapiens
caagaaaaccagtggaaga

SEQ ID NO: 456149 - DNA, 14 bp, Homo sapiens
caagaagattctaa

SEQ ID NO: 456150 - DNA, 18 bp, Homo sapiens
caagaagattctaaaaca

SEQ ID NO: 456151 - DNA, 16 bp, Homo sapiens
caagaagtttcttcag

SEQ ID NO: 456152 - DNA, 18 bp, Homo sapiens
caagaatagatgctgact

SEQ ID NO: 456153 - DNA, 18 bp, Homo sapiens
caagagctcaggagaagg

SEQ ID NO: 456154 - DNA, 19 bp, Homo sapiens
caagagggcactggtggcc

SEQ ID NO: 456155 - DNA, 23 bp, Homo sapiens
caagataaacacaatttcttcat

SEQ ID NO: 456156 - DNA, 21 bp, Homo sapiens
caagccaaacattcttatttt

SEQ ID NO: 456157 - DNA, 13 bp, Homo sapiens
caagccaggagac

SEQ ID NO: 456158 - DNA, 14 bp, Homo sapiens
caagccaggagacc

SEQ ID NO: 456159 - DNA, 18 bp, Homo sapiens
caagccagggttccagac

SEQ ID NO: 456160 - DNA, 13 bp, Homo sapiens
aggcccttcctct

SEQ ID NO: 456161 - DNA, 15 bp, Homo sapiens
aggcccttcctctcc

SEQ ID NO: 456162 - DNA, 13 bp, Homo sapiens
aggccgtgtctct

SEQ ID NO: 456163 - DNA, 18 bp, Homo sapiens
aggccgtgtctctgagga

SEQ ID NO: 456164 - DNA, 18 bp, Homo sapiens
aggcctgccccccttccc

SEQ ID NO: 456165 - DNA, 22 bp, Homo sapiens
aggcctgccccccttcccaccc

SEQ ID NO: 456166 - DNA, 12 bp, Homo sapiens
aggcctggtctg

SEQ ID NO: 456167 - DNA, 24 bp, Homo sapiens
aggcctggtctggagcccctatcc

SEQ ID NO: 456168 - DNA, 14 bp, Homo sapiens
aggccttaacaaac

SEQ ID NO: 456169 - DNA, 13 bp, Homo sapiens
aggcgcccacctg

SEQ ID NO: 456170 - DNA, 14 bp, Homo sapiens
aggcgcccacctgc

SEQ ID NO: 456171 - DNA, 16 bp, Homo sapiens
aggcgcccacctgccc

SEQ ID NO: 456172 - DNA, 12 bp, Homo sapiens
aggcgcgcaccg

SEQ ID NO: 456173 - DNA, 15 bp, Homo sapiens
aggcgcgcaccgccc

SEQ ID NO: 456174 - DNA, 16 bp, Homo sapiens
aggcgcgcaccgccca

SEQ ID NO: 456175 - DNA, 17 bp, Homo sapiens
aggctattaaaagaatc

SEQ ID NO: 456176 - DNA, 16 bp, Homo sapiens
aggctccctgaggtac

SEQ ID NO: 456177 - DNA, 16 bp, Homo sapiens
aggctggatgtgcttt

SEQ ID NO: 456178 - DNA, 20 bp, Homo sapiens
aggctggatgtgctttcatc

SEQ ID NO: 456179 - DNA, 12 bp, Homo sapiens
aggctgggcccc

SEQ ID NO: 456180 - DNA, 11 bp, Homo sapiens
aggctggggcc

SEQ ID NO: 456181 - DNA, 17 bp, Homo sapiens
aggctggggcctggcct

SEQ ID NO: 456182 - DNA, 23 bp, Homo sapiens
aggctggggcctggcctatttaa

SEQ ID NO: 456183 - DNA, 14 bp, Homo sapiens
aggctgtattttct

SEQ ID NO: 456184 - DNA, 16 bp, Homo sapiens
ataagctggtatcagt

SEQ ID NO: 456185 - DNA, 21 bp, Homo sapiens
ataagctggtatcagtggttc

SEQ ID NO: 456186 - DNA, 19 bp, Homo sapiens
ataagtaacactagtagct

SEQ ID NO: 456187 - DNA, 13 bp, Homo sapiens
ataagtaatatct

SEQ ID NO: 456188 - DNA, 18 bp, Homo sapiens
ataagtgctcagtattga

SEQ ID NO: 456189 - DNA, 14 bp, Homo sapiens
ataagttccaaaaa

SEQ ID NO: 456190 - DNA, 16 bp, Homo sapiens
ataatcaagacaagtg

SEQ ID NO: 456191 - DNA, 15 bp, Homo sapiens
ataatgatactgaat

SEQ ID NO: 456192 - DNA, 13 bp, Homo sapiens
ataattatgttta

SEQ ID NO: 456193 - DNA, 18 bp, Homo sapiens
ataatttcttactaaaca

SEQ ID NO: 456194 - DNA, 22 bp, Homo sapiens
atacaaagctgtcactcacaaa

SEQ ID NO: 456195 - DNA, 14 bp, Homo sapiens
atacaataaaagag

SEQ ID NO: 456196 - DNA, 17 bp, Homo sapiens
atacactggaattcaga

SEQ ID NO: 456197 - DNA, 15 bp, Homo sapiens
atacactgtatctaa

SEQ ID NO: 456198 - DNA, 13 bp, Homo sapiens
atacattatgctt

SEQ ID NO: 456199 - DNA, 19 bp, Homo sapiens
ataccaggttacctcactt

SEQ ID NO: 456200 - DNA, 18 bp, Homo sapiens
ataccctagaagaaaacc

SEQ ID NO: 456201 - DNA, 20 bp, Homo sapiens
ataccctagaagaaaacccg

SEQ ID NO: 456202 - DNA, 20 bp, Homo sapiens
ataccctaggtctccacccc

SEQ ID NO: 456203 - DNA, 20 bp, Homo sapiens
atactctgtgtaatctctga

SEQ ID NO: 456204 - DNA, 23 bp, Homo sapiens
atactggttatagttgatatgta

SEQ ID NO: 456205 - DNA, 14 bp, Homo sapiens
atactgttttggaa

SEQ ID NO: 456206 - DNA, 17 bp, Homo sapiens
atactgttttggaatgt

SEQ ID NO: 456207 - DNA, 17 bp, Homo sapiens
atacttttgtgtattct

SEQ ID NO: 456208 - DNA, 19 bp, Homo sapiens
atacttttgtgtattctgt

SEQ ID NO: 456209 - DNA, 15 bp, Homo sapiens
atagacaaaggcctt

SEQ ID NO: 456210 - DNA, 21 bp, Homo sapiens
atagacaaaggccttaacaaa

SEQ ID NO: 456211 - DNA, 11 bp, Homo sapiens
atagacacagt

SEQ ID NO: 456212 - DNA, 15 bp, Homo sapiens
atagataattatcca

SEQ ID NO: 456213 - DNA, 23 bp, Homo sapiens
atagcatcctgattattgaatgt

SEQ ID NO: 456214 - DNA, 20 bp, Homo sapiens
atagccattcatttacaact

SEQ ID NO: 456215 - DNA, 17 bp, Homo sapiens
atagcctcaccttccct

SEQ ID NO: 456216 - DNA, 20 bp, Homo sapiens
ataggaaataaatctaaata

SEQ ID NO: 456217 - DNA, 18 bp, Homo sapiens
ataggagcttccagatgg

SEQ ID NO: 456218 - DNA, 19 bp, Homo sapiens
atagggtttggaagaaagg

SEQ ID NO: 456219 - DNA, 12 bp, Homo sapiens
atagttccattc

SEQ ID NO: 456220 - DNA, 18 bp, Homo sapiens
atagttccattctatgac

SEQ ID NO: 456221 - DNA, 18 bp, Homo sapiens
atagttctatttctatct

SEQ ID NO: 456222 - DNA, 20 bp, Homo sapiens
atagttctatttctatctgc

SEQ ID NO: 456223 - DNA, 12 bp, Homo sapiens
atagttctgcaa

SEQ ID NO: 456224 - DNA, 19 bp, Homo sapiens
atagttctgcaataacagt

SEQ ID NO: 456225 - DNA, 21 bp, Homo sapiens
atataaatgtttatattgttt

SEQ ID NO: 456226 - DNA, 21 bp, Homo sapiens
atataatttgccagacagaga

SEQ ID NO: 456227 - DNA, 17 bp, Homo sapiens
atatacagacctccaga

SEQ ID NO: 456228 - DNA, 21 bp, Homo sapiens
atatagttaattgtggcttta

SEQ ID NO: 456229 - DNA, 15 bp, Homo sapiens
atatagttgaacaag

SEQ ID NO: 456230 - DNA, 18 bp, Homo sapiens
atatataaattattactt

SEQ ID NO: 456231 - DNA, 18 bp, Homo sapiens
atatatgaataattatgt

SEQ ID NO: 456232 - DNA, 19 bp, Homo sapiens
atatatttattattttcat

SEQ ID NO: 456233 - DNA, 23 bp, Homo sapiens
atatcagctctaaagcagagatg

SEQ ID NO: 456234 - DNA, 17 bp, Homo sapiens
atatcctggtgtctagt

SEQ ID NO: 456235 - DNA, 21 bp, Homo sapiens
atatctgtaaatttaactgca

SEQ ID NO: 456236 - DNA, 16 bp, Homo sapiens
atatcttttcttctcc

SEQ ID NO: 456237 - DNA, 16 bp, Homo sapiens
atatgaaagagaaaat

SEQ ID NO: 456238 - DNA, 19 bp, Homo sapiens
atatgaaagagaaaatgct

SEQ ID NO: 456239 - DNA, 21 bp, Homo sapiens
atatgacaatttcaaaatgca

SEQ ID NO: 456240 - DNA, 22 bp, Homo sapiens
atatgacctaaatccattttct

SEQ ID NO: 456241 - DNA, 13 bp, Homo sapiens
atatgatatgcat

SEQ ID NO: 456242 - DNA, 16 bp, Homo sapiens
atatgatatgcatgta

SEQ ID NO: 456243 - DNA, 19 bp, Homo sapiens
atatgattctcctctccca

SEQ ID NO: 456244 - DNA, 22 bp, Homo sapiens
atatgattctcctctcccaaat

SEQ ID NO: 456245 - DNA, 16 bp, Homo sapiens
atatgattgaaaagaa

SEQ ID NO: 456246 - DNA, 20 bp, Homo sapiens
atatgattgaaaagaagaaa

SEQ ID NO: 456247 - DNA, 17 bp, Homo sapiens
atatgcatgtagcatat

SEQ ID NO: 456248 - DNA, 21 bp, Homo sapiens
atatgcatgtagcatataaat

SEQ ID NO: 456249 - DNA, 11 bp, Homo sapiens
atatgctcttt

SEQ ID NO: 456250 - DNA, 12 bp, Homo sapiens
atatggaacctt

SEQ ID NO: 456251 - DNA, 16 bp, Homo sapiens
atatggaaccttccct

SEQ ID NO: 456252 - DNA, 17 bp, Homo sapiens
atatggcttgtagggtg

SEQ ID NO: 456253 - DNA, 14 bp, Homo sapiens
atatgtaacagttg

SEQ ID NO: 456254 - DNA, 22 bp, Homo sapiens
atatgtaacagttggtgatttt

SEQ ID NO: 456255 - DNA, 21 bp, Homo sapiens
atattataagttgacctttat

SEQ ID NO: 456256 - DNA, 18 bp, Homo sapiens
atattcttgctttcacaa

SEQ ID NO: 456257 - DNA, 23 bp, Homo sapiens
atattcttgctttcacaaatata

SEQ ID NO: 456258 - DNA, 16 bp, Homo sapiens
atattgagatcagcat

SEQ ID NO: 456259 - DNA, 22 bp, Homo sapiens
atattgagatcagcattcaaaa

SEQ ID NO: 456260 - DNA, 20 bp, Homo sapiens
agcattcaaaatagttctat

SEQ ID NO: 456261 - DNA, 21 bp, Homo sapiens
agcattcaaaatagttctatt

SEQ ID NO: 456262 - DNA, 22 bp, Homo sapiens
agcattcaaaatagttctattt

SEQ ID NO: 456263 - DNA, 16 bp, Homo sapiens
agcattctggggtggg

SEQ ID NO: 456264 - DNA, 20 bp, Homo sapiens
agcattctggggtggggctt

SEQ ID NO: 456265 - DNA, 21 bp, Homo sapiens
agccaaagaaactcagaagag

SEQ ID NO: 456266 - DNA, 22 bp, Homo sapiens
agccaaagaaactcagaagagt

SEQ ID NO: 456267 - DNA, 16 bp, Homo sapiens
agccaacttaaacctg

SEQ ID NO: 456268 - DNA, 15 bp, Homo sapiens
agccaatttcaaaga

SEQ ID NO: 456269 - DNA, 17 bp, Homo sapiens
agccaatttcaaagaaa

SEQ ID NO: 456270 - DNA, 16 bp, Homo sapiens
agccacagtggggccc

SEQ ID NO: 456271 - DNA, 20 bp, Homo sapiens
agccacagtggggcccatgg

SEQ ID NO: 456272 - DNA, 16 bp, Homo sapiens
agccagccgccctggg

SEQ ID NO: 456273 - DNA, 17 bp, Homo sapiens
agccagccgccctgggc

SEQ ID NO: 456274 - DNA, 18 bp, Homo sapiens
agccaggccaactgcccc

SEQ ID NO: 456275 - DNA, 14 bp, Homo sapiens
agccagggttccag

SEQ ID NO: 456276 - DNA, 20 bp, Homo sapiens
agccatatgacaatttcaaa

SEQ ID NO: 456277 - DNA, 22 bp, Homo sapiens
agccatatgacaatttcaaaat

SEQ ID NO: 456278 - DNA, 17 bp, Homo sapiens
agcccacccgccccaga

SEQ ID NO: 456279 - DNA, 21 bp, Homo sapiens
agcccacccgccccagagact

SEQ ID NO: 456280 - DNA, 18 bp, Homo sapiens
agcccagaaaaaaggact

SEQ ID NO: 456281 - DNA, 15 bp, Homo sapiens
agcccagaacgggcc

SEQ ID NO: 456282 - DNA, 17 bp, Homo sapiens
agcccagaacgggcctc

SEQ ID NO: 456283 - DNA, 19 bp, Homo sapiens
agcccagaacgggcctccc

SEQ ID NO: 456284 - DNA, 12 bp, Homo sapiens
agcccaggagga

SEQ ID NO: 456285 - DNA, 16 bp, Homo sapiens
agcccaggaggacctg

SEQ ID NO: 456286 - DNA, 16 bp, Homo sapiens
agccccatccttcccg

SEQ ID NO: 456287 - DNA, 21 bp, Homo sapiens
agccccatccttcccgcagca

SEQ ID NO: 456288 - DNA, 14 bp, Homo sapiens
agccccggagcacc

SEQ ID NO: 456289 - DNA, 19 bp, Homo sapiens
agccccggagcaccacggg

SEQ ID NO: 456290 - DNA, 12 bp, Homo sapiens
agcccctcctct

SEQ ID NO: 456291 - DNA, 13 bp, Homo sapiens
agcccctcctctc

SEQ ID NO: 456292 - DNA, 18 bp, Homo sapiens
agcccctcctctcctcgt

SEQ ID NO: 456293 - DNA, 21 bp, Homo sapiens
agcccctgctggaccaaggtg

SEQ ID NO: 456294 - DNA, 10 bp, Homo sapiens
agcccggcca

SEQ ID NO: 456295 - DNA, 15 bp, Homo sapiens
agcccggccaaggac

SEQ ID NO: 456296 - DNA, 12 bp, Homo sapiens
agccctccccct

SEQ ID NO: 456297 - DNA, 13 bp, Homo sapiens
agccctccctgcc

SEQ ID NO: 456298 - DNA, 15 bp, Homo sapiens
agccctccctgcccc

SEQ ID NO: 456299 - DNA, 17 bp, Homo sapiens
agccctccctgcccctc

SEQ ID NO: 456300 - DNA, 17 bp, Homo sapiens
agccctctccacccaga

SEQ ID NO: 456301 - DNA, 13 bp, Homo sapiens
agccctctttctc

SEQ ID NO: 456302 - DNA, 18 bp, Homo sapiens
agccctctttctctctgt

SEQ ID NO: 456303 - DNA, 21 bp, Homo sapiens
agccctctttctctctgtgtg

SEQ ID NO: 456304 - DNA, 17 bp, Homo sapiens
agccctgagactcccgc

SEQ ID NO: 456305 - DNA, 22 bp, Homo sapiens
agccctgagactcccgcctttg

SEQ ID NO: 456306 - DNA, 15 bp, Homo sapiens
agccctgagcccaga

SEQ ID NO: 456307 - DNA, 15 bp, Homo sapiens
agccctgccctcact

SEQ ID NO: 456308 - DNA, 18 bp, Homo sapiens
agccctgccctcactcca

SEQ ID NO: 456309 - DNA, 19 bp, Homo sapiens
agccctgccctcactccac

SEQ ID NO: 456310 - DNA, 22 bp, Homo sapiens
agccctgccctcactccactcc

SEQ ID NO: 456311 - DNA, 17 bp, Homo sapiens
agccctgctttgggctg

SEQ ID NO: 456312 - DNA, 19 bp, Homo sapiens
agccctgctttgggctgcc

SEQ ID NO: 456313 - DNA, 12 bp, Homo sapiens
agccgccctggg

SEQ ID NO: 456314 - DNA, 20 bp, Homo sapiens
agccgcgctctgcccctccg

SEQ ID NO: 456315 - DNA, 13 bp, Homo sapiens
agccggggtgggg

SEQ ID NO: 456316 - DNA, 21 bp, Homo sapiens
agccggggtggggtgcctgag

SEQ ID NO: 456317 - DNA, 22 bp, Homo sapiens
agccggggtggggtgcctgagc

SEQ ID NO: 456318 - DNA, 13 bp, Homo sapiens
agccgtggcttcc

SEQ ID NO: 456319 - DNA, 14 bp, Homo sapiens
agccgtggcttccc

SEQ ID NO: 456320 - DNA, 23 bp, Homo sapiens
agccgtttgaatatattttatct

SEQ ID NO: 456321 - DNA, 14 bp, Homo sapiens
agcctcccccaggc

SEQ ID NO: 456322 - DNA, 23 bp, Homo sapiens
agcctccccctcagatgatctct

SEQ ID NO: 456323 - DNA, 21 bp, Homo sapiens
agcctcctaggctccctgagg

SEQ ID NO: 456324 - DNA, 15 bp, Homo sapiens
agcctctccccgctc

SEQ ID NO: 456325 - DNA, 20 bp, Homo sapiens
agcctctccccgctctggat

SEQ ID NO: 456326 - DNA, 16 bp, Homo sapiens
agcctgagccacagtg

SEQ ID NO: 456327 - DNA, 20 bp, Homo sapiens
agcctgagccacagtggggc

SEQ ID NO: 456328 - DNA, 15 bp, Homo sapiens
tctctctctctgttc

SEQ ID NO: 456329 - DNA, 10 bp, Homo sapiens
tctctctctg

SEQ ID NO: 456330 - DNA, 11 bp, Homo sapiens
tctctctctgt

SEQ ID NO: 456331 - DNA, 12 bp, Homo sapiens
tctctctctgtt

SEQ ID NO: 456332 - DNA, 14 bp, Homo sapiens
tctctctctgttcc

SEQ ID NO: 456333 - DNA, 18 bp, Homo sapiens
tctctctggggccctggg

SEQ ID NO: 456334 - DNA, 17 bp, Homo sapiens
tctctctgtgtggcaaa

SEQ ID NO: 456335 - DNA, 18 bp, Homo sapiens
tctctctgtgtggcaaac

SEQ ID NO: 456336 - DNA, 12 bp, Homo sapiens
tctctctgttcc

SEQ ID NO: 456337 - DNA, 15 bp, Homo sapiens
tctctctttccatct

SEQ ID NO: 456338 - DNA, 23 bp, Homo sapiens
tctctggggccctgggcctcagt

SEQ ID NO: 456339 - DNA, 15 bp, Homo sapiens
tctctgtgtggcaaa

SEQ ID NO: 456340 - DNA, 20 bp, Homo sapiens
tctctgtgtggcaaacattt

SEQ ID NO: 456341 - DNA, 21 bp, Homo sapiens
tctctgtgtggcaaacattta

SEQ ID NO: 456342 - DNA, 21 bp, Homo sapiens
tctctgtttaccctccctgtc

SEQ ID NO: 456343 - DNA, 14 bp, Homo sapiens
tctcttaccccgtc

SEQ ID NO: 456344 - DNA, 21 bp, Homo sapiens
tctcttaccccgtccctttcc

SEQ ID NO: 456345 - DNA, 19 bp, Homo sapiens
tctcttccttgctttctct

SEQ ID NO: 456346 - DNA, 13 bp, Homo sapiens
tctcttctccact

SEQ ID NO: 456347 - DNA, 11 bp, Homo sapiens
tctgaaaagaa

SEQ ID NO: 456348 - DNA, 13 bp, Homo sapiens
tctgaaaatattt

SEQ ID NO: 456349 - DNA, 21 bp, Homo sapiens
tctgaaaatatttttttctag

SEQ ID NO: 456350 - DNA, 22 bp, Homo sapiens
tctgaaaatatttttttctagc

SEQ ID NO: 456351 - DNA, 18 bp, Homo sapiens
tctgaaactatagaataa

SEQ ID NO: 456352 - DNA, 18 bp, Homo sapiens
tctgaagtcactgcacag

SEQ ID NO: 456353 - DNA, 21 bp, Homo sapiens
tctgaagtcccttcctgtcct

SEQ ID NO: 456354 - DNA, 22 bp, Homo sapiens
tctgaagtcccttcctgtcctg

SEQ ID NO: 456355 - DNA, 18 bp, Homo sapiens
tctgaattcataaaaata

SEQ ID NO: 456356 - DNA, 19 bp, Homo sapiens
tctgaattcataaaaataa

SEQ ID NO: 456357 - DNA, 23 bp, Homo sapiens
tctgaccccacttatgctgctgt

SEQ ID NO: 456358 - DNA, 15 bp, Homo sapiens
tctgagcagtgggga

SEQ ID NO: 456359 - DNA, 22 bp, Homo sapiens
tctgagccctgccctcactcca

SEQ ID NO: 456360 - DNA, 16 bp, Homo sapiens
tctgaggagtaaaaag

SEQ ID NO: 456361 - DNA, 21 bp, Homo sapiens
tctgaggccccttaactcatc

SEQ ID NO: 456362 - DNA, 12 bp, Homo sapiens
tctgaggtctca

SEQ ID NO: 456363 - DNA, 15 bp, Homo sapiens
tctgattaaatttaa

SEQ ID NO: 456364 - DNA, 21 bp, Homo sapiens
tctgattaaatttaatatact

SEQ ID NO: 456365 - DNA, 22 bp, Homo sapiens
tctgattctatgcctgtatttc

SEQ ID NO: 456366 - DNA, 15 bp, Homo sapiens
tctgattggacattt

SEQ ID NO: 456367 - DNA, 19 bp, Homo sapiens
tctgattggacattttctt

SEQ ID NO: 456368 - DNA, 19 bp, Homo sapiens
tctgcagcctgagctccac

SEQ ID NO: 456369 - DNA, 23 bp, Homo sapiens
tctgcagcctgagctccaccctc

SEQ ID NO: 456370 - DNA, 15 bp, Homo sapiens
tctgcagtattctgt

SEQ ID NO: 456371 - DNA, 12 bp, Homo sapiens
tctgcatagaca

SEQ ID NO: 456372 - DNA, 16 bp, Homo sapiens
tctgcatagacaaagg

SEQ ID NO: 456373 - DNA, 14 bp, Homo sapiens
tctgccccctcccc

SEQ ID NO: 456374 - DNA, 15 bp, Homo sapiens
tctgccccctccccc

SEQ ID NO: 456375 - DNA, 16 bp, Homo sapiens
tctgccccctcccccg

SEQ ID NO: 456376 - DNA, 19 bp, Homo sapiens
tctgccccctcccccgcag

SEQ ID NO: 456377 - DNA, 20 bp, Homo sapiens
tctgccccctcccccgcaga

SEQ ID NO: 456378 - DNA, 16 bp, Homo sapiens
tctgcccctccgtccc

SEQ ID NO: 456379 - DNA, 20 bp, Homo sapiens
tctgcccctccgtccccagg

SEQ ID NO: 456380 - DNA, 21 bp, Homo sapiens
tctgcccctccgtccccaggg

SEQ ID NO: 456381 - DNA, 20 bp, Homo sapiens
tctgccccttgaccccacac

SEQ ID NO: 456382 - DNA, 18 bp, Homo sapiens
tctgccctccctccttcc

SEQ ID NO: 456383 - DNA, 14 bp, Homo sapiens
tctgccttggacac

SEQ ID NO: 456384 - DNA, 16 bp, Homo sapiens
tctgccttggacacca

SEQ ID NO: 456385 - DNA, 16 bp, Homo sapiens
tctgctaatttatgaa

SEQ ID NO: 456386 - DNA, 18 bp, Homo sapiens
tctgctccaacagacacc

SEQ ID NO: 456387 - DNA, 16 bp, Homo sapiens
tctgctgtacagatat

SEQ ID NO: 456388 - DNA, 16 bp, Homo sapiens
tctgcttgtcattctg

SEQ ID NO: 456389 - DNA, 19 bp, Homo sapiens
tctgcttgtcattctgcta

SEQ ID NO: 456390 - DNA, 13 bp, Homo sapiens
tctggagccccta

SEQ ID NO: 456391 - DNA, 20 bp, Homo sapiens
tctggagtctgaaggagagg

SEQ ID NO: 456392 - DNA, 23 bp, Homo sapiens
tctggagtctgaaggagaggagt

SEQ ID NO: 456393 - DNA, 20 bp, Homo sapiens
tctggagtcttcctgtagtg

SEQ ID NO: 456394 - DNA, 22 bp, Homo sapiens
tctggccttggttcctccagca

SEQ ID NO: 456395 - DNA, 16 bp, Homo sapiens
tctggctgtggcccct

SEQ ID NO: 456396 - DNA, 18 bp, Homo sapiens
tctggctgtggcccctcc

SEQ ID NO: 456397 - DNA, 14 bp, Homo sapiens
tctggggccctggg

SEQ ID NO: 456398 - DNA, 15 bp, Homo sapiens
tctggggccctgggc

SEQ ID NO: 456399 - DNA, 18 bp, Homo sapiens
tctggggggttgcctcga

SEQ ID NO: 456400 - DNA, 17 bp, Homo sapiens
tctggtgcgtgtggccc

SEQ ID NO: 456401 - DNA, 21 bp, Homo sapiens
tctggtgcgtgtggccctgtg

SEQ ID NO: 456402 - DNA, 22 bp, Homo sapiens
tctggtgcgtgtggccctgtgg

SEQ ID NO: 456403 - DNA, 16 bp, Homo sapiens
tctgtaaatttaactg

SEQ ID NO: 456404 - DNA, 22 bp, Homo sapiens
tctgtaaatttaactgcatata

SEQ ID NO: 456405 - DNA, 23 bp, Homo sapiens
tctgtaatcacactctcttctta

SEQ ID NO: 456406 - DNA, 16 bp, Homo sapiens
tctgtagccaacttaa

SEQ ID NO: 456407 - DNA, 17 bp, Homo sapiens
tctgtcagccagccgcc

SEQ ID NO: 456408 - DNA, 22 bp, Homo sapiens
tctgtcatctctctggggccct

SEQ ID NO: 456409 - DNA, 15 bp, Homo sapiens
tctgtctgagccctg

SEQ ID NO: 456410 - DNA, 20 bp, Homo sapiens
tctgtgaagcctttatctat

SEQ ID NO: 456411 - DNA, 14 bp, Homo sapiens
tctgtggattctat

SEQ ID NO: 456412 - DNA, 17 bp, Homo sapiens
tctgtgtaatctctgat

SEQ ID NO: 456413 - DNA, 18 bp, Homo sapiens
tctgtgtaatctctgatt

SEQ ID NO: 456414 - DNA, 16 bp, Homo sapiens
tctgtgtggcaaacat

SEQ ID NO: 456415 - DNA, 18 bp, Homo sapiens
tcttaacttaaaagaaca

SEQ ID NO: 456416 - DNA, 22 bp, Homo sapiens
tcttaagattccattttggaaa

SEQ ID NO: 456417 - DNA, 22 bp, Homo sapiens
tcttaccccgtccctttccctg

SEQ ID NO: 456418 - DNA, 20 bp, Homo sapiens
tcttacctgtaatagcctca

SEQ ID NO: 456419 - DNA, 16 bp, Homo sapiens
tcttactaaacatttt

SEQ ID NO: 456420 - DNA, 13 bp, Homo sapiens
tcttactgttttg

SEQ ID NO: 456421 - DNA, 13 bp, Homo sapiens
tcttagagaataa

SEQ ID NO: 456422 - DNA, 14 bp, Homo sapiens
tcttagagaataag

SEQ ID NO: 456423 - DNA, 20 bp, Homo sapiens
tcttcaaacaggaatttctg

SEQ ID NO: 456424 - DNA, 23 bp, Homo sapiens
tcttcaaacagttccataccaag

SEQ ID NO: 456425 - DNA, 15 bp, Homo sapiens
tccacccctcaagcc

SEQ ID NO: 456426 - DNA, 20 bp, Homo sapiens
tccacccctcaagccaggag

SEQ ID NO: 456427 - DNA, 13 bp, Homo sapiens
tccaccctcccct

SEQ ID NO: 456428 - DNA, 16 bp, Homo sapiens
tccaccgccaccccac

SEQ ID NO: 456429 - DNA, 15 bp, Homo sapiens
tccacctgtgctgct

SEQ ID NO: 456430 - DNA, 17 bp, Homo sapiens
tccacgcctcctggcca

SEQ ID NO: 456431 - DNA, 18 bp, Homo sapiens
tccacgcctcctggccag

SEQ ID NO: 456432 - DNA, 19 bp, Homo sapiens
tccactaggtgcccagtct

SEQ ID NO: 456433 - DNA, 13 bp, Homo sapiens
tccactcccctca

SEQ ID NO: 456434 - DNA, 12 bp, Homo sapiens
tccactcctccc

SEQ ID NO: 456435 - DNA, 13 bp, Homo sapiens
tccactcctccca

SEQ ID NO: 456436 - DNA, 18 bp, Homo sapiens
tccactcctcccaactct

SEQ ID NO: 456437 - DNA, 14 bp, Homo sapiens
tccactctgaggtc

SEQ ID NO: 456438 - DNA, 17 bp, Homo sapiens
tccactctgaggtctca

SEQ ID NO: 456439 - DNA, 13 bp, Homo sapiens
tccactgccttcg

SEQ ID NO: 456440 - DNA, 22 bp, Homo sapiens
tccactgccttcgatacaccgg

SEQ ID NO: 456441 - DNA, 23 bp, Homo sapiens
tccacttagaaattgcatttcct

SEQ ID NO: 456442 - DNA, 15 bp, Homo sapiens
tccacttccagaggg

SEQ ID NO: 456443 - DNA, 12 bp, Homo sapiens
tccactttcctc

SEQ ID NO: 456444 - DNA, 14 bp, Homo sapiens
tccactttcctctc

SEQ ID NO: 456445 - DNA, 16 bp, Homo sapiens
tccactttcctctctc

SEQ ID NO: 456446 - DNA, 20 bp, Homo sapiens
tccagacagagtggatctgg

SEQ ID NO: 456447 - DNA, 14 bp, Homo sapiens
tccagacattgtat

SEQ ID NO: 456448 - DNA, 16 bp, Homo sapiens
tccagacattgtattt

SEQ ID NO: 456449 - DNA, 16 bp, Homo sapiens
tccagactcgagaggg

SEQ ID NO: 456450 - DNA, 22 bp, Homo sapiens
tccagactcgagagggctgagc

SEQ ID NO: 456451 - DNA, 20 bp, Homo sapiens
tccagagagaagcaccccac

SEQ ID NO: 456452 - DNA, 21 bp, Homo sapiens
tccagagagaagcaccccacc

SEQ ID NO: 456453 - DNA, 22 bp, Homo sapiens
tccagagagaagcaccccacca

SEQ ID NO: 456454 - DNA, 17 bp, Homo sapiens
tccagagagtggctcct

SEQ ID NO: 456455 - DNA, 22 bp, Homo sapiens
tccagagagtggctcctcccgg

SEQ ID NO: 456456 - DNA, 20 bp, Homo sapiens
tccagagggggccagaggga

SEQ ID NO: 456457 - DNA, 22 bp, Homo sapiens
tccagagtaggtgggtcttgga

SEQ ID NO: 456458 - DNA, 23 bp, Homo sapiens
tccagagtaggtgggtcttggat

SEQ ID NO: 456459 - DNA, 17 bp, Homo sapiens
tccagcaatgcctgcct

SEQ ID NO: 456460 - DNA, 16 bp, Homo sapiens
tccagcacctttgtaa

SEQ ID NO: 456461 - DNA, 16 bp, Homo sapiens
tccagcagtgctgggc

SEQ ID NO: 456462 - DNA, 22 bp, Homo sapiens
tccagctgattttaactttttt

SEQ ID NO: 456463 - DNA, 12 bp, Homo sapiens
tccaggctgggg

SEQ ID NO: 456464 - DNA, 21 bp, Homo sapiens
tccagtttgcccaccacaact

SEQ ID NO: 456465 - DNA, 14 bp, Homo sapiens
tccagtttgttctc

SEQ ID NO: 456466 - DNA, 17 bp, Homo sapiens
tccagtttgttctccgg

SEQ ID NO: 456467 - DNA, 13 bp, Homo sapiens
tccatagacacag

SEQ ID NO: 456468 - DNA, 13 bp, Homo sapiens
tccatatgctctt

SEQ ID NO: 456469 - DNA, 22 bp, Homo sapiens
tccatcctgaggaccgccccaa

SEQ ID NO: 456470 - DNA, 23 bp, Homo sapiens
tccatcctgaggaccgccccaac

SEQ ID NO: 456471 - DNA, 21 bp, Homo sapiens
tccatctaaaatactcaccaa

SEQ ID NO: 456472 - DNA, 22 bp, Homo sapiens
tccatctaaaatactcaccaaa

SEQ ID NO: 456473 - DNA, 16 bp, Homo sapiens
tccatctcaaaagtat

SEQ ID NO: 456474 - DNA, 17 bp, Homo sapiens
tccatgtgaaatttaca

SEQ ID NO: 456475 - DNA, 19 bp, Homo sapiens
tccattgcaaaaggttaag

SEQ ID NO: 456476 - DNA, 12 bp, Homo sapiens
tccattttctaa

SEQ ID NO: 456477 - DNA, 14 bp, Homo sapiens
tccattttctaaac

SEQ ID NO: 456478 - DNA, 16 bp, Homo sapiens
tccattttctaaactg

SEQ ID NO: 456479 - DNA, 23 bp, Homo sapiens
tccattttctaaactgttttcat

SEQ ID NO: 456480 - DNA, 14 bp, Homo sapiens
tccattttggaaaa

SEQ ID NO: 456481 - DNA, 14 bp, Homo sapiens
tcccaaacccttcg

SEQ ID NO: 456482 - DNA, 16 bp, Homo sapiens
tcccaaataaactcct

SEQ ID NO: 456483 - DNA, 17 bp, Homo sapiens
tcccaaataaactcctt

SEQ ID NO: 456484 - DNA, 14 bp, Homo sapiens
tcccaacgtactcc

SEQ ID NO: 456485 - DNA, 22 bp, Homo sapiens
tcccaagtcaaacagtgtggct

SEQ ID NO: 456486 - DNA, 18 bp, Homo sapiens
tcccacaaaatatttcta

SEQ ID NO: 456487 - DNA, 19 bp, Homo sapiens
tcccaccaaccctcagagc

SEQ ID NO: 456488 - DNA, 18 bp, Homo sapiens
tcccaccgggagcctccc

SEQ ID NO: 456489 - DNA, 21 bp, Homo sapiens
tcccaccgggagcctccccct

SEQ ID NO: 456490 - DNA, 19 bp, Homo sapiens
tcccacgacataagctggt

SEQ ID NO: 456491 - DNA, 16 bp, Homo sapiens
tcccagcacctggcac

SEQ ID NO: 456492 - DNA, 13 bp, Homo sapiens
tcccagctggcag

SEQ ID NO: 456493 - DNA, 15 bp, Homo sapiens
tcccagctggcagcg

SEQ ID NO: 456494 - DNA, 18 bp, Homo sapiens
tcccagctggcagcgcct

SEQ ID NO: 456495 - DNA, 16 bp, Homo sapiens
tcccaggcgccccttc

SEQ ID NO: 456496 - DNA, 15 bp, Homo sapiens
tcccagggcccgagc

SEQ ID NO: 456497 - DNA, 18 bp, Homo sapiens
tcccatgggggctccaga

SEQ ID NO: 456498 - DNA, 11 bp, Homo sapiens
tccccacccac

SEQ ID NO: 456499 - DNA, 14 bp, Homo sapiens
tccccacccaccac

SEQ ID NO: 456500 - DNA, 15 bp, Homo sapiens
tccccacccaccacc

SEQ ID NO: 456501 - DNA, 22 bp, Homo sapiens
tccccacccaccaccgctcccg

SEQ ID NO: 456502 - DNA, 17 bp, Homo sapiens
tccccaccccataagcc

SEQ ID NO: 456503 - DNA, 12 bp, Homo sapiens
tccccactcccg

SEQ ID NO: 456504 - DNA, 13 bp, Homo sapiens
tccccactcccgt

SEQ ID NO: 456505 - DNA, 21 bp, Homo sapiens
tccccagttaatgtgccaaaa

SEQ ID NO: 456506 - DNA, 16 bp, Homo sapiens
tccccatatataaatt

SEQ ID NO: 456507 - DNA, 20 bp, Homo sapiens
tcccccaggctgcgcctgcc

SEQ ID NO: 456508 - DNA, 21 bp, Homo sapiens
tcccccaggctgcgcctgccc

SEQ ID NO: 456509 - DNA, 22 bp, Homo sapiens
tcccccaggctgcgcctgcccg

SEQ ID NO: 456510 - DNA, 22 bp, Homo sapiens
tccccctcagatgatctctcca

SEQ ID NO: 456511 - DNA, 14 bp, Homo sapiens
tccccctgccagca

SEQ ID NO: 456512 - DNA, 15 bp, Homo sapiens
tcccccttcccctgc

SEQ ID NO: 456513 - DNA, 13 bp, Homo sapiens
tcccccttcccgc

SEQ ID NO: 456514 - DNA, 21 bp, Homo sapiens
tccccgcagccctctccaccc

SEQ ID NO: 456515 - DNA, 23 bp, Homo sapiens
tccccgcagccctctccacccag

SEQ ID NO: 456516 - DNA, 18 bp, Homo sapiens
tccccgcccgccctcctc

SEQ ID NO: 456517 - DNA, 20 bp, Homo sapiens
tccccgcccgccctcctctg

SEQ ID NO: 456518 - DNA, 16 bp, Homo sapiens
tccccggacgctggct

SEQ ID NO: 456519 - DNA, 18 bp, Homo sapiens
tccccggacgctggctcg

SEQ ID NO: 456520 - DNA, 20 bp, Homo sapiens
tccccgtgcggcccgtgcgc

SEQ ID NO: 456521 - DNA, 15 bp, Homo sapiens
tcccctcctagcaca

SEQ ID NO: 456522 - DNA, 12 bp, Homo sapiens
tcccctctcctg

SEQ ID NO: 456523 - DNA, 15 bp, Homo sapiens
tcccctctcctgagc

SEQ ID NO: 456524 - DNA, 17 bp, Homo sapiens
tcccctgcgccctccct

SEQ ID NO: 456525 - DNA, 15 bp, Homo sapiens
tcccctgttcactct

SEQ ID NO: 456526 - DNA, 17 bp, Homo sapiens
tcccgcagcaccagcct

SEQ ID NO: 456527 - DNA, 19 bp, Homo sapiens
tcccgcagcaccagcctga

SEQ ID NO: 456528 - DNA, 21 bp, Homo sapiens
tcccgcagcaccagcctgagc

SEQ ID NO: 456529 - DNA, 13 bp, Homo sapiens
tcccgcctttgac

SEQ ID NO: 456530 - DNA, 20 bp, Homo sapiens
tcccgcgggaagccagcccg

SEQ ID NO: 456531 - DNA, 17 bp, Homo sapiens
tcccggtgtatgcagtg

SEQ ID NO: 456532 - DNA, 18 bp, Homo sapiens
tcccgtccgtccgcccgc

SEQ ID NO: 456533 - DNA, 16 bp, Homo sapiens
tccctaccctcttctc

SEQ ID NO: 456534 - DNA, 18 bp, Homo sapiens
tccctaccctcttctcag

SEQ ID NO: 456535 - DNA, 16 bp, Homo sapiens
tccctacttaggaaat

SEQ ID NO: 456536 - DNA, 15 bp, Homo sapiens
tccctccacacctcc

SEQ ID NO: 456537 - DNA, 18 bp, Homo sapiens
tccctccacacctccacc

SEQ ID NO: 456538 - DNA, 19 bp, Homo sapiens
tccctccacacctccaccc

SEQ ID NO: 456539 - DNA, 20 bp, Homo sapiens
tccctccacacctccacccg

SEQ ID NO: 456540 - DNA, 14 bp, Homo sapiens
tccctccactcctc

SEQ ID NO: 456541 - DNA, 15 bp, Homo sapiens
tccctccctccacac

SEQ ID NO: 456542 - DNA, 17 bp, Homo sapiens
tccctcggccccaccca

SEQ ID NO: 456543 - DNA, 16 bp, Homo sapiens
tccctcggtcagcacc

SEQ ID NO: 456544 - DNA, 17 bp, Homo sapiens
tccctcggtcagcaccg

SEQ ID NO: 456545 - DNA, 13 bp, Homo sapiens
tccctgacttccc

SEQ ID NO: 456546 - DNA, 19 bp, Homo sapiens
tccctgacttcccagctgg

SEQ ID NO: 456547 - DNA, 19 bp, Homo sapiens
tccctgaggtacctttcca

SEQ ID NO: 456548 - DNA, 22 bp, Homo sapiens
tccctgaggtacctttccaccc

SEQ ID NO: 456549 - DNA, 23 bp, Homo sapiens
tccctgaggtacctttccaccca

SEQ ID NO: 456550 - DNA, 15 bp, Homo sapiens
tccctgggcccctcc

SEQ ID NO: 456551 - DNA, 17 bp, Homo sapiens
tccctgggcccctccac

SEQ ID NO: 456552 - DNA, 19 bp, Homo sapiens
tccctgggcccctccacgc

SEQ ID NO: 456553 - DNA, 20 bp, Homo sapiens
tccctgggcccctccacgcc

SEQ ID NO: 456554 - DNA, 14 bp, Homo sapiens
tccctgtcccctga

SEQ ID NO: 456555 - DNA, 20 bp, Homo sapiens
tccctgtgggggtggccatc

SEQ ID NO: 456556 - DNA, 14 bp, Homo sapiens
tcccttcctacagt

SEQ ID NO: 456557 - DNA, 22 bp, Homo sapiens
tcccttggatgtagtctgaggc

SEQ ID NO: 456558 - DNA, 15 bp, Homo sapiens
tcccttggcccctct

SEQ ID NO: 456559 - DNA, 17 bp, Homo sapiens
tcccttggcccctctct

SEQ ID NO: 456560 - DNA, 14 bp, Homo sapiens
tccgcccagcctct

SEQ ID NO: 456561 - DNA, 16 bp, Homo sapiens
tccgcccagcctctcc

SEQ ID NO: 456562 - DNA, 21 bp, Homo sapiens
tccgcccgcccaccccgctgc

SEQ ID NO: 456563 - DNA, 20 bp, Homo sapiens
tccgctgtcgccccaggccc

SEQ ID NO: 456564 - DNA, 17 bp, Homo sapiens
tccggaacagccaaaga

SEQ ID NO: 456565 - DNA, 22 bp, Homo sapiens
tccggaacagccaaagaaactc

SEQ ID NO: 456566 - DNA, 13 bp, Homo sapiens
tccggcagaggca

SEQ ID NO: 456567 - DNA, 19 bp, Homo sapiens
tccggcagaggcagggccc

SEQ ID NO: 456568 - DNA, 15 bp, Homo sapiens
tccggcctgcagccc

SEQ ID NO: 456569 - DNA, 16 bp, Homo sapiens
tccggcctgcagccca

SEQ ID NO: 456570 - DNA, 17 bp, Homo sapiens
tccggcctgcagcccag

SEQ ID NO: 456571 - DNA, 18 bp, Homo sapiens
tccggcctgcagcccaga

SEQ ID NO: 456572 - DNA, 20 bp, Homo sapiens
tccggcctgcagcccagaac

SEQ ID NO: 456573 - DNA, 16 bp, Homo sapiens
tccgggtgtggcctca

SEQ ID NO: 456574 - DNA, 18 bp, Homo sapiens
tccgggtgtggcctcagc

SEQ ID NO: 456575 - DNA, 22 bp, Homo sapiens
tccgtccccagggtgcaggcgc

SEQ ID NO: 456576 - DNA, 21 bp, Homo sapiens
tcctagcacaaggagtgcccg

SEQ ID NO: 456577 - DNA, 19 bp, Homo sapiens
tcctaggcgctcagaggcc

SEQ ID NO: 456578 - DNA, 15 bp, Homo sapiens
tcctaggctccctga

SEQ ID NO: 456579 - DNA, 17 bp, Homo sapiens
tcctaggctccctgagg

SEQ ID NO: 456580 - DNA, 18 bp, Homo sapiens
tcctaggctccctgaggt

SEQ ID NO: 456581 - DNA, 22 bp, Homo sapiens
tcctccagactcgagagggctg

SEQ ID NO: 456582 - DNA, 19 bp, Homo sapiens
tcctcccaactctggcctt

SEQ ID NO: 456583 - DNA, 19 bp, Homo sapiens
tcctcctaggcgctcagag

SEQ ID NO: 456584 - DNA, 20 bp, Homo sapiens
tcctcctaggcgctcagagg

SEQ ID NO: 456585 - DNA, 22 bp, Homo sapiens
tcctcgggcgcctgcgctcctc

SEQ ID NO: 456586 - DNA, 17 bp, Homo sapiens
tcctcgtccggcctgca

SEQ ID NO: 456587 - DNA, 13 bp, Homo sapiens
tcctctccactgc

SEQ ID NO: 456588 - DNA, 15 bp, Homo sapiens
tcctctccactgcct

SEQ ID NO: 456589 - DNA, 13 bp, Homo sapiens
tcctctcgagccc

SEQ ID NO: 456590 - DNA, 13 bp, Homo sapiens
tcctctctctccc

SEQ ID NO: 456591 - DNA, 16 bp, Homo sapiens
tcctctctctccctcc

SEQ ID NO: 456592 - DNA, 18 bp, Homo sapiens
tcctctctctccctccac

SEQ ID NO: 456593 - DNA, 22 bp, Homo sapiens
tcctctctctctctctctctgt

SEQ ID NO: 456594 - DNA, 14 bp, Homo sapiens
tcctctgccccctc

SEQ ID NO: 456595 - DNA, 15 bp, Homo sapiens
tcctctgccccctcc

SEQ ID NO: 456596 - DNA, 19 bp, Homo sapiens
tcctctgccccctcccccg

SEQ ID NO: 456597 - DNA, 21 bp, Homo sapiens
tcctctgccccctcccccgca

SEQ ID NO: 456598 - DNA, 14 bp, Homo sapiens
tcctctgccttgga

SEQ ID NO: 456599 - DNA, 22 bp, Homo sapiens
tcctctgccttggacaccatcc

SEQ ID NO: 456600 - DNA, 13 bp, Homo sapiens
tcctcttacctgt

SEQ ID NO: 456601 - DNA, 15 bp, Homo sapiens
tcctgaaataaaact

SEQ ID NO: 456602 - DNA, 16 bp, Homo sapiens
tcctgagcctgtctct

SEQ ID NO: 456603 - DNA, 19 bp, Homo sapiens
tcctgataaacattaaaca

SEQ ID NO: 456604 - DNA, 20 bp, Homo sapiens
tcctgccctcgtctccctgg

SEQ ID NO: 456605 - DNA, 21 bp, Homo sapiens
tcctgcgggttttaatttatt

SEQ ID NO: 456606 - DNA, 18 bp, Homo sapiens
tcctgctagctgtagaaa

SEQ ID NO: 456607 - DNA, 16 bp, Homo sapiens
tcctgctgctcgggaa

SEQ ID NO: 456608 - DNA, 17 bp, Homo sapiens
tcctgtcctgctcacgt

SEQ ID NO: 456609 - DNA, 20 bp, Homo sapiens
tccttagaatactgtattgt

SEQ ID NO: 456610 - DNA, 13 bp, Homo sapiens
tccttcactctga

SEQ ID NO: 456611 - DNA, 15 bp, Homo sapiens
tccttcactctgaca

SEQ ID NO: 456612 - DNA, 12 bp, Homo sapiens
tccttccatcct

SEQ ID NO: 456613 - DNA, 12 bp, Homo sapiens
tccttcccgcag

SEQ ID NO: 456614 - DNA, 16 bp, Homo sapiens
tccttcccgcagcacc

SEQ ID NO: 456615 - DNA, 12 bp, Homo sapiens
tccttctcccct

SEQ ID NO: 456616 - DNA, 19 bp, Homo sapiens
tccttctcccctccagacc

SEQ ID NO: 456617 - DNA, 15 bp, Homo sapiens
tccttgtacttgaat

SEQ ID NO: 456618 - DNA, 23 bp, Homo sapiens
tccttgtacttgaataataacca

SEQ ID NO: 456619 - DNA, 18 bp, Homo sapiens
tcctttcacaaccttctg

SEQ ID NO: 456620 - DNA, 14 bp, Homo sapiens
tcgagagggctgag

SEQ ID NO: 456621 - DNA, 15 bp, Homo sapiens
tcgagagggctgagc

SEQ ID NO: 456622 - DNA, 16 bp, Homo sapiens
tcgagagggctgagcc

SEQ ID NO: 456623 - DNA, 18 bp, Homo sapiens
tcgagagggctgagcccc

SEQ ID NO: 456624 - DNA, 21 bp, Homo sapiens
tcgagagggctgagcccctcc

SEQ ID NO: 456625 - DNA, 16 bp, Homo sapiens
tcgagcccagatggaa

SEQ ID NO: 456626 - DNA, 14 bp, Homo sapiens
tcgagtccccccac

SEQ ID NO: 456627 - DNA, 23 bp, Homo sapiens
tcgagtccccccacccctcccca

SEQ ID NO: 456628 - DNA, 13 bp, Homo sapiens
tcgcatccaccgc

SEQ ID NO: 456629 - DNA, 17 bp, Homo sapiens
tcgcatccaccgccacc

SEQ ID NO: 456630 - DNA, 18 bp, Homo sapiens
tcgcatccaccgccaccc

SEQ ID NO: 456631 - DNA, 19 bp, Homo sapiens
tcgcatccaccgccacccc

SEQ ID NO: 456632 - DNA, 12 bp, Homo sapiens
tcgcccctcctc

SEQ ID NO: 456633 - DNA, 16 bp, Homo sapiens
tcggagccccccactc

SEQ ID NO: 456634 - DNA, 19 bp, Homo sapiens
tcggagccccccactcagt

SEQ ID NO: 456635 - DNA, 22 bp, Homo sapiens
tcggagccccccactcagtagg

SEQ ID NO: 456636 - DNA, 14 bp, Homo sapiens
tcggaggctgggcc

SEQ ID NO: 456637 - DNA, 21 bp, Homo sapiens
tcggcaccttcccctgaggac

SEQ ID NO: 456638 - DNA, 15 bp, Homo sapiens
tcggctgggcagggc

SEQ ID NO: 456639 - DNA, 17 bp, Homo sapiens
tcggctgggcagggccg

SEQ ID NO: 456640 - DNA, 19 bp, Homo sapiens
tcggctgggcagggccgca

SEQ ID NO: 456641 - DNA, 19 bp, Homo sapiens
tcgggggaggagcaccccc

SEQ ID NO: 456642 - DNA, 18 bp, Homo sapiens
tcgtccggcctgcagccc

SEQ ID NO: 456643 - DNA, 15 bp, Homo sapiens
tcgttgacatgcaca

SEQ ID NO: 456644 - DNA, 14 bp, Homo sapiens
tctaaaaaataact

SEQ ID NO: 456645 - DNA, 15 bp, Homo sapiens
tctaaaattctagtc

SEQ ID NO: 456646 - DNA, 13 bp, Homo sapiens
tctaaactgtttt

SEQ ID NO: 456647 - DNA, 15 bp, Homo sapiens
tctaaactgttttca

SEQ ID NO: 456648 - DNA, 18 bp, Homo sapiens
tctaaactgttttcatgt

SEQ ID NO: 456649 - DNA, 14 bp, Homo sapiens
tctaacctttctaa

SEQ ID NO: 456650 - DNA, 14 bp, Homo sapiens
tctaagcttatttc

SEQ ID NO: 456651 - DNA, 15 bp, Homo sapiens
tctaagtcagtttca

SEQ ID NO: 456652 - DNA, 23 bp, Homo sapiens
tctaagtcagtttcacatatttg

SEQ ID NO: 456653 - DNA, 13 bp, Homo sapiens
tctaatggaatat

SEQ ID NO: 456654 - DNA, 12 bp, Homo sapiens
tctacaggcatt

SEQ ID NO: 456655 - DNA, 21 bp, Homo sapiens
tctactttataatcaagacaa

SEQ ID NO: 456656 - DNA, 17 bp, Homo sapiens
tctagcaagaagattct

SEQ ID NO: 456657 - DNA, 17 bp, Homo sapiens
tctagtcaactgctgtt

SEQ ID NO: 456658 - DNA, 18 bp, Homo sapiens
tctagtcaactgctgttt

SEQ ID NO: 456659 - DNA, 22 bp, Homo sapiens
tctagtcaactgctgttttatg

SEQ ID NO: 456660 - DNA, 13 bp, Homo sapiens
tctagtttgcata

SEQ ID NO: 456661 - DNA, 16 bp, Homo sapiens
tctatactgtttgtaa

SEQ ID NO: 456662 - DNA, 12 bp, Homo sapiens
tctatatttcat

SEQ ID NO: 456663 - DNA, 15 bp, Homo sapiens
tctatatttcatatt

SEQ ID NO: 456664 - DNA, 20 bp, Homo sapiens
tctatctgcaaatagtttca

SEQ ID NO: 456665 - DNA, 14 bp, Homo sapiens
tctatgcctgtatt

SEQ ID NO: 456666 - DNA, 15 bp, Homo sapiens
tctatggattcactt

SEQ ID NO: 456667 - DNA, 15 bp, Homo sapiens
tctatgtagaactgt

SEQ ID NO: 456668 - DNA, 16 bp, Homo sapiens
tctattatctgggttt

SEQ ID NO: 456669 - DNA, 21 bp, Homo sapiens
tctattcccatcgctggaaaa

SEQ ID NO: 456670 - DNA, 14 bp, Homo sapiens
tctattgtagcatt

SEQ ID NO: 456671 - DNA, 14 bp, Homo sapiens
tctatttctatctg

SEQ ID NO: 456672 - DNA, 16 bp, Homo sapiens
tctattttttactaca

SEQ ID NO: 456673 - DNA, 20 bp, Homo sapiens
tctcaaacactgcttaagga

SEQ ID NO: 456674 - DNA, 23 bp, Homo sapiens
tctcacaaataagtaatatcttt

SEQ ID NO: 456675 - DNA, 16 bp, Homo sapiens
tctcacctagctgctc

SEQ ID NO: 456676 - DNA, 15 bp, Homo sapiens
tctcaccttcgcctt

SEQ ID NO: 456677 - DNA, 17 bp, Homo sapiens
tctcactcctacctggt

SEQ ID NO: 456678 - DNA, 14 bp, Homo sapiens
tctcagatccctcg

SEQ ID NO: 456679 - DNA, 22 bp, Homo sapiens
tctcagcaaattcttgaataaa

SEQ ID NO: 456680 - DNA, 15 bp, Homo sapiens
tctcagctccactct

SEQ ID NO: 456681 - DNA, 13 bp, Homo sapiens
tctccacccagag

SEQ ID NO: 456682 - DNA, 19 bp, Homo sapiens
tctccacccagaggtctcc

SEQ ID NO: 456683 - DNA, 12 bp, Homo sapiens
tctccacccctc

SEQ ID NO: 456684 - DNA, 22 bp, Homo sapiens
tctccacccctcaagccaggag

SEQ ID NO: 456685 - DNA, 23 bp, Homo sapiens
tctccacccctcaagccaggaga

SEQ ID NO: 456686 - DNA, 15 bp, Homo sapiens
tctccagctgatttt

SEQ ID NO: 456687 - DNA, 18 bp, Homo sapiens
tctcccatgggggctcca

SEQ ID NO: 456688 - DNA, 17 bp, Homo sapiens
tctccccatatataaat

SEQ ID NO: 456689 - DNA, 18 bp, Homo sapiens
tctccccatatataaatt

SEQ ID NO: 456690 - DNA, 14 bp, Homo sapiens
tctccccgcagccc

SEQ ID NO: 456691 - DNA, 22 bp, Homo sapiens
tctccccgctctggatcctgca

SEQ ID NO: 456692 - DNA, 13 bp, Homo sapiens
tctcccctccaga

SEQ ID NO: 456693 - DNA, 19 bp, Homo sapiens
tctcccctccagaccccta

SEQ ID NO: 456694 - DNA, 15 bp, Homo sapiens
tctccctaccctctt

SEQ ID NO: 456695 - DNA, 21 bp, Homo sapiens
tctccctaccctcttctcagc

SEQ ID NO: 456696 - DNA, 22 bp, Homo sapiens
tctccctaccctcttctcagct

SEQ ID NO: 456697 - DNA, 16 bp, Homo sapiens
tctccctccactcctc

SEQ ID NO: 456698 - DNA, 19 bp, Homo sapiens
tctccctccactcctccca

SEQ ID NO: 456699 - DNA, 19 bp, Homo sapiens
tctccctggccacccttgg

SEQ ID NO: 456700 - DNA, 22 bp, Homo sapiens
tctccctggccacccttggcct

SEQ ID NO: 456701 - DNA, 21 bp, Homo sapiens
tctccggccccgcctctgccc

SEQ ID NO: 456702 - DNA, 23 bp, Homo sapiens
tctccgggtgtggcctcagccct

SEQ ID NO: 456703 - DNA, 15 bp, Homo sapiens
tctcctcgtccggcc

SEQ ID NO: 456704 - DNA, 18 bp, Homo sapiens
tctcctctctctccctcc

SEQ ID NO: 456705 - DNA, 17 bp, Homo sapiens
tctcctgagcctgtctc

SEQ ID NO: 456706 - DNA, 19 bp, Homo sapiens
tctcctgagcctgtctctc

SEQ ID NO: 456707 - DNA, 20 bp, Homo sapiens
tctcctgggggtggcaggca

SEQ ID NO: 456708 - DNA, 22 bp, Homo sapiens
tctcctgggggtggcaggcaca

SEQ ID NO: 456709 - DNA, 16 bp, Homo sapiens
tctccttgtacttgaa

SEQ ID NO: 456710 - DNA, 19 bp, Homo sapiens
tctccttgtacttgaataa

SEQ ID NO: 456711 - DNA, 14 bp, Homo sapiens
tctctaaaattcta

SEQ ID NO: 456712 - DNA, 21 bp, Homo sapiens
tctctccccatatataaatta

SEQ ID NO: 456713 - DNA, 21 bp, Homo sapiens
tctctccctccactcctccca

SEQ ID NO: 456714 - DNA, 16 bp, Homo sapiens
tctctcctctctctcc

SEQ ID NO: 456715 - DNA, 17 bp, Homo sapiens
tctctcctctctctccc

SEQ ID NO: 456716 - DNA, 12 bp, Homo sapiens
tctctctccctc

SEQ ID NO: 456717 - DNA, 13 bp, Homo sapiens
tctctctctctgt

SEQ ID NO: 456718 - DNA, 14 bp, Homo sapiens
tctctctctctgtt

SEQ ID NO: 456719 - DNA, 20 bp, Homo sapiens
tcaccttctgttttagagtt

SEQ ID NO: 456720 - DNA, 16 bp, Homo sapiens
tcacgctgacagcctc

SEQ ID NO: 456721 - DNA, 17 bp, Homo sapiens
tcacgctgacagcctcc

SEQ ID NO: 456722 - DNA, 20 bp, Homo sapiens
tcacgctgacagcctcctag

SEQ ID NO: 456723 - DNA, 20 bp, Homo sapiens
tcactatggtatgctggcca

SEQ ID NO: 456724 - DNA, 12 bp, Homo sapiens
tcactccactcc

SEQ ID NO: 456725 - DNA, 13 bp, Homo sapiens
tcactccactccc

SEQ ID NO: 456726 - DNA, 22 bp, Homo sapiens
tcactccctttgtggactttat

SEQ ID NO: 456727 - DNA, 15 bp, Homo sapiens
tcactcctacctggt

SEQ ID NO: 456728 - DNA, 12 bp, Homo sapiens
tcactctgacag

SEQ ID NO: 456729 - DNA, 16 bp, Homo sapiens
tcactctgacagtatt

SEQ ID NO: 456730 - DNA, 20 bp, Homo sapiens
tcactctgtcagccagccgc

SEQ ID NO: 456731 - DNA, 23 bp, Homo sapiens
tcactgaataatggaattatgta

SEQ ID NO: 456732 - DNA, 12 bp, Homo sapiens
tcactgctggct

SEQ ID NO: 456733 - DNA, 15 bp, Homo sapiens
tcactgctggctgcc

SEQ ID NO: 456734 - DNA, 17 bp, Homo sapiens
tcactgctggctgcctt

SEQ ID NO: 456735 - DNA, 18 bp, Homo sapiens
tcactggtgcatttaaaa

SEQ ID NO: 456736 - DNA, 23 bp, Homo sapiens
tcactggtgcatttaaaatggac

SEQ ID NO: 456737 - DNA, 18 bp, Homo sapiens
tcacttaaactttgtcac

SEQ ID NO: 456738 - DNA, 23 bp, Homo sapiens
tcacttaaactttgtcacttctg

SEQ ID NO: 456739 - DNA, 23 bp, Homo sapiens
tcagaaagggcagcccctcccca

SEQ ID NO: 456740 - DNA, 23 bp, Homo sapiens
tcagaatttctttgtcattcaag

SEQ ID NO: 456741 - DNA, 14 bp, Homo sapiens
tcagactctctcct

SEQ ID NO: 456742 - DNA, 17 bp, Homo sapiens
tcagactctctcctctc

SEQ ID NO: 456743 - DNA, 21 bp, Homo sapiens
tcagagccacccctaaagaga

SEQ ID NO: 456744 - DNA, 14 bp, Homo sapiens
tcagaggccgctct

SEQ ID NO: 456745 - DNA, 18 bp, Homo sapiens
tcagcaaccctacagtat

SEQ ID NO: 456746 - DNA, 20 bp, Homo sapiens
tcagcaaccctacagtatat

SEQ ID NO: 456747 - DNA, 19 bp, Homo sapiens
tcagcaactgttagctggg

SEQ ID NO: 456748 - DNA, 23 bp, Homo sapiens
tcagcaccgtggtgtgaggcccc

SEQ ID NO: 456749 - DNA, 23 bp, Homo sapiens
tcagcaggggggttgggttccag

SEQ ID NO: 456750 - DNA, 14 bp, Homo sapiens
tcagcatagagcta

SEQ ID NO: 456751 - DNA, 16 bp, Homo sapiens
tcagcattcaaaatag

SEQ ID NO: 456752 - DNA, 14 bp, Homo sapiens
tcagccctccctgc

SEQ ID NO: 456753 - DNA, 15 bp, Homo sapiens
tcagccctccctgcc

SEQ ID NO: 456754 - DNA, 16 bp, Homo sapiens
tcagccctccctgccc

SEQ ID NO: 456755 - DNA, 12 bp, Homo sapiens
tcagctccactc

SEQ ID NO: 456756 - DNA, 22 bp, Homo sapiens
tcagctctaaagcagagatgta

SEQ ID NO: 456757 - DNA, 13 bp, Homo sapiens
tcagctctgcata

SEQ ID NO: 456758 - DNA, 21 bp, Homo sapiens
tcagcttgtttctatactgtt

SEQ ID NO: 456759 - DNA, 12 bp, Homo sapiens
tcaggaatgggc

SEQ ID NO: 456760 - DNA, 21 bp, Homo sapiens
tcaggagaaggcctgcccccc

SEQ ID NO: 456761 - DNA, 17 bp, Homo sapiens
tcaggatgggaagaaaa

SEQ ID NO: 456762 - DNA, 15 bp, Homo sapiens
tcaggctcttctcct

SEQ ID NO: 456763 - DNA, 21 bp, Homo sapiens
tcaggctcttctcctttcaca

SEQ ID NO: 456764 - DNA, 22 bp, Homo sapiens
tcagggtgctccctcctcagtc

SEQ ID NO: 456765 - DNA, 16 bp, Homo sapiens
tcaggttcctcctagg

SEQ ID NO: 456766 - DNA, 22 bp, Homo sapiens
tcagtacagggcaggagctgct

SEQ ID NO: 456767 - DNA, 15 bp, Homo sapiens
tcagtcatcatctca

SEQ ID NO: 456768 - DNA, 21 bp, Homo sapiens
tcagtctttgggggattcaaa

SEQ ID NO: 456769 - DNA, 17 bp, Homo sapiens
tcagttcaacctggtgg

SEQ ID NO: 456770 - DNA, 13 bp, Homo sapiens
tcagttgaaaaga

SEQ ID NO: 456771 - DNA, 19 bp, Homo sapiens
tcagtttcacatatttgta

SEQ ID NO: 456772 - DNA, 12 bp, Homo sapiens
tcataaattggc

SEQ ID NO: 456773 - DNA, 22 bp, Homo sapiens
tcataaattggctcctttccca

SEQ ID NO: 456774 - DNA, 16 bp, Homo sapiens
tcatactctgtgtaat

SEQ ID NO: 456775 - DNA, 18 bp, Homo sapiens
tcatagcatcctgattat

SEQ ID NO: 456776 - DNA, 22 bp, Homo sapiens
tcatataatttgccagacagag

SEQ ID NO: 456777 - DNA, 20 bp, Homo sapiens
tcatcaagtagcgttggaga

SEQ ID NO: 456778 - DNA, 23 bp, Homo sapiens
tcatcaatacttttgtgtattct

SEQ ID NO: 456779 - DNA, 24 bp, Homo sapiens
tcatcaatacttttgtgtattctg

SEQ ID NO: 456780 - DNA, 21 bp, Homo sapiens
tcatccagtttgttctccggg

SEQ ID NO: 456781 - DNA, 13 bp, Homo sapiens
tcatccatagaca

SEQ ID NO: 456782 - DNA, 16 bp, Homo sapiens
tcatcggaggctgggc

SEQ ID NO: 456783 - DNA, 19 bp, Homo sapiens
tcatcggaggctgggcccc

SEQ ID NO: 456784 - DNA, 18 bp, Homo sapiens
tcatctcaaacactgctt

SEQ ID NO: 456785 - DNA, 20 bp, Homo sapiens
tcatctctctggggccctgg

SEQ ID NO: 456786 - DNA, 22 bp, Homo sapiens
tcatctctctggggccctgggc

SEQ ID NO: 456787 - DNA, 15 bp, Homo sapiens
tcatctcttgatgaa

SEQ ID NO: 456788 - DNA, 13 bp, Homo sapiens
tcatgatgctcat

SEQ ID NO: 456789 - DNA, 15 bp, Homo sapiens
tcatgcatagacaag

SEQ ID NO: 456790 - DNA, 22 bp, Homo sapiens
tcatgtttaagaaatgagaaat

SEQ ID NO: 456791 - DNA, 15 bp, Homo sapiens
tcatgtttctgcagt

SEQ ID NO: 456792 - DNA, 16 bp, Homo sapiens
tcattctccttgtaaa

SEQ ID NO: 456793 - DNA, 20 bp, Homo sapiens
tcattctgctaatttatgaa

SEQ ID NO: 456794 - DNA, 21 bp, Homo sapiens
tcattctgctaatttatgaag

SEQ ID NO: 456795 - DNA, 15 bp, Homo sapiens
tcattcttttcagct

SEQ ID NO: 456796 - DNA, 15 bp, Homo sapiens
tcattggttacaaat

SEQ ID NO: 456797 - DNA, 20 bp, Homo sapiens
tcattggttacaaattttta

SEQ ID NO: 456798 - DNA, 20 bp, Homo sapiens
tcattttgggaaattcttgc

SEQ ID NO: 456799 - DNA, 23 bp, Homo sapiens
tccaaaatagtcatgtttctgca

SEQ ID NO: 456800 - DNA, 19 bp, Homo sapiens
tccaacagacaccctccac

SEQ ID NO: 456801 - DNA, 12 bp, Homo sapiens
tccaagtgtgtg

SEQ ID NO: 456802 - DNA, 15 bp, Homo sapiens
tccaagtgtgtgtgc

SEQ ID NO: 456803 - DNA, 19 bp, Homo sapiens
tccaataccctagaagaaa

SEQ ID NO: 456804 - DNA, 22 bp, Homo sapiens
tccaataccctagaagaaaacc

SEQ ID NO: 456805 - DNA, 19 bp, Homo sapiens
tccacagaacctttgtcaa

SEQ ID NO: 456806 - DNA, 12 bp, Homo sapiens
tccacaggacac

SEQ ID NO: 456807 - DNA, 21 bp, Homo sapiens
tccacaggacacgaaggctgc

SEQ ID NO: 456808 - DNA, 17 bp, Homo sapiens
tccacatccccaccctc

SEQ ID NO: 456809 - DNA, 16 bp, Homo sapiens
tccaccaggattaatc

SEQ ID NO: 456810 - DNA, 15 bp, Homo sapiens
tccacccagaccctc

SEQ ID NO: 456811 - DNA, 17 bp, Homo sapiens
tccacccagaccctcct

SEQ ID NO: 456812 - DNA, 22 bp, Homo sapiens
tccacccagaccctccttcccc

SEQ ID NO: 456813 - DNA, 12 bp, Homo sapiens
tccacccagagg

SEQ ID NO: 456814 - DNA, 16 bp, Homo sapiens
tccacccagaggtctc

SEQ ID NO: 456815 - DNA, 23 bp, Homo sapiens
tccaccccggctccccctgccag

SEQ ID NO: 456816 - DNA, 12 bp, Homo sapiens
tatgaaagagaa

SEQ ID NO: 456817 - DNA, 16 bp, Homo sapiens
tatgaataattatgtt

SEQ ID NO: 456818 - DNA, 18 bp, Homo sapiens
tatgaataattatgttta

SEQ ID NO: 456819 - DNA, 21 bp, Homo sapiens
tatgaggggactgcatgcaag

SEQ ID NO: 456820 - DNA, 12 bp, Homo sapiens
tatgatatgcat

SEQ ID NO: 456821 - DNA, 14 bp, Homo sapiens
tatgatatgcatgt

SEQ ID NO: 456822 - DNA, 15 bp, Homo sapiens
tatgatatgcatgta

SEQ ID NO: 456823 - DNA, 22 bp, Homo sapiens
tatgatatgcatgtagcatata

SEQ ID NO: 456824 - DNA, 15 bp, Homo sapiens
tatgattctcctctc

SEQ ID NO: 456825 - DNA, 16 bp, Homo sapiens
tatgattctcctctcc

SEQ ID NO: 456826 - DNA, 18 bp, Homo sapiens
tatgattctcctctccca

SEQ ID NO: 456827 - DNA, 15 bp, Homo sapiens
tatgcatgtagcata

SEQ ID NO: 456828 - DNA, 22 bp, Homo sapiens
tatgcatgtagcatataaatgt

SEQ ID NO: 456829 - DNA, 12 bp, Homo sapiens
tatgcctgtatt

SEQ ID NO: 456830 - DNA, 17 bp, Homo sapiens
tatgcctgtatttccaa

SEQ ID NO: 456831 - DNA, 15 bp, Homo sapiens
tatgctgctgtgaat

SEQ ID NO: 456832 - DNA, 12 bp, Homo sapiens
tatgctggccag

SEQ ID NO: 456833 - DNA, 18 bp, Homo sapiens
tatgctggccagcaccct

SEQ ID NO: 456834 - DNA, 20 bp, Homo sapiens
tatgctggccagcaccctct

SEQ ID NO: 456835 - DNA, 19 bp, Homo sapiens
tatgcttaggccagtcagt

SEQ ID NO: 456836 - DNA, 18 bp, Homo sapiens
tatggcttgtagggtgag

SEQ ID NO: 456837 - DNA, 16 bp, Homo sapiens
tatggtatgctggcca

SEQ ID NO: 456838 - DNA, 18 bp, Homo sapiens
tatggtatgctggccagc

SEQ ID NO: 456839 - DNA, 22 bp, Homo sapiens
tatggtatgctggccagcaccc

SEQ ID NO: 456840 - DNA, 13 bp, Homo sapiens
tatgtaaacatca

SEQ ID NO: 456841 - DNA, 17 bp, Homo sapiens
tatgtaagaagaaactg

SEQ ID NO: 456842 - DNA, 14 bp, Homo sapiens
tatgttaagctctt

SEQ ID NO: 456843 - DNA, 16 bp, Homo sapiens
tatgtttacctcactg

SEQ ID NO: 456844 - DNA, 18 bp, Homo sapiens
tattactgatgtgtgcaa

SEQ ID NO: 456845 - DNA, 21 bp, Homo sapiens
tattataagttgacctttatt

SEQ ID NO: 456846 - DNA, 15 bp, Homo sapiens
tattatagtctgtac

SEQ ID NO: 456847 - DNA, 17 bp, Homo sapiens
tattatagtctgtactt

SEQ ID NO: 456848 - DNA, 14 bp, Homo sapiens
tattatctgggttt

SEQ ID NO: 456849 - DNA, 19 bp, Homo sapiens
tattatgaggctattaaaa

SEQ ID NO: 456850 - DNA, 19 bp, Homo sapiens
tattatgatctctgctttg

SEQ ID NO: 456851 - DNA, 17 bp, Homo sapiens
tattattactgttctta

SEQ ID NO: 456852 - DNA, 15 bp, Homo sapiens
tattattattactgt

SEQ ID NO: 456853 - DNA, 21 bp, Homo sapiens
tattcattacatcctctgctt

SEQ ID NO: 456854 - DNA, 15 bp, Homo sapiens
tattcctgcctttga

SEQ ID NO: 456855 - DNA, 21 bp, Homo sapiens
tattctagtcaactgctgttt

SEQ ID NO: 456856 - DNA, 23 bp, Homo sapiens
tattctgtagccaacttaaacct

SEQ ID NO: 456857 - DNA, 19 bp, Homo sapiens
tattctgtggattctatat

SEQ ID NO: 456858 - DNA, 14 bp, Homo sapiens
tattcttccaagtt

SEQ ID NO: 456859 - DNA, 11 bp, Homo sapiens
tattgaataac

SEQ ID NO: 456860 - DNA, 13 bp, Homo sapiens
tattgaatgttat

SEQ ID NO: 456861 - DNA, 16 bp, Homo sapiens
tattgttacagctgaa

SEQ ID NO: 456862 - DNA, 16 bp, Homo sapiens
tattgtttataggaaa

SEQ ID NO: 456863 - DNA, 15 bp, Homo sapiens
tatttaatttcataa

SEQ ID NO: 456864 - DNA, 20 bp, Homo sapiens
tatttaatttcataaattgg

SEQ ID NO: 456865 - DNA, 18 bp, Homo sapiens
tatttattaaacttcagc

SEQ ID NO: 456866 - DNA, 11 bp, Homo sapiens
tatttatttct

SEQ ID NO: 456867 - DNA, 22 bp, Homo sapiens
tatttcacttaaactttgtcac

SEQ ID NO: 456868 - DNA, 20 bp, Homo sapiens
tatttcataaacaacttaat

SEQ ID NO: 456869 - DNA, 23 bp, Homo sapiens
tatttctaagcttatttctaact

SEQ ID NO: 456870 - DNA, 14 bp, Homo sapiens
tatttgatctggtg

SEQ ID NO: 456871 - DNA, 18 bp, Homo sapiens
tatttggattcacagcct

SEQ ID NO: 456872 - DNA, 12 bp, Homo sapiens
tattttctgaat

SEQ ID NO: 456873 - DNA, 19 bp, Homo sapiens
tattttctgaattcataaa

SEQ ID NO: 456874 - DNA, 18 bp, Homo sapiens
tattttcttacagtattt

SEQ ID NO: 456875 - DNA, 22 bp, Homo sapiens
tattttcttttatatctgtaaa

SEQ ID NO: 456876 - DNA, 14 bp, Homo sapiens
tattttttactaca

SEQ ID NO: 456877 - DNA, 16 bp, Homo sapiens
tatttttttctagcta

SEQ ID NO: 456878 - DNA, 22 bp, Homo sapiens
tatttttttctagctataacaa

SEQ ID NO: 456879 - DNA, 17 bp, Homo sapiens
tcaaactttcacctcag

SEQ ID NO: 456880 - DNA, 17 bp, Homo sapiens
tcaaatgagtttaaaaa

SEQ ID NO: 456881 - DNA, 22 bp, Homo sapiens
tcaaatgagtttaaaaaaataa

SEQ ID NO: 456882 - DNA, 12 bp, Homo sapiens
tcaaatgcatga

SEQ ID NO: 456883 - DNA, 17 bp, Homo sapiens
tcaacatttcagtgttt

SEQ ID NO: 456884 - DNA, 14 bp, Homo sapiens
tcaaccctgccctg

SEQ ID NO: 456885 - DNA, 14 bp, Homo sapiens
tcaacgcagccctg

SEQ ID NO: 456886 - DNA, 15 bp, Homo sapiens
tcaacgcagccctgc

SEQ ID NO: 456887 - DNA, 17 bp, Homo sapiens
tcaactaatacatggtt

SEQ ID NO: 456888 - DNA, 19 bp, Homo sapiens
tcaactctgtgtcccagca

SEQ ID NO: 456889 - DNA, 17 bp, Homo sapiens
tcaactgctgttttatg

SEQ ID NO: 456890 - DNA, 22 bp, Homo sapiens
tcaactgctgttttatgtcata

SEQ ID NO: 456891 - DNA, 13 bp, Homo sapiens
tcaactttttcct

SEQ ID NO: 456892 - DNA, 10 bp, Homo sapiens
tcaaggccaa

SEQ ID NO: 456893 - DNA, 13 bp, Homo sapiens
tcaataaaggtca

SEQ ID NO: 456894 - DNA, 22 bp, Homo sapiens
tcaatacttttgtgtattctgt

SEQ ID NO: 456895 - DNA, 17 bp, Homo sapiens
tcaatctggcttctgca

SEQ ID NO: 456896 - DNA, 22 bp, Homo sapiens
tcaatgcatacaataaaagagc

SEQ ID NO: 456897 - DNA, 12 bp, Homo sapiens
tcaatgtactgt

SEQ ID NO: 456898 - DNA, 15 bp, Homo sapiens
tcaatgtactgtatt

SEQ ID NO: 456899 - DNA, 16 bp, Homo sapiens
tcaatgtactgtattg

SEQ ID NO: 456900 - DNA, 13 bp, Homo sapiens
tcaatgtgaaata

SEQ ID NO: 456901 - DNA, 14 bp, Homo sapiens
tcaatgtgaaataa

SEQ ID NO: 456902 - DNA, 23 bp, Homo sapiens
tcacaaaaggctggatgtgcttt

SEQ ID NO: 456903 - DNA, 20 bp, Homo sapiens
tcacaaataagtaatatctt

SEQ ID NO: 456904 - DNA, 14 bp, Homo sapiens
tcacaaccttctgt

SEQ ID NO: 456905 - DNA, 21 bp, Homo sapiens
tcacacacacacaatggcaag

SEQ ID NO: 456906 - DNA, 20 bp, Homo sapiens
tcacacagctaacaagtagc

SEQ ID NO: 456907 - DNA, 15 bp, Homo sapiens
tcacagcagtacttg

SEQ ID NO: 456908 - DNA, 22 bp, Homo sapiens
tcacagcctttgcgctctgggt

SEQ ID NO: 456909 - DNA, 12 bp, Homo sapiens
tcacatatttgt

SEQ ID NO: 456910 - DNA, 17 bp, Homo sapiens
tcaccagctatctgtca

SEQ ID NO: 456911 - DNA, 19 bp, Homo sapiens
tcaccagctatctgtcatc

SEQ ID NO: 456912 - DNA, 23 bp, Homo sapiens
tcacctcttatgcacacctccca

SEQ ID NO: 456913 - DNA, 15 bp, Homo sapiens
tcaccttctgtttta

SEQ ID NO: 456914 - DNA, 15 bp, Homo sapiens
tagaatgagaaatca

SEQ ID NO: 456915 - DNA, 19 bp, Homo sapiens
tagacacagtattgacttc

SEQ ID NO: 456916 - DNA, 19 bp, Homo sapiens
tagactttaattcttctct

SEQ ID NO: 456917 - DNA, 22 bp, Homo sapiens
tagagaaggacccggaggggcc

SEQ ID NO: 456918 - DNA, 10 bp, Homo sapiens
tagagaggac

SEQ ID NO: 456919 - DNA, 20 bp, Homo sapiens
tagagcattctggggtgggg

SEQ ID NO: 456920 - DNA, 13 bp, Homo sapiens
tagagtgtcttaa

SEQ ID NO: 456921 - DNA, 23 bp, Homo sapiens
tagatgctgactgtactcctccc

SEQ ID NO: 456922 - DNA, 19 bp, Homo sapiens
tagcaagaagattctaaaa

SEQ ID NO: 456923 - DNA, 19 bp, Homo sapiens
tagcatcctgattattgaa

SEQ ID NO: 456924 - DNA, 15 bp, Homo sapiens
tagccctctttctct

SEQ ID NO: 456925 - DNA, 16 bp, Homo sapiens
tagccctctttctctc

SEQ ID NO: 456926 - DNA, 24 bp, Homo sapiens
tagccctctttctctctgtgtggc

SEQ ID NO: 456927 - DNA, 20 bp, Homo sapiens
tagctataacaactctattt

SEQ ID NO: 456928 - DNA, 15 bp, Homo sapiens
taggagcttccagat

SEQ ID NO: 456929 - DNA, 16 bp, Homo sapiens
taggagttctcctgga

SEQ ID NO: 456930 - DNA, 17 bp, Homo sapiens
taggagttctcctggag

SEQ ID NO: 456931 - DNA, 14 bp, Homo sapiens
taggcgctcagagg

SEQ ID NO: 456932 - DNA, 17 bp, Homo sapiens
taggcgctcagaggccg

SEQ ID NO: 456933 - DNA, 14 bp, Homo sapiens
taggctccctgagg

SEQ ID NO: 456934 - DNA, 15 bp, Homo sapiens
taggctccctgaggt

SEQ ID NO: 456935 - DNA, 16 bp, Homo sapiens
taggctgtattttctt

SEQ ID NO: 456936 - DNA, 20 bp, Homo sapiens
tagggaaatccaactccagg

SEQ ID NO: 456937 - DNA, 12 bp, Homo sapiens
taggtctccacc

SEQ ID NO: 456938 - DNA, 14 bp, Homo sapiens
taggtctccacccc

SEQ ID NO: 456939 - DNA, 16 bp, Homo sapiens
taggtctccacccctc

SEQ ID NO: 456940 - DNA, 22 bp, Homo sapiens
tagtaaataatgattcaatgtg

SEQ ID NO: 456941 - DNA, 15 bp, Homo sapiens
tagtcaactgctgtt

SEQ ID NO: 456942 - DNA, 17 bp, Homo sapiens
tagtcacttatttcata

SEQ ID NO: 456943 - DNA, 20 bp, Homo sapiens
tagtcctcaccttctgtttt

SEQ ID NO: 456944 - DNA, 13 bp, Homo sapiens
tagtctctgattt

SEQ ID NO: 456945 - DNA, 15 bp, Homo sapiens
tagtctgtacttcag

SEQ ID NO: 456946 - DNA, 14 bp, Homo sapiens
tagtgatacactgt

SEQ ID NO: 456947 - DNA, 18 bp, Homo sapiens
tagtgatacactgtatct

SEQ ID NO: 456948 - DNA, 22 bp, Homo sapiens
tagtgatacactgtatctaaaa

SEQ ID NO: 456949 - DNA, 18 bp, Homo sapiens
tagtgatggttcccctgt

SEQ ID NO: 456950 - DNA, 24 bp, Homo sapiens
tagtgcctgtgatcgtgtgttgcc

SEQ ID NO: 456951 - DNA, 18 bp, Homo sapiens
tagtggcaaaaaagaaca

SEQ ID NO: 456952 - DNA, 20 bp, Homo sapiens
tagtgtcccttacctggctt

SEQ ID NO: 456953 - DNA, 19 bp, Homo sapiens
tagtgtgctcggacacagt

SEQ ID NO: 456954 - DNA, 12 bp, Homo sapiens
tagttctatttc

SEQ ID NO: 456955 - DNA, 14 bp, Homo sapiens
tagttctatttcta

SEQ ID NO: 456956 - DNA, 21 bp, Homo sapiens
tagttgaacaagatttcccta

SEQ ID NO: 456957 - DNA, 16 bp, Homo sapiens
tataaaaaagaaaact

SEQ ID NO: 456958 - DNA, 14 bp, Homo sapiens
tataaattataatg

SEQ ID NO: 456959 - DNA, 17 bp, Homo sapiens
tataacaactctatttt

SEQ ID NO: 456960 - DNA, 21 bp, Homo sapiens
tataacaagccaaacattctt

SEQ ID NO: 456961 - DNA, 22 bp, Homo sapiens
tataagagacaaagtttggaag

SEQ ID NO: 456962 - DNA, 22 bp, Homo sapiens
tataagggagtaggctgtattt

SEQ ID NO: 456963 - DNA, 22 bp, Homo sapiens
tataagttgacctttatttatt

SEQ ID NO: 456964 - DNA, 21 bp, Homo sapiens
tataatttgccagacagagat

SEQ ID NO: 456965 - DNA, 19 bp, Homo sapiens
tatacaaagctgtcactca

SEQ ID NO: 456966 - DNA, 21 bp, Homo sapiens
tatacagtttttgtaaccata

SEQ ID NO: 456967 - DNA, 18 bp, Homo sapiens
tataccgagacccaccat

SEQ ID NO: 456968 - DNA, 11 bp, Homo sapiens
tatactgcata

SEQ ID NO: 456969 - DNA, 21 bp, Homo sapiens
tatactggttatagttgatat

SEQ ID NO: 456970 - DNA, 19 bp, Homo sapiens
tatactgtttgtaatatac

SEQ ID NO: 456971 - DNA, 15 bp, Homo sapiens
tatacttcacactga

SEQ ID NO: 456972 - DNA, 15 bp, Homo sapiens
tatagttgatatgta

SEQ ID NO: 456973 - DNA, 19 bp, Homo sapiens
tatataaatatctatttat

SEQ ID NO: 456974 - DNA, 22 bp, Homo sapiens
tatataaattattactttaaat

SEQ ID NO: 456975 - DNA, 10 bp, Homo sapiens
tatatattat

SEQ ID NO: 456976 - DNA, 20 bp, Homo sapiens
tatatatttattattttcat

SEQ ID NO: 456977 - DNA, 11 bp, Homo sapiens
tatatcagctc

SEQ ID NO: 456978 - DNA, 14 bp, Homo sapiens
tatatctgtaaatt

SEQ ID NO: 456979 - DNA, 13 bp, Homo sapiens
tatatgatatgca

SEQ ID NO: 456980 - DNA, 14 bp, Homo sapiens
tatatgatatgcat

SEQ ID NO: 456981 - DNA, 21 bp, Homo sapiens
tatatgatatgcatgtagcat

SEQ ID NO: 456982 - DNA, 15 bp, Homo sapiens
tatattaaggcagta

SEQ ID NO: 456983 - DNA, 12 bp, Homo sapiens
tatattatatat

SEQ ID NO: 456984 - DNA, 12 bp, Homo sapiens
tatatttatttc

SEQ ID NO: 456985 - DNA, 13 bp, Homo sapiens
tatattttatctt

SEQ ID NO: 456986 - DNA, 15 bp, Homo sapiens
tatcacgggcccgct

SEQ ID NO: 456987 - DNA, 13 bp, Homo sapiens
tatcagaactcct

SEQ ID NO: 456988 - DNA, 21 bp, Homo sapiens
tatcagctctaaagcagagat

SEQ ID NO: 456989 - DNA, 16 bp, Homo sapiens
tatcagctctgcataa

SEQ ID NO: 456990 - DNA, 22 bp, Homo sapiens
tatcagctctgcataagattat

SEQ ID NO: 456991 - DNA, 19 bp, Homo sapiens
tatcagggcccaaataaca

SEQ ID NO: 456992 - DNA, 13 bp, Homo sapiens
tatcctgcaccct

SEQ ID NO: 456993 - DNA, 15 bp, Homo sapiens
tatcctgcaccctct

SEQ ID NO: 456994 - DNA, 20 bp, Homo sapiens
tatcctgcaccctctgctat

SEQ ID NO: 456995 - DNA, 18 bp, Homo sapiens
tatcctgctagctgtaga

SEQ ID NO: 456996 - DNA, 17 bp, Homo sapiens
tatcctggtgtctagtt

SEQ ID NO: 456997 - DNA, 18 bp, Homo sapiens
tatctaaaaaataactgt

SEQ ID NO: 456998 - DNA, 19 bp, Homo sapiens
tatctaaaaaataactgtg

SEQ ID NO: 456999 - DNA, 15 bp, Homo sapiens
tatctagcaagaaga

SEQ ID NO: 457000 - DNA, 23 bp, Homo sapiens
tatctagcaagaagattctaaaa

SEQ ID NO: 457001 - DNA, 19 bp, Homo sapiens
tatctatttatctgtctga

SEQ ID NO: 457002 - DNA, 20 bp, Homo sapiens
tatctccagccaatttcaaa

SEQ ID NO: 457003 - DNA, 18 bp, Homo sapiens
tatctctttctctctttc

SEQ ID NO: 457004 - DNA, 22 bp, Homo sapiens
tatctgcaaatagtttcaaatg

SEQ ID NO: 457005 - DNA, 22 bp, Homo sapiens
tatctgggttttagaaattcta

SEQ ID NO: 457006 - DNA, 12 bp, Homo sapiens
tatctgtctgag

SEQ ID NO: 457007 - DNA, 15 bp, Homo sapiens
tatctgtctgagccc

SEQ ID NO: 457008 - DNA, 17 bp, Homo sapiens
tatctgtctgagccctg

SEQ ID NO: 457009 - DNA, 19 bp, Homo sapiens
tatctgtctgagccctgcc

SEQ ID NO: 457010 - DNA, 16 bp, Homo sapiens
tatctttcagttatta

SEQ ID NO: 457011 - DNA, 15 bp, Homo sapiens
tatcttttcttctcc

SEQ ID NO: 457012 - DNA, 20 bp, Homo sapiens
taactttttctaagctgttt

SEQ ID NO: 457013 - DNA, 16 bp, Homo sapiens
taagaaagctatatat

SEQ ID NO: 457014 - DNA, 15 bp, Homo sapiens
taagaaatgagaaat

SEQ ID NO: 457015 - DNA, 15 bp, Homo sapiens
taagacaacaggcat

SEQ ID NO: 457016 - DNA, 18 bp, Homo sapiens
taagagacaaagtttgga

SEQ ID NO: 457017 - DNA, 19 bp, Homo sapiens
taagagccctgagcccaga

SEQ ID NO: 457018 - DNA, 23 bp, Homo sapiens
taagatgggcatagggtttggaa

SEQ ID NO: 457019 - DNA, 17 bp, Homo sapiens
taagattatatacaaag

SEQ ID NO: 457020 - DNA, 21 bp, Homo sapiens
taagattccagagagtggctc

SEQ ID NO: 457021 - DNA, 22 bp, Homo sapiens
taagccatatgacaatttcaaa

SEQ ID NO: 457022 - DNA, 14 bp, Homo sapiens
taaggaaaagagaa

SEQ ID NO: 457023 - DNA, 17 bp, Homo sapiens
taaggacttctgcagct

SEQ ID NO: 457024 - DNA, 16 bp, Homo sapiens
taagtcttactgtttt

SEQ ID NO: 457025 - DNA, 15 bp, Homo sapiens
taagttgaagggaaa

SEQ ID NO: 457026 - DNA, 13 bp, Homo sapiens
taagttgaccttt

SEQ ID NO: 457027 - DNA, 14 bp, Homo sapiens
taagttgaccttta

SEQ ID NO: 457028 - DNA, 22 bp, Homo sapiens
taagttgtattttaataaagat

SEQ ID NO: 457029 - DNA, 24 bp, Homo sapiens
taagttgtattttaataaagattc

SEQ ID NO: 457030 - DNA, 14 bp, Homo sapiens
taataaagattcca

SEQ ID NO: 457031 - DNA, 15 bp, Homo sapiens
taatagcctcacctt

SEQ ID NO: 457032 - DNA, 14 bp, Homo sapiens
taatatactgcata

SEQ ID NO: 457033 - DNA, 15 bp, Homo sapiens
taatatactgcatat

SEQ ID NO: 457034 - DNA, 14 bp, Homo sapiens
taatatctttcagt

SEQ ID NO: 457035 - DNA, 15 bp, Homo sapiens
taatatctttcagtt

SEQ ID NO: 457036 - DNA, 22 bp, Homo sapiens
taatatggaaccttccctccaa

SEQ ID NO: 457037 - DNA, 11 bp, Homo sapiens
taatattccaa

SEQ ID NO: 457038 - DNA, 15 bp, Homo sapiens
taatcacaaaatcac

SEQ ID NO: 457039 - DNA, 18 bp, Homo sapiens
taatcacactctcttctt

SEQ ID NO: 457040 - DNA, 23 bp, Homo sapiens
taatgcttaacataaacttgtac

SEQ ID NO: 457041 - DNA, 14 bp, Homo sapiens
taatggtttttatt

SEQ ID NO: 457042 - DNA, 17 bp, Homo sapiens
taatgtaaaattcatag

SEQ ID NO: 457043 - DNA, 13 bp, Homo sapiens
taatgtcatctct

SEQ ID NO: 457044 - DNA, 18 bp, Homo sapiens
taatgtttccctcaagaa

SEQ ID NO: 457045 - DNA, 14 bp, Homo sapiens
taattatgtttacc

SEQ ID NO: 457046 - DNA, 14 bp, Homo sapiens
taattcaactctgt

SEQ ID NO: 457047 - DNA, 17 bp, Homo sapiens
taattgtggctttatga

SEQ ID NO: 457048 - DNA, 16 bp, Homo sapiens
taatttatgaagatag

SEQ ID NO: 457049 - DNA, 21 bp, Homo sapiens
taatttatgaagatagtttat

SEQ ID NO: 457050 - DNA, 15 bp, Homo sapiens
taatttatttcatcc

SEQ ID NO: 457051 - DNA, 15 bp, Homo sapiens
taatttcataaattg

SEQ ID NO: 457052 - DNA, 19 bp, Homo sapiens
taatttgccagacagagat

SEQ ID NO: 457053 - DNA, 20 bp, Homo sapiens
taatttgccagacagagatc

SEQ ID NO: 457054 - DNA, 15 bp, Homo sapiens
tacaaagctgtcact

SEQ ID NO: 457055 - DNA, 16 bp, Homo sapiens
tacaaagctgtcactc

SEQ ID NO: 457056 - DNA, 14 bp, Homo sapiens
tacaataaaagagc

SEQ ID NO: 457057 - DNA, 22 bp, Homo sapiens
tacaatggctgggtttgggcag

SEQ ID NO: 457058 - DNA, 15 bp, Homo sapiens
tacaccgggcctgga

SEQ ID NO: 457059 - DNA, 21 bp, Homo sapiens
tacagaaccagcactcccagg

SEQ ID NO: 457060 - DNA, 18 bp, Homo sapiens
tacagaatctaactggtg

SEQ ID NO: 457061 - DNA, 16 bp, Homo sapiens
tacagctaatcagcat

SEQ ID NO: 457062 - DNA, 17 bp, Homo sapiens
tacaggtattttcatca

SEQ ID NO: 457063 - DNA, 14 bp, Homo sapiens
tacagtaagctgct

SEQ ID NO: 457064 - DNA, 21 bp, Homo sapiens
tacagtaagctgctctattgt

SEQ ID NO: 457065 - DNA, 17 bp, Homo sapiens
tacagtatataagcttt

SEQ ID NO: 457066 - DNA, 20 bp, Homo sapiens
tacataaagtaataactgtt

SEQ ID NO: 457067 - DNA, 12 bp, Homo sapiens
tacatagtcttt

SEQ ID NO: 457068 - DNA, 14 bp, Homo sapiens
tacatagtctttgt

SEQ ID NO: 457069 - DNA, 21 bp, Homo sapiens
tacatctaagtcagtttcaca

SEQ ID NO: 457070 - DNA, 15 bp, Homo sapiens
tacatggtttaaagt

SEQ ID NO: 457071 - DNA, 20 bp, Homo sapiens
tacattagcagtttgctttg

SEQ ID NO: 457072 - DNA, 17 bp, Homo sapiens
tacatttttttaaacaa

SEQ ID NO: 457073 - DNA, 17 bp, Homo sapiens
tacccccaacaccaccc

SEQ ID NO: 457074 - DNA, 18 bp, Homo sapiens
taccccgtccctttccct

SEQ ID NO: 457075 - DNA, 19 bp, Homo sapiens
taccctagaagaaaacccg

SEQ ID NO: 457076 - DNA, 17 bp, Homo sapiens
taccctaggtctccacc

SEQ ID NO: 457077 - DNA, 22 bp, Homo sapiens
taccctaggtctccacccctca

SEQ ID NO: 457078 - DNA, 11 bp, Homo sapiens
taccctccctg

SEQ ID NO: 457079 - DNA, 19 bp, Homo sapiens
taccctccctgtcccctga

SEQ ID NO: 457080 - DNA, 21 bp, Homo sapiens
taccctcttctcagctccact

SEQ ID NO: 457081 - DNA, 18 bp, Homo sapiens
taccgaaacaccccgctc

SEQ ID NO: 457082 - DNA, 23 bp, Homo sapiens
taccgagacccaccatccttcca

SEQ ID NO: 457083 - DNA, 17 bp, Homo sapiens
taccgagtctcttctcc

SEQ ID NO: 457084 - DNA, 21 bp, Homo sapiens
taccgagtctcttctccactg

SEQ ID NO: 457085 - DNA, 23 bp, Homo sapiens
tacctgtaatagcctcaccttcc

SEQ ID NO: 457086 - DNA, 20 bp, Homo sapiens
tacctgtagtgagaaactga

SEQ ID NO: 457087 - DNA, 15 bp, Homo sapiens
tacctttccacccag

SEQ ID NO: 457088 - DNA, 23 bp, Homo sapiens
tacctttccacccagaccctcct

SEQ ID NO: 457089 - DNA, 16 bp, Homo sapiens
tactaagaataaataa

SEQ ID NO: 457090 - DNA, 19 bp, Homo sapiens
tactatttgaaaaaagaag

SEQ ID NO: 457091 - DNA, 16 bp, Homo sapiens
tactcccattaggtag

SEQ ID NO: 457092 - DNA, 23 bp, Homo sapiens
tactgaattgttatgtaaacatc

SEQ ID NO: 457093 - DNA, 22 bp, Homo sapiens
tactgcagaatacagtaagctg

SEQ ID NO: 457094 - DNA, 15 bp, Homo sapiens
tactgtttgtaatat

SEQ ID NO: 457095 - DNA, 21 bp, Homo sapiens
tactgttttgtgcggtgtgtc

SEQ ID NO: 457096 - DNA, 18 bp, Homo sapiens
tacttacactgaaatcca

SEQ ID NO: 457097 - DNA, 15 bp, Homo sapiens
tacttctttttcatt

SEQ ID NO: 457098 - DNA, 16 bp, Homo sapiens
tacttctttttcatta

SEQ ID NO: 457099 - DNA, 21 bp, Homo sapiens
tactttaaattatatgatatg

SEQ ID NO: 457100 - DNA, 18 bp, Homo sapiens
tagaaatacattatgctt

SEQ ID NO: 457101 - DNA, 14 bp, Homo sapiens
tagaaattctataa

SEQ ID NO: 457102 - DNA, 16 bp, Homo sapiens
tagaaattctataaga

SEQ ID NO: 457103 - DNA, 20 bp, Homo sapiens
tagaaattctataagagaca

SEQ ID NO: 457104 - DNA, 20 bp, Homo sapiens
tagaactgtcccacaaaata

SEQ ID NO: 457105 - DNA, 22 bp, Homo sapiens
tagaactgtcccacaaaatatt

SEQ ID NO: 457106 - DNA, 23 bp, Homo sapiens
tagaactgtcccacaaaatattt

SEQ ID NO: 457107 - DNA, 22 bp, Homo sapiens
tagaatatcctatactggttat

SEQ ID NO: 457108 - DNA, 14 bp, Homo sapiens
tagaatgagaaatc

SEQ ID NO: 457109 - DNA, 22 bp, Homo sapiens
gttctccgggtgtggcctcagc

SEQ ID NO: 457110 - DNA, 16 bp, Homo sapiens
gttctgaataatttct

SEQ ID NO: 457111 - DNA, 16 bp, Homo sapiens
gttcttcctcttacct

SEQ ID NO: 457112 - DNA, 17 bp, Homo sapiens
gttgaagggaaatcaat

SEQ ID NO: 457113 - DNA, 17 bp, Homo sapiens
gttgcaaattattctag

SEQ ID NO: 457114 - DNA, 16 bp, Homo sapiens
gttgccattttgtctg

SEQ ID NO: 457115 - DNA, 18 bp, Homo sapiens
gttgcctcgagtcccccc

SEQ ID NO: 457116 - DNA, 22 bp, Homo sapiens
gttgcctcgagtccccccaccc

SEQ ID NO: 457117 - DNA, 22 bp, Homo sapiens
gttgctgtcctccagggcgagc

SEQ ID NO: 457118 - DNA, 20 bp, Homo sapiens
gttgctttaaagtacctgta

SEQ ID NO: 457119 - DNA, 23 bp, Homo sapiens
gttgctttaaagtacctgtagtg

SEQ ID NO: 457120 - DNA, 13 bp, Homo sapiens
gttggaggcctgg

SEQ ID NO: 457121 - DNA, 15 bp, Homo sapiens
gttggccggctggcc

SEQ ID NO: 457122 - DNA, 17 bp, Homo sapiens
gttggccggctggccgg

SEQ ID NO: 457123 - DNA, 14 bp, Homo sapiens
gttgggttccagac

SEQ ID NO: 457124 - DNA, 19 bp, Homo sapiens
gttgtctgaagtcactgca

SEQ ID NO: 457125 - DNA, 20 bp, Homo sapiens
gttgtgtgggtttactctgt

SEQ ID NO: 457126 - DNA, 18 bp, Homo sapiens
gtttaagaaatgagaaat

SEQ ID NO: 457127 - DNA, 19 bp, Homo sapiens
gtttaagaaatgagaaatt

SEQ ID NO: 457128 - DNA, 15 bp, Homo sapiens
gtttaccctccctgt

SEQ ID NO: 457129 - DNA, 12 bp, Homo sapiens
gtttactctgtg

SEQ ID NO: 457130 - DNA, 22 bp, Homo sapiens
gtttataggaaataaatctaaa

SEQ ID NO: 457131 - DNA, 21 bp, Homo sapiens
gtttatattgtttttatatat

SEQ ID NO: 457132 - DNA, 22 bp, Homo sapiens
gtttcaatgcatacaataaaag

SEQ ID NO: 457133 - DNA, 23 bp, Homo sapiens
gtttcaatgcatacaataaaaga

SEQ ID NO: 457134 - DNA, 13 bp, Homo sapiens
gtttcacatctgt

SEQ ID NO: 457135 - DNA, 22 bp, Homo sapiens
gtttcagaaagggcagcccctc

SEQ ID NO: 457136 - DNA, 21 bp, Homo sapiens
gtttctatggattcacttcta

SEQ ID NO: 457137 - DNA, 15 bp, Homo sapiens
gtttggcaacctttg

SEQ ID NO: 457138 - DNA, 14 bp, Homo sapiens
gtttgggcagtgga

SEQ ID NO: 457139 - DNA, 12 bp, Homo sapiens
gtttgttctccg

SEQ ID NO: 457140 - DNA, 23 bp, Homo sapiens
gtttgttctccgggtgtggcctc

SEQ ID NO: 457141 - DNA, 23 bp, Homo sapiens
gttttaaagggagccatgctctt

SEQ ID NO: 457142 - DNA, 16 bp, Homo sapiens
gttttcaaaatacttc

SEQ ID NO: 457143 - DNA, 11 bp, Homo sapiens
gtttttgtaac

SEQ ID NO: 457144 - DNA, 17 bp, Homo sapiens
gttttttaataaaagtt

SEQ ID NO: 457145 - DNA, 12 bp, Homo sapiens
taaaaaagaaaa

SEQ ID NO: 457146 - DNA, 12 bp, Homo sapiens
taaaaaataaca

SEQ ID NO: 457147 - DNA, 18 bp, Homo sapiens
taaaaaataacatattct

SEQ ID NO: 457148 - DNA, 21 bp, Homo sapiens
taaaaaataactgtgcactat

SEQ ID NO: 457149 - DNA, 13 bp, Homo sapiens
taaaaaccctgta

SEQ ID NO: 457150 - DNA, 13 bp, Homo sapiens
taaaagagcttta

SEQ ID NO: 457151 - DNA, 20 bp, Homo sapiens
taaaaggaggacagggaggg

SEQ ID NO: 457152 - DNA, 21 bp, Homo sapiens
taaaaggaggacagggaggga

SEQ ID NO: 457153 - DNA, 20 bp, Homo sapiens
taaaagttctcaaatattgg

SEQ ID NO: 457154 - DNA, 15 bp, Homo sapiens
taaaatcagactctt

SEQ ID NO: 457155 - DNA, 15 bp, Homo sapiens
taaaattcaacaaat

SEQ ID NO: 457156 - DNA, 20 bp, Homo sapiens
taaaattctagtctctgatt

SEQ ID NO: 457157 - DNA, 21 bp, Homo sapiens
taaaattctagtctctgattt

SEQ ID NO: 457158 - DNA, 14 bp, Homo sapiens
taaacactgtaatc

SEQ ID NO: 457159 - DNA, 19 bp, Homo sapiens
taaacattaaacactgtaa

SEQ ID NO: 457160 - DNA, 20 bp, Homo sapiens
taaacattaaacactgtaat

SEQ ID NO: 457161 - DNA, 13 bp, Homo sapiens
taaactcttcaag

SEQ ID NO: 457162 - DNA, 15 bp, Homo sapiens
taaactgttttcatg

SEQ ID NO: 457163 - DNA, 16 bp, Homo sapiens
taaactgttttcatgt

SEQ ID NO: 457164 - DNA, 17 bp, Homo sapiens
taaactgttttcatgtg

SEQ ID NO: 457165 - DNA, 12 bp, Homo sapiens
taaacttcagca

SEQ ID NO: 457166 - DNA, 17 bp, Homo sapiens
taaacttcagcaaccct

SEQ ID NO: 457167 - DNA, 19 bp, Homo sapiens
taaactttgtcacttctgc

SEQ ID NO: 457168 - DNA, 15 bp, Homo sapiens
taaagaaaggcagag

SEQ ID NO: 457169 - DNA, 16 bp, Homo sapiens
taaaggaaagttctat

SEQ ID NO: 457170 - DNA, 20 bp, Homo sapiens
taaagtaataactgttagaa

SEQ ID NO: 457171 - DNA, 20 bp, Homo sapiens
taaataaactcttcaaggcc

SEQ ID NO: 457172 - DNA, 21 bp, Homo sapiens
taaataaagaagaaaataacc

SEQ ID NO: 457173 - DNA, 23 bp, Homo sapiens
taaatatctatttatctgtctga

SEQ ID NO: 457174 - DNA, 15 bp, Homo sapiens
taaatctaaatataa

SEQ ID NO: 457175 - DNA, 14 bp, Homo sapiens
taaatctgtctgat

SEQ ID NO: 457176 - DNA, 15 bp, Homo sapiens
taaatctgtctgatt

SEQ ID NO: 457177 - DNA, 16 bp, Homo sapiens
taaatctgtctgattc

SEQ ID NO: 457178 - DNA, 16 bp, Homo sapiens
taaatgattccaaata

SEQ ID NO: 457179 - DNA, 18 bp, Homo sapiens
taaatgattccaaataaa

SEQ ID NO: 457180 - DNA, 17 bp, Homo sapiens
taaatgtttatattgtt

SEQ ID NO: 457181 - DNA, 19 bp, Homo sapiens
taaattattactttaaatt

SEQ ID NO: 457182 - DNA, 23 bp, Homo sapiens
taaattattactttaaattatat

SEQ ID NO: 457183 - DNA, 18 bp, Homo sapiens
taaattcaacacttattt

SEQ ID NO: 457184 - DNA, 21 bp, Homo sapiens
taaattcaacacttattttct

SEQ ID NO: 457185 - DNA, 22 bp, Homo sapiens
taaattcaacacttattttctg

SEQ ID NO: 457186 - DNA, 17 bp, Homo sapiens
taaattggctcctttcc

SEQ ID NO: 457187 - DNA, 19 bp, Homo sapiens
taaattggctcctttccca

SEQ ID NO: 457188 - DNA, 20 bp, Homo sapiens
taaattggctcctttcccac

SEQ ID NO: 457189 - DNA, 16 bp, Homo sapiens
taaatttaatatactg

SEQ ID NO: 457190 - DNA, 23 bp, Homo sapiens
taaattttaatgtaaaattcata

SEQ ID NO: 457191 - DNA, 19 bp, Homo sapiens
taacaatgccttgttgtat

SEQ ID NO: 457192 - DNA, 20 bp, Homo sapiens
taacagcaattttcataata

SEQ ID NO: 457193 - DNA, 15 bp, Homo sapiens
taacatattcttgct

SEQ ID NO: 457194 - DNA, 17 bp, Homo sapiens
taacatattcttgcttt

SEQ ID NO: 457195 - DNA, 19 bp, Homo sapiens
taacatattcttgctttca

SEQ ID NO: 457196 - DNA, 18 bp, Homo sapiens
taacatctgaaaagaaat

SEQ ID NO: 457197 - DNA, 20 bp, Homo sapiens
taaccacgattccaacccag

SEQ ID NO: 457198 - DNA, 23 bp, Homo sapiens
taaccaggccccagcctccaggc

SEQ ID NO: 457199 - DNA, 15 bp, Homo sapiens
taactactaagaata

SEQ ID NO: 457200 - DNA, 20 bp, Homo sapiens
taactctgcatagacaaagg

SEQ ID NO: 457201 - DNA, 18 bp, Homo sapiens
taactgttaacccagtgt

SEQ ID NO: 457202 - DNA, 18 bp, Homo sapiens
taacttaaaagaacatag

SEQ ID NO: 457203 - DNA, 14 bp, Homo sapiens
taacttatctccag

SEQ ID NO: 457204 - DNA, 14 bp, Homo sapiens
taacttgatcttgt

SEQ ID NO: 457205 - DNA, 16 bp, Homo sapiens
taacttttattatctt

SEQ ID NO: 457206 - DNA, 15 bp, Homo sapiens
gtgaggcccccggag

SEQ ID NO: 457207 - DNA, 21 bp, Homo sapiens
gtgaggcccccggaggcgccc

SEQ ID NO: 457208 - DNA, 22 bp, Homo sapiens
gtgaggcccccggaggcgccca

SEQ ID NO: 457209 - DNA, 19 bp, Homo sapiens
gtgaggcgtgggatccaga

SEQ ID NO: 457210 - DNA, 21 bp, Homo sapiens
gtgaggcgtgggatccagaga

SEQ ID NO: 457211 - DNA, 14 bp, Homo sapiens
gtgatggttcccct

SEQ ID NO: 457212 - DNA, 16 bp, Homo sapiens
gtgatggttcccctgt

SEQ ID NO: 457213 - DNA, 19 bp, Homo sapiens
gtgcaggcgcgcaccgccc

SEQ ID NO: 457214 - DNA, 18 bp, Homo sapiens
gtgcatctcagcccacat

SEQ ID NO: 457215 - DNA, 18 bp, Homo sapiens
gtgcatttgagagaagcc

SEQ ID NO: 457216 - DNA, 19 bp, Homo sapiens
gtgcatttgagagaagcca

SEQ ID NO: 457217 - DNA, 20 bp, Homo sapiens
gtgcccaagaatagatgctg

SEQ ID NO: 457218 - DNA, 15 bp, Homo sapiens
gtgcccagtcttgag

SEQ ID NO: 457219 - DNA, 20 bp, Homo sapiens
gtgcccagtcttgagtgggc

SEQ ID NO: 457220 - DNA, 18 bp, Homo sapiens
gtgcccccagcgtggggc

SEQ ID NO: 457221 - DNA, 21 bp, Homo sapiens
gtgcctgagcccgaatttctc

SEQ ID NO: 457222 - DNA, 15 bp, Homo sapiens
gtgcctgcaccagga

SEQ ID NO: 457223 - DNA, 18 bp, Homo sapiens
gtgcctgcaccaggagac

SEQ ID NO: 457224 - DNA, 14 bp, Homo sapiens
gtgccttccccgtg

SEQ ID NO: 457225 - DNA, 20 bp, Homo sapiens
gtgccttccccgtgcggccc

SEQ ID NO: 457226 - DNA, 18 bp, Homo sapiens
gtgcggcccgtgcgcagc

SEQ ID NO: 457227 - DNA, 14 bp, Homo sapiens
gtgctaagttgtct

SEQ ID NO: 457228 - DNA, 15 bp, Homo sapiens
gtgctccctcctcag

SEQ ID NO: 457229 - DNA, 14 bp, Homo sapiens
gtgctcttcctcat

SEQ ID NO: 457230 - DNA, 15 bp, Homo sapiens
gtgctgctgcaccaa

SEQ ID NO: 457231 - DNA, 11 bp, Homo sapiens
gtgctgggccc

SEQ ID NO: 457232 - DNA, 12 bp, Homo sapiens
gtgctgggccca

SEQ ID NO: 457233 - DNA, 13 bp, Homo sapiens
gtgctgtgggcag

SEQ ID NO: 457234 - DNA, 18 bp, Homo sapiens
gtgctgtgggcagcaccc

SEQ ID NO: 457235 - DNA, 17 bp, Homo sapiens
gtgcttttccatctaaa

SEQ ID NO: 457236 - DNA, 20 bp, Homo sapiens
gtggactttatttaatttca

SEQ ID NO: 457237 - DNA, 21 bp, Homo sapiens
gtggactttatttaatttcat

SEQ ID NO: 457238 - DNA, 20 bp, Homo sapiens
gtggatgaaaaaaagggaaa

SEQ ID NO: 457239 - DNA, 17 bp, Homo sapiens
gtggcaaaaaagaacag

SEQ ID NO: 457240 - DNA, 14 bp, Homo sapiens
gtggcaccagatgc

SEQ ID NO: 457241 - DNA, 22 bp, Homo sapiens
gtggcaggcacacagcagcccc

SEQ ID NO: 457242 - DNA, 21 bp, Homo sapiens
gtggcattggggggccgggca

SEQ ID NO: 457243 - DNA, 15 bp, Homo sapiens
gtggccatccctggg

SEQ ID NO: 457244 - DNA, 17 bp, Homo sapiens
gtggccatccctgggcc

SEQ ID NO: 457245 - DNA, 18 bp, Homo sapiens
gtggcccctccttctccc

SEQ ID NO: 457246 - DNA, 22 bp, Homo sapiens
gtggcccctccttctcccctcc

SEQ ID NO: 457247 - DNA, 16 bp, Homo sapiens
gtggcccgacagcctg

SEQ ID NO: 457248 - DNA, 18 bp, Homo sapiens
gtggcccgacagcctggc

SEQ ID NO: 457249 - DNA, 13 bp, Homo sapiens
gtggccctgtggg

SEQ ID NO: 457250 - DNA, 15 bp, Homo sapiens
gtggcctgagaagag

SEQ ID NO: 457251 - DNA, 20 bp, Homo sapiens
gtggctcctcccggtgccca

SEQ ID NO: 457252 - DNA, 20 bp, Homo sapiens
gtggcttcccgctcagccct

SEQ ID NO: 457253 - DNA, 13 bp, Homo sapiens
gtggcttcttcaa

SEQ ID NO: 457254 - DNA, 17 bp, Homo sapiens
gtgggatccagagagaa

SEQ ID NO: 457255 - DNA, 17 bp, Homo sapiens
gtgggattcaggaatgg

SEQ ID NO: 457256 - DNA, 14 bp, Homo sapiens
gtgggcagcaccct

SEQ ID NO: 457257 - DNA, 16 bp, Homo sapiens
gtgggcagcaccctcc

SEQ ID NO: 457258 - DNA, 14 bp, Homo sapiens
gtgggctccagagt

SEQ ID NO: 457259 - DNA, 14 bp, Homo sapiens
gtggggagggtggg

SEQ ID NO: 457260 - DNA, 14 bp, Homo sapiens
gtgggggagaatgg

SEQ ID NO: 457261 - DNA, 19 bp, Homo sapiens
gtgggggtgcctggtgcgc

SEQ ID NO: 457262 - DNA, 12 bp, Homo sapiens
gtgggggtggcc

SEQ ID NO: 457263 - DNA, 21 bp, Homo sapiens
gtgggggtggccatccctggg

SEQ ID NO: 457264 - DNA, 23 bp, Homo sapiens
gtggtcacaggattctcttctca

SEQ ID NO: 457265 - DNA, 16 bp, Homo sapiens
gtggtcttggagagga

SEQ ID NO: 457266 - DNA, 20 bp, Homo sapiens
gtggtcttggagaggaggtg

SEQ ID NO: 457267 - DNA, 15 bp, Homo sapiens
gtggttggaggcctg

SEQ ID NO: 457268 - DNA, 16 bp, Homo sapiens
gtggtttcagaaaggg

SEQ ID NO: 457269 - DNA, 22 bp, Homo sapiens
gtgtatttctattttgcagcag

SEQ ID NO: 457270 - DNA, 23 bp, Homo sapiens
gtgtcccctcactctgtcagcca

SEQ ID NO: 457271 - DNA, 14 bp, Homo sapiens
gtgtggagtggagg

SEQ ID NO: 457272 - DNA, 15 bp, Homo sapiens
gtgtggcctcagccc

SEQ ID NO: 457273 - DNA, 16 bp, Homo sapiens
gtgtggcctcagccct

SEQ ID NO: 457274 - DNA, 21 bp, Homo sapiens
gtgtggcctcagccctcagaa

SEQ ID NO: 457275 - DNA, 23 bp, Homo sapiens
gtgtggcttggaacatttgggag

SEQ ID NO: 457276 - DNA, 16 bp, Homo sapiens
gtgtgtgcaatgttcc

SEQ ID NO: 457277 - DNA, 14 bp, Homo sapiens
gtgttcccttggca

SEQ ID NO: 457278 - DNA, 13 bp, Homo sapiens
gtgttttgctttg

SEQ ID NO: 457279 - DNA, 19 bp, Homo sapiens
gttaaggggatctaaaagg

SEQ ID NO: 457280 - DNA, 20 bp, Homo sapiens
gttaaggggatctaaaagga

SEQ ID NO: 457281 - DNA, 16 bp, Homo sapiens
gttaataggaggacag

SEQ ID NO: 457282 - DNA, 14 bp, Homo sapiens
gttaatgtgccaaa

SEQ ID NO: 457283 - DNA, 14 bp, Homo sapiens
gttaattacttttg

SEQ ID NO: 457284 - DNA, 14 bp, Homo sapiens
gttagctgggaaga

SEQ ID NO: 457285 - DNA, 18 bp, Homo sapiens
gttatatcagcagacact

SEQ ID NO: 457286 - DNA, 14 bp, Homo sapiens
gttatatcatcaat

SEQ ID NO: 457287 - DNA, 19 bp, Homo sapiens
gttatgtaataaccaaatg

SEQ ID NO: 457288 - DNA, 13 bp, Homo sapiens
gttattaaatgat

SEQ ID NO: 457289 - DNA, 20 bp, Homo sapiens
gttattgggcaagtgattga

SEQ ID NO: 457290 - DNA, 19 bp, Homo sapiens
gttcaaagaacccccctcc

SEQ ID NO: 457291 - DNA, 21 bp, Homo sapiens
gttcaatctgtgaagccttta

SEQ ID NO: 457292 - DNA, 18 bp, Homo sapiens
gttcatctgaggagtcca

SEQ ID NO: 457293 - DNA, 18 bp, Homo sapiens
gttcattcatactcaaag

SEQ ID NO: 457294 - DNA, 12 bp, Homo sapiens
gttcatttccac

SEQ ID NO: 457295 - DNA, 21 bp, Homo sapiens
gttccaagtgtgtgtgcaatg

SEQ ID NO: 457296 - DNA, 13 bp, Homo sapiens
gttccagacagag

SEQ ID NO: 457297 - DNA, 19 bp, Homo sapiens
gttccagacagagtggatc

SEQ ID NO: 457298 - DNA, 12 bp, Homo sapiens
gttccagacagg

SEQ ID NO: 457299 - DNA, 21 bp, Homo sapiens
gttccagacagggtggggctt

SEQ ID NO: 457300 - DNA, 18 bp, Homo sapiens
gttccgttcatctgagga

SEQ ID NO: 457301 - DNA, 17 bp, Homo sapiens
gttctatttctatctgc

SEQ ID NO: 457302 - DNA, 17 bp, Homo sapiens
gttctcatcttgtaaat

SEQ ID NO: 457303 - DNA, 23 bp, Homo sapiens
gttctcccatgggggctccagac

SEQ ID NO: 457304 - DNA, 13 bp, Homo sapiens
ggtcgcccctcct

SEQ ID NO: 457305 - DNA, 14 bp, Homo sapiens
ggtcgcccctcctc

SEQ ID NO: 457306 - DNA, 21 bp, Homo sapiens
ggtcgcccctcctcgggcgcc

SEQ ID NO: 457307 - DNA, 15 bp, Homo sapiens
ggtcgggggaggagc

SEQ ID NO: 457308 - DNA, 12 bp, Homo sapiens
ggtctctgagca

SEQ ID NO: 457309 - DNA, 12 bp, Homo sapiens
ggtctgaaggcc

SEQ ID NO: 457310 - DNA, 16 bp, Homo sapiens
ggtctgaaggcctcca

SEQ ID NO: 457311 - DNA, 21 bp, Homo sapiens
ggtctgagaagattcaattta

SEQ ID NO: 457312 - DNA, 20 bp, Homo sapiens
ggtcttggagaggaggtgtg

SEQ ID NO: 457313 - DNA, 22 bp, Homo sapiens
ggtcttggattggtaccagagc

SEQ ID NO: 457314 - DNA, 13 bp, Homo sapiens
ggtgactgtccca

SEQ ID NO: 457315 - DNA, 22 bp, Homo sapiens
ggtgagacagtgggggtgcctg

SEQ ID NO: 457316 - DNA, 12 bp, Homo sapiens
ggtgcaggcgcg

SEQ ID NO: 457317 - DNA, 19 bp, Homo sapiens
ggtgcatttgagagaagcc

SEQ ID NO: 457318 - DNA, 13 bp, Homo sapiens
ggtgcgctgtgct

SEQ ID NO: 457319 - DNA, 19 bp, Homo sapiens
ggtgcgctgtgctccagca

SEQ ID NO: 457320 - DNA, 15 bp, Homo sapiens
ggtgcggaccggagc

SEQ ID NO: 457321 - DNA, 16 bp, Homo sapiens
ggtgcgtgaccggccc

SEQ ID NO: 457322 - DNA, 22 bp, Homo sapiens
ggtgcgtgtggccctgtgggag

SEQ ID NO: 457323 - DNA, 21 bp, Homo sapiens
ggtggcaccagatgcaacctc

SEQ ID NO: 457324 - DNA, 21 bp, Homo sapiens
ggtggcaggcacacagcagcc

SEQ ID NO: 457325 - DNA, 20 bp, Homo sapiens
ggtggccactccagacccct

SEQ ID NO: 457326 - DNA, 21 bp, Homo sapiens
ggtggccactccagacccctg

SEQ ID NO: 457327 - DNA, 22 bp, Homo sapiens
ggtggccactccagacccctgg

SEQ ID NO: 457328 - DNA, 23 bp, Homo sapiens
ggtggccactccagacccctggc

SEQ ID NO: 457329 - DNA, 14 bp, Homo sapiens
ggtggccatccctg

SEQ ID NO: 457330 - DNA, 19 bp, Homo sapiens
ggtggccatccctgggccc

SEQ ID NO: 457331 - DNA, 22 bp, Homo sapiens
ggtggccatccctgggcccctc

SEQ ID NO: 457332 - DNA, 19 bp, Homo sapiens
ggtggcccgacagcctggc

SEQ ID NO: 457333 - DNA, 15 bp, Homo sapiens
ggtggggcttggaag

SEQ ID NO: 457334 - DNA, 22 bp, Homo sapiens
ggtggggcttggaagggcgctg

SEQ ID NO: 457335 - DNA, 17 bp, Homo sapiens
ggtggtcttggagagga

SEQ ID NO: 457336 - DNA, 20 bp, Homo sapiens
ggtggtcttggagaggaggt

SEQ ID NO: 457337 - DNA, 14 bp, Homo sapiens
ggtggttggaggcc

SEQ ID NO: 457338 - DNA, 15 bp, Homo sapiens
ggtggttggaggcct

SEQ ID NO: 457339 - DNA, 17 bp, Homo sapiens
ggtggtttcagaaaggg

SEQ ID NO: 457340 - DNA, 18 bp, Homo sapiens
ggtggtttcagaaagggc

SEQ ID NO: 457341 - DNA, 21 bp, Homo sapiens
ggtgtggagtggaggggtcag

SEQ ID NO: 457342 - DNA, 12 bp, Homo sapiens
ggttaagccata

SEQ ID NO: 457343 - DNA, 13 bp, Homo sapiens
ggttaagccatat

SEQ ID NO: 457344 - DNA, 18 bp, Homo sapiens
ggttaaggggatctaaaa

SEQ ID NO: 457345 - DNA, 19 bp, Homo sapiens
ggttaaggggatctaaaag

SEQ ID NO: 457346 - DNA, 17 bp, Homo sapiens
ggttccagacagagtgg

SEQ ID NO: 457347 - DNA, 19 bp, Homo sapiens
ggttccagacagagtggat

SEQ ID NO: 457348 - DNA, 14 bp, Homo sapiens
ggttccagacaggg

SEQ ID NO: 457349 - DNA, 12 bp, Homo sapiens
ggttcctccagc

SEQ ID NO: 457350 - DNA, 17 bp, Homo sapiens
ggttgcctcgagtcccc

SEQ ID NO: 457351 - DNA, 14 bp, Homo sapiens
ggttggccggctgg

SEQ ID NO: 457352 - DNA, 17 bp, Homo sapiens
ggttggccggctggccg

SEQ ID NO: 457353 - DNA, 15 bp, Homo sapiens
ggttgggttccagac

SEQ ID NO: 457354 - DNA, 15 bp, Homo sapiens
ggtttacccagtggg

SEQ ID NO: 457355 - DNA, 22 bp, Homo sapiens
ggtttcaatgcatacaataaaa

SEQ ID NO: 457356 - DNA, 14 bp, Homo sapiens
ggtttcagaaaggg

SEQ ID NO: 457357 - DNA, 18 bp, Homo sapiens
ggtttgggcagtggagag

SEQ ID NO: 457358 - DNA, 19 bp, Homo sapiens
ggtttgggcagtggagagg

SEQ ID NO: 457359 - DNA, 19 bp, Homo sapiens
ggttttagaaattctataa

SEQ ID NO: 457360 - DNA, 18 bp, Homo sapiens
ggtttttgctctacttta

SEQ ID NO: 457361 - DNA, 22 bp, Homo sapiens
gtaaacatcataaatagtaaat

SEQ ID NO: 457362 - DNA, 12 bp, Homo sapiens
gtaaataaactc

SEQ ID NO: 457363 - DNA, 18 bp, Homo sapiens
gtaaataaactcttcaag

SEQ ID NO: 457364 - DNA, 19 bp, Homo sapiens
gtaaataatgattcaatgt

SEQ ID NO: 457365 - DNA, 23 bp, Homo sapiens
gtaaataatgattcaatgtgaat

SEQ ID NO: 457366 - DNA, 22 bp, Homo sapiens
gtaaatcccacgacataagctg

SEQ ID NO: 457367 - DNA, 16 bp, Homo sapiens
gtaacagttggtgatt

SEQ ID NO: 457368 - DNA, 14 bp, Homo sapiens
gtaagaagaaactg

SEQ ID NO: 457369 - DNA, 16 bp, Homo sapiens
gtaagaagaaactgct

SEQ ID NO: 457370 - DNA, 17 bp, Homo sapiens
gtaagctgctctattgt

SEQ ID NO: 457371 - DNA, 20 bp, Homo sapiens
gtaagttgaagggaaatcaa

SEQ ID NO: 457372 - DNA, 23 bp, Homo sapiens
gtaagttgttggtttatactgta

SEQ ID NO: 457373 - DNA, 13 bp, Homo sapiens
gtaatatctttca

SEQ ID NO: 457374 - DNA, 20 bp, Homo sapiens
gtacacccaattttaaaaaa

SEQ ID NO: 457375 - DNA, 20 bp, Homo sapiens
gtacataaagtaataactgt

SEQ ID NO: 457376 - DNA, 23 bp, Homo sapiens
gtacatttgatttgatatacaga

SEQ ID NO: 457377 - DNA, 13 bp, Homo sapiens
gtaccaactgagc

SEQ ID NO: 457378 - DNA, 16 bp, Homo sapiens
gtaccaactgagccaa

SEQ ID NO: 457379 - DNA, 17 bp, Homo sapiens
gtaccatcccactgata

SEQ ID NO: 457380 - DNA, 18 bp, Homo sapiens
gtaccgaaacaccccgct

SEQ ID NO: 457381 - DNA, 16 bp, Homo sapiens
gtacctttccacccag

SEQ ID NO: 457382 - DNA, 18 bp, Homo sapiens
gtacctttccacccagac

SEQ ID NO: 457383 - DNA, 14 bp, Homo sapiens
gtactcctcagacg

SEQ ID NO: 457384 - DNA, 14 bp, Homo sapiens
gtactcctcccagg

SEQ ID NO: 457385 - DNA, 12 bp, Homo sapiens
gtactgtattgg

SEQ ID NO: 457386 - DNA, 17 bp, Homo sapiens
gtacttgctcaataaag

SEQ ID NO: 457387 - DNA, 14 bp, Homo sapiens
gtagagaggacagt

SEQ ID NO: 457388 - DNA, 14 bp, Homo sapiens
gtagcatataaatg

SEQ ID NO: 457389 - DNA, 19 bp, Homo sapiens
gtaggtctgaaggcctcca

SEQ ID NO: 457390 - DNA, 22 bp, Homo sapiens
gtatatcagctctaaagcagag

SEQ ID NO: 457391 - DNA, 16 bp, Homo sapiens
gtatctaaaaaataac

SEQ ID NO: 457392 - DNA, 19 bp, Homo sapiens
gtatctaaaaaataactgt

SEQ ID NO: 457393 - DNA, 14 bp, Homo sapiens
gtatctattttcaa

SEQ ID NO: 457394 - DNA, 15 bp, Homo sapiens
gtatgctggccagca

SEQ ID NO: 457395 - DNA, 18 bp, Homo sapiens
gtatgttaagctctttat

SEQ ID NO: 457396 - DNA, 15 bp, Homo sapiens
gtattcctgcctttg

SEQ ID NO: 457397 - DNA, 19 bp, Homo sapiens
gtattctgtggattctata

SEQ ID NO: 457398 - DNA, 21 bp, Homo sapiens
gtattctgtggattctatatt

SEQ ID NO: 457399 - DNA, 22 bp, Homo sapiens
gtatttccaacaaacttactgt

SEQ ID NO: 457400 - DNA, 14 bp, Homo sapiens
gtcaaacagtgtgg

SEQ ID NO: 457401 - DNA, 22 bp, Homo sapiens
gtcaaacagtgtggcttaaaca

SEQ ID NO: 457402 - DNA, 16 bp, Homo sapiens
gtcaactgctgtttta

SEQ ID NO: 457403 - DNA, 23 bp, Homo sapiens
gtcaactgctgttttatgtcata

SEQ ID NO: 457404 - DNA, 19 bp, Homo sapiens
gtcaatgtgaaataaagag

SEQ ID NO: 457405 - DNA, 22 bp, Homo sapiens
gtcacagcagtacttgctcaat

SEQ ID NO: 457406 - DNA, 22 bp, Homo sapiens
gtcagcaccgtggtgtgaggcc

SEQ ID NO: 457407 - DNA, 18 bp, Homo sapiens
gtcagccagccgccctgg

SEQ ID NO: 457408 - DNA, 15 bp, Homo sapiens
gtcaggtgggaaagc

SEQ ID NO: 457409 - DNA, 21 bp, Homo sapiens
gtcagtgaagcccaggaggac

SEQ ID NO: 457410 - DNA, 22 bp, Homo sapiens
gtcatcggaggctgggcccctg

SEQ ID NO: 457411 - DNA, 20 bp, Homo sapiens
gtcattctgctaatttatga

SEQ ID NO: 457412 - DNA, 13 bp, Homo sapiens
gtccacctgtgct

SEQ ID NO: 457413 - DNA, 17 bp, Homo sapiens
gtccagaacaaaagata

SEQ ID NO: 457414 - DNA, 18 bp, Homo sapiens
gtccatgtgaaatttaca

SEQ ID NO: 457415 - DNA, 16 bp, Homo sapiens
gtccattgcaaaaggt

SEQ ID NO: 457416 - DNA, 16 bp, Homo sapiens
gtcccacaaaatattt

SEQ ID NO: 457417 - DNA, 17 bp, Homo sapiens
gtcccacaaaatatttc

SEQ ID NO: 457418 - DNA, 11 bp, Homo sapiens
gtccccagggt

SEQ ID NO: 457419 - DNA, 17 bp, Homo sapiens
gtccccattctataaat

SEQ ID NO: 457420 - DNA, 19 bp, Homo sapiens
gtccccccacccctcccca

SEQ ID NO: 457421 - DNA, 17 bp, Homo sapiens
gtccccggacgctggct

SEQ ID NO: 457422 - DNA, 13 bp, Homo sapiens
gtcccctcactct

SEQ ID NO: 457423 - DNA, 15 bp, Homo sapiens
gtcccctcactctgt

SEQ ID NO: 457424 - DNA, 16 bp, Homo sapiens
gtcccctcactctgtc

SEQ ID NO: 457425 - DNA, 23 bp, Homo sapiens
gtcccctcactctgtcagccagc

SEQ ID NO: 457426 - DNA, 23 bp, Homo sapiens
gtccctaccgagtctcttctcca

SEQ ID NO: 457427 - DNA, 15 bp, Homo sapiens
gtccctgacttccca

SEQ ID NO: 457428 - DNA, 18 bp, Homo sapiens
gtccctgacttcccagct

SEQ ID NO: 457429 - DNA, 10 bp, Homo sapiens
gtccctttcc

SEQ ID NO: 457430 - DNA, 16 bp, Homo sapiens
gtccctttccctgcat

SEQ ID NO: 457431 - DNA, 13 bp, Homo sapiens
gtccgcccgccca

SEQ ID NO: 457432 - DNA, 17 bp, Homo sapiens
gtccgcccgcccacccc

SEQ ID NO: 457433 - DNA, 14 bp, Homo sapiens
gtccggcctgcagc

SEQ ID NO: 457434 - DNA, 15 bp, Homo sapiens
gtccggcctgcagcc

SEQ ID NO: 457435 - DNA, 17 bp, Homo sapiens
gtccggcctgcagccca

SEQ ID NO: 457436 - DNA, 15 bp, Homo sapiens
gtccgtccgcccgcc

SEQ ID NO: 457437 - DNA, 23 bp, Homo sapiens
gtccgtccgcccgcccaccccgc

SEQ ID NO: 457438 - DNA, 17 bp, Homo sapiens
gtcctcaggtgaataac

SEQ ID NO: 457439 - DNA, 14 bp, Homo sapiens
gtcctccagggcga

SEQ ID NO: 457440 - DNA, 15 bp, Homo sapiens
gtcctccagggcgag

SEQ ID NO: 457441 - DNA, 16 bp, Homo sapiens
gtcctccagggcgagc

SEQ ID NO: 457442 - DNA, 16 bp, Homo sapiens
gtcctctcgagcccag

SEQ ID NO: 457443 - DNA, 17 bp, Homo sapiens
gtcctctcgagcccaga

SEQ ID NO: 457444 - DNA, 13 bp, Homo sapiens
gtcctgcccatgt

SEQ ID NO: 457445 - DNA, 23 bp, Homo sapiens
gtcctgcccatgtgtcccctcac

SEQ ID NO: 457446 - DNA, 12 bp, Homo sapiens
gtcctgctgctc

SEQ ID NO: 457447 - DNA, 13 bp, Homo sapiens
gtcctgctgctcg

SEQ ID NO: 457448 - DNA, 14 bp, Homo sapiens
gtcctgctgctcgg

SEQ ID NO: 457449 - DNA, 22 bp, Homo sapiens
gtcctgctgctcgggaaggcct

SEQ ID NO: 457450 - DNA, 23 bp, Homo sapiens
gtcctggggtggttggaggcctg

SEQ ID NO: 457451 - DNA, 18 bp, Homo sapiens
gtccttagaatactgtat

SEQ ID NO: 457452 - DNA, 15 bp, Homo sapiens
gtccttctgacccca

SEQ ID NO: 457453 - DNA, 18 bp, Homo sapiens
gtcgagtgatatggcttg

SEQ ID NO: 457454 - DNA, 12 bp, Homo sapiens
gtcggctgggca

SEQ ID NO: 457455 - DNA, 15 bp, Homo sapiens
gtcggctgggcaggg

SEQ ID NO: 457456 - DNA, 18 bp, Homo sapiens
gtcgggggaggagcaccc

SEQ ID NO: 457457 - DNA, 22 bp, Homo sapiens
gtcgggggaggagcacccccag

SEQ ID NO: 457458 - DNA, 17 bp, Homo sapiens
gtctcaagagggcactg

SEQ ID NO: 457459 - DNA, 20 bp, Homo sapiens
gtctcaccttcgcctttgct

SEQ ID NO: 457460 - DNA, 17 bp, Homo sapiens
gtctccacccctcaagc

SEQ ID NO: 457461 - DNA, 24 bp, Homo sapiens
gtctccccgcagccctctccaccc

SEQ ID NO: 457462 - DNA, 13 bp, Homo sapiens
gtctccctggcca

SEQ ID NO: 457463 - DNA, 21 bp, Homo sapiens
gtctccctggccacccttggc

SEQ ID NO: 457464 - DNA, 23 bp, Homo sapiens
gtctctccctaccctcttctcag

SEQ ID NO: 457465 - DNA, 14 bp, Homo sapiens
gtctctgagcagtg

SEQ ID NO: 457466 - DNA, 15 bp, Homo sapiens
gtctcttctccactg

SEQ ID NO: 457467 - DNA, 16 bp, Homo sapiens
gtctcttctccactgg

SEQ ID NO: 457468 - DNA, 21 bp, Homo sapiens
gtctgaaggcctccatttgta

SEQ ID NO: 457469 - DNA, 16 bp, Homo sapiens
gtctgaagtcactgca

SEQ ID NO: 457470 - DNA, 18 bp, Homo sapiens
gtctgagccctgccctca

SEQ ID NO: 457471 - DNA, 20 bp, Homo sapiens
gtctgagccctgccctcact

SEQ ID NO: 457472 - DNA, 24 bp, Homo sapiens
gtctgagccctgccctcactccac

SEQ ID NO: 457473 - DNA, 10 bp, Homo sapiens
gtctgcccct

SEQ ID NO: 457474 - DNA, 24 bp, Homo sapiens
gtctggagcccctatcctgcaccc

SEQ ID NO: 457475 - DNA, 16 bp, Homo sapiens
gtctggctgtggcccc

SEQ ID NO: 457476 - DNA, 18 bp, Homo sapiens
gtctggctgtggcccctc

SEQ ID NO: 457477 - DNA, 15 bp, Homo sapiens
gtctgtgagtctgtc

SEQ ID NO: 457478 - DNA, 20 bp, Homo sapiens
gtctgtgatgtcagtagtgc

SEQ ID NO: 457479 - DNA, 20 bp, Homo sapiens
gtctgtttcaatgacctgta

SEQ ID NO: 457480 - DNA, 17 bp, Homo sapiens
gtcttcaaccctgccct

SEQ ID NO: 457481 - DNA, 21 bp, Homo sapiens
gtcttcaaccctgccctgcac

SEQ ID NO: 457482 - DNA, 23 bp, Homo sapiens
gtcttcaaccctgccctgcacct

SEQ ID NO: 457483 - DNA, 15 bp, Homo sapiens
gtcttccctgcttca

SEQ ID NO: 457484 - DNA, 18 bp, Homo sapiens
gtcttgagtgggccccct

SEQ ID NO: 457485 - DNA, 19 bp, Homo sapiens
gtcttgagtgggccccctc

SEQ ID NO: 457486 - DNA, 15 bp, Homo sapiens
gtcttggagaggagg

SEQ ID NO: 457487 - DNA, 17 bp, Homo sapiens
gtctttatgtaagaaga

SEQ ID NO: 457488 - DNA, 21 bp, Homo sapiens
gtctttatgtaagaagaaact

SEQ ID NO: 457489 - DNA, 18 bp, Homo sapiens
gtctttgctgtttatata

SEQ ID NO: 457490 - DNA, 19 bp, Homo sapiens
gtctttgctgtttatatat

SEQ ID NO: 457491 - DNA, 20 bp, Homo sapiens
gtctttgggggattcaaatg

SEQ ID NO: 457492 - DNA, 23 bp, Homo sapiens
gtctttgggggattcaaatgcat

SEQ ID NO: 457493 - DNA, 22 bp, Homo sapiens
gtgaaatttacagttactgcct

SEQ ID NO: 457494 - DNA, 15 bp, Homo sapiens
gtgacatgcggctgc

SEQ ID NO: 457495 - DNA, 14 bp, Homo sapiens
gtgaccggcccgcc

SEQ ID NO: 457496 - DNA, 22 bp, Homo sapiens
gtgactgtcccaccgggagcct

SEQ ID NO: 457497 - DNA, 21 bp, Homo sapiens
gtgagacagtgggggtgcctg

SEQ ID NO: 457498 - DNA, 15 bp, Homo sapiens
gtgagcatacagagt

SEQ ID NO: 457499 - DNA, 23 bp, Homo sapiens
gggccaagccagggttccagaca

SEQ ID NO: 457500 - DNA, 24 bp, Homo sapiens
gggccaagccagggttccagacag

SEQ ID NO: 457501 - DNA, 12 bp, Homo sapiens
gggccagaggga

SEQ ID NO: 457502 - DNA, 13 bp, Homo sapiens
gggccagagggac

SEQ ID NO: 457503 - DNA, 19 bp, Homo sapiens
gggcccagccggggtgggg

SEQ ID NO: 457504 - DNA, 14 bp, Homo sapiens
gggcccatggcccc

SEQ ID NO: 457505 - DNA, 13 bp, Homo sapiens
gggcccctccacg

SEQ ID NO: 457506 - DNA, 18 bp, Homo sapiens
gggcccctccacgcctcc

SEQ ID NO: 457507 - DNA, 12 bp, Homo sapiens
gggcccctggga

SEQ ID NO: 457508 - DNA, 16 bp, Homo sapiens
gggcccgagcgcgtgc

SEQ ID NO: 457509 - DNA, 23 bp, Homo sapiens
gggcccgagcgcgtgccttcccc

SEQ ID NO: 457510 - DNA, 21 bp, Homo sapiens
gggcccgctcaacctctcaga

SEQ ID NO: 457511 - DNA, 17 bp, Homo sapiens
gggccctgggcctcagt

SEQ ID NO: 457512 - DNA, 21 bp, Homo sapiens
gggccctggggtctctgagca

SEQ ID NO: 457513 - DNA, 13 bp, Homo sapiens
gggccgcagggcg

SEQ ID NO: 457514 - DNA, 16 bp, Homo sapiens
gggcgctccggcagag

SEQ ID NO: 457515 - DNA, 16 bp, Homo sapiens
gggcgctgagggcagg

SEQ ID NO: 457516 - DNA, 14 bp, Homo sapiens
gggctaactggccc

SEQ ID NO: 457517 - DNA, 16 bp, Homo sapiens
gggctaactggcccca

SEQ ID NO: 457518 - DNA, 21 bp, Homo sapiens
gggctaactggccccaggcgg

SEQ ID NO: 457519 - DNA, 12 bp, Homo sapiens
gggctccagagt

SEQ ID NO: 457520 - DNA, 11 bp, Homo sapiens
gggctgagccc

SEQ ID NO: 457521 - DNA, 14 bp, Homo sapiens
gggctgagcccctc

SEQ ID NO: 457522 - DNA, 11 bp, Homo sapiens
gggctggccct

SEQ ID NO: 457523 - DNA, 14 bp, Homo sapiens
gggctggccctgcc

SEQ ID NO: 457524 - DNA, 21 bp, Homo sapiens
gggctggccctgccctccccc

SEQ ID NO: 457525 - DNA, 23 bp, Homo sapiens
gggctggccctgccctcccccac

SEQ ID NO: 457526 - DNA, 14 bp, Homo sapiens
gggcttagaatggg

SEQ ID NO: 457527 - DNA, 16 bp, Homo sapiens
gggcttagaatggggc

SEQ ID NO: 457528 - DNA, 14 bp, Homo sapiens
gggcttggaagggc

SEQ ID NO: 457529 - DNA, 16 bp, Homo sapiens
gggcttggaagggcgc

SEQ ID NO: 457530 - DNA, 13 bp, Homo sapiens
gggcttggagcag

SEQ ID NO: 457531 - DNA, 17 bp, Homo sapiens
gggcttggagcagagac

SEQ ID NO: 457532 - DNA, 16 bp, Homo sapiens
gggcttggggtagaga

SEQ ID NO: 457533 - DNA, 18 bp, Homo sapiens
gggcttggggtagagagg

SEQ ID NO: 457534 - DNA, 22 bp, Homo sapiens
gggcttggggtagagaggacag

SEQ ID NO: 457535 - DNA, 15 bp, Homo sapiens
ggggacttggatagg

SEQ ID NO: 457536 - DNA, 16 bp, Homo sapiens
ggggacttggatagga

SEQ ID NO: 457537 - DNA, 20 bp, Homo sapiens
ggggcaagagctcaggagaa

SEQ ID NO: 457538 - DNA, 23 bp, Homo sapiens
ggggcaagagctcaggagaaggc

SEQ ID NO: 457539 - DNA, 13 bp, Homo sapiens
ggggcagagctga

SEQ ID NO: 457540 - DNA, 22 bp, Homo sapiens
ggggcatctgagtccagctccc

SEQ ID NO: 457541 - DNA, 13 bp, Homo sapiens
ggggcccatggcc

SEQ ID NO: 457542 - DNA, 16 bp, Homo sapiens
ggggcccatggcccca

SEQ ID NO: 457543 - DNA, 18 bp, Homo sapiens
ggggcccatggccccagc

SEQ ID NO: 457544 - DNA, 11 bp, Homo sapiens
ggggccctggg

SEQ ID NO: 457545 - DNA, 16 bp, Homo sapiens
ggggccgggcaggtcc

SEQ ID NO: 457546 - DNA, 23 bp, Homo sapiens
ggggccgggcaggtcctgcccat

SEQ ID NO: 457547 - DNA, 11 bp, Homo sapiens
ggggcctggca

SEQ ID NO: 457548 - DNA, 14 bp, Homo sapiens
ggggcctggcctat

SEQ ID NO: 457549 - DNA, 22 bp, Homo sapiens
ggggcctggcctatttaagccc

SEQ ID NO: 457550 - DNA, 14 bp, Homo sapiens
ggggctggccctgc

SEQ ID NO: 457551 - DNA, 16 bp, Homo sapiens
ggggctggccctgccc

SEQ ID NO: 457552 - DNA, 18 bp, Homo sapiens
ggggctggccctgccctc

SEQ ID NO: 457553 - DNA, 19 bp, Homo sapiens
ggggcttggggtagagagg

SEQ ID NO: 457554 - DNA, 15 bp, Homo sapiens
gggggatgggccagg

SEQ ID NO: 457555 - DNA, 22 bp, Homo sapiens
gggggcatctgagtccagctcc

SEQ ID NO: 457556 - DNA, 23 bp, Homo sapiens
gggggcatctgagtccagctccc

SEQ ID NO: 457557 - DNA, 14 bp, Homo sapiens
gggggccgggcagg

SEQ ID NO: 457558 - DNA, 18 bp, Homo sapiens
gggggccgggcaggtcct

SEQ ID NO: 457559 - DNA, 23 bp, Homo sapiens
gggggccgggcaggtcctgccca

SEQ ID NO: 457560 - DNA, 12 bp, Homo sapiens
gggggtggccat

SEQ ID NO: 457561 - DNA, 22 bp, Homo sapiens
ggggtcgggggaggagcacccc

SEQ ID NO: 457562 - DNA, 20 bp, Homo sapiens
ggggtctctgagcagtgggg

SEQ ID NO: 457563 - DNA, 18 bp, Homo sapiens
ggggtgccaaaatgccta

SEQ ID NO: 457564 - DNA, 13 bp, Homo sapiens
ggggtgcctgagc

SEQ ID NO: 457565 - DNA, 14 bp, Homo sapiens
ggggtgcctgagcc

SEQ ID NO: 457566 - DNA, 19 bp, Homo sapiens
ggggtggggcttggaaggg

SEQ ID NO: 457567 - DNA, 22 bp, Homo sapiens
gggtaagttgaagggaaatcaa

SEQ ID NO: 457568 - DNA, 20 bp, Homo sapiens
gggtcagcaggggggttggg

SEQ ID NO: 457569 - DNA, 20 bp, Homo sapiens
gggtccccggacgctggctc

SEQ ID NO: 457570 - DNA, 14 bp, Homo sapiens
gggtcctgctgctc

SEQ ID NO: 457571 - DNA, 13 bp, Homo sapiens
gggtcgcccctcc

SEQ ID NO: 457572 - DNA, 15 bp, Homo sapiens
gggtcgcccctcctc

SEQ ID NO: 457573 - DNA, 15 bp, Homo sapiens
gggtctctgagcagt

SEQ ID NO: 457574 - DNA, 15 bp, Homo sapiens
gggtgaggcgtggga

SEQ ID NO: 457575 - DNA, 22 bp, Homo sapiens
gggtgaggcgtgggatccagag

SEQ ID NO: 457576 - DNA, 20 bp, Homo sapiens
gggtgcatttgagagaagcc

SEQ ID NO: 457577 - DNA, 14 bp, Homo sapiens
gggtgcctgagccc

SEQ ID NO: 457578 - DNA, 21 bp, Homo sapiens
gggtgcctggtgcgctgtgct

SEQ ID NO: 457579 - DNA, 23 bp, Homo sapiens
gggtggcaggcacacagcagccc

SEQ ID NO: 457580 - DNA, 13 bp, Homo sapiens
gggtggccatccc

SEQ ID NO: 457581 - DNA, 17 bp, Homo sapiens
gggttaaagaaaggcag

SEQ ID NO: 457582 - DNA, 20 bp, Homo sapiens
gggttaaagaaaggcagaga

SEQ ID NO: 457583 - DNA, 23 bp, Homo sapiens
gggttccagacagagtggatctg

SEQ ID NO: 457584 - DNA, 16 bp, Homo sapiens
gggttctagaaggggc

SEQ ID NO: 457585 - DNA, 20 bp, Homo sapiens
gggtttacccagtgggacag

SEQ ID NO: 457586 - DNA, 19 bp, Homo sapiens
ggtacctttccacccagac

SEQ ID NO: 457587 - DNA, 22 bp, Homo sapiens
ggtacctttccacccagaccct

SEQ ID NO: 457588 - DNA, 17 bp, Homo sapiens
ggtatgctggccagcac

SEQ ID NO: 457589 - DNA, 23 bp, Homo sapiens
ggtcagcaccgtggtgtgaggcc

SEQ ID NO: 457590 - DNA, 20 bp, Homo sapiens
ggtcagtgaagcccaggagg

SEQ ID NO: 457591 - DNA, 14 bp, Homo sapiens
ggtccaccccgtcc

SEQ ID NO: 457592 - DNA, 22 bp, Homo sapiens
ggtccaccccgtcccggccccg

SEQ ID NO: 457593 - DNA, 19 bp, Homo sapiens
ggtccccggacgctggctc

SEQ ID NO: 457594 - DNA, 22 bp, Homo sapiens
ggtcctgcccatgtgtcccctc

SEQ ID NO: 457595 - DNA, 13 bp, Homo sapiens
ggtcctgctgctc

SEQ ID NO: 457596 - DNA, 21 bp, Homo sapiens
ggtcctgctgctcgggaaggc

SEQ ID NO: 457597 - DNA, 16 bp, Homo sapiens
gcctggcgggcagccc

SEQ ID NO: 457598 - DNA, 18 bp, Homo sapiens
gcctggcgggcagcccct

SEQ ID NO: 457599 - DNA, 20 bp, Homo sapiens
gcctggcgggcagcccctgc

SEQ ID NO: 457600 - DNA, 12 bp, Homo sapiens
gcctggtctgga

SEQ ID NO: 457601 - DNA, 16 bp, Homo sapiens
gcctggtctggagccc

SEQ ID NO: 457602 - DNA, 17 bp, Homo sapiens
gcctggtctggagcccc

SEQ ID NO: 457603 - DNA, 17 bp, Homo sapiens
gcctggtgcgctgtgct

SEQ ID NO: 457604 - DNA, 20 bp, Homo sapiens
gcctgtatttccaacaaact

SEQ ID NO: 457605 - DNA, 20 bp, Homo sapiens
gcctgtccacctgtgctgct

SEQ ID NO: 457606 - DNA, 22 bp, Homo sapiens
gcctgtccacctgtgctgctgc

SEQ ID NO: 457607 - DNA, 17 bp, Homo sapiens
gcctgtgatcgtgtgtt

SEQ ID NO: 457608 - DNA, 18 bp, Homo sapiens
gccttaagaaagctatat

SEQ ID NO: 457609 - DNA, 21 bp, Homo sapiens
gccttcaggttcctcctaggc

SEQ ID NO: 457610 - DNA, 23 bp, Homo sapiens
gccttcgatacaccgggcctgga

SEQ ID NO: 457611 - DNA, 20 bp, Homo sapiens
gccttgagtgacatgcggct

SEQ ID NO: 457612 - DNA, 17 bp, Homo sapiens
gccttggttcctccagc

SEQ ID NO: 457613 - DNA, 18 bp, Homo sapiens
gccttggttcctccagca

SEQ ID NO: 457614 - DNA, 16 bp, Homo sapiens
gccttgttgtattcct

SEQ ID NO: 457615 - DNA, 15 bp, Homo sapiens
gcctttgttgctcag

SEQ ID NO: 457616 - DNA, 14 bp, Homo sapiens
gcgaggcagaatgg

SEQ ID NO: 457617 - DNA, 23 bp, Homo sapiens
gcgcaccgcccaacccccacctc

SEQ ID NO: 457618 - DNA, 16 bp, Homo sapiens
gcgcagccgcgctctg

SEQ ID NO: 457619 - DNA, 21 bp, Homo sapiens
gcgcagccgcgctctgcccct

SEQ ID NO: 457620 - DNA, 12 bp, Homo sapiens
gcgcccacctgc

SEQ ID NO: 457621 - DNA, 12 bp, Homo sapiens
gcgccctccctc

SEQ ID NO: 457622 - DNA, 13 bp, Homo sapiens
gcgccctccctcc

SEQ ID NO: 457623 - DNA, 14 bp, Homo sapiens
gcgccctccctccc

SEQ ID NO: 457624 - DNA, 16 bp, Homo sapiens
gcgccctccctccctc

SEQ ID NO: 457625 - DNA, 20 bp, Homo sapiens
gcgccctccctccctccaca

SEQ ID NO: 457626 - DNA, 11 bp, Homo sapiens
gcgcctgcccg

SEQ ID NO: 457627 - DNA, 15 bp, Homo sapiens
gcgcctgcgctcctc

SEQ ID NO: 457628 - DNA, 23 bp, Homo sapiens
gcgcctgcgctcctctgcagcct

SEQ ID NO: 457629 - DNA, 13 bp, Homo sapiens
gcgcgtgccccca

SEQ ID NO: 457630 - DNA, 13 bp, Homo sapiens
gcgcgtgccttcc

SEQ ID NO: 457631 - DNA, 14 bp, Homo sapiens
gcgcgtgccttccc

SEQ ID NO: 457632 - DNA, 21 bp, Homo sapiens
gcgctcagaggccgctctggg

SEQ ID NO: 457633 - DNA, 22 bp, Homo sapiens
gcgctccggcagaggcagggcc

SEQ ID NO: 457634 - DNA, 23 bp, Homo sapiens
gcgctccggcagaggcagggccc

SEQ ID NO: 457635 - DNA, 15 bp, Homo sapiens
gcgctcctctgcagc

SEQ ID NO: 457636 - DNA, 17 bp, Homo sapiens
gcgctcctctgcagcct

SEQ ID NO: 457637 - DNA, 22 bp, Homo sapiens
gcgctcctctgcagcctgagct

SEQ ID NO: 457638 - DNA, 23 bp, Homo sapiens
gcgctcctctgcagcctgagctc

SEQ ID NO: 457639 - DNA, 14 bp, Homo sapiens
gcgctctgcccctc

SEQ ID NO: 457640 - DNA, 15 bp, Homo sapiens
gcgctctgcccctcc

SEQ ID NO: 457641 - DNA, 14 bp, Homo sapiens
gcgctgagggcagg

SEQ ID NO: 457642 - DNA, 20 bp, Homo sapiens
gcggaggggcttggagcaga

SEQ ID NO: 457643 - DNA, 15 bp, Homo sapiens
gcggcaccgcccacc

SEQ ID NO: 457644 - DNA, 22 bp, Homo sapiens
gcggcccggcccacgcagagcc

SEQ ID NO: 457645 - DNA, 20 bp, Homo sapiens
gcggcctttgttgctcagca

SEQ ID NO: 457646 - DNA, 22 bp, Homo sapiens
gcggcggtggactgcgctggac

SEQ ID NO: 457647 - DNA, 12 bp, Homo sapiens
gcggctgaggac

SEQ ID NO: 457648 - DNA, 14 bp, Homo sapiens
gcggctgaggacgg

SEQ ID NO: 457649 - DNA, 20 bp, Homo sapiens
gcggctgaggacggggcaga

SEQ ID NO: 457650 - DNA, 23 bp, Homo sapiens
gcggctgaggacggggcagagct

SEQ ID NO: 457651 - DNA, 14 bp, Homo sapiens
gcgggcagcccctg

SEQ ID NO: 457652 - DNA, 20 bp, Homo sapiens
gcgggggctaactggcccca

SEQ ID NO: 457653 - DNA, 20 bp, Homo sapiens
gcgtgaccggcccgccacct

SEQ ID NO: 457654 - DNA, 21 bp, Homo sapiens
gcgtgacttcagactctctcc

SEQ ID NO: 457655 - DNA, 14 bp, Homo sapiens
gcgtgcccccagcg

SEQ ID NO: 457656 - DNA, 22 bp, Homo sapiens
gcgtgggatccagagagaagca

SEQ ID NO: 457657 - DNA, 15 bp, Homo sapiens
gcgtgtggccctgtg

SEQ ID NO: 457658 - DNA, 20 bp, Homo sapiens
gcgtttttttacaacattca

SEQ ID NO: 457659 - DNA, 16 bp, Homo sapiens
gctaactggccccagg

SEQ ID NO: 457660 - DNA, 16 bp, Homo sapiens
gctaatcagcattctc

SEQ ID NO: 457661 - DNA, 19 bp, Homo sapiens
gctacatgaagttgtaaga

SEQ ID NO: 457662 - DNA, 22 bp, Homo sapiens
gctacatgaagttgtaagaaaa

SEQ ID NO: 457663 - DNA, 18 bp, Homo sapiens
gctaccaattgtttcttg

SEQ ID NO: 457664 - DNA, 20 bp, Homo sapiens
gctagaatatcctatactgg

SEQ ID NO: 457665 - DNA, 17 bp, Homo sapiens
gctagagcattctgggg

SEQ ID NO: 457666 - DNA, 22 bp, Homo sapiens
gctaggttaataggaggacaga

SEQ ID NO: 457667 - DNA, 18 bp, Homo sapiens
gctataacaactctattt

SEQ ID NO: 457668 - DNA, 12 bp, Homo sapiens
gctatatatgaa

SEQ ID NO: 457669 - DNA, 22 bp, Homo sapiens
gctatccacagaacctttgtca

SEQ ID NO: 457670 - DNA, 18 bp, Homo sapiens
gctatgcgcaatgtggca

SEQ ID NO: 457671 - DNA, 18 bp, Homo sapiens
gctattaaaagaatccaa

SEQ ID NO: 457672 - DNA, 21 bp, Homo sapiens
gctattgtttataggaaataa

SEQ ID NO: 457673 - DNA, 13 bp, Homo sapiens
gctcaacctctca

SEQ ID NO: 457674 - DNA, 22 bp, Homo sapiens
gctcacagaacccttggagcca

SEQ ID NO: 457675 - DNA, 23 bp, Homo sapiens
gctcacgctgacagcctcctagg

SEQ ID NO: 457676 - DNA, 19 bp, Homo sapiens
gctcagcaaggggctctgc

SEQ ID NO: 457677 - DNA, 17 bp, Homo sapiens
gctcaggagaaggcctg

SEQ ID NO: 457678 - DNA, 15 bp, Homo sapiens
gctccaacagacacc

SEQ ID NO: 457679 - DNA, 20 bp, Homo sapiens
gctccaacagacaccctcca

SEQ ID NO: 457680 - DNA, 15 bp, Homo sapiens
gctccaccctcccct

SEQ ID NO: 457681 - DNA, 19 bp, Homo sapiens
gctccaccctcccctcttc

SEQ ID NO: 457682 - DNA, 23 bp, Homo sapiens
gctccagcagtgctgggcccagc

SEQ ID NO: 457683 - DNA, 14 bp, Homo sapiens
gctcctctgcagcc

SEQ ID NO: 457684 - DNA, 14 bp, Homo sapiens
gctcctctgccttg

SEQ ID NO: 457685 - DNA, 16 bp, Homo sapiens
gctcctttcccacagt

SEQ ID NO: 457686 - DNA, 12 bp, Homo sapiens
gctcggacacag

SEQ ID NO: 457687 - DNA, 14 bp, Homo sapiens
gctcggacacagtt

SEQ ID NO: 457688 - DNA, 13 bp, Homo sapiens
gctcgggaaggcc

SEQ ID NO: 457689 - DNA, 19 bp, Homo sapiens
gctcgggaaggcctgaggg

SEQ ID NO: 457690 - DNA, 23 bp, Homo sapiens
gctcgggaaggcctgagggaagc

SEQ ID NO: 457691 - DNA, 14 bp, Homo sapiens
gctctaaagcagag

SEQ ID NO: 457692 - DNA, 22 bp, Homo sapiens
gctctacagctaatcagcattc

SEQ ID NO: 457693 - DNA, 17 bp, Homo sapiens
gctctattgtagcattt

SEQ ID NO: 457694 - DNA, 13 bp, Homo sapiens
ggccctgccctcc

SEQ ID NO: 457695 - DNA, 14 bp, Homo sapiens
ggccctgccctccc

SEQ ID NO: 457696 - DNA, 23 bp, Homo sapiens
ggccctgccctcccccacggccg

SEQ ID NO: 457697 - DNA, 16 bp, Homo sapiens
ggccctgggcctcagt

SEQ ID NO: 457698 - DNA, 16 bp, Homo sapiens
ggccctggggtctctg

SEQ ID NO: 457699 - DNA, 21 bp, Homo sapiens
ggccctggggtctctgagcag

SEQ ID NO: 457700 - DNA, 19 bp, Homo sapiens
ggccgcagggcgctccggc

SEQ ID NO: 457701 - DNA, 20 bp, Homo sapiens
ggccgcagggcgctccggca

SEQ ID NO: 457702 - DNA, 22 bp, Homo sapiens
ggccgcagggcgctccggcaga

SEQ ID NO: 457703 - DNA, 19 bp, Homo sapiens
ggccgcctcctccagactc

SEQ ID NO: 457704 - DNA, 22 bp, Homo sapiens
ggccggctggccggtccacccc

SEQ ID NO: 457705 - DNA, 12 bp, Homo sapiens
ggccgtccctga

SEQ ID NO: 457706 - DNA, 15 bp, Homo sapiens
ggcctcagccctcag

SEQ ID NO: 457707 - DNA, 10 bp, Homo sapiens
ggcctccccg

SEQ ID NO: 457708 - DNA, 22 bp, Homo sapiens
ggcctccccgggggtccccgga

SEQ ID NO: 457709 - DNA, 23 bp, Homo sapiens
ggcctccccgggggtccccggac

SEQ ID NO: 457710 - DNA, 12 bp, Homo sapiens
ggcctctgtgcc

SEQ ID NO: 457711 - DNA, 15 bp, Homo sapiens
ggcctgagggaagcc

SEQ ID NO: 457712 - DNA, 21 bp, Homo sapiens
ggcctgagggaagcccacccg

SEQ ID NO: 457713 - DNA, 13 bp, Homo sapiens
ggcctgcagccca

SEQ ID NO: 457714 - DNA, 15 bp, Homo sapiens
ggcctgcagcccaga

SEQ ID NO: 457715 - DNA, 13 bp, Homo sapiens
ggcctgcccccct

SEQ ID NO: 457716 - DNA, 17 bp, Homo sapiens
ggcctgccccccttccc

SEQ ID NO: 457717 - DNA, 17 bp, Homo sapiens
ggcctggcctatttaag

SEQ ID NO: 457718 - DNA, 18 bp, Homo sapiens
ggcctggcctatttaagc

SEQ ID NO: 457719 - DNA, 22 bp, Homo sapiens
ggcctggcctatttaagccccc

SEQ ID NO: 457720 - DNA, 14 bp, Homo sapiens
ggcctggtctggag

SEQ ID NO: 457721 - DNA, 18 bp, Homo sapiens
ggccttggttcctccagc

SEQ ID NO: 457722 - DNA, 18 bp, Homo sapiens
ggcgcctgcgctcctctg

SEQ ID NO: 457723 - DNA, 14 bp, Homo sapiens
ggcgctcagaggcc

SEQ ID NO: 457724 - DNA, 16 bp, Homo sapiens
ggcgctccggcagagg

SEQ ID NO: 457725 - DNA, 12 bp, Homo sapiens
ggcgggcagccc

SEQ ID NO: 457726 - DNA, 16 bp, Homo sapiens
ggcgggcagcccctgc

SEQ ID NO: 457727 - DNA, 16 bp, Homo sapiens
ggcgtgggatccagag

SEQ ID NO: 457728 - DNA, 16 bp, Homo sapiens
ggctaactggccccag

SEQ ID NO: 457729 - DNA, 14 bp, Homo sapiens
ggctcattcttttc

SEQ ID NO: 457730 - DNA, 18 bp, Homo sapiens
ggctccagagtaggtggg

SEQ ID NO: 457731 - DNA, 17 bp, Homo sapiens
ggctcccacaggccctt

SEQ ID NO: 457732 - DNA, 21 bp, Homo sapiens
ggctcccacaggcccttcctc

SEQ ID NO: 457733 - DNA, 16 bp, Homo sapiens
ggctccccctgccagc

SEQ ID NO: 457734 - DNA, 12 bp, Homo sapiens
ggctccctgagg

SEQ ID NO: 457735 - DNA, 17 bp, Homo sapiens
ggctccctgaggtacct

SEQ ID NO: 457736 - DNA, 18 bp, Homo sapiens
ggctcctttcccacagtc

SEQ ID NO: 457737 - DNA, 10 bp, Homo sapiens
ggctctggct

SEQ ID NO: 457738 - DNA, 12 bp, Homo sapiens
ggctgccctggt

SEQ ID NO: 457739 - DNA, 15 bp, Homo sapiens
ggctgccctggtgct

SEQ ID NO: 457740 - DNA, 16 bp, Homo sapiens
ggctgccttagaacct

SEQ ID NO: 457741 - DNA, 15 bp, Homo sapiens
ggctgcgcctgcccg

SEQ ID NO: 457742 - DNA, 17 bp, Homo sapiens
ggctgcgcctgcccgcc

SEQ ID NO: 457743 - DNA, 11 bp, Homo sapiens
ggctggccctg

SEQ ID NO: 457744 - DNA, 17 bp, Homo sapiens
ggctgggcccctgggat

SEQ ID NO: 457745 - DNA, 19 bp, Homo sapiens
ggctgggtcgcccctcctc

SEQ ID NO: 457746 - DNA, 21 bp, Homo sapiens
ggctgggtcgcccctcctcgg

SEQ ID NO: 457747 - DNA, 22 bp, Homo sapiens
ggctgggtttgggcagtggaga

SEQ ID NO: 457748 - DNA, 13 bp, Homo sapiens
ggcttaaacattt

SEQ ID NO: 457749 - DNA, 22 bp, Homo sapiens
ggcttccatggtggtttcagaa

SEQ ID NO: 457750 - DNA, 17 bp, Homo sapiens
ggcttcccgctcagccc

SEQ ID NO: 457751 - DNA, 17 bp, Homo sapiens
ggcttggagcagagacg

SEQ ID NO: 457752 - DNA, 23 bp, Homo sapiens
ggcttggagcagagacggcagcc

SEQ ID NO: 457753 - DNA, 17 bp, Homo sapiens
ggcttggggtagagagg

SEQ ID NO: 457754 - DNA, 19 bp, Homo sapiens
ggcttggggtagagaggac

SEQ ID NO: 457755 - DNA, 22 bp, Homo sapiens
ggctttatgcaggattctcttt

SEQ ID NO: 457756 - DNA, 14 bp, Homo sapiens
ggcttttcactgct

SEQ ID NO: 457757 - DNA, 19 bp, Homo sapiens
ggcttttcactgctggctg

SEQ ID NO: 457758 - DNA, 18 bp, Homo sapiens
gggaaatccaactccagg

SEQ ID NO: 457759 - DNA, 13 bp, Homo sapiens
gggaactcatcaa

SEQ ID NO: 457760 - DNA, 16 bp, Homo sapiens
gggaagcccacccgcc

SEQ ID NO: 457761 - DNA, 22 bp, Homo sapiens
gggaaggcctgagggaagccca

SEQ ID NO: 457762 - DNA, 20 bp, Homo sapiens
gggacagatcttgagcaagg

SEQ ID NO: 457763 - DNA, 16 bp, Homo sapiens
gggacagcggcccggc

SEQ ID NO: 457764 - DNA, 21 bp, Homo sapiens
gggacccccgaggcccccctc

SEQ ID NO: 457765 - DNA, 22 bp, Homo sapiens
gggacccccggcctccaggctg

SEQ ID NO: 457766 - DNA, 16 bp, Homo sapiens
gggactggcccacccc

SEQ ID NO: 457767 - DNA, 23 bp, Homo sapiens
gggactggcccacccctcttccc

SEQ ID NO: 457768 - DNA, 15 bp, Homo sapiens
gggagaatggctctg

SEQ ID NO: 457769 - DNA, 13 bp, Homo sapiens
gggagagcgccac

SEQ ID NO: 457770 - DNA, 22 bp, Homo sapiens
gggagagcgccacccgcccgcc

SEQ ID NO: 457771 - DNA, 17 bp, Homo sapiens
gggagattaaaaccaga

SEQ ID NO: 457772 - DNA, 16 bp, Homo sapiens
gggaggggagaaagga

SEQ ID NO: 457773 - DNA, 19 bp, Homo sapiens
gggatggagaggcggcctc

SEQ ID NO: 457774 - DNA, 14 bp, Homo sapiens
gggatgggccaggg

SEQ ID NO: 457775 - DNA, 20 bp, Homo sapiens
gggatgggggatgggccagg

SEQ ID NO: 457776 - DNA, 15 bp, Homo sapiens
gggatgtcttgagat

SEQ ID NO: 457777 - DNA, 15 bp, Homo sapiens
gggattcaaatgcat

SEQ ID NO: 457778 - DNA, 16 bp, Homo sapiens
gggattcaaatgcatg

SEQ ID NO: 457779 - DNA, 19 bp, Homo sapiens
gggcaagagctcaggagaa

SEQ ID NO: 457780 - DNA, 16 bp, Homo sapiens
gggcacgggagagcgc

SEQ ID NO: 457781 - DNA, 21 bp, Homo sapiens
gggcagagctgagtcggctgg

SEQ ID NO: 457782 - DNA, 12 bp, Homo sapiens
gggcagcaccct

SEQ ID NO: 457783 - DNA, 14 bp, Homo sapiens
gggcagcaccctcc

SEQ ID NO: 457784 - DNA, 18 bp, Homo sapiens
gggcagcaccctcccccg

SEQ ID NO: 457785 - DNA, 13 bp, Homo sapiens
gggcagcccctgc

SEQ ID NO: 457786 - DNA, 14 bp, Homo sapiens
gggcaggagctgct

SEQ ID NO: 457787 - DNA, 15 bp, Homo sapiens
gggcagggccgcagg

SEQ ID NO: 457788 - DNA, 16 bp, Homo sapiens
gggcaggtcctgccca

SEQ ID NO: 457789 - DNA, 17 bp, Homo sapiens
gggcagtggagagggga

SEQ ID NO: 457790 - DNA, 22 bp, Homo sapiens
gggcatctgagtccagctcccc

SEQ ID NO: 457791 - DNA, 17 bp, Homo sapiens
gggcatggccaggtggc

SEQ ID NO: 457792 - DNA, 14 bp, Homo sapiens
gctgtgggcagcac

SEQ ID NO: 457793 - DNA, 18 bp, Homo sapiens
gctgtttcttgatgggag

SEQ ID NO: 457794 - DNA, 19 bp, Homo sapiens
gctgttttatgtcatactc

SEQ ID NO: 457795 - DNA, 22 bp, Homo sapiens
gcttaacctttccgctgtcgcc

SEQ ID NO: 457796 - DNA, 16 bp, Homo sapiens
gcttaggccagtcagt

SEQ ID NO: 457797 - DNA, 16 bp, Homo sapiens
gcttatcagaactcct

SEQ ID NO: 457798 - DNA, 22 bp, Homo sapiens
gcttatcagaactcctttctaa

SEQ ID NO: 457799 - DNA, 12 bp, Homo sapiens
gcttatttctaa

SEQ ID NO: 457800 - DNA, 23 bp, Homo sapiens
gcttccatggtggtttcagaaag

SEQ ID NO: 457801 - DNA, 19 bp, Homo sapiens
gcttgattctaaaggggac

SEQ ID NO: 457802 - DNA, 16 bp, Homo sapiens
gcttggagcagagacg

SEQ ID NO: 457803 - DNA, 23 bp, Homo sapiens
gcttggagcagagacggcagccc

SEQ ID NO: 457804 - DNA, 16 bp, Homo sapiens
gcttggagggatggag

SEQ ID NO: 457805 - DNA, 18 bp, Homo sapiens
gcttggatccatacaaaa

SEQ ID NO: 457806 - DNA, 18 bp, Homo sapiens
gcttggggtagagaggac

SEQ ID NO: 457807 - DNA, 20 bp, Homo sapiens
gcttggggtagagaggacag

SEQ ID NO: 457808 - DNA, 14 bp, Homo sapiens
gcttgtagggtgag

SEQ ID NO: 457809 - DNA, 15 bp, Homo sapiens
gcttgtagggtgagg

SEQ ID NO: 457810 - DNA, 22 bp, Homo sapiens
gcttgttcttcctcttacctgt

SEQ ID NO: 457811 - DNA, 18 bp, Homo sapiens
gcttgtttctatactgtt

SEQ ID NO: 457812 - DNA, 17 bp, Homo sapiens
gctttatgaagttaaca

SEQ ID NO: 457813 - DNA, 21 bp, Homo sapiens
gctttcatgtttaagaaatga

SEQ ID NO: 457814 - DNA, 11 bp, Homo sapiens
gctttctcatg

SEQ ID NO: 457815 - DNA, 16 bp, Homo sapiens
gctttgggctgccctg

SEQ ID NO: 457816 - DNA, 18 bp, Homo sapiens
gctttgggctgccctggt

SEQ ID NO: 457817 - DNA, 22 bp, Homo sapiens
gcttttcactgctggctgcctt

SEQ ID NO: 457818 - DNA, 17 bp, Homo sapiens
gcttttcccacctcttt

SEQ ID NO: 457819 - DNA, 15 bp, Homo sapiens
ggaaaaaatatttta

SEQ ID NO: 457820 - DNA, 16 bp, Homo sapiens
ggaaagacgtttttgt

SEQ ID NO: 457821 - DNA, 20 bp, Homo sapiens
ggaaataagcaaaaaactgc

SEQ ID NO: 457822 - DNA, 18 bp, Homo sapiens
ggaaatagttccattcta

SEQ ID NO: 457823 - DNA, 16 bp, Homo sapiens
ggaacagacctcggct

SEQ ID NO: 457824 - DNA, 16 bp, Homo sapiens
ggaacagccaaagaaa

SEQ ID NO: 457825 - DNA, 15 bp, Homo sapiens
ggaaccttccctcca

SEQ ID NO: 457826 - DNA, 23 bp, Homo sapiens
ggaagcactgccattagactgaa

SEQ ID NO: 457827 - DNA, 13 bp, Homo sapiens
ggaagcccacccg

SEQ ID NO: 457828 - DNA, 16 bp, Homo sapiens
ggaagcccacccgccc

SEQ ID NO: 457829 - DNA, 13 bp, Homo sapiens
ggaaggcctgagg

SEQ ID NO: 457830 - DNA, 15 bp, Homo sapiens
ggaaggcctgaggga

SEQ ID NO: 457831 - DNA, 17 bp, Homo sapiens
ggaagtacataaagtaa

SEQ ID NO: 457832 - DNA, 19 bp, Homo sapiens
ggaatccatatcagctctg

SEQ ID NO: 457833 - DNA, 19 bp, Homo sapiens
ggacacgaaggctgcccct

SEQ ID NO: 457834 - DNA, 18 bp, Homo sapiens
ggacccccggcctccagg

SEQ ID NO: 457835 - DNA, 19 bp, Homo sapiens
ggacccccggcctccaggc

SEQ ID NO: 457836 - DNA, 20 bp, Homo sapiens
gcccctccttctcccctcca

SEQ ID NO: 457837 - DNA, 22 bp, Homo sapiens
gcccctccttctcccctccaga

SEQ ID NO: 457838 - DNA, 14 bp, Homo sapiens
gcccctgctggacc

SEQ ID NO: 457839 - DNA, 15 bp, Homo sapiens
gcccctgggatggga

SEQ ID NO: 457840 - DNA, 20 bp, Homo sapiens
gcccctgggatgggaccagg

SEQ ID NO: 457841 - DNA, 12 bp, Homo sapiens
gccccttccccc

SEQ ID NO: 457842 - DNA, 19 bp, Homo sapiens
gccccttgaccccacacgc

SEQ ID NO: 457843 - DNA, 19 bp, Homo sapiens
gcccgacagcctggcacag

SEQ ID NO: 457844 - DNA, 12 bp, Homo sapiens
gcccgccacctt

SEQ ID NO: 457845 - DNA, 22 bp, Homo sapiens
gcccgcccaccccgctgcctgg

SEQ ID NO: 457846 - DNA, 23 bp, Homo sapiens
gcccgcccaccccgctgcctggc

SEQ ID NO: 457847 - DNA, 14 bp, Homo sapiens
gcccgcccgccggt

SEQ ID NO: 457848 - DNA, 17 bp, Homo sapiens
gcccgccctcctctgcc

SEQ ID NO: 457849 - DNA, 20 bp, Homo sapiens
gcccgccggttggccggctg

SEQ ID NO: 457850 - DNA, 17 bp, Homo sapiens
gcccggccaaggacact

SEQ ID NO: 457851 - DNA, 20 bp, Homo sapiens
gcccggcccacgcagagccc

SEQ ID NO: 457852 - DNA, 16 bp, Homo sapiens
gcccgtgcgcagccgc

SEQ ID NO: 457853 - DNA, 23 bp, Homo sapiens
gcccgtgcgcagccgcgctctgc

SEQ ID NO: 457854 - DNA, 14 bp, Homo sapiens
gccctcactccact

SEQ ID NO: 457855 - DNA, 20 bp, Homo sapiens
gccctcactccactcccctc

SEQ ID NO: 457856 - DNA, 12 bp, Homo sapiens
gccctcagaaca

SEQ ID NO: 457857 - DNA, 10 bp, Homo sapiens
gccctccccc

SEQ ID NO: 457858 - DNA, 13 bp, Homo sapiens
gccctcccccacg

SEQ ID NO: 457859 - DNA, 14 bp, Homo sapiens
gccctcccccacgg

SEQ ID NO: 457860 - DNA, 13 bp, Homo sapiens
gccaacttaaacc

SEQ ID NO: 457861 - DNA, 22 bp, Homo sapiens
gccaacttaaacctgtgctttc

SEQ ID NO: 457862 - DNA, 12 bp, Homo sapiens
gccaagccaggg

SEQ ID NO: 457863 - DNA, 21 bp, Homo sapiens
gccaagccagggttccagaca

SEQ ID NO: 457864 - DNA, 14 bp, Homo sapiens
gccaaggacactga

SEQ ID NO: 457865 - DNA, 16 bp, Homo sapiens
gccaaggacactgatg

SEQ ID NO: 457866 - DNA, 20 bp, Homo sapiens
gccaaggacactgatgggtc

SEQ ID NO: 457867 - DNA, 16 bp, Homo sapiens
gccaatggagactgtc

SEQ ID NO: 457868 - DNA, 21 bp, Homo sapiens
gccaatggagactgtctcaag

SEQ ID NO: 457869 - DNA, 20 bp, Homo sapiens
gccacacttcaggctcttct

SEQ ID NO: 457870 - DNA, 22 bp, Homo sapiens
gccacacttcaggctcttctcc

SEQ ID NO: 457871 - DNA, 21 bp, Homo sapiens
gccacagtggggcccatggcc

SEQ ID NO: 457872 - DNA, 13 bp, Homo sapiens
gccaccccactga

SEQ ID NO: 457873 - DNA, 15 bp, Homo sapiens
gccacccgcccgccc

SEQ ID NO: 457874 - DNA, 18 bp, Homo sapiens
gataaacattaaacactg

SEQ ID NO: 457875 - DNA, 19 bp, Homo sapiens
gataaacattaaacactgt

SEQ ID NO: 457876 - DNA, 18 bp, Homo sapiens
gataaatccaactctgac

SEQ ID NO: 457877 - DNA, 17 bp, Homo sapiens
gatatacagacctccag

SEQ ID NO: 457878 - DNA, 18 bp, Homo sapiens
gatatgcatgtagcatat

SEQ ID NO: 457879 - DNA, 21 bp, Homo sapiens
gatattttcaacgcagccctg

SEQ ID NO: 457880 - DNA, 23 bp, Homo sapiens
gatattttcaacgcagccctgct

SEQ ID NO: 457881 - DNA, 21 bp, Homo sapiens
gatcagacagatctggaatgt

SEQ ID NO: 457882 - DNA, 18 bp, Homo sapiens
gatcatggtttttgctct

SEQ ID NO: 457883 - DNA, 12 bp, Homo sapiens
gatccagagaga

SEQ ID NO: 457884 - DNA, 18 bp, Homo sapiens
gatccctcggtcagcacc

SEQ ID NO: 457885 - DNA, 14 bp, Homo sapiens
gatcgtacttgaaa

SEQ ID NO: 457886 - DNA, 13 bp, Homo sapiens
gatctggagtctg

SEQ ID NO: 457887 - DNA, 19 bp, Homo sapiens
gatctggagtctgaaggag

SEQ ID NO: 457888 - DNA, 18 bp, Homo sapiens
gatctggtgcgtgtggcc

SEQ ID NO: 457889 - DNA, 21 bp, Homo sapiens
gatctggtgcgtgtggccctg

SEQ ID NO: 457890 - DNA, 20 bp, Homo sapiens
gatctgtatttaatggtttt

SEQ ID NO: 457891 - DNA, 12 bp, Homo sapiens
gatcttccccct

SEQ ID NO: 457892 - DNA, 13 bp, Homo sapiens
gatgactggaaac

SEQ ID NO: 457893 - DNA, 22 bp, Homo sapiens
gatgattcaatcattttgggaa

SEQ ID NO: 457894 - DNA, 18 bp, Homo sapiens
gatgggaagaaaaaggaa

SEQ ID NO: 457895 - DNA, 17 bp, Homo sapiens
gatgggggatgggccag

SEQ ID NO: 457896 - DNA, 15 bp, Homo sapiens
gatgggtcctgctgc

SEQ ID NO: 457897 - DNA, 22 bp, Homo sapiens
gatgggttttgttaggggtggg

SEQ ID NO: 457898 - DNA, 18 bp, Homo sapiens
gatggttcccctgttcac

SEQ ID NO: 457899 - DNA, 13 bp, Homo sapiens
gatgtggatgaaa

SEQ ID NO: 457900 - DNA, 20 bp, Homo sapiens
gatgttaaacgtcacagcag

SEQ ID NO: 457901 - DNA, 22 bp, Homo sapiens
gatgtttgttttcaaaatactt

SEQ ID NO: 457902 - DNA, 22 bp, Homo sapiens
gattaatctctaaaattctagt

SEQ ID NO: 457903 - DNA, 14 bp, Homo sapiens
gattattttctata

SEQ ID NO: 457904 - DNA, 13 bp, Homo sapiens
gattcaaatgcat

SEQ ID NO: 457905 - DNA, 15 bp, Homo sapiens
gattcaaatgcatga

SEQ ID NO: 457906 - DNA, 20 bp, Homo sapiens
gattcaatcattttgggaaa

SEQ ID NO: 457907 - DNA, 11 bp, Homo sapiens
gattcaatgtg

SEQ ID NO: 457908 - DNA, 13 bp, Homo sapiens
gattcaatgtgaa

SEQ ID NO: 457909 - DNA, 10 bp, Homo sapiens
gattccaaat

SEQ ID NO: 457910 - DNA, 12 bp, Homo sapiens
gattccaaataa

SEQ ID NO: 457911 - DNA, 13 bp, Homo sapiens
gattccaaataaa

SEQ ID NO: 457912 - DNA, 23 bp, Homo sapiens
gattccaaataaaacttgagccc

SEQ ID NO: 457913 - DNA, 21 bp, Homo sapiens
gattccaacccaggtctgctt

SEQ ID NO: 457914 - DNA, 16 bp, Homo sapiens
gattctaaaacattct

SEQ ID NO: 457915 - DNA, 17 bp, Homo sapiens
gattctaaaggggacag

SEQ ID NO: 457916 - DNA, 18 bp, Homo sapiens
gattctaaaggggacaga

SEQ ID NO: 457917 - DNA, 24 bp, Homo sapiens
gattctaaaggggacagatcttga

SEQ ID NO: 457918 - DNA, 15 bp, Homo sapiens
gattctcctctccca

SEQ ID NO: 457919 - DNA, 22 bp, Homo sapiens
gattcttttttcaatgtactgt

SEQ ID NO: 457920 - DNA, 14 bp, Homo sapiens
gattggacattttc

SEQ ID NO: 457921 - DNA, 22 bp, Homo sapiens
gattgggggggcttggggtaga

SEQ ID NO: 457922 - DNA, 15 bp, Homo sapiens
gatttcctaagctgt

SEQ ID NO: 457923 - DNA, 18 bp, Homo sapiens
gatttcctttgacctctc

SEQ ID NO: 457924 - DNA, 23 bp, Homo sapiens
gatttgagtccattgcaaaaggt

SEQ ID NO: 457925 - DNA, 22 bp, Homo sapiens
gatttgatatacagacctccag

SEQ ID NO: 457926 - DNA, 17 bp, Homo sapiens
gatttgcaaatgcacat

SEQ ID NO: 457927 - DNA, 15 bp, Homo sapiens
gatttgccaaaaact

SEQ ID NO: 457928 - DNA, 23 bp, Homo sapiens
gatttgccaaaaactaaaattca

SEQ ID NO: 457929 - DNA, 13 bp, Homo sapiens
gattttctttcta

SEQ ID NO: 457930 - DNA, 15 bp, Homo sapiens
gattttctttctatg

SEQ ID NO: 457931 - DNA, 13 bp, Homo sapiens
gcaaaaaagaaca

SEQ ID NO: 457932 - DNA, 10 bp, Homo sapiens
gcaaacattt

SEQ ID NO: 457933 - DNA, 20 bp, Homo sapiens
gcaaagtaccaactgagcca

SEQ ID NO: 457934 - DNA, 15 bp, Homo sapiens
gcaaatagtttcaaa

SEQ ID NO: 457935 - DNA, 18 bp, Homo sapiens
gcaaatgcacatttgtca

SEQ ID NO: 457936 - DNA, 15 bp, Homo sapiens
gcaaattattctagt

SEQ ID NO: 457937 - DNA, 16 bp, Homo sapiens
gcaaattattctagtc

SEQ ID NO: 457938 - DNA, 17 bp, Homo sapiens
gcaaattcttgaataaa

SEQ ID NO: 457939 - DNA, 13 bp, Homo sapiens
gcaacctttgtgt

SEQ ID NO: 457940 - DNA, 16 bp, Homo sapiens
gcaagaagattctaaa

SEQ ID NO: 457941 - DNA, 17 bp, Homo sapiens
gcaagaagattctaaaa

SEQ ID NO: 457942 - DNA, 13 bp, Homo sapiens
gcaagaagtggga

SEQ ID NO: 457943 - DNA, 17 bp, Homo sapiens
gcaagagctcaggagaa

SEQ ID NO: 457944 - DNA, 17 bp, Homo sapiens
gcaagctcagggtgctc

SEQ ID NO: 457945 - DNA, 14 bp, Homo sapiens
gcaagtatatttat

SEQ ID NO: 457946 - DNA, 16 bp, Homo sapiens
gcaagtttttggtaat

SEQ ID NO: 457947 - DNA, 13 bp, Homo sapiens
gcaataacagttt

SEQ ID NO: 457948 - DNA, 14 bp, Homo sapiens
gcaataacagtttt

SEQ ID NO: 457949 - DNA, 22 bp, Homo sapiens
gcaatgttccgttcatctgagg

SEQ ID NO: 457950 - DNA, 22 bp, Homo sapiens
gcacaaggagtgcccgccttga

SEQ ID NO: 457951 - DNA, 19 bp, Homo sapiens
gcacacagcagccccccag

SEQ ID NO: 457952 - DNA, 21 bp, Homo sapiens
gcacacagcagccccccagca

SEQ ID NO: 457953 - DNA, 17 bp, Homo sapiens
gcacactgagtttgaac

SEQ ID NO: 457954 - DNA, 21 bp, Homo sapiens
gcacagtgcatctcagcccac

SEQ ID NO: 457955 - DNA, 17 bp, Homo sapiens
gcaccagatgcaacctc

SEQ ID NO: 457956 - DNA, 14 bp, Homo sapiens
gcaccagcctgagc

SEQ ID NO: 457957 - DNA, 18 bp, Homo sapiens
gcaccagcctgagccaca

SEQ ID NO: 457958 - DNA, 16 bp, Homo sapiens
gcaccccaccacacac

SEQ ID NO: 457959 - DNA, 13 bp, Homo sapiens
gcacccccagcct

SEQ ID NO: 457960 - DNA, 14 bp, Homo sapiens
gcacccccagcctc

SEQ ID NO: 457961 - DNA, 17 bp, Homo sapiens
gcacccccagcctcccc

SEQ ID NO: 457962 - DNA, 21 bp, Homo sapiens
gcacccccagcctcccccagg

SEQ ID NO: 457963 - DNA, 22 bp, Homo sapiens
gcacccccagcctcccccaggc

SEQ ID NO: 457964 - DNA, 17 bp, Homo sapiens
gcaccctctcctggggg

SEQ ID NO: 457965 - DNA, 23 bp, Homo sapiens
gcaccctctgctatgtctgtgat

SEQ ID NO: 457966 - DNA, 21 bp, Homo sapiens
gcaccgcccaacccccacctc

SEQ ID NO: 457967 - DNA, 21 bp, Homo sapiens
gcaccttgggcacgggagagc

SEQ ID NO: 457968 - DNA, 23 bp, Homo sapiens
gcaccttgggcacgggagagcgc

SEQ ID NO: 457969 - DNA, 20 bp, Homo sapiens
gcacgggagagcgccacccg

SEQ ID NO: 457970 - DNA, 18 bp, Homo sapiens
gcacggtggtgaggcagt

SEQ ID NO: 457971 - DNA, 20 bp, Homo sapiens
gcactagaatgagaaatcat

SEQ ID NO: 457972 - DNA, 14 bp, Homo sapiens
gagagggctgagcc

SEQ ID NO: 457973 - DNA, 19 bp, Homo sapiens
gagagggctgagcccctcc

SEQ ID NO: 457974 - DNA, 15 bp, Homo sapiens
gagaggggacttgga

SEQ ID NO: 457975 - DNA, 16 bp, Homo sapiens
gagagtggctcctccc

SEQ ID NO: 457976 - DNA, 22 bp, Homo sapiens
gagagtttctatggattcactt

SEQ ID NO: 457977 - DNA, 18 bp, Homo sapiens
gacagaaccaacgggtct

SEQ ID NO: 457978 - DNA, 14 bp, Homo sapiens
gacagacagacaga

SEQ ID NO: 457979 - DNA, 18 bp, Homo sapiens
gacagacggacgggacag

SEQ ID NO: 457980 - DNA, 12 bp, Homo sapiens
gacagagtggat

SEQ ID NO: 457981 - DNA, 17 bp, Homo sapiens
gacagagtggatctgga

SEQ ID NO: 457982 - DNA, 15 bp, Homo sapiens
gacagatcttgagca

SEQ ID NO: 457983 - DNA, 14 bp, Homo sapiens
gacagcctcctagg

SEQ ID NO: 457984 - DNA, 15 bp, Homo sapiens
gacagcctcctaggc

SEQ ID NO: 457985 - DNA, 20 bp, Homo sapiens
ctgtgggggtggccatccct

SEQ ID NO: 457986 - DNA, 14 bp, Homo sapiens
ctgtgtcccagcac

SEQ ID NO: 457987 - DNA, 21 bp, Homo sapiens
ctgtgtcccagcacctggcac

SEQ ID NO: 457988 - DNA, 15 bp, Homo sapiens
ctgtgtggcaaacat

SEQ ID NO: 457989 - DNA, 16 bp, Homo sapiens
ctgtgtggcaaacatt

SEQ ID NO: 457990 - DNA, 14 bp, Homo sapiens
ctgttcatttccac

SEQ ID NO: 457991 - DNA, 23 bp, Homo sapiens
ctgttcatttccaccaagggtat

SEQ ID NO: 457992 - DNA, 13 bp, Homo sapiens
ctgttccaagtgt

SEQ ID NO: 457993 - DNA, 15 bp, Homo sapiens
ctgttccaagtgtgt

SEQ ID NO: 457994 - DNA, 19 bp, Homo sapiens
ctgttctaactagtaatct

SEQ ID NO: 457995 - DNA, 16 bp, Homo sapiens
ctgttgctgtcctcca

SEQ ID NO: 457996 - DNA, 22 bp, Homo sapiens
ctgtttaccctccctgtcccct

SEQ ID NO: 457997 - DNA, 15 bp, Homo sapiens
ctgtttatatatata

SEQ ID NO: 457998 - DNA, 16 bp, Homo sapiens
ctgtttcgcatccacc

SEQ ID NO: 457999 - DNA, 13 bp, Homo sapiens
ctgttttatgtca

SEQ ID NO: 458000 - DNA, 21 bp, Homo sapiens
ctgttttatgtcatactctgt

SEQ ID NO: 458001 - DNA, 19 bp, Homo sapiens
ctgttttgaataacatagg

SEQ ID NO: 458002 - DNA, 12 bp, Homo sapiens
ctgttttgtgcg

SEQ ID NO: 458003 - DNA, 19 bp, Homo sapiens
cttaaaagaacataggaat

SEQ ID NO: 458004 - DNA, 11 bp, Homo sapiens
cttaaacattt

SEQ ID NO: 458005 - DNA, 16 bp, Homo sapiens
cttaaacattttttgt

SEQ ID NO: 458006 - DNA, 14 bp, Homo sapiens
cttaaactttgtca

SEQ ID NO: 458007 - DNA, 13 bp, Homo sapiens
cttaaatttctaa

SEQ ID NO: 458008 - DNA, 17 bp, Homo sapiens
cttaacataaacttgta

SEQ ID NO: 458009 - DNA, 18 bp, Homo sapiens
cttaacctttccgctgtc

SEQ ID NO: 458010 - DNA, 17 bp, Homo sapiens
cttaacttaaaagaaca

SEQ ID NO: 458011 - DNA, 15 bp, Homo sapiens
cttaagaaagctata

SEQ ID NO: 458012 - DNA, 13 bp, Homo sapiens
cttaaggaaaaga

SEQ ID NO: 458013 - DNA, 18 bp, Homo sapiens
cttaaggaaaagagaaac

SEQ ID NO: 458014 - DNA, 15 bp, Homo sapiens
cttaagtcttactgt

SEQ ID NO: 458015 - DNA, 22 bp, Homo sapiens
cttaatgttctgaataatttct

SEQ ID NO: 458016 - DNA, 23 bp, Homo sapiens
cttaccccgtccctttccctgca

SEQ ID NO: 458017 - DNA, 16 bp, Homo sapiens
cttactgttttgtgcg

SEQ ID NO: 458018 - DNA, 16 bp, Homo sapiens
cttagaaattgcattt

SEQ ID NO: 458019 - DNA, 13 bp, Homo sapiens
cttagagaataag

SEQ ID NO: 458020 - DNA, 14 bp, Homo sapiens
cttatctccagcca

SEQ ID NO: 458021 - DNA, 20 bp, Homo sapiens
cttatgttgatcgatgttaa

SEQ ID NO: 458022 - DNA, 21 bp, Homo sapiens
cttatgttgatcgatgttaaa

SEQ ID NO: 458023 - DNA, 22 bp, Homo sapiens
cttattgtttttggatggctta

SEQ ID NO: 458024 - DNA, 16 bp, Homo sapiens
cttatttctaactatt

SEQ ID NO: 458025 - DNA, 13 bp, Homo sapiens
cttcaaaacagaa

SEQ ID NO: 458026 - DNA, 19 bp, Homo sapiens
cttcaaacaggaatttctg

SEQ ID NO: 458027 - DNA, 16 bp, Homo sapiens
cttcaaccattcccca

SEQ ID NO: 458028 - DNA, 12 bp, Homo sapiens
cttcaaggccaa

SEQ ID NO: 458029 - DNA, 14 bp, Homo sapiens
cttcacgattctta

SEQ ID NO: 458030 - DNA, 22 bp, Homo sapiens
cttcactctgacagtattaaca

SEQ ID NO: 458031 - DNA, 14 bp, Homo sapiens
cttcagactctctc

SEQ ID NO: 458032 - DNA, 16 bp, Homo sapiens
cttcagactctctcct

SEQ ID NO: 458033 - DNA, 21 bp, Homo sapiens
cttcagactctctcctctctc

SEQ ID NO: 458034 - DNA, 13 bp, Homo sapiens
cttcagcaaccct

SEQ ID NO: 458035 - DNA, 23 bp, Homo sapiens
cttcagcaaccctacagtatata

SEQ ID NO: 458036 - DNA, 16 bp, Homo sapiens
cttcaggctcttctcc

SEQ ID NO: 458037 - DNA, 18 bp, Homo sapiens
cttcaggctcttctcctt

SEQ ID NO: 458038 - DNA, 19 bp, Homo sapiens
cttcaggctcttctccttt

SEQ ID NO: 458039 - DNA, 19 bp, Homo sapiens
cttcagggttctaaccttt

SEQ ID NO: 458040 - DNA, 14 bp, Homo sapiens
cttcaggttcctcc

SEQ ID NO: 458041 - DNA, 19 bp, Homo sapiens
cttcagttctcatcttgta

SEQ ID NO: 458042 - DNA, 12 bp, Homo sapiens
cttccagagggg

SEQ ID NO: 458043 - DNA, 22 bp, Homo sapiens
cttccagagggggccagaggga

SEQ ID NO: 458044 - DNA, 23 bp, Homo sapiens
cttccagagggggccagagggac

SEQ ID NO: 458045 - DNA, 20 bp, Homo sapiens
cttccatcctgaggaccgcc

SEQ ID NO: 458046 - DNA, 21 bp, Homo sapiens
cttccatggtggtttcagaaa

SEQ ID NO: 458047 - DNA, 22 bp, Homo sapiens
cttccatggtggtttcagaaag

SEQ ID NO: 458048 - DNA, 22 bp, Homo sapiens
cttcccaacgtactcctcagac

SEQ ID NO: 458049 - DNA, 12 bp, Homo sapiens
cttcccacccct

SEQ ID NO: 458050 - DNA, 13 bp, Homo sapiens
cttcccaccccta

SEQ ID NO: 458051 - DNA, 22 bp, Homo sapiens
cttcccagctggcagcgcctcc

SEQ ID NO: 458052 - DNA, 13 bp, Homo sapiens
cttccccactccc

SEQ ID NO: 458053 - DNA, 13 bp, Homo sapiens
cttcccccttccc

SEQ ID NO: 458054 - DNA, 15 bp, Homo sapiens
cttcccctgcgccct

SEQ ID NO: 458055 - DNA, 17 bp, Homo sapiens
cttcccctgcgccctcc

SEQ ID NO: 458056 - DNA, 19 bp, Homo sapiens
cttcccctgcgccctccct

SEQ ID NO: 458057 - DNA, 20 bp, Homo sapiens
cttcccctgcgccctccctc

SEQ ID NO: 458058 - DNA, 18 bp, Homo sapiens
cttccccttctgtgtcac

SEQ ID NO: 458059 - DNA, 13 bp, Homo sapiens
cttcccgcagcac

SEQ ID NO: 458060 - DNA, 14 bp, Homo sapiens
cttcccgcagcacc

SEQ ID NO: 458061 - DNA, 15 bp, Homo sapiens
cttcccgcagcacca

SEQ ID NO: 458062 - DNA, 17 bp, Homo sapiens
cttcccgcagcaccagc

SEQ ID NO: 458063 - DNA, 20 bp, Homo sapiens
cttcccgcagcaccagcctg

SEQ ID NO: 458064 - DNA, 22 bp, Homo sapiens
cttcccgcagcaccagcctgag

SEQ ID NO: 458065 - DNA, 22 bp, Homo sapiens
cttcccgccttcaggttcctcc

SEQ ID NO: 458066 - DNA, 15 bp, Homo sapiens
cttcccgctcagccc

SEQ ID NO: 458067 - DNA, 17 bp, Homo sapiens
cttcccgctcagccctc

SEQ ID NO: 458068 - DNA, 11 bp, Homo sapiens
cttccctccaa

SEQ ID NO: 458069 - DNA, 12 bp, Homo sapiens
cttccctgcttc

SEQ ID NO: 458070 - DNA, 21 bp, Homo sapiens
cttcctctccactgccttcga

SEQ ID NO: 458071 - DNA, 13 bp, Homo sapiens
cttcctcttacct

SEQ ID NO: 458072 - DNA, 21 bp, Homo sapiens
cttcctggattttctttctat

SEQ ID NO: 458073 - DNA, 12 bp, Homo sapiens
cttcctgtcctg

SEQ ID NO: 458074 - DNA, 14 bp, Homo sapiens
cttcctgtcctgct

SEQ ID NO: 458075 - DNA, 15 bp, Homo sapiens
cttcctgtcctgctc

SEQ ID NO: 458076 - DNA, 19 bp, Homo sapiens
cttccttttgtatcctcca

SEQ ID NO: 458077 - DNA, 17 bp, Homo sapiens
cttctatattaaggcag

SEQ ID NO: 458078 - DNA, 13 bp, Homo sapiens
cttctcagctcca

SEQ ID NO: 458079 - DNA, 15 bp, Homo sapiens
cttctccactggatg

SEQ ID NO: 458080 - DNA, 15 bp, Homo sapiens
cttctcccctccaga

SEQ ID NO: 458081 - DNA, 16 bp, Homo sapiens
cttctcccctccagac

SEQ ID NO: 458082 - DNA, 22 bp, Homo sapiens
cttctcccctccagacccctac

SEQ ID NO: 458083 - DNA, 22 bp, Homo sapiens
ctggcccacccctcttccccct

SEQ ID NO: 458084 - DNA, 11 bp, Homo sapiens
ctggccccagg

SEQ ID NO: 458085 - DNA, 14 bp, Homo sapiens
ctggccctgccctc

SEQ ID NO: 458086 - DNA, 19 bp, Homo sapiens
ctggccctgccctccccca

SEQ ID NO: 458087 - DNA, 16 bp, Homo sapiens
ctggccggtccacccc

SEQ ID NO: 458088 - DNA, 17 bp, Homo sapiens
ctggccggtccaccccg

SEQ ID NO: 458089 - DNA, 18 bp, Homo sapiens
ctggccggtccaccccgt

SEQ ID NO: 458090 - DNA, 12 bp, Homo sapiens
ctggcctattta

SEQ ID NO: 458091 - DNA, 15 bp, Homo sapiens
ctggcctctgtgcca

SEQ ID NO: 458092 - DNA, 18 bp, Homo sapiens
ctggccttggttcctcca

SEQ ID NO: 458093 - DNA, 22 bp, Homo sapiens
ctggccttggttcctccagcaa

SEQ ID NO: 458094 - DNA, 13 bp, Homo sapiens
ctggcgggcagcc

SEQ ID NO: 458095 - DNA, 22 bp, Homo sapiens
ctggcgggcagcccctgctgga

SEQ ID NO: 458096 - DNA, 19 bp, Homo sapiens
ctggctgccttagaacctt

SEQ ID NO: 458097 - DNA, 18 bp, Homo sapiens
ctggctgtggcccctcct

SEQ ID NO: 458098 - DNA, 17 bp, Homo sapiens
ctggcttttcactgctg

SEQ ID NO: 458099 - DNA, 18 bp, Homo sapiens
ctgggatcagctggtgtc

SEQ ID NO: 458100 - DNA, 15 bp, Homo sapiens
ctgggatgggaccag

SEQ ID NO: 458101 - DNA, 13 bp, Homo sapiens
ctgggcagggccg

SEQ ID NO: 458102 - DNA, 19 bp, Homo sapiens
ctgggcagggccgcagggc

SEQ ID NO: 458103 - DNA, 13 bp, Homo sapiens
ctgggcccagccg

SEQ ID NO: 458104 - DNA, 22 bp, Homo sapiens
ctgggcccctccacgcctcctg

SEQ ID NO: 458105 - DNA, 21 bp, Homo sapiens
ctgggcctcccgtccgtccgc

SEQ ID NO: 458106 - DNA, 17 bp, Homo sapiens
ctggggccctgggcctc

SEQ ID NO: 458107 - DNA, 18 bp, Homo sapiens
ctggggccctgggcctca

SEQ ID NO: 458108 - DNA, 16 bp, Homo sapiens
ctggggcctggcctat

SEQ ID NO: 458109 - DNA, 18 bp, Homo sapiens
ctctttgaaaattcttgt

SEQ ID NO: 458110 - DNA, 22 bp, Homo sapiens
ctgaaaatatttttttctagct

SEQ ID NO: 458111 - DNA, 17 bp, Homo sapiens
ctgaaactatagaataa

SEQ ID NO: 458112 - DNA, 15 bp, Homo sapiens
ctgaactttggaagc

SEQ ID NO: 458113 - DNA, 19 bp, Homo sapiens
ctgaagagcgctcctctgc

SEQ ID NO: 458114 - DNA, 23 bp, Homo sapiens
ctgaaggaattctggagtgagtt

SEQ ID NO: 458115 - DNA, 13 bp, Homo sapiens
ctgaaggagagga

SEQ ID NO: 458116 - DNA, 14 bp, Homo sapiens
ctgaaggagaggag

SEQ ID NO: 458117 - DNA, 13 bp, Homo sapiens
ctgaaggcctcca

SEQ ID NO: 458118 - DNA, 14 bp, Homo sapiens
ctgaaggcctccat

SEQ ID NO: 458119 - DNA, 16 bp, Homo sapiens
ctgaaggcctccattt

SEQ ID NO: 458120 - DNA, 13 bp, Homo sapiens
ctgaagtcactgc

SEQ ID NO: 458121 - DNA, 13 bp, Homo sapiens
ctgaataatttct

SEQ ID NO: 458122 - DNA, 16 bp, Homo sapiens
ctgaataatttcttac

SEQ ID NO: 458123 - DNA, 19 bp, Homo sapiens
ctgaatccacctgcagtta

SEQ ID NO: 458124 - DNA, 14 bp, Homo sapiens
ctgacagaaggact

SEQ ID NO: 458125 - DNA, 20 bp, Homo sapiens
ctgacagatgaccgcaataa

SEQ ID NO: 458126 - DNA, 13 bp, Homo sapiens
ctgacagcctcct

SEQ ID NO: 458127 - DNA, 21 bp, Homo sapiens
ctgacagcctcctaggctccc

SEQ ID NO: 458128 - DNA, 12 bp, Homo sapiens
ctgaccccactt

SEQ ID NO: 458129 - DNA, 15 bp, Homo sapiens
ctgacgatcttcccc

SEQ ID NO: 458130 - DNA, 16 bp, Homo sapiens
ctgacgatcttccccc

SEQ ID NO: 458131 - DNA, 17 bp, Homo sapiens
ctgacgatcttccccct

SEQ ID NO: 458132 - DNA, 18 bp, Homo sapiens
ctgacgatcttccccctt

SEQ ID NO: 458133 - DNA, 22 bp, Homo sapiens
ctgacgatcttcccccttcccg

SEQ ID NO: 458134 - DNA, 23 bp, Homo sapiens
ctgactccctgtgggggtggcca

SEQ ID NO: 458135 - DNA, 12 bp, Homo sapiens
ctgagactcccg

SEQ ID NO: 458136 - DNA, 16 bp, Homo sapiens
ctgagagctgctcctt

SEQ ID NO: 458137 - DNA, 17 bp, Homo sapiens
ctgagagctgctccttt

SEQ ID NO: 458138 - DNA, 18 bp, Homo sapiens
ctgagagctgctcctttg

SEQ ID NO: 458139 - DNA, 13 bp, Homo sapiens
ctgagcagtgggg

SEQ ID NO: 458140 - DNA, 19 bp, Homo sapiens
ctgagcccagaaaaaagga

SEQ ID NO: 458141 - DNA, 20 bp, Homo sapiens
ctgagcccagaaaaaaggac

SEQ ID NO: 458142 - DNA, 10 bp, Homo sapiens
ctgagcccga

SEQ ID NO: 458143 - DNA, 14 bp, Homo sapiens
ctgagcctgtctct

SEQ ID NO: 458144 - DNA, 15 bp, Homo sapiens
ctgagcctgtctctc

SEQ ID NO: 458145 - DNA, 19 bp, Homo sapiens
ctgagcctgtctctcccta

SEQ ID NO: 458146 - DNA, 19 bp, Homo sapiens
ctgagctccaccctcccct

SEQ ID NO: 458147 - DNA, 21 bp, Homo sapiens
ctgagcttgattctaaagggg

SEQ ID NO: 458148 - DNA, 21 bp, Homo sapiens
ctgaggaccgccccaaccctc

SEQ ID NO: 458149 - DNA, 15 bp, Homo sapiens
ctgaggacggggcag

SEQ ID NO: 458150 - DNA, 18 bp, Homo sapiens
ctgaggacggggcagagc

SEQ ID NO: 458151 - DNA, 13 bp, Homo sapiens
ctgaggagtccaa

SEQ ID NO: 458152 - DNA, 23 bp, Homo sapiens
ctgaggccccttaactcatctgt

SEQ ID NO: 458153 - DNA, 16 bp, Homo sapiens
ctgagggaagcccacc

SEQ ID NO: 458154 - DNA, 20 bp, Homo sapiens
ctgagggaagcccacccgcc

SEQ ID NO: 458155 - DNA, 23 bp, Homo sapiens
ctgagggaagcccacccgcccca

SEQ ID NO: 458156 - DNA, 16 bp, Homo sapiens
ctgaggtacctttcca

SEQ ID NO: 458157 - DNA, 17 bp, Homo sapiens
ctgaggtctcaccttcg

SEQ ID NO: 458158 - DNA, 20 bp, Homo sapiens
ctgagtccagctccccccaa

SEQ ID NO: 458159 - DNA, 16 bp, Homo sapiens
ctgagtcggctgggca

SEQ ID NO: 458160 - DNA, 19 bp, Homo sapiens
ctgagtcggctgggcaggg

SEQ ID NO: 458161 - DNA, 23 bp, Homo sapiens
ctgagtcggctgggcagggccgc

SEQ ID NO: 458162 - DNA, 23 bp, Homo sapiens
ctgagtgaatgagtaaataaact

SEQ ID NO: 458163 - DNA, 21 bp, Homo sapiens
ctgatatctttgagggctgac

SEQ ID NO: 458164 - DNA, 14 bp, Homo sapiens
ctgatgggtcctgc

SEQ ID NO: 458165 - DNA, 17 bp, Homo sapiens
ctgatgggtcctgctgc

SEQ ID NO: 458166 - DNA, 21 bp, Homo sapiens
ctgattaaatttaatatactg

SEQ ID NO: 458167 - DNA, 22 bp, Homo sapiens
ctgattaaatttaatatactgc

SEQ ID NO: 458168 - DNA, 18 bp, Homo sapiens
ctgattattgaatgttat

SEQ ID NO: 458169 - DNA, 13 bp, Homo sapiens
ctgattctatgcc

SEQ ID NO: 458170 - DNA, 21 bp, Homo sapiens
ctgattctatgcctgtatttc

SEQ ID NO: 458171 - DNA, 15 bp, Homo sapiens
ctgattggacatttt

SEQ ID NO: 458172 - DNA, 16 bp, Homo sapiens
ctgatttgcaaatgca

SEQ ID NO: 458173 - DNA, 13 bp, Homo sapiens
ctgcaataacagt

SEQ ID NO: 458174 - DNA, 16 bp, Homo sapiens
ctgcaataacagtttt

SEQ ID NO: 458175 - DNA, 20 bp, Homo sapiens
ctgcaataacagttttaaga

SEQ ID NO: 458176 - DNA, 21 bp, Homo sapiens
ctgcacagtgcatctcagccc

SEQ ID NO: 458177 - DNA, 13 bp, Homo sapiens
ctgcaccaggaga

SEQ ID NO: 458178 - DNA, 15 bp, Homo sapiens
ctgcaccaggagaca

SEQ ID NO: 458179 - DNA, 15 bp, Homo sapiens
ctgcagcccagaacg

SEQ ID NO: 458180 - DNA, 23 bp, Homo sapiens
ctgcagcccagaacgggcctccc

SEQ ID NO: 458181 - DNA, 20 bp, Homo sapiens
ctgcagctatgcgcaatgtg

SEQ ID NO: 458182 - DNA, 21 bp, Homo sapiens
ctgcagtattctgtagccaac

SEQ ID NO: 458183 - DNA, 21 bp, Homo sapiens
ctgcataacagcttgaaaact

SEQ ID NO: 458184 - DNA, 21 bp, Homo sapiens
ctgcataagattatatacaaa

SEQ ID NO: 458185 - DNA, 21 bp, Homo sapiens
ctgcatatagataattatcca

SEQ ID NO: 458186 - DNA, 20 bp, Homo sapiens
ctgcatatcctggtgtctag

SEQ ID NO: 458187 - DNA, 23 bp, Homo sapiens
ctgcatcccttggcccctctctg

SEQ ID NO: 458188 - DNA, 21 bp, Homo sapiens
ctgcatcgatccccagcctgg

SEQ ID NO: 458189 - DNA, 23 bp, Homo sapiens
ctgcattactattaactctgcat

SEQ ID NO: 458190 - DNA, 17 bp, Homo sapiens
ctgcccacgctcctgcc

SEQ ID NO: 458191 - DNA, 19 bp, Homo sapiens
ctgcccacgctcctgccct

SEQ ID NO: 458192 - DNA, 20 bp, Homo sapiens
ctgcccatgtgtcccctcac

SEQ ID NO: 458193 - DNA, 13 bp, Homo sapiens
ctgccccccttcc

SEQ ID NO: 458194 - DNA, 20 bp, Homo sapiens
ctgccccccttcccacccct

SEQ ID NO: 458195 - DNA, 14 bp, Homo sapiens
ctgccccctccccc

SEQ ID NO: 458196 - DNA, 19 bp, Homo sapiens
ctgccccctcccccgcaga

SEQ ID NO: 458197 - DNA, 13 bp, Homo sapiens
ctgcccctccctt

SEQ ID NO: 458198 - DNA, 14 bp, Homo sapiens
ctgcccctcccttc

SEQ ID NO: 458199 - DNA, 17 bp, Homo sapiens
ctgcccctcccttcaac

SEQ ID NO: 458200 - DNA, 20 bp, Homo sapiens
ctgcccctccgtccccaggg

SEQ ID NO: 458201 - DNA, 13 bp, Homo sapiens
ctgcccgcccgcc

SEQ ID NO: 458202 - DNA, 14 bp, Homo sapiens
ctgccctcactcca

SEQ ID NO: 458203 - DNA, 16 bp, Homo sapiens
ctgccctcactccact

SEQ ID NO: 458204 - DNA, 18 bp, Homo sapiens
ctcagcaaggggctctgc

SEQ ID NO: 458205 - DNA, 20 bp, Homo sapiens
ctcagcaaggggctctgccc

SEQ ID NO: 458206 - DNA, 12 bp, Homo sapiens
ctcagccctcag

SEQ ID NO: 458207 - DNA, 16 bp, Homo sapiens
ctcagctccactctga

SEQ ID NO: 458208 - DNA, 23 bp, Homo sapiens
ctcaggagaaggcctgcccccct

SEQ ID NO: 458209 - DNA, 23 bp, Homo sapiens
ctcaggatgggaagaaaaaggaa

SEQ ID NO: 458210 - DNA, 22 bp, Homo sapiens
ctcaggttgtctgaagtcactg

SEQ ID NO: 458211 - DNA, 23 bp, Homo sapiens
ctcagtacagggcaggagctgct

SEQ ID NO: 458212 - DNA, 18 bp, Homo sapiens
ctcagttcaacctggtgg

SEQ ID NO: 458213 - DNA, 21 bp, Homo sapiens
ctcagttcaacctggtggcac

SEQ ID NO: 458214 - DNA, 22 bp, Homo sapiens
ctcagttcaacctggtggcacc

SEQ ID NO: 458215 - DNA, 23 bp, Homo sapiens
ctcagttcaacctggtggcacca

SEQ ID NO: 458216 - DNA, 20 bp, Homo sapiens
ctcatagccccggtgtgcgg

SEQ ID NO: 458217 - DNA, 21 bp, Homo sapiens
ctcatccactaggtgcccagt

SEQ ID NO: 458218 - DNA, 22 bp, Homo sapiens
ctcatccactaggtgcccagtc

SEQ ID NO: 458219 - DNA, 17 bp, Homo sapiens
ctccaacagacaccctc

SEQ ID NO: 458220 - DNA, 12 bp, Homo sapiens
ctccacccagag

SEQ ID NO: 458221 - DNA, 16 bp, Homo sapiens
ctccacccgtcctggg

SEQ ID NO: 458222 - DNA, 14 bp, Homo sapiens
ctccaccctcccct

SEQ ID NO: 458223 - DNA, 18 bp, Homo sapiens
ctccacgcctcctggcca

SEQ ID NO: 458224 - DNA, 9 bp, Homo sapiens
ctccactcc

SEQ ID NO: 458225 - DNA, 16 bp, Homo sapiens
ctccactcccctcatc

SEQ ID NO: 458226 - DNA, 17 bp, Homo sapiens
ctccactcccctcatcc

SEQ ID NO: 458227 - DNA, 13 bp, Homo sapiens
ctccactcctccc

SEQ ID NO: 458228 - DNA, 14 bp, Homo sapiens
ctccactctgaggt

SEQ ID NO: 458229 - DNA, 18 bp, Homo sapiens
ctccactctgaggtctca

SEQ ID NO: 458230 - DNA, 16 bp, Homo sapiens
ctccactggatggagg

SEQ ID NO: 458231 - DNA, 12 bp, Homo sapiens
ctccagacccct

SEQ ID NO: 458232 - DNA, 23 bp, Homo sapiens
ctccagacccctaccctttccca

SEQ ID NO: 458233 - DNA, 17 bp, Homo sapiens
ctccagacccctggctt

SEQ ID NO: 458234 - DNA, 18 bp, Homo sapiens
ctccagacccctggcttt

SEQ ID NO: 458235 - DNA, 20 bp, Homo sapiens
ctccagacccctggcttttc

SEQ ID NO: 458236 - DNA, 23 bp, Homo sapiens
ctccagagtaggtgggtcttgga

SEQ ID NO: 458237 - DNA, 23 bp, Homo sapiens
ctccagcagtgctgggcccagcc

SEQ ID NO: 458238 - DNA, 21 bp, Homo sapiens
ctccagccaatttcaaagaaa

SEQ ID NO: 458239 - DNA, 16 bp, Homo sapiens
ctccaggcccccaact

SEQ ID NO: 458240 - DNA, 16 bp, Homo sapiens
ctccaggctggggcct

SEQ ID NO: 458241 - DNA, 17 bp, Homo sapiens
ctccaggctggggcctg

SEQ ID NO: 458242 - DNA, 20 bp, Homo sapiens
ctccaggctggggcctggcc

SEQ ID NO: 458243 - DNA, 22 bp, Homo sapiens
ctccaggctggggcctggccta

SEQ ID NO: 458244 - DNA, 21 bp, Homo sapiens
ctccatttgtaccgaaacacc

SEQ ID NO: 458245 - DNA, 16 bp, Homo sapiens
ctcccaactctggcct

SEQ ID NO: 458246 - DNA, 15 bp, Homo sapiens
ctcccacaggccctt

SEQ ID NO: 458247 - DNA, 16 bp, Homo sapiens
ctcccacaggcccttc

SEQ ID NO: 458248 - DNA, 22 bp, Homo sapiens
ctcccaggcgccccttccccct

SEQ ID NO: 458249 - DNA, 18 bp, Homo sapiens
ctcccatgggggctccag

SEQ ID NO: 458250 - DNA, 21 bp, Homo sapiens
ctccccatatataaattatta

SEQ ID NO: 458251 - DNA, 16 bp, Homo sapiens
ctccccatgtgcctgc

SEQ ID NO: 458252 - DNA, 20 bp, Homo sapiens
ctccccatgtgcctgcacca

SEQ ID NO: 458253 - DNA, 11 bp, Homo sapiens
ctcccccaggc

SEQ ID NO: 458254 - DNA, 17 bp, Homo sapiens
ctcccccaggctgcgcc

SEQ ID NO: 458255 - DNA, 12 bp, Homo sapiens
ctccccctcaga

SEQ ID NO: 458256 - DNA, 13 bp, Homo sapiens
ctccccctgccag

SEQ ID NO: 458257 - DNA, 14 bp, Homo sapiens
ctccccctgccagc

SEQ ID NO: 458258 - DNA, 21 bp, Homo sapiens
ctccccgcccgccctcctctg

SEQ ID NO: 458259 - DNA, 14 bp, Homo sapiens
ctccccgctctgga

SEQ ID NO: 458260 - DNA, 17 bp, Homo sapiens
ctcccgccgcctcgggc

SEQ ID NO: 458261 - DNA, 13 bp, Homo sapiens
ctcccgcctttga

SEQ ID NO: 458262 - DNA, 23 bp, Homo sapiens
ctcccgtccgtccgcccgcccac

SEQ ID NO: 458263 - DNA, 16 bp, Homo sapiens
ctccctaccctcttct

SEQ ID NO: 458264 - DNA, 16 bp, Homo sapiens
ctccctataccgagac

SEQ ID NO: 458265 - DNA, 19 bp, Homo sapiens
ctccctataccgagaccca

SEQ ID NO: 458266 - DNA, 20 bp, Homo sapiens
ctccctataccgagacccac

SEQ ID NO: 458267 - DNA, 22 bp, Homo sapiens
ctccctataccgagacccacca

SEQ ID NO: 458268 - DNA, 10 bp, Homo sapiens
ctccctccac

SEQ ID NO: 458269 - DNA, 13 bp, Homo sapiens
ctccctccactcc

SEQ ID NO: 458270 - DNA, 19 bp, Homo sapiens
ctccctgactccctgtggg

SEQ ID NO: 458271 - DNA, 13 bp, Homo sapiens
ctccctgcccctc

SEQ ID NO: 458272 - DNA, 13 bp, Homo sapiens
ctccctgtcccct

SEQ ID NO: 458273 - DNA, 24 bp, Homo sapiens
ctccctgtgggggtggccatccct

SEQ ID NO: 458274 - DNA, 23 bp, Homo sapiens
ctcccttcaaccattccccatgg

SEQ ID NO: 458275 - DNA, 20 bp, Homo sapiens
ctccctttgtggactttatt

SEQ ID NO: 458276 - DNA, 16 bp, Homo sapiens
ctccgcccagcctctc

SEQ ID NO: 458277 - DNA, 12 bp, Homo sapiens
ctccggcagagg

SEQ ID NO: 458278 - DNA, 19 bp, Homo sapiens
ctccggcagaggcagggcc

SEQ ID NO: 458279 - DNA, 21 bp, Homo sapiens
ctccgggtgtggcctcagccc

SEQ ID NO: 458280 - DNA, 20 bp, Homo sapiens
ctccgtccccagggtgcagg

SEQ ID NO: 458281 - DNA, 14 bp, Homo sapiens
ctcctaggcgctca

SEQ ID NO: 458282 - DNA, 19 bp, Homo sapiens
ctcctcagtctttggggga

SEQ ID NO: 458283 - DNA, 21 bp, Homo sapiens
ctcctcagtctttgggggatt

SEQ ID NO: 458284 - DNA, 13 bp, Homo sapiens
ctcctccagactc

SEQ ID NO: 458285 - DNA, 22 bp, Homo sapiens
ctcctccagactcgagagggct

SEQ ID NO: 458286 - DNA, 13 bp, Homo sapiens
ctcctcccaactc

SEQ ID NO: 458287 - DNA, 17 bp, Homo sapiens
ctcctcccaactctggc

SEQ ID NO: 458288 - DNA, 19 bp, Homo sapiens
ctcctcccaactctggcct

SEQ ID NO: 458289 - DNA, 22 bp, Homo sapiens
ctcctcccaggcgccccttccc

SEQ ID NO: 458290 - DNA, 15 bp, Homo sapiens
ctcctcccggtgccc

SEQ ID NO: 458291 - DNA, 20 bp, Homo sapiens
ctcctcgggcgcctgcgctc

SEQ ID NO: 458292 - DNA, 23 bp, Homo sapiens
ctcctcgggcgcctgcgctcctc

SEQ ID NO: 458293 - DNA, 11 bp, Homo sapiens
ctcctctccca

SEQ ID NO: 458294 - DNA, 13 bp, Homo sapiens
ctcctctcccaaa

SEQ ID NO: 458295 - DNA, 15 bp, Homo sapiens
ctcctctctctccct

SEQ ID NO: 458296 - DNA, 16 bp, Homo sapiens
ctcctctctctccctc

SEQ ID NO: 458297 - DNA, 14 bp, Homo sapiens
ctcctctgcagcct

SEQ ID NO: 458298 - DNA, 15 bp, Homo sapiens
ctcctctgcagcctg

SEQ ID NO: 458299 - DNA, 21 bp, Homo sapiens
ctcctctgcagcctgagctcc

SEQ ID NO: 458300 - DNA, 11 bp, Homo sapiens
ctcctctgccc

SEQ ID NO: 458301 - DNA, 18 bp, Homo sapiens
ctcctctgccccctcccc

SEQ ID NO: 458302 - DNA, 12 bp, Homo sapiens
ctcctctgcctt

SEQ ID NO: 458303 - DNA, 14 bp, Homo sapiens
ctcctctgccttgg

SEQ ID NO: 458304 - DNA, 14 bp, Homo sapiens
ctcctctgctccaa

SEQ ID NO: 458305 - DNA, 22 bp, Homo sapiens
ctcctctgctccaacagacacc

SEQ ID NO: 458306 - DNA, 14 bp, Homo sapiens
ctcctgggggtggc

SEQ ID NO: 458307 - DNA, 18 bp, Homo sapiens
ctccttaaccacctagtc

SEQ ID NO: 458308 - DNA, 14 bp, Homo sapiens
ctccttctcccctc

SEQ ID NO: 458309 - DNA, 19 bp, Homo sapiens
ctccttctcccctccagac

SEQ ID NO: 458310 - DNA, 13 bp, Homo sapiens
ctcctttcacaac

SEQ ID NO: 458311 - DNA, 16 bp, Homo sapiens
ctcctttcacaacctt

SEQ ID NO: 458312 - DNA, 15 bp, Homo sapiens
ctcctttccaaataa

SEQ ID NO: 458313 - DNA, 23 bp, Homo sapiens
ctcctttctaaggagcactagaa

SEQ ID NO: 458314 - DNA, 22 bp, Homo sapiens
ctcgactctgctgctcatggga

SEQ ID NO: 458315 - DNA, 15 bp, Homo sapiens
ctcgagagggctgag

SEQ ID NO: 458316 - DNA, 14 bp, Homo sapiens
ctcgagtcccccca

SEQ ID NO: 458317 - DNA, 19 bp, Homo sapiens
ctcgagtccccccacccct

SEQ ID NO: 458318 - DNA, 22 bp, Homo sapiens
ctcgagtccccccacccctccc

SEQ ID NO: 458319 - DNA, 12 bp, Homo sapiens
ctcggacacagt

SEQ ID NO: 458320 - DNA, 19 bp, Homo sapiens
ctcggagccccccactcag

SEQ ID NO: 458321 - DNA, 16 bp, Homo sapiens
ctcggccccacccacc

SEQ ID NO: 458322 - DNA, 22 bp, Homo sapiens
ctcggctgtgtggggagggtgg

SEQ ID NO: 458323 - DNA, 13 bp, Homo sapiens
ctcgggaaggcct

SEQ ID NO: 458324 - DNA, 17 bp, Homo sapiens
ctcgggaaggcctgagg

SEQ ID NO: 458325 - DNA, 12 bp, Homo sapiens
ctcgggccgcct

SEQ ID NO: 458326 - DNA, 20 bp, Homo sapiens
ctcgggcgcctgcgctcctc

SEQ ID NO: 458327 - DNA, 20 bp, Homo sapiens
ctcgtccggcctgcagccca

SEQ ID NO: 458328 - DNA, 19 bp, Homo sapiens
ctcgtgccatgatctgtat

SEQ ID NO: 458329 - DNA, 13 bp, Homo sapiens
ctcgttgacatgc

SEQ ID NO: 458330 - DNA, 14 bp, Homo sapiens
ctctaaaattctag

SEQ ID NO: 458331 - DNA, 15 bp, Homo sapiens
ctctaaaattctagt

SEQ ID NO: 458332 - DNA, 16 bp, Homo sapiens
ctctacccccaacacc

SEQ ID NO: 458333 - DNA, 17 bp, Homo sapiens
ctctacccccaacacca

SEQ ID NO: 458334 - DNA, 15 bp, Homo sapiens
ctctactttataatc

SEQ ID NO: 458335 - DNA, 20 bp, Homo sapiens
ctctattgtagcatttcttg

SEQ ID NO: 458336 - DNA, 23 bp, Homo sapiens
ctctcagatccctcggtcagcac

SEQ ID NO: 458337 - DNA, 12 bp, Homo sapiens
ctctccacccag

SEQ ID NO: 458338 - DNA, 22 bp, Homo sapiens
ctctccacccagaggtctccct

SEQ ID NO: 458339 - DNA, 14 bp, Homo sapiens
ctctccactgcctt

SEQ ID NO: 458340 - DNA, 15 bp, Homo sapiens
ctctccactgccttc

SEQ ID NO: 458341 - DNA, 19 bp, Homo sapiens
ctctccccatatataaatt

SEQ ID NO: 458342 - DNA, 17 bp, Homo sapiens
ctctccccgctctggat

SEQ ID NO: 458343 - DNA, 15 bp, Homo sapiens
ctctccctaccctct

SEQ ID NO: 458344 - DNA, 22 bp, Homo sapiens
ctctccctaccctcttctcagc

SEQ ID NO: 458345 - DNA, 14 bp, Homo sapiens
ctctccctccactc

SEQ ID NO: 458346 - DNA, 18 bp, Homo sapiens
ctctccctccactcctcc

SEQ ID NO: 458347 - DNA, 12 bp, Homo sapiens
ctctcctcgtcc

SEQ ID NO: 458348 - DNA, 19 bp, Homo sapiens
ctctcctgagcctgtctct

SEQ ID NO: 458349 - DNA, 12 bp, Homo sapiens
ctctctccctcc

SEQ ID NO: 458350 - DNA, 17 bp, Homo sapiens
ctctctccctccactcc

SEQ ID NO: 458351 - DNA, 14 bp, Homo sapiens
ctctctctccctcc

SEQ ID NO: 458352 - DNA, 15 bp, Homo sapiens
ctctctctccctcca

SEQ ID NO: 458353 - DNA, 10 bp, Homo sapiens
ctctctctct

SEQ ID NO: 458354 - DNA, 15 bp, Homo sapiens
ctctctctctctctg

SEQ ID NO: 458355 - DNA, 14 bp, Homo sapiens
ctctctctctctgt

SEQ ID NO: 458356 - DNA, 18 bp, Homo sapiens
ctctctggggccctgggc

SEQ ID NO: 458357 - DNA, 20 bp, Homo sapiens
ctctctggggccctgggcct

SEQ ID NO: 458358 - DNA, 21 bp, Homo sapiens
ctctctgtgtggcaaacattt

SEQ ID NO: 458359 - DNA, 15 bp, Homo sapiens
ctctctgtttaccct

SEQ ID NO: 458360 - DNA, 23 bp, Homo sapiens
ctctctgtttaccctccctgtcc

SEQ ID NO: 458361 - DNA, 22 bp, Homo sapiens
ctctcttaccccgtccctttcc

SEQ ID NO: 458362 - DNA, 20 bp, Homo sapiens
ctctgaagtcccttcctgtc

SEQ ID NO: 458363 - DNA, 19 bp, Homo sapiens
ctctgaggtctcaccttcg

SEQ ID NO: 458364 - DNA, 11 bp, Homo sapiens
aaaaaagaaca

SEQ ID NO: 458365 - DNA, 19 bp, Homo sapiens
aaaaaccatctgtaaaaga

SEQ ID NO: 458366 - DNA, 12 bp, Homo sapiens
aaaaagaaaact

SEQ ID NO: 458367 - DNA, 11 bp, Homo sapiens
aaaaagaacag

SEQ ID NO: 458368 - DNA, 23 bp, Homo sapiens
aaaaagcaggaaagatcccaagt

SEQ ID NO: 458369 - DNA, 12 bp, Homo sapiens
aaaaagggaaaa

SEQ ID NO: 458370 - DNA, 19 bp, Homo sapiens
aaaacccgagggacagcag

SEQ ID NO: 458371 - DNA, 15 bp, Homo sapiens
aaaactaaaattcaa

SEQ ID NO: 458372 - DNA, 18 bp, Homo sapiens
aaaactcagttaaaatgt

SEQ ID NO: 458373 - DNA, 19 bp, Homo sapiens
aaaagaaatgctaatgtaa

SEQ ID NO: 458374 - DNA, 13 bp, Homo sapiens
aaaagaacatagg

SEQ ID NO: 458375 - DNA, 18 bp, Homo sapiens
aaaagcctgcatcgggga

SEQ ID NO: 458376 - DNA, 19 bp, Homo sapiens
aaaaggctggatgtgcttt

SEQ ID NO: 458377 - DNA, 22 bp, Homo sapiens
aaaaggctggatgtgctttcat

SEQ ID NO: 458378 - DNA, 20 bp, Homo sapiens
aaaataacatattcttgctt

SEQ ID NO: 458379 - DNA, 21 bp, Homo sapiens
aaaataacatctgaaaagaaa

SEQ ID NO: 458380 - DNA, 13 bp, Homo sapiens
aaaataaccaaaa

SEQ ID NO: 458381 - DNA, 16 bp, Homo sapiens
aaaataactgtgcact

SEQ ID NO: 458382 - DNA, 12 bp, Homo sapiens
aaaatactgttt

SEQ ID NO: 458383 - DNA, 18 bp, Homo sapiens
aaaatagtaaatgctttg

SEQ ID NO: 458384 - DNA, 19 bp, Homo sapiens
aaaatagtaaatgctttgt

SEQ ID NO: 458385 - DNA, 22 bp, Homo sapiens
aaaatagtcatgtttctgcagt

SEQ ID NO: 458386 - DNA, 23 bp, Homo sapiens
aaaatagttctatttctatctgc

SEQ ID NO: 458387 - DNA, 14 bp, Homo sapiens
aaaatattctgtca

SEQ ID NO: 458388 - DNA, 13 bp, Homo sapiens
aaaatatttctaa

SEQ ID NO: 458389 - DNA, 17 bp, Homo sapiens
aaaatatttctaagctt

SEQ ID NO: 458390 - DNA, 21 bp, Homo sapiens
aaaatatttctaagcttattt

SEQ ID NO: 458391 - DNA, 20 bp, Homo sapiens
aaaatatttttttctagcta

SEQ ID NO: 458392 - DNA, 12 bp, Homo sapiens
aaaatgcaaata

SEQ ID NO: 458393 - DNA, 14 bp, Homo sapiens
aaaatgctttctca

SEQ ID NO: 458394 - DNA, 15 bp, Homo sapiens
aaaatgctttctcat

SEQ ID NO: 458395 - DNA, 23 bp, Homo sapiens
aaaatggacttttgttcatggga

SEQ ID NO: 458396 - DNA, 12 bp, Homo sapiens
aaaattcatagc

SEQ ID NO: 458397 - DNA, 12 bp, Homo sapiens
aaaattctagtc

SEQ ID NO: 458398 - DNA, 20 bp, Homo sapiens
aaaattctagtctctgattt

SEQ ID NO: 458399 - DNA, 19 bp, Homo sapiens
aaaattgaacaaagactac

SEQ ID NO: 458400 - DNA, 14 bp, Homo sapiens
aaacaataaacgaa

SEQ ID NO: 458401 - DNA, 13 bp, Homo sapiens
aaacaccccgctc

SEQ ID NO: 458402 - DNA, 23 bp, Homo sapiens
aaacactaatggccaagtgtaca

SEQ ID NO: 458403 - DNA, 22 bp, Homo sapiens
aaacactgcttaaggaaaagag

SEQ ID NO: 458404 - DNA, 21 bp, Homo sapiens
aaacactgtaatcttaaaagt

SEQ ID NO: 458405 - DNA, 14 bp, Homo sapiens
aaacattcttattt

SEQ ID NO: 458406 - DNA, 17 bp, Homo sapiens
aaacattctttaacata

SEQ ID NO: 458407 - DNA, 19 bp, Homo sapiens
aaacattctttaacataca

SEQ ID NO: 458408 - DNA, 16 bp, Homo sapiens
aaaccaagccgtggct

SEQ ID NO: 458409 - DNA, 15 bp, Homo sapiens
aaacccgagggacag

SEQ ID NO: 458410 - DNA, 13 bp, Homo sapiens
aaacctgtgcttt

SEQ ID NO: 458411 - DNA, 17 bp, Homo sapiens
aaacgtaatttgttata

SEQ ID NO: 458412 - DNA, 21 bp, Homo sapiens
aaactactgattgaatgttaa

SEQ ID NO: 458413 - DNA, 14 bp, Homo sapiens
aaactcagttaaaa

SEQ ID NO: 458414 - DNA, 17 bp, Homo sapiens
aaactcagttaaaatgt

SEQ ID NO: 458415 - DNA, 23 bp, Homo sapiens
aaacttactgtcagagaatatga

SEQ ID NO: 458416 - DNA, 11 bp, Homo sapiens
aaacttcagca

SEQ ID NO: 458417 - DNA, 20 bp, Homo sapiens
aaacttgtacttacactgaa

SEQ ID NO: 458418 - DNA, 23 bp, Homo sapiens
aaacttgtacttacactgaaatc

SEQ ID NO: 458419 - DNA, 23 bp, Homo sapiens
aaacttgtgttcaatctgtgaag

SEQ ID NO: 458420 - DNA, 11 bp, Homo sapiens
aaactttgtca

SEQ ID NO: 458421 - DNA, 21 bp, Homo sapiens
aaagaaatgctaatgtaatca

SEQ ID NO: 458422 - DNA, 16 bp, Homo sapiens
aaagaacccccctccc

SEQ ID NO: 458423 - DNA, 17 bp, Homo sapiens
aaagaacccccctcccc

SEQ ID NO: 458424 - DNA, 20 bp, Homo sapiens
aaagaacccccctccccaag

SEQ ID NO: 458425 - DNA, 19 bp, Homo sapiens
aaagaagaaagtctatgct

SEQ ID NO: 458426 - DNA, 13 bp, Homo sapiens
aaagacacctact

SEQ ID NO: 458427 - DNA, 15 bp, Homo sapiens
aaagagaaaatgctt

SEQ ID NO: 458428 - DNA, 21 bp, Homo sapiens
aaagagaaaatgctttctcat

SEQ ID NO: 458429 - DNA, 22 bp, Homo sapiens
aaagagttctccttgtacttga

SEQ ID NO: 458430 - DNA, 19 bp, Homo sapiens
aaagcagagatgtattatg

SEQ ID NO: 458431 - DNA, 21 bp, Homo sapiens
aaagcaggaaagatcccaagt

SEQ ID NO: 458432 - DNA, 14 bp, Homo sapiens
aaagctatatatga

SEQ ID NO: 458433 - DNA, 17 bp, Homo sapiens
aaaggaaagttctatta

SEQ ID NO: 458434 - DNA, 17 bp, Homo sapiens
aaaggccttaacaaacg

SEQ ID NO: 458435 - DNA, 18 bp, Homo sapiens
aaagggagccatgctctt

SEQ ID NO: 458436 - DNA, 17 bp, Homo sapiens
aaagggcagcccctccc

SEQ ID NO: 458437 - DNA, 22 bp, Homo sapiens
aaagggcagcccctccccatgg

SEQ ID NO: 458438 - DNA, 15 bp, Homo sapiens
aaaggttaagccata

SEQ ID NO: 458439 - DNA, 13 bp, Homo sapiens
aaagtctatgctt

SEQ ID NO: 458440 - DNA, 19 bp, Homo sapiens
aaagttctattatctgggt

SEQ ID NO: 458441 - DNA, 13 bp, Homo sapiens
aaataaactcttc

SEQ ID NO: 458442 - DNA, 16 bp, Homo sapiens
aaataaagaagaaaat

SEQ ID NO: 458443 - DNA, 19 bp, Homo sapiens
aaataaagaagaaaataac

SEQ ID NO: 458444 - DNA, 20 bp, Homo sapiens
aaataaagaagaaaataacc

SEQ ID NO: 458445 - DNA, 24 bp, Homo sapiens
aaataaagagttctccttgtactt

SEQ ID NO: 458446 - DNA, 16 bp, Homo sapiens
aaataacagagctgga

SEQ ID NO: 458447 - DNA, 20 bp, Homo sapiens
aaataacatattcttgcttt

SEQ ID NO: 458448 - DNA, 19 bp, Homo sapiens
aaataacatctgaaaagaa

SEQ ID NO: 458449 - DNA, 16 bp, Homo sapiens
aaataagtaatatctt

SEQ ID NO: 458450 - DNA, 23 bp, Homo sapiens
aaataatgcttaacataaacttg

SEQ ID NO: 458451 - DNA, 14 bp, Homo sapiens
aaatactcaccaaa

SEQ ID NO: 458452 - DNA, 16 bp, Homo sapiens
aaatagtcatgtttct

SEQ ID NO: 458453 - DNA, 19 bp, Homo sapiens
aaatagtcatgtttctgca

SEQ ID NO: 458454 - DNA, 16 bp, Homo sapiens
aaatagttctatttct

SEQ ID NO: 458455 - DNA, 21 bp, Homo sapiens
aaatatctatttatctgtctg

SEQ ID NO: 458456 - DNA, 21 bp, Homo sapiens
aaatatgattctcctctccca

SEQ ID NO: 458457 - DNA, 23 bp, Homo sapiens
aaatattccatccatatactttg

SEQ ID NO: 458458 - DNA, 13 bp, Homo sapiens
aaatatttcactt

SEQ ID NO: 458459 - DNA, 13 bp, Homo sapiens
aaatcaatttaaa

SEQ ID NO: 458460 - DNA, 15 bp, Homo sapiens
aaatctgtctgattc

SEQ ID NO: 458461 - DNA, 19 bp, Homo sapiens
aaatctgtctgattctatg

SEQ ID NO: 458462 - DNA, 12 bp, Homo sapiens
aaatgagaaatt

SEQ ID NO: 458463 - DNA, 14 bp, Homo sapiens
aaatgagaaattgt

SEQ ID NO: 458464 - DNA, 21 bp, Homo sapiens
aaatgcatgatattgtatgta

SEQ ID NO: 458465 - DNA, 19 bp, Homo sapiens
aaatgctttgtgtgattga

SEQ ID NO: 458466 - DNA, 20 bp, Homo sapiens
aaatgtatcctgataaacat

SEQ ID NO: 458467 - DNA, 21 bp, Homo sapiens
aaatgtttatattgtttttat

SEQ ID NO: 458468 - DNA, 20 bp, Homo sapiens
aaatgttttacaatggctgg

SEQ ID NO: 458469 - DNA, 21 bp, Homo sapiens
aaatgttttacaatggctggg

SEQ ID NO: 458470 - DNA, 14 bp, Homo sapiens
aaattatatgatat

SEQ ID NO: 458471 - DNA, 18 bp, Homo sapiens
aaattatatgatatgcat

SEQ ID NO: 458472 - DNA, 12 bp, Homo sapiens
aaattattactt

SEQ ID NO: 458473 - DNA, 13 bp, Homo sapiens
aaattattacttt

SEQ ID NO: 458474 - DNA, 14 bp, Homo sapiens
aaattattctagtc

SEQ ID NO: 458475 - DNA, 18 bp, Homo sapiens
aaattgcatttcctgaca

SEQ ID NO: 458476 - DNA, 21 bp, Homo sapiens
aaattggctcctttcccacag

SEQ ID NO: 458477 - DNA, 13 bp, Homo sapiens
aaattgtgccaaa

SEQ ID NO: 458478 - DNA, 17 bp, Homo sapiens
aaatttaactgcatata

SEQ ID NO: 458479 - DNA, 14 bp, Homo sapiens
aaattttaatgtaa

SEQ ID NO: 458480 - DNA, 21 bp, Homo sapiens
aaatttttactcaggctttct

SEQ ID NO: 458481 - DNA, 19 bp, Homo sapiens
aacaaacgtaatttgttat

SEQ ID NO: 458482 - DNA, 23 bp, Homo sapiens
aacaaatatgattctcctctccc

SEQ ID NO: 458483 - DNA, 14 bp, Homo sapiens
aacaaggaaggaca

SEQ ID NO: 458484 - DNA, 17 bp, Homo sapiens
aacaatgccttgttgta

SEQ ID NO: 458485 - DNA, 16 bp, Homo sapiens
aacactaatggccaag

SEQ ID NO: 458486 - DNA, 21 bp, Homo sapiens
aacacttattttctgaattca

SEQ ID NO: 458487 - DNA, 17 bp, Homo sapiens
aacagacaccctccact

SEQ ID NO: 458488 - DNA, 19 bp, Homo sapiens
aacagaccagcatagttct

SEQ ID NO: 458489 - DNA, 22 bp, Homo sapiens
aacagacctcactgctttgtag

SEQ ID NO: 458490 - DNA, 16 bp, Homo sapiens
aacagatgtttgtttt

SEQ ID NO: 458491 - DNA, 17 bp, Homo sapiens
aacagatgtttgttttc

SEQ ID NO: 458492 - DNA, 18 bp, Homo sapiens
aacagcatgtctactgct

SEQ ID NO: 458493 - DNA, 17 bp, Homo sapiens
aacagccaaagaaactc

SEQ ID NO: 458494 - DNA, 23 bp, Homo sapiens
aacagctaggttaataggaggac

SEQ ID NO: 458495 - DNA, 21 bp, Homo sapiens
aacaggaatttctgttagcaa

SEQ ID NO: 458496 - DNA, 21 bp, Homo sapiens
aacagtgtggcttaaacattt

SEQ ID NO: 458497 - DNA, 18 bp, Homo sapiens
aacagtgttgaaattgga

SEQ ID NO: 458498 - DNA, 17 bp, Homo sapiens
aacagttaagacaacag

SEQ ID NO: 458499 - DNA, 17 bp, Homo sapiens
aacagttccataccaag

SEQ ID NO: 458500 - DNA, 13 bp, Homo sapiens
aacagttttaaga

SEQ ID NO: 458501 - DNA, 17 bp, Homo sapiens
aacataaacttgtactt

SEQ ID NO: 458502 - DNA, 13 bp, Homo sapiens
aacatctgaaaag

SEQ ID NO: 458503 - DNA, 16 bp, Homo sapiens
aacatctgaaaagaaa

SEQ ID NO: 458504 - DNA, 18 bp, Homo sapiens
aacatctgaaaagaaatg

SEQ ID NO: 458505 - DNA, 15 bp, Homo sapiens
aacattaaacactgt

SEQ ID NO: 458506 - DNA, 21 bp, Homo sapiens
aacattttttgtttcttggtg

SEQ ID NO: 458507 - DNA, 18 bp, Homo sapiens
aaccaaatgcaatgtgaa

SEQ ID NO: 458508 - DNA, 17 bp, Homo sapiens
aaccaacgggtctgtgg

SEQ ID NO: 458509 - DNA, 18 bp, Homo sapiens
aaccaagccgtggcttcc

SEQ ID NO: 458510 - DNA, 14 bp, Homo sapiens
aaccatagaactgt

SEQ ID NO: 458511 - DNA, 18 bp, Homo sapiens
aaccatatgattgaaaag

SEQ ID NO: 458512 - DNA, 20 bp, Homo sapiens
aaccatatgattgaaaagaa

SEQ ID NO: 458513 - DNA, 23 bp, Homo sapiens
aaccatatgattgaaaagaagaa

SEQ ID NO: 458514 - DNA, 22 bp, Homo sapiens
aagcagagccagtcttcctcct

SEQ ID NO: 458515 - DNA, 20 bp, Homo sapiens
aagcaggaaagatcccaagt

SEQ ID NO: 458516 - DNA, 21 bp, Homo sapiens
aagcaggaaagatcccaagtc

SEQ ID NO: 458517 - DNA, 19 bp, Homo sapiens
aagccaaacattcttattt

SEQ ID NO: 458518 - DNA, 13 bp, Homo sapiens
aagccaggagacc

SEQ ID NO: 458519 - DNA, 21 bp, Homo sapiens
aagccaggccaactgccccgc

SEQ ID NO: 458520 - DNA, 17 bp, Homo sapiens
aagccagggttccagac

SEQ ID NO: 458521 - DNA, 24 bp, Homo sapiens
aagccatatgacaatttcaaaatg

SEQ ID NO: 458522 - DNA, 14 bp, Homo sapiens
aagcccacccgccc

SEQ ID NO: 458523 - DNA, 18 bp, Homo sapiens
aagcccacccgccccaga

SEQ ID NO: 458524 - DNA, 19 bp, Homo sapiens
aagcccacccgccccagag

SEQ ID NO: 458525 - DNA, 23 bp, Homo sapiens
aagcccacccgccccagagactg

SEQ ID NO: 458526 - DNA, 13 bp, Homo sapiens
aagcccaggagga

SEQ ID NO: 458527 - DNA, 14 bp, Homo sapiens
aagccgtggcttcc

SEQ ID NO: 458528 - DNA, 13 bp, Homo sapiens
aagcttatttcta

SEQ ID NO: 458529 - DNA, 20 bp, Homo sapiens
aaggaaaagagaaacactaa

SEQ ID NO: 458530 - DNA, 16 bp, Homo sapiens
aaggaaggacatttcc

SEQ ID NO: 458531 - DNA, 12 bp, Homo sapiens
aaggagaggagt

SEQ ID NO: 458532 - DNA, 13 bp, Homo sapiens
aaggagaggagtg

SEQ ID NO: 458533 - DNA, 22 bp, Homo sapiens
aaggagcactagaatgagaaat

SEQ ID NO: 458534 - DNA, 22 bp, Homo sapiens
aaggattcttttttcaatgtac

SEQ ID NO: 458535 - DNA, 12 bp, Homo sapiens
aaggcctgaggg

SEQ ID NO: 458536 - DNA, 18 bp, Homo sapiens
aaggcctgccccccttcc

SEQ ID NO: 458537 - DNA, 20 bp, Homo sapiens
aaggcctgccccccttccca

SEQ ID NO: 458538 - DNA, 12 bp, Homo sapiens
aaggctgcccct

SEQ ID NO: 458539 - DNA, 16 bp, Homo sapiens
aaggctgcccctgtaa

SEQ ID NO: 458540 - DNA, 17 bp, Homo sapiens
aagggagccatgctctt

SEQ ID NO: 458541 - DNA, 18 bp, Homo sapiens
aagggcagcaagataaac

SEQ ID NO: 458542 - DNA, 14 bp, Homo sapiens
aaggtggtcttgga

SEQ ID NO: 458543 - DNA, 21 bp, Homo sapiens
aaggtggtcttggagaggagg

SEQ ID NO: 458544 - DNA, 13 bp, Homo sapiens
aaggtttcaatgc

SEQ ID NO: 458545 - DNA, 23 bp, Homo sapiens
acagacaccctccactctgaggt

SEQ ID NO: 458546 - DNA, 21 bp, Homo sapiens
acagacctcactgctttgtag

SEQ ID NO: 458547 - DNA, 22 bp, Homo sapiens
acagacctccagattattttct

SEQ ID NO: 458548 - DNA, 13 bp, Homo sapiens
acagacctcggct

SEQ ID NO: 458549 - DNA, 23 bp, Homo sapiens
acagacctcggctgtgtggggag

SEQ ID NO: 458550 - DNA, 18 bp, Homo sapiens
acagacggacgggacagc

SEQ ID NO: 458551 - DNA, 17 bp, Homo sapiens
acagagctggatgctga

SEQ ID NO: 458552 - DNA, 11 bp, Homo sapiens
acagagtggat

SEQ ID NO: 458553 - DNA, 17 bp, Homo sapiens
acagagtggatctggag

SEQ ID NO: 458554 - DNA, 18 bp, Homo sapiens
acagagtggatctggagt

SEQ ID NO: 458555 - DNA, 18 bp, Homo sapiens
acagatgggtattaaact

SEQ ID NO: 458556 - DNA, 19 bp, Homo sapiens
acagatgggtattaaactt

SEQ ID NO: 458557 - DNA, 20 bp, Homo sapiens
acagatgggtattaaacttg

SEQ ID NO: 458558 - DNA, 19 bp, Homo sapiens
acagatgtttgttttcaaa

SEQ ID NO: 458559 - DNA, 20 bp, Homo sapiens
acagatgtttgttttcaaaa

SEQ ID NO: 458560 - DNA, 19 bp, Homo sapiens
acagcagccccccagcact

SEQ ID NO: 458561 - DNA, 23 bp, Homo sapiens
acagcagtacttgctcaataaag

SEQ ID NO: 458562 - DNA, 14 bp, Homo sapiens
acagcatgtctact

SEQ ID NO: 458563 - DNA, 14 bp, Homo sapiens
acagccaaagaaac

SEQ ID NO: 458564 - DNA, 15 bp, Homo sapiens
acagcctcctaggct

SEQ ID NO: 458565 - DNA, 18 bp, Homo sapiens
acagcctcctaggctccc

SEQ ID NO: 458566 - DNA, 22 bp, Homo sapiens
acagcctcctaggctccctgag

SEQ ID NO: 458567 - DNA, 12 bp, Homo sapiens
acagcctggcac

SEQ ID NO: 458568 - DNA, 15 bp, Homo sapiens
acagcctggcacagg

SEQ ID NO: 458569 - DNA, 19 bp, Homo sapiens
acagcggcccggcccacgc

SEQ ID NO: 458570 - DNA, 15 bp, Homo sapiens
acaggaaagccctcc

SEQ ID NO: 458571 - DNA, 17 bp, Homo sapiens
accccataagccctgag

SEQ ID NO: 458572 - DNA, 18 bp, Homo sapiens
accccataagccctgaga

SEQ ID NO: 458573 - DNA, 19 bp, Homo sapiens
accccataagccctgagac

SEQ ID NO: 458574 - DNA, 22 bp, Homo sapiens
accccataagccctgagactcc

SEQ ID NO: 458575 - DNA, 16 bp, Homo sapiens
acccccagcctccccc

SEQ ID NO: 458576 - DNA, 20 bp, Homo sapiens
acccccagcctcccccaggc

SEQ ID NO: 458577 - DNA, 14 bp, Homo sapiens
acccccctccccaa

SEQ ID NO: 458578 - DNA, 14 bp, Homo sapiens
acccccgaggcccc

SEQ ID NO: 458579 - DNA, 19 bp, Homo sapiens
acccccggcctccaggctg

SEQ ID NO: 458580 - DNA, 23 bp, Homo sapiens
acccccggcctccaggctggggc

SEQ ID NO: 458581 - DNA, 13 bp, Homo sapiens
accccgtcccggc

SEQ ID NO: 458582 - DNA, 14 bp, Homo sapiens
accccgtctgcccc

SEQ ID NO: 458583 - DNA, 15 bp, Homo sapiens
accccgtctgcccct

SEQ ID NO: 458584 - DNA, 22 bp, Homo sapiens
acccctaaagagatactttgat

SEQ ID NO: 458585 - DNA, 15 bp, Homo sapiens
acccctcaagccagg

SEQ ID NO: 458586 - DNA, 20 bp, Homo sapiens
acccctcaagccaggagacc

SEQ ID NO: 458587 - DNA, 23 bp, Homo sapiens
acccctcaagccaggagaccctg

SEQ ID NO: 458588 - DNA, 21 bp, Homo sapiens
acccctccccacccaccaccg

SEQ ID NO: 458589 - DNA, 17 bp, Homo sapiens
acccctggcttttcact

SEQ ID NO: 458590 - DNA, 19 bp, Homo sapiens
acccgagggacagcagatt

SEQ ID NO: 458591 - DNA, 14 bp, Homo sapiens
acccgccccagaga

SEQ ID NO: 458592 - DNA, 16 bp, Homo sapiens
acccgccccagagact

SEQ ID NO: 458593 - DNA, 17 bp, Homo sapiens
acccgcccgcccccgcc

SEQ ID NO: 458594 - DNA, 16 bp, Homo sapiens
accctagaagaaaacc

SEQ ID NO: 458595 - DNA, 14 bp, Homo sapiens
tcttcaaccctgcc

SEQ ID NO: 458596 - DNA, 18 bp, Homo sapiens
tcttcaaccctgccctgc

SEQ ID NO: 458597 - DNA, 15 bp, Homo sapiens
tgaagttaacagtct

SEQ ID NO: 458598 - DNA, 17 bp, Homo sapiens
tgaagttgtaagaaaag

SEQ ID NO: 458599 - DNA, 16 bp, Homo sapiens
tgaataaagacaccta

SEQ ID NO: 458600 - DNA, 16 bp, Homo sapiens
tgaataggagttctcc

SEQ ID NO: 458601 - DNA, 13 bp, Homo sapiens
tgaatatatttta

SEQ ID NO: 458602 - DNA, 21 bp, Homo sapiens
tgaatcactgcacctctttgt

SEQ ID NO: 458603 - DNA, 18 bp, Homo sapiens
tgaatgtccccattctat

SEQ ID NO: 458604 - DNA, 19 bp, Homo sapiens
tgaatgttatatcatcaat

SEQ ID NO: 458605 - DNA, 23 bp, Homo sapiens
tgaattttttttttaaatgattc

SEQ ID NO: 458606 - DNA, 15 bp, Homo sapiens
tgacaatttcaaaat

SEQ ID NO: 458607 - DNA, 18 bp, Homo sapiens
tgacaatttcaaaatgca

SEQ ID NO: 458608 - DNA, 19 bp, Homo sapiens
tgacaatttcaaaatgcat

SEQ ID NO: 458609 - DNA, 20 bp, Homo sapiens
tgacaatttcaaaatgcatg

SEQ ID NO: 458610 - DNA, 21 bp, Homo sapiens
tgacaatttcaaaatgcatgt

SEQ ID NO: 458611 - DNA, 15 bp, Homo sapiens
tgacacataaatctg

SEQ ID NO: 458612 - DNA, 16 bp, Homo sapiens
tgacacataaatctgt

SEQ ID NO: 458613 - DNA, 17 bp, Homo sapiens
tgacaggaaagccctcc

SEQ ID NO: 458614 - DNA, 13 bp, Homo sapiens
tgacatgcacagt

SEQ ID NO: 458615 - DNA, 23 bp, Homo sapiens
tgaccccacttatgctgctgtga

SEQ ID NO: 458616 - DNA, 17 bp, Homo sapiens
tgaccggcccgccacct

SEQ ID NO: 458617 - DNA, 21 bp, Homo sapiens
tgacctaaatccattttctaa

SEQ ID NO: 458618 - DNA, 19 bp, Homo sapiens
tgacctctcacttttttat

SEQ ID NO: 458619 - DNA, 22 bp, Homo sapiens
tgacctgacgatcttccccctt

SEQ ID NO: 458620 - DNA, 23 bp, Homo sapiens
tgacctgacgatcttcccccttc

SEQ ID NO: 458621 - DNA, 23 bp, Homo sapiens
tgacgacctacatctgaaatcta

SEQ ID NO: 458622 - DNA, 23 bp, Homo sapiens
tgactccctgtgggggtggccat

SEQ ID NO: 458623 - DNA, 13 bp, Homo sapiens
tgactggaaacaa

SEQ ID NO: 458624 - DNA, 17 bp, Homo sapiens
tgactgtactcctccca

SEQ ID NO: 458625 - DNA, 17 bp, Homo sapiens
tgactgtttttgtagtg

SEQ ID NO: 458626 - DNA, 22 bp, Homo sapiens
tgacttcagactctctcctctc

SEQ ID NO: 458627 - DNA, 17 bp, Homo sapiens
tgacttctttttggcat

SEQ ID NO: 458628 - DNA, 18 bp, Homo sapiens
tgagaaattgtgccaaag

SEQ ID NO: 458629 - DNA, 20 bp, Homo sapiens
tgagaagatgttaattactt

SEQ ID NO: 458630 - DNA, 16 bp, Homo sapiens
tgagaagggtgttgta

SEQ ID NO: 458631 - DNA, 19 bp, Homo sapiens
tgagaataaaaccagctat

SEQ ID NO: 458632 - DNA, 21 bp, Homo sapiens
tgagacagtgggggtgcctgg

SEQ ID NO: 458633 - DNA, 17 bp, Homo sapiens
tgagactcccgcctttg

SEQ ID NO: 458634 - DNA, 21 bp, Homo sapiens
tgagagaagccacgctgtcct

SEQ ID NO: 458635 - DNA, 14 bp, Homo sapiens
tgagagctgctcct

SEQ ID NO: 458636 - DNA, 18 bp, Homo sapiens
tctctccctaccctcttc

SEQ ID NO: 458637 - DNA, 23 bp, Homo sapiens
tctctccctaccctcttctcagc

SEQ ID NO: 458638 - DNA, 11 bp, Homo sapiens
tctctccctcc

SEQ ID NO: 458639 - DNA, 12 bp, Homo sapiens
tctctccctcca

SEQ ID NO: 458640 - DNA, 11 bp, Homo sapiens
tctctctccct

SEQ ID NO: 458641 - DNA, 14 bp, Homo sapiens
tctctctccctcca

SEQ ID NO: 458642 - DNA, 16 bp, Homo sapiens
tctctctctctctctg

SEQ ID NO: 458643 - DNA, 16 bp, Homo sapiens
tctctctctctctgtt

SEQ ID NO: 458644 - DNA, 13 bp, Homo sapiens
tctctctgtgtgg

SEQ ID NO: 458645 - DNA, 14 bp, Homo sapiens
tctctctgtgtggc

SEQ ID NO: 458646 - DNA, 21 bp, Homo sapiens
tctctctttccatctcccttg

SEQ ID NO: 458647 - DNA, 16 bp, Homo sapiens
tctctgagcagtgggg

SEQ ID NO: 458648 - DNA, 15 bp, Homo sapiens
tctctgattaaattt

SEQ ID NO: 458649 - DNA, 22 bp, Homo sapiens
tctctgattaaatttaatatac

SEQ ID NO: 458650 - DNA, 14 bp, Homo sapiens
tctctggggccctg

SEQ ID NO: 458651 - DNA, 22 bp, Homo sapiens
tctctggttgccaaatactcat

SEQ ID NO: 458652 - DNA, 16 bp, Homo sapiens
tctctgttccaagtgt

SEQ ID NO: 458653 - DNA, 23 bp, Homo sapiens
tctctgttccaagtgtgtgtgca

SEQ ID NO: 458654 - DNA, 15 bp, Homo sapiens
tctcttctccactgg

SEQ ID NO: 458655 - DNA, 16 bp, Homo sapiens
tctcttctccactgga

SEQ ID NO: 458656 - DNA, 19 bp, Homo sapiens
tctctttgaaaattcttgt

SEQ ID NO: 458657 - DNA, 17 bp, Homo sapiens
tctgaaaagaaatgcta

SEQ ID NO: 458658 - DNA, 14 bp, Homo sapiens
tctgaaaatatttt

SEQ ID NO: 458659 - DNA, 13 bp, Homo sapiens
tctgaaggcctcc

SEQ ID NO: 458660 - DNA, 15 bp, Homo sapiens
tctgaagtcactgca

SEQ ID NO: 458661 - DNA, 17 bp, Homo sapiens
tctgaagtcccttcctg

SEQ ID NO: 458662 - DNA, 15 bp, Homo sapiens
tctgaataatttctt

SEQ ID NO: 458663 - DNA, 12 bp, Homo sapiens
tctgagaagatt

SEQ ID NO: 458664 - DNA, 14 bp, Homo sapiens
tctgagcagtgggg

SEQ ID NO: 458665 - DNA, 18 bp, Homo sapiens
tctgagccctgccctcac

SEQ ID NO: 458666 - DNA, 20 bp, Homo sapiens
tctgagccctgccctcactc

SEQ ID NO: 458667 - DNA, 14 bp, Homo sapiens
tctgaggagtccaa

SEQ ID NO: 458668 - DNA, 16 bp, Homo sapiens
tctgaggagtccaaaa

SEQ ID NO: 458669 - DNA, 13 bp, Homo sapiens
tctgattctatgc

SEQ ID NO: 458670 - DNA, 16 bp, Homo sapiens
tctgattggacatttt

SEQ ID NO: 458671 - DNA, 21 bp, Homo sapiens
tctgattggacattttcttca

SEQ ID NO: 458672 - DNA, 16 bp, Homo sapiens
tctgcaaatagtttca

SEQ ID NO: 458673 - DNA, 14 bp, Homo sapiens
tctgcaataacagt

SEQ ID NO: 458674 - DNA, 18 bp, Homo sapiens
tctgcagcctgagctcca

SEQ ID NO: 458675 - DNA, 22 bp, Homo sapiens
tctgcagctatgcgcaatgtgg

SEQ ID NO: 458676 - DNA, 15 bp, Homo sapiens
tctgcatagacaaag

SEQ ID NO: 458677 - DNA, 23 bp, Homo sapiens
tctgcattactattaactctgca

SEQ ID NO: 458678 - DNA, 9 bp, Homo sapiens
tctgccccc

SEQ ID NO: 458679 - DNA, 22 bp, Homo sapiens
tctgccccctcccccgcagaca

SEQ ID NO: 458680 - DNA, 23 bp, Homo sapiens
tctgccccctcccccgcagacag

SEQ ID NO: 458681 - DNA, 12 bp, Homo sapiens
tctgcccctccg

SEQ ID NO: 458682 - DNA, 18 bp, Homo sapiens
tctgcctttgagcttctc

SEQ ID NO: 458683 - DNA, 17 bp, Homo sapiens
tctgctatgtctgtgat

SEQ ID NO: 458684 - DNA, 23 bp, Homo sapiens
tctgctccaacagacaccctcca

SEQ ID NO: 458685 - DNA, 15 bp, Homo sapiens
tctgctgcctctgaa

SEQ ID NO: 458686 - DNA, 17 bp, Homo sapiens
tctgctgcctctgaaaa

SEQ ID NO: 458687 - DNA, 14 bp, Homo sapiens
tctggaatgtgaag

SEQ ID NO: 458688 - DNA, 16 bp, Homo sapiens
tctggagcccctatcc

SEQ ID NO: 458689 - DNA, 13 bp, Homo sapiens
tctggagtctgaa

SEQ ID NO: 458690 - DNA, 15 bp, Homo sapiens
tctggagtctgaagg

SEQ ID NO: 458691 - DNA, 21 bp, Homo sapiens
tctggagtctgaaggagagga

SEQ ID NO: 458692 - DNA, 19 bp, Homo sapiens
tctggccttggttcctcca

SEQ ID NO: 458693 - DNA, 19 bp, Homo sapiens
tctggctgtggcccctcct

SEQ ID NO: 458694 - DNA, 13 bp, Homo sapiens
tctggcttctgca

SEQ ID NO: 458695 - DNA, 16 bp, Homo sapiens
tctggcttctgcatta

SEQ ID NO: 458696 - DNA, 18 bp, Homo sapiens
tctggggccctgggcctc

SEQ ID NO: 458697 - DNA, 19 bp, Homo sapiens
tctggggccctgggcctca

SEQ ID NO: 458698 - DNA, 20 bp, Homo sapiens
tctggggtggggcttggaag

SEQ ID NO: 458699 - DNA, 22 bp, Homo sapiens
tctgggttttagaaattctata

SEQ ID NO: 458700 - DNA, 22 bp, Homo sapiens
tctggtcagtgaagcccaggag

SEQ ID NO: 458701 - DNA, 23 bp, Homo sapiens
tctggtcagtgaagcccaggagg

SEQ ID NO: 458702 - DNA, 16 bp, Homo sapiens
tctggtggtttaatac

SEQ ID NO: 458703 - DNA, 13 bp, Homo sapiens
tctgtaaatttaa

SEQ ID NO: 458704 - DNA, 20 bp, Homo sapiens
tctgtagccaacttaaacct

SEQ ID NO: 458705 - DNA, 16 bp, Homo sapiens
tctgtatatcagctct

SEQ ID NO: 458706 - DNA, 19 bp, Homo sapiens
tctgtcaccagctatctgt

SEQ ID NO: 458707 - DNA, 20 bp, Homo sapiens
tctgtcagccagccgccctg

SEQ ID NO: 458708 - DNA, 13 bp, Homo sapiens
tctgtcatctctc

SEQ ID NO: 458709 - DNA, 18 bp, Homo sapiens
tctgtcatctctctgggg

SEQ ID NO: 458710 - DNA, 23 bp, Homo sapiens
tctgtcatctctctggggccctg

SEQ ID NO: 458711 - DNA, 20 bp, Homo sapiens
tctgtcattggttacaaatt

SEQ ID NO: 458712 - DNA, 21 bp, Homo sapiens
tctgtcattggttacaaattt

SEQ ID NO: 458713 - DNA, 16 bp, Homo sapiens
tctgtctgagccctgc

SEQ ID NO: 458714 - DNA, 17 bp, Homo sapiens
tctgtctgagccctgcc

SEQ ID NO: 458715 - DNA, 20 bp, Homo sapiens
tctgtctgagccctgccctc

SEQ ID NO: 458716 - DNA, 22 bp, Homo sapiens
tctgtctgagccctgccctcac

SEQ ID NO: 458717 - DNA, 14 bp, Homo sapiens
tctgtgagtctgtc

SEQ ID NO: 458718 - DNA, 17 bp, Homo sapiens
tctgtgggactggccca

SEQ ID NO: 458719 - DNA, 16 bp, Homo sapiens
tctgtgtaatctctga

SEQ ID NO: 458720 - DNA, 14 bp, Homo sapiens
tctgtgtcccagca

SEQ ID NO: 458721 - DNA, 17 bp, Homo sapiens
tctgtgtggcaaacatt

SEQ ID NO: 458722 - DNA, 18 bp, Homo sapiens
tctgtgtggcaaacattt

SEQ ID NO: 458723 - DNA, 19 bp, Homo sapiens
tctgtgtggcaaacattta

SEQ ID NO: 458724 - DNA, 22 bp, Homo sapiens
tctgttgctgtcctccagggcg

SEQ ID NO: 458725 - DNA, 16 bp, Homo sapiens
tctgtttaccctccct

SEQ ID NO: 458726 - DNA, 20 bp, Homo sapiens
tctgtttaccctccctgtcc

SEQ ID NO: 458727 - DNA, 24 bp, Homo sapiens
tctgtttaccctccctgtcccctg

SEQ ID NO: 458728 - DNA, 16 bp, Homo sapiens
tcttaaaatgtttcaa

SEQ ID NO: 458729 - DNA, 13 bp, Homo sapiens
tcttaccctttct

SEQ ID NO: 458730 - DNA, 14 bp, Homo sapiens
tcttaccctttctt

SEQ ID NO: 458731 - DNA, 16 bp, Homo sapiens
tcttcaaaatatcaag

SEQ ID NO: 458732 - DNA, 15 bp, Homo sapiens
tcttcaaccctgccc

SEQ ID NO: 458733 - DNA, 16 bp, Homo sapiens
tcttcaaccctgccct

SEQ ID NO: 458734 - DNA, 15 bp, Homo sapiens
gggcagcccctgctg

SEQ ID NO: 458735 - DNA, 16 bp, Homo sapiens
gggcagcccctgctgg

SEQ ID NO: 458736 - DNA, 20 bp, Homo sapiens
gggcagcccctgctggacca

SEQ ID NO: 458737 - DNA, 11 bp, Homo sapiens
gggcagggccg

SEQ ID NO: 458738 - DNA, 18 bp, Homo sapiens
gggcagggccgcagggcg

SEQ ID NO: 458739 - DNA, 20 bp, Homo sapiens
gggcagggccgcagggcgct

SEQ ID NO: 458740 - DNA, 17 bp, Homo sapiens
gggcagggttctagaag

SEQ ID NO: 458741 - DNA, 19 bp, Homo sapiens
gggcagtggagaggggact

SEQ ID NO: 458742 - DNA, 21 bp, Homo sapiens
gggcatagggtttggaagaaa

SEQ ID NO: 458743 - DNA, 21 bp, Homo sapiens
gggcatctgagtccagctccc

SEQ ID NO: 458744 - DNA, 15 bp, Homo sapiens
gggcatggccaggtg

SEQ ID NO: 458745 - DNA, 20 bp, Homo sapiens
gggcatggccaggtggccac

SEQ ID NO: 458746 - DNA, 22 bp, Homo sapiens
gggccaagccagggttccagac

SEQ ID NO: 458747 - DNA, 20 bp, Homo sapiens
gggccagagggactttgcct

SEQ ID NO: 458748 - DNA, 11 bp, Homo sapiens
gggcccagccg

SEQ ID NO: 458749 - DNA, 15 bp, Homo sapiens
gggcccatggcccca

SEQ ID NO: 458750 - DNA, 16 bp, Homo sapiens
gggcccatggccccag

SEQ ID NO: 458751 - DNA, 21 bp, Homo sapiens
gggcccatggccccagctggc

SEQ ID NO: 458752 - DNA, 12 bp, Homo sapiens
gggccctgggcc

SEQ ID NO: 458753 - DNA, 13 bp, Homo sapiens
gggccctgggcct

SEQ ID NO: 458754 - DNA, 18 bp, Homo sapiens
gggccctgggcctcagtt

SEQ ID NO: 458755 - DNA, 22 bp, Homo sapiens
gggccctggggtctctgagcag

SEQ ID NO: 458756 - DNA, 16 bp, Homo sapiens
gggccgcagggcgctc

SEQ ID NO: 458757 - DNA, 11 bp, Homo sapiens
gggccgcctcc

SEQ ID NO: 458758 - DNA, 13 bp, Homo sapiens
gggccgcctcctc

SEQ ID NO: 458759 - DNA, 20 bp, Homo sapiens
gggccgcctcctccagactc

SEQ ID NO: 458760 - DNA, 23 bp, Homo sapiens
gggccgggcaggtcctgcccatg

SEQ ID NO: 458761 - DNA, 13 bp, Homo sapiens
gggcctcccgtcc

SEQ ID NO: 458762 - DNA, 20 bp, Homo sapiens
gggcctcccgtccgtccgcc

SEQ ID NO: 458763 - DNA, 22 bp, Homo sapiens
gggcctggcagccgtgccttca

SEQ ID NO: 458764 - DNA, 17 bp, Homo sapiens
gggcgctccggcagagg

SEQ ID NO: 458765 - DNA, 20 bp, Homo sapiens
gggcgctccggcagaggcag

SEQ ID NO: 458766 - DNA, 16 bp, Homo sapiens
gggcgtgacttcagac

SEQ ID NO: 458767 - DNA, 16 bp, Homo sapiens
gggctaacgggcgcct

SEQ ID NO: 458768 - DNA, 20 bp, Homo sapiens
gggctaactggccccaggcg

SEQ ID NO: 458769 - DNA, 12 bp, Homo sapiens
gggctgagcccc

SEQ ID NO: 458770 - DNA, 18 bp, Homo sapiens
gggctgagcccctcctct

SEQ ID NO: 458771 - DNA, 18 bp, Homo sapiens
tcaaaatgcatgtgattg

SEQ ID NO: 458772 - DNA, 13 bp, Homo sapiens
tcaaacactgctt

SEQ ID NO: 458773 - DNA, 14 bp, Homo sapiens
tcaaacagtgtggc

SEQ ID NO: 458774 - DNA, 17 bp, Homo sapiens
tcaaagaaaacagacca

SEQ ID NO: 458775 - DNA, 19 bp, Homo sapiens
tcaaagaggccagtacttt

SEQ ID NO: 458776 - DNA, 20 bp, Homo sapiens
tcaaagaggccagtactttg

SEQ ID NO: 458777 - DNA, 11 bp, Homo sapiens
tcaaatgcatg

SEQ ID NO: 458778 - DNA, 18 bp, Homo sapiens
tcaacacttattttctga

SEQ ID NO: 458779 - DNA, 18 bp, Homo sapiens
tcaaccattccccatggg

SEQ ID NO: 458780 - DNA, 13 bp, Homo sapiens
tcaaccctgccct

SEQ ID NO: 458781 - DNA, 20 bp, Homo sapiens
tcaacttcagttgaaaagag

SEQ ID NO: 458782 - DNA, 16 bp, Homo sapiens
tcaagaacaaacagaa

SEQ ID NO: 458783 - DNA, 17 bp, Homo sapiens
tcaagactcaatgtgga

SEQ ID NO: 458784 - DNA, 18 bp, Homo sapiens
tcaagccaggagaccctg

SEQ ID NO: 458785 - DNA, 15 bp, Homo sapiens
tcaataaaggtcata

SEQ ID NO: 458786 - DNA, 20 bp, Homo sapiens
tcaataaaggtcatattgga

SEQ ID NO: 458787 - DNA, 21 bp, Homo sapiens
tcaatacttttgtgtattctg

SEQ ID NO: 458788 - DNA, 21 bp, Homo sapiens
tcaatcattttgggaaattct

SEQ ID NO: 458789 - DNA, 13 bp, Homo sapiens
tcaatgtactgta

SEQ ID NO: 458790 - DNA, 12 bp, Homo sapiens
tcaatgtgaaat

SEQ ID NO: 458791 - DNA, 22 bp, Homo sapiens
tcaatgtggaaaaaatatttta

SEQ ID NO: 458792 - DNA, 15 bp, Homo sapiens
tcaatttttaactta

SEQ ID NO: 458793 - DNA, 22 bp, Homo sapiens
tcaatttttaacttatctccag

SEQ ID NO: 458794 - DNA, 17 bp, Homo sapiens
tcacaattctctgattt

SEQ ID NO: 458795 - DNA, 18 bp, Homo sapiens
tcacactctcttcttact

SEQ ID NO: 458796 - DNA, 21 bp, Homo sapiens
tcacagatgggtattaaactt

SEQ ID NO: 458797 - DNA, 22 bp, Homo sapiens
tcacagatgggtattaaacttg

SEQ ID NO: 458798 - DNA, 16 bp, Homo sapiens
tcacagccgtttgaat

SEQ ID NO: 458799 - DNA, 18 bp, Homo sapiens
tcacagggtgttggaaga

SEQ ID NO: 458800 - DNA, 12 bp, Homo sapiens
tcacatctgtat

SEQ ID NO: 458801 - DNA, 14 bp, Homo sapiens
tcacatctgtatat

SEQ ID NO: 458802 - DNA, 12 bp, Homo sapiens
tcaccaaaatat

SEQ ID NO: 458803 - DNA, 18 bp, Homo sapiens
tcaccagctatctgtcat

SEQ ID NO: 458804 - DNA, 14 bp, Homo sapiens
tcacctagctgctc

SEQ ID NO: 458805 - DNA, 15 bp, Homo sapiens
tcaccttcgcctttg

SEQ ID NO: 458806 - DNA, 14 bp, Homo sapiens
tcaccttctgtttt

SEQ ID NO: 458807 - DNA, 21 bp, Homo sapiens
tcacgctgacagcctcctagg

SEQ ID NO: 458808 - DNA, 16 bp, Homo sapiens
tcacgtctgtgagtct

SEQ ID NO: 458809 - DNA, 22 bp, Homo sapiens
tcacgtctgtgagtctgtcctt

SEQ ID NO: 458810 - DNA, 22 bp, Homo sapiens
tcactatggtatgctggccagc

SEQ ID NO: 458811 - DNA, 17 bp, Homo sapiens
tcactccactcccctca

SEQ ID NO: 458812 - DNA, 19 bp, Homo sapiens
tcactccctttgtggactt

SEQ ID NO: 458813 - DNA, 17 bp, Homo sapiens
tcactctacccccaaca

SEQ ID NO: 458814 - DNA, 13 bp, Homo sapiens
tcactctgtcagc

SEQ ID NO: 458815 - DNA, 23 bp, Homo sapiens
tcactctgtcagccagccgccct

SEQ ID NO: 458816 - DNA, 22 bp, Homo sapiens
tcactgcacagtgcatctcagc

SEQ ID NO: 458817 - DNA, 24 bp, Homo sapiens
tcactgcacagtgcatctcagccc

SEQ ID NO: 458818 - DNA, 18 bp, Homo sapiens
tcactgctggctgcctta

SEQ ID NO: 458819 - DNA, 21 bp, Homo sapiens
tcacttaaactttgtcacttc

SEQ ID NO: 458820 - DNA, 14 bp, Homo sapiens
tcacttctgctgta

SEQ ID NO: 458821 - DNA, 21 bp, Homo sapiens
tcagaaagggcagcccctccc

SEQ ID NO: 458822 - DNA, 15 bp, Homo sapiens
tcagactctctcctc

SEQ ID NO: 458823 - DNA, 13 bp, Homo sapiens
tcagaggccgctc

SEQ ID NO: 458824 - DNA, 17 bp, Homo sapiens
tcagaggccgctctggg

SEQ ID NO: 458825 - DNA, 14 bp, Homo sapiens
tcagcaaattcttg

SEQ ID NO: 458826 - DNA, 20 bp, Homo sapiens
tcagcaaattcttgaataaa

SEQ ID NO: 458827 - DNA, 11 bp, Homo sapiens
tcagcaaccct

SEQ ID NO: 458828 - DNA, 21 bp, Homo sapiens
tcagcaaccctacagtatata

SEQ ID NO: 458829 - DNA, 14 bp, Homo sapiens
tcagcagacactcc

SEQ ID NO: 458830 - DNA, 15 bp, Homo sapiens
tcagcagacactcca

SEQ ID NO: 458831 - DNA, 17 bp, Homo sapiens
tcagcagacactccagt

SEQ ID NO: 458832 - DNA, 19 bp, Homo sapiens
tcagcatagagctatatat

SEQ ID NO: 458833 - DNA, 23 bp, Homo sapiens
tcagcattcaaaatagttctatt

SEQ ID NO: 458834 - DNA, 17 bp, Homo sapiens
tcagcattctcactcct

SEQ ID NO: 458835 - DNA, 20 bp, Homo sapiens
tcagcattctcactcctacc

SEQ ID NO: 458836 - DNA, 23 bp, Homo sapiens
tcagcattctcactcctacctgg

SEQ ID NO: 458837 - DNA, 17 bp, Homo sapiens
tcagccctccctgcccc

SEQ ID NO: 458838 - DNA, 19 bp, Homo sapiens
tcagccctccctgcccctc

SEQ ID NO: 458839 - DNA, 13 bp, Homo sapiens
tcagctccactct

SEQ ID NO: 458840 - DNA, 16 bp, Homo sapiens
tcagctccactctgaa

SEQ ID NO: 458841 - DNA, 21 bp, Homo sapiens
tcagctccactctgaagtccc

SEQ ID NO: 458842 - DNA, 14 bp, Homo sapiens
tcagctctgcataa

SEQ ID NO: 458843 - DNA, 20 bp, Homo sapiens
tcagctgtttcgcatccacc

SEQ ID NO: 458844 - DNA, 22 bp, Homo sapiens
tcagctgtttcgcatccaccgc

SEQ ID NO: 458845 - DNA, 23 bp, Homo sapiens
tcagctgtttcgcatccaccgcc

SEQ ID NO: 458846 - DNA, 20 bp, Homo sapiens
tcagcttgtttctatactgt

SEQ ID NO: 458847 - DNA, 22 bp, Homo sapiens
tcaggaatgggccaagccaggg

SEQ ID NO: 458848 - DNA, 22 bp, Homo sapiens
tcagggtacaggaaaaaacatt

SEQ ID NO: 458849 - DNA, 13 bp, Homo sapiens
tcaggttcctcct

SEQ ID NO: 458850 - DNA, 14 bp, Homo sapiens
tcaggttcctccta

SEQ ID NO: 458851 - DNA, 22 bp, Homo sapiens
tcaggttgtctgaagtcactgc

SEQ ID NO: 458852 - DNA, 14 bp, Homo sapiens
tcagtacagggcag

SEQ ID NO: 458853 - DNA, 15 bp, Homo sapiens
tcagtacagggcagg

SEQ ID NO: 458854 - DNA, 23 bp, Homo sapiens
tcagtctttgggggattcaaatg

SEQ ID NO: 458855 - DNA, 19 bp, Homo sapiens
tcagtgaagcccaggagga

SEQ ID NO: 458856 - DNA, 22 bp, Homo sapiens
tcagttcaacctggtggcacca

SEQ ID NO: 458857 - DNA, 15 bp, Homo sapiens
tcagttctcatcttg

SEQ ID NO: 458858 - DNA, 13 bp, Homo sapiens
tcagtttctctgg

SEQ ID NO: 458859 - DNA, 21 bp, Homo sapiens
tcataaacaacttaatgttct

SEQ ID NO: 458860 - DNA, 16 bp, Homo sapiens
tccttctcccctccag

SEQ ID NO: 458861 - DNA, 17 bp, Homo sapiens
tccttctcccctccaga

SEQ ID NO: 458862 - DNA, 14 bp, Homo sapiens
tccttctgacccca

SEQ ID NO: 458863 - DNA, 15 bp, Homo sapiens
tccttgcacttctgt

SEQ ID NO: 458864 - DNA, 14 bp, Homo sapiens
tccttgctttctct

SEQ ID NO: 458865 - DNA, 19 bp, Homo sapiens
tcctttcacaaccttctgt

SEQ ID NO: 458866 - DNA, 19 bp, Homo sapiens
tcctttctaaggagcacta

SEQ ID NO: 458867 - DNA, 16 bp, Homo sapiens
tccttttgtatcctcc

SEQ ID NO: 458868 - DNA, 18 bp, Homo sapiens
tcctttttctttttttaa

SEQ ID NO: 458869 - DNA, 22 bp, Homo sapiens
tcgagagggctgagcccctcct

SEQ ID NO: 458870 - DNA, 13 bp, Homo sapiens
tcgagtcccccca

SEQ ID NO: 458871 - DNA, 17 bp, Homo sapiens
tcgagtccccccacccc

SEQ ID NO: 458872 - DNA, 13 bp, Homo sapiens
tcgccccaggccc

SEQ ID NO: 458873 - DNA, 20 bp, Homo sapiens
tcgccccaggccctccctga

SEQ ID NO: 458874 - DNA, 13 bp, Homo sapiens
tcgcccctcctcg

SEQ ID NO: 458875 - DNA, 14 bp, Homo sapiens
tcgcccctcctcgg

SEQ ID NO: 458876 - DNA, 12 bp, Homo sapiens
tcgctggaaaac

SEQ ID NO: 458877 - DNA, 19 bp, Homo sapiens
tcggaggctgggcccctgg

SEQ ID NO: 458878 - DNA, 17 bp, Homo sapiens
tcggccccacccaccct

SEQ ID NO: 458879 - DNA, 13 bp, Homo sapiens
tcggctgggcagg

SEQ ID NO: 458880 - DNA, 15 bp, Homo sapiens
tcgggccgcctcctc

SEQ ID NO: 458881 - DNA, 17 bp, Homo sapiens
tcgggccgcctcctcca

SEQ ID NO: 458882 - DNA, 18 bp, Homo sapiens
tcgggggaggagcacccc

SEQ ID NO: 458883 - DNA, 23 bp, Homo sapiens
tcggtgttttgcaaacatttctt

SEQ ID NO: 458884 - DNA, 21 bp, Homo sapiens
tcggttcaagttgatgtgaca

SEQ ID NO: 458885 - DNA, 17 bp, Homo sapiens
tcgtccggcctgcagcc

SEQ ID NO: 458886 - DNA, 20 bp, Homo sapiens
tcgtccggcctgcagcccag

SEQ ID NO: 458887 - DNA, 22 bp, Homo sapiens
tcgtccggcctgcagcccagaa

SEQ ID NO: 458888 - DNA, 16 bp, Homo sapiens
tctaaaaaataactgt

SEQ ID NO: 458889 - DNA, 16 bp, Homo sapiens
tctaaaaggaggacag

SEQ ID NO: 458890 - DNA, 22 bp, Homo sapiens
tctaaaatactcaccaaaatat

SEQ ID NO: 458891 - DNA, 12 bp, Homo sapiens
tctaaaattcta

SEQ ID NO: 458892 - DNA, 20 bp, Homo sapiens
tctaaagcagagatgtatta

SEQ ID NO: 458893 - DNA, 16 bp, Homo sapiens
tctaactagtaatctt

SEQ ID NO: 458894 - DNA, 19 bp, Homo sapiens
tctaagcttatttctaact

SEQ ID NO: 458895 - DNA, 20 bp, Homo sapiens
tctaagcttatttctaacta

SEQ ID NO: 458896 - DNA, 20 bp, Homo sapiens
tctaagtcagtttcacatat

SEQ ID NO: 458897 - DNA, 14 bp, Homo sapiens
tctacaacataatg

SEQ ID NO: 458898 - DNA, 23 bp, Homo sapiens
tctacagctaatcagcattctca

SEQ ID NO: 458899 - DNA, 11 bp, Homo sapiens
tctacaggcat

SEQ ID NO: 458900 - DNA, 21 bp, Homo sapiens
tctacccccaacaccacccct

SEQ ID NO: 458901 - DNA, 23 bp, Homo sapiens
tctactgcttggatccatacaaa

SEQ ID NO: 458902 - DNA, 14 bp, Homo sapiens
tctactttataatc

SEQ ID NO: 458903 - DNA, 13 bp, Homo sapiens
tctagaaggggcg

SEQ ID NO: 458904 - DNA, 16 bp, Homo sapiens
tctagaaggggcgagg

SEQ ID NO: 458905 - DNA, 14 bp, Homo sapiens
tctagcaagaagat

SEQ ID NO: 458906 - DNA, 19 bp, Homo sapiens
tctagcaagaagattctaa

SEQ ID NO: 458907 - DNA, 12 bp, Homo sapiens
tctagctataac

SEQ ID NO: 458908 - DNA, 21 bp, Homo sapiens
tctagtcaactgctgttttat

SEQ ID NO: 458909 - DNA, 23 bp, Homo sapiens
tctagtcctggatgactcggtct

SEQ ID NO: 458910 - DNA, 12 bp, Homo sapiens
tctagtctctga

SEQ ID NO: 458911 - DNA, 16 bp, Homo sapiens
tctagtctctgatttg

SEQ ID NO: 458912 - DNA, 11 bp, Homo sapiens
tctatatttca

SEQ ID NO: 458913 - DNA, 21 bp, Homo sapiens
tctatatttcatattgagatc

SEQ ID NO: 458914 - DNA, 18 bp, Homo sapiens
tctatgcctgtatttcca

SEQ ID NO: 458915 - DNA, 14 bp, Homo sapiens
tctatggattcact

SEQ ID NO: 458916 - DNA, 22 bp, Homo sapiens
tctatggattcacttctattta

SEQ ID NO: 458917 - DNA, 13 bp, Homo sapiens
tctattaaaagcc

SEQ ID NO: 458918 - DNA, 15 bp, Homo sapiens
tctattatctgggtt

SEQ ID NO: 458919 - DNA, 19 bp, Homo sapiens
tctattgtagcatttcttg

SEQ ID NO: 458920 - DNA, 20 bp, Homo sapiens
tctattgtagcatttcttga

SEQ ID NO: 458921 - DNA, 19 bp, Homo sapiens
tctatttatctgtctgagc

SEQ ID NO: 458922 - DNA, 13 bp, Homo sapiens
tctatttctatct

SEQ ID NO: 458923 - DNA, 17 bp, Homo sapiens
tctcaccttcgcctttg

SEQ ID NO: 458924 - DNA, 20 bp, Homo sapiens
tctcaccttcgcctttgctg

SEQ ID NO: 458925 - DNA, 13 bp, Homo sapiens
tctcactcctacc

SEQ ID NO: 458926 - DNA, 16 bp, Homo sapiens
tctcagatccctcggt

SEQ ID NO: 458927 - DNA, 13 bp, Homo sapiens
tctcagctccact

SEQ ID NO: 458928 - DNA, 20 bp, Homo sapiens
tctcagctccactctgaagt

SEQ ID NO: 458929 - DNA, 23 bp, Homo sapiens
tctcatcttgtaaataatgctta

SEQ ID NO: 458930 - DNA, 18 bp, Homo sapiens
tctcatgcatagacaagt

SEQ ID NO: 458931 - DNA, 13 bp, Homo sapiens
tctccacccctca

SEQ ID NO: 458932 - DNA, 17 bp, Homo sapiens
tctccacccctcaagcc

SEQ ID NO: 458933 - DNA, 16 bp, Homo sapiens
tctccagccaatttca

SEQ ID NO: 458934 - DNA, 21 bp, Homo sapiens
tctcccaaataaactccttaa

SEQ ID NO: 458935 - DNA, 19 bp, Homo sapiens
tctcccatgggggctccag

SEQ ID NO: 458936 - DNA, 20 bp, Homo sapiens
tctccccgcagccctctcca

SEQ ID NO: 458937 - DNA, 16 bp, Homo sapiens
tctccccgctctggat

SEQ ID NO: 458938 - DNA, 12 bp, Homo sapiens
tctcccctccag

SEQ ID NO: 458939 - DNA, 14 bp, Homo sapiens
tctcccctccagac

SEQ ID NO: 458940 - DNA, 15 bp, Homo sapiens
tctcccctccagacc

SEQ ID NO: 458941 - DNA, 16 bp, Homo sapiens
tctcccctccagaccc

SEQ ID NO: 458942 - DNA, 15 bp, Homo sapiens
tctccctccactcct

SEQ ID NO: 458943 - DNA, 20 bp, Homo sapiens
tctccctccactcctcccaa

SEQ ID NO: 458944 - DNA, 16 bp, Homo sapiens
tctccgggtgtggcct

SEQ ID NO: 458945 - DNA, 19 bp, Homo sapiens
tctccgggtgtggcctcag

SEQ ID NO: 458946 - DNA, 18 bp, Homo sapiens
tctcctcgtccggcctgc

SEQ ID NO: 458947 - DNA, 21 bp, Homo sapiens
tctcctcgtccggcctgcagc

SEQ ID NO: 458948 - DNA, 15 bp, Homo sapiens
tctcctctctctccc

SEQ ID NO: 458949 - DNA, 19 bp, Homo sapiens
tctcctctctctccctcca

SEQ ID NO: 458950 - DNA, 11 bp, Homo sapiens
tctcctctgct

SEQ ID NO: 458951 - DNA, 17 bp, Homo sapiens
tctccttcactctgaca

SEQ ID NO: 458952 - DNA, 16 bp, Homo sapiens
tctcctttcacaacct

SEQ ID NO: 458953 - DNA, 14 bp, Homo sapiens
tctcgggtgcattt

SEQ ID NO: 458954 - DNA, 17 bp, Homo sapiens
tctctaaaattctagtc

SEQ ID NO: 458955 - DNA, 18 bp, Homo sapiens
tctctccccatatataaa

SEQ ID NO: 458956 - DNA, 20 bp, Homo sapiens
tctctccccatatataaatt

SEQ ID NO: 458957 - DNA, 23 bp, Homo sapiens
tctctccccatatataaattatt

SEQ ID NO: 458958 - DNA, 12 bp, Homo sapiens
gtgcgctgtgct

SEQ ID NO: 458959 - DNA, 21 bp, Homo sapiens
gtgcgctgtgctccagcagtg

SEQ ID NO: 458960 - DNA, 17 bp, Homo sapiens
gtgcggaccggagcggc

SEQ ID NO: 458961 - DNA, 17 bp, Homo sapiens
gtgcggcccgtgcgcag

SEQ ID NO: 458962 - DNA, 21 bp, Homo sapiens
gtgcggcccgtgcgcagccgc

SEQ ID NO: 458963 - DNA, 22 bp, Homo sapiens
gtgcgtgaccggcccgccacct

SEQ ID NO: 458964 - DNA, 18 bp, Homo sapiens
gtgcgtgtggccctgtgg

SEQ ID NO: 458965 - DNA, 21 bp, Homo sapiens
gtgcgtgtggccctgtgggag

SEQ ID NO: 458966 - DNA, 17 bp, Homo sapiens
gtgctccagcagtgctg

SEQ ID NO: 458967 - DNA, 21 bp, Homo sapiens
gtgctccagcagtgctgggcc

SEQ ID NO: 458968 - DNA, 23 bp, Homo sapiens
gtgctccagcagtgctgggccca

SEQ ID NO: 458969 - DNA, 15 bp, Homo sapiens
tactggaaataacct

SEQ ID NO: 458970 - DNA, 23 bp, Homo sapiens
tactggttatagttgatatgtaa

SEQ ID NO: 458971 - DNA, 15 bp, Homo sapiens
tactgtcagagaata

SEQ ID NO: 458972 - DNA, 10 bp, Homo sapiens
tactgttctt

SEQ ID NO: 458973 - DNA, 12 bp, Homo sapiens
tactgtttgtaa

SEQ ID NO: 458974 - DNA, 22 bp, Homo sapiens
tacttacactgaaatccaaaat

SEQ ID NO: 458975 - DNA, 19 bp, Homo sapiens
tacttcacactgaactcag

SEQ ID NO: 458976 - DNA, 16 bp, Homo sapiens
tacttcagttctcatc

SEQ ID NO: 458977 - DNA, 17 bp, Homo sapiens
tacttcctggattttct

SEQ ID NO: 458978 - DNA, 16 bp, Homo sapiens
tactttaaattatatg

SEQ ID NO: 458979 - DNA, 17 bp, Homo sapiens
tactttaaattatatga

SEQ ID NO: 458980 - DNA, 19 bp, Homo sapiens
tactttataatcaagacaa

SEQ ID NO: 458981 - DNA, 15 bp, Homo sapiens
tactttgtgcaatat

SEQ ID NO: 458982 - DNA, 19 bp, Homo sapiens
tagaactgttcatttccac

SEQ ID NO: 458983 - DNA, 21 bp, Homo sapiens
tagaactgttcatttccacca

SEQ ID NO: 458984 - DNA, 14 bp, Homo sapiens
tagaagaaaacccg

SEQ ID NO: 458985 - DNA, 19 bp, Homo sapiens
tagaatgagaaatcatgtt

SEQ ID NO: 458986 - DNA, 13 bp, Homo sapiens
tagaatggggctt

SEQ ID NO: 458987 - DNA, 18 bp, Homo sapiens
tagacaaaggccttaaca

SEQ ID NO: 458988 - DNA, 13 bp, Homo sapiens
tagactgaattta

SEQ ID NO: 458989 - DNA, 16 bp, Homo sapiens
tagactgaatttaact

SEQ ID NO: 458990 - DNA, 14 bp, Homo sapiens
tagatgctgactgt

SEQ ID NO: 458991 - DNA, 16 bp, Homo sapiens
tagcaagaagattcta

SEQ ID NO: 458992 - DNA, 17 bp, Homo sapiens
tagcaagaagattctaa

SEQ ID NO: 458993 - DNA, 18 bp, Homo sapiens
tagcaagaagattctaaa

SEQ ID NO: 458994 - DNA, 20 bp, Homo sapiens
tagcaatatgttagcaagag

SEQ ID NO: 458995 - DNA, 16 bp, Homo sapiens
tagcacttgacctttt

SEQ ID NO: 458996 - DNA, 13 bp, Homo sapiens
tagcatataaatg

SEQ ID NO: 458997 - DNA, 15 bp, Homo sapiens
tagcatataaatgtt

SEQ ID NO: 458998 - DNA, 21 bp, Homo sapiens
tagcatataaatgtttatatt

SEQ ID NO: 458999 - DNA, 18 bp, Homo sapiens
tagcatcctgattattga

SEQ ID NO: 459000 - DNA, 12 bp, Homo sapiens
tagcatttcttg

SEQ ID NO: 459001 - DNA, 17 bp, Homo sapiens
tagccaacttaaacctg

SEQ ID NO: 459002 - DNA, 22 bp, Homo sapiens
tagccaacttaaacctgtgctt

SEQ ID NO: 459003 - DNA, 17 bp, Homo sapiens
tagccagaggctctaat

SEQ ID NO: 459004 - DNA, 16 bp, Homo sapiens
tagccattcatttaca

SEQ ID NO: 459005 - DNA, 21 bp, Homo sapiens
tagcccacaataatgaataat

SEQ ID NO: 459006 - DNA, 18 bp, Homo sapiens
tagccctctttctctctg

SEQ ID NO: 459007 - DNA, 19 bp, Homo sapiens
tagccctctttctctctgt

SEQ ID NO: 459008 - DNA, 21 bp, Homo sapiens
tagccctctttctctctgtgt

SEQ ID NO: 459009 - DNA, 13 bp, Homo sapiens
tagctagaatatc

SEQ ID NO: 459010 - DNA, 17 bp, Homo sapiens
tagctagaatatcctat

SEQ ID NO: 459011 - DNA, 21 bp, Homo sapiens
tagctgttttgaataacatag

SEQ ID NO: 459012 - DNA, 15 bp, Homo sapiens
taggaaataaatcta

SEQ ID NO: 459013 - DNA, 22 bp, Homo sapiens
taggacccaaggtggtcttgga

SEQ ID NO: 459014 - DNA, 17 bp, Homo sapiens
taggagcttccagatgg

SEQ ID NO: 459015 - DNA, 18 bp, Homo sapiens
taggcgctcagaggccgc

SEQ ID NO: 459016 - DNA, 17 bp, Homo sapiens
tagggaaatccaactcc

SEQ ID NO: 459017 - DNA, 20 bp, Homo sapiens
tagggaagaaaactatcctg

SEQ ID NO: 459018 - DNA, 11 bp, Homo sapiens
taggggtgggg

SEQ ID NO: 459019 - DNA, 20 bp, Homo sapiens
taggggtgggggagaatggc

SEQ ID NO: 459020 - DNA, 20 bp, Homo sapiens
taggtctccacccctcaagc

SEQ ID NO: 459021 - DNA, 17 bp, Homo sapiens
taggtctgaaggcctcc

SEQ ID NO: 459022 - DNA, 23 bp, Homo sapiens
taggtgcccagtcttgagtgggc

SEQ ID NO: 459023 - DNA, 16 bp, Homo sapiens
taggtgggtcttggat

SEQ ID NO: 459024 - DNA, 16 bp, Homo sapiens
taggttaataggagga

SEQ ID NO: 459025 - DNA, 19 bp, Homo sapiens
taggttaataggaggacag

SEQ ID NO: 459026 - DNA, 21 bp, Homo sapiens
tagtatttttactattataat

SEQ ID NO: 459027 - DNA, 17 bp, Homo sapiens
tagtcatgtttctgcag

SEQ ID NO: 459028 - DNA, 15 bp, Homo sapiens
tagtctttgtttaca

SEQ ID NO: 459029 - DNA, 17 bp, Homo sapiens
tagtctttgtttacatg

SEQ ID NO: 459030 - DNA, 14 bp, Homo sapiens
tagtgatggttccc

SEQ ID NO: 459031 - DNA, 15 bp, Homo sapiens
tagtgtcccttacct

SEQ ID NO: 459032 - DNA, 16 bp, Homo sapiens
tagttccattctatga

SEQ ID NO: 459033 - DNA, 18 bp, Homo sapiens
tagttccattctatgact

SEQ ID NO: 459034 - DNA, 15 bp, Homo sapiens
tagttctatttctat

SEQ ID NO: 459035 - DNA, 16 bp, Homo sapiens
tagttctatttctatc

SEQ ID NO: 459036 - DNA, 11 bp, Homo sapiens
tagttctgcaa

SEQ ID NO: 459037 - DNA, 20 bp, Homo sapiens
tagttgaacaagatttccct

SEQ ID NO: 459038 - DNA, 22 bp, Homo sapiens
tagtttattatagtctgtactt

SEQ ID NO: 459039 - DNA, 16 bp, Homo sapiens
tagtttgcatacttcc

SEQ ID NO: 459040 - DNA, 18 bp, Homo sapiens
tataaaagactgtcttaa

SEQ ID NO: 459041 - DNA, 12 bp, Homo sapiens
tataaatatcta

SEQ ID NO: 459042 - DNA, 17 bp, Homo sapiens
tataaatgtttatattg

SEQ ID NO: 459043 - DNA, 18 bp, Homo sapiens
tataaatgtttatattgt

SEQ ID NO: 459044 - DNA, 19 bp, Homo sapiens
tataaatgtttatattgtt

SEQ ID NO: 459045 - DNA, 15 bp, Homo sapiens
tataaattattactt

SEQ ID NO: 459046 - DNA, 16 bp, Homo sapiens
tataaattattacttt

SEQ ID NO: 459047 - DNA, 18 bp, Homo sapiens
tataacaagccaaacatt

SEQ ID NO: 459048 - DNA, 14 bp, Homo sapiens
tatacaaagctgtc

SEQ ID NO: 459049 - DNA, 22 bp, Homo sapiens
tatacaaagctgtcactcacaa

SEQ ID NO: 459050 - DNA, 11 bp, Homo sapiens
tatacagacct

SEQ ID NO: 459051 - DNA, 22 bp, Homo sapiens
tatacagtttttgtaaccatat

SEQ ID NO: 459052 - DNA, 22 bp, Homo sapiens
tatactgcatatcctggtgtct

SEQ ID NO: 459053 - DNA, 19 bp, Homo sapiens
tatactggttatagttgat

SEQ ID NO: 459054 - DNA, 22 bp, Homo sapiens
tatagtggccacactctgcctt

SEQ ID NO: 459055 - DNA, 22 bp, Homo sapiens
tatagttaattgtggctttatg

SEQ ID NO: 459056 - DNA, 12 bp, Homo sapiens
tatataaattat

SEQ ID NO: 459057 - DNA, 15 bp, Homo sapiens
tatataaattattac

SEQ ID NO: 459058 - DNA, 18 bp, Homo sapiens
tatatacaaagctgtcac

SEQ ID NO: 459059 - DNA, 13 bp, Homo sapiens
tatatataaatat

SEQ ID NO: 459060 - DNA, 14 bp, Homo sapiens
tatatataaatatc

SEQ ID NO: 459061 - DNA, 14 bp, Homo sapiens
tatatatatatgta

SEQ ID NO: 459062 - DNA, 16 bp, Homo sapiens
tatatatatatgtata

SEQ ID NO: 459063 - DNA, 18 bp, Homo sapiens
tatatattataagttgac

SEQ ID NO: 459064 - DNA, 13 bp, Homo sapiens
tatatattatata

SEQ ID NO: 459065 - DNA, 22 bp, Homo sapiens
tatatatttattattttcatat

SEQ ID NO: 459066 - DNA, 16 bp, Homo sapiens
tatatcagctctaaag

SEQ ID NO: 459067 - DNA, 20 bp, Homo sapiens
tcaaaatagttctatttcta

SEQ ID NO: 459068 - DNA, 21 bp, Homo sapiens
tcaaaatagttctatttctat

SEQ ID NO: 459069 - DNA, 13 bp, Homo sapiens
tcaaaatgcatgt

SEQ ID NO: 459070 - DNA, 15 bp, Homo sapiens
tcaaaatgcatgtga

SEQ ID NO: 459071 - DNA, 14 bp, Homo sapiens
ggccgcctcctcca

SEQ ID NO: 459072 - DNA, 23 bp, Homo sapiens
ggccggtccaccccgtcccggcc

SEQ ID NO: 459073 - DNA, 13 bp, Homo sapiens
ggccgtgtctctg

SEQ ID NO: 459074 - DNA, 18 bp, Homo sapiens
ggccgtgtctctgaggac

SEQ ID NO: 459075 - DNA, 10 bp, Homo sapiens
ggcctcagcc

SEQ ID NO: 459076 - DNA, 14 bp, Homo sapiens
ggcctcagccctca

SEQ ID NO: 459077 - DNA, 21 bp, Homo sapiens
ggcctcccgtccgtccgcccg

SEQ ID NO: 459078 - DNA, 14 bp, Homo sapiens
ggcctcgtgccatg

SEQ ID NO: 459079 - DNA, 14 bp, Homo sapiens
ggcctgagaagagt

SEQ ID NO: 459080 - DNA, 18 bp, Homo sapiens
ggcctgagggaagcccac

SEQ ID NO: 459081 - DNA, 19 bp, Homo sapiens
ggcctgagggaagcccacc

SEQ ID NO: 459082 - DNA, 18 bp, Homo sapiens
ggcctgccccccttccca

SEQ ID NO: 459083 - DNA, 14 bp, Homo sapiens
ggcctggcagccgt

SEQ ID NO: 459084 - DNA, 15 bp, Homo sapiens
ggcctggcagccgtg

SEQ ID NO: 459085 - DNA, 16 bp, Homo sapiens
ggcctggcctatttaa

SEQ ID NO: 459086 - DNA, 20 bp, Homo sapiens
ggcctggcctatttaagccc

SEQ ID NO: 459087 - DNA, 15 bp, Homo sapiens
ggccttagaaaacat

SEQ ID NO: 459088 - DNA, 12 bp, Homo sapiens
ggcgcccacctg

SEQ ID NO: 459089 - DNA, 14 bp, Homo sapiens
ggcgcccacctgcc

SEQ ID NO: 459090 - DNA, 19 bp, Homo sapiens
ggcgcctgcgctcctctgc

SEQ ID NO: 459091 - DNA, 24 bp, Homo sapiens
ggcgcctgcgctcctctgcagcct

SEQ ID NO: 459092 - DNA, 17 bp, Homo sapiens
ggcgctccggcagaggc

SEQ ID NO: 459093 - DNA, 21 bp, Homo sapiens
ggcgctccggcagaggcaggg

SEQ ID NO: 459094 - DNA, 15 bp, Homo sapiens
ggcggaggggcttgg

SEQ ID NO: 459095 - DNA, 16 bp, Homo sapiens
ggcggaggggcttgga

SEQ ID NO: 459096 - DNA, 19 bp, Homo sapiens
ggcggaggggcttggagca

SEQ ID NO: 459097 - DNA, 23 bp, Homo sapiens
ggcggccagggacccccgaggcc

SEQ ID NO: 459098 - DNA, 14 bp, Homo sapiens
ggcgggcagcccct

SEQ ID NO: 459099 - DNA, 18 bp, Homo sapiens
ggcgggcagcccctgctg

SEQ ID NO: 459100 - DNA, 22 bp, Homo sapiens
ggcgggcagcccctgctggacc

SEQ ID NO: 459101 - DNA, 17 bp, Homo sapiens
ggcgtgggatccagaga

SEQ ID NO: 459102 - DNA, 18 bp, Homo sapiens
ggcgtgggatccagagag

SEQ ID NO: 459103 - DNA, 14 bp, Homo sapiens
ggctaacgggcgcc

SEQ ID NO: 459104 - DNA, 15 bp, Homo sapiens
ggctaactggcccca

SEQ ID NO: 459105 - DNA, 19 bp, Homo sapiens
ggctaactggccccaggcg

SEQ ID NO: 459106 - DNA, 18 bp, Homo sapiens
ggctcccacaggcccttc

SEQ ID NO: 459107 - DNA, 17 bp, Homo sapiens
ggctcctcccggtgccc

SEQ ID NO: 459108 - DNA, 11 bp, Homo sapiens
ggctcctttcc

SEQ ID NO: 459109 - DNA, 16 bp, Homo sapiens
ggctcctttcccacag

SEQ ID NO: 459110 - DNA, 21 bp, Homo sapiens
ggctctgccctccctccttcc

SEQ ID NO: 459111 - DNA, 14 bp, Homo sapiens
ggctctgttgctgt

SEQ ID NO: 459112 - DNA, 20 bp, Homo sapiens
ctccagagtaggtgggtctt

SEQ ID NO: 459113 - DNA, 15 bp, Homo sapiens
ctccagattattttc

SEQ ID NO: 459114 - DNA, 16 bp, Homo sapiens
ctccagattattttct

SEQ ID NO: 459115 - DNA, 22 bp, Homo sapiens
ctccagattattttctatattt

SEQ ID NO: 459116 - DNA, 14 bp, Homo sapiens
ctccagcagtgctg

SEQ ID NO: 459117 - DNA, 15 bp, Homo sapiens
ctccagcagtgctgg

SEQ ID NO: 459118 - DNA, 16 bp, Homo sapiens
ctccagcagtgctggg

SEQ ID NO: 459119 - DNA, 22 bp, Homo sapiens
ctccagccaatttcaaagaaaa

SEQ ID NO: 459120 - DNA, 13 bp, Homo sapiens
ctccttgaataag

SEQ ID NO: 459121 - DNA, 14 bp, Homo sapiens
ctccttgtacttga

SEQ ID NO: 459122 - DNA, 13 bp, Homo sapiens
ctcctttctaagg

SEQ ID NO: 459123 - DNA, 20 bp, Homo sapiens
ctcgagagggctgagcccct

SEQ ID NO: 459124 - DNA, 13 bp, Homo sapiens
ctcgagtcccccc

SEQ ID NO: 459125 - DNA, 15 bp, Homo sapiens
ctcgagtccccccac

SEQ ID NO: 459126 - DNA, 16 bp, Homo sapiens
ctcgagtccccccacc

SEQ ID NO: 459127 - DNA, 12 bp, Homo sapiens
ctcggagccccc

SEQ ID NO: 459128 - DNA, 15 bp, Homo sapiens
ctcgggaaggcctga

SEQ ID NO: 459129 - DNA, 14 bp, Homo sapiens
ctcgggcgcctgcg

SEQ ID NO: 459130 - DNA, 13 bp, Homo sapiens
ctcgtccggcctg

SEQ ID NO: 459131 - DNA, 16 bp, Homo sapiens
ctcgtccggcctgcag

SEQ ID NO: 459132 - DNA, 17 bp, Homo sapiens
ctcgtgccatgatctgt

SEQ ID NO: 459133 - DNA, 18 bp, Homo sapiens
ctcgttgacatgcacagt

SEQ ID NO: 459134 - DNA, 22 bp, Homo sapiens
ctctaataacctttatctaaat

SEQ ID NO: 459135 - DNA, 16 bp, Homo sapiens
ctctacttagcatgtc

SEQ ID NO: 459136 - DNA, 21 bp, Homo sapiens
ctctattgtagcatttcttga

SEQ ID NO: 459137 - DNA, 17 bp, Homo sapiens
ctctcacttttttataa

SEQ ID NO: 459138 - DNA, 23 bp, Homo sapiens
ctctcacttttttataaattata

SEQ ID NO: 459139 - DNA, 22 bp, Homo sapiens
ctctcagatccctcggtcagca

SEQ ID NO: 459140 - DNA, 16 bp, Homo sapiens
ctctccactgccttcg

SEQ ID NO: 459141 - DNA, 20 bp, Homo sapiens
ctctccctaccctcttctca

SEQ ID NO: 459142 - DNA, 12 bp, Homo sapiens
ctctccctccac

SEQ ID NO: 459143 - DNA, 16 bp, Homo sapiens
ctctccctccactcct

SEQ ID NO: 459144 - DNA, 20 bp, Homo sapiens
ctctccctccactcctccca

SEQ ID NO: 459145 - DNA, 17 bp, Homo sapiens
ctctcctcgtccggcct

SEQ ID NO: 459146 - DNA, 16 bp, Homo sapiens
ctctcctctctctccc

SEQ ID NO: 459147 - DNA, 17 bp, Homo sapiens
ctctcctctctctccct

SEQ ID NO: 459148 - DNA, 18 bp, Homo sapiens
ctctcctctctctccctc

SEQ ID NO: 459149 - DNA, 20 bp, Homo sapiens
ctctcctgggggtggcaggc

SEQ ID NO: 459150 - DNA, 23 bp, Homo sapiens
ctctccttcactctgacagtatt

SEQ ID NO: 459151 - DNA, 20 bp, Homo sapiens
ctctctattctggaagagcg

SEQ ID NO: 459152 - DNA, 13 bp, Homo sapiens
ctctctccctcca

SEQ ID NO: 459153 - DNA, 10 bp, Homo sapiens
ctctctctgt

SEQ ID NO: 459154 - DNA, 13 bp, Homo sapiens
ctctctctgttcc

SEQ ID NO: 459155 - DNA, 19 bp, Homo sapiens
ctctctggggccctgggcc

SEQ ID NO: 459156 - DNA, 15 bp, Homo sapiens
ctctctgtgtggcaa

SEQ ID NO: 459157 - DNA, 15 bp, Homo sapiens
ctctctgttccaagt

SEQ ID NO: 459158 - DNA, 18 bp, Homo sapiens
ctctctgttccaagtgtg

SEQ ID NO: 459159 - DNA, 19 bp, Homo sapiens
ctctctgttccaagtgtgt

SEQ ID NO: 459160 - DNA, 22 bp, Homo sapiens
ctctctgttccaagtgtgtgtg

SEQ ID NO: 459161 - DNA, 24 bp, Homo sapiens
ctctctgttccaagtgtgtgtgca

SEQ ID NO: 459162 - DNA, 22 bp, Homo sapiens
ctctctgtttaccctccctgtc

SEQ ID NO: 459163 - DNA, 20 bp, Homo sapiens
ctctcttaccccgtcccttt

SEQ ID NO: 459164 - DNA, 15 bp, Homo sapiens
ctctcttcttactgt

SEQ ID NO: 459165 - DNA, 22 bp, Homo sapiens
ctctgaaaatatttttttctag

SEQ ID NO: 459166 - DNA, 13 bp, Homo sapiens
ctctgacagtatt

SEQ ID NO: 459167 - DNA, 14 bp, Homo sapiens
ctctgagctgctag

SEQ ID NO: 459168 - DNA, 16 bp, Homo sapiens
ctctgaggtctcacct

SEQ ID NO: 459169 - DNA, 15 bp, Homo sapiens
ctctgcagcctgagc

SEQ ID NO: 459170 - DNA, 16 bp, Homo sapiens
ctctgcatagacaaag

SEQ ID NO: 459171 - DNA, 10 bp, Homo sapiens
ctctgccccc

SEQ ID NO: 459172 - DNA, 13 bp, Homo sapiens
ctctgcccctccg

SEQ ID NO: 459173 - DNA, 20 bp, Homo sapiens
ctctgccctccctccttcct

SEQ ID NO: 459174 - DNA, 20 bp, Homo sapiens
ctctgctccaacagacaccc

SEQ ID NO: 459175 - DNA, 13 bp, Homo sapiens
ctctgctgctcat

SEQ ID NO: 459176 - DNA, 15 bp, Homo sapiens
ctctgctgctcatgg

SEQ ID NO: 459177 - DNA, 17 bp, Homo sapiens
ctctggatcctgcactc

SEQ ID NO: 459178 - DNA, 22 bp, Homo sapiens
ctctggccttggttcctccagc

SEQ ID NO: 459179 - DNA, 18 bp, Homo sapiens
ctctggggccctgggcct

SEQ ID NO: 459180 - DNA, 16 bp, Homo sapiens
ctctgggttttgggat

SEQ ID NO: 459181 - DNA, 14 bp, Homo sapiens
ctctgtcagccagc

SEQ ID NO: 459182 - DNA, 15 bp, Homo sapiens
ctctgtgtggcaaac

SEQ ID NO: 459183 - DNA, 12 bp, Homo sapiens
ctctgttccaag

SEQ ID NO: 459184 - DNA, 21 bp, Homo sapiens
ctctgttccaagtgtgtgtgc

SEQ ID NO: 459185 - DNA, 23 bp, Homo sapiens
ctcttaacttaaaagaacatagg

SEQ ID NO: 459186 - DNA, 14 bp, Homo sapiens
ctcttaccccgtcc

SEQ ID NO: 459187 - DNA, 20 bp, Homo sapiens
ctcttaccccgtccctttcc

SEQ ID NO: 459188 - DNA, 21 bp, Homo sapiens
ctcttaccccgtccctttccc

SEQ ID NO: 459189 - DNA, 22 bp, Homo sapiens
ctcttaccccgtccctttccct

SEQ ID NO: 459190 - DNA, 23 bp, Homo sapiens
ctcttaccccgtccctttccctg

SEQ ID NO: 459191 - DNA, 20 bp, Homo sapiens
ctcttacctgtaatagcctc

SEQ ID NO: 459192 - DNA, 18 bp, Homo sapiens
ctcttacggctatctagt

SEQ ID NO: 459193 - DNA, 15 bp, Homo sapiens
ctcttagagaataag

SEQ ID NO: 459194 - DNA, 17 bp, Homo sapiens
ctcttatgcacacctcc

SEQ ID NO: 459195 - DNA, 15 bp, Homo sapiens
ctcttcaaggccaag

SEQ ID NO: 459196 - DNA, 17 bp, Homo sapiens
ctcttcccccttcccct

SEQ ID NO: 459197 - DNA, 16 bp, Homo sapiens
ctcttctcagctccac

SEQ ID NO: 459198 - DNA, 20 bp, Homo sapiens
ctcttctcagctccactctg

SEQ ID NO: 459199 - DNA, 12 bp, Homo sapiens
ctcttctccact

SEQ ID NO: 459200 - DNA, 13 bp, Homo sapiens
ctcttctccactg

SEQ ID NO: 459201 - DNA, 15 bp, Homo sapiens
ctcttctcctttcac

SEQ ID NO: 459202 - DNA, 21 bp, Homo sapiens
ctcttcttactgtatttggga

SEQ ID NO: 459203 - DNA, 12 bp, Homo sapiens
ctcttcttcctt

SEQ ID NO: 459204 - DNA, 13 bp, Homo sapiens
ctctttctctctg

SEQ ID NO: 459205 - DNA, 15 bp, Homo sapiens
ctctttctctctgtg

SEQ ID NO: 459206 - DNA, 16 bp, Homo sapiens
ctctttctctctgtgt

SEQ ID NO: 459207 - DNA, 21 bp, Homo sapiens
ctctttctctctttccatctc

SEQ ID NO: 459208 - DNA, 20 bp, Homo sapiens
ctgaaaatatttttttctag

SEQ ID NO: 459209 - DNA, 23 bp, Homo sapiens
ctgaagagcgctcctctgccttg

SEQ ID NO: 459210 - DNA, 15 bp, Homo sapiens
ctgaaggcctccatt

SEQ ID NO: 459211 - DNA, 20 bp, Homo sapiens
gcgcatagtgtgctcggaca

SEQ ID NO: 459212 - DNA, 15 bp, Homo sapiens
gcgcccacctgccca

SEQ ID NO: 459213 - DNA, 16 bp, Homo sapiens
gcgcctcccgccgcct

SEQ ID NO: 459214 - DNA, 17 bp, Homo sapiens
gcgcctgcccgcccgcc

SEQ ID NO: 459215 - DNA, 16 bp, Homo sapiens
gcgcctgcgctcctct

SEQ ID NO: 459216 - DNA, 18 bp, Homo sapiens
gcgcctgcgctcctctgc

SEQ ID NO: 459217 - DNA, 17 bp, Homo sapiens
gcgcgcaccgcccaacc

SEQ ID NO: 459218 - DNA, 19 bp, Homo sapiens
gcgctcagaggccgctctg

SEQ ID NO: 459219 - DNA, 15 bp, Homo sapiens
gcgctccggcagagg

SEQ ID NO: 459220 - DNA, 16 bp, Homo sapiens
gcgctccggcagaggc

SEQ ID NO: 459221 - DNA, 12 bp, Homo sapiens
gcgctcctctgc

SEQ ID NO: 459222 - DNA, 18 bp, Homo sapiens
gcgctcctctgcagcctg

SEQ ID NO: 459223 - DNA, 21 bp, Homo sapiens
gcgctcctctgcagcctgagc

SEQ ID NO: 459224 - DNA, 13 bp, Homo sapiens
gcgctctgcccct

SEQ ID NO: 459225 - DNA, 24 bp, Homo sapiens
gcgctgtgctccagcagtgctggg

SEQ ID NO: 459226 - DNA, 23 bp, Homo sapiens
gcggaggggcttggagcagagac

SEQ ID NO: 459227 - DNA, 17 bp, Homo sapiens
gcggcaccgcccaccca

SEQ ID NO: 459228 - DNA, 18 bp, Homo sapiens
gcggcaccgcccacccac

SEQ ID NO: 459229 - DNA, 20 bp, Homo sapiens
gcggccagggacccccgagg

SEQ ID NO: 459230 - DNA, 21 bp, Homo sapiens
gcggcccggcccacgcagagc

SEQ ID NO: 459231 - DNA, 15 bp, Homo sapiens
gcggcccgtgcgcag

SEQ ID NO: 459232 - DNA, 22 bp, Homo sapiens
gcggcccgtgcgcagccgcgct

SEQ ID NO: 459233 - DNA, 22 bp, Homo sapiens
gcggcctcgtgccatgatctgt

SEQ ID NO: 459234 - DNA, 18 bp, Homo sapiens
gcggtggactgcgctgga

SEQ ID NO: 459235 - DNA, 15 bp, Homo sapiens
gcgtgaccggcccgc

SEQ ID NO: 459236 - DNA, 17 bp, Homo sapiens
gctaactggccccaggc

SEQ ID NO: 459237 - DNA, 23 bp, Homo sapiens
gctaagttgtcttacacttctca

SEQ ID NO: 459238 - DNA, 14 bp, Homo sapiens
gctaatcagcattc

SEQ ID NO: 459239 - DNA, 13 bp, Homo sapiens
gctaatgtaatca

SEQ ID NO: 459240 - DNA, 13 bp, Homo sapiens
gctagctgtagaa

SEQ ID NO: 459241 - DNA, 17 bp, Homo sapiens
gctagctgtagaaatgt

SEQ ID NO: 459242 - DNA, 23 bp, Homo sapiens
gctatatatatatatatatgtat

SEQ ID NO: 459243 - DNA, 16 bp, Homo sapiens
gctatctgtcatctct

SEQ ID NO: 459244 - DNA, 21 bp, Homo sapiens
gctatctgtcatctctctggg

SEQ ID NO: 459245 - DNA, 13 bp, Homo sapiens
gctatgtctgtga

SEQ ID NO: 459246 - DNA, 14 bp, Homo sapiens
gctcaacctctcag

SEQ ID NO: 459247 - DNA, 21 bp, Homo sapiens
gctcaacctctcagatccctc

SEQ ID NO: 459248 - DNA, 17 bp, Homo sapiens
gctcacgctgacagcct

SEQ ID NO: 459249 - DNA, 18 bp, Homo sapiens
gctcacgctgacagcctc

SEQ ID NO: 459250 - DNA, 20 bp, Homo sapiens
gctcacgctgacagcctcct

SEQ ID NO: 459251 - DNA, 22 bp, Homo sapiens
gctcacgtctgtgagtctgtcc

SEQ ID NO: 459252 - DNA, 14 bp, Homo sapiens
gctcagaggccgct

SEQ ID NO: 459253 - DNA, 12 bp, Homo sapiens
gctcagccctcc

SEQ ID NO: 459254 - DNA, 16 bp, Homo sapiens
gctcagccctccctgc

SEQ ID NO: 459255 - DNA, 18 bp, Homo sapiens
gctcagccctccctgccc

SEQ ID NO: 459256 - DNA, 19 bp, Homo sapiens
gctcagccctccctgcccc

SEQ ID NO: 459257 - DNA, 21 bp, Homo sapiens
gctcagccctccctgcccctc

SEQ ID NO: 459258 - DNA, 15 bp, Homo sapiens
gctcagtacagggca

SEQ ID NO: 459259 - DNA, 23 bp, Homo sapiens
gctcagtacagggcaggagctgc

SEQ ID NO: 459260 - DNA, 13 bp, Homo sapiens
gctcattcttttc

SEQ ID NO: 459261 - DNA, 16 bp, Homo sapiens
gctccaacagacaccc

SEQ ID NO: 459262 - DNA, 17 bp, Homo sapiens
gctccaacagacaccct

SEQ ID NO: 459263 - DNA, 23 bp, Homo sapiens
gctccaacagacaccctccactc

SEQ ID NO: 459264 - DNA, 13 bp, Homo sapiens
gctccaccctccc

SEQ ID NO: 459265 - DNA, 20 bp, Homo sapiens
gctccaccctcccctcttct

SEQ ID NO: 459266 - DNA, 13 bp, Homo sapiens
gctccactctgaa

SEQ ID NO: 459267 - DNA, 18 bp, Homo sapiens
gctccagcagtgctgggc

SEQ ID NO: 459268 - DNA, 16 bp, Homo sapiens
gctcccacaggccctt

SEQ ID NO: 459269 - DNA, 17 bp, Homo sapiens
gctcccacaggcccttc

SEQ ID NO: 459270 - DNA, 20 bp, Homo sapiens
gctcccacaggcccttcctc

SEQ ID NO: 459271 - DNA, 15 bp, Homo sapiens
gctccctcctcagtc

SEQ ID NO: 459272 - DNA, 12 bp, Homo sapiens
gctccggcagag

SEQ ID NO: 459273 - DNA, 14 bp, Homo sapiens
gctccggcagaggc

SEQ ID NO: 459274 - DNA, 20 bp, Homo sapiens
gctccggcagaggcagggcc

SEQ ID NO: 459275 - DNA, 19 bp, Homo sapiens
gctcctcccggtgcccaag

SEQ ID NO: 459276 - DNA, 15 bp, Homo sapiens
gctcctctgcagcct

SEQ ID NO: 459277 - DNA, 17 bp, Homo sapiens
gctcctctgcagcctga

SEQ ID NO: 459278 - DNA, 19 bp, Homo sapiens
gctcctctgcagcctgagc

SEQ ID NO: 459279 - DNA, 16 bp, Homo sapiens
gctcctctgccttgga

SEQ ID NO: 459280 - DNA, 17 bp, Homo sapiens
gctcctctgccttggac

SEQ ID NO: 459281 - DNA, 18 bp, Homo sapiens
gctcctctgccttggaca

SEQ ID NO: 459282 - DNA, 12 bp, Homo sapiens
gctcctttccca

SEQ ID NO: 459283 - DNA, 13 bp, Homo sapiens
gctcctttcccac

SEQ ID NO: 459284 - DNA, 14 bp, Homo sapiens
gctcctttcccaca

SEQ ID NO: 459285 - DNA, 17 bp, Homo sapiens
gctcctttcccacagtc

SEQ ID NO: 459286 - DNA, 16 bp, Homo sapiens
gctcgggaaggcctga

SEQ ID NO: 459287 - DNA, 17 bp, Homo sapiens
gctcgggaaggcctgag

SEQ ID NO: 459288 - DNA, 15 bp, Homo sapiens
gctctaaagcagaga

SEQ ID NO: 459289 - DNA, 18 bp, Homo sapiens
gctctactttataatcaa

SEQ ID NO: 459290 - DNA, 21 bp, Homo sapiens
gctctagggaagcagtgcgtg

SEQ ID NO: 459291 - DNA, 14 bp, Homo sapiens
gctctccttcactc

SEQ ID NO: 459292 - DNA, 13 bp, Homo sapiens
gctctgcccctcc

SEQ ID NO: 459293 - DNA, 14 bp, Homo sapiens
gctctgcccctccg

SEQ ID NO: 459294 - DNA, 22 bp, Homo sapiens
gctctgcccctccgtccccagg

SEQ ID NO: 459295 - DNA, 15 bp, Homo sapiens
gctctggatcctgca

SEQ ID NO: 459296 - DNA, 13 bp, Homo sapiens
gctcttctccttt

SEQ ID NO: 459297 - DNA, 18 bp, Homo sapiens
gctctttaagtaaaatgt

SEQ ID NO: 459298 - DNA, 16 bp, Homo sapiens
gctgagagacctcagg

SEQ ID NO: 459299 - DNA, 15 bp, Homo sapiens
gctgagcccctcctc

SEQ ID NO: 459300 - DNA, 21 bp, Homo sapiens
gctgagcccctcctctcctcg

SEQ ID NO: 459301 - DNA, 17 bp, Homo sapiens
gctgaggacggggcaga

SEQ ID NO: 459302 - DNA, 22 bp, Homo sapiens
gctgaggacggggcagagctga

SEQ ID NO: 459303 - DNA, 22 bp, Homo sapiens
gctgagggcagggttctagaag

SEQ ID NO: 459304 - DNA, 15 bp, Homo sapiens
gctgagtcggctggg

SEQ ID NO: 459305 - DNA, 20 bp, Homo sapiens
gctgagtcggctgggcaggg

SEQ ID NO: 459306 - DNA, 23 bp, Homo sapiens
gctgagtcggctgggcagggccg

SEQ ID NO: 459307 - DNA, 19 bp, Homo sapiens
gctgatctaaggaccccag

SEQ ID NO: 459308 - DNA, 13 bp, Homo sapiens
gctgcaatacatt

SEQ ID NO: 459309 - DNA, 21 bp, Homo sapiens
ggtccccggacgctggctcgg

SEQ ID NO: 459310 - DNA, 20 bp, Homo sapiens
ggtcctgcccatgtgtcccc

SEQ ID NO: 459311 - DNA, 18 bp, Homo sapiens
ggtcgggggaggagcacc

SEQ ID NO: 459312 - DNA, 23 bp, Homo sapiens
ggtcgggggaggagcacccccag

SEQ ID NO: 459313 - DNA, 13 bp, Homo sapiens
ggtctcaccttcg

SEQ ID NO: 459314 - DNA, 11 bp, Homo sapiens
ggtctccaccc

SEQ ID NO: 459315 - DNA, 14 bp, Homo sapiens
ggtctccacccctc

SEQ ID NO: 459316 - DNA, 13 bp, Homo sapiens
ggtctctgagcag

SEQ ID NO: 459317 - DNA, 12 bp, Homo sapiens
ggtgactgtccc

SEQ ID NO: 459318 - DNA, 16 bp, Homo sapiens
ggtgagacagtggggg

SEQ ID NO: 459319 - DNA, 23 bp, Homo sapiens
ggtgagacagtgggggtgcctgg

SEQ ID NO: 459320 - DNA, 18 bp, Homo sapiens
ggtgaggcgtgggatcca

SEQ ID NO: 459321 - DNA, 21 bp, Homo sapiens
ggtgcaggcgcgcaccgccca

SEQ ID NO: 459322 - DNA, 13 bp, Homo sapiens
ggtgcagtgaaga

SEQ ID NO: 459323 - DNA, 21 bp, Homo sapiens
ggtgcatttgagagaagccac

SEQ ID NO: 459324 - DNA, 12 bp, Homo sapiens
ggtgcctgagcc

SEQ ID NO: 459325 - DNA, 20 bp, Homo sapiens
ggtgcgtgaccggcccgcca

SEQ ID NO: 459326 - DNA, 23 bp, Homo sapiens
ggtggcaggcacacagcagcccc

SEQ ID NO: 459327 - DNA, 18 bp, Homo sapiens
ggtggccatccctgggcc

SEQ ID NO: 459328 - DNA, 14 bp, Homo sapiens
ggtggcccctgcct

SEQ ID NO: 459329 - DNA, 16 bp, Homo sapiens
ggtggcccgacagcct

SEQ ID NO: 459330 - DNA, 13 bp, Homo sapiens
ggtgggctccaga

SEQ ID NO: 459331 - DNA, 18 bp, Homo sapiens
ggtgggctccagagtagg

SEQ ID NO: 459332 - DNA, 20 bp, Homo sapiens
ggtggggcttagaatggggc

SEQ ID NO: 459333 - DNA, 22 bp, Homo sapiens
ggtggtcttggagaggaggtgt

SEQ ID NO: 459334 - DNA, 13 bp, Homo sapiens
ggtggttggaggc

SEQ ID NO: 459335 - DNA, 16 bp, Homo sapiens
ggtggttggaggcctg

SEQ ID NO: 459336 - DNA, 20 bp, Homo sapiens
ggtgtgaggcccccggaggc

SEQ ID NO: 459337 - DNA, 18 bp, Homo sapiens
ggtgtggcctcagccctc

SEQ ID NO: 459338 - DNA, 20 bp, Homo sapiens
ggtgtgttttgtcttcaact

SEQ ID NO: 459339 - DNA, 19 bp, Homo sapiens
ggttaaagaaaggcagaga

SEQ ID NO: 459340 - DNA, 17 bp, Homo sapiens
ggttaagccatatgaca

SEQ ID NO: 459341 - DNA, 12 bp, Homo sapiens
ggttccagacag

SEQ ID NO: 459342 - DNA, 13 bp, Homo sapiens
ggttccagacagg

SEQ ID NO: 459343 - DNA, 20 bp, Homo sapiens
gtcaatgtgaaataaagagt

SEQ ID NO: 459344 - DNA, 19 bp, Homo sapiens
gtcaccagctatctgtcat

SEQ ID NO: 459345 - DNA, 23 bp, Homo sapiens
gtcaccagctatctgtcatctct

SEQ ID NO: 459346 - DNA, 15 bp, Homo sapiens
gtcacttatttcata

SEQ ID NO: 459347 - DNA, 13 bp, Homo sapiens
gtcagcagggggg

SEQ ID NO: 459348 - DNA, 11 bp, Homo sapiens
gtcagccagcc

SEQ ID NO: 459349 - DNA, 12 bp, Homo sapiens
gtcagccagccg

SEQ ID NO: 459350 - DNA, 14 bp, Homo sapiens
gtcagcttgaatgt

SEQ ID NO: 459351 - DNA, 19 bp, Homo sapiens
gtcagtccctacttaggaa

SEQ ID NO: 459352 - DNA, 19 bp, Homo sapiens
gtcagtgaagcccaggagg

SEQ ID NO: 459353 - DNA, 18 bp, Homo sapiens
gtcatcggaggctgggcc

SEQ ID NO: 459354 - DNA, 22 bp, Homo sapiens
gtcatctctctggggccctggg

SEQ ID NO: 459355 - DNA, 17 bp, Homo sapiens
gtcattggttacaaatt

SEQ ID NO: 459356 - DNA, 15 bp, Homo sapiens
gtccacctgtgctgc

SEQ ID NO: 459357 - DNA, 16 bp, Homo sapiens
gtccacctgtgctgct

SEQ ID NO: 459358 - DNA, 18 bp, Homo sapiens
gtccacctgtgctgctgc

SEQ ID NO: 459359 - DNA, 18 bp, Homo sapiens
gtccactttcctctctct

SEQ ID NO: 459360 - DNA, 23 bp, Homo sapiens
gtccattgcaaaaggttaagcca

SEQ ID NO: 459361 - DNA, 23 bp, Homo sapiens
gtccccattctataaattcaaca

SEQ ID NO: 459362 - DNA, 14 bp, Homo sapiens
gtccccccacccct

SEQ ID NO: 459363 - DNA, 23 bp, Homo sapiens
gtccccccacccctccccaccca

SEQ ID NO: 459364 - DNA, 16 bp, Homo sapiens
gtccccggacgctggc

SEQ ID NO: 459365 - DNA, 19 bp, Homo sapiens
gtcccctcactctgtcagc

SEQ ID NO: 459366 - DNA, 20 bp, Homo sapiens
gtcccctcactctgtcagcc

SEQ ID NO: 459367 - DNA, 22 bp, Homo sapiens
gtccctaccgagtctcttctcc

SEQ ID NO: 459368 - DNA, 16 bp, Homo sapiens
gtccctacttaggaaa

SEQ ID NO: 459369 - DNA, 14 bp, Homo sapiens
gtccctgacttccc

SEQ ID NO: 459370 - DNA, 19 bp, Homo sapiens
gtccctgacttcccagctg

SEQ ID NO: 459371 - DNA, 20 bp, Homo sapiens
gtcccttccagtcatgtgtg

SEQ ID NO: 459372 - DNA, 16 bp, Homo sapiens
gtcccttcctgtcctg

SEQ ID NO: 459373 - DNA, 20 bp, Homo sapiens
gcaaacatttctttttcctt

SEQ ID NO: 459374 - DNA, 17 bp, Homo sapiens
gcaaagtaccaactgag

SEQ ID NO: 459375 - DNA, 14 bp, Homo sapiens
gcaaattattctag

SEQ ID NO: 459376 - DNA, 23 bp, Homo sapiens
gcaaattattctagtcaactgct

SEQ ID NO: 459377 - DNA, 15 bp, Homo sapiens
gcaagaagattctaa

SEQ ID NO: 459378 - DNA, 16 bp, Homo sapiens
gcaaggcaagaagtgg

SEQ ID NO: 459379 - DNA, 19 bp, Homo sapiens
gcaaggcaagaagtgggat

SEQ ID NO: 459380 - DNA, 19 bp, Homo sapiens
gcaataacagttttaagat

SEQ ID NO: 459381 - DNA, 23 bp, Homo sapiens
gcaatgttccgttcatctgagga

SEQ ID NO: 459382 - DNA, 17 bp, Homo sapiens
gcacaagaagtttcttc

SEQ ID NO: 459383 - DNA, 16 bp, Homo sapiens
gcacacagcagccccc

SEQ ID NO: 459384 - DNA, 20 bp, Homo sapiens
gcacacagcagccccccagc

SEQ ID NO: 459385 - DNA, 22 bp, Homo sapiens
gcacactgagtttgaacacaga

SEQ ID NO: 459386 - DNA, 15 bp, Homo sapiens
gcacagtgcatctca

SEQ ID NO: 459387 - DNA, 18 bp, Homo sapiens
gcacagtgcatctcagcc

SEQ ID NO: 459388 - DNA, 15 bp, Homo sapiens
gcacagtttgcaatc

SEQ ID NO: 459389 - DNA, 17 bp, Homo sapiens
gcaccaacctcactgcc

SEQ ID NO: 459390 - DNA, 20 bp, Homo sapiens
gcaccacggcgtttttttac

SEQ ID NO: 459391 - DNA, 15 bp, Homo sapiens
gcaccacggggtcgg

SEQ ID NO: 459392 - DNA, 20 bp, Homo sapiens
gcaccagatgcaacctcact

SEQ ID NO: 459393 - DNA, 15 bp, Homo sapiens
gcaccagcctgagcc

SEQ ID NO: 459394 - DNA, 17 bp, Homo sapiens
gcaccagcctgagccac

SEQ ID NO: 459395 - DNA, 19 bp, Homo sapiens
gcaccagcctgagccacag

SEQ ID NO: 459396 - DNA, 22 bp, Homo sapiens
gcaccccaccacacacaccctt

SEQ ID NO: 459397 - DNA, 12 bp, Homo sapiens
gcacccccagcc

SEQ ID NO: 459398 - DNA, 16 bp, Homo sapiens
gcacccccagcctccc

SEQ ID NO: 459399 - DNA, 15 bp, Homo sapiens
gcaccctctcctggg

SEQ ID NO: 459400 - DNA, 22 bp, Homo sapiens
gcaccctctcctgggggtggca

SEQ ID NO: 459401 - DNA, 22 bp, Homo sapiens
gcaccctctgctatgtctgtga

SEQ ID NO: 459402 - DNA, 22 bp, Homo sapiens
gcaccgcccaacccccacctcc

SEQ ID NO: 459403 - DNA, 17 bp, Homo sapiens
gcaccgcccacccacac

SEQ ID NO: 459404 - DNA, 17 bp, Homo sapiens
gcaccgtggtgtgaggc

SEQ ID NO: 459405 - DNA, 19 bp, Homo sapiens
gcaccgtggtgtgaggccc

SEQ ID NO: 459406 - DNA, 20 bp, Homo sapiens
gcaccgtggtgtgaggcccc

SEQ ID NO: 459407 - DNA, 14 bp, Homo sapiens
gcacctacgggggc

SEQ ID NO: 459408 - DNA, 18 bp, Homo sapiens
gcaccttcccctgaggac

SEQ ID NO: 459409 - DNA, 15 bp, Homo sapiens
gcacgggagagcgcc

SEQ ID NO: 459410 - DNA, 23 bp, Homo sapiens
gcactaaggccgtgtctctgagg

SEQ ID NO: 459411 - DNA, 13 bp, Homo sapiens
gcactcccagggc

SEQ ID NO: 459412 - DNA, 15 bp, Homo sapiens
gcactcccagggccc

SEQ ID NO: 459413 - DNA, 19 bp, Homo sapiens
gcactcccagggcccgagc

SEQ ID NO: 459414 - DNA, 21 bp, Homo sapiens
gcactgccattagactgaatt

SEQ ID NO: 459415 - DNA, 22 bp, Homo sapiens
gcagaatggtgggctccagagt

SEQ ID NO: 459416 - DNA, 16 bp, Homo sapiens
gcagagacggcagccc

SEQ ID NO: 459417 - DNA, 17 bp, Homo sapiens
gcagagacggcagcccc

SEQ ID NO: 459418 - DNA, 18 bp, Homo sapiens
gcagagattgggggggct

SEQ ID NO: 459419 - DNA, 20 bp, Homo sapiens
gcagagctgagtcggctggg

SEQ ID NO: 459420 - DNA, 22 bp, Homo sapiens
gcagagctgagtcggctgggca

SEQ ID NO: 459421 - DNA, 21 bp, Homo sapiens
gcagcaccagcctgagccaca

SEQ ID NO: 459422 - DNA, 15 bp, Homo sapiens
gcagcaccctccccc

SEQ ID NO: 459423 - DNA, 20 bp, Homo sapiens
gcagcagtaccatcccactg

SEQ ID NO: 459424 - DNA, 22 bp, Homo sapiens
gcagcccagaacgggcctcccc

SEQ ID NO: 459425 - DNA, 23 bp, Homo sapiens
gcagcccagaacgggcctccccg

SEQ ID NO: 459426 - DNA, 14 bp, Homo sapiens
gcagccccccagca

SEQ ID NO: 459427 - DNA, 16 bp, Homo sapiens
gcagccccccagcact

SEQ ID NO: 459428 - DNA, 14 bp, Homo sapiens
gcagcccctgctgg

SEQ ID NO: 459429 - DNA, 21 bp, Homo sapiens
gcagccctctccacccagagg

SEQ ID NO: 459430 - DNA, 13 bp, Homo sapiens
gcagccctgcttt

SEQ ID NO: 459431 - DNA, 14 bp, Homo sapiens
gcagccctgctttg

SEQ ID NO: 459432 - DNA, 14 bp, Homo sapiens
gcagccgcgctctg

SEQ ID NO: 459433 - DNA, 20 bp, Homo sapiens
gcagccgcgctctgcccctc

SEQ ID NO: 459434 - DNA, 15 bp, Homo sapiens
gcagccgtgccttca

SEQ ID NO: 459435 - DNA, 12 bp, Homo sapiens
gcagcctgagct

SEQ ID NO: 459436 - DNA, 12 bp, Homo sapiens
gcagcgcctccc

SEQ ID NO: 459437 - DNA, 13 bp, Homo sapiens
gcagcgcctcccg

SEQ ID NO: 459438 - DNA, 15 bp, Homo sapiens
gcagcgcctcccgcc

SEQ ID NO: 459439 - DNA, 22 bp, Homo sapiens
gcagctatgcgcaatgtggcat

SEQ ID NO: 459440 - DNA, 18 bp, Homo sapiens
gcaggaagagatgctcta

SEQ ID NO: 459441 - DNA, 18 bp, Homo sapiens
gcaggcacacagcagccc

SEQ ID NO: 459442 - DNA, 13 bp, Homo sapiens
gaagatgccaagg

SEQ ID NO: 459443 - DNA, 14 bp, Homo sapiens
gaagatgccaaggg

SEQ ID NO: 459444 - DNA, 22 bp, Homo sapiens
gaagattctaaaacattcttta

SEQ ID NO: 459445 - DNA, 17 bp, Homo sapiens
gaagccacgctgtcctc

SEQ ID NO: 459446 - DNA, 18 bp, Homo sapiens
gaagccacgctgtcctct

SEQ ID NO: 459447 - DNA, 19 bp, Homo sapiens
gaagccacgctgtcctctc

SEQ ID NO: 459448 - DNA, 13 bp, Homo sapiens
gaagcccacccgc

SEQ ID NO: 459449 - DNA, 19 bp, Homo sapiens
gaagcccacccgccccaga

SEQ ID NO: 459450 - DNA, 20 bp, Homo sapiens
gaagcccacccgccccagag

SEQ ID NO: 459451 - DNA, 22 bp, Homo sapiens
gaaggacccggaggggcctggc

SEQ ID NO: 459452 - DNA, 14 bp, Homo sapiens
gaaggcctgaggga

SEQ ID NO: 459453 - DNA, 19 bp, Homo sapiens
gaaggcctgagggaagccc

SEQ ID NO: 459454 - DNA, 23 bp, Homo sapiens
gaaggcctgagggaagcccaccc

SEQ ID NO: 459455 - DNA, 14 bp, Homo sapiens
gaaggcctgccccc

SEQ ID NO: 459456 - DNA, 15 bp, Homo sapiens
gaaggcctgcccccc

SEQ ID NO: 459457 - DNA, 14 bp, Homo sapiens
gaagtctccccgca

SEQ ID NO: 459458 - DNA, 14 bp, Homo sapiens
gaagtggcctgaga

SEQ ID NO: 459459 - DNA, 20 bp, Homo sapiens
gaataaactccccagcgtat

SEQ ID NO: 459460 - DNA, 14 bp, Homo sapiens
gaataaagacacct

SEQ ID NO: 459461 - DNA, 16 bp, Homo sapiens
gaataaataaagaaga

SEQ ID NO: 459462 - DNA, 17 bp, Homo sapiens
gaataaataaagaagaa

SEQ ID NO: 459463 - DNA, 18 bp, Homo sapiens
cttcaaccctgccctgca

SEQ ID NO: 459464 - DNA, 13 bp, Homo sapiens
cttcacatccacc

SEQ ID NO: 459465 - DNA, 17 bp, Homo sapiens
cttcacatccaccccgg

SEQ ID NO: 459466 - DNA, 23 bp, Homo sapiens
cttcacgattcttaccctttctt

SEQ ID NO: 459467 - DNA, 17 bp, Homo sapiens
cttcactctgacagtat

SEQ ID NO: 459468 - DNA, 20 bp, Homo sapiens
cttcagactctctcctctct

SEQ ID NO: 459469 - DNA, 18 bp, Homo sapiens
cttcagagttctctgtaa

SEQ ID NO: 459470 - DNA, 11 bp, Homo sapiens
cttcagcaacc

SEQ ID NO: 459471 - DNA, 20 bp, Homo sapiens
cttcagcaaccctacagtat

SEQ ID NO: 459472 - DNA, 19 bp, Homo sapiens
cttcagctgtttcgcatcc

SEQ ID NO: 459473 - DNA, 22 bp, Homo sapiens
cttcaggctcttctcctttcac

SEQ ID NO: 459474 - DNA, 15 bp, Homo sapiens
cttcaggttcctcct

SEQ ID NO: 459475 - DNA, 16 bp, Homo sapiens
cttcaggttcctccta

SEQ ID NO: 459476 - DNA, 17 bp, Homo sapiens
cttcaggttcctcctag

SEQ ID NO: 459477 - DNA, 19 bp, Homo sapiens
cttcaggttcctcctaggc

SEQ ID NO: 459478 - DNA, 24 bp, Homo sapiens
cttcaggttcctcctaggcgctca

SEQ ID NO: 459479 - DNA, 16 bp, Homo sapiens
cttcagttctcatctt

SEQ ID NO: 459480 - DNA, 17 bp, Homo sapiens
cttcagttctcatcttg

SEQ ID NO: 459481 - DNA, 13 bp, Homo sapiens
cttcatccataga

SEQ ID NO: 459482 - DNA, 14 bp, Homo sapiens
cttcatccatagac

SEQ ID NO: 459483 - DNA, 18 bp, Homo sapiens
cttcatccatagacacag

SEQ ID NO: 459484 - DNA, 20 bp, Homo sapiens
cttcatccatagacacagta

SEQ ID NO: 459485 - DNA, 22 bp, Homo sapiens
cttcatccatagacacagtatt

SEQ ID NO: 459486 - DNA, 19 bp, Homo sapiens
cttccagagggggccagag

SEQ ID NO: 459487 - DNA, 21 bp, Homo sapiens
cttccagtcatgtgtgcatca

SEQ ID NO: 459488 - DNA, 13 bp, Homo sapiens
cttccatcctgag

SEQ ID NO: 459489 - DNA, 14 bp, Homo sapiens
cttccatcctgagg

SEQ ID NO: 459490 - DNA, 16 bp, Homo sapiens
cttcccagctggcagc

SEQ ID NO: 459491 - DNA, 18 bp, Homo sapiens
cttcccagctggcagcgc

SEQ ID NO: 459492 - DNA, 11 bp, Homo sapiens
cttccccactc

SEQ ID NO: 459493 - DNA, 15 bp, Homo sapiens
cttccccctccaatc

SEQ ID NO: 459494 - DNA, 20 bp, Homo sapiens
cttcccccttcccctgcgcc

SEQ ID NO: 459495 - DNA, 14 bp, Homo sapiens
cttcccccttcccg

SEQ ID NO: 459496 - DNA, 14 bp, Homo sapiens
cttcccctgaggac

SEQ ID NO: 459497 - DNA, 21 bp, Homo sapiens
cttcccctgcgccctccctcc

SEQ ID NO: 459498 - DNA, 14 bp, Homo sapiens
cttccccttctgtg

SEQ ID NO: 459499 - DNA, 21 bp, Homo sapiens
cttcccgcagcaccagcctga

SEQ ID NO: 459500 - DNA, 23 bp, Homo sapiens
cttcccgccttcaggttcctcct

SEQ ID NO: 459501 - DNA, 18 bp, Homo sapiens
cttcccgctcagccctcc

SEQ ID NO: 459502 - DNA, 23 bp, Homo sapiens
cttcccgctcagccctccctgcc

SEQ ID NO: 459503 - DNA, 14 bp, Homo sapiens
cttccctagttctt

SEQ ID NO: 459504 - DNA, 21 bp, Homo sapiens
cttccctatacttcacactga

SEQ ID NO: 459505 - DNA, 16 bp, Homo sapiens
cttccgtgagacacaa

SEQ ID NO: 459506 - DNA, 16 bp, Homo sapiens
cttcctacagtaaagg

SEQ ID NO: 459507 - DNA, 14 bp, Homo sapiens
cttcctctccactg

SEQ ID NO: 459508 - DNA, 22 bp, Homo sapiens
cttcctggattttctttctatg

SEQ ID NO: 459509 - DNA, 23 bp, Homo sapiens
cttcctggattttctttctatgt

SEQ ID NO: 459510 - DNA, 23 bp, Homo sapiens
cttcctgtagtggcaaaaaagaa

SEQ ID NO: 459511 - DNA, 20 bp, Homo sapiens
cttctcaaatgctactcagt

SEQ ID NO: 459512 - DNA, 21 bp, Homo sapiens
cttctcaaatgctactcagta

SEQ ID NO: 459513 - DNA, 15 bp, Homo sapiens
cttctcagctccact

SEQ ID NO: 459514 - DNA, 16 bp, Homo sapiens
cttctcagctccactc

SEQ ID NO: 459515 - DNA, 17 bp, Homo sapiens
cttctcagctccactct

SEQ ID NO: 459516 - DNA, 19 bp, Homo sapiens
cttctcagctccactctga

SEQ ID NO: 459517 - DNA, 13 bp, Homo sapiens
cttctccactgga

SEQ ID NO: 459518 - DNA, 14 bp, Homo sapiens
cttctcccctccag

SEQ ID NO: 459519 - DNA, 17 bp, Homo sapiens
cttctcccctccagacc

SEQ ID NO: 459520 - DNA, 21 bp, Homo sapiens
cttctcctctgctccaacaga

SEQ ID NO: 459521 - DNA, 14 bp, Homo sapiens
cttctcctttcaca

SEQ ID NO: 459522 - DNA, 13 bp, Homo sapiens
cttctgctgtaca

SEQ ID NO: 459523 - DNA, 16 bp, Homo sapiens
cttctgctgtacagat

SEQ ID NO: 459524 - DNA, 13 bp, Homo sapiens
cttctgtgtcaca

SEQ ID NO: 459525 - DNA, 15 bp, Homo sapiens
cttcttactgtattt

SEQ ID NO: 459526 - DNA, 18 bp, Homo sapiens
cttcttgcggcaccgccc

SEQ ID NO: 459527 - DNA, 21 bp, Homo sapiens
cttcttgcggcaccgcccacc

SEQ ID NO: 459528 - DNA, 13 bp, Homo sapiens
cttctttttggca

SEQ ID NO: 459529 - DNA, 17 bp, Homo sapiens
cttgactataaaaactg

SEQ ID NO: 459530 - DNA, 14 bp, Homo sapiens
cttgactatttcac

SEQ ID NO: 459531 - DNA, 22 bp, Homo sapiens
cttgagatgtattatgcaaagt

SEQ ID NO: 459532 - DNA, 21 bp, Homo sapiens
cttgagcaaggcaagaagtgg

SEQ ID NO: 459533 - DNA, 20 bp, Homo sapiens
cttgagtgggccccctctct

SEQ ID NO: 459534 - DNA, 14 bp, Homo sapiens
cttgatgggagagg

SEQ ID NO: 459535 - DNA, 17 bp, Homo sapiens
cttgcggcaccgcccac

SEQ ID NO: 459536 - DNA, 19 bp, Homo sapiens
cttgcggcaccgcccaccc

SEQ ID NO: 459537 - DNA, 23 bp, Homo sapiens
cttgctagtgatacactgtatct

SEQ ID NO: 459538 - DNA, 14 bp, Homo sapiens
cttgctcaataaag

SEQ ID NO: 459539 - DNA, 18 bp, Homo sapiens
cttgctcaataaaggtca

SEQ ID NO: 459540 - DNA, 17 bp, Homo sapiens
cttgctccttgaataag

SEQ ID NO: 459541 - DNA, 17 bp, Homo sapiens
cttgctttcacaaatat

SEQ ID NO: 459542 - DNA, 12 bp, Homo sapiens
cttggagaggag

SEQ ID NO: 459543 - DNA, 13 bp, Homo sapiens
cttggagaggagg

SEQ ID NO: 459544 - DNA, 21 bp, Homo sapiens
cttggagaggaggtgtggagt

SEQ ID NO: 459545 - DNA, 21 bp, Homo sapiens
cttggagcagagacggcagcc

SEQ ID NO: 459546 - DNA, 20 bp, Homo sapiens
cttggataggagcttccaga

SEQ ID NO: 459547 - DNA, 17 bp, Homo sapiens
cttgggcacgggagagc

SEQ ID NO: 459548 - DNA, 20 bp, Homo sapiens
cttgggcacgggagagcgcc

SEQ ID NO: 459549 - DNA, 22 bp, Homo sapiens
cttgggcacgggagagcgccac

SEQ ID NO: 459550 - DNA, 17 bp, Homo sapiens
cttggggtagagaggac

SEQ ID NO: 459551 - DNA, 13 bp, Homo sapiens
cttggttcctcca

SEQ ID NO: 459552 - DNA, 22 bp, Homo sapiens
cttggttcctccagcaatgcct

SEQ ID NO: 459553 - DNA, 15 bp, Homo sapiens
cttggttgttccttt

SEQ ID NO: 459554 - DNA, 19 bp, Homo sapiens
cttggttgttcctttttct

SEQ ID NO: 459555 - DNA, 22 bp, Homo sapiens
cttggttgttcctttttctttt

SEQ ID NO: 459556 - DNA, 16 bp, Homo sapiens
cttgtgttcaatctgt

SEQ ID NO: 459557 - DNA, 19 bp, Homo sapiens
cttgtgttcaatctgtgaa

SEQ ID NO: 459558 - DNA, 13 bp, Homo sapiens
cttgttgtattcc

SEQ ID NO: 459559 - DNA, 22 bp, Homo sapiens
cttgttgtattcctgcctttga

SEQ ID NO: 459560 - DNA, 20 bp, Homo sapiens
cgggcctggagaactagaga

SEQ ID NO: 459561 - DNA, 14 bp, Homo sapiens
cggggcagagctga

SEQ ID NO: 459562 - DNA, 16 bp, Homo sapiens
cggggctggccctgcc

SEQ ID NO: 459563 - DNA, 15 bp, Homo sapiens
cgggggaggagcacc

SEQ ID NO: 459564 - DNA, 16 bp, Homo sapiens
cgggggaggagcaccc

SEQ ID NO: 459565 - DNA, 24 bp, Homo sapiens
cgggggaggagcacccccagcctc

SEQ ID NO: 459566 - DNA, 22 bp, Homo sapiens
cgggggcatctgagtccagctc

SEQ ID NO: 459567 - DNA, 16 bp, Homo sapiens
cgggggctaactggcc

SEQ ID NO: 459568 - DNA, 15 bp, Homo sapiens
cggggtcgggggagg

SEQ ID NO: 459569 - DNA, 22 bp, Homo sapiens
cgggtctgtgggactggcccac

SEQ ID NO: 459570 - DNA, 23 bp, Homo sapiens
cgggtgcatttgagagaagccac

SEQ ID NO: 459571 - DNA, 18 bp, Homo sapiens
cgggtgcgtgaccggccc

SEQ ID NO: 459572 - DNA, 17 bp, Homo sapiens
cgggtgtggcctcagcc

SEQ ID NO: 459573 - DNA, 20 bp, Homo sapiens
cggtccaccccgtcccggcc

SEQ ID NO: 459574 - DNA, 12 bp, Homo sapiens
cgtcaatgtgaa

SEQ ID NO: 459575 - DNA, 15 bp, Homo sapiens
cgtcaatgtgaaata

SEQ ID NO: 459576 - DNA, 21 bp, Homo sapiens
cgtcacagcagtacttgctca

SEQ ID NO: 459577 - DNA, 20 bp, Homo sapiens
cgtcatcggaggctgggccc

SEQ ID NO: 459578 - DNA, 11 bp, Homo sapiens
cgtccccaggg

SEQ ID NO: 459579 - DNA, 14 bp, Homo sapiens
cgtccgcccgccca

SEQ ID NO: 459580 - DNA, 17 bp, Homo sapiens
cgtccgcccgcccaccc

SEQ ID NO: 459581 - DNA, 19 bp, Homo sapiens
cgtccgcccgcccaccccg

SEQ ID NO: 459582 - DNA, 18 bp, Homo sapiens
cgtccggcctgcagccca

SEQ ID NO: 459583 - DNA, 11 bp, Homo sapiens
cgtctgcccct

SEQ ID NO: 459584 - DNA, 19 bp, Homo sapiens
cgtctgccccttgacccca

SEQ ID NO: 459585 - DNA, 17 bp, Homo sapiens
cgtgacttcagactctc

SEQ ID NO: 459586 - DNA, 19 bp, Homo sapiens
cgtgacttcagactctctc

SEQ ID NO: 459587 - DNA, 13 bp, Homo sapiens
cgtgcccccagcg

SEQ ID NO: 459588 - DNA, 22 bp, Homo sapiens
cgtgccttccccgtgcggcccg

SEQ ID NO: 459589 - DNA, 20 bp, Homo sapiens
cgtgcgcagccgcgctctgc

SEQ ID NO: 459590 - DNA, 19 bp, Homo sapiens
cgtgcggcccgtgcgcagc

SEQ ID NO: 459591 - DNA, 22 bp, Homo sapiens
cgtgcggcccgtgcgcagccgc

SEQ ID NO: 459592 - DNA, 18 bp, Homo sapiens
cgtgggatccagagagaa

SEQ ID NO: 459593 - DNA, 15 bp, Homo sapiens
cgtggtgtgaggccc

SEQ ID NO: 459594 - DNA, 19 bp, Homo sapiens
cgtggtgtgaggcccccgg

SEQ ID NO: 459595 - DNA, 14 bp, Homo sapiens
cgtgtctctgagga

SEQ ID NO: 459596 - DNA, 17 bp, Homo sapiens
cgtgtggccctgtggga

SEQ ID NO: 459597 - DNA, 20 bp, Homo sapiens
cgtgtggccctgtgggagtc

SEQ ID NO: 459598 - DNA, 23 bp, Homo sapiens
cgttctgggtcagcttgaatgtc

SEQ ID NO: 459599 - DNA, 18 bp, Homo sapiens
cgtttcacatctgtatat

SEQ ID NO: 459600 - DNA, 15 bp, Homo sapiens
cgtttttgtgctgtg

SEQ ID NO: 459601 - DNA, 16 bp, Homo sapiens
ctaaaaaataactgtg

SEQ ID NO: 459602 - DNA, 22 bp, Homo sapiens
ctaaaaaataactgtgcactat

SEQ ID NO: 459603 - DNA, 18 bp, Homo sapiens
ctaaaaggaggacaggga

SEQ ID NO: 459604 - DNA, 21 bp, Homo sapiens
ctaaaatactcaccaaaatat

SEQ ID NO: 459605 - DNA, 15 bp, Homo sapiens
ctaaaattcaacaaa

SEQ ID NO: 459606 - DNA, 12 bp, Homo sapiens
ctaaaattctag

SEQ ID NO: 459607 - DNA, 17 bp, Homo sapiens
ctaaacattttgttatt

SEQ ID NO: 459608 - DNA, 17 bp, Homo sapiens
ctaaactgttttcatgt

SEQ ID NO: 459609 - DNA, 22 bp, Homo sapiens
ctaaaggggacagatcttgagc

SEQ ID NO: 459610 - DNA, 20 bp, Homo sapiens
ctaacctgggttgttgcaga

SEQ ID NO: 459611 - DNA, 14 bp, Homo sapiens
ctaactcaaggaat

SEQ ID NO: 459612 - DNA, 13 bp, Homo sapiens
ctaactggcccca

SEQ ID NO: 459613 - DNA, 14 bp, Homo sapiens
ctaactggccccag

SEQ ID NO: 459614 - DNA, 15 bp, Homo sapiens
ctaactggccccagg

SEQ ID NO: 459615 - DNA, 13 bp, Homo sapiens
ctaagaataaata

SEQ ID NO: 459616 - DNA, 22 bp, Homo sapiens
ctaagaataaataaagaagaaa

SEQ ID NO: 459617 - DNA, 16 bp, Homo sapiens
ctaagagccacaataa

SEQ ID NO: 459618 - DNA, 12 bp, Homo sapiens
ctaagcttattt

SEQ ID NO: 459619 - DNA, 23 bp, Homo sapiens
ctaaggagcactagaatgagaaa

SEQ ID NO: 459620 - DNA, 22 bp, Homo sapiens
ctaaggccgtgtctctgaggac

SEQ ID NO: 459621 - DNA, 14 bp, Homo sapiens
ctaattcaactctg

SEQ ID NO: 459622 - DNA, 15 bp, Homo sapiens
ctaattcaactctgt

SEQ ID NO: 459623 - DNA, 18 bp, Homo sapiens
ctacagagagtgaataca

SEQ ID NO: 459624 - DNA, 18 bp, Homo sapiens
ctacagagtgttataaca

SEQ ID NO: 459625 - DNA, 22 bp, Homo sapiens
ctacagctaatcagcattctca

SEQ ID NO: 459626 - DNA, 19 bp, Homo sapiens
ctacaggtattttcatcaa

SEQ ID NO: 459627 - DNA, 13 bp, Homo sapiens
ctacatctgaaat

SEQ ID NO: 459628 - DNA, 19 bp, Homo sapiens
ctaccaactaagttgtatt

SEQ ID NO: 459629 - DNA, 16 bp, Homo sapiens
ctaccctcttctcagc

SEQ ID NO: 459630 - DNA, 19 bp, Homo sapiens
ctaccctcttctcagctcc

SEQ ID NO: 459631 - DNA, 21 bp, Homo sapiens
ctaccgagtctcttctccact

SEQ ID NO: 459632 - DNA, 22 bp, Homo sapiens
ctaccgagtctcttctccactg

SEQ ID NO: 459633 - DNA, 13 bp, Homo sapiens
ctactaagaataa

SEQ ID NO: 459634 - DNA, 21 bp, Homo sapiens
ctactaagaataaataaagaa

SEQ ID NO: 459635 - DNA, 20 bp, Homo sapiens
ctactatttgaaaaaagaag

SEQ ID NO: 459636 - DNA, 21 bp, Homo sapiens
ctacttaggaaatactcagca

SEQ ID NO: 459637 - DNA, 13 bp, Homo sapiens
ctacttatttcag

SEQ ID NO: 459638 - DNA, 12 bp, Homo sapiens
ctactttataat

SEQ ID NO: 459639 - DNA, 17 bp, Homo sapiens
ctagaatgagaaatcat

SEQ ID NO: 459640 - DNA, 22 bp, Homo sapiens
ctagcaagaagattctaaaaca

SEQ ID NO: 459641 - DNA, 18 bp, Homo sapiens
ctagccctctttctctct

SEQ ID NO: 459642 - DNA, 22 bp, Homo sapiens
ctagctataacaactctatttt

SEQ ID NO: 459643 - DNA, 13 bp, Homo sapiens
ctaggcgctcaga

SEQ ID NO: 459644 - DNA, 14 bp, Homo sapiens
ctaggcgctcagag

SEQ ID NO: 459645 - DNA, 18 bp, Homo sapiens
ctaggcgctcagaggccg

SEQ ID NO: 459646 - DNA, 12 bp, Homo sapiens
ctaggctccctg

SEQ ID NO: 459647 - DNA, 14 bp, Homo sapiens
ctaggctccctgag

SEQ ID NO: 459648 - DNA, 14 bp, Homo sapiens
cgcccctcctcggg

SEQ ID NO: 459649 - DNA, 14 bp, Homo sapiens
cgcccgcccccgcc

SEQ ID NO: 459650 - DNA, 23 bp, Homo sapiens
cgcccgcccccgccctcgctccg

SEQ ID NO: 459651 - DNA, 12 bp, Homo sapiens
cgccctcctctg

SEQ ID NO: 459652 - DNA, 13 bp, Homo sapiens
cgccctcctctgc

SEQ ID NO: 459653 - DNA, 15 bp, Homo sapiens
cgccctcctctgccc

SEQ ID NO: 459654 - DNA, 16 bp, Homo sapiens
cgccctcctctgcccc

SEQ ID NO: 459655 - DNA, 12 bp, Homo sapiens
cgccctgggctg

SEQ ID NO: 459656 - DNA, 18 bp, Homo sapiens
cgccgcctcgggccgcct

SEQ ID NO: 459657 - DNA, 22 bp, Homo sapiens
cgccggggctggccctgccctc

SEQ ID NO: 459658 - DNA, 16 bp, Homo sapiens
cgccggttggccggct

SEQ ID NO: 459659 - DNA, 20 bp, Homo sapiens
cgccggttggccggctggcc

SEQ ID NO: 459660 - DNA, 21 bp, Homo sapiens
cgccggttggccggctggccg

SEQ ID NO: 459661 - DNA, 16 bp, Homo sapiens
cgcctcccgccgcctc

SEQ ID NO: 459662 - DNA, 15 bp, Homo sapiens
cgcctcctccagact

SEQ ID NO: 459663 - DNA, 17 bp, Homo sapiens
cgcctcgggccgcctcc

SEQ ID NO: 459664 - DNA, 20 bp, Homo sapiens
cgcctcgggccgcctcctcc

SEQ ID NO: 459665 - DNA, 12 bp, Homo sapiens
cgcctgcccgcc

SEQ ID NO: 459666 - DNA, 14 bp, Homo sapiens
cgcctgcgctcctc

SEQ ID NO: 459667 - DNA, 15 bp, Homo sapiens
cgcctgcgctcctct

SEQ ID NO: 459668 - DNA, 19 bp, Homo sapiens
cgcctgcgctcctctgcag

SEQ ID NO: 459669 - DNA, 20 bp, Homo sapiens
cgcctgcgctcctctgcagc

SEQ ID NO: 459670 - DNA, 14 bp, Homo sapiens
cgccttcaggttcc

SEQ ID NO: 459671 - DNA, 21 bp, Homo sapiens
cgcctttgctgaagtctcccc

SEQ ID NO: 459672 - DNA, 17 bp, Homo sapiens
cgcgcgtgcccccagcg

SEQ ID NO: 459673 - DNA, 21 bp, Homo sapiens
cgcgtgccttccccgtgcggc

SEQ ID NO: 459674 - DNA, 22 bp, Homo sapiens
cgctagagcattctggggtggg

SEQ ID NO: 459675 - DNA, 20 bp, Homo sapiens
cgctcaacctctcagatccc

SEQ ID NO: 459676 - DNA, 21 bp, Homo sapiens
cgctcacgctgacagcctcct

SEQ ID NO: 459677 - DNA, 12 bp, Homo sapiens
cgctcagccctc

SEQ ID NO: 459678 - DNA, 21 bp, Homo sapiens
cgctcccgcgggaagccagcc

SEQ ID NO: 459679 - DNA, 13 bp, Homo sapiens
cgctcctctgcag

SEQ ID NO: 459680 - DNA, 16 bp, Homo sapiens
cgctcctctgcagcct

SEQ ID NO: 459681 - DNA, 17 bp, Homo sapiens
cgctcctctgcagcctg

SEQ ID NO: 459682 - DNA, 14 bp, Homo sapiens
cgctcctctgcctt

SEQ ID NO: 459683 - DNA, 20 bp, Homo sapiens
cgctctgcccctccgtcccc

SEQ ID NO: 459684 - DNA, 22 bp, Homo sapiens
cgctctggggggttgcctcgag

SEQ ID NO: 459685 - DNA, 14 bp, Homo sapiens
cgctgacagcctcc

SEQ ID NO: 459686 - DNA, 17 bp, Homo sapiens
cgctgacagcctcctag

SEQ ID NO: 459687 - DNA, 19 bp, Homo sapiens
cgctgacagcctcctaggc

SEQ ID NO: 459688 - DNA, 14 bp, Homo sapiens
cgctgagggcaggg

SEQ ID NO: 459689 - DNA, 21 bp, Homo sapiens
cgctgcctggcgggcagcccc

SEQ ID NO: 459690 - DNA, 23 bp, Homo sapiens
cgctgcctggcgggcagcccctg

SEQ ID NO: 459691 - DNA, 14 bp, Homo sapiens
cgctggtaactgtt

SEQ ID NO: 459692 - DNA, 23 bp, Homo sapiens
cgctgtcctctcgagcccagatg

SEQ ID NO: 459693 - DNA, 13 bp, Homo sapiens
cgctgtgctccag

SEQ ID NO: 459694 - DNA, 23 bp, Homo sapiens
cgctgtgctccagcagtgctggg

SEQ ID NO: 459695 - DNA, 20 bp, Homo sapiens
cggaagtggcctgagaagag

SEQ ID NO: 459696 - DNA, 20 bp, Homo sapiens
cggaccggagcggctgagga

SEQ ID NO: 459697 - DNA, 18 bp, Homo sapiens
cggacgggacagcggccc

SEQ ID NO: 459698 - DNA, 12 bp, Homo sapiens
cggaggcgccca

SEQ ID NO: 459699 - DNA, 22 bp, Homo sapiens
cggaggctgggcccctgggatg

SEQ ID NO: 459700 - DNA, 15 bp, Homo sapiens
cggaggggcctggca

SEQ ID NO: 459701 - DNA, 16 bp, Homo sapiens
cggaggggcctggcag

SEQ ID NO: 459702 - DNA, 19 bp, Homo sapiens
cggaggggcttggagcaga

SEQ ID NO: 459703 - DNA, 14 bp, Homo sapiens
cggcaccgcccacc

SEQ ID NO: 459704 - DNA, 14 bp, Homo sapiens
cggcagaggcaggg

SEQ ID NO: 459705 - DNA, 15 bp, Homo sapiens
cggcagaggcagggc

SEQ ID NO: 459706 - DNA, 17 bp, Homo sapiens
cggcagaggcagggccc

SEQ ID NO: 459707 - DNA, 22 bp, Homo sapiens
cggcagaggcagggccctgggg

SEQ ID NO: 459708 - DNA, 15 bp, Homo sapiens
cggccagggaccccc

SEQ ID NO: 459709 - DNA, 17 bp, Homo sapiens
cggccagggacccccga

SEQ ID NO: 459710 - DNA, 19 bp, Homo sapiens
cggccagggacccccgagg

SEQ ID NO: 459711 - DNA, 23 bp, Homo sapiens
cggccagggacccccgaggcccc

SEQ ID NO: 459712 - DNA, 21 bp, Homo sapiens
cggcccacgcagagccccgga

SEQ ID NO: 459713 - DNA, 20 bp, Homo sapiens
cggccccacccaccctctgg

SEQ ID NO: 459714 - DNA, 18 bp, Homo sapiens
cggccccgcgcgtgcccc

SEQ ID NO: 459715 - DNA, 14 bp, Homo sapiens
cggcccgccacctt

SEQ ID NO: 459716 - DNA, 16 bp, Homo sapiens
cggcccggcccacgca

SEQ ID NO: 459717 - DNA, 16 bp, Homo sapiens
cggcccgtgcgcagcc

SEQ ID NO: 459718 - DNA, 18 bp, Homo sapiens
cggcctccaggctggggc

SEQ ID NO: 459719 - DNA, 19 bp, Homo sapiens
cggcctcgtgccatgatct

SEQ ID NO: 459720 - DNA, 14 bp, Homo sapiens
cggcctgcagccca

SEQ ID NO: 459721 - DNA, 15 bp, Homo sapiens
cggcctgcagcccag

SEQ ID NO: 459722 - DNA, 17 bp, Homo sapiens
cggctccccctgccagc

SEQ ID NO: 459723 - DNA, 20 bp, Homo sapiens
cggctgaggacggggcagag

SEQ ID NO: 459724 - DNA, 22 bp, Homo sapiens
cggctgaggacggggcagagct

SEQ ID NO: 459725 - DNA, 23 bp, Homo sapiens
cggctgaggacggggcagagctg

SEQ ID NO: 459726 - DNA, 20 bp, Homo sapiens
cggctggccggtccaccccg

SEQ ID NO: 459727 - DNA, 16 bp, Homo sapiens
cctggcgggcagcccc

SEQ ID NO: 459728 - DNA, 17 bp, Homo sapiens
cctggcgggcagcccct

SEQ ID NO: 459729 - DNA, 22 bp, Homo sapiens
cctggcgggcagcccctgctgg

SEQ ID NO: 459730 - DNA, 17 bp, Homo sapiens
cctggctcccacaggcc

SEQ ID NO: 459731 - DNA, 20 bp, Homo sapiens
cctggcttttcactgctggc

SEQ ID NO: 459732 - DNA, 12 bp, Homo sapiens
cctgggcccctc

SEQ ID NO: 459733 - DNA, 15 bp, Homo sapiens
cctgggcccctccac

SEQ ID NO: 459734 - DNA, 21 bp, Homo sapiens
cctgggcccctccacgcctcc

SEQ ID NO: 459735 - DNA, 12 bp, Homo sapiens
cctgggcctccc

SEQ ID NO: 459736 - DNA, 14 bp, Homo sapiens
cctgggcctcccgt

SEQ ID NO: 459737 - DNA, 16 bp, Homo sapiens
cctgggcctcccgtcc

SEQ ID NO: 459738 - DNA, 18 bp, Homo sapiens
cctgggctgtctgtcacc

SEQ ID NO: 459739 - DNA, 15 bp, Homo sapiens
cctggggggggcaag

SEQ ID NO: 459740 - DNA, 23 bp, Homo sapiens
cctggggtctctgagcagtgggg

SEQ ID NO: 459741 - DNA, 22 bp, Homo sapiens
cctggggtggttggaggcctgg

SEQ ID NO: 459742 - DNA, 15 bp, Homo sapiens
cctggtctggagccc

SEQ ID NO: 459743 - DNA, 17 bp, Homo sapiens
cctggtgcgctgtgctc

SEQ ID NO: 459744 - DNA, 14 bp, Homo sapiens
cctggtggcaccag

SEQ ID NO: 459745 - DNA, 17 bp, Homo sapiens
cctggtggcaccagatg

SEQ ID NO: 459746 - DNA, 18 bp, Homo sapiens
cctggtggcaccagatgc

SEQ ID NO: 459747 - DNA, 23 bp, Homo sapiens
cctggtggcaccagatgcaacct

SEQ ID NO: 459748 - DNA, 19 bp, Homo sapiens
cctgtaaggtttcaatgca

SEQ ID NO: 459749 - DNA, 19 bp, Homo sapiens
cctgtaatagcctcacctt

SEQ ID NO: 459750 - DNA, 23 bp, Homo sapiens
cctgtagtggcaaaaaagaacag

SEQ ID NO: 459751 - DNA, 14 bp, Homo sapiens
cctgtcctgctcac

SEQ ID NO: 459752 - DNA, 21 bp, Homo sapiens
cctgtctctccctaccctctt

SEQ ID NO: 459753 - DNA, 20 bp, Homo sapiens
cctgtgaataaaaaccctgt

SEQ ID NO: 459754 - DNA, 15 bp, Homo sapiens
cctgtgatcgtgtgt

SEQ ID NO: 459755 - DNA, 16 bp, Homo sapiens
cctgtgatcgtgtgtt

SEQ ID NO: 459756 - DNA, 13 bp, Homo sapiens
cctgtgctgctgc

SEQ ID NO: 459757 - DNA, 12 bp, Homo sapiens
cctgtgctttca

SEQ ID NO: 459758 - DNA, 13 bp, Homo sapiens
cctgtgggagtcc

SEQ ID NO: 459759 - DNA, 17 bp, Homo sapiens
cctgtgggggtggccat

SEQ ID NO: 459760 - DNA, 16 bp, Homo sapiens
ccgtccgtccgcccgc

SEQ ID NO: 459761 - DNA, 11 bp, Homo sapiens
ccgtctgcccc

SEQ ID NO: 459762 - DNA, 21 bp, Homo sapiens
ccgtctgccccttgaccccac

SEQ ID NO: 459763 - DNA, 13 bp, Homo sapiens
ccgtgagacacaa

SEQ ID NO: 459764 - DNA, 14 bp, Homo sapiens
ccgtgccttcagct

SEQ ID NO: 459765 - DNA, 13 bp, Homo sapiens
ccgtgcgcagccg

SEQ ID NO: 459766 - DNA, 15 bp, Homo sapiens
ccgtgcggcccgtgc

SEQ ID NO: 459767 - DNA, 19 bp, Homo sapiens
ccgtgcggcccgtgcgcag

SEQ ID NO: 459768 - DNA, 21 bp, Homo sapiens
ccgtgcggcccgtgcgcagcc

SEQ ID NO: 459769 - DNA, 14 bp, Homo sapiens
ccgtggcttcccgc

SEQ ID NO: 459770 - DNA, 15 bp, Homo sapiens
ccgtggcttcccgct

SEQ ID NO: 459771 - DNA, 21 bp, Homo sapiens
ccgtggcttcccgctcagccc

SEQ ID NO: 459772 - DNA, 16 bp, Homo sapiens
ccgtggtgtgaggccc

SEQ ID NO: 459773 - DNA, 18 bp, Homo sapiens
ccgtggtgtgaggccccc

SEQ ID NO: 459774 - DNA, 12 bp, Homo sapiens
ccgttcatctga

SEQ ID NO: 459775 - DNA, 14 bp, Homo sapiens
ccgttcatctgagg

SEQ ID NO: 459776 - DNA, 21 bp, Homo sapiens
ccgttcatctgaggagtccaa

SEQ ID NO: 459777 - DNA, 23 bp, Homo sapiens
ccgttgtgtgggtttactctgtg

SEQ ID NO: 459778 - DNA, 22 bp, Homo sapiens
cctaaataatatcctgaataac

SEQ ID NO: 459779 - DNA, 17 bp, Homo sapiens
cctaaatccattttcta

SEQ ID NO: 459780 - DNA, 15 bp, Homo sapiens
cctacagtatataag

SEQ ID NO: 459781 - DNA, 18 bp, Homo sapiens
cctacagtatataagctt

SEQ ID NO: 459782 - DNA, 12 bp, Homo sapiens
cctacatctgaa

SEQ ID NO: 459783 - DNA, 19 bp, Homo sapiens
cctaccgagtctcttctcc

SEQ ID NO: 459784 - DNA, 20 bp, Homo sapiens
cctaccgagtctcttctcca

SEQ ID NO: 459785 - DNA, 23 bp, Homo sapiens
cctaccgagtctcttctccactg

SEQ ID NO: 459786 - DNA, 12 bp, Homo sapiens
cctacctggtaa

SEQ ID NO: 459787 - DNA, 13 bp, Homo sapiens
cctagaagaaaac

SEQ ID NO: 459788 - DNA, 20 bp, Homo sapiens
cctagcacaaggagtgcccg

SEQ ID NO: 459789 - DNA, 21 bp, Homo sapiens
cctagcacaaggagtgcccgc

SEQ ID NO: 459790 - DNA, 17 bp, Homo sapiens
cctaggcgctcagaggc

SEQ ID NO: 459791 - DNA, 16 bp, Homo sapiens
cctaggctccctgagg

SEQ ID NO: 459792 - DNA, 19 bp, Homo sapiens
cctaggtctccacccctca

SEQ ID NO: 459793 - DNA, 15 bp, Homo sapiens
cctagtgatttttgg

SEQ ID NO: 459794 - DNA, 13 bp, Homo sapiens
cctagttctttgc

SEQ ID NO: 459795 - DNA, 22 bp, Homo sapiens
cctagttctttgcattcgtcct

SEQ ID NO: 459796 - DNA, 23 bp, Homo sapiens
cctataccgagacccaccatcct

SEQ ID NO: 459797 - DNA, 15 bp, Homo sapiens
cctcaagccaggaga

SEQ ID NO: 459798 - DNA, 16 bp, Homo sapiens
cctcaagccaggagac

SEQ ID NO: 459799 - DNA, 19 bp, Homo sapiens
cctcaagccaggagaccct

SEQ ID NO: 459800 - DNA, 15 bp, Homo sapiens
cctcactccactccc

SEQ ID NO: 459801 - DNA, 15 bp, Homo sapiens
cctcggctgtgtggg

SEQ ID NO: 459802 - DNA, 12 bp, Homo sapiens
cctcgggccgcc

SEQ ID NO: 459803 - DNA, 20 bp, Homo sapiens
cctcgggccgcctcctccag

SEQ ID NO: 459804 - DNA, 22 bp, Homo sapiens
cctcgggccgcctcctccagac

SEQ ID NO: 459805 - DNA, 18 bp, Homo sapiens
cctcgggcgcctgcgctc

SEQ ID NO: 459806 - DNA, 14 bp, Homo sapiens
cctcggtcagcacc

SEQ ID NO: 459807 - DNA, 18 bp, Homo sapiens
cctcgtccggcctgcagc

SEQ ID NO: 459808 - DNA, 19 bp, Homo sapiens
cctcgtccggcctgcagcc

SEQ ID NO: 459809 - DNA, 21 bp, Homo sapiens
cctcgtccggcctgcagccca

SEQ ID NO: 459810 - DNA, 22 bp, Homo sapiens
cctcgtccggcctgcagcccag

SEQ ID NO: 459811 - DNA, 19 bp, Homo sapiens
cctcgtctccctggccacc

SEQ ID NO: 459812 - DNA, 16 bp, Homo sapiens
cctctagaacagccag

SEQ ID NO: 459813 - DNA, 14 bp, Homo sapiens
cctctcactttttt

SEQ ID NO: 459814 - DNA, 15 bp, Homo sapiens
cctctccacccagag

SEQ ID NO: 459815 - DNA, 17 bp, Homo sapiens
cctctccacccagaggt

SEQ ID NO: 459816 - DNA, 12 bp, Homo sapiens
cctctccactgc

SEQ ID NO: 459817 - DNA, 13 bp, Homo sapiens
cctctccactgcc

SEQ ID NO: 459818 - DNA, 16 bp, Homo sapiens
cctctccactgccttc

SEQ ID NO: 459819 - DNA, 19 bp, Homo sapiens
cctctccactgccttcgat

SEQ ID NO: 459820 - DNA, 22 bp, Homo sapiens
cctctcccaaataaactcctta

SEQ ID NO: 459821 - DNA, 19 bp, Homo sapiens
cctctcctcgtccggcctg

SEQ ID NO: 459822 - DNA, 22 bp, Homo sapiens
cctctcctcgtccggcctgcag

SEQ ID NO: 459823 - DNA, 19 bp, Homo sapiens
cctctcctgagcctgtctc

SEQ ID NO: 459824 - DNA, 14 bp, Homo sapiens
cctctctctccctc

SEQ ID NO: 459825 - DNA, 13 bp, Homo sapiens
cctctctgtttac

SEQ ID NO: 459826 - DNA, 22 bp, Homo sapiens
cctctcttaccccgtccctttc

SEQ ID NO: 459827 - DNA, 17 bp, Homo sapiens
cctctgaaaatattttt

SEQ ID NO: 459828 - DNA, 23 bp, Homo sapiens
cctctgaaaatatttttttctag

SEQ ID NO: 459829 - DNA, 14 bp, Homo sapiens
cctctgcagcctga

SEQ ID NO: 459830 - DNA, 15 bp, Homo sapiens
cctctgcagcctgag

SEQ ID NO: 459831 - DNA, 16 bp, Homo sapiens
cctctgcagcctgagc

SEQ ID NO: 459832 - DNA, 17 bp, Homo sapiens
cctctgcagcctgagct

SEQ ID NO: 459833 - DNA, 23 bp, Homo sapiens
cctctgcagcctgagctccaccc

SEQ ID NO: 459834 - DNA, 19 bp, Homo sapiens
cctctgccccctcccccgc

SEQ ID NO: 459835 - DNA, 12 bp, Homo sapiens
cctctgccttgg

SEQ ID NO: 459836 - DNA, 13 bp, Homo sapiens
cctctgccttgga

SEQ ID NO: 459837 - DNA, 18 bp, Homo sapiens
cctctgctatgtctgtga

SEQ ID NO: 459838 - DNA, 17 bp, Homo sapiens
cccaggccctccctgac

SEQ ID NO: 459839 - DNA, 18 bp, Homo sapiens
cccaggcgccccttcccc

SEQ ID NO: 459840 - DNA, 15 bp, Homo sapiens
cccaggcggaggggc

SEQ ID NO: 459841 - DNA, 17 bp, Homo sapiens
cccaggctgcgcctgcc

SEQ ID NO: 459842 - DNA, 18 bp, Homo sapiens
cccaggctgcgcctgccc

SEQ ID NO: 459843 - DNA, 13 bp, Homo sapiens
cccagggtgcagg

SEQ ID NO: 459844 - DNA, 14 bp, Homo sapiens
cccagtgggacaga

SEQ ID NO: 459845 - DNA, 18 bp, Homo sapiens
cccagtgggacagaggag

SEQ ID NO: 459846 - DNA, 14 bp, Homo sapiens
cccagttagcccgg

SEQ ID NO: 459847 - DNA, 21 bp, Homo sapiens
cccagtttgggaactcatcaa

SEQ ID NO: 459848 - DNA, 17 bp, Homo sapiens
cccataagccctgagac

SEQ ID NO: 459849 - DNA, 19 bp, Homo sapiens
cccataagccctgagactc

SEQ ID NO: 459850 - DNA, 22 bp, Homo sapiens
cccataagccctgagactcccg

SEQ ID NO: 459851 - DNA, 12 bp, Homo sapiens
cccatatataaa

SEQ ID NO: 459852 - DNA, 21 bp, Homo sapiens
cccatccttcccgcagcacca

SEQ ID NO: 459853 - DNA, 19 bp, Homo sapiens
cccatcgctggaaaacagc

SEQ ID NO: 459854 - DNA, 14 bp, Homo sapiens
cccatggccccagc

SEQ ID NO: 459855 - DNA, 16 bp, Homo sapiens
cccatggccccagctg

SEQ ID NO: 459856 - DNA, 19 bp, Homo sapiens
cccatgtgcctgcaccagg

SEQ ID NO: 459857 - DNA, 17 bp, Homo sapiens
cccatgtgtcccctcac

SEQ ID NO: 459858 - DNA, 23 bp, Homo sapiens
cccatgtgtcccctcactctgtc

SEQ ID NO: 459859 - DNA, 19 bp, Homo sapiens
cccattctataaattcaac

SEQ ID NO: 459860 - DNA, 18 bp, Homo sapiens
ccccaaccctcggagccc

SEQ ID NO: 459861 - DNA, 13 bp, Homo sapiens
ccccaaggaagaa

SEQ ID NO: 459862 - DNA, 22 bp, Homo sapiens
ccccacacgccggggctggccc

SEQ ID NO: 459863 - DNA, 21 bp, Homo sapiens
ccccacccaccctctggtcct

SEQ ID NO: 459864 - DNA, 16 bp, Homo sapiens
ccccacccctccccac

SEQ ID NO: 459865 - DNA, 16 bp, Homo sapiens
ccccaccctcccctct

SEQ ID NO: 459866 - DNA, 18 bp, Homo sapiens
ccccaccctcccctctcc

SEQ ID NO: 459867 - DNA, 16 bp, Homo sapiens
ccccacggccgtccct

SEQ ID NO: 459868 - DNA, 14 bp, Homo sapiens
ccccactcagtagg

SEQ ID NO: 459869 - DNA, 14 bp, Homo sapiens
ccccactgagagct

SEQ ID NO: 459870 - DNA, 23 bp, Homo sapiens
ccccactgagagctgctcctttg

SEQ ID NO: 459871 - DNA, 22 bp, Homo sapiens
ccccacttatgctgctgtgaat

SEQ ID NO: 459872 - DNA, 17 bp, Homo sapiens
ccccagagactgcccac

SEQ ID NO: 459873 - DNA, 16 bp, Homo sapiens
ccccagctggctgggt

SEQ ID NO: 459874 - DNA, 23 bp, Homo sapiens
ccccaggcggaggggcttggagc

SEQ ID NO: 459875 - DNA, 15 bp, Homo sapiens
ccccagggtgcaggc

SEQ ID NO: 459876 - DNA, 22 bp, Homo sapiens
ccccagggtgcaggcgcgcacc

SEQ ID NO: 459877 - DNA, 15 bp, Homo sapiens
ccccataagccctga

SEQ ID NO: 459878 - DNA, 18 bp, Homo sapiens
ccccataagccctgagac

SEQ ID NO: 459879 - DNA, 14 bp, Homo sapiens
ccccatccttcccg

SEQ ID NO: 459880 - DNA, 21 bp, Homo sapiens
ccccatccttcccgcagcacc

SEQ ID NO: 459881 - DNA, 17 bp, Homo sapiens
ccctccacacctccacc

SEQ ID NO: 459882 - DNA, 18 bp, Homo sapiens
ccctccacacctccaccc

SEQ ID NO: 459883 - DNA, 17 bp, Homo sapiens
ccctccacgcctcctgg

SEQ ID NO: 459884 - DNA, 18 bp, Homo sapiens
ccctccacgcctcctggc

SEQ ID NO: 459885 - DNA, 14 bp, Homo sapiens
ccctccactctgag

SEQ ID NO: 459886 - DNA, 19 bp, Homo sapiens
ccctccactctgaggtctc

SEQ ID NO: 459887 - DNA, 22 bp, Homo sapiens
ccctccagacccctaccctttc

SEQ ID NO: 459888 - DNA, 14 bp, Homo sapiens
ccctccccaaggaa

SEQ ID NO: 459889 - DNA, 17 bp, Homo sapiens
ccctccccacccaccac

SEQ ID NO: 459890 - DNA, 23 bp, Homo sapiens
ccctccccatggtgcagtgaaga

SEQ ID NO: 459891 - DNA, 15 bp, Homo sapiens
ccctcccccacggcc

SEQ ID NO: 459892 - DNA, 14 bp, Homo sapiens
ccctcccccgcaga

SEQ ID NO: 459893 - DNA, 22 bp, Homo sapiens
ccctcccctctcctgagcctgt

SEQ ID NO: 459894 - DNA, 14 bp, Homo sapiens
ccctccctccacac

SEQ ID NO: 459895 - DNA, 15 bp, Homo sapiens
ccctccctccacacc

SEQ ID NO: 459896 - DNA, 21 bp, Homo sapiens
ccctccctgactccctgtggg

SEQ ID NO: 459897 - DNA, 14 bp, Homo sapiens
ccctccctgcccct

SEQ ID NO: 459898 - DNA, 12 bp, Homo sapiens
ccctccctgtcc

SEQ ID NO: 459899 - DNA, 14 bp, Homo sapiens
ccctcccttcaacc

SEQ ID NO: 459900 - DNA, 14 bp, Homo sapiens
ccctccgtccccag

SEQ ID NO: 459901 - DNA, 17 bp, Homo sapiens
ccctccgtccccagggt

SEQ ID NO: 459902 - DNA, 19 bp, Homo sapiens
ccctccgtccccagggtgc

SEQ ID NO: 459903 - DNA, 14 bp, Homo sapiens
ccctcctcgggcgc

SEQ ID NO: 459904 - DNA, 21 bp, Homo sapiens
ccctcctcgggcgcctgcgct

SEQ ID NO: 459905 - DNA, 15 bp, Homo sapiens
ccctcctctcctcgt

SEQ ID NO: 459906 - DNA, 13 bp, Homo sapiens
ccctcctctgccc

SEQ ID NO: 459907 - DNA, 18 bp, Homo sapiens
ccctccttccccacccca

SEQ ID NO: 459908 - DNA, 19 bp, Homo sapiens
ccctccttccccaccccat

SEQ ID NO: 459909 - DNA, 19 bp, Homo sapiens
ccctccttctcccctccag

SEQ ID NO: 459910 - DNA, 20 bp, Homo sapiens
ccctccttctcccctccaga

SEQ ID NO: 459911 - DNA, 13 bp, Homo sapiens
ccctcgctccggg

SEQ ID NO: 459912 - DNA, 18 bp, Homo sapiens
ccctcggagccccccact

SEQ ID NO: 459913 - DNA, 20 bp, Homo sapiens
ccctcggtcagcaccgtggt

SEQ ID NO: 459914 - DNA, 21 bp, Homo sapiens
ccctcggtcagcaccgtggtg

SEQ ID NO: 459915 - DNA, 19 bp, Homo sapiens
ccctcgtctccctggccac

SEQ ID NO: 459916 - DNA, 12 bp, Homo sapiens
ccctctccaccc

SEQ ID NO: 459917 - DNA, 16 bp, Homo sapiens
ccctctccacccagag

SEQ ID NO: 459918 - DNA, 19 bp, Homo sapiens
ccctctccacccagaggtc

SEQ ID NO: 459919 - DNA, 19 bp, Homo sapiens
ccctctcctgagcctgtct

SEQ ID NO: 459920 - DNA, 21 bp, Homo sapiens
ccctctcctgagcctgtctct

SEQ ID NO: 459921 - DNA, 18 bp, Homo sapiens
ccctctctgtttaccctc

SEQ ID NO: 459922 - DNA, 22 bp, Homo sapiens
ccctctctgtttaccctccctg

SEQ ID NO: 459923 - DNA, 17 bp, Homo sapiens
ccctctcttaccccgtc

SEQ ID NO: 459924 - DNA, 12 bp, Homo sapiens
ccctcttccccc

SEQ ID NO: 459925 - DNA, 14 bp, Homo sapiens
ccctctttctctct

SEQ ID NO: 459926 - DNA, 16 bp, Homo sapiens
ccctctttctctctgt

SEQ ID NO: 459927 - DNA, 19 bp, Homo sapiens
ccctctttctctctgtgtg

SEQ ID NO: 459928 - DNA, 16 bp, Homo sapiens
ccctgacttcccagct

SEQ ID NO: 459929 - DNA, 18 bp, Homo sapiens
ccctgacttcccagctgg

SEQ ID NO: 459930 - DNA, 19 bp, Homo sapiens
ccctgacttcccagctggc

SEQ ID NO: 459931 - DNA, 21 bp, Homo sapiens
ccctgacttcccagctggcag

SEQ ID NO: 459932 - DNA, 19 bp, Homo sapiens
ccctgagactcccgccttt

SEQ ID NO: 459933 - DNA, 21 bp, Homo sapiens
ccctgaggtacctttccaccc

SEQ ID NO: 459934 - DNA, 23 bp, Homo sapiens
ccctgaggtacctttccacccag

SEQ ID NO: 459935 - DNA, 15 bp, Homo sapiens
ccctgcaccttgggc

SEQ ID NO: 459936 - DNA, 13 bp, Homo sapiens
ccctgcatccctt

SEQ ID NO: 459937 - DNA, 14 bp, Homo sapiens
cattcatttacaac

SEQ ID NO: 459938 - DNA, 23 bp, Homo sapiens
cattcatttacaacttccagatt

SEQ ID NO: 459939 - DNA, 23 bp, Homo sapiens
cattctatgactcttgtctcctc

SEQ ID NO: 459940 - DNA, 16 bp, Homo sapiens
cattctcactcctacc

SEQ ID NO: 459941 - DNA, 17 bp, Homo sapiens
cattctcactcctacct

SEQ ID NO: 459942 - DNA, 23 bp, Homo sapiens
cattctttacagcaaatgttata

SEQ ID NO: 459943 - DNA, 21 bp, Homo sapiens
cattgcaaaaggttaagccat

SEQ ID NO: 459944 - DNA, 15 bp, Homo sapiens
cattggttacaaatt

SEQ ID NO: 459945 - DNA, 22 bp, Homo sapiens
catttacaacttccagatttga

SEQ ID NO: 459946 - DNA, 16 bp, Homo sapiens
catttagtcctcacct

SEQ ID NO: 459947 - DNA, 17 bp, Homo sapiens
catttagtcctcacctt

SEQ ID NO: 459948 - DNA, 18 bp, Homo sapiens
catttatctactatttga

SEQ ID NO: 459949 - DNA, 16 bp, Homo sapiens
catttgagagaagcca

SEQ ID NO: 459950 - DNA, 23 bp, Homo sapiens
catttgagagaagccacgctgtc

SEQ ID NO: 459951 - DNA, 18 bp, Homo sapiens
catttgggagactgagct

SEQ ID NO: 459952 - DNA, 14 bp, Homo sapiens
cattttgtctggct

SEQ ID NO: 459953 - DNA, 16 bp, Homo sapiens
cattttgtctggctgt

SEQ ID NO: 459954 - DNA, 21 bp, Homo sapiens
ccaaacttctgaactttggaa

SEQ ID NO: 459955 - DNA, 18 bp, Homo sapiens
ccaaagaaactcagaaga

SEQ ID NO: 459956 - DNA, 19 bp, Homo sapiens
ccaaagaaactcagaagag

SEQ ID NO: 459957 - DNA, 16 bp, Homo sapiens
ccaaataaactcctta

SEQ ID NO: 459958 - DNA, 18 bp, Homo sapiens
ccaaccaatgcacacagt

SEQ ID NO: 459959 - DNA, 15 bp, Homo sapiens
ccaacccccacctcc

SEQ ID NO: 459960 - DNA, 15 bp, Homo sapiens
ccaaccctcggagcc

SEQ ID NO: 459961 - DNA, 17 bp, Homo sapiens
ccaactaagttgtattt

SEQ ID NO: 459962 - DNA, 12 bp, Homo sapiens
ccaactccaggg

SEQ ID NO: 459963 - DNA, 20 bp, Homo sapiens
ccaactccgcccagcctctc

SEQ ID NO: 459964 - DNA, 12 bp, Homo sapiens
ccaactctggcc

SEQ ID NO: 459965 - DNA, 18 bp, Homo sapiens
ccaagccagggttccaga

SEQ ID NO: 459966 - DNA, 14 bp, Homo sapiens
ccaagccgtggctt

SEQ ID NO: 459967 - DNA, 17 bp, Homo sapiens
ccaagccgtggcttccc

SEQ ID NO: 459968 - DNA, 23 bp, Homo sapiens
ccaagccgtggcttcccgctcag

SEQ ID NO: 459969 - DNA, 18 bp, Homo sapiens
ccaaggaagaacaaatat

SEQ ID NO: 459970 - DNA, 19 bp, Homo sapiens
ccaagggacagtggtctaa

SEQ ID NO: 459971 - DNA, 23 bp, Homo sapiens
ccaagggaggggagaaaggaact

SEQ ID NO: 459972 - DNA, 20 bp, Homo sapiens
ccaagggtatctgctgcctc

SEQ ID NO: 459973 - DNA, 18 bp, Homo sapiens
ccaaggtggtcttggaga

SEQ ID NO: 459974 - DNA, 23 bp, Homo sapiens
ccaaggtggtcttggagaggagg

SEQ ID NO: 459975 - DNA, 24 bp, Homo sapiens
ccaaggtggtcttggagaggaggt

SEQ ID NO: 459976 - DNA, 20 bp, Homo sapiens
ccaagtaaccaggccccagc

SEQ ID NO: 459977 - DNA, 17 bp, Homo sapiens
ccaagtgtacatttgat

SEQ ID NO: 459978 - DNA, 16 bp, Homo sapiens
ccaagtgtgtgtgcaa

SEQ ID NO: 459979 - DNA, 14 bp, Homo sapiens
ccaataccctagaa

SEQ ID NO: 459980 - DNA, 21 bp, Homo sapiens
cagagctgagtcggctgggca

SEQ ID NO: 459981 - DNA, 22 bp, Homo sapiens
cagagctgagtcggctgggcag

SEQ ID NO: 459982 - DNA, 23 bp, Homo sapiens
cagagctgagtcggctgggcagg

SEQ ID NO: 459983 - DNA, 12 bp, Homo sapiens
cagaggcagggc

SEQ ID NO: 459984 - DNA, 13 bp, Homo sapiens
cagaggcagggcc

SEQ ID NO: 459985 - DNA, 16 bp, Homo sapiens
cagaggtctccctata

SEQ ID NO: 459986 - DNA, 16 bp, Homo sapiens
cagagtaggtgggtct

SEQ ID NO: 459987 - DNA, 17 bp, Homo sapiens
cagagtaggtgggtctt

SEQ ID NO: 459988 - DNA, 14 bp, Homo sapiens
cagagtggatctgg

SEQ ID NO: 459989 - DNA, 20 bp, Homo sapiens
cagagtggatctggagtctg

SEQ ID NO: 459990 - DNA, 19 bp, Homo sapiens
cagagtgttataacaccat

SEQ ID NO: 459991 - DNA, 21 bp, Homo sapiens
cagatatcgagagtttctatg

SEQ ID NO: 459992 - DNA, 20 bp, Homo sapiens
cagatccctcggtcagcacc

SEQ ID NO: 459993 - DNA, 14 bp, Homo sapiens
cagatcgtacttga

SEQ ID NO: 459994 - DNA, 16 bp, Homo sapiens
cagatgacacataaat

SEQ ID NO: 459995 - DNA, 18 bp, Homo sapiens
cagatgacacataaatct

SEQ ID NO: 459996 - DNA, 15 bp, Homo sapiens
cagatgatctctcca

SEQ ID NO: 459997 - DNA, 18 bp, Homo sapiens
cagatgatctctccacgg

SEQ ID NO: 459998 - DNA, 22 bp, Homo sapiens
cagatgtttgttttcaaaatac

SEQ ID NO: 459999 - DNA, 22 bp, Homo sapiens
cagattcacctccattaaccaa

SEQ ID NO: 460000 - DNA, 19 bp, Homo sapiens
cagcaaattcttgaataaa

SEQ ID NO: 460001 - DNA, 21 bp, Homo sapiens
cagcaaattcttgaataaact

SEQ ID NO: 460002 - DNA, 11 bp, Homo sapiens
cagcaccctcc

SEQ ID NO: 460003 - DNA, 14 bp, Homo sapiens
cagcaccctccccc

SEQ ID NO: 460004 - DNA, 18 bp, Homo sapiens
cagcaccctctcctgggg

SEQ ID NO: 460005 - DNA, 16 bp, Homo sapiens
tgctgttttatgtcat

SEQ ID NO: 460006 - DNA, 13 bp, Homo sapiens
tgcttaacataaa

SEQ ID NO: 460007 - DNA, 21 bp, Homo sapiens
tgcttaacataaacttgtact

SEQ ID NO: 460008 - DNA, 22 bp, Homo sapiens
tgcttaacataaacttgtactt

SEQ ID NO: 460009 - DNA, 20 bp, Homo sapiens
tgcttaaggaaaagagaaac

SEQ ID NO: 460010 - DNA, 14 bp, Homo sapiens
tgcttgttcttcct

SEQ ID NO: 460011 - DNA, 21 bp, Homo sapiens
tgctttaaagtacctgtagtg

SEQ ID NO: 460012 - DNA, 17 bp, Homo sapiens
tgctttcatgtttaaga

SEQ ID NO: 460013 - DNA, 16 bp, Homo sapiens
tgctttgggctgccct

SEQ ID NO: 460014 - DNA, 18 bp, Homo sapiens
tgctttgggctgccctgg

SEQ ID NO: 460015 - DNA, 22 bp, Homo sapiens
tggaaacaaggaaggacatttc

SEQ ID NO: 460016 - DNA, 16 bp, Homo sapiens
tggaaagggtgtggct

SEQ ID NO: 460017 - DNA, 18 bp, Homo sapiens
tggaaagggtgtggcttg

SEQ ID NO: 460018 - DNA, 14 bp, Homo sapiens
tggaaccttccctc

SEQ ID NO: 460019 - DNA, 15 bp, Homo sapiens
tggaattatgtataa

SEQ ID NO: 460020 - DNA, 21 bp, Homo sapiens
tggacttttgttcatgggaga

SEQ ID NO: 460021 - DNA, 18 bp, Homo sapiens
tggagagctcagtacagg

SEQ ID NO: 460022 - DNA, 21 bp, Homo sapiens
tggagaggaggtgtggagtgg

SEQ ID NO: 460023 - DNA, 23 bp, Homo sapiens
tggagaggaggtgtggagtggag

SEQ ID NO: 460024 - DNA, 13 bp, Homo sapiens
tggagcagagacg

SEQ ID NO: 460025 - DNA, 18 bp, Homo sapiens
tggagcagagacggcagc

SEQ ID NO: 460026 - DNA, 23 bp, Homo sapiens
tggaggaaaaccaagccgtggct

SEQ ID NO: 460027 - DNA, 23 bp, Homo sapiens
tggaggccaccaagctgctctcc

SEQ ID NO: 460028 - DNA, 20 bp, Homo sapiens
tggaggcctggtctggagcc

SEQ ID NO: 460029 - DNA, 17 bp, Homo sapiens
tggagtctgaaggagag

SEQ ID NO: 460030 - DNA, 18 bp, Homo sapiens
tggagtcttcctgtagtg

SEQ ID NO: 460031 - DNA, 18 bp, Homo sapiens
tggataggagcttccaga

SEQ ID NO: 460032 - DNA, 20 bp, Homo sapiens
tggatccatacaaaactatc

SEQ ID NO: 460033 - DNA, 13 bp, Homo sapiens
tggatgattcttt

SEQ ID NO: 460034 - DNA, 18 bp, Homo sapiens
tggatgtagtctgaggcc

SEQ ID NO: 460035 - DNA, 18 bp, Homo sapiens
tggattctatatttcata

SEQ ID NO: 460036 - DNA, 14 bp, Homo sapiens
tggatttcctttga

SEQ ID NO: 460037 - DNA, 14 bp, Homo sapiens
tggattttctttct

SEQ ID NO: 460038 - DNA, 18 bp, Homo sapiens
tggattttctttctatgt

SEQ ID NO: 460039 - DNA, 19 bp, Homo sapiens
tggattttctttctatgta

SEQ ID NO: 460040 - DNA, 23 bp, Homo sapiens
tggattttctttctatgtagaac

SEQ ID NO: 460041 - DNA, 15 bp, Homo sapiens
tggcaaaaaagaaca

SEQ ID NO: 460042 - DNA, 16 bp, Homo sapiens
tggcaaaaaagaacag

SEQ ID NO: 460043 - DNA, 13 bp, Homo sapiens
tggcaagtttttg

SEQ ID NO: 460044 - DNA, 18 bp, Homo sapiens
aaatagtttcaaatgagt

SEQ ID NO: 460045 - DNA, 21 bp, Homo sapiens
aaatagtttcaaatgagttta

SEQ ID NO: 460046 - DNA, 21 bp, Homo sapiens
aaatatagttgaacaagattt

SEQ ID NO: 460047 - DNA, 19 bp, Homo sapiens
aaatatgattctcctctcc

SEQ ID NO: 460048 - DNA, 19 bp, Homo sapiens
aaatattgctattgtttat

SEQ ID NO: 460049 - DNA, 23 bp, Homo sapiens
aaatatttttttctagctataac

SEQ ID NO: 460050 - DNA, 14 bp, Homo sapiens
aaatcaatttaaag

SEQ ID NO: 460051 - DNA, 23 bp, Homo sapiens
aaatcacagatgggtattaaact

SEQ ID NO: 460052 - DNA, 22 bp, Homo sapiens
aaatctgtctgattctatgcct

SEQ ID NO: 460053 - DNA, 23 bp, Homo sapiens
aaatctgtctgattctatgcctg

SEQ ID NO: 460054 - DNA, 13 bp, Homo sapiens
aattatatgatat

SEQ ID NO: 460055 - DNA, 19 bp, Homo sapiens
aattatatgatatgcatgt

SEQ ID NO: 460056 - DNA, 15 bp, Homo sapiens
aattattactttaaa

SEQ ID NO: 460057 - DNA, 12 bp, Homo sapiens
aattattctagt

SEQ ID NO: 460058 - DNA, 14 bp, Homo sapiens
aattattctagtca

SEQ ID NO: 460059 - DNA, 19 bp, Homo sapiens
aattattctagtcaactgc

SEQ ID NO: 460060 - DNA, 12 bp, Homo sapiens
aattattggtaa

SEQ ID NO: 460061 - DNA, 16 bp, Homo sapiens
aattcaacacttattt

SEQ ID NO: 460062 - DNA, 14 bp, Homo sapiens
aattccaccaggat

SEQ ID NO: 460063 - DNA, 16 bp, Homo sapiens
aattctagtctctgat

SEQ ID NO: 460064 - DNA, 13 bp, Homo sapiens
aattctataagag

SEQ ID NO: 460065 - DNA, 19 bp, Homo sapiens
aattctataagagacaaag

SEQ ID NO: 460066 - DNA, 13 bp, Homo sapiens
aattcttgcactg

SEQ ID NO: 460067 - DNA, 16 bp, Homo sapiens
aattggctcctttccc

SEQ ID NO: 460068 - DNA, 17 bp, Homo sapiens
aattggctcctttccca

SEQ ID NO: 460069 - DNA, 15 bp, Homo sapiens
aattgtgccaaagat

SEQ ID NO: 460070 - DNA, 17 bp, Homo sapiens
aattgtgccaaagatag

SEQ ID NO: 460071 - DNA, 19 bp, Homo sapiens
aattgttatgtaaacatca

SEQ ID NO: 460072 - DNA, 15 bp, Homo sapiens
aattgtttaaaagca

SEQ ID NO: 460073 - DNA, 20 bp, Homo sapiens
aatttaactactaagaataa

SEQ ID NO: 460074 - DNA, 12 bp, Homo sapiens
aatttaactgca

SEQ ID NO: 460075 - DNA, 15 bp, Homo sapiens
aatttatctgtgaat

SEQ ID NO: 460076 - DNA, 22 bp, Homo sapiens
aatttatcttccatatgctctt

SEQ ID NO: 460077 - DNA, 17 bp, Homo sapiens
aatttcaaaatgcatgt

SEQ ID NO: 460078 - DNA, 15 bp, Homo sapiens
aatttcataaattgg

SEQ ID NO: 460079 - DNA, 16 bp, Homo sapiens
aatttgccagacagag

SEQ ID NO: 460080 - DNA, 18 bp, Homo sapiens
aatttgccagacagagat

SEQ ID NO: 460081 - DNA, 14 bp, Homo sapiens
aattttaaaaaata

SEQ ID NO: 460082 - DNA, 17 bp, Homo sapiens
aattttaaaaaataaca

SEQ ID NO: 460083 - DNA, 12 bp, Homo sapiens
acaaaaggctgg

SEQ ID NO: 460084 - DNA, 21 bp, Homo sapiens
acaaaaggctggatgtgcttt

SEQ ID NO: 460085 - DNA, 23 bp, Homo sapiens
acaaaaggctggatgtgctttca

SEQ ID NO: 460086 - DNA, 18 bp, Homo sapiens
acaaacagaaacgagatt

SEQ ID NO: 460087 - DNA, 14 bp, Homo sapiens
acaaagctgtcact

SEQ ID NO: 460088 - DNA, 21 bp, Homo sapiens
acaaatatgattctcctctcc

SEQ ID NO: 460089 - DNA, 15 bp, Homo sapiens
acaaatatttcactt

SEQ ID NO: 460090 - DNA, 20 bp, Homo sapiens
acaaccactgggatcagctg

SEQ ID NO: 460091 - DNA, 15 bp, Homo sapiens
acaaccatagaactg

SEQ ID NO: 460092 - DNA, 17 bp, Homo sapiens
acaactaacaatgcctt

SEQ ID NO: 460093 - DNA, 14 bp, Homo sapiens
acaactctattttt

SEQ ID NO: 460094 - DNA, 13 bp, Homo sapiens
acaaggagtgccc

SEQ ID NO: 460095 - DNA, 21 bp, Homo sapiens
acaagtatgaataaagacacc

SEQ ID NO: 460096 - DNA, 14 bp, Homo sapiens
acaataagccactg

SEQ ID NO: 460097 - DNA, 16 bp, Homo sapiens
acaatgccttgttgta

SEQ ID NO: 460098 - DNA, 14 bp, Homo sapiens
acaggaatttctgt

SEQ ID NO: 460099 - DNA, 18 bp, Homo sapiens
acaggacacgaaggctgc

SEQ ID NO: 460100 - DNA, 16 bp, Homo sapiens
acagggcaggagctgc

SEQ ID NO: 460101 - DNA, 13 bp, Homo sapiens
acagggtggggct

SEQ ID NO: 460102 - DNA, 17 bp, Homo sapiens
acagggtggggcttaga

SEQ ID NO: 460103 - DNA, 19 bp, Homo sapiens
acagtattaacatcaaaga

SEQ ID NO: 460104 - DNA, 18 bp, Homo sapiens
acagtgcatctcagccca

SEQ ID NO: 460105 - DNA, 17 bp, Homo sapiens
acagtggcaagctacca

SEQ ID NO: 460106 - DNA, 15 bp, Homo sapiens
acagtggggcccatg

SEQ ID NO: 460107 - DNA, 16 bp, Homo sapiens
acagtggggcccatgg

SEQ ID NO: 460108 - DNA, 22 bp, Homo sapiens
acagtggggcccatggccccag

SEQ ID NO: 460109 - DNA, 23 bp, Homo sapiens
acagtggggcccatggccccagc

SEQ ID NO: 460110 - DNA, 18 bp, Homo sapiens
acagtgggggtgcctggt

SEQ ID NO: 460111 - DNA, 19 bp, Homo sapiens
acagtgtggcttaaacatt

SEQ ID NO: 460112 - DNA, 20 bp, Homo sapiens
acagtgtggcttaaacattt

SEQ ID NO: 460113 - DNA, 22 bp, Homo sapiens
acagtttgcaatcttatgttga

SEQ ID NO: 460114 - DNA, 16 bp, Homo sapiens
acataaacttgtactt

SEQ ID NO: 460115 - DNA, 24 bp, Homo sapiens
acataaagtaataactgttagaat

SEQ ID NO: 460116 - DNA, 13 bp, Homo sapiens
acataaatctgtc

SEQ ID NO: 460117 - DNA, 15 bp, Homo sapiens
acataaatctgtctg

SEQ ID NO: 460118 - DNA, 17 bp, Homo sapiens
acataaatctgtctgat

SEQ ID NO: 460119 - DNA, 18 bp, Homo sapiens
acataaatctgtctgatt

SEQ ID NO: 460120 - DNA, 15 bp, Homo sapiens
acatacatctaagtc

SEQ ID NO: 460121 - DNA, 20 bp, Homo sapiens
acataggtgctcttcctcat

SEQ ID NO: 460122 - DNA, 21 bp, Homo sapiens
acatatttgtagctagaatat

SEQ ID NO: 460123 - DNA, 15 bp, Homo sapiens
acatccggaacagcc

SEQ ID NO: 460124 - DNA, 17 bp, Homo sapiens
acatctaagtcagtttc

SEQ ID NO: 460125 - DNA, 22 bp, Homo sapiens
acatctaagtcagtttcacata

SEQ ID NO: 460126 - DNA, 20 bp, Homo sapiens
acatgcacagtttgcaatct

SEQ ID NO: 460127 - DNA, 15 bp, Homo sapiens
acatgccgaatgcca

SEQ ID NO: 460128 - DNA, 18 bp, Homo sapiens
acattaaacactgtaatc

SEQ ID NO: 460129 - DNA, 18 bp, Homo sapiens
acattagcagtttgcttt

SEQ ID NO: 460130 - DNA, 22 bp, Homo sapiens
acattagcagtttgctttgtat

SEQ ID NO: 460131 - DNA, 23 bp, Homo sapiens
acattgcaggaagagatgctcta

SEQ ID NO: 460132 - DNA, 23 bp, Homo sapiens
acattgtattttactttgtgcaa

SEQ ID NO: 460133 - DNA, 17 bp, Homo sapiens
accaaaatatagttaat

SEQ ID NO: 460134 - DNA, 16 bp, Homo sapiens
accaacgggtctgtgg

SEQ ID NO: 460135 - DNA, 22 bp, Homo sapiens
accaacgggtctgtgggactgg

SEQ ID NO: 460136 - DNA, 23 bp, Homo sapiens
accaagtaaccaggccccagcct

SEQ ID NO: 460137 - DNA, 18 bp, Homo sapiens
accaataataagagccct

SEQ ID NO: 460138 - DNA, 18 bp, Homo sapiens
accacacacacccttccc

SEQ ID NO: 460139 - DNA, 19 bp, Homo sapiens
accacacacacccttcccc

SEQ ID NO: 460140 - DNA, 21 bp, Homo sapiens
accacacacacccttccccac

SEQ ID NO: 460141 - DNA, 23 bp, Homo sapiens
accagcactcccagggcccgagc

SEQ ID NO: 460142 - DNA, 16 bp, Homo sapiens
accagcatagttctgc

SEQ ID NO: 460143 - DNA, 12 bp, Homo sapiens
accagcctgagc

SEQ ID NO: 460144 - DNA, 13 bp, Homo sapiens
accagcctgagcc

SEQ ID NO: 460145 - DNA, 14 bp, Homo sapiens
accagcctgagcca

SEQ ID NO: 460146 - DNA, 13 bp, Homo sapiens
accaggccccagc

SEQ ID NO: 460147 - DNA, 15 bp, Homo sapiens
accatatgattgaaa

SEQ ID NO: 460148 - DNA, 23 bp, Homo sapiens
accatatgattgaaaagaagaaa

SEQ ID NO: 460149 - DNA, 14 bp, Homo sapiens
accatcccactgat

SEQ ID NO: 460150 - DNA, 14 bp, Homo sapiens
accatccttccatc

SEQ ID NO: 460151 - DNA, 16 bp, Homo sapiens
accatccttccatcct

SEQ ID NO: 460152 - DNA, 15 bp, Homo sapiens
accattccccatggg

SEQ ID NO: 460153 - DNA, 19 bp, Homo sapiens
accatttagtcctcacctt

SEQ ID NO: 460154 - DNA, 18 bp, Homo sapiens
accatttatctactattt

SEQ ID NO: 460155 - DNA, 17 bp, Homo sapiens
acccaattttaaaaaat

SEQ ID NO: 460156 - DNA, 20 bp, Homo sapiens
acccacaccccgtctgcccc

SEQ ID NO: 460157 - DNA, 22 bp, Homo sapiens
acccacaccccgtctgcccctt

SEQ ID NO: 460158 - DNA, 16 bp, Homo sapiens
acccaccatccttcca

SEQ ID NO: 460159 - DNA, 21 bp, Homo sapiens
acccaccatccttccatcctg

SEQ ID NO: 460160 - DNA, 18 bp, Homo sapiens
acccaccctctggtcctt

SEQ ID NO: 460161 - DNA, 19 bp, Homo sapiens
acccactagccctctttct

SEQ ID NO: 460162 - DNA, 14 bp, Homo sapiens
acccagaccctcct

SEQ ID NO: 460163 - DNA, 19 bp, Homo sapiens
acccagaccctccttcccc

SEQ ID NO: 460164 - DNA, 16 bp, Homo sapiens
acccagaggtctccct

SEQ ID NO: 460165 - DNA, 18 bp, Homo sapiens
acccagaggtctccctat

SEQ ID NO: 460166 - DNA, 12 bp, Homo sapiens
acccagtgttca

SEQ ID NO: 460167 - DNA, 16 bp, Homo sapiens
acccagtgttcagcat

SEQ ID NO: 460168 - DNA, 19 bp, Homo sapiens
accccacacgccggggctg

SEQ ID NO: 460169 - DNA, 22 bp, Homo sapiens
accccacacgccggggctggcc

SEQ ID NO: 460170 - DNA, 14 bp, Homo sapiens
accccactgagagc

SEQ ID NO: 460171 - DNA, 15 bp, Homo sapiens
accccactgagagct

SEQ ID NO: 460172 - DNA, 17 bp, Homo sapiens
accccactgagagctgc

SEQ ID NO: 460173 - DNA, 23 bp, Homo sapiens
accccacttatgctgctgtgaat

SEQ ID NO: 460174 - DNA, 14 bp, Homo sapiens
accccataagccct

SEQ ID NO: 460175 - DNA, 16 bp, Homo sapiens
acccccacctcccggt

SEQ ID NO: 460176 - DNA, 12 bp, Homo sapiens
acccccagcctc

SEQ ID NO: 460177 - DNA, 20 bp, Homo sapiens
acccccgaggcccccctctg

SEQ ID NO: 460178 - DNA, 22 bp, Homo sapiens
acccccgaggcccccctctgcc

SEQ ID NO: 460179 - DNA, 17 bp, Homo sapiens
acccccggcctccaggc

SEQ ID NO: 460180 - DNA, 21 bp, Homo sapiens
acccccggcctccaggctggg

SEQ ID NO: 460181 - DNA, 15 bp, Homo sapiens
accccgtcccggccc

SEQ ID NO: 460182 - DNA, 18 bp, Homo sapiens
accccgtcccggccccgc

SEQ ID NO: 460183 - DNA, 15 bp, Homo sapiens
accccgtccctttcc

SEQ ID NO: 460184 - DNA, 22 bp, Homo sapiens
accccgtccctttccctgcatc

SEQ ID NO: 460185 - DNA, 23 bp, Homo sapiens
accccgtctgccccttgacccca

SEQ ID NO: 460186 - DNA, 15 bp, Homo sapiens
acccctaccctttcc

SEQ ID NO: 460187 - DNA, 16 bp, Homo sapiens
acccctcaagccagga

SEQ ID NO: 460188 - DNA, 18 bp, Homo sapiens
acccctcaagccaggaga

SEQ ID NO: 460189 - DNA, 15 bp, Homo sapiens
acccctccccaccca

SEQ ID NO: 460190 - DNA, 17 bp, Homo sapiens
acccctccccacccacc

SEQ ID NO: 460191 - DNA, 14 bp, Homo sapiens
acccctcttccccc

SEQ ID NO: 460192 - DNA, 19 bp, Homo sapiens
acccctcttcccccttccc

SEQ ID NO: 460193 - DNA, 15 bp, Homo sapiens
acccgccccagagac

SEQ ID NO: 460194 - DNA, 20 bp, Homo sapiens
acccgccccagagactgccc

SEQ ID NO: 460195 - DNA, 19 bp, Homo sapiens
acccgtcctggggtggttg

SEQ ID NO: 460196 - DNA, 16 bp, Homo sapiens
accctacagtatataa

SEQ ID NO: 460197 - DNA, 17 bp, Homo sapiens
accctagaagaaaaccc

SEQ ID NO: 460198 - DNA, 18 bp, Homo sapiens
accctagaagaaaacccg

SEQ ID NO: 460199 - DNA, 18 bp, Homo sapiens
accctaggtctccacccc

SEQ ID NO: 460200 - DNA, 22 bp, Homo sapiens
accctaggtctccacccctcaa

SEQ ID NO: 460201 - DNA, 11 bp, Homo sapiens
accctcagagc

SEQ ID NO: 460202 - DNA, 14 bp, Homo sapiens
accctccactctga

SEQ ID NO: 460203 - DNA, 15 bp, Homo sapiens
accctccactctgag

SEQ ID NO: 460204 - DNA, 13 bp, Homo sapiens
accctcccctctc

SEQ ID NO: 460205 - DNA, 18 bp, Homo sapiens
accctcccctctcctgag

SEQ ID NO: 460206 - DNA, 15 bp, Homo sapiens
accctccctgtcccc

SEQ ID NO: 460207 - DNA, 14 bp, Homo sapiens
accctccttcccca

SEQ ID NO: 460208 - DNA, 20 bp, Homo sapiens
accctccttccccaccccat

SEQ ID NO: 460209 - DNA, 21 bp, Homo sapiens
accctccttccccaccccata

SEQ ID NO: 460210 - DNA, 13 bp, Homo sapiens
accctcggagccc

SEQ ID NO: 460211 - DNA, 15 bp, Homo sapiens
accctctcctggggg

SEQ ID NO: 460212 - DNA, 23 bp, Homo sapiens
accctctcctgggggtggcaggc

SEQ ID NO: 460213 - DNA, 15 bp, Homo sapiens
accctctgctatgtc

SEQ ID NO: 460214 - DNA, 20 bp, Homo sapiens
accctctgctatgtctgtga

SEQ ID NO: 460215 - DNA, 14 bp, Homo sapiens
accctgggcctccc

SEQ ID NO: 460216 - DNA, 15 bp, Homo sapiens
acccttccccactcc

SEQ ID NO: 460217 - DNA, 21 bp, Homo sapiens
accgagtctcttctccactgg

SEQ ID NO: 460218 - DNA, 17 bp, Homo sapiens
accgcccaacccccacc

SEQ ID NO: 460219 - DNA, 21 bp, Homo sapiens
accgcccaacccccacctccc

SEQ ID NO: 460220 - DNA, 16 bp, Homo sapiens
accgccccaaccctcg

SEQ ID NO: 460221 - DNA, 17 bp, Homo sapiens
accggagcggctgagga

SEQ ID NO: 460222 - DNA, 17 bp, Homo sapiens
accgtcaatgtgaaata

SEQ ID NO: 460223 - DNA, 21 bp, Homo sapiens
accgtggtgtgaggcccccgg

SEQ ID NO: 460224 - DNA, 18 bp, Homo sapiens
acctaaatccattttcta

SEQ ID NO: 460225 - DNA, 12 bp, Homo sapiens
acctacagcctc

SEQ ID NO: 460226 - DNA, 16 bp, Homo sapiens
acctcactggtgcatt

SEQ ID NO: 460227 - DNA, 17 bp, Homo sapiens
acctcactggtgcattt

SEQ ID NO: 460228 - DNA, 18 bp, Homo sapiens
acctcactggtgcattta

SEQ ID NO: 460229 - DNA, 22 bp, Homo sapiens
acctcactggtgcatttaaaat

SEQ ID NO: 460230 - DNA, 10 bp, Homo sapiens
acctccaccc

SEQ ID NO: 460231 - DNA, 19 bp, Homo sapiens
acctccagattattttcta

SEQ ID NO: 460232 - DNA, 22 bp, Homo sapiens
acctccagattattttctatat

SEQ ID NO: 460233 - DNA, 13 bp, Homo sapiens
acctcggctgtgt

SEQ ID NO: 460234 - DNA, 20 bp, Homo sapiens
acctcggctgtgtggggagg

SEQ ID NO: 460235 - DNA, 14 bp, Homo sapiens
acctctacaggcat

SEQ ID NO: 460236 - DNA, 17 bp, Homo sapiens
acctctcacttttttat

SEQ ID NO: 460237 - DNA, 18 bp, Homo sapiens
acctgaagagcgctcctc

SEQ ID NO: 460238 - DNA, 18 bp, Homo sapiens
acctgacgatcttccccc

SEQ ID NO: 460239 - DNA, 11 bp, Homo sapiens
acctgcagtta

SEQ ID NO: 460240 - DNA, 10 bp, Homo sapiens
acctgcccag

SEQ ID NO: 460241 - DNA, 20 bp, Homo sapiens
acctgcccagttagcccggc

SEQ ID NO: 460242 - DNA, 22 bp, Homo sapiens
acctggcacaccagaagtgcca

SEQ ID NO: 460243 - DNA, 20 bp, Homo sapiens
acctgtaatagcctcacctt

SEQ ID NO: 460244 - DNA, 15 bp, Homo sapiens
acctgtagtgagaaa

SEQ ID NO: 460245 - DNA, 13 bp, Homo sapiens
acctgtgctttca

SEQ ID NO: 460246 - DNA, 17 bp, Homo sapiens
accttccctagttcttt

SEQ ID NO: 460247 - DNA, 13 bp, Homo sapiens
accttccctccaa

SEQ ID NO: 460248 - DNA, 12 bp, Homo sapiens
accttctgtggc

SEQ ID NO: 460249 - DNA, 13 bp, Homo sapiens
accttctgtggct

SEQ ID NO: 460250 - DNA, 19 bp, Homo sapiens
acctttatttattaaactt

SEQ ID NO: 460251 - DNA, 20 bp, Homo sapiens
acctttatttattaaacttc

SEQ ID NO: 460252 - DNA, 13 bp, Homo sapiens
acgaaacacagaa

SEQ ID NO: 460253 - DNA, 15 bp, Homo sapiens
acgacataagctggt

SEQ ID NO: 460254 - DNA, 17 bp, Homo sapiens
acgatcttcccccttcc

SEQ ID NO: 460255 - DNA, 20 bp, Homo sapiens
acgcagagccccggagcacc

SEQ ID NO: 460256 - DNA, 21 bp, Homo sapiens
acgcagagccccggagcacca

SEQ ID NO: 460257 - DNA, 12 bp, Homo sapiens
acgcagccctgc

SEQ ID NO: 460258 - DNA, 22 bp, Homo sapiens
acgcagccctgctttgggctgc

SEQ ID NO: 460259 - DNA, 19 bp, Homo sapiens
acgccggggctggccctgc

SEQ ID NO: 460260 - DNA, 13 bp, Homo sapiens
acgcctcctggcc

SEQ ID NO: 460261 - DNA, 13 bp, Homo sapiens
acgctcctgccct

SEQ ID NO: 460262 - DNA, 23 bp, Homo sapiens
acgctgccgctgccgctgcacca

SEQ ID NO: 460263 - DNA, 11 bp, Homo sapiens
acgctggctcg

SEQ ID NO: 460264 - DNA, 21 bp, Homo sapiens
acgctgtcctctcgagcccag

SEQ ID NO: 460265 - DNA, 14 bp, Homo sapiens
acggacgggacagc

SEQ ID NO: 460266 - DNA, 18 bp, Homo sapiens
acggacgggacagcggcc

SEQ ID NO: 460267 - DNA, 14 bp, Homo sapiens
acggcagccccatc

SEQ ID NO: 460268 - DNA, 13 bp, Homo sapiens
acgggagagcgcc

SEQ ID NO: 460269 - DNA, 19 bp, Homo sapiens
acgggagagcgccacccgc

SEQ ID NO: 460270 - DNA, 21 bp, Homo sapiens
acgggagagcgccacccgccc

SEQ ID NO: 460271 - DNA, 23 bp, Homo sapiens
acgggcccgctcaacctctcaga

SEQ ID NO: 460272 - DNA, 12 bp, Homo sapiens
acggggcagagc

SEQ ID NO: 460273 - DNA, 14 bp, Homo sapiens
acggggcagagctg

SEQ ID NO: 460274 - DNA, 12 bp, Homo sapiens
acgggtctgtgg

SEQ ID NO: 460275 - DNA, 16 bp, Homo sapiens
acgtactcctcagacg

SEQ ID NO: 460276 - DNA, 18 bp, Homo sapiens
acgtcatcggaggctggg

SEQ ID NO: 460277 - DNA, 12 bp, Homo sapiens
acgtctgtgagt

SEQ ID NO: 460278 - DNA, 14 bp, Homo sapiens
actaaaattcaaca

SEQ ID NO: 460279 - DNA, 18 bp, Homo sapiens
actaaaattcaacaaatg

SEQ ID NO: 460280 - DNA, 22 bp, Homo sapiens
actaaaattcaacaaatgatgt

SEQ ID NO: 460281 - DNA, 15 bp, Homo sapiens
actaacaatgccttg

SEQ ID NO: 460282 - DNA, 14 bp, Homo sapiens
actaagaataaata

SEQ ID NO: 460283 - DNA, 23 bp, Homo sapiens
actaagtaacctctacaggcatt

SEQ ID NO: 460284 - DNA, 22 bp, Homo sapiens
actacataattaaattttaatg

SEQ ID NO: 460285 - DNA, 14 bp, Homo sapiens
actagaatgagaaa

SEQ ID NO: 460286 - DNA, 17 bp, Homo sapiens
actagaatgagaaatca

SEQ ID NO: 460287 - DNA, 17 bp, Homo sapiens
actagccctctttctct

SEQ ID NO: 460288 - DNA, 15 bp, Homo sapiens
actaggtgcccagtc

SEQ ID NO: 460289 - DNA, 13 bp, Homo sapiens
actagtaatcttg

SEQ ID NO: 460290 - DNA, 15 bp, Homo sapiens
actagtagctgtttt

SEQ ID NO: 460291 - DNA, 23 bp, Homo sapiens
actatccttttttattgaataac

SEQ ID NO: 460292 - DNA, 18 bp, Homo sapiens
actatggtatgctggcca

SEQ ID NO: 460293 - DNA, 19 bp, Homo sapiens
actatggtatgctggccag

SEQ ID NO: 460294 - DNA, 12 bp, Homo sapiens
actcagccttaa

SEQ ID NO: 460295 - DNA, 15 bp, Homo sapiens
actcaggctttctat

SEQ ID NO: 460296 - DNA, 16 bp, Homo sapiens
actcaggctttctatt

SEQ ID NO: 460297 - DNA, 15 bp, Homo sapiens
actcatctgttatcc

SEQ ID NO: 460298 - DNA, 14 bp, Homo sapiens
actccaaggtggca

SEQ ID NO: 460299 - DNA, 17 bp, Homo sapiens
actccacctcttccttt

SEQ ID NO: 460300 - DNA, 19 bp, Homo sapiens
actccagacccctggcttt

SEQ ID NO: 460301 - DNA, 21 bp, Homo sapiens
actccagacccctggcttttc

SEQ ID NO: 460302 - DNA, 21 bp, Homo sapiens
actccagggttaaagaaaggc

SEQ ID NO: 460303 - DNA, 13 bp, Homo sapiens
actcccaggcccc

SEQ ID NO: 460304 - DNA, 20 bp, Homo sapiens
actccccgcccgccctcctc

SEQ ID NO: 460305 - DNA, 21 bp, Homo sapiens
actccccgcccgccctcctct

SEQ ID NO: 460306 - DNA, 22 bp, Homo sapiens
actccgcccagcctctccccgc

SEQ ID NO: 460307 - DNA, 12 bp, Homo sapiens
actcctcagacg

SEQ ID NO: 460308 - DNA, 16 bp, Homo sapiens
actcgagagggctgag

SEQ ID NO: 460309 - DNA, 18 bp, Homo sapiens
actcgagagggctgagcc

SEQ ID NO: 460310 - DNA, 19 bp, Homo sapiens
actcgagagggctgagccc

SEQ ID NO: 460311 - DNA, 18 bp, Homo sapiens
actcggtctgagaagatt

SEQ ID NO: 460312 - DNA, 17 bp, Homo sapiens
actctaacactcgactc

SEQ ID NO: 460313 - DNA, 22 bp, Homo sapiens
actctaagaaatggctttccac

SEQ ID NO: 460314 - DNA, 18 bp, Homo sapiens
actctctcctctctctcc

SEQ ID NO: 460315 - DNA, 23 bp, Homo sapiens
actctctcctctctctccctcca

SEQ ID NO: 460316 - DNA, 14 bp, Homo sapiens
actctcttcttact

SEQ ID NO: 460317 - DNA, 18 bp, Homo sapiens
actctgcatagacaaagg

SEQ ID NO: 460318 - DNA, 12 bp, Homo sapiens
actctgctgctc

SEQ ID NO: 460319 - DNA, 11 bp, Homo sapiens
actctggcctt

SEQ ID NO: 460320 - DNA, 16 bp, Homo sapiens
actctgtcagccagcc

SEQ ID NO: 460321 - DNA, 21 bp, Homo sapiens
actctgtcagccagccgccct

SEQ ID NO: 460322 - DNA, 14 bp, Homo sapiens
actctgtgtcccag

SEQ ID NO: 460323 - DNA, 16 bp, Homo sapiens
actcttcaaggccaag

SEQ ID NO: 460324 - DNA, 17 bp, Homo sapiens
actcttgtctcctcctc

SEQ ID NO: 460325 - DNA, 19 bp, Homo sapiens
actgaaattgtttaaaagc

SEQ ID NO: 460326 - DNA, 14 bp, Homo sapiens
actgaactcaggat

SEQ ID NO: 460327 - DNA, 21 bp, Homo sapiens
actgaataatggaattatgta

SEQ ID NO: 460328 - DNA, 13 bp, Homo sapiens
actgaatttaact

SEQ ID NO: 460329 - DNA, 14 bp, Homo sapiens
actgagaagatgtt

SEQ ID NO: 460330 - DNA, 14 bp, Homo sapiens
actgagagctgctc

SEQ ID NO: 460331 - DNA, 21 bp, Homo sapiens
actgatatcacgggcccgctc

SEQ ID NO: 460332 - DNA, 21 bp, Homo sapiens
actgatgggtcctgctgctcg

SEQ ID NO: 460333 - DNA, 18 bp, Homo sapiens
actgcacagtgcatctca

SEQ ID NO: 460334 - DNA, 15 bp, Homo sapiens
actgcatgcaagctc

SEQ ID NO: 460335 - DNA, 12 bp, Homo sapiens
actgcccaccct

SEQ ID NO: 460336 - DNA, 18 bp, Homo sapiens
actgcccaccctgggcct

SEQ ID NO: 460337 - DNA, 14 bp, Homo sapiens
actgccccgcgtct

SEQ ID NO: 460338 - DNA, 14 bp, Homo sapiens
actgcttaaggaaa

SEQ ID NO: 460339 - DNA, 23 bp, Homo sapiens
actgcttggatccatacaaaact

SEQ ID NO: 460340 - DNA, 21 bp, Homo sapiens
actggaaacaaggaaggacat

SEQ ID NO: 460341 - DNA, 14 bp, Homo sapiens
actggatagtgagt

SEQ ID NO: 460342 - DNA, 14 bp, Homo sapiens
actggcccacccct

SEQ ID NO: 460343 - DNA, 11 bp, Homo sapiens
actggccccag

SEQ ID NO: 460344 - DNA, 13 bp, Homo sapiens
actggccccaggc

SEQ ID NO: 460345 - DNA, 14 bp, Homo sapiens
actggccccaggcg

SEQ ID NO: 460346 - DNA, 22 bp, Homo sapiens
actggccccaggcggaggggct

SEQ ID NO: 460347 - DNA, 15 bp, Homo sapiens
actggtgcatttaaa

SEQ ID NO: 460348 - DNA, 20 bp, Homo sapiens
actggtgcatttaaaatgga

SEQ ID NO: 460349 - DNA, 12 bp, Homo sapiens
actggtggcccg

SEQ ID NO: 460350 - DNA, 20 bp, Homo sapiens
actgtactcctcccaggcgc

SEQ ID NO: 460351 - DNA, 21 bp, Homo sapiens
actgtatctaaaaaataactg

SEQ ID NO: 460352 - DNA, 17 bp, Homo sapiens
actgtcagagaatatga

SEQ ID NO: 460353 - DNA, 18 bp, Homo sapiens
actgtcagagaatatgac

SEQ ID NO: 460354 - DNA, 16 bp, Homo sapiens
actgtcccacaaaata

SEQ ID NO: 460355 - DNA, 19 bp, Homo sapiens
actgtcccacaaaatattt

SEQ ID NO: 460356 - DNA, 23 bp, Homo sapiens
actgtcccacaaaatatttctaa

SEQ ID NO: 460357 - DNA, 19 bp, Homo sapiens
actgtctcaagagggcact

SEQ ID NO: 460358 - DNA, 21 bp, Homo sapiens
actgtctcaagagggcactgg

SEQ ID NO: 460359 - DNA, 20 bp, Homo sapiens
actgtcttcaaccctgccct

SEQ ID NO: 460360 - DNA, 22 bp, Homo sapiens
actgtcttcaaccctgccctgc

SEQ ID NO: 460361 - DNA, 16 bp, Homo sapiens
actgttaacccagtgt

SEQ ID NO: 460362 - DNA, 15 bp, Homo sapiens
actgttcatttccac

SEQ ID NO: 460363 - DNA, 22 bp, Homo sapiens
actgttctaactagtaatcttg

SEQ ID NO: 460364 - DNA, 13 bp, Homo sapiens
actgtttgtaata

SEQ ID NO: 460365 - DNA, 13 bp, Homo sapiens
actgttttcatgt

SEQ ID NO: 460366 - DNA, 14 bp, Homo sapiens
actgttttcatgtg

SEQ ID NO: 460367 - DNA, 22 bp, Homo sapiens
actgttttggaatgttggctgt

SEQ ID NO: 460368 - DNA, 21 bp, Homo sapiens
acttaaaagaacataggaatt

SEQ ID NO: 460369 - DNA, 15 bp, Homo sapiens
acttaaacctgtgct

SEQ ID NO: 460370 - DNA, 18 bp, Homo sapiens
acttaaacctgtgctttc

SEQ ID NO: 460371 - DNA, 16 bp, Homo sapiens
acttaaactttgtcac

SEQ ID NO: 460372 - DNA, 21 bp, Homo sapiens
acttaaactttgtcacttctg

SEQ ID NO: 460373 - DNA, 14 bp, Homo sapiens
acttacactgaaat

SEQ ID NO: 460374 - DNA, 18 bp, Homo sapiens
acttacactgaaatccaa

SEQ ID NO: 460375 - DNA, 13 bp, Homo sapiens
acttatctccagc

SEQ ID NO: 460376 - DNA, 12 bp, Homo sapiens
acttatgctgct

SEQ ID NO: 460377 - DNA, 21 bp, Homo sapiens
acttcagcaaccctacagtat

SEQ ID NO: 460378 - DNA, 14 bp, Homo sapiens
acttcagttctcat

SEQ ID NO: 460379 - DNA, 13 bp, Homo sapiens
acttccagagggg

SEQ ID NO: 460380 - DNA, 15 bp, Homo sapiens
acttccagagggggc

SEQ ID NO: 460381 - DNA, 13 bp, Homo sapiens
acttccagatttg

SEQ ID NO: 460382 - DNA, 16 bp, Homo sapiens
acttcccagctggcag

SEQ ID NO: 460383 - DNA, 23 bp, Homo sapiens
acttcccagctggcagcgcctcc

SEQ ID NO: 460384 - DNA, 20 bp, Homo sapiens
acttctatttatttattatt

SEQ ID NO: 460385 - DNA, 12 bp, Homo sapiens
acttcttcatcc

SEQ ID NO: 460386 - DNA, 11 bp, Homo sapiens
acttgagccca

SEQ ID NO: 460387 - DNA, 13 bp, Homo sapiens
acttgagcccact

SEQ ID NO: 460388 - DNA, 17 bp, Homo sapiens
acttgctcaataaaggt

SEQ ID NO: 460389 - DNA, 23 bp, Homo sapiens
acttgtacttacactgaaatcca

SEQ ID NO: 460390 - DNA, 17 bp, Homo sapiens
acttgtagggatgcctt

SEQ ID NO: 460391 - DNA, 15 bp, Homo sapiens
actttaaattatatg

SEQ ID NO: 460392 - DNA, 18 bp, Homo sapiens
actttataatcaagacaa

SEQ ID NO: 460393 - DNA, 17 bp, Homo sapiens
actttatttaatttcat

SEQ ID NO: 460394 - DNA, 14 bp, Homo sapiens
actttgccatcctt

SEQ ID NO: 460395 - DNA, 14 bp, Homo sapiens
actttgtcacttct

SEQ ID NO: 460396 - DNA, 20 bp, Homo sapiens
actttgtcacttctgctgta

SEQ ID NO: 460397 - DNA, 14 bp, Homo sapiens
actttgtgcaatat

SEQ ID NO: 460398 - DNA, 13 bp, Homo sapiens
acttttaattagt

SEQ ID NO: 460399 - DNA, 18 bp, Homo sapiens
acttttgtgtattctgtg

SEQ ID NO: 460400 - DNA, 19 bp, Homo sapiens
acttttgtgtattctgtgg

SEQ ID NO: 460401 - DNA, 23 bp, Homo sapiens
acttttttataaattataatgca

SEQ ID NO: 460402 - DNA, 18 bp, Homo sapiens
agaaaacagaccagcata

SEQ ID NO: 460403 - DNA, 19 bp, Homo sapiens
agaaaacagaccagcatag

SEQ ID NO: 460404 - DNA, 17 bp, Homo sapiens
agaaaatgctttctcat

SEQ ID NO: 460405 - DNA, 18 bp, Homo sapiens
agaaaatgctttctcatg

SEQ ID NO: 460406 - DNA, 19 bp, Homo sapiens
agaaaatgctttctcatgc

SEQ ID NO: 460407 - DNA, 16 bp, Homo sapiens
agaaacgagatttgcc

SEQ ID NO: 460408 - DNA, 15 bp, Homo sapiens
agaaaggaacatccg

SEQ ID NO: 460409 - DNA, 13 bp, Homo sapiens
agaaaggcagaga

SEQ ID NO: 460410 - DNA, 19 bp, Homo sapiens
agaaagggagaaggattct

SEQ ID NO: 460411 - DNA, 22 bp, Homo sapiens
agaaagggagaaggattctttt

SEQ ID NO: 460412 - DNA, 21 bp, Homo sapiens
agaaagggcagcccctcccca

SEQ ID NO: 460413 - DNA, 15 bp, Homo sapiens
agaaagtctatgctt

SEQ ID NO: 460414 - DNA, 12 bp, Homo sapiens
agaaatgagaaa

SEQ ID NO: 460415 - DNA, 22 bp, Homo sapiens
agaaatgctaatgtaatcattt

SEQ ID NO: 460416 - DNA, 15 bp, Homo sapiens
agaaattctataaga

SEQ ID NO: 460417 - DNA, 17 bp, Homo sapiens
agaaattgcatttcctg

SEQ ID NO: 460418 - DNA, 16 bp, Homo sapiens
agaaattgtgccaaag

SEQ ID NO: 460419 - DNA, 18 bp, Homo sapiens
agaaattgtgccaaagat

SEQ ID NO: 460420 - DNA, 19 bp, Homo sapiens
agaacataggaattttgtt

SEQ ID NO: 460421 - DNA, 20 bp, Homo sapiens
agaaccagcactcccagggc

SEQ ID NO: 460422 - DNA, 13 bp, Homo sapiens
agaacccccctcc

SEQ ID NO: 460423 - DNA, 16 bp, Homo sapiens
agaacgggcctccccg

SEQ ID NO: 460424 - DNA, 17 bp, Homo sapiens
agaacgggcctccccgg

SEQ ID NO: 460425 - DNA, 19 bp, Homo sapiens
agaacgggcctccccgggg

SEQ ID NO: 460426 - DNA, 13 bp, Homo sapiens
agaactcctttct

SEQ ID NO: 460427 - DNA, 17 bp, Homo sapiens
agaactgtcccacaaaa

SEQ ID NO: 460428 - DNA, 20 bp, Homo sapiens
agaactgtcccacaaaatat

SEQ ID NO: 460429 - DNA, 22 bp, Homo sapiens
agaactgtcccacaaaatattt

SEQ ID NO: 460430 - DNA, 17 bp, Homo sapiens
agaactgttcatttcca

SEQ ID NO: 460431 - DNA, 18 bp, Homo sapiens
agaactgttcatttccac

SEQ ID NO: 460432 - DNA, 12 bp, Homo sapiens
agaagaaactgc

SEQ ID NO: 460433 - DNA, 16 bp, Homo sapiens
agaagaaagtctatgc

SEQ ID NO: 460434 - DNA, 22 bp, Homo sapiens
agaagagtctttgattcaccaa

SEQ ID NO: 460435 - DNA, 22 bp, Homo sapiens
agaagatttattatgaaccgca

SEQ ID NO: 460436 - DNA, 18 bp, Homo sapiens
agaagccacgctgtcctc

SEQ ID NO: 460437 - DNA, 13 bp, Homo sapiens
agaaggcagcagg

SEQ ID NO: 460438 - DNA, 12 bp, Homo sapiens
agaataaataaa

SEQ ID NO: 460439 - DNA, 20 bp, Homo sapiens
agaataaataaagaagaaaa

SEQ ID NO: 460440 - DNA, 22 bp, Homo sapiens
agaatacagtaagctgctctat

SEQ ID NO: 460441 - DNA, 21 bp, Homo sapiens
agaatatgacctaaatccatt

SEQ ID NO: 460442 - DNA, 13 bp, Homo sapiens
agaatggctctgg

SEQ ID NO: 460443 - DNA, 14 bp, Homo sapiens
agaatggctctggc

SEQ ID NO: 460444 - DNA, 23 bp, Homo sapiens
agaatggtgggctccagagtagg

SEQ ID NO: 460445 - DNA, 19 bp, Homo sapiens
agaattaggtaatggatat

SEQ ID NO: 460446 - DNA, 21 bp, Homo sapiens
agaatttctttgtcattcaag

SEQ ID NO: 460447 - DNA, 14 bp, Homo sapiens
agacaacaggcatt

SEQ ID NO: 460448 - DNA, 18 bp, Homo sapiens
agacaaccatagaactgt

SEQ ID NO: 460449 - DNA, 22 bp, Homo sapiens
agacaagtgtttattaaaatac

SEQ ID NO: 460450 - DNA, 20 bp, Homo sapiens
agacagacggacgggacagc

SEQ ID NO: 460451 - DNA, 14 bp, Homo sapiens
agacagagtggatc

SEQ ID NO: 460452 - DNA, 23 bp, Homo sapiens
agaccagcatagttctgcaataa

SEQ ID NO: 460453 - DNA, 14 bp, Homo sapiens
agacccaccatcct

SEQ ID NO: 460454 - DNA, 21 bp, Homo sapiens
agacccaccatccttccatcc

SEQ ID NO: 460455 - DNA, 22 bp, Homo sapiens
agacccaccatccttccatcct

SEQ ID NO: 460456 - DNA, 23 bp, Homo sapiens
agacccaccatccttccatcctg

SEQ ID NO: 460457 - DNA, 17 bp, Homo sapiens
agacccctaccctttcc

SEQ ID NO: 460458 - DNA, 21 bp, Homo sapiens
agacccctggcttttcactgc

SEQ ID NO: 460459 - DNA, 19 bp, Homo sapiens
agaccctccttccccaccc

SEQ ID NO: 460460 - DNA, 13 bp, Homo sapiens
agaccctgtcttt

SEQ ID NO: 460461 - DNA, 16 bp, Homo sapiens
agaccctgtctttgct

SEQ ID NO: 460462 - DNA, 20 bp, Homo sapiens
agacctcggctgtgtgggga

SEQ ID NO: 460463 - DNA, 18 bp, Homo sapiens
agacgaggtgtcttcctt

SEQ ID NO: 460464 - DNA, 23 bp, Homo sapiens
agacggacgggacagcggcccgg

SEQ ID NO: 460465 - DNA, 13 bp, Homo sapiens
agacggcagcccc

SEQ ID NO: 460466 - DNA, 22 bp, Homo sapiens
agacgtttttgtgctgtgggca

SEQ ID NO: 460467 - DNA, 15 bp, Homo sapiens
agactactggcctct

SEQ ID NO: 460468 - DNA, 15 bp, Homo sapiens
agactcgagagggct

SEQ ID NO: 460469 - DNA, 21 bp, Homo sapiens
agactgagcttgattctaaag

SEQ ID NO: 460470 - DNA, 21 bp, Homo sapiens
agactgcccaccctgggcctc

SEQ ID NO: 460471 - DNA, 17 bp, Homo sapiens
agagacaaagtttggaa

SEQ ID NO: 460472 - DNA, 22 bp, Homo sapiens
agagacgaggtgtcttccttcc

SEQ ID NO: 460473 - DNA, 13 bp, Homo sapiens
agcacctttgtaa

SEQ ID NO: 460474 - DNA, 18 bp, Homo sapiens
agcacggtggtgaggcag

SEQ ID NO: 460475 - DNA, 13 bp, Homo sapiens
agcactagaatga

SEQ ID NO: 460476 - DNA, 19 bp, Homo sapiens
agcactagaatgagaaatc

SEQ ID NO: 460477 - DNA, 15 bp, Homo sapiens
agcactcccagggcc

SEQ ID NO: 460478 - DNA, 16 bp, Homo sapiens
agcactcccagggccc

SEQ ID NO: 460479 - DNA, 18 bp, Homo sapiens
agcactcccagggcccga

SEQ ID NO: 460480 - DNA, 19 bp, Homo sapiens
agcactgccattagactga

SEQ ID NO: 460481 - DNA, 23 bp, Homo sapiens
agcactttccacttccagagggg

SEQ ID NO: 460482 - DNA, 14 bp, Homo sapiens
agcagacactccag

SEQ ID NO: 460483 - DNA, 16 bp, Homo sapiens
agcagattccacagga

SEQ ID NO: 460484 - DNA, 18 bp, Homo sapiens
agcaggactaacaactgg

SEQ ID NO: 460485 - DNA, 21 bp, Homo sapiens
agcagtaccatcccactgata

SEQ ID NO: 460486 - DNA, 16 bp, Homo sapiens
agcagtacttgctcaa

SEQ ID NO: 460487 - DNA, 19 bp, Homo sapiens
agcagtacttgctcaataa

SEQ ID NO: 460488 - DNA, 13 bp, Homo sapiens
agcagtgctgggc

SEQ ID NO: 460489 - DNA, 24 bp, Homo sapiens
agcatacagagtgtcctgatttgt

SEQ ID NO: 460490 - DNA, 12 bp, Homo sapiens
agcatataaatg

SEQ ID NO: 460491 - DNA, 14 bp, Homo sapiens
agcatgtctactgc

SEQ ID NO: 460492 - DNA, 15 bp, Homo sapiens
agcatgtctactgct

SEQ ID NO: 460493 - DNA, 22 bp, Homo sapiens
agcattctcactcctacctggt

SEQ ID NO: 460494 - DNA, 16 bp, Homo sapiens
agccaaaaacaataaa

SEQ ID NO: 460495 - DNA, 18 bp, Homo sapiens
agccaaacattcttattt

SEQ ID NO: 460496 - DNA, 12 bp, Homo sapiens
agccaaagaaac

SEQ ID NO: 460497 - DNA, 13 bp, Homo sapiens
agccaaagaaact

SEQ ID NO: 460498 - DNA, 20 bp, Homo sapiens
agccacgctgtcctctcgag

SEQ ID NO: 460499 - DNA, 15 bp, Homo sapiens
agccagccgccctgg

SEQ ID NO: 460500 - DNA, 22 bp, Homo sapiens
agccagccgccctgggctgtct

SEQ ID NO: 460501 - DNA, 17 bp, Homo sapiens
agccaggagaccctgtc

SEQ ID NO: 460502 - DNA, 19 bp, Homo sapiens
agccaggagaccctgtctt

SEQ ID NO: 460503 - DNA, 13 bp, Homo sapiens
agccagggttcca

SEQ ID NO: 460504 - DNA, 16 bp, Homo sapiens
agccagggttccagac

SEQ ID NO: 460505 - DNA, 17 bp, Homo sapiens
agccagggttccagaca

SEQ ID NO: 460506 - DNA, 18 bp, Homo sapiens
agccagggttccagacag

SEQ ID NO: 460507 - DNA, 20 bp, Homo sapiens
agccagggttccagacaggg

SEQ ID NO: 460508 - DNA, 12 bp, Homo sapiens
agccatgctctt

SEQ ID NO: 460509 - DNA, 18 bp, Homo sapiens
agcccacccgccccagag

SEQ ID NO: 460510 - DNA, 20 bp, Homo sapiens
agcccagaacgggcctcccc

SEQ ID NO: 460511 - DNA, 15 bp, Homo sapiens
agccccatccttccc

SEQ ID NO: 460512 - DNA, 20 bp, Homo sapiens
agccccatccttcccgcagc

SEQ ID NO: 460513 - DNA, 14 bp, Homo sapiens
agccccccactcag

SEQ ID NO: 460514 - DNA, 22 bp, Homo sapiens
agccccccagagagagctctgc

SEQ ID NO: 460515 - DNA, 13 bp, Homo sapiens
agccccccagcac

SEQ ID NO: 460516 - DNA, 15 bp, Homo sapiens
agccccctcttgaga

SEQ ID NO: 460517 - DNA, 20 bp, Homo sapiens
agcccctatcctgcaccctc

SEQ ID NO: 460518 - DNA, 21 bp, Homo sapiens
agcccctatcctgcaccctct

SEQ ID NO: 460519 - DNA, 11 bp, Homo sapiens
agcccctcctc

SEQ ID NO: 460520 - DNA, 18 bp, Homo sapiens
agcccgaatttctcactc

SEQ ID NO: 460521 - DNA, 14 bp, Homo sapiens
agcccggccaagga

SEQ ID NO: 460522 - DNA, 13 bp, Homo sapiens
agccctcagaaca

SEQ ID NO: 460523 - DNA, 21 bp, Homo sapiens
agccctcccccttccccttct

SEQ ID NO: 460524 - DNA, 16 bp, Homo sapiens
agccctccctgcccct

SEQ ID NO: 460525 - DNA, 19 bp, Homo sapiens
agccctccctgcccctccc

SEQ ID NO: 460526 - DNA, 22 bp, Homo sapiens
agccctccctgcccctcccttc

SEQ ID NO: 460527 - DNA, 23 bp, Homo sapiens
agccctccctgcccctcccttca

SEQ ID NO: 460528 - DNA, 15 bp, Homo sapiens
agccctctccaccca

SEQ ID NO: 460529 - DNA, 16 bp, Homo sapiens
agccctctccacccag

SEQ ID NO: 460530 - DNA, 21 bp, Homo sapiens
agccctctccacccagaggtc

SEQ ID NO: 460531 - DNA, 23 bp, Homo sapiens
agccctctccacccagaggtctc

SEQ ID NO: 460532 - DNA, 14 bp, Homo sapiens
agccctctttctct

SEQ ID NO: 460533 - DNA, 17 bp, Homo sapiens
agccctctttctctctg

SEQ ID NO: 460534 - DNA, 20 bp, Homo sapiens
agccctctttctctctgtgt

SEQ ID NO: 460535 - DNA, 23 bp, Homo sapiens
agccctctttctctctgtgtggc

SEQ ID NO: 460536 - DNA, 11 bp, Homo sapiens
agccctgccct

SEQ ID NO: 460537 - DNA, 14 bp, Homo sapiens
agccgcgctctgcc

SEQ ID NO: 460538 - DNA, 15 bp, Homo sapiens
agccgcgctctgccc

SEQ ID NO: 460539 - DNA, 16 bp, Homo sapiens
agccgtgccttcagct

SEQ ID NO: 460540 - DNA, 17 bp, Homo sapiens
agccgtgccttcagctc

SEQ ID NO: 460541 - DNA, 13 bp, Homo sapiens
atgctttctcatg

SEQ ID NO: 460542 - DNA, 14 bp, Homo sapiens
atgctttctcatgc

SEQ ID NO: 460543 - DNA, 23 bp, Homo sapiens
atgctttctcatgcatagacaag

SEQ ID NO: 460544 - DNA, 16 bp, Homo sapiens
atgctttgtgtgattg

SEQ ID NO: 460545 - DNA, 15 bp, Homo sapiens
atggaattatgtata

SEQ ID NO: 460546 - DNA, 20 bp, Homo sapiens
atggacttttgttcatggga

SEQ ID NO: 460547 - DNA, 21 bp, Homo sapiens
atggacttttgttcatgggag

SEQ ID NO: 460548 - DNA, 15 bp, Homo sapiens
atggatatgaaagag

SEQ ID NO: 460549 - DNA, 16 bp, Homo sapiens
atggccaagtgtacat

SEQ ID NO: 460550 - DNA, 20 bp, Homo sapiens
atggcttccgtgagacacaa

SEQ ID NO: 460551 - DNA, 13 bp, Homo sapiens
atgggaccaggga

SEQ ID NO: 460552 - DNA, 20 bp, Homo sapiens
atgggagaggttctgtgcaa

SEQ ID NO: 460553 - DNA, 11 bp, Homo sapiens
atgggccaggg

SEQ ID NO: 460554 - DNA, 18 bp, Homo sapiens
atggtagaaattttatct

SEQ ID NO: 460555 - DNA, 20 bp, Homo sapiens
atggtgggctccagagtagg

SEQ ID NO: 460556 - DNA, 21 bp, Homo sapiens
atggtggtttcagaaagggca

SEQ ID NO: 460557 - DNA, 20 bp, Homo sapiens
atggttcccctgttcactct

SEQ ID NO: 460558 - DNA, 14 bp, Homo sapiens
atgtaaaattcata

SEQ ID NO: 460559 - DNA, 15 bp, Homo sapiens
atgtaaacatcataa

SEQ ID NO: 460560 - DNA, 18 bp, Homo sapiens
atgtaacagttggtgatt

SEQ ID NO: 460561 - DNA, 19 bp, Homo sapiens
atgtaatcatttatcttat

SEQ ID NO: 460562 - DNA, 22 bp, Homo sapiens
atgtagaactgttcatttccac

SEQ ID NO: 460563 - DNA, 18 bp, Homo sapiens
atgtatatgttatttttg

SEQ ID NO: 460564 - DNA, 17 bp, Homo sapiens
atgtattatgcaaagta

SEQ ID NO: 460565 - DNA, 16 bp, Homo sapiens
atgtcagtagtgcctg

SEQ ID NO: 460566 - DNA, 21 bp, Homo sapiens
atgtcagtagtgcctgtgatc

SEQ ID NO: 460567 - DNA, 22 bp, Homo sapiens
atgtccccattctataaattca

SEQ ID NO: 460568 - DNA, 16 bp, Homo sapiens
atgtcctattactgat

SEQ ID NO: 460569 - DNA, 23 bp, Homo sapiens
atgtcctattactgatgtgtgca

SEQ ID NO: 460570 - DNA, 18 bp, Homo sapiens
atgtgcaaacgctgtatt

SEQ ID NO: 460571 - DNA, 17 bp, Homo sapiens
atgtgcctgcaccagga

SEQ ID NO: 460572 - DNA, 19 bp, Homo sapiens
atgtgcctgcaccaggaga

SEQ ID NO: 460573 - DNA, 22 bp, Homo sapiens
atgtgcctgcaccaggagacag

SEQ ID NO: 460574 - DNA, 17 bp, Homo sapiens
atgtggaatgcatccaa

SEQ ID NO: 460575 - DNA, 22 bp, Homo sapiens
atgtggcattggggggccgggc

SEQ ID NO: 460576 - DNA, 16 bp, Homo sapiens
atgtggcttcttcaac

SEQ ID NO: 460577 - DNA, 11 bp, Homo sapiens
atgtgtcccct

SEQ ID NO: 460578 - DNA, 14 bp, Homo sapiens
atgtgtcccctcac

SEQ ID NO: 460579 - DNA, 18 bp, Homo sapiens
atgtgtcccctcactctg

SEQ ID NO: 460580 - DNA, 16 bp, Homo sapiens
atgtgttgcaaattat

SEQ ID NO: 460581 - DNA, 20 bp, Homo sapiens
atgtgttgcaaattattcta

SEQ ID NO: 460582 - DNA, 23 bp, Homo sapiens
atgtgttgcaaattattctagtc

SEQ ID NO: 460583 - DNA, 22 bp, Homo sapiens
atgttgatcgatgttaaacgtc

SEQ ID NO: 460584 - DNA, 20 bp, Homo sapiens
atgtttacctcactggtgca

SEQ ID NO: 460585 - DNA, 20 bp, Homo sapiens
atgtttgttttcaaaatact

SEQ ID NO: 460586 - DNA, 21 bp, Homo sapiens
atgttttccccaattatcctc

SEQ ID NO: 460587 - DNA, 12 bp, Homo sapiens
attaaacttcag

SEQ ID NO: 460588 - DNA, 19 bp, Homo sapiens
attaaatttaatatactgc

SEQ ID NO: 460589 - DNA, 19 bp, Homo sapiens
attaaattttaatgtaaaa

SEQ ID NO: 460590 - DNA, 19 bp, Homo sapiens
attaatctctaaaattcta

SEQ ID NO: 460591 - DNA, 20 bp, Homo sapiens
attaatctctaaaattctag

SEQ ID NO: 460592 - DNA, 22 bp, Homo sapiens
attaatctctaaaattctagtc

SEQ ID NO: 460593 - DNA, 15 bp, Homo sapiens
attacagatttagtt

SEQ ID NO: 460594 - DNA, 17 bp, Homo sapiens
attacagatttagttta

SEQ ID NO: 460595 - DNA, 15 bp, Homo sapiens
attactattaactct

SEQ ID NO: 460596 - DNA, 15 bp, Homo sapiens
attactgttcttatt

SEQ ID NO: 460597 - DNA, 14 bp, Homo sapiens
attataagttgacc

SEQ ID NO: 460598 - DNA, 14 bp, Homo sapiens
attatatacaaagc

SEQ ID NO: 460599 - DNA, 15 bp, Homo sapiens
attatatgatatgca

SEQ ID NO: 460600 - DNA, 19 bp, Homo sapiens
attatccttttatctcaca

SEQ ID NO: 460601 - DNA, 18 bp, Homo sapiens
attatgaggctattaaaa

SEQ ID NO: 460602 - DNA, 14 bp, Homo sapiens
attatgtataacaa

SEQ ID NO: 460603 - DNA, 13 bp, Homo sapiens
attatgttgttca

SEQ ID NO: 460604 - DNA, 13 bp, Homo sapiens
attattactttaa

SEQ ID NO: 460605 - DNA, 18 bp, Homo sapiens
attattctagtcaactgc

SEQ ID NO: 460606 - DNA, 23 bp, Homo sapiens
attattctagtcaactgctgttt

SEQ ID NO: 460607 - DNA, 14 bp, Homo sapiens
attattttctatat

SEQ ID NO: 460608 - DNA, 18 bp, Homo sapiens
attattttctatatttgg

SEQ ID NO: 460609 - DNA, 17 bp, Homo sapiens
attcaaaatagttctat

SEQ ID NO: 460610 - DNA, 19 bp, Homo sapiens
attcaaaatagttctattt

SEQ ID NO: 460611 - DNA, 12 bp, Homo sapiens
attcaaatgcat

SEQ ID NO: 460612 - DNA, 14 bp, Homo sapiens
attcaaatgcatga

SEQ ID NO: 460613 - DNA, 11 bp, Homo sapiens
attcaacaaat

SEQ ID NO: 460614 - DNA, 16 bp, Homo sapiens
attcaagcctgtgaat

SEQ ID NO: 460615 - DNA, 22 bp, Homo sapiens
attcaagcctgtgaataaaaac

SEQ ID NO: 460616 - DNA, 13 bp, Homo sapiens
attcaatgtgaat

SEQ ID NO: 460617 - DNA, 14 bp, Homo sapiens
attcaggaatgggc

SEQ ID NO: 460618 - DNA, 15 bp, Homo sapiens
attcataaaaataac

SEQ ID NO: 460619 - DNA, 16 bp, Homo sapiens
attcataaaaataacc

SEQ ID NO: 460620 - DNA, 17 bp, Homo sapiens
attcatagcatcctgat

SEQ ID NO: 460621 - DNA, 14 bp, Homo sapiens
attcatgtccagag

SEQ ID NO: 460622 - DNA, 15 bp, Homo sapiens
attcattacatcctc

SEQ ID NO: 460623 - DNA, 15 bp, Homo sapiens
attcatttacaactt

SEQ ID NO: 460624 - DNA, 20 bp, Homo sapiens
attcatttacaacttccaga

SEQ ID NO: 460625 - DNA, 20 bp, Homo sapiens
attccaacccaggtctgctt

SEQ ID NO: 460626 - DNA, 21 bp, Homo sapiens
attccaataccctagaagaaa

SEQ ID NO: 460627 - DNA, 14 bp, Homo sapiens
attccacaggacac

SEQ ID NO: 460628 - DNA, 23 bp, Homo sapiens
attccaccaggattaatctctaa

SEQ ID NO: 460629 - DNA, 22 bp, Homo sapiens
attccatgggttgaacaagcca

SEQ ID NO: 460630 - DNA, 20 bp, Homo sapiens
attcctatgctgcaatacat

SEQ ID NO: 460631 - DNA, 12 bp, Homo sapiens
attcctgccttt

SEQ ID NO: 460632 - DNA, 18 bp, Homo sapiens
attctaaaacattcttta

SEQ ID NO: 460633 - DNA, 19 bp, Homo sapiens
attctaaaacattctttaa

SEQ ID NO: 460634 - DNA, 14 bp, Homo sapiens
attctagtcaactg

SEQ ID NO: 460635 - DNA, 20 bp, Homo sapiens
attctagtcaactgctgttt

SEQ ID NO: 460636 - DNA, 22 bp, Homo sapiens
attctagtcaactgctgtttta

SEQ ID NO: 460637 - DNA, 16 bp, Homo sapiens
attctatatttcatat

SEQ ID NO: 460638 - DNA, 21 bp, Homo sapiens
atgagtaaataaactcttcaa

SEQ ID NO: 460639 - DNA, 15 bp, Homo sapiens
atgagttcaaatact

SEQ ID NO: 460640 - DNA, 18 bp, Homo sapiens
atgagtttaaaaaaataa

SEQ ID NO: 460641 - DNA, 23 bp, Homo sapiens
atgatctctccacggtagcactt

SEQ ID NO: 460642 - DNA, 15 bp, Homo sapiens
atgatgattcaatca

SEQ ID NO: 460643 - DNA, 21 bp, Homo sapiens
atgattcaatcattttgggaa

SEQ ID NO: 460644 - DNA, 12 bp, Homo sapiens
atgattcaatgt

SEQ ID NO: 460645 - DNA, 15 bp, Homo sapiens
atgattcaatgtgaa

SEQ ID NO: 460646 - DNA, 14 bp, Homo sapiens
atgattccaaataa

SEQ ID NO: 460647 - DNA, 22 bp, Homo sapiens
atgcagaaatgtggatgctctt

SEQ ID NO: 460648 - DNA, 13 bp, Homo sapiens
atgcatagacaag

SEQ ID NO: 460649 - DNA, 18 bp, Homo sapiens
atgcatagacaagtgttt

SEQ ID NO: 460650 - DNA, 20 bp, Homo sapiens
atgcatgatattgtatgtac

SEQ ID NO: 460651 - DNA, 19 bp, Homo sapiens
atgcatgtagcatataaat

SEQ ID NO: 460652 - DNA, 20 bp, Homo sapiens
atgcatgtagcatataaatg

SEQ ID NO: 460653 - DNA, 15 bp, Homo sapiens
atgcctgcctgaaca

SEQ ID NO: 460654 - DNA, 15 bp, Homo sapiens
atgcctgtatttcca

SEQ ID NO: 460655 - DNA, 16 bp, Homo sapiens
atgcctgtatttccaa

SEQ ID NO: 460656 - DNA, 23 bp, Homo sapiens
atgccttctgttttccaaaggag

SEQ ID NO: 460657 - DNA, 22 bp, Homo sapiens
atgcctttctagtcctattcta

SEQ ID NO: 460658 - DNA, 16 bp, Homo sapiens
atgctagcacaatatt

SEQ ID NO: 460659 - DNA, 20 bp, Homo sapiens
atgctgactgtactcctccc

SEQ ID NO: 460660 - DNA, 21 bp, Homo sapiens
atgctgcaatacattaaaata

SEQ ID NO: 460661 - DNA, 11 bp, Homo sapiens
atgctgctgtg

SEQ ID NO: 460662 - DNA, 19 bp, Homo sapiens
atgctgctgtgaatttttt

SEQ ID NO: 460663 - DNA, 21 bp, Homo sapiens
atgctggcatagagcagcact

SEQ ID NO: 460664 - DNA, 22 bp, Homo sapiens
atgcttaacataaacttgtact

SEQ ID NO: 460665 - DNA, 14 bp, Homo sapiens
caaaatatagttaa

SEQ ID NO: 460666 - DNA, 14 bp, Homo sapiens
caaaatatttctaa

SEQ ID NO: 460667 - DNA, 20 bp, Homo sapiens
caaaatatttctaagcttat

SEQ ID NO: 460668 - DNA, 13 bp, Homo sapiens
caaaatgcatgtg

SEQ ID NO: 460669 - DNA, 18 bp, Homo sapiens
caaaatgtcaatttttaa

SEQ ID NO: 460670 - DNA, 13 bp, Homo sapiens
caaacagatgttt

SEQ ID NO: 460671 - DNA, 14 bp, Homo sapiens
caaacagtgtggct

SEQ ID NO: 460672 - DNA, 23 bp, Homo sapiens
caaacagtgtggcttaaacattt

SEQ ID NO: 460673 - DNA, 19 bp, Homo sapiens
caaacattcttattttaga

SEQ ID NO: 460674 - DNA, 16 bp, Homo sapiens
caaacgtaatttgtta

SEQ ID NO: 460675 - DNA, 14 bp, Homo sapiens
caaacttactgtca

SEQ ID NO: 460676 - DNA, 13 bp, Homo sapiens
caaagaaaacaga

SEQ ID NO: 460677 - DNA, 13 bp, Homo sapiens
caaagaaactcag

SEQ ID NO: 460678 - DNA, 17 bp, Homo sapiens
caaagaaactcagaaga

SEQ ID NO: 460679 - DNA, 14 bp, Homo sapiens
caaagaacccccct

SEQ ID NO: 460680 - DNA, 19 bp, Homo sapiens
caaagaacccccctcccca

SEQ ID NO: 460681 - DNA, 12 bp, Homo sapiens
caaagatggctt

SEQ ID NO: 460682 - DNA, 22 bp, Homo sapiens
caaagtttggaagtacataaag

SEQ ID NO: 460683 - DNA, 11 bp, Homo sapiens
caaataacagt

SEQ ID NO: 460684 - DNA, 22 bp, Homo sapiens
caaataagtgcatttattgcct

SEQ ID NO: 460685 - DNA, 18 bp, Homo sapiens
caaatattgctattgttt

SEQ ID NO: 460686 - DNA, 21 bp, Homo sapiens
caaatattgctattgtttata

SEQ ID NO: 460687 - DNA, 22 bp, Homo sapiens
caaatatttcacttaaactttg

SEQ ID NO: 460688 - DNA, 19 bp, Homo sapiens
caaatgaaagttttatttt

SEQ ID NO: 460689 - DNA, 22 bp, Homo sapiens
caaatgcatgatattgtatgta

SEQ ID NO: 460690 - DNA, 15 bp, Homo sapiens
caaatgctactcagt

SEQ ID NO: 460691 - DNA, 16 bp, Homo sapiens
caaatgctactcagta

SEQ ID NO: 460692 - DNA, 14 bp, Homo sapiens
caaattattctagt

SEQ ID NO: 460693 - DNA, 16 bp, Homo sapiens
caaattcttgaataaa

SEQ ID NO: 460694 - DNA, 19 bp, Homo sapiens
caaatttttactcaggctt

SEQ ID NO: 460695 - DNA, 18 bp, Homo sapiens
caaccaggctcctgtgat

SEQ ID NO: 460696 - DNA, 15 bp, Homo sapiens
caaccatagaactgt

SEQ ID NO: 460697 - DNA, 14 bp, Homo sapiens
caacccccacctcc

SEQ ID NO: 460698 - DNA, 17 bp, Homo sapiens
caacccccacctcccgg

SEQ ID NO: 460699 - DNA, 21 bp, Homo sapiens
caaccctcagagccaccccta

SEQ ID NO: 460700 - DNA, 21 bp, Homo sapiens
caaccctcggagccccccact

SEQ ID NO: 460701 - DNA, 15 bp, Homo sapiens
caaccctgccctgca

SEQ ID NO: 460702 - DNA, 17 bp, Homo sapiens
caaccctgccctgcacc

SEQ ID NO: 460703 - DNA, 16 bp, Homo sapiens
caacctcactgccctc

SEQ ID NO: 460704 - DNA, 21 bp, Homo sapiens
caacctcactgccctccctcg

SEQ ID NO: 460705 - DNA, 23 bp, Homo sapiens
caacctcactgccctccctcggc

SEQ ID NO: 460706 - DNA, 22 bp, Homo sapiens
caacctggtggcaccagatgca

SEQ ID NO: 460707 - DNA, 19 bp, Homo sapiens
caaccttctgtggctcaca

SEQ ID NO: 460708 - DNA, 14 bp, Homo sapiens
caacgggtctgtgg

SEQ ID NO: 460709 - DNA, 15 bp, Homo sapiens
caactaacaatgcct

SEQ ID NO: 460710 - DNA, 16 bp, Homo sapiens
caactaagttgtattt

SEQ ID NO: 460711 - DNA, 17 bp, Homo sapiens
caactaattcaataaaa

SEQ ID NO: 460712 - DNA, 15 bp, Homo sapiens
caactccgcccagcc

SEQ ID NO: 460713 - DNA, 18 bp, Homo sapiens
caactctgtgtcccagca

SEQ ID NO: 460714 - DNA, 19 bp, Homo sapiens
caacttaaacctgtgcttt

SEQ ID NO: 460715 - DNA, 23 bp, Homo sapiens
caacttaaacctgtgctttcatg

SEQ ID NO: 460716 - DNA, 13 bp, Homo sapiens
caagaacaaacag

SEQ ID NO: 460717 - DNA, 15 bp, Homo sapiens
caagaagattctaaa

SEQ ID NO: 460718 - DNA, 19 bp, Homo sapiens
caagaatggaattttctga

SEQ ID NO: 460719 - DNA, 16 bp, Homo sapiens
caagagctcaggagaa

SEQ ID NO: 460720 - DNA, 22 bp, Homo sapiens
caagagctcaggagaaggcctg

SEQ ID NO: 460721 - DNA, 13 bp, Homo sapiens
caagagggcactg

SEQ ID NO: 460722 - DNA, 23 bp, Homo sapiens
caagatttccctaaaaattccac

SEQ ID NO: 460723 - DNA, 12 bp, Homo sapiens
caagccaggaga

SEQ ID NO: 460724 - DNA, 20 bp, Homo sapiens
caagccaggagaccctgtct

SEQ ID NO: 460725 - DNA, 17 bp, Homo sapiens
caagccgtggcttcccg

SEQ ID NO: 460726 - DNA, 22 bp, Homo sapiens
caatttaaaggaaagttctatt

SEQ ID NO: 460727 - DNA, 23 bp, Homo sapiens
caatttaaaggaaagttctatta

SEQ ID NO: 460728 - DNA, 19 bp, Homo sapiens
caatttcaaaatgcatgtg

SEQ ID NO: 460729 - DNA, 14 bp, Homo sapiens
caattttaaaaaat

SEQ ID NO: 460730 - DNA, 19 bp, Homo sapiens
caattttaaaaaataacat

SEQ ID NO: 460731 - DNA, 22 bp, Homo sapiens
caattttaaaaaataacatatt

SEQ ID NO: 460732 - DNA, 13 bp, Homo sapiens
cacaaaaggctgg

SEQ ID NO: 460733 - DNA, 20 bp, Homo sapiens
cacaaataagtaatatcttt

SEQ ID NO: 460734 - DNA, 14 bp, Homo sapiens
cacaactaacaatg

SEQ ID NO: 460735 - DNA, 16 bp, Homo sapiens
cacaactaacaatgcc

SEQ ID NO: 460736 - DNA, 23 bp, Homo sapiens
cacaactaacaatgccttgttgt

SEQ ID NO: 460737 - DNA, 16 bp, Homo sapiens
cacaataatgaataat

SEQ ID NO: 460738 - DNA, 23 bp, Homo sapiens
cacaattctctgattttgagctc

SEQ ID NO: 460739 - DNA, 14 bp, Homo sapiens
cacacacccttccc

SEQ ID NO: 460740 - DNA, 13 bp, Homo sapiens
cacacagcagccc

SEQ ID NO: 460741 - DNA, 22 bp, Homo sapiens
cacaccagaagtgccatgctca

SEQ ID NO: 460742 - DNA, 21 bp, Homo sapiens
cacaccccgtctgccccttga

SEQ ID NO: 460743 - DNA, 11 bp, Homo sapiens
cacacccttcc

SEQ ID NO: 460744 - DNA, 12 bp, Homo sapiens
cacacccttccc

SEQ ID NO: 460745 - DNA, 15 bp, Homo sapiens
cacacccttccccac

SEQ ID NO: 460746 - DNA, 16 bp, Homo sapiens
cacacccttccccact

SEQ ID NO: 460747 - DNA, 15 bp, Homo sapiens
cacacctccacccgt

SEQ ID NO: 460748 - DNA, 21 bp, Homo sapiens
cacacgccggggctggccctg

SEQ ID NO: 460749 - DNA, 17 bp, Homo sapiens
cacacttcaggctcttc

SEQ ID NO: 460750 - DNA, 16 bp, Homo sapiens
cacagaacctttgtca

SEQ ID NO: 460751 - DNA, 17 bp, Homo sapiens
cacagaacctttgtcaa

SEQ ID NO: 460752 - DNA, 22 bp, Homo sapiens
cacagaacctttgtcaacttca

SEQ ID NO: 460753 - DNA, 22 bp, Homo sapiens
cacagatgggtattaaacttgt

SEQ ID NO: 460754 - DNA, 18 bp, Homo sapiens
cacaggacacgaaggctg

SEQ ID NO: 460755 - DNA, 16 bp, Homo sapiens
cacaggcccttcctct

SEQ ID NO: 460756 - DNA, 22 bp, Homo sapiens
cacaggcccttcctctccactg

SEQ ID NO: 460757 - DNA, 23 bp, Homo sapiens
cacaggcccttcctctccactgc

SEQ ID NO: 460758 - DNA, 17 bp, Homo sapiens
cacagtgcatctcagcc

SEQ ID NO: 460759 - DNA, 22 bp, Homo sapiens
cacagtggggcccatggcccca

SEQ ID NO: 460760 - DNA, 18 bp, Homo sapiens
cacagttcttggtgactg

SEQ ID NO: 460761 - DNA, 12 bp, Homo sapiens
cacatctgtata

SEQ ID NO: 460762 - DNA, 20 bp, Homo sapiens
cacatctgtatatcagctct

SEQ ID NO: 460763 - DNA, 20 bp, Homo sapiens
cacatttgtcactgaataat

SEQ ID NO: 460764 - DNA, 20 bp, Homo sapiens
caccaaaggaaacccaattc

SEQ ID NO: 460765 - DNA, 18 bp, Homo sapiens
caccaacctcactgccct

SEQ ID NO: 460766 - DNA, 22 bp, Homo sapiens
caccaagctgctctccttcact

SEQ ID NO: 460767 - DNA, 17 bp, Homo sapiens
caccacacacacccttc

SEQ ID NO: 460768 - DNA, 15 bp, Homo sapiens
caccaccgctcccgc

SEQ ID NO: 460769 - DNA, 23 bp, Homo sapiens
caccacggggtcgggggaggagc

SEQ ID NO: 460770 - DNA, 17 bp, Homo sapiens
caccagaagtgccatgc

SEQ ID NO: 460771 - DNA, 20 bp, Homo sapiens
caccagcctgagccacagtg

SEQ ID NO: 460772 - DNA, 17 bp, Homo sapiens
caccatcccctcctagc

SEQ ID NO: 460773 - DNA, 13 bp, Homo sapiens
caccatccttcca

SEQ ID NO: 460774 - DNA, 20 bp, Homo sapiens
cacccacaccccgtctgccc

SEQ ID NO: 460775 - DNA, 13 bp, Homo sapiens
cacccagaccctc

SEQ ID NO: 460776 - DNA, 16 bp, Homo sapiens
cacccagaccctcctt

SEQ ID NO: 460777 - DNA, 17 bp, Homo sapiens
cacccagaccctccttc

SEQ ID NO: 460778 - DNA, 14 bp, Homo sapiens
caccccactgagag

SEQ ID NO: 460779 - DNA, 22 bp, Homo sapiens
caccccactgagagctgctcct

SEQ ID NO: 460780 - DNA, 20 bp, Homo sapiens
cgacttgggacggaagtggc

SEQ ID NO: 460781 - DNA, 12 bp, Homo sapiens
cgagcccagatg

SEQ ID NO: 460782 - DNA, 18 bp, Homo sapiens
cgagcgcgtgccttcccc

SEQ ID NO: 460783 - DNA, 20 bp, Homo sapiens
cgaggcagaatggtgggctc

SEQ ID NO: 460784 - DNA, 14 bp, Homo sapiens
cgaggcccccctct

SEQ ID NO: 460785 - DNA, 23 bp, Homo sapiens
cgaggcccccctctgcctttgag

SEQ ID NO: 460786 - DNA, 13 bp, Homo sapiens
cgagggaagcagt

SEQ ID NO: 460787 - DNA, 12 bp, Homo sapiens
cgagtcccccca

SEQ ID NO: 460788 - DNA, 16 bp, Homo sapiens
cgagtccccccacccc

SEQ ID NO: 460789 - DNA, 20 bp, Homo sapiens
cgagtctcttctccactgga

SEQ ID NO: 460790 - DNA, 21 bp, Homo sapiens
cgatttcctaagctgttggaa

SEQ ID NO: 460791 - DNA, 21 bp, Homo sapiens
cgcaatatgggaggaacaaag

SEQ ID NO: 460792 - DNA, 13 bp, Homo sapiens
cgcaatgtggcat

SEQ ID NO: 460793 - DNA, 16 bp, Homo sapiens
cgcagacagacagaca

SEQ ID NO: 460794 - DNA, 12 bp, Homo sapiens
cgcagcaccagc

SEQ ID NO: 460795 - DNA, 13 bp, Homo sapiens
cgcagcaccagcc

SEQ ID NO: 460796 - DNA, 15 bp, Homo sapiens
cgcagcaccagcctg

SEQ ID NO: 460797 - DNA, 20 bp, Homo sapiens
cgcagcaccagcctgagcca

SEQ ID NO: 460798 - DNA, 10 bp, Homo sapiens
cgcagccctg

SEQ ID NO: 460799 - DNA, 17 bp, Homo sapiens
cgcagccgcgctctgcc

SEQ ID NO: 460800 - DNA, 20 bp, Homo sapiens
cgcagccgcgctctgcccct

SEQ ID NO: 460801 - DNA, 22 bp, Homo sapiens
cgcagggcgctccggcagaggc

SEQ ID NO: 460802 - DNA, 23 bp, Homo sapiens
cgcagggcgctccggcagaggca

SEQ ID NO: 460803 - DNA, 20 bp, Homo sapiens
cgcatccaccgccaccccac

SEQ ID NO: 460804 - DNA, 23 bp, Homo sapiens
cgcatccaccgccaccccactga

SEQ ID NO: 460805 - DNA, 17 bp, Homo sapiens
cgcccaacccccacctc

SEQ ID NO: 460806 - DNA, 22 bp, Homo sapiens
cgcccacccacaccccgtctgc

SEQ ID NO: 460807 - DNA, 16 bp, Homo sapiens
cgcccaccccgctgcc

SEQ ID NO: 460808 - DNA, 23 bp, Homo sapiens
cgccccagagactgcccaccctg

SEQ ID NO: 460809 - DNA, 18 bp, Homo sapiens
cgcccccgccctcgctcc

SEQ ID NO: 460810 - DNA, 11 bp, Homo sapiens
cgcccctcctc

SEQ ID NO: 460811 - DNA, 13 bp, Homo sapiens
cgcccctcctcgg

SEQ ID NO: 460812 - DNA, 15 bp, Homo sapiens
cgcccgcccaccccg

SEQ ID NO: 460813 - DNA, 23 bp, Homo sapiens
cgcccgcccaccccgctgcctgg

SEQ ID NO: 460814 - DNA, 17 bp, Homo sapiens
cgcccgcccccgccctc

SEQ ID NO: 460815 - DNA, 19 bp, Homo sapiens
cgcccgccctcctctgccc

SEQ ID NO: 460816 - DNA, 21 bp, Homo sapiens
cgcccgccctcctctgccccc

SEQ ID NO: 460817 - DNA, 11 bp, Homo sapiens
cgccctccctc

SEQ ID NO: 460818 - DNA, 17 bp, Homo sapiens
cgccctccctccctcca

SEQ ID NO: 460819 - DNA, 18 bp, Homo sapiens
cgccctccctccctccac

SEQ ID NO: 460820 - DNA, 21 bp, Homo sapiens
cgccctccctccctccacacc

SEQ ID NO: 460821 - DNA, 10 bp, Homo sapiens
cgccctcctc

SEQ ID NO: 460822 - DNA, 14 bp, Homo sapiens
cgccctcctctgcc

SEQ ID NO: 460823 - DNA, 19 bp, Homo sapiens
cgccctcctctgccccctc

SEQ ID NO: 460824 - DNA, 21 bp, Homo sapiens
cgccctcctctgccccctccc

SEQ ID NO: 460825 - DNA, 14 bp, Homo sapiens
cgccctgggctgtc

SEQ ID NO: 460826 - DNA, 16 bp, Homo sapiens
cgccgcctcgggccgc

SEQ ID NO: 460827 - DNA, 15 bp, Homo sapiens
cgccggggctggccc

SEQ ID NO: 460828 - DNA, 16 bp, Homo sapiens
cgccggggctggccct

SEQ ID NO: 460829 - DNA, 23 bp, Homo sapiens
cgccggggctggccctgccctcc

SEQ ID NO: 460830 - DNA, 19 bp, Homo sapiens
cgccggttggccggctggc

SEQ ID NO: 460831 - DNA, 13 bp, Homo sapiens
cgcctcctccaga

SEQ ID NO: 460832 - DNA, 14 bp, Homo sapiens
cgcctcctggccag

SEQ ID NO: 460833 - DNA, 19 bp, Homo sapiens
cgcctcgggccgcctcctc

SEQ ID NO: 460834 - DNA, 23 bp, Homo sapiens
cgcctgcgctcctctgcagcctg

SEQ ID NO: 460835 - DNA, 19 bp, Homo sapiens
cgcctttgctgaagtctcc

SEQ ID NO: 460836 - DNA, 13 bp, Homo sapiens
cgcgcaccgccca

SEQ ID NO: 460837 - DNA, 16 bp, Homo sapiens
cgcgcgtgcccccagc

SEQ ID NO: 460838 - DNA, 13 bp, Homo sapiens
cgcgctctgcccc

SEQ ID NO: 460839 - DNA, 16 bp, Homo sapiens
cgcgctctgcccctcc

SEQ ID NO: 460840 - DNA, 16 bp, Homo sapiens
cgcgggaagccagccc

SEQ ID NO: 460841 - DNA, 12 bp, Homo sapiens
cgcgtgccccca

SEQ ID NO: 460842 - DNA, 16 bp, Homo sapiens
cgcgtgcccccagcgt

SEQ ID NO: 460843 - DNA, 17 bp, Homo sapiens
cgctcacgctgacagcc

SEQ ID NO: 460844 - DNA, 18 bp, Homo sapiens
cgctcacgctgacagcct

SEQ ID NO: 460845 - DNA, 20 bp, Homo sapiens
cgctcacgctgacagcctcc

SEQ ID NO: 460846 - DNA, 23 bp, Homo sapiens
cgctcacgctgacagcctcctag

SEQ ID NO: 460847 - DNA, 20 bp, Homo sapiens
cgctcagaggccgctctggg

SEQ ID NO: 460848 - DNA, 14 bp, Homo sapiens
cgctccggcagagg

SEQ ID NO: 460849 - DNA, 19 bp, Homo sapiens
cgctccggcagaggcaggg

SEQ ID NO: 460850 - DNA, 21 bp, Homo sapiens
cgctccggcagaggcagggcc

SEQ ID NO: 460851 - DNA, 14 bp, Homo sapiens
cgctcctctgcagc

SEQ ID NO: 460852 - DNA, 15 bp, Homo sapiens
cgctcctctgcagcc

SEQ ID NO: 460853 - DNA, 18 bp, Homo sapiens
cgctcctctgcagcctga

SEQ ID NO: 460854 - DNA, 23 bp, Homo sapiens
cgctcctctgcagcctgagctcc

SEQ ID NO: 460855 - DNA, 18 bp, Homo sapiens
cgctctggatcctgcact

SEQ ID NO: 460856 - DNA, 15 bp, Homo sapiens
cgctgacagcctcct

SEQ ID NO: 460857 - DNA, 22 bp, Homo sapiens
cgctgagggcagggttctagaa

SEQ ID NO: 460858 - DNA, 23 bp, Homo sapiens
cgctgagggcagggttctagaag

SEQ ID NO: 460859 - DNA, 15 bp, Homo sapiens
cgctgccgctgcacc

SEQ ID NO: 460860 - DNA, 10 bp, Homo sapiens
cgctgcctgg

SEQ ID NO: 460861 - DNA, 17 bp, Homo sapiens
cgctgcctggcgggcag

SEQ ID NO: 460862 - DNA, 19 bp, Homo sapiens
cgctgtcctctcgagccca

SEQ ID NO: 460863 - DNA, 17 bp, Homo sapiens
cgctgtcgccccaggcc

SEQ ID NO: 460864 - DNA, 18 bp, Homo sapiens
cgctgtcgccccaggccc

SEQ ID NO: 460865 - DNA, 19 bp, Homo sapiens
cgctgtgctccagcagtgc

SEQ ID NO: 460866 - DNA, 13 bp, Homo sapiens
cggacgctggctc

SEQ ID NO: 460867 - DNA, 16 bp, Homo sapiens
cggacgggacagcggc

SEQ ID NO: 460868 - DNA, 17 bp, Homo sapiens
cggacgggacagcggcc

SEQ ID NO: 460869 - DNA, 18 bp, Homo sapiens
cggagccccccactcagt

SEQ ID NO: 460870 - DNA, 18 bp, Homo sapiens
cggaggcgcccacctgcc

SEQ ID NO: 460871 - DNA, 13 bp, Homo sapiens
cggaggctgggcc

SEQ ID NO: 460872 - DNA, 19 bp, Homo sapiens
cggaggctgggcccctggg

SEQ ID NO: 460873 - DNA, 12 bp, Homo sapiens
cggcaccgccca

SEQ ID NO: 460874 - DNA, 15 bp, Homo sapiens
cggcaccgcccaccc

SEQ ID NO: 460875 - DNA, 13 bp, Homo sapiens
cggcaccttcccc

SEQ ID NO: 460876 - DNA, 24 bp, Homo sapiens
cggcagaggcagggccctggggtc

SEQ ID NO: 460877 - DNA, 11 bp, Homo sapiens
cggcagcccca

SEQ ID NO: 460878 - DNA, 12 bp, Homo sapiens
cagatcttgagc

SEQ ID NO: 460879 - DNA, 16 bp, Homo sapiens
cagatcttgagcaagg

SEQ ID NO: 460880 - DNA, 18 bp, Homo sapiens
cagattattttctatatt

SEQ ID NO: 460881 - DNA, 17 bp, Homo sapiens
cagattccacaggacac

SEQ ID NO: 460882 - DNA, 16 bp, Homo sapiens
cagcaaccctacagta

SEQ ID NO: 460883 - DNA, 15 bp, Homo sapiens
cagcaagataaacac

SEQ ID NO: 460884 - DNA, 20 bp, Homo sapiens
cagcaagataaacacaattt

SEQ ID NO: 460885 - DNA, 12 bp, Homo sapiens
cagcaaggggct

SEQ ID NO: 460886 - DNA, 14 bp, Homo sapiens
cagcaaggggctct

SEQ ID NO: 460887 - DNA, 20 bp, Homo sapiens
cagcaaggggctctgccctc

SEQ ID NO: 460888 - DNA, 13 bp, Homo sapiens
cagcaccagcctg

SEQ ID NO: 460889 - DNA, 18 bp, Homo sapiens
cagcaccagcctgagcca

SEQ ID NO: 460890 - DNA, 19 bp, Homo sapiens
cagcaccagcctgagccac

SEQ ID NO: 460891 - DNA, 12 bp, Homo sapiens
cagcaccctccc

SEQ ID NO: 460892 - DNA, 17 bp, Homo sapiens
cagcaccctctcctggg

SEQ ID NO: 460893 - DNA, 23 bp, Homo sapiens
cagcaccctctcctgggggtggc

SEQ ID NO: 460894 - DNA, 19 bp, Homo sapiens
cagcacctggcacaccaga

SEQ ID NO: 460895 - DNA, 14 bp, Homo sapiens
cagcactcccaggg

SEQ ID NO: 460896 - DNA, 20 bp, Homo sapiens
cagcagattccacaggacac

SEQ ID NO: 460897 - DNA, 22 bp, Homo sapiens
cagcagattccacaggacacga

SEQ ID NO: 460898 - DNA, 16 bp, Homo sapiens
cagcagccccccagca

SEQ ID NO: 460899 - DNA, 17 bp, Homo sapiens
cagcagccccccagcac

SEQ ID NO: 460900 - DNA, 23 bp, Homo sapiens
cagcaggcggcctttgttgctca

SEQ ID NO: 460901 - DNA, 16 bp, Homo sapiens
cagcaggggggttggg

SEQ ID NO: 460902 - DNA, 16 bp, Homo sapiens
cagcagtaccatccca

SEQ ID NO: 460903 - DNA, 20 bp, Homo sapiens
cagcagtaccatcccactga

SEQ ID NO: 460904 - DNA, 16 bp, Homo sapiens
cagcagtacttgctca

SEQ ID NO: 460905 - DNA, 18 bp, Homo sapiens
cagcagtgctgggcccag

SEQ ID NO: 460906 - DNA, 20 bp, Homo sapiens
cagcagtgctgggcccagcc

SEQ ID NO: 460907 - DNA, 21 bp, Homo sapiens
cagcagtgctgggcccagccg

SEQ ID NO: 460908 - DNA, 19 bp, Homo sapiens
cagcatagttctgcaataa

SEQ ID NO: 460909 - DNA, 21 bp, Homo sapiens
cagcatagttctgcaataaca

SEQ ID NO: 460910 - DNA, 12 bp, Homo sapiens
cagcattcaaaa

SEQ ID NO: 460911 - DNA, 15 bp, Homo sapiens
cagcattcaaaatag

SEQ ID NO: 460912 - DNA, 12 bp, Homo sapiens
cagccaaagaaa

SEQ ID NO: 460913 - DNA, 14 bp, Homo sapiens
cagccaaagaaact

SEQ ID NO: 460914 - DNA, 16 bp, Homo sapiens
cagccaatttcaaaga

SEQ ID NO: 460915 - DNA, 22 bp, Homo sapiens
cagccaatttcaaagaaaacag

SEQ ID NO: 460916 - DNA, 17 bp, Homo sapiens
cagccagccgccctggg

SEQ ID NO: 460917 - DNA, 21 bp, Homo sapiens
cagcccagaacgggcctcccc

SEQ ID NO: 460918 - DNA, 23 bp, Homo sapiens
cagcccagaacgggcctccccgg

SEQ ID NO: 460919 - DNA, 12 bp, Homo sapiens
cagccccatcct

SEQ ID NO: 460920 - DNA, 21 bp, Homo sapiens
cagccccatccttcccgcagc

SEQ ID NO: 460921 - DNA, 13 bp, Homo sapiens
cagcccctcccca

SEQ ID NO: 460922 - DNA, 14 bp, Homo sapiens
cagcccctccccat

SEQ ID NO: 460923 - DNA, 16 bp, Homo sapiens
cagccctccctgcccc

SEQ ID NO: 460924 - DNA, 14 bp, Homo sapiens
cagccctctccacc

SEQ ID NO: 460925 - DNA, 20 bp, Homo sapiens
cagccctgctttgggctgcc

SEQ ID NO: 460926 - DNA, 14 bp, Homo sapiens
cagccgccctgggc

SEQ ID NO: 460927 - DNA, 18 bp, Homo sapiens
cagccgcgctctgcccct

SEQ ID NO: 460928 - DNA, 22 bp, Homo sapiens
cagccggggtggggtgcctgag

SEQ ID NO: 460929 - DNA, 14 bp, Homo sapiens
cagccgtgccttca

SEQ ID NO: 460930 - DNA, 21 bp, Homo sapiens
cagccgtttgaatatatttta

SEQ ID NO: 460931 - DNA, 18 bp, Homo sapiens
cagcctccaggcccccaa

SEQ ID NO: 460932 - DNA, 12 bp, Homo sapiens
cagcctccccca

SEQ ID NO: 460933 - DNA, 13 bp, Homo sapiens
cagcctcccccag

SEQ ID NO: 460934 - DNA, 14 bp, Homo sapiens
cagcctcccccagg

SEQ ID NO: 460935 - DNA, 16 bp, Homo sapiens
cagcctcccccaggct

SEQ ID NO: 460936 - DNA, 18 bp, Homo sapiens
cagcctcccccaggctgc

SEQ ID NO: 460937 - DNA, 14 bp, Homo sapiens
cagcctcctaggct

SEQ ID NO: 460938 - DNA, 20 bp, Homo sapiens
cagcctcctaggctccctga

SEQ ID NO: 460939 - DNA, 14 bp, Homo sapiens
cagcctgagccaca

SEQ ID NO: 460940 - DNA, 18 bp, Homo sapiens
cagcctgagccacagtgg

SEQ ID NO: 460941 - DNA, 20 bp, Homo sapiens
cagcctgagccacagtgggg

SEQ ID NO: 460942 - DNA, 11 bp, Homo sapiens
cagcctgagct

SEQ ID NO: 460943 - DNA, 12 bp, Homo sapiens
cagcctgagctc

SEQ ID NO: 460944 - DNA, 13 bp, Homo sapiens
cagcctggcacag

SEQ ID NO: 460945 - DNA, 21 bp, Homo sapiens
cagcctggcacagggcagtgg

SEQ ID NO: 460946 - DNA, 19 bp, Homo sapiens
cagcctttgcgctctgggt

SEQ ID NO: 460947 - DNA, 12 bp, Homo sapiens
cagcggcccggc

SEQ ID NO: 460948 - DNA, 13 bp, Homo sapiens
cagcggcccggcc

SEQ ID NO: 460949 - DNA, 17 bp, Homo sapiens
cagcggcccggcccacg

SEQ ID NO: 460950 - DNA, 22 bp, Homo sapiens
cagcgtaacggagggtgaagag

SEQ ID NO: 460951 - DNA, 23 bp, Homo sapiens
cagctaggttaataggaggacag

SEQ ID NO: 460952 - DNA, 21 bp, Homo sapiens
cagctatgcgcaatgtggcat

SEQ ID NO: 460953 - DNA, 13 bp, Homo sapiens
cagctccactctg

SEQ ID NO: 460954 - DNA, 17 bp, Homo sapiens
cagctccactctgaagt

SEQ ID NO: 460955 - DNA, 22 bp, Homo sapiens
cctggactggtggcccctgcct

SEQ ID NO: 460956 - DNA, 16 bp, Homo sapiens
cctggagaactagaga

SEQ ID NO: 460957 - DNA, 21 bp, Homo sapiens
cctggattttctttctatgta

SEQ ID NO: 460958 - DNA, 12 bp, Homo sapiens
cctggcagccgt

SEQ ID NO: 460959 - DNA, 19 bp, Homo sapiens
cctggcagccgtgccttca

SEQ ID NO: 460960 - DNA, 19 bp, Homo sapiens
cctggcctatttaagcccc

SEQ ID NO: 460961 - DNA, 21 bp, Homo sapiens
cctggcctatttaagccccct

SEQ ID NO: 460962 - DNA, 18 bp, Homo sapiens
cctggcgggcagcccctg

SEQ ID NO: 460963 - DNA, 21 bp, Homo sapiens
cctggcgggcagcccctgctg

SEQ ID NO: 460964 - DNA, 23 bp, Homo sapiens
cctggcgggcagcccctgctgga

SEQ ID NO: 460965 - DNA, 16 bp, Homo sapiens
cctgggatgggaccag

SEQ ID NO: 460966 - DNA, 22 bp, Homo sapiens
cctgggcctcagttcaacctgg

SEQ ID NO: 460967 - DNA, 17 bp, Homo sapiens
cctgggctgtctgtcac

SEQ ID NO: 460968 - DNA, 19 bp, Homo sapiens
cctgggctgtctgtcacca

SEQ ID NO: 460969 - DNA, 22 bp, Homo sapiens
cctgggggtggcaggcacacag

SEQ ID NO: 460970 - DNA, 18 bp, Homo sapiens
cctggggtctctgagcag

SEQ ID NO: 460971 - DNA, 20 bp, Homo sapiens
cctggtctggagcccctatc

SEQ ID NO: 460972 - DNA, 16 bp, Homo sapiens
cctggtgcgctgtgct

SEQ ID NO: 460973 - DNA, 20 bp, Homo sapiens
cctggtgcgctgtgctccag

SEQ ID NO: 460974 - DNA, 22 bp, Homo sapiens
cctggtgcgctgtgctccagca

SEQ ID NO: 460975 - DNA, 15 bp, Homo sapiens
cctggtgctgccaca

SEQ ID NO: 460976 - DNA, 18 bp, Homo sapiens
cctggtgctgccacactt

SEQ ID NO: 460977 - DNA, 15 bp, Homo sapiens
cctggtggcaccaga

SEQ ID NO: 460978 - DNA, 18 bp, Homo sapiens
cctgtaaggtttcaatgc

SEQ ID NO: 460979 - DNA, 20 bp, Homo sapiens
cctgtagtggcaaaaaagaa

SEQ ID NO: 460980 - DNA, 21 bp, Homo sapiens
cctgtagtggcaaaaaagaac

SEQ ID NO: 460981 - DNA, 13 bp, Homo sapiens
cctgtatttccaa

SEQ ID NO: 460982 - DNA, 16 bp, Homo sapiens
cctgtccacctgtgct

SEQ ID NO: 460983 - DNA, 18 bp, Homo sapiens
cctgtccccagttaatgt

SEQ ID NO: 460984 - DNA, 14 bp, Homo sapiens
cctgtctttgctgt

SEQ ID NO: 460985 - DNA, 18 bp, Homo sapiens
cctgtctttgctgtttat

SEQ ID NO: 460986 - DNA, 19 bp, Homo sapiens
cctgtctttgctgtttata

SEQ ID NO: 460987 - DNA, 23 bp, Homo sapiens
cctgtctttgctgtttatatata

SEQ ID NO: 460988 - DNA, 16 bp, Homo sapiens
cctgtgctgctgcacc

SEQ ID NO: 460989 - DNA, 14 bp, Homo sapiens
cctgtgctttcatg

SEQ ID NO: 460990 - DNA, 14 bp, Homo sapiens
cctgtgggagtcca

SEQ ID NO: 460991 - DNA, 19 bp, Homo sapiens
cctgtgggagtccactttc

SEQ ID NO: 460992 - DNA, 14 bp, Homo sapiens
cctgtgggggtggc

SEQ ID NO: 460993 - DNA, 18 bp, Homo sapiens
cctgtgggggtggccatc

SEQ ID NO: 460994 - DNA, 21 bp, Homo sapiens
cctgttcactctacttagcat

SEQ ID NO: 460995 - DNA, 23 bp, Homo sapiens
ccttaagtcttactgttttgtgc

SEQ ID NO: 460996 - DNA, 15 bp, Homo sapiens
ccttagaacctttct

SEQ ID NO: 460997 - DNA, 17 bp, Homo sapiens
ccttcaggttcctccta

SEQ ID NO: 460998 - DNA, 13 bp, Homo sapiens
ccttcccacccct

SEQ ID NO: 460999 - DNA, 15 bp, Homo sapiens
ccttcccacccctat

SEQ ID NO: 461000 - DNA, 11 bp, Homo sapiens
ccttccccact

SEQ ID NO: 461001 - DNA, 21 bp, Homo sapiens
ccttcccctgaggacctttct

SEQ ID NO: 461002 - DNA, 16 bp, Homo sapiens
ccttcccctgcgccct

SEQ ID NO: 461003 - DNA, 22 bp, Homo sapiens
ccttcccctgcgccctccctcc

SEQ ID NO: 461004 - DNA, 17 bp, Homo sapiens
ccttccccttctgtgtc

SEQ ID NO: 461005 - DNA, 18 bp, Homo sapiens
ccttccccttctgtgtca

SEQ ID NO: 461006 - DNA, 21 bp, Homo sapiens
ccttccccttctgtgtcacag

SEQ ID NO: 461007 - DNA, 19 bp, Homo sapiens
ccttcccgcagcaccagcc

SEQ ID NO: 461008 - DNA, 22 bp, Homo sapiens
ccttcccgcagcaccagcctga

SEQ ID NO: 461009 - DNA, 16 bp, Homo sapiens
ccttcccgccttcagg

SEQ ID NO: 461010 - DNA, 12 bp, Homo sapiens
ccttccctccaa

SEQ ID NO: 461011 - DNA, 14 bp, Homo sapiens
ccttcctctccact

SEQ ID NO: 461012 - DNA, 21 bp, Homo sapiens
ccttcctctccactgccttcg

SEQ ID NO: 461013 - DNA, 15 bp, Homo sapiens
ccttcctgtcctgct

SEQ ID NO: 461014 - DNA, 22 bp, Homo sapiens
ccttcgatacaccgggcctgga

SEQ ID NO: 461015 - DNA, 13 bp, Homo sapiens
ccttcgcctttgc

SEQ ID NO: 461016 - DNA, 13 bp, Homo sapiens
ccttctcccctcc

SEQ ID NO: 461017 - DNA, 16 bp, Homo sapiens
ccttctcccctccaga

SEQ ID NO: 461018 - DNA, 18 bp, Homo sapiens
ccttctcccctccagacc

SEQ ID NO: 461019 - DNA, 21 bp, Homo sapiens
ccttgcccaaccaatgcacac

SEQ ID NO: 461020 - DNA, 14 bp, Homo sapiens
ccttgcttcacttt

SEQ ID NO: 461021 - DNA, 14 bp, Homo sapiens
ccttggatttttga

SEQ ID NO: 461022 - DNA, 14 bp, Homo sapiens
ccttggcctgtcca

SEQ ID NO: 461023 - DNA, 15 bp, Homo sapiens
ccttggttcctccag

SEQ ID NO: 461024 - DNA, 16 bp, Homo sapiens
ccttggttcctccagc

SEQ ID NO: 461025 - DNA, 19 bp, Homo sapiens
ccttgtacagaaccagcac

SEQ ID NO: 461026 - DNA, 17 bp, Homo sapiens
cctttaataatgttata

SEQ ID NO: 461027 - DNA, 14 bp, Homo sapiens
cctttatttattaa

SEQ ID NO: 461028 - DNA, 20 bp, Homo sapiens
cctttatttattaaacttca

SEQ ID NO: 461029 - DNA, 21 bp, Homo sapiens
cctttatttattaaacttcag

SEQ ID NO: 461030 - DNA, 23 bp, Homo sapiens
cctttatttattaaacttcagca

SEQ ID NO: 461031 - DNA, 14 bp, Homo sapiens
cctttccacccaga

SEQ ID NO: 461032 - DNA, 15 bp, Homo sapiens
cctttccacccagac

SEQ ID NO: 461033 - DNA, 16 bp, Homo sapiens
cctttccgctgtcgcc

SEQ ID NO: 461034 - DNA, 21 bp, Homo sapiens
cctttccgctgtcgccccagg

SEQ ID NO: 461035 - DNA, 15 bp, Homo sapiens
cctttgagcttctcc

SEQ ID NO: 461036 - DNA, 17 bp, Homo sapiens
cctttgagcttctcctc

SEQ ID NO: 461037 - DNA, 19 bp, Homo sapiens
cctttgagcttctcctctg

SEQ ID NO: 461038 - DNA, 22 bp, Homo sapiens
cctttgagcttctcctctgctc

SEQ ID NO: 461039 - DNA, 18 bp, Homo sapiens
cctttgctgaagtctccc

SEQ ID NO: 461040 - DNA, 20 bp, Homo sapiens
cctttgctgaagtctccccg

SEQ ID NO: 461041 - DNA, 15 bp, Homo sapiens
cctttggtgaataac

SEQ ID NO: 461042 - DNA, 18 bp, Homo sapiens
cctttgtcaacttcagtt

SEQ ID NO: 461043 - DNA, 17 bp, Homo sapiens
cctttgtggactttatt

SEQ ID NO: 461044 - DNA, 22 bp, Homo sapiens
cctttgtggactttatttaatt

SEQ ID NO: 461045 - DNA, 17 bp, Homo sapiens
ccttttgtatcctccat

SEQ ID NO: 461046 - DNA, 18 bp, Homo sapiens
ccttttttattgaataac

SEQ ID NO: 461047 - DNA, 17 bp, Homo sapiens
cgaaacacagaactcag

SEQ ID NO: 461048 - DNA, 13 bp, Homo sapiens
cgaatttctcact

SEQ ID NO: 461049 - DNA, 13 bp, Homo sapiens
cgacagcctggca

SEQ ID NO: 461050 - DNA, 14 bp, Homo sapiens
cgacagcctggcac

SEQ ID NO: 461051 - DNA, 22 bp, Homo sapiens
cgacgacaaatcttttggcaga

SEQ ID NO: 461052 - DNA, 19 bp, Homo sapiens
cggccaaggacactgatgg

SEQ ID NO: 461053 - DNA, 14 bp, Homo sapiens
cggccagggacccc

SEQ ID NO: 461054 - DNA, 20 bp, Homo sapiens
cggccagggacccccgaggc

SEQ ID NO: 461055 - DNA, 18 bp, Homo sapiens
cggcccacgcagagcccc

SEQ ID NO: 461056 - DNA, 22 bp, Homo sapiens
cggcccacgcagagccccggag

SEQ ID NO: 461057 - DNA, 23 bp, Homo sapiens
cggcccagggggaagatgccaag

SEQ ID NO: 461058 - DNA, 16 bp, Homo sapiens
cggccccgcgcgtgcc

SEQ ID NO: 461059 - DNA, 17 bp, Homo sapiens
cggcccggcccacgcag

SEQ ID NO: 461060 - DNA, 18 bp, Homo sapiens
cggcccggcccacgcaga

SEQ ID NO: 461061 - DNA, 15 bp, Homo sapiens
cggccgtccctgact

SEQ ID NO: 461062 - DNA, 12 bp, Homo sapiens
cggcctgcagcc

SEQ ID NO: 461063 - DNA, 21 bp, Homo sapiens
cggcggccagggacccccgag

SEQ ID NO: 461064 - DNA, 21 bp, Homo sapiens
cggcggtggactgcgctggac

SEQ ID NO: 461065 - DNA, 15 bp, Homo sapiens
cggctccccctgcca

SEQ ID NO: 461066 - DNA, 18 bp, Homo sapiens
cggctccccctgccagca

SEQ ID NO: 461067 - DNA, 22 bp, Homo sapiens
cggctggccggtccaccccgtc

SEQ ID NO: 461068 - DNA, 12 bp, Homo sapiens
cggctgggcagg

SEQ ID NO: 461069 - DNA, 13 bp, Homo sapiens
cggctgggcaggg

SEQ ID NO: 461070 - DNA, 14 bp, Homo sapiens
cggctgggcagggc

SEQ ID NO: 461071 - DNA, 15 bp, Homo sapiens
cggctgggcagggcc

SEQ ID NO: 461072 - DNA, 17 bp, Homo sapiens
cggctgggcagggccgc

SEQ ID NO: 461073 - DNA, 20 bp, Homo sapiens
cggctgggcagggccgcagg

SEQ ID NO: 461074 - DNA, 19 bp, Homo sapiens
cggctgtgtggggagggtg

SEQ ID NO: 461075 - DNA, 15 bp, Homo sapiens
cgggaaggcctgagg

SEQ ID NO: 461076 - DNA, 13 bp, Homo sapiens
cgggacagcggcc

SEQ ID NO: 461077 - DNA, 16 bp, Homo sapiens
cgggacagcggcccgg

SEQ ID NO: 461078 - DNA, 19 bp, Homo sapiens
cgggacagcggcccggccc

SEQ ID NO: 461079 - DNA, 22 bp, Homo sapiens
cgggactgtcttcaaccctgcc

SEQ ID NO: 461080 - DNA, 15 bp, Homo sapiens
cgggagagcgccacc

SEQ ID NO: 461081 - DNA, 20 bp, Homo sapiens
cgggagagcgccacccgccc

SEQ ID NO: 461082 - DNA, 15 bp, Homo sapiens
cgggcagcccctgct

SEQ ID NO: 461083 - DNA, 18 bp, Homo sapiens
cgggcccgctcaacctct

SEQ ID NO: 461084 - DNA, 21 bp, Homo sapiens
cgggcccgctcaacctctcag

SEQ ID NO: 461085 - DNA, 12 bp, Homo sapiens
cgggccgcctcc

SEQ ID NO: 461086 - DNA, 15 bp, Homo sapiens
cgggccgcctcctcc

SEQ ID NO: 461087 - DNA, 16 bp, Homo sapiens
cgggccgcctcctcca

SEQ ID NO: 461088 - DNA, 20 bp, Homo sapiens
cgggccgcctcctccagact

SEQ ID NO: 461089 - DNA, 14 bp, Homo sapiens
cgggcctccccggg

SEQ ID NO: 461090 - DNA, 23 bp, Homo sapiens
cgggcctccccgggggtccccgg

SEQ ID NO: 461091 - DNA, 14 bp, Homo sapiens
cgggcgcctgcgct

SEQ ID NO: 461092 - DNA, 17 bp, Homo sapiens
cgggcgcctgcgctcct

SEQ ID NO: 461093 - DNA, 23 bp, Homo sapiens
cgggcgcctgcgctcctctgcag

SEQ ID NO: 461094 - DNA, 16 bp, Homo sapiens
cgggctggcctgtgcc

SEQ ID NO: 461095 - DNA, 17 bp, Homo sapiens
cgggctggcctgtgcct

SEQ ID NO: 461096 - DNA, 12 bp, Homo sapiens
cggggctggccc

SEQ ID NO: 461097 - DNA, 13 bp, Homo sapiens
cggggctggccct

SEQ ID NO: 461098 - DNA, 17 bp, Homo sapiens
cggggctggccctgccc

SEQ ID NO: 461099 - DNA, 17 bp, Homo sapiens
cgggggaggagcacccc

SEQ ID NO: 461100 - DNA, 20 bp, Homo sapiens
cgggggctaactggccccag

SEQ ID NO: 461101 - DNA, 22 bp, Homo sapiens
cgggggctaactggccccaggc

SEQ ID NO: 461102 - DNA, 23 bp, Homo sapiens
cgggggctaactggccccaggcg

SEQ ID NO: 461103 - DNA, 21 bp, Homo sapiens
cggggtcgggggaggagcacc

SEQ ID NO: 461104 - DNA, 22 bp, Homo sapiens
cggggtggggtgcctgagcccg

SEQ ID NO: 461105 - DNA, 11 bp, Homo sapiens
cgggtctgtgg

SEQ ID NO: 461106 - DNA, 16 bp, Homo sapiens
cgggtctgtgggactg

SEQ ID NO: 461107 - DNA, 22 bp, Homo sapiens
cgggtgcatttgagagaagcca

SEQ ID NO: 461108 - DNA, 19 bp, Homo sapiens
cgggtgcgtgaccggcccg

SEQ ID NO: 461109 - DNA, 21 bp, Homo sapiens
cgggtgcgtgaccggcccgcc

SEQ ID NO: 461110 - DNA, 18 bp, Homo sapiens
cgggtgtggcctcagccc

SEQ ID NO: 461111 - DNA, 22 bp, Homo sapiens
cgggtgtggcctcagccctcag

SEQ ID NO: 461112 - DNA, 12 bp, Homo sapiens
cggtccaccccg

SEQ ID NO: 461113 - DNA, 22 bp, Homo sapiens
cggtccaccccgtcccggcccc

SEQ ID NO: 461114 - DNA, 20 bp, Homo sapiens
cgtagggcttctaccagaga

SEQ ID NO: 461115 - DNA, 14 bp, Homo sapiens
cgtcaatgtgaaat

SEQ ID NO: 461116 - DNA, 12 bp, Homo sapiens
cgtccccagggt

SEQ ID NO: 461117 - DNA, 19 bp, Homo sapiens
cgtccccagggtgcaggcg

SEQ ID NO: 461118 - DNA, 12 bp, Homo sapiens
cgtcccggcccc

SEQ ID NO: 461119 - DNA, 18 bp, Homo sapiens
cgtccctgacttcccagc

SEQ ID NO: 461120 - DNA, 20 bp, Homo sapiens
cgtccctgacttcccagctg

SEQ ID NO: 461121 - DNA, 22 bp, Homo sapiens
cgtccctgacttcccagctggc

SEQ ID NO: 461122 - DNA, 16 bp, Homo sapiens
cgtccctttccctgca

SEQ ID NO: 461123 - DNA, 17 bp, Homo sapiens
cgtccctttccctgcat

SEQ ID NO: 461124 - DNA, 19 bp, Homo sapiens
cgtccctttccctgcatcc

SEQ ID NO: 461125 - DNA, 10 bp, Homo sapiens
cgtccggcct

SEQ ID NO: 461126 - DNA, 16 bp, Homo sapiens
cgtccggcctgcagcc

SEQ ID NO: 461127 - DNA, 16 bp, Homo sapiens
cgtccgtccgcccgcc

SEQ ID NO: 461128 - DNA, 20 bp, Homo sapiens
cgtctccctggccacccttg

SEQ ID NO: 461129 - DNA, 16 bp, Homo sapiens
cgtcttccctgcttca

SEQ ID NO: 461130 - DNA, 18 bp, Homo sapiens
cgtgaccggcccgccacc

SEQ ID NO: 461131 - DNA, 22 bp, Homo sapiens
cgtgaccggcccgccaccttgt

SEQ ID NO: 461132 - DNA, 12 bp, Homo sapiens
cgtgagacacaa

SEQ ID NO: 461133 - DNA, 14 bp, Homo sapiens
cgtgagacacaaga

SEQ ID NO: 461134 - DNA, 15 bp, Homo sapiens
cgtgagagtcatctc

SEQ ID NO: 461135 - DNA, 15 bp, Homo sapiens
cgtgccttcagctct

SEQ ID NO: 461136 - DNA, 16 bp, Homo sapiens
cgtgccttccccgtgc

SEQ ID NO: 461137 - DNA, 13 bp, Homo sapiens
cgtgcgcagccgc

SEQ ID NO: 461138 - DNA, 21 bp, Homo sapiens
cgtgcgcagccgcgctctgcc

SEQ ID NO: 461139 - DNA, 12 bp, Homo sapiens
cgtgcggcccgt

SEQ ID NO: 461140 - DNA, 19 bp, Homo sapiens
cgtggcttcccgctcagcc

SEQ ID NO: 461141 - DNA, 20 bp, Homo sapiens
cgtggcttcccgctcagccc

SEQ ID NO: 461142 - DNA, 15 bp, Homo sapiens
cgtgggatccagaga

SEQ ID NO: 461143 - DNA, 21 bp, Homo sapiens
cgtgggatccagagagaagca

SEQ ID NO: 461144 - DNA, 23 bp, Homo sapiens
cgtgtggccctgtgggagtccac

SEQ ID NO: 461145 - DNA, 23 bp, Homo sapiens
cgtgtgttgccattttgtctggc

SEQ ID NO: 461146 - DNA, 14 bp, Homo sapiens
cgtgttcacacaca

SEQ ID NO: 461147 - DNA, 13 bp, Homo sapiens
cgtttttgtgctg

SEQ ID NO: 461148 - DNA, 18 bp, Homo sapiens
cgtttttgtgctgtgggc

SEQ ID NO: 461149 - DNA, 22 bp, Homo sapiens
cgtttttgtgctgtgggcagca

SEQ ID NO: 461150 - DNA, 23 bp, Homo sapiens
ctaaaacattctttaacatacat

SEQ ID NO: 461151 - DNA, 12 bp, Homo sapiens
ctaaaaggagga

SEQ ID NO: 461152 - DNA, 22 bp, Homo sapiens
ctaaaatactcaccaaaatata

SEQ ID NO: 461153 - DNA, 17 bp, Homo sapiens
ctaaaattcaacaaatg

SEQ ID NO: 461154 - DNA, 18 bp, Homo sapiens
ctaaaattcaacaaatga

SEQ ID NO: 461155 - DNA, 15 bp, Homo sapiens
ctaaagaaaaagata

SEQ ID NO: 461156 - DNA, 15 bp, Homo sapiens
ctaaaggggacagat

SEQ ID NO: 461157 - DNA, 23 bp, Homo sapiens
ctaaatccattttctaaactgtt

SEQ ID NO: 461158 - DNA, 18 bp, Homo sapiens
ctaacaatgccttgttgt

SEQ ID NO: 461159 - DNA, 17 bp, Homo sapiens
ctaactggccccaggcg

SEQ ID NO: 461160 - DNA, 20 bp, Homo sapiens
ctaagaataaataaagaaga

SEQ ID NO: 461161 - DNA, 11 bp, Homo sapiens
ctaagctgttt

SEQ ID NO: 461162 - DNA, 14 bp, Homo sapiens
ctaagtaacctcta

SEQ ID NO: 461163 - DNA, 21 bp, Homo sapiens
ctaagtaacctctacaggcat

SEQ ID NO: 461164 - DNA, 22 bp, Homo sapiens
ctaagtaacctctacaggcatt

SEQ ID NO: 461165 - DNA, 19 bp, Homo sapiens
ctaatcagcattctcactc

SEQ ID NO: 461166 - DNA, 21 bp, Homo sapiens
ctaatcagcattctcactcct

SEQ ID NO: 461167 - DNA, 20 bp, Homo sapiens
ctaatggccaagtgtacatt

SEQ ID NO: 461168 - DNA, 22 bp, Homo sapiens
ctaatggccaagtgtacatttg

SEQ ID NO: 461169 - DNA, 18 bp, Homo sapiens
ctaatttatgaagatagt

SEQ ID NO: 461170 - DNA, 18 bp, Homo sapiens
ctacagctaatcagcatt

SEQ ID NO: 461171 - DNA, 19 bp, Homo sapiens
ctacagctaatcagcattc

SEQ ID NO: 461172 - DNA, 21 bp, Homo sapiens
ctacagctaatcagcattctc

SEQ ID NO: 461173 - DNA, 21 bp, Homo sapiens
ctacatgaagttgtaagaaaa

SEQ ID NO: 461174 - DNA, 22 bp, Homo sapiens
ctaccctcttctcagctccact

SEQ ID NO: 461175 - DNA, 13 bp, Homo sapiens
ctaccctttccca

SEQ ID NO: 461176 - DNA, 15 bp, Homo sapiens
ctaccctttcccaaa

SEQ ID NO: 461177 - DNA, 19 bp, Homo sapiens
ctaccctttcccaaaccct

SEQ ID NO: 461178 - DNA, 23 bp, Homo sapiens
ctaccgagtctcttctccactgg

SEQ ID NO: 461179 - DNA, 18 bp, Homo sapiens
ctactggcctctgtgcca

SEQ ID NO: 461180 - DNA, 17 bp, Homo sapiens
ctacttagcatgtccct

SEQ ID NO: 461181 - DNA, 13 bp, Homo sapiens
ctagaagaaaacc

SEQ ID NO: 461182 - DNA, 20 bp, Homo sapiens
ctagaagaaaacccgaggga

SEQ ID NO: 461183 - DNA, 14 bp, Homo sapiens
ctagaatgagaaat

SEQ ID NO: 461184 - DNA, 16 bp, Homo sapiens
ctagaatgagaaatca

SEQ ID NO: 461185 - DNA, 21 bp, Homo sapiens
ctagcaaacagatgtttgttt

SEQ ID NO: 461186 - DNA, 20 bp, Homo sapiens
ctagcacaaggagtgcccgc

SEQ ID NO: 461187 - DNA, 21 bp, Homo sapiens
ctagccctctttctctctgtg

SEQ ID NO: 461188 - DNA, 21 bp, Homo sapiens
ctagctataacaactctattt

SEQ ID NO: 461189 - DNA, 15 bp, Homo sapiens
ctaggcgctcagagg

SEQ ID NO: 461190 - DNA, 16 bp, Homo sapiens
ctaggcgctcagaggc

SEQ ID NO: 461191 - DNA, 17 bp, Homo sapiens
ctaggcgctcagaggcc

SEQ ID NO: 461192 - DNA, 20 bp, Homo sapiens
ctaggcgctcagaggccgct

SEQ ID NO: 461193 - DNA, 13 bp, Homo sapiens
ctaggctccctga

SEQ ID NO: 461194 - DNA, 14 bp, Homo sapiens
ctaggtctccaccc

SEQ ID NO: 461195 - DNA, 17 bp, Homo sapiens
ctaggtctccacccctc

SEQ ID NO: 461196 - DNA, 13 bp, Homo sapiens
ctagtagctgttt

SEQ ID NO: 461197 - DNA, 23 bp, Homo sapiens
ctagtagctgttttgaataacat

SEQ ID NO: 461198 - DNA, 13 bp, Homo sapiens
ctagtctctgatt

SEQ ID NO: 461199 - DNA, 18 bp, Homo sapiens
ctagtctctgatttgcaa

SEQ ID NO: 461200 - DNA, 14 bp, Homo sapiens
ctagtgatttttgg

SEQ ID NO: 461201 - DNA, 20 bp, Homo sapiens
ctagtttgcatacttcctgg

SEQ ID NO: 461202 - DNA, 22 bp, Homo sapiens
ctataccctaggtctccacccc

SEQ ID NO: 461203 - DNA, 20 bp, Homo sapiens
ctataccgagacccaccatc

SEQ ID NO: 461204 - DNA, 16 bp, Homo sapiens
ctatacttcacactga

SEQ ID NO: 461205 - DNA, 20 bp, Homo sapiens
ctatccacagaacctttgtc

SEQ ID NO: 461206 - DNA, 21 bp, Homo sapiens
ctatccacagaacctttgtca

SEQ ID NO: 461207 - DNA, 22 bp, Homo sapiens
ctatccacagaacctttgtcaa

SEQ ID NO: 461208 - DNA, 17 bp, Homo sapiens
ctatcctgcgggtttta

SEQ ID NO: 461209 - DNA, 20 bp, Homo sapiens
ctatggaaagggtgtggctt

SEQ ID NO: 461210 - DNA, 22 bp, Homo sapiens
ctatggaaagggtgtggcttgg

SEQ ID NO: 461211 - DNA, 14 bp, Homo sapiens
ctatgtagaactgt

SEQ ID NO: 461212 - DNA, 19 bp, Homo sapiens
ctatgtagaactgttcatt

SEQ ID NO: 461213 - DNA, 12 bp, Homo sapiens
ctattaactctg

SEQ ID NO: 461214 - DNA, 13 bp, Homo sapiens
ctattatctgggt

SEQ ID NO: 461215 - DNA, 23 bp, Homo sapiens
ctattcccatcgctggaaaacag

SEQ ID NO: 461216 - DNA, 21 bp, Homo sapiens
ctattggcatggatttccttt

SEQ ID NO: 461217 - DNA, 18 bp, Homo sapiens
ctattgtttataggaaat

SEQ ID NO: 461218 - DNA, 16 bp, Homo sapiens
ctatttatctgtctga

SEQ ID NO: 461219 - DNA, 16 bp, Homo sapiens
ctatttgaaaaaagaa

SEQ ID NO: 461220 - DNA, 18 bp, Homo sapiens
ctcaacctctcagatccc

SEQ ID NO: 461221 - DNA, 17 bp, Homo sapiens
ctcaagaacaaacagaa

SEQ ID NO: 461222 - DNA, 17 bp, Homo sapiens
ctcaagagggcactggt

SEQ ID NO: 461223 - DNA, 16 bp, Homo sapiens
ctcaagccaggagacc

SEQ ID NO: 461224 - DNA, 19 bp, Homo sapiens
ctcaagccaggagaccctg

SEQ ID NO: 461225 - DNA, 23 bp, Homo sapiens
ctcaagccaggagaccctgtctt

SEQ ID NO: 461226 - DNA, 20 bp, Homo sapiens
ctcaagcgctatccacagaa

SEQ ID NO: 461227 - DNA, 15 bp, Homo sapiens
ctcaataaaggtcat

SEQ ID NO: 461228 - DNA, 13 bp, Homo sapiens
ctcacaaaaggct

SEQ ID NO: 461229 - DNA, 15 bp, Homo sapiens
ctcacaaaaggctgg

SEQ ID NO: 461230 - DNA, 17 bp, Homo sapiens
ctcacagaacccttgga

SEQ ID NO: 461231 - DNA, 14 bp, Homo sapiens
ctcaccaaaatata

SEQ ID NO: 461232 - DNA, 19 bp, Homo sapiens
ctcaccttccctagttctt

SEQ ID NO: 461233 - DNA, 15 bp, Homo sapiens
ctcacgctgacagcc

SEQ ID NO: 461234 - DNA, 22 bp, Homo sapiens
ctcacgctgacagcctcctagg

SEQ ID NO: 461235 - DNA, 21 bp, Homo sapiens
ctcacgtctgtgagtctgtcc

SEQ ID NO: 461236 - DNA, 13 bp, Homo sapiens
ctcactccactcc

SEQ ID NO: 461237 - DNA, 18 bp, Homo sapiens
ctcactccactcccctca

SEQ ID NO: 461238 - DNA, 16 bp, Homo sapiens
ctcactcctacctggt

SEQ ID NO: 461239 - DNA, 18 bp, Homo sapiens
ctcactctgtcagccagc

SEQ ID NO: 461240 - DNA, 19 bp, Homo sapiens
ctcactctgtcagccagcc

SEQ ID NO: 461241 - DNA, 17 bp, Homo sapiens
ctcactgccctccctcg

SEQ ID NO: 461242 - DNA, 17 bp, Homo sapiens
ctcactggtgcatttaa

SEQ ID NO: 461243 - DNA, 22 bp, Homo sapiens
ctcactggtgcatttaaaatgg

SEQ ID NO: 461244 - DNA, 22 bp, Homo sapiens
ctcagatccctcggtcagcacc

SEQ ID NO: 461245 - DNA, 16 bp, Homo sapiens
ctcagcaaggggctct

SEQ ID NO: 461246 - DNA, 19 bp, Homo sapiens
ctcagcccacatagtgatg

SEQ ID NO: 461247 - DNA, 13 bp, Homo sapiens
ctcagccctcaga

SEQ ID NO: 461248 - DNA, 17 bp, Homo sapiens
ctcagccctcagaacaa

SEQ ID NO: 461249 - DNA, 13 bp, Homo sapiens
ctcagccttaaga

SEQ ID NO: 461250 - DNA, 14 bp, Homo sapiens
ctcagctccactct

SEQ ID NO: 461251 - DNA, 19 bp, Homo sapiens
ctcagctccactctgaagt

SEQ ID NO: 461252 - DNA, 13 bp, Homo sapiens
ctcaggctttcta

SEQ ID NO: 461253 - DNA, 14 bp, Homo sapiens
ctcaggttgtctga

SEQ ID NO: 461254 - DNA, 11 bp, Homo sapiens
ctcagtacagg

SEQ ID NO: 461255 - DNA, 14 bp, Homo sapiens
ctcagtacagggca

SEQ ID NO: 461256 - DNA, 22 bp, Homo sapiens
ctcagtacagggcaggagctgc

SEQ ID NO: 461257 - DNA, 19 bp, Homo sapiens
ctcatccactaggtgccca

SEQ ID NO: 461258 - DNA, 23 bp, Homo sapiens
ctcatccactaggtgcccagtct

SEQ ID NO: 461259 - DNA, 21 bp, Homo sapiens
ctcatcttgtaaataatgctt

SEQ ID NO: 461260 - DNA, 13 bp, Homo sapiens
ctcattagctctc

SEQ ID NO: 461261 - DNA, 15 bp, Homo sapiens
ctccacacctccacc

SEQ ID NO: 461262 - DNA, 12 bp, Homo sapiens
ctccacccctca

SEQ ID NO: 461263 - DNA, 13 bp, Homo sapiens
ctccacccctcaa

SEQ ID NO: 461264 - DNA, 15 bp, Homo sapiens
ctccacccctcaagc

SEQ ID NO: 461265 - DNA, 20 bp, Homo sapiens
ctccacccgtcctggggtgg

SEQ ID NO: 461266 - DNA, 15 bp, Homo sapiens
ctccacgcctcctgg

SEQ ID NO: 461267 - DNA, 20 bp, Homo sapiens
ctccacgcctcctggccaga

SEQ ID NO: 461268 - DNA, 21 bp, Homo sapiens
ctccacgcctcctggccagac

SEQ ID NO: 461269 - DNA, 14 bp, Homo sapiens
ctccactcctccca

SEQ ID NO: 461270 - DNA, 16 bp, Homo sapiens
ctccactcctcccaac

SEQ ID NO: 461271 - DNA, 13 bp, Homo sapiens
ctccactctgagg

SEQ ID NO: 461272 - DNA, 15 bp, Homo sapiens
ctccactctgaggtc

SEQ ID NO: 461273 - DNA, 23 bp, Homo sapiens
ctccactctgaggtctcaccttc

SEQ ID NO: 461274 - DNA, 15 bp, Homo sapiens
ctccactgccttcga

SEQ ID NO: 461275 - DNA, 13 bp, Homo sapiens
ctccactggatgg

SEQ ID NO: 461276 - DNA, 14 bp, Homo sapiens
ctccactggatgga

SEQ ID NO: 461277 - DNA, 13 bp, Homo sapiens
ctccagacattgt

SEQ ID NO: 461278 - DNA, 15 bp, Homo sapiens
ctccagacccctacc

SEQ ID NO: 461279 - DNA, 21 bp, Homo sapiens
ctccagacccctaccctttcc

SEQ ID NO: 461280 - DNA, 23 bp, Homo sapiens
ctccagactcgagagggctgagc

SEQ ID NO: 461281 - DNA, 21 bp, Homo sapiens
ctccagagtaggtgggtcttg

SEQ ID NO: 461282 - DNA, 14 bp, Homo sapiens
ctccagattatttt

SEQ ID NO: 461283 - DNA, 17 bp, Homo sapiens
ctccagattattttcta

SEQ ID NO: 461284 - DNA, 21 bp, Homo sapiens
ctccagattattttctatatt

SEQ ID NO: 461285 - DNA, 23 bp, Homo sapiens
ctccagattattttctatatttg

SEQ ID NO: 461286 - DNA, 18 bp, Homo sapiens
ctccagcagtgctgggcc

SEQ ID NO: 461287 - DNA, 19 bp, Homo sapiens
ctccagcagtgctgggccc

SEQ ID NO: 461288 - DNA, 18 bp, Homo sapiens
ctccaggcccccaactcc

SEQ ID NO: 461289 - DNA, 14 bp, Homo sapiens
ctccaggctggggc

SEQ ID NO: 461290 - DNA, 15 bp, Homo sapiens
ctccaggctggggcc

SEQ ID NO: 461291 - DNA, 18 bp, Homo sapiens
ctccaggctggggcctgg

SEQ ID NO: 461292 - DNA, 21 bp, Homo sapiens
ctccaggctggggcctggcct

SEQ ID NO: 461293 - DNA, 16 bp, Homo sapiens
ctccagggcgagcact

SEQ ID NO: 461294 - DNA, 18 bp, Homo sapiens
ctccagtttgcccaccac

SEQ ID NO: 461295 - DNA, 15 bp, Homo sapiens
ctcccaactctggcc

SEQ ID NO: 461296 - DNA, 14 bp, Homo sapiens
ctcccaggcgcccc

SEQ ID NO: 461297 - DNA, 12 bp, Homo sapiens
ctcccagggccc

SEQ ID NO: 461298 - DNA, 23 bp, Homo sapiens
ctcccagggcccgagcgcgtgcc

SEQ ID NO: 461299 - DNA, 14 bp, Homo sapiens
ctccccaaggaaga

SEQ ID NO: 461300 - DNA, 17 bp, Homo sapiens
ctccccacccaccaccg

SEQ ID NO: 461301 - DNA, 18 bp, Homo sapiens
ctccccatatataaatta

SEQ ID NO: 461302 - DNA, 21 bp, Homo sapiens
ctccccatggtgcagtgaaga

SEQ ID NO: 461303 - DNA, 22 bp, Homo sapiens
ctcccccacggccgtccctgac

SEQ ID NO: 461304 - DNA, 16 bp, Homo sapiens
ctcccccaggctgcgc

SEQ ID NO: 461305 - DNA, 14 bp, Homo sapiens
ctccccctcagatg

SEQ ID NO: 461306 - DNA, 15 bp, Homo sapiens
ctccccctgccagca

SEQ ID NO: 461307 - DNA, 14 bp, Homo sapiens
ctccccgcagccct

SEQ ID NO: 461308 - DNA, 19 bp, Homo sapiens
ctccccgcccgccctcctc

SEQ ID NO: 461309 - DNA, 22 bp, Homo sapiens
ctccccgcccgccctcctctgc

SEQ ID NO: 461310 - DNA, 19 bp, Homo sapiens
ctccccgggggtccccgga

SEQ ID NO: 461311 - DNA, 11 bp, Homo sapiens
ctcccctccag

SEQ ID NO: 461312 - DNA, 15 bp, Homo sapiens
ctcccctccagaccc

SEQ ID NO: 461313 - DNA, 16 bp, Homo sapiens
ctcccctccagacccc

SEQ ID NO: 461314 - DNA, 17 bp, Homo sapiens
ctcccctccagacccct

SEQ ID NO: 461315 - DNA, 18 bp, Homo sapiens
ctcccctctcctgagcct

SEQ ID NO: 461316 - DNA, 19 bp, Homo sapiens
ctcccctcttcttgcggca

SEQ ID NO: 461317 - DNA, 20 bp, Homo sapiens
ctcccgccgcctcgggccgc

SEQ ID NO: 461318 - DNA, 15 bp, Homo sapiens
ctcccggtgcccaag

SEQ ID NO: 461319 - DNA, 21 bp, Homo sapiens
ctcccggtgcccaagaataga

SEQ ID NO: 461320 - DNA, 19 bp, Homo sapiens
ctcccggtgtatgcagtgg

SEQ ID NO: 461321 - DNA, 13 bp, Homo sapiens
ctccctaccctct

SEQ ID NO: 461322 - DNA, 17 bp, Homo sapiens
ctccctataccgagacc

SEQ ID NO: 461323 - DNA, 15 bp, Homo sapiens
ctccctccacacctc

SEQ ID NO: 461324 - DNA, 18 bp, Homo sapiens
ctccctccacacctccac

SEQ ID NO: 461325 - DNA, 19 bp, Homo sapiens
ctccctccacacctccacc

SEQ ID NO: 461326 - DNA, 15 bp, Homo sapiens
ctccctccactcctc

SEQ ID NO: 461327 - DNA, 16 bp, Homo sapiens
ctccctccctccacac

SEQ ID NO: 461328 - DNA, 15 bp, Homo sapiens
ctctgaaaatatttt

SEQ ID NO: 461329 - DNA, 13 bp, Homo sapiens
ctctgaagtccct

SEQ ID NO: 461330 - DNA, 17 bp, Homo sapiens
ctctgaagtcccttcct

SEQ ID NO: 461331 - DNA, 24 bp, Homo sapiens
ctctgaagtcccttcctgtcctgc

SEQ ID NO: 461332 - DNA, 12 bp, Homo sapiens
ctctgagcagtg

SEQ ID NO: 461333 - DNA, 15 bp, Homo sapiens
ctctgagcagtgggg

SEQ ID NO: 461334 - DNA, 16 bp, Homo sapiens
ctctgagcagtgggga

SEQ ID NO: 461335 - DNA, 18 bp, Homo sapiens
ctctgaggtctcaccttc

SEQ ID NO: 461336 - DNA, 17 bp, Homo sapiens
ctctgcagcctgagctc

SEQ ID NO: 461337 - DNA, 13 bp, Homo sapiens
ctctgcaggatgg

SEQ ID NO: 461338 - DNA, 19 bp, Homo sapiens
ctctgcataagattatata

SEQ ID NO: 461339 - DNA, 16 bp, Homo sapiens
ctctgccccctccccc

SEQ ID NO: 461340 - DNA, 17 bp, Homo sapiens
ctctgccccctcccccg

SEQ ID NO: 461341 - DNA, 18 bp, Homo sapiens
ctctgcccctccgtcccc

SEQ ID NO: 461342 - DNA, 22 bp, Homo sapiens
ctctgcccctccgtccccaggg

SEQ ID NO: 461343 - DNA, 13 bp, Homo sapiens
ctctgcctttgag

SEQ ID NO: 461344 - DNA, 19 bp, Homo sapiens
ctctgcctttgagcttctc

SEQ ID NO: 461345 - DNA, 21 bp, Homo sapiens
ctctgcctttgagcttctcct

SEQ ID NO: 461346 - DNA, 17 bp, Homo sapiens
ctctgctatgtctgtga

SEQ ID NO: 461347 - DNA, 22 bp, Homo sapiens
ctctgctccaacagacaccctc

SEQ ID NO: 461348 - DNA, 20 bp, Homo sapiens
ctctggccttggttcctcca

SEQ ID NO: 461349 - DNA, 21 bp, Homo sapiens
ctctggccttggttcctccag

SEQ ID NO: 461350 - DNA, 16 bp, Homo sapiens
ctctggggccctgggc

SEQ ID NO: 461351 - DNA, 17 bp, Homo sapiens
ctctggggccctgggcc

SEQ ID NO: 461352 - DNA, 21 bp, Homo sapiens
ctctggggccctgggcctcag

SEQ ID NO: 461353 - DNA, 22 bp, Homo sapiens
ctctggggccctgggcctcagt

SEQ ID NO: 461354 - DNA, 21 bp, Homo sapiens
ctctggggggttgcctcgagt

SEQ ID NO: 461355 - DNA, 21 bp, Homo sapiens
ctctgggttttgggatttggg

SEQ ID NO: 461356 - DNA, 20 bp, Homo sapiens
ctctgtcagccagccgccct

SEQ ID NO: 461357 - DNA, 19 bp, Homo sapiens
ctctgtgctaagttgtctt

SEQ ID NO: 461358 - DNA, 20 bp, Homo sapiens
ctctgtgctaagttgtctta

SEQ ID NO: 461359 - DNA, 19 bp, Homo sapiens
ctctgtgtggcaaacattt

SEQ ID NO: 461360 - DNA, 11 bp, Homo sapiens
ctctgttccaa

SEQ ID NO: 461361 - DNA, 18 bp, Homo sapiens
ctctgttccaagtgtgtg

SEQ ID NO: 461362 - DNA, 22 bp, Homo sapiens
ctgataaacattaaacactgta

SEQ ID NO: 461363 - DNA, 15 bp, Homo sapiens
ctgatatcacgggcc

SEQ ID NO: 461364 - DNA, 21 bp, Homo sapiens
ctgatatcacgggcccgctca

SEQ ID NO: 461365 - DNA, 13 bp, Homo sapiens
ctgatgatataaa

SEQ ID NO: 461366 - DNA, 16 bp, Homo sapiens
ctgatgatataaacaa

SEQ ID NO: 461367 - DNA, 18 bp, Homo sapiens
ctgatgggtcctgctgct

SEQ ID NO: 461368 - DNA, 17 bp, Homo sapiens
ctgattaaatttaatat

SEQ ID NO: 461369 - DNA, 14 bp, Homo sapiens
ctgattattgaatg

SEQ ID NO: 461370 - DNA, 20 bp, Homo sapiens
ctgattctatgcctgtattt

SEQ ID NO: 461371 - DNA, 23 bp, Homo sapiens
ctgattctatgcctgtatttcca

SEQ ID NO: 461372 - DNA, 17 bp, Homo sapiens
ctgatttgcaaatgcac

SEQ ID NO: 461373 - DNA, 12 bp, Homo sapiens
ctgcaataacag

SEQ ID NO: 461374 - DNA, 15 bp, Homo sapiens
ctgcaataacagttt

SEQ ID NO: 461375 - DNA, 21 bp, Homo sapiens
ctgcaataacagttttaagat

SEQ ID NO: 461376 - DNA, 20 bp, Homo sapiens
ctgcaatacattaaaataac

SEQ ID NO: 461377 - DNA, 22 bp, Homo sapiens
ctgcacagtgcatctcagccca

SEQ ID NO: 461378 - DNA, 21 bp, Homo sapiens
ctgcaccaacctcactgccct

SEQ ID NO: 461379 - DNA, 22 bp, Homo sapiens
ctgcaccaacctcactgccctc

SEQ ID NO: 461380 - DNA, 17 bp, Homo sapiens
ctgcaccaggagacaga

SEQ ID NO: 461381 - DNA, 14 bp, Homo sapiens
ctgcaccctctgct

SEQ ID NO: 461382 - DNA, 11 bp, Homo sapiens
ctgcaccttgg

SEQ ID NO: 461383 - DNA, 15 bp, Homo sapiens
ctgcagccccccaga

SEQ ID NO: 461384 - DNA, 14 bp, Homo sapiens
ctgcagcctgagct

SEQ ID NO: 461385 - DNA, 17 bp, Homo sapiens
ctgcagcctgagctcca

SEQ ID NO: 461386 - DNA, 21 bp, Homo sapiens
ctgcagcctgagctccaccct

SEQ ID NO: 461387 - DNA, 22 bp, Homo sapiens
ctgcagcctgagctccaccctc

SEQ ID NO: 461388 - DNA, 22 bp, Homo sapiens
ctgcagctatgcgcaatgtggc

SEQ ID NO: 461389 - DNA, 22 bp, Homo sapiens
ctgcaggatgggtgaaaccaca

SEQ ID NO: 461390 - DNA, 23 bp, Homo sapiens
ctgcataagattatatacaaagc

SEQ ID NO: 461391 - DNA, 13 bp, Homo sapiens
ctgcatagacaaa

SEQ ID NO: 461392 - DNA, 17 bp, Homo sapiens
ctgcatagacaaaggcc

SEQ ID NO: 461393 - DNA, 21 bp, Homo sapiens
ctgcatcccttggcccctctc

SEQ ID NO: 461394 - DNA, 12 bp, Homo sapiens
cttctttaaaca

SEQ ID NO: 461395 - DNA, 19 bp, Homo sapiens
cttgaatgtccccattcta

SEQ ID NO: 461396 - DNA, 20 bp, Homo sapiens
cttgaatgtccccattctat

SEQ ID NO: 461397 - DNA, 13 bp, Homo sapiens
cttgagatgtatt

SEQ ID NO: 461398 - DNA, 14 bp, Homo sapiens
cttgagatgtatta

SEQ ID NO: 461399 - DNA, 18 bp, Homo sapiens
cttgagcaaggcaagaag

SEQ ID NO: 461400 - DNA, 15 bp, Homo sapiens
cttgagcccactcct

SEQ ID NO: 461401 - DNA, 23 bp, Homo sapiens
cttgagggtaataatgatgatga

SEQ ID NO: 461402 - DNA, 19 bp, Homo sapiens
cttgagtgggccccctctc

SEQ ID NO: 461403 - DNA, 19 bp, Homo sapiens
cttgatcatgaatcactgc

SEQ ID NO: 461404 - DNA, 16 bp, Homo sapiens
cttgattctaaagggg

SEQ ID NO: 461405 - DNA, 14 bp, Homo sapiens
cttgcacttctgtt

SEQ ID NO: 461406 - DNA, 15 bp, Homo sapiens
cttgcacttctgtta

SEQ ID NO: 461407 - DNA, 15 bp, Homo sapiens
cttgcggcaccgccc

SEQ ID NO: 461408 - DNA, 18 bp, Homo sapiens
cttgcggcaccgcccacc

SEQ ID NO: 461409 - DNA, 16 bp, Homo sapiens
cttgctagtgatacac

SEQ ID NO: 461410 - DNA, 19 bp, Homo sapiens
cttgctagtgatacactgt

SEQ ID NO: 461411 - DNA, 23 bp, Homo sapiens
cttgctttcacaaatatagttga

SEQ ID NO: 461412 - DNA, 11 bp, Homo sapiens
cttggagagga

SEQ ID NO: 461413 - DNA, 15 bp, Homo sapiens
cttggagcagagacg

SEQ ID NO: 461414 - DNA, 13 bp, Homo sapiens
cttggagggatgg

SEQ ID NO: 461415 - DNA, 23 bp, Homo sapiens
cttggagggatggagaggcggcc

SEQ ID NO: 461416 - DNA, 22 bp, Homo sapiens
cttggattggtaccagagccta

SEQ ID NO: 461417 - DNA, 18 bp, Homo sapiens
cttggctctgttgctgtc

SEQ ID NO: 461418 - DNA, 17 bp, Homo sapiens
cttgggacggaagtggc

SEQ ID NO: 461419 - DNA, 21 bp, Homo sapiens
cttgggcacgggagagcgcca

SEQ ID NO: 461420 - DNA, 17 bp, Homo sapiens
cttggtgttgttatggc

SEQ ID NO: 461421 - DNA, 20 bp, Homo sapiens
cttgtacttacactgaaatc

SEQ ID NO: 461422 - DNA, 17 bp, Homo sapiens
cttgtagggatgccttt

SEQ ID NO: 461423 - DNA, 13 bp, Homo sapiens
cttgtagggtgag

SEQ ID NO: 461424 - DNA, 19 bp, Homo sapiens
cttgttttttttttccact

SEQ ID NO: 461425 - DNA, 20 bp, Homo sapiens
cttgttttttttttccactt

SEQ ID NO: 461426 - DNA, 14 bp, Homo sapiens
ctttatgtaagaag

SEQ ID NO: 461427 - DNA, 14 bp, Homo sapiens
ctttcacaaccttc

SEQ ID NO: 461428 - DNA, 18 bp, Homo sapiens
ctttcatgtttaagaaat

SEQ ID NO: 461429 - DNA, 19 bp, Homo sapiens
ctttcatgtttaagaaatg

SEQ ID NO: 461430 - DNA, 18 bp, Homo sapiens
ctttccacccagaccctc

SEQ ID NO: 461431 - DNA, 19 bp, Homo sapiens
ctttccacccagaccctcc

SEQ ID NO: 461432 - DNA, 24 bp, Homo sapiens
ctttccacccagaccctccttccc

SEQ ID NO: 461433 - DNA, 21 bp, Homo sapiens
ctttcccacccactagccctc

SEQ ID NO: 461434 - DNA, 15 bp, Homo sapiens
ctttcccatcttaaa

SEQ ID NO: 461435 - DNA, 14 bp, Homo sapiens
ctttccctgcatcc

SEQ ID NO: 461436 - DNA, 20 bp, Homo sapiens
ctttccgctgtcgccccagg

SEQ ID NO: 461437 - DNA, 12 bp, Homo sapiens
ctttcctctctc

SEQ ID NO: 461438 - DNA, 14 bp, Homo sapiens
ctttcctctctctc

SEQ ID NO: 461439 - DNA, 12 bp, Homo sapiens
ctttctctctgt

SEQ ID NO: 461440 - DNA, 14 bp, Homo sapiens
ctttctctctgtgt

SEQ ID NO: 461441 - DNA, 16 bp, Homo sapiens
ctttctctctgtgtgg

SEQ ID NO: 461442 - DNA, 22 bp, Homo sapiens
ctttctctctttccatctccct

SEQ ID NO: 461443 - DNA, 23 bp, Homo sapiens
ctttcttttgaatcaatctggct

SEQ ID NO: 461444 - DNA, 14 bp, Homo sapiens
ctttgagcttctcc

SEQ ID NO: 461445 - DNA, 15 bp, Homo sapiens
ctttgagcttctcct

SEQ ID NO: 461446 - DNA, 20 bp, Homo sapiens
ctttgagcttctcctctgct

SEQ ID NO: 461447 - DNA, 23 bp, Homo sapiens
ctttgccaagggaggggagaaag

SEQ ID NO: 461448 - DNA, 13 bp, Homo sapiens
ctttggctttttc

SEQ ID NO: 461449 - DNA, 17 bp, Homo sapiens
ctttggggcttatcaga

SEQ ID NO: 461450 - DNA, 16 bp, Homo sapiens
ctttgggggattcaaa

SEQ ID NO: 461451 - DNA, 12 bp, Homo sapiens
ctttgtatgcac

SEQ ID NO: 461452 - DNA, 13 bp, Homo sapiens
ctttgtcacttct

SEQ ID NO: 461453 - DNA, 17 bp, Homo sapiens
ctttgtcacttctgctg

SEQ ID NO: 461454 - DNA, 14 bp, Homo sapiens
ctttgtgacaggaa

SEQ ID NO: 461455 - DNA, 23 bp, Homo sapiens
ctttgtgacaggaaagccctccc

SEQ ID NO: 461456 - DNA, 13 bp, Homo sapiens
ctttgtgcaatat

SEQ ID NO: 461457 - DNA, 12 bp, Homo sapiens
ctttgtggactt

SEQ ID NO: 461458 - DNA, 20 bp, Homo sapiens
ctttgttgctcagcaagggg

SEQ ID NO: 461459 - DNA, 23 bp, Homo sapiens
ctttgtttacatgagttcaaata

SEQ ID NO: 461460 - DNA, 14 bp, Homo sapiens
cttttaactgccgc

SEQ ID NO: 461461 - DNA, 13 bp, Homo sapiens
cttttatatctgt

SEQ ID NO: 461462 - DNA, 14 bp, Homo sapiens
cttttatatctgta

SEQ ID NO: 461463 - DNA, 15 bp, Homo sapiens
cttttatctcacaaa

SEQ ID NO: 461464 - DNA, 13 bp, Homo sapiens
cttttcccatcac

SEQ ID NO: 461465 - DNA, 17 bp, Homo sapiens
cttttgaaaaaggatca

SEQ ID NO: 461466 - DNA, 14 bp, Homo sapiens
cttttgtatcctcc

SEQ ID NO: 461467 - DNA, 15 bp, Homo sapiens
cttttgtgtattctg

SEQ ID NO: 461468 - DNA, 22 bp, Homo sapiens
ctttttggcattatctctttct

SEQ ID NO: 461469 - DNA, 17 bp, Homo sapiens
cttttttattgaataac

SEQ ID NO: 461470 - DNA, 22 bp, Homo sapiens
cttttttcaatgtactgtattg

SEQ ID NO: 461471 - DNA, 23 bp, Homo sapiens
cttttttttttcgtcttccctgc

SEQ ID NO: 461472 - DNA, 21 bp, Homo sapiens
gaaaaccaagccgtggcttcc

SEQ ID NO: 461473 - DNA, 22 bp, Homo sapiens
gaaaactatcctgcgggtttta

SEQ ID NO: 461474 - DNA, 20 bp, Homo sapiens
gaaaagaagaaagtctatgc

SEQ ID NO: 461475 - DNA, 19 bp, Homo sapiens
gaaaatatttttttctagc

SEQ ID NO: 461476 - DNA, 14 bp, Homo sapiens
gaaaatgctttctc

SEQ ID NO: 461477 - DNA, 12 bp, Homo sapiens
gaaacaaggaag

SEQ ID NO: 461478 - DNA, 21 bp, Homo sapiens
gaaacacagaactcagcctta

SEQ ID NO: 461479 - DNA, 17 bp, Homo sapiens
gaaacgagatttgccaa

SEQ ID NO: 461480 - DNA, 16 bp, Homo sapiens
gaaagctatatatgaa

SEQ ID NO: 461481 - DNA, 15 bp, Homo sapiens
gaaagggcagcccct

SEQ ID NO: 461482 - DNA, 20 bp, Homo sapiens
gaaagttctattatctgggt

SEQ ID NO: 461483 - DNA, 13 bp, Homo sapiens
gaaataaatctaa

SEQ ID NO: 461484 - DNA, 14 bp, Homo sapiens
gaaataaatctaaa

SEQ ID NO: 461485 - DNA, 15 bp, Homo sapiens
gaaataaatctaaat

SEQ ID NO: 461486 - DNA, 15 bp, Homo sapiens
gaaatacattatgct

SEQ ID NO: 461487 - DNA, 20 bp, Homo sapiens
gaaatagttccattctatga

SEQ ID NO: 461488 - DNA, 15 bp, Homo sapiens
gaaatgctaatgtaa

SEQ ID NO: 461489 - DNA, 16 bp, Homo sapiens
gaaatgtggatgctct

SEQ ID NO: 461490 - DNA, 17 bp, Homo sapiens
gaaatgtggatgctctt

SEQ ID NO: 461491 - DNA, 22 bp, Homo sapiens
gaaattctataagagacaaagt

SEQ ID NO: 461492 - DNA, 23 bp, Homo sapiens
gacagggtggggcttagaatggg

SEQ ID NO: 461493 - DNA, 23 bp, Homo sapiens
gacagtgggggtgcctggtgcgc

SEQ ID NO: 461494 - DNA, 14 bp, Homo sapiens
gacatacacaaatg

SEQ ID NO: 461495 - DNA, 14 bp, Homo sapiens
gacatgagattcca

SEQ ID NO: 461496 - DNA, 17 bp, Homo sapiens
gaccagcatagttctgc

SEQ ID NO: 461497 - DNA, 13 bp, Homo sapiens
gaccccacacgcc

SEQ ID NO: 461498 - DNA, 15 bp, Homo sapiens
gacccccgaggcccc

SEQ ID NO: 461499 - DNA, 21 bp, Homo sapiens
gacccccgaggcccccctctg

SEQ ID NO: 461500 - DNA, 18 bp, Homo sapiens
gacccccggcctccaggc

SEQ ID NO: 461501 - DNA, 12 bp, Homo sapiens
gacccctaccct

SEQ ID NO: 461502 - DNA, 15 bp, Homo sapiens
gacccctaccctttc

SEQ ID NO: 461503 - DNA, 22 bp, Homo sapiens
gacccctggcttttcactgctg

SEQ ID NO: 461504 - DNA, 18 bp, Homo sapiens
gacccggaggggcctggc

SEQ ID NO: 461505 - DNA, 12 bp, Homo sapiens
gaccctccttcc

SEQ ID NO: 461506 - DNA, 14 bp, Homo sapiens
gaccctccttcccc

SEQ ID NO: 461507 - DNA, 17 bp, Homo sapiens
gaccggcccgccacctt

SEQ ID NO: 461508 - DNA, 18 bp, Homo sapiens
gacctgacgatcttcccc

SEQ ID NO: 461509 - DNA, 23 bp, Homo sapiens
gacctgacgatcttcccccttcc

SEQ ID NO: 461510 - DNA, 15 bp, Homo sapiens
gacctttatttatta

SEQ ID NO: 461511 - DNA, 19 bp, Homo sapiens
gacctttatttattaaact

SEQ ID NO: 461512 - DNA, 22 bp, Homo sapiens
gacctttatttattaaacttca

SEQ ID NO: 461513 - DNA, 18 bp, Homo sapiens
gacgctgccgctgccgct

SEQ ID NO: 461514 - DNA, 21 bp, Homo sapiens
gacgctgccgctgccgctgca

SEQ ID NO: 461515 - DNA, 17 bp, Homo sapiens
gacgctggtaactgtta

SEQ ID NO: 461516 - DNA, 19 bp, Homo sapiens
gacgggacagcggcccggc

SEQ ID NO: 461517 - DNA, 19 bp, Homo sapiens
gattctaaaacattcttta

SEQ ID NO: 461518 - DNA, 20 bp, Homo sapiens
gattctaaaacattctttaa

SEQ ID NO: 461519 - DNA, 14 bp, Homo sapiens
gattctatatttca

SEQ ID NO: 461520 - DNA, 21 bp, Homo sapiens
gattctatgcctgtatttcca

SEQ ID NO: 461521 - DNA, 17 bp, Homo sapiens
gattcttaccctttctt

SEQ ID NO: 461522 - DNA, 22 bp, Homo sapiens
gattcttttcccatcaccagaa

SEQ ID NO: 461523 - DNA, 16 bp, Homo sapiens
gattcttttttcaatg

SEQ ID NO: 461524 - DNA, 17 bp, Homo sapiens
gattcttttttcaatgt

SEQ ID NO: 461525 - DNA, 19 bp, Homo sapiens
gattggcagcttcaaaaca

SEQ ID NO: 461526 - DNA, 16 bp, Homo sapiens
gattggtaccagagcc

SEQ ID NO: 461527 - DNA, 15 bp, Homo sapiens
gatttccctaaaaat

SEQ ID NO: 461528 - DNA, 12 bp, Homo sapiens
gatttcctaagc

SEQ ID NO: 461529 - DNA, 20 bp, Homo sapiens
gatttgatatacagacctcc

SEQ ID NO: 461530 - DNA, 16 bp, Homo sapiens
gattttctttctatgt

SEQ ID NO: 461531 - DNA, 17 bp, Homo sapiens
gattttctttctatgta

SEQ ID NO: 461532 - DNA, 12 bp, Homo sapiens
gcaaaaaagaac

SEQ ID NO: 461533 - DNA, 17 bp, Homo sapiens
gcaaaaggttaagccat

SEQ ID NO: 461534 - DNA, 18 bp, Homo sapiens
gcaaaaggttaagccata

SEQ ID NO: 461535 - DNA, 19 bp, Homo sapiens
gcaaaaggttaagccatat

SEQ ID NO: 461536 - DNA, 11 bp, Homo sapiens
gcaaacattta

SEQ ID NO: 461537 - DNA, 15 bp, Homo sapiens
gcaaagatggcttcc

SEQ ID NO: 461538 - DNA, 16 bp, Homo sapiens
gcaaatagtttcaaat

SEQ ID NO: 461539 - DNA, 16 bp, Homo sapiens
gcaaatgaaagtttta

SEQ ID NO: 461540 - DNA, 13 bp, Homo sapiens
gcaaattattcta

SEQ ID NO: 461541 - DNA, 22 bp, Homo sapiens
gcaaattattctagtcaactgc

SEQ ID NO: 461542 - DNA, 12 bp, Homo sapiens
gcaacctttgtg

SEQ ID NO: 461543 - DNA, 21 bp, Homo sapiens
gcaactgttagctgggaagaa

SEQ ID NO: 461544 - DNA, 19 bp, Homo sapiens
gcaagaagattctaaaaca

SEQ ID NO: 461545 - DNA, 16 bp, Homo sapiens
gcaagagctcaggaga

SEQ ID NO: 461546 - DNA, 14 bp, Homo sapiens
gcaaggggctctgc

SEQ ID NO: 461547 - DNA, 14 bp, Homo sapiens
gcaatcttatgttg

SEQ ID NO: 461548 - DNA, 12 bp, Homo sapiens
gcacacagcagc

SEQ ID NO: 461549 - DNA, 14 bp, Homo sapiens
gcacacagcagccc

SEQ ID NO: 461550 - DNA, 15 bp, Homo sapiens
gcacacagcagcccc

SEQ ID NO: 461551 - DNA, 17 bp, Homo sapiens
gcacacagcagcccccc

SEQ ID NO: 461552 - DNA, 18 bp, Homo sapiens
gcacaccagaagtgccat

SEQ ID NO: 461553 - DNA, 13 bp, Homo sapiens
gcacagtgcatct

SEQ ID NO: 461554 - DNA, 22 bp, Homo sapiens
gcacagtttgcaatcttatgtt

SEQ ID NO: 461555 - DNA, 21 bp, Homo sapiens
gcacatttgtcactgaataat

SEQ ID NO: 461556 - DNA, 15 bp, Homo sapiens
gcaccaacctcactg

SEQ ID NO: 461557 - DNA, 19 bp, Homo sapiens
gcaccaacctcactgccct

SEQ ID NO: 461558 - DNA, 22 bp, Homo sapiens
gcaccaacctcactgccctccc

SEQ ID NO: 461559 - DNA, 21 bp, Homo sapiens
gcaccacggcgtttttttaca

SEQ ID NO: 461560 - DNA, 12 bp, Homo sapiens
gcaccagcctga

SEQ ID NO: 461561 - DNA, 12 bp, Homo sapiens
gcaccaggagac

SEQ ID NO: 461562 - DNA, 11 bp, Homo sapiens
gcacccccagc

SEQ ID NO: 461563 - DNA, 16 bp, Homo sapiens
gcaccctctcctgggg

SEQ ID NO: 461564 - DNA, 20 bp, Homo sapiens
gcaccctctgctatgtctgt

SEQ ID NO: 461565 - DNA, 15 bp, Homo sapiens
gcaccgcccaacccc

SEQ ID NO: 461566 - DNA, 20 bp, Homo sapiens
gcaccgcccaacccccacct

SEQ ID NO: 461567 - DNA, 14 bp, Homo sapiens
gcaccgcccaccca

SEQ ID NO: 461568 - DNA, 16 bp, Homo sapiens
gcaccgcccacccaca

SEQ ID NO: 461569 - DNA, 19 bp, Homo sapiens
gcaccgcccacccacaccc

SEQ ID NO: 461570 - DNA, 18 bp, Homo sapiens
gcaccgtggtgtgaggcc

SEQ ID NO: 461571 - DNA, 21 bp, Homo sapiens
gcaccgtggtgtgaggccccc

SEQ ID NO: 461572 - DNA, 15 bp, Homo sapiens
gcacctggcacacca

SEQ ID NO: 461573 - DNA, 16 bp, Homo sapiens
gcacctggcacaccag

SEQ ID NO: 461574 - DNA, 18 bp, Homo sapiens
gcaccttgggcacgggag

SEQ ID NO: 461575 - DNA, 13 bp, Homo sapiens
gcacgggagagcg

SEQ ID NO: 461576 - DNA, 22 bp, Homo sapiens
gcacgggagagcgccacccgcc

SEQ ID NO: 461577 - DNA, 14 bp, Homo sapiens
gcactaaggccgtg

SEQ ID NO: 461578 - DNA, 17 bp, Homo sapiens
gcactcccaggcccctg

SEQ ID NO: 461579 - DNA, 24 bp, Homo sapiens
gcactggtggcccgacagcctggc

SEQ ID NO: 461580 - DNA, 19 bp, Homo sapiens
gcactggtttgtttctcaa

SEQ ID NO: 461581 - DNA, 22 bp, Homo sapiens
gcactttccacttccagagggg

SEQ ID NO: 461582 - DNA, 21 bp, Homo sapiens
gcagaatggtgggctccagag

SEQ ID NO: 461583 - DNA, 17 bp, Homo sapiens
gcagacagacagacaga

SEQ ID NO: 461584 - DNA, 19 bp, Homo sapiens
gcagagacggcagccccat

SEQ ID NO: 461585 - DNA, 14 bp, Homo sapiens
gcagagatgtatta

SEQ ID NO: 461586 - DNA, 20 bp, Homo sapiens
gcagagattgggggggcttg

SEQ ID NO: 461587 - DNA, 21 bp, Homo sapiens
gcagagattgggggggcttgg

SEQ ID NO: 461588 - DNA, 11 bp, Homo sapiens
gcagagccccg

SEQ ID NO: 461589 - DNA, 15 bp, Homo sapiens
gcagagccccggagc

SEQ ID NO: 461590 - DNA, 19 bp, Homo sapiens
gcagagccccggagcacca

SEQ ID NO: 461591 - DNA, 13 bp, Homo sapiens
gcagaggcagggc

SEQ ID NO: 461592 - DNA, 14 bp, Homo sapiens
gcagaggcagggcc

SEQ ID NO: 461593 - DNA, 20 bp, Homo sapiens
gcagcaccagcctgagccac

SEQ ID NO: 461594 - DNA, 20 bp, Homo sapiens
gcagcccagaacgggcctcc

SEQ ID NO: 461595 - DNA, 21 bp, Homo sapiens
gcagccccatccttcccgcag

SEQ ID NO: 461596 - DNA, 22 bp, Homo sapiens
gcagcccctgctggaccaaggt

SEQ ID NO: 461597 - DNA, 18 bp, Homo sapiens
gcagccctctccacccag

SEQ ID NO: 461598 - DNA, 19 bp, Homo sapiens
gcagccctctccacccaga

SEQ ID NO: 461599 - DNA, 20 bp, Homo sapiens
gcagccctctccacccagag

SEQ ID NO: 461600 - DNA, 18 bp, Homo sapiens
gcagccgcgctctgcccc

SEQ ID NO: 461601 - DNA, 21 bp, Homo sapiens
gcagccgcgctctgcccctcc

SEQ ID NO: 461602 - DNA, 16 bp, Homo sapiens
gcagcctgagctccac

SEQ ID NO: 461603 - DNA, 19 bp, Homo sapiens
gcagcctgagctccaccct

SEQ ID NO: 461604 - DNA, 21 bp, Homo sapiens
gcagcctgagctccaccctcc

SEQ ID NO: 461605 - DNA, 18 bp, Homo sapiens
gcaggaaagatcccaagt

SEQ ID NO: 461606 - DNA, 22 bp, Homo sapiens
gcaggaaagatcccaagtcaaa

SEQ ID NO: 461607 - DNA, 17 bp, Homo sapiens
gcaggactaacaactgg

SEQ ID NO: 461608 - DNA, 17 bp, Homo sapiens
gcaggcacacagcagcc

SEQ ID NO: 461609 - DNA, 21 bp, Homo sapiens
gcaggcgcgcaccgcccaacc

SEQ ID NO: 461610 - DNA, 20 bp, Homo sapiens
gcagggccctggggtctctg

SEQ ID NO: 461611 - DNA, 22 bp, Homo sapiens
gcagggccctggggtctctgag

SEQ ID NO: 461612 - DNA, 14 bp, Homo sapiens
gcagggcgctccgg

SEQ ID NO: 461613 - DNA, 21 bp, Homo sapiens
gcagggcgctccggcagaggc

SEQ ID NO: 461614 - DNA, 15 bp, Homo sapiens
gagcggctgaggacg

SEQ ID NO: 461615 - DNA, 21 bp, Homo sapiens
gagcgggggctaactggcccc

SEQ ID NO: 461616 - DNA, 19 bp, Homo sapiens
gagctaaattacaattgtc

SEQ ID NO: 461617 - DNA, 18 bp, Homo sapiens
gagctcaggagaaggcct

SEQ ID NO: 461618 - DNA, 14 bp, Homo sapiens
gagctcagtacagg

SEQ ID NO: 461619 - DNA, 18 bp, Homo sapiens
gagctcagtacagggcag

SEQ ID NO: 461620 - DNA, 23 bp, Homo sapiens
gagctgagtcggctgggcagggc

SEQ ID NO: 461621 - DNA, 13 bp, Homo sapiens
gagctgcagcccc

SEQ ID NO: 461622 - DNA, 21 bp, Homo sapiens
gagctgtgagaagggtgttgt

SEQ ID NO: 461623 - DNA, 14 bp, Homo sapiens
gagcttctcctctg

SEQ ID NO: 461624 - DNA, 15 bp, Homo sapiens
gagcttctcctctgc

SEQ ID NO: 461625 - DNA, 20 bp, Homo sapiens
gaggaaaaccaagccgtggc

SEQ ID NO: 461626 - DNA, 21 bp, Homo sapiens
gaggaaaaccaagccgtggct

SEQ ID NO: 461627 - DNA, 16 bp, Homo sapiens
gaggacggggcagagc

SEQ ID NO: 461628 - DNA, 21 bp, Homo sapiens
gaggactgttctaactagtaa

SEQ ID NO: 461629 - DNA, 22 bp, Homo sapiens
gaggagcacccccagcctcccc

SEQ ID NO: 461630 - DNA, 16 bp, Homo sapiens
gaggcagaatggtggg

SEQ ID NO: 461631 - DNA, 13 bp, Homo sapiens
gaggcagggccct

SEQ ID NO: 461632 - DNA, 16 bp, Homo sapiens
gaggcagggccctggg

SEQ ID NO: 461633 - DNA, 14 bp, Homo sapiens
gaggcccccctctg

SEQ ID NO: 461634 - DNA, 15 bp, Homo sapiens
gaggcccccctctgc

SEQ ID NO: 461635 - DNA, 21 bp, Homo sapiens
gaggcccccctctgcctttga

SEQ ID NO: 461636 - DNA, 17 bp, Homo sapiens
gaggcccccggaggcgc

SEQ ID NO: 461637 - DNA, 19 bp, Homo sapiens
gaggcccccggaggcgccc

SEQ ID NO: 461638 - DNA, 20 bp, Homo sapiens
gaggcccccggaggcgccca

SEQ ID NO: 461639 - DNA, 13 bp, Homo sapiens
gaggcctggtctg

SEQ ID NO: 461640 - DNA, 17 bp, Homo sapiens
gaggcgcccacctgccc

SEQ ID NO: 461641 - DNA, 18 bp, Homo sapiens
gaggcgcccacctgccca

SEQ ID NO: 461642 - DNA, 20 bp, Homo sapiens
gaggcgtgggatccagagag

SEQ ID NO: 461643 - DNA, 14 bp, Homo sapiens
gaggctgggcccct

SEQ ID NO: 461644 - DNA, 22 bp, Homo sapiens
gaggcttcctactataaaatgt

SEQ ID NO: 461645 - DNA, 20 bp, Homo sapiens
gagggaagcccacccgcccc

SEQ ID NO: 461646 - DNA, 13 bp, Homo sapiens
gagggatggagag

SEQ ID NO: 461647 - DNA, 12 bp, Homo sapiens
gagggctgagcc

SEQ ID NO: 461648 - DNA, 17 bp, Homo sapiens
gagggctgagcccctcc

SEQ ID NO: 461649 - DNA, 20 bp, Homo sapiens
gagggctgagcccctcctct

SEQ ID NO: 461650 - DNA, 21 bp, Homo sapiens
gagggctgagcccctcctctc

SEQ ID NO: 461651 - DNA, 13 bp, Homo sapiens
gaggggacttgga

SEQ ID NO: 461652 - DNA, 13 bp, Homo sapiens
gaggggcctggca

SEQ ID NO: 461653 - DNA, 16 bp, Homo sapiens
gaggggcttggagcag

SEQ ID NO: 461654 - DNA, 21 bp, Homo sapiens
gaggggcttggagcagagacg

SEQ ID NO: 461655 - DNA, 21 bp, Homo sapiens
gaggtacctttccacccagac

SEQ ID NO: 461656 - DNA, 17 bp, Homo sapiens
gaggtgtggagtggagg

SEQ ID NO: 461657 - DNA, 16 bp, Homo sapiens
gagtaaataaactctt

SEQ ID NO: 461658 - DNA, 15 bp, Homo sapiens
gagtaggtgggtctt

SEQ ID NO: 461659 - DNA, 13 bp, Homo sapiens
gagtcatctcaaa

SEQ ID NO: 461660 - DNA, 16 bp, Homo sapiens
gagtccactttcctct

SEQ ID NO: 461661 - DNA, 17 bp, Homo sapiens
gagtccactttcctctc

SEQ ID NO: 461662 - DNA, 20 bp, Homo sapiens
gagtccactttcctctctct

SEQ ID NO: 461663 - DNA, 21 bp, Homo sapiens
gagtccactttcctctctctc

SEQ ID NO: 461664 - DNA, 16 bp, Homo sapiens
gagtccagctcccccc

SEQ ID NO: 461665 - DNA, 13 bp, Homo sapiens
gagtccccccacc

SEQ ID NO: 461666 - DNA, 16 bp, Homo sapiens
gagtccccccacccct

SEQ ID NO: 461667 - DNA, 17 bp, Homo sapiens
gagtccccccacccctc

SEQ ID NO: 461668 - DNA, 14 bp, Homo sapiens
gagtcggctgggca

SEQ ID NO: 461669 - DNA, 17 bp, Homo sapiens
gagtcggctgggcaggg

SEQ ID NO: 461670 - DNA, 15 bp, Homo sapiens
gagtctcttctccac

SEQ ID NO: 461671 - DNA, 16 bp, Homo sapiens
gagtctcttctccact

SEQ ID NO: 461672 - DNA, 20 bp, Homo sapiens
gagtctgaaggagaggagtg

SEQ ID NO: 461673 - DNA, 12 bp, Homo sapiens
gagtctgtcctt

SEQ ID NO: 461674 - DNA, 15 bp, Homo sapiens
gagtcttcctgtagt

SEQ ID NO: 461675 - DNA, 17 bp, Homo sapiens
gagtcttcctgtagtgg

SEQ ID NO: 461676 - DNA, 14 bp, Homo sapiens
gagtgcgctagagc

SEQ ID NO: 461677 - DNA, 20 bp, Homo sapiens
gagtggaggggtcagcaggg

SEQ ID NO: 461678 - DNA, 19 bp, Homo sapiens
gagtgtgtagaaacacagc

SEQ ID NO: 461679 - DNA, 19 bp, Homo sapiens
gatacaccgggcctggaga

SEQ ID NO: 461680 - DNA, 17 bp, Homo sapiens
gatagcgtgcagtagag

SEQ ID NO: 461681 - DNA, 20 bp, Homo sapiens
gatatacagacctccagatt

SEQ ID NO: 461682 - DNA, 15 bp, Homo sapiens
gatatgaaagagaaa

SEQ ID NO: 461683 - DNA, 23 bp, Homo sapiens
gatatgcatgtagcatataaatg

SEQ ID NO: 461684 - DNA, 15 bp, Homo sapiens
gatcagcattcaaaa

SEQ ID NO: 461685 - DNA, 17 bp, Homo sapiens
gatcagcattcaaaata

SEQ ID NO: 461686 - DNA, 22 bp, Homo sapiens
gatcatggtttttgctctactt

SEQ ID NO: 461687 - DNA, 14 bp, Homo sapiens
gatccagagagaag

SEQ ID NO: 461688 - DNA, 22 bp, Homo sapiens
gatcccaagtcaaacagtgtgg

SEQ ID NO: 461689 - DNA, 22 bp, Homo sapiens
gatcgtttcacatctgtatatc

SEQ ID NO: 461690 - DNA, 17 bp, Homo sapiens
gatctggtgcgtgtggc

SEQ ID NO: 461691 - DNA, 23 bp, Homo sapiens
gatctggtgcgtgtggccctgtg

SEQ ID NO: 461692 - DNA, 19 bp, Homo sapiens
gatgaaaaaaagggaaaac

SEQ ID NO: 461693 - DNA, 15 bp, Homo sapiens
gatgacacataaatc

SEQ ID NO: 461694 - DNA, 18 bp, Homo sapiens
gatgacacataaatctgt

SEQ ID NO: 461695 - DNA, 13 bp, Homo sapiens
gatgagaaaacag

SEQ ID NO: 461696 - DNA, 23 bp, Homo sapiens
gatgcagaaatgtggatgctctt

SEQ ID NO: 461697 - DNA, 20 bp, Homo sapiens
gatgctgctggaggaatcag

SEQ ID NO: 461698 - DNA, 20 bp, Homo sapiens
gatggcttccgtgagacaca

SEQ ID NO: 461699 - DNA, 15 bp, Homo sapiens
gatgggtattaaact

SEQ ID NO: 461700 - DNA, 16 bp, Homo sapiens
gatgggtcctgctgct

SEQ ID NO: 461701 - DNA, 13 bp, Homo sapiens
gatggttcccctg

SEQ ID NO: 461702 - DNA, 21 bp, Homo sapiens
gatggttcccctgttcactct

SEQ ID NO: 461703 - DNA, 15 bp, Homo sapiens
gatgtagtctgaggc

SEQ ID NO: 461704 - DNA, 18 bp, Homo sapiens
gatgtcttgagatgtatt

SEQ ID NO: 461705 - DNA, 20 bp, Homo sapiens
gattaaatttaatatactgc

SEQ ID NO: 461706 - DNA, 19 bp, Homo sapiens
gattaatctctaaaattct

SEQ ID NO: 461707 - DNA, 18 bp, Homo sapiens
gattatatacaaagctgt

SEQ ID NO: 461708 - DNA, 15 bp, Homo sapiens
gattattttctatat

SEQ ID NO: 461709 - DNA, 14 bp, Homo sapiens
gattcaaatgcatg

SEQ ID NO: 461710 - DNA, 12 bp, Homo sapiens
gattctaaaaca

SEQ ID NO: 461711 - DNA, 14 bp, Homo sapiens
gattctaaaacatt

SEQ ID NO: 461712 - DNA, 18 bp, Homo sapiens
gcagggttctagaagggg

SEQ ID NO: 461713 - DNA, 21 bp, Homo sapiens
gcaggtcctgcccatgtgtcc

SEQ ID NO: 461714 - DNA, 14 bp, Homo sapiens
gcagtaccatccca

SEQ ID NO: 461715 - DNA, 17 bp, Homo sapiens
gcagtaccatcccactg

SEQ ID NO: 461716 - DNA, 21 bp, Homo sapiens
gcagtacttgctcaataaagg

SEQ ID NO: 461717 - DNA, 17 bp, Homo sapiens
gcagtgctgggcccagc

SEQ ID NO: 461718 - DNA, 14 bp, Homo sapiens
gcagtggagagggg

SEQ ID NO: 461719 - DNA, 15 bp, Homo sapiens
gcagtggtgatgcct

SEQ ID NO: 461720 - DNA, 21 bp, Homo sapiens
gcagtggtgatgcctaaagga

SEQ ID NO: 461721 - DNA, 21 bp, Homo sapiens
gcagttgagaaaatttgaatg

SEQ ID NO: 461722 - DNA, 12 bp, Homo sapiens
gcatacaataaa

SEQ ID NO: 461723 - DNA, 14 bp, Homo sapiens
gcatagagctatat

SEQ ID NO: 461724 - DNA, 20 bp, Homo sapiens
gcatagggtttggaagaaag

SEQ ID NO: 461725 - DNA, 22 bp, Homo sapiens
gcatagtgtgctcggacacagt

SEQ ID NO: 461726 - DNA, 21 bp, Homo sapiens
gcatagttctgcaataacagt

SEQ ID NO: 461727 - DNA, 19 bp, Homo sapiens
gcatataaatgtttatatt

SEQ ID NO: 461728 - DNA, 16 bp, Homo sapiens
gcatccaccgccaccc

SEQ ID NO: 461729 - DNA, 17 bp, Homo sapiens
gcatccaccgccacccc

SEQ ID NO: 461730 - DNA, 16 bp, Homo sapiens
gcatcccttggcccct

SEQ ID NO: 461731 - DNA, 12 bp, Homo sapiens
gcatctcagccc

SEQ ID NO: 461732 - DNA, 15 bp, Homo sapiens
gcatctcagcccaca

SEQ ID NO: 461733 - DNA, 19 bp, Homo sapiens
gcatctctccccatatata

SEQ ID NO: 461734 - DNA, 21 bp, Homo sapiens
gcatctctccccatatataaa

SEQ ID NO: 461735 - DNA, 23 bp, Homo sapiens
gcatctctccccatatataaatt

SEQ ID NO: 461736 - DNA, 12 bp, Homo sapiens
gcatgcaactaa

SEQ ID NO: 461737 - DNA, 18 bp, Homo sapiens
gcattatccttttatctc

SEQ ID NO: 461738 - DNA, 22 bp, Homo sapiens
gcattcaaaatagttctatttc

SEQ ID NO: 461739 - DNA, 15 bp, Homo sapiens
gcattctcactccta

SEQ ID NO: 461740 - DNA, 19 bp, Homo sapiens
gcattggggggccgggcag

SEQ ID NO: 461741 - DNA, 15 bp, Homo sapiens
gccaaaatgtcaatt

SEQ ID NO: 461742 - DNA, 14 bp, Homo sapiens
gccaaagaaactca

SEQ ID NO: 461743 - DNA, 21 bp, Homo sapiens
gccaaagaaactcagaagagt

SEQ ID NO: 461744 - DNA, 16 bp, Homo sapiens
gccaaagatagcagaa

SEQ ID NO: 461745 - DNA, 20 bp, Homo sapiens
gccaagccagggttccagac

SEQ ID NO: 461746 - DNA, 20 bp, Homo sapiens
gccaatttcaaagaaaacag

SEQ ID NO: 461747 - DNA, 23 bp, Homo sapiens
gccacacttcaggctcttctcct

SEQ ID NO: 461748 - DNA, 18 bp, Homo sapiens
gccacagtggggcccatg

SEQ ID NO: 461749 - DNA, 16 bp, Homo sapiens
gccaccaagctgctct

SEQ ID NO: 461750 - DNA, 14 bp, Homo sapiens
gccaccccactgag

SEQ ID NO: 461751 - DNA, 17 bp, Homo sapiens
gccaccccactgagagc

SEQ ID NO: 461752 - DNA, 12 bp, Homo sapiens
gccacccgcccg

SEQ ID NO: 461753 - DNA, 14 bp, Homo sapiens
gccacccttggcct

SEQ ID NO: 461754 - DNA, 13 bp, Homo sapiens
gccacgctgtcct

SEQ ID NO: 461755 - DNA, 16 bp, Homo sapiens
gccactccagacccct

SEQ ID NO: 461756 - DNA, 18 bp, Homo sapiens
gccagacgctgccgctgc

SEQ ID NO: 461757 - DNA, 12 bp, Homo sapiens
gccagcaccctc

SEQ ID NO: 461758 - DNA, 19 bp, Homo sapiens
gccagccgccctgggctgt

SEQ ID NO: 461759 - DNA, 20 bp, Homo sapiens
gccagccgccctgggctgtc

SEQ ID NO: 461760 - DNA, 16 bp, Homo sapiens
gccaggagaccctgtc

SEQ ID NO: 461761 - DNA, 18 bp, Homo sapiens
gccaggccaactgccccg

SEQ ID NO: 461762 - DNA, 18 bp, Homo sapiens
gccagggacccccgaggc

SEQ ID NO: 461763 - DNA, 20 bp, Homo sapiens
gccagggacccccgaggccc

SEQ ID NO: 461764 - DNA, 14 bp, Homo sapiens
gccagggttccaga

SEQ ID NO: 461765 - DNA, 17 bp, Homo sapiens
gccagggttccagacag

SEQ ID NO: 461766 - DNA, 23 bp, Homo sapiens
gccagggttccagacagggtggg

SEQ ID NO: 461767 - DNA, 18 bp, Homo sapiens
gccatccctgggcccctc

SEQ ID NO: 461768 - DNA, 21 bp, Homo sapiens
gcccaaccaatgcacacagta

SEQ ID NO: 461769 - DNA, 21 bp, Homo sapiens
gcccaagaatagatgctgact

SEQ ID NO: 461770 - DNA, 18 bp, Homo sapiens
gcccaccacaactaacaa

SEQ ID NO: 461771 - DNA, 13 bp, Homo sapiens
gcccacccacacc

SEQ ID NO: 461772 - DNA, 10 bp, Homo sapiens
gcccaccccg

SEQ ID NO: 461773 - DNA, 16 bp, Homo sapiens
gcccaccccgctgcct

SEQ ID NO: 461774 - DNA, 18 bp, Homo sapiens
gcccaccccgctgcctgg

SEQ ID NO: 461775 - DNA, 19 bp, Homo sapiens
gcccacccctcttccccct

SEQ ID NO: 461776 - DNA, 21 bp, Homo sapiens
gcccacccctcttcccccttc

SEQ ID NO: 461777 - DNA, 12 bp, Homo sapiens
gcccacccgccc

SEQ ID NO: 461778 - DNA, 13 bp, Homo sapiens
gcccacccgcccc

SEQ ID NO: 461779 - DNA, 16 bp, Homo sapiens
gcccacccgccccaga

SEQ ID NO: 461780 - DNA, 18 bp, Homo sapiens
gcccacccgccccagaga

SEQ ID NO: 461781 - DNA, 21 bp, Homo sapiens
gcccacccgccccagagactg

SEQ ID NO: 461782 - DNA, 14 bp, Homo sapiens
gcccacctgcccag

SEQ ID NO: 461783 - DNA, 15 bp, Homo sapiens
gcccacctgcccagt

SEQ ID NO: 461784 - DNA, 14 bp, Homo sapiens
gcccacgcagagcc

SEQ ID NO: 461785 - DNA, 17 bp, Homo sapiens
gcccacgcagagccccg

SEQ ID NO: 461786 - DNA, 23 bp, Homo sapiens
gcccacgcagagccccggagcac

SEQ ID NO: 461787 - DNA, 14 bp, Homo sapiens
gcccacgctcctgc

SEQ ID NO: 461788 - DNA, 20 bp, Homo sapiens
gcccagaacgggcctccccg

SEQ ID NO: 461789 - DNA, 23 bp, Homo sapiens
gcccagcatatgtgccataaaca

SEQ ID NO: 461790 - DNA, 15 bp, Homo sapiens
gcccagccggggtgg

SEQ ID NO: 461791 - DNA, 19 bp, Homo sapiens
gcccagccggggtggggtg

SEQ ID NO: 461792 - DNA, 22 bp, Homo sapiens
gcccagcctctccccgctctgg

SEQ ID NO: 461793 - DNA, 18 bp, Homo sapiens
gcccagctgatctaagga

SEQ ID NO: 461794 - DNA, 16 bp, Homo sapiens
gcccaggaggacctgg

SEQ ID NO: 461795 - DNA, 18 bp, Homo sapiens
gcccagtcttgagtgggc

SEQ ID NO: 461796 - DNA, 21 bp, Homo sapiens
gcccagtctttggagagctca

SEQ ID NO: 461797 - DNA, 21 bp, Homo sapiens
gcccagttagcccggccaagg

SEQ ID NO: 461798 - DNA, 16 bp, Homo sapiens
gcccatggccccagct

SEQ ID NO: 461799 - DNA, 13 bp, Homo sapiens
gccccaaccctcg

SEQ ID NO: 461800 - DNA, 16 bp, Homo sapiens
gccccaaccctcggag

SEQ ID NO: 461801 - DNA, 20 bp, Homo sapiens
gccccaaccctcggagcccc

SEQ ID NO: 461802 - DNA, 23 bp, Homo sapiens
gccccaaccctcggagcccccca

SEQ ID NO: 461803 - DNA, 14 bp, Homo sapiens
gccccagagactgc

SEQ ID NO: 461804 - DNA, 16 bp, Homo sapiens
gccccagcctccaggc

SEQ ID NO: 461805 - DNA, 22 bp, Homo sapiens
gccccagctggctgggtcgccc

SEQ ID NO: 461806 - DNA, 13 bp, Homo sapiens
gccccaggccctc

SEQ ID NO: 461807 - DNA, 17 bp, Homo sapiens
gccccaggccctccctg

SEQ ID NO: 461808 - DNA, 22 bp, Homo sapiens
gccccaggcggaggggcttgga

SEQ ID NO: 461809 - DNA, 14 bp, Homo sapiens
gctgctgcaccaac

SEQ ID NO: 461810 - DNA, 13 bp, Homo sapiens
gctggatgctgag

SEQ ID NO: 461811 - DNA, 13 bp, Homo sapiens
gctggcagcgcct

SEQ ID NO: 461812 - DNA, 15 bp, Homo sapiens
gctggcagcgcctcc

SEQ ID NO: 461813 - DNA, 19 bp, Homo sapiens
gctggcagcgcctcccgcc

SEQ ID NO: 461814 - DNA, 16 bp, Homo sapiens
gctggcatagagcagc

SEQ ID NO: 461815 - DNA, 13 bp, Homo sapiens
gctggccagcacc

SEQ ID NO: 461816 - DNA, 15 bp, Homo sapiens
gctggccagcaccct

SEQ ID NO: 461817 - DNA, 18 bp, Homo sapiens
gctggccagcaccctctc

SEQ ID NO: 461818 - DNA, 16 bp, Homo sapiens
gctggccctgccctcc

SEQ ID NO: 461819 - DNA, 18 bp, Homo sapiens
gctggccctgccctcccc

SEQ ID NO: 461820 - DNA, 19 bp, Homo sapiens
gctggccctggctcccaca

SEQ ID NO: 461821 - DNA, 19 bp, Homo sapiens
gctggccggtccaccccgt

SEQ ID NO: 461822 - DNA, 14 bp, Homo sapiens
gctggctgccttag

SEQ ID NO: 461823 - DNA, 14 bp, Homo sapiens
gctgggcagggccg

SEQ ID NO: 461824 - DNA, 21 bp, Homo sapiens
gctgggcagggccgcagggcg

SEQ ID NO: 461825 - DNA, 23 bp, Homo sapiens
gctgggcagggccgcagggcgct

SEQ ID NO: 461826 - DNA, 22 bp, Homo sapiens
gctgggcccagccggggtgggg

SEQ ID NO: 461827 - DNA, 18 bp, Homo sapiens
gctgggcccctgggatgg

SEQ ID NO: 461828 - DNA, 14 bp, Homo sapiens
gctggggcctggcc

SEQ ID NO: 461829 - DNA, 15 bp, Homo sapiens
gctggggcctggcct

SEQ ID NO: 461830 - DNA, 15 bp, Homo sapiens
gctgggtcgcccctc

SEQ ID NO: 461831 - DNA, 19 bp, Homo sapiens
gctgggtcgcccctcctcg

SEQ ID NO: 461832 - DNA, 14 bp, Homo sapiens
gctggtaactgtta

SEQ ID NO: 461833 - DNA, 19 bp, Homo sapiens
gctgtattttcttttatat

SEQ ID NO: 461834 - DNA, 22 bp, Homo sapiens
gctgtattttcttttatatctg

SEQ ID NO: 461835 - DNA, 24 bp, Homo sapiens
gctgtattttcttttatatctgta

SEQ ID NO: 461836 - DNA, 15 bp, Homo sapiens
gctgtcgccccaggc

SEQ ID NO: 461837 - DNA, 17 bp, Homo sapiens
gctgtcgccccaggccc

SEQ ID NO: 461838 - DNA, 19 bp, Homo sapiens
gctgtcgccccaggccctc

SEQ ID NO: 461839 - DNA, 21 bp, Homo sapiens
gctgtgctccagcagtgctgg

SEQ ID NO: 461840 - DNA, 22 bp, Homo sapiens
gctgtgctccagcagtgctggg

SEQ ID NO: 461841 - DNA, 21 bp, Homo sapiens
gctgtggcccctccttctccc

SEQ ID NO: 461842 - DNA, 22 bp, Homo sapiens
gctgtggcccctccttctcccc

SEQ ID NO: 461843 - DNA, 16 bp, Homo sapiens
gctgtgggcagcaccc

SEQ ID NO: 461844 - DNA, 20 bp, Homo sapiens
gctgtgggcagcaccctccc

SEQ ID NO: 461845 - DNA, 19 bp, Homo sapiens
gctgtgtggggagggtggg

SEQ ID NO: 461846 - DNA, 13 bp, Homo sapiens
gcttaaacatttt

SEQ ID NO: 461847 - DNA, 15 bp, Homo sapiens
gcttaacataaactt

SEQ ID NO: 461848 - DNA, 18 bp, Homo sapiens
gcttaaggaaaagagaaa

SEQ ID NO: 461849 - DNA, 19 bp, Homo sapiens
gcttaaggaaaagagaaac

SEQ ID NO: 461850 - DNA, 21 bp, Homo sapiens
gcttaaggaaaagagaaacac

SEQ ID NO: 461851 - DNA, 21 bp, Homo sapiens
gcttatcagaactcctttcta

SEQ ID NO: 461852 - DNA, 11 bp, Homo sapiens
gcttatttcta

SEQ ID NO: 461853 - DNA, 13 bp, Homo sapiens
gcttatttctaac

SEQ ID NO: 461854 - DNA, 20 bp, Homo sapiens
gcttcccctaacctgggttg

SEQ ID NO: 461855 - DNA, 18 bp, Homo sapiens
gcttcccgctcagccctc

SEQ ID NO: 461856 - DNA, 23 bp, Homo sapiens
gcttcccgctcagccctccctgc

SEQ ID NO: 461857 - DNA, 14 bp, Homo sapiens
gcttctcctctgct

SEQ ID NO: 461858 - DNA, 20 bp, Homo sapiens
gcttgattctaaaggggaca

SEQ ID NO: 461859 - DNA, 15 bp, Homo sapiens
gcttggagcagagac

SEQ ID NO: 461860 - DNA, 22 bp, Homo sapiens
gcttggagcagagacggcagcc

SEQ ID NO: 461861 - DNA, 20 bp, Homo sapiens
gcttgtagggtgaggcgtgg

SEQ ID NO: 461862 - DNA, 21 bp, Homo sapiens
gcttgtttaaggttcttgctg

SEQ ID NO: 461863 - DNA, 11 bp, Homo sapiens
gcttgtttcta

SEQ ID NO: 461864 - DNA, 13 bp, Homo sapiens
gcttgtttctata

SEQ ID NO: 461865 - DNA, 16 bp, Homo sapiens
gcttgtttctatactg

SEQ ID NO: 461866 - DNA, 19 bp, Homo sapiens
gctttatgcaggattctct

SEQ ID NO: 461867 - DNA, 19 bp, Homo sapiens
gctttcatccaactggaag

SEQ ID NO: 461868 - DNA, 17 bp, Homo sapiens
gctttctcatgcataga

SEQ ID NO: 461869 - DNA, 18 bp, Homo sapiens
gctttgctctagggaagc

SEQ ID NO: 461870 - DNA, 14 bp, Homo sapiens
gctttgggctgccc

SEQ ID NO: 461871 - DNA, 20 bp, Homo sapiens
gctttggggcttatcagaac

SEQ ID NO: 461872 - DNA, 15 bp, Homo sapiens
gctttgtatgcactt

SEQ ID NO: 461873 - DNA, 16 bp, Homo sapiens
gctttgtgtgattgaa

SEQ ID NO: 461874 - DNA, 13 bp, Homo sapiens
gcttttcactgct

SEQ ID NO: 461875 - DNA, 14 bp, Homo sapiens
gcttttcactgctg

SEQ ID NO: 461876 - DNA, 18 bp, Homo sapiens
gcttttcactgctggctg

SEQ ID NO: 461877 - DNA, 14 bp, Homo sapiens
ggaaaaaatatttt

SEQ ID NO: 461878 - DNA, 15 bp, Homo sapiens
ggaaagatcccaagt

SEQ ID NO: 461879 - DNA, 20 bp, Homo sapiens
ggaaagatcccaagtcaaac

SEQ ID NO: 461880 - DNA, 12 bp, Homo sapiens
ggaaagccctcc

SEQ ID NO: 461881 - DNA, 14 bp, Homo sapiens
ggaaagttctatta

SEQ ID NO: 461882 - DNA, 18 bp, Homo sapiens
ggaaattcttgcactgta

SEQ ID NO: 461883 - DNA, 18 bp, Homo sapiens
ggaacagccaaagaaact

SEQ ID NO: 461884 - DNA, 17 bp, Homo sapiens
ggaacatttgggagact

SEQ ID NO: 461885 - DNA, 16 bp, Homo sapiens
ggaaccttccctccaa

SEQ ID NO: 461886 - DNA, 13 bp, Homo sapiens
ggaactcatcaaa

SEQ ID NO: 461887 - DNA, 14 bp, Homo sapiens
ggaagaaaaaggaa

SEQ ID NO: 461888 - DNA, 16 bp, Homo sapiens
ggaagaaaactatcct

SEQ ID NO: 461889 - DNA, 14 bp, Homo sapiens
ggaagcccacccgc

SEQ ID NO: 461890 - DNA, 17 bp, Homo sapiens
ggaagcccacccgcccc

SEQ ID NO: 461891 - DNA, 21 bp, Homo sapiens
ggaagcccacccgccccagag

SEQ ID NO: 461892 - DNA, 23 bp, Homo sapiens
ggaagcccacccgccccagagac

SEQ ID NO: 461893 - DNA, 23 bp, Homo sapiens
ggaaggcctgagggaagcccacc

SEQ ID NO: 461894 - DNA, 22 bp, Homo sapiens
ggaatgttggctgtaatgtaac

SEQ ID NO: 461895 - DNA, 23 bp, Homo sapiens
ggacaccatcccctcctagcaca

SEQ ID NO: 461896 - DNA, 15 bp, Homo sapiens
ggacacgaaggctgc

SEQ ID NO: 461897 - DNA, 21 bp, Homo sapiens
ggacactgatgggtcctgctg

SEQ ID NO: 461898 - DNA, 23 bp, Homo sapiens
ggacagaaccaacgggtctgtgg

SEQ ID NO: 461899 - DNA, 19 bp, Homo sapiens
ggacagcggcccggcccac

SEQ ID NO: 461900 - DNA, 20 bp, Homo sapiens
ggacagcggcccggcccacg

SEQ ID NO: 461901 - DNA, 23 bp, Homo sapiens
ggacagtggtctaattcaactct

SEQ ID NO: 461902 - DNA, 16 bp, Homo sapiens
ggaccagggatggggg

SEQ ID NO: 461903 - DNA, 22 bp, Homo sapiens
ggacccccgaggcccccctctg

SEQ ID NO: 461904 - DNA, 23 bp, Homo sapiens
ggacccccggcctccaggctggg

SEQ ID NO: 461905 - DNA, 16 bp, Homo sapiens
ggaccgccccaaccct

SEQ ID NO: 461906 - DNA, 22 bp, Homo sapiens
ggaccgccccaaccctcggagc

SEQ ID NO: 461907 - DNA, 16 bp, Homo sapiens
ggaccggagcggctga

SEQ ID NO: 461908 - DNA, 13 bp, Homo sapiens
ggacggaagtggc

SEQ ID NO: 461909 - DNA, 13 bp, Homo sapiens
ggacgggacagcg

SEQ ID NO: 461910 - DNA, 21 bp, Homo sapiens
ggacgggacagcggcccggcc

SEQ ID NO: 461911 - DNA, 23 bp, Homo sapiens
ggacgggacagcggcccggccca

SEQ ID NO: 461912 - DNA, 21 bp, Homo sapiens
ggacgtcatcggaggctgggc

SEQ ID NO: 461913 - DNA, 16 bp, Homo sapiens
ggactgcgctggacga

SEQ ID NO: 461914 - DNA, 21 bp, Homo sapiens
ggactgtcttcaaccctgccc

SEQ ID NO: 461915 - DNA, 22 bp, Homo sapiens
ggactgtcttcaaccctgccct

SEQ ID NO: 461916 - DNA, 14 bp, Homo sapiens
ggacttctgcagct

SEQ ID NO: 461917 - DNA, 10 bp, Homo sapiens
ggactttatt

SEQ ID NO: 461918 - DNA, 14 bp, Homo sapiens
ggactttatttaat

SEQ ID NO: 461919 - DNA, 23 bp, Homo sapiens
ggagaaaggaacttttaaactgc

SEQ ID NO: 461920 - DNA, 13 bp, Homo sapiens
ggagaactagaga

SEQ ID NO: 461921 - DNA, 17 bp, Homo sapiens
ggagaaggcctgccccc

SEQ ID NO: 461922 - DNA, 18 bp, Homo sapiens
ggagaaggcctgcccccc

SEQ ID NO: 461923 - DNA, 22 bp, Homo sapiens
ggagaaggcctgccccccttcc

SEQ ID NO: 461924 - DNA, 23 bp, Homo sapiens
ggagaaggcctgccccccttccc

SEQ ID NO: 461925 - DNA, 14 bp, Homo sapiens
ggagaccctgtctt

SEQ ID NO: 461926 - DNA, 14 bp, Homo sapiens
ggagactgagcttg

SEQ ID NO: 461927 - DNA, 15 bp, Homo sapiens
ggagactgagcttga

SEQ ID NO: 461928 - DNA, 16 bp, Homo sapiens
ggagagcgccacccgc

SEQ ID NO: 461929 - DNA, 18 bp, Homo sapiens
ggagagcgccacccgccc

SEQ ID NO: 461930 - DNA, 20 bp, Homo sapiens
ggagagctcagtacagggca

SEQ ID NO: 461931 - DNA, 16 bp, Homo sapiens
ggagaggcggcctcgt

SEQ ID NO: 461932 - DNA, 23 bp, Homo sapiens
ggagataccagagactctgaaac

SEQ ID NO: 461933 - DNA, 13 bp, Homo sapiens
ggagcacccccag

SEQ ID NO: 461934 - DNA, 15 bp, Homo sapiens
ggagcacccccagcc

SEQ ID NO: 461935 - DNA, 17 bp, Homo sapiens
ggagcacccccagcctc

SEQ ID NO: 461936 - DNA, 21 bp, Homo sapiens
ggagcacccccagcctccccc

SEQ ID NO: 461937 - DNA, 22 bp, Homo sapiens
ggagcactagaatgagaaatca

SEQ ID NO: 461938 - DNA, 16 bp, Homo sapiens
ggagcagagacggcag

SEQ ID NO: 461939 - DNA, 17 bp, Homo sapiens
ggagcagagacggcagc

SEQ ID NO: 461940 - DNA, 20 bp, Homo sapiens
ggagcagagacggcagcccc

SEQ ID NO: 461941 - DNA, 13 bp, Homo sapiens
ggagccccccact

SEQ ID NO: 461942 - DNA, 17 bp, Homo sapiens
ggagcctccccctcaga

SEQ ID NO: 461943 - DNA, 19 bp, Homo sapiens
ggagcctccccctcagatg

SEQ ID NO: 461944 - DNA, 15 bp, Homo sapiens
ggagcggctgaggac

SEQ ID NO: 461945 - DNA, 13 bp, Homo sapiens
ggagcttccagat

SEQ ID NO: 461946 - DNA, 15 bp, Homo sapiens
ggagcttccagatgg

SEQ ID NO: 461947 - DNA, 22 bp, Homo sapiens
ggaggaaaaccaagccgtggct

SEQ ID NO: 461948 - DNA, 11 bp, Homo sapiens
ggaggacagaa

SEQ ID NO: 461949 - DNA, 19 bp, Homo sapiens
ggaggagcacccccagcct

SEQ ID NO: 461950 - DNA, 22 bp, Homo sapiens
ggaggccaccaagctgctctcc

SEQ ID NO: 461951 - DNA, 20 bp, Homo sapiens
ggaggccagcacggtggtga

SEQ ID NO: 461952 - DNA, 16 bp, Homo sapiens
ggaggcctggtctgga

SEQ ID NO: 461953 - DNA, 17 bp, Homo sapiens
ggaggcctggtctggag

SEQ ID NO: 461954 - DNA, 17 bp, Homo sapiens
ggaggcgcccacctgcc

SEQ ID NO: 461955 - DNA, 18 bp, Homo sapiens
ggaggcgcccacctgccc

SEQ ID NO: 461956 - DNA, 16 bp, Homo sapiens
ggaggctgggcccctg

SEQ ID NO: 461957 - DNA, 19 bp, Homo sapiens
ggaggctgggcccctggga

SEQ ID NO: 461958 - DNA, 16 bp, Homo sapiens
ggagggatggagaggc

SEQ ID NO: 461959 - DNA, 22 bp, Homo sapiens
ggagggatggagaggcggcctc

SEQ ID NO: 461960 - DNA, 13 bp, Homo sapiens
ggaggggcctggc

SEQ ID NO: 461961 - DNA, 14 bp, Homo sapiens
ggaggggcctggca

SEQ ID NO: 461962 - DNA, 23 bp, Homo sapiens
ggaggggtcagcaggggggttgg

SEQ ID NO: 461963 - DNA, 19 bp, Homo sapiens
ggagtccactttcctctct

SEQ ID NO: 461964 - DNA, 16 bp, Homo sapiens
ggagtctgaaggagag

SEQ ID NO: 461965 - DNA, 18 bp, Homo sapiens
ggagtctgaaggagagga

SEQ ID NO: 461966 - DNA, 17 bp, Homo sapiens
ggagtcttcctgtagtg

SEQ ID NO: 461967 - DNA, 17 bp, Homo sapiens
ggagtggaggggtcagc

SEQ ID NO: 461968 - DNA, 15 bp, Homo sapiens
ggagttctcctggag

SEQ ID NO: 461969 - DNA, 16 bp, Homo sapiens
ggagttctcctggagc

SEQ ID NO: 461970 - DNA, 17 bp, Homo sapiens
ggagttctcctggagca

SEQ ID NO: 461971 - DNA, 18 bp, Homo sapiens
ggataggagcttccagat

SEQ ID NO: 461972 - DNA, 21 bp, Homo sapiens
ggatgggggatgggccagggt

SEQ ID NO: 461973 - DNA, 16 bp, Homo sapiens
ggattcaaatgcatga

SEQ ID NO: 461974 - DNA, 12 bp, Homo sapiens
ggattcacttct

SEQ ID NO: 461975 - DNA, 20 bp, Homo sapiens
ggcaaaaaagaacagtgttg

SEQ ID NO: 461976 - DNA, 12 bp, Homo sapiens
ggcaaacattta

SEQ ID NO: 461977 - DNA, 13 bp, Homo sapiens
ggcacacagcagc

SEQ ID NO: 461978 - DNA, 19 bp, Homo sapiens
ggcacacagcagcccccca

SEQ ID NO: 461979 - DNA, 22 bp, Homo sapiens
ggcacacagcagccccccagca

SEQ ID NO: 461980 - DNA, 15 bp, Homo sapiens
ggcaccgcccaccca

SEQ ID NO: 461981 - DNA, 17 bp, Homo sapiens
ggcaccgcccacccaca

SEQ ID NO: 461982 - DNA, 22 bp, Homo sapiens
ggcaccgcccacccacaccccg

SEQ ID NO: 461983 - DNA, 15 bp, Homo sapiens
ggcactggtggcccg

SEQ ID NO: 461984 - DNA, 20 bp, Homo sapiens
ggcagagctgagtcggctgg

SEQ ID NO: 461985 - DNA, 21 bp, Homo sapiens
ggcagagctgagtcggctggg

SEQ ID NO: 461986 - DNA, 23 bp, Homo sapiens
ggcagagctgagtcggctgggca

SEQ ID NO: 461987 - DNA, 12 bp, Homo sapiens
ggcagaggcagg

SEQ ID NO: 461988 - DNA, 19 bp, Homo sapiens
gccccatccttcccgcagc

SEQ ID NO: 461989 - DNA, 23 bp, Homo sapiens
gcccccaactccgcccagcctct

SEQ ID NO: 461990 - DNA, 11 bp, Homo sapiens
gcccccacccg

SEQ ID NO: 461991 - DNA, 20 bp, Homo sapiens
gccccccagagagagctctg

SEQ ID NO: 461992 - DNA, 21 bp, Homo sapiens
gcccccctcctttccaaataa

SEQ ID NO: 461993 - DNA, 19 bp, Homo sapiens
gcccccctctgcctttgag

SEQ ID NO: 461994 - DNA, 14 bp, Homo sapiens
gccccccttcccac

SEQ ID NO: 461995 - DNA, 14 bp, Homo sapiens
gcccccgccctcgc

SEQ ID NO: 461996 - DNA, 18 bp, Homo sapiens
gcccccggaggcgcccac

SEQ ID NO: 461997 - DNA, 20 bp, Homo sapiens
gcccccggaggcgcccacct

SEQ ID NO: 461998 - DNA, 14 bp, Homo sapiens
gccccctcccccgc

SEQ ID NO: 461999 - DNA, 16 bp, Homo sapiens
gccccctcccccgcag

SEQ ID NO: 462000 - DNA, 18 bp, Homo sapiens
gccccctcccccgcagac

SEQ ID NO: 462001 - DNA, 16 bp, Homo sapiens
gccccggagcaccacg

SEQ ID NO: 462002 - DNA, 16 bp, Homo sapiens
gccccggtgtgcggtg

SEQ ID NO: 462003 - DNA, 20 bp, Homo sapiens
gcccctatcctgcaccctct

SEQ ID NO: 462004 - DNA, 15 bp, Homo sapiens
gcccctccacgcctc

SEQ ID NO: 462005 - DNA, 16 bp, Homo sapiens
gcccctccacgcctcc

SEQ ID NO: 462006 - DNA, 20 bp, Homo sapiens
gcccctccacgcctcctggc

SEQ ID NO: 462007 - DNA, 23 bp, Homo sapiens
gcccctccacgcctcctggccag

SEQ ID NO: 462008 - DNA, 16 bp, Homo sapiens
gcccctccgtccccag

SEQ ID NO: 462009 - DNA, 18 bp, Homo sapiens
gcccctccgtccccaggg

SEQ ID NO: 462010 - DNA, 20 bp, Homo sapiens
gcccctccgtccccagggtg

SEQ ID NO: 462011 - DNA, 12 bp, Homo sapiens
gcccctcctcgg

SEQ ID NO: 462012 - DNA, 19 bp, Homo sapiens
gcccctcctcgggcgcctg

SEQ ID NO: 462013 - DNA, 22 bp, Homo sapiens
gcccctcctcgggcgcctgcgc

SEQ ID NO: 462014 - DNA, 13 bp, Homo sapiens
gcccctcctctcc

SEQ ID NO: 462015 - DNA, 15 bp, Homo sapiens
gcccctcctctcctc

SEQ ID NO: 462016 - DNA, 23 bp, Homo sapiens
gcccctcctctcctcgtccggcc

SEQ ID NO: 462017 - DNA, 15 bp, Homo sapiens
gcccctccttctccc

SEQ ID NO: 462018 - DNA, 21 bp, Homo sapiens
gcccctctctgtttaccctcc

SEQ ID NO: 462019 - DNA, 15 bp, Homo sapiens
gcccctgctggacca

SEQ ID NO: 462020 - DNA, 19 bp, Homo sapiens
gcccctgtaaggtttcaat

SEQ ID NO: 462021 - DNA, 14 bp, Homo sapiens
gccccttgacccca

SEQ ID NO: 462022 - DNA, 15 bp, Homo sapiens
gccccttgaccccac

SEQ ID NO: 462023 - DNA, 14 bp, Homo sapiens
gcccgacagcctgg

SEQ ID NO: 462024 - DNA, 23 bp, Homo sapiens
gcccgagcgcgtgccttccccgt

SEQ ID NO: 462025 - DNA, 15 bp, Homo sapiens
gcccgcccaccccgc

SEQ ID NO: 462026 - DNA, 17 bp, Homo sapiens
gcccgcccaccccgctg

SEQ ID NO: 462027 - DNA, 21 bp, Homo sapiens
gcccgcccccgccctcgctcc

SEQ ID NO: 462028 - DNA, 14 bp, Homo sapiens
gcccgccctcctct

SEQ ID NO: 462029 - DNA, 16 bp, Homo sapiens
gcccgccctcctctgc

SEQ ID NO: 462030 - DNA, 20 bp, Homo sapiens
gcccgccctcctctgccccc

SEQ ID NO: 462031 - DNA, 21 bp, Homo sapiens
gcccgccctcctctgccccct

SEQ ID NO: 462032 - DNA, 23 bp, Homo sapiens
gcccgccggttggccggctggcc

SEQ ID NO: 462033 - DNA, 15 bp, Homo sapiens
gcccgctcaacctct

SEQ ID NO: 462034 - DNA, 19 bp, Homo sapiens
gcccgctcaacctctcaga

SEQ ID NO: 462035 - DNA, 14 bp, Homo sapiens
gcccggccaaggac

SEQ ID NO: 462036 - DNA, 22 bp, Homo sapiens
gcccggccaaggacactgatgg

SEQ ID NO: 462037 - DNA, 13 bp, Homo sapiens
gcccggcccacgc

SEQ ID NO: 462038 - DNA, 19 bp, Homo sapiens
gcccggcccacgcagagcc

SEQ ID NO: 462039 - DNA, 21 bp, Homo sapiens
gcccggcccacgcagagcccc

SEQ ID NO: 462040 - DNA, 23 bp, Homo sapiens
gcccggcccacgcagagccccgg

SEQ ID NO: 462041 - DNA, 16 bp, Homo sapiens
gccctcactccactcc

SEQ ID NO: 462042 - DNA, 17 bp, Homo sapiens
gccctcactccactccc

SEQ ID NO: 462043 - DNA, 21 bp, Homo sapiens
gccctcactccactcccctca

SEQ ID NO: 462044 - DNA, 15 bp, Homo sapiens
gccctcccccttccc

SEQ ID NO: 462045 - DNA, 19 bp, Homo sapiens
gccctccctgactccctgt

SEQ ID NO: 462046 - DNA, 21 bp, Homo sapiens
gccctccctgactccctgtgg

SEQ ID NO: 462047 - DNA, 15 bp, Homo sapiens
gccctccctgcccct

SEQ ID NO: 462048 - DNA, 21 bp, Homo sapiens
gccctccctgcccctcccttc

SEQ ID NO: 462049 - DNA, 11 bp, Homo sapiens
gccctcctctg

SEQ ID NO: 462050 - DNA, 13 bp, Homo sapiens
gccctcctctgcc

SEQ ID NO: 462051 - DNA, 16 bp, Homo sapiens
gccctcctctgccccc

SEQ ID NO: 462052 - DNA, 17 bp, Homo sapiens
gccctcctctgccccct

SEQ ID NO: 462053 - DNA, 17 bp, Homo sapiens
gccctcgtctccctggc

SEQ ID NO: 462054 - DNA, 16 bp, Homo sapiens
gccctctccacccaga

SEQ ID NO: 462055 - DNA, 18 bp, Homo sapiens
gccctctccacccagagg

SEQ ID NO: 462056 - DNA, 19 bp, Homo sapiens
gccctctccacccagaggt

SEQ ID NO: 462057 - DNA, 19 bp, Homo sapiens
gccctctttctctctgtgt

SEQ ID NO: 462058 - DNA, 13 bp, Homo sapiens
gccctgagactcc

SEQ ID NO: 462059 - DNA, 21 bp, Homo sapiens
gccctgagactcccgcctttg

SEQ ID NO: 462060 - DNA, 16 bp, Homo sapiens
gccctgcaccttgggc

SEQ ID NO: 462061 - DNA, 14 bp, Homo sapiens
gccctgccctcact

SEQ ID NO: 462062 - DNA, 15 bp, Homo sapiens
gccctgccctcactc

SEQ ID NO: 462063 - DNA, 21 bp, Homo sapiens
gccctgccctcactccactcc

SEQ ID NO: 462064 - DNA, 12 bp, Homo sapiens
gccctgccctcc

SEQ ID NO: 462065 - DNA, 17 bp, Homo sapiens
gccctgccctcccccac

SEQ ID NO: 462066 - DNA, 19 bp, Homo sapiens
gccctgccctcccccacgg

SEQ ID NO: 462067 - DNA, 16 bp, Homo sapiens
gccctgctttgggctg

SEQ ID NO: 462068 - DNA, 20 bp, Homo sapiens
gccctgctttgggctgccct

SEQ ID NO: 462069 - DNA, 23 bp, Homo sapiens
gccctgctttgggctgccctggt

SEQ ID NO: 462070 - DNA, 19 bp, Homo sapiens
gccctggctcccacaggcc

SEQ ID NO: 462071 - DNA, 15 bp, Homo sapiens
gccctgggcctcagt

SEQ ID NO: 462072 - DNA, 23 bp, Homo sapiens
gccctgggcctcagttcaacctg

SEQ ID NO: 462073 - DNA, 19 bp, Homo sapiens
gccctggggtctctgagca

SEQ ID NO: 462074 - DNA, 22 bp, Homo sapiens
gccctggggtctctgagcagtg

SEQ ID NO: 462075 - DNA, 23 bp, Homo sapiens
gccctggggtctctgagcagtgg

SEQ ID NO: 462076 - DNA, 16 bp, Homo sapiens
gccctggtgctgccac

SEQ ID NO: 462077 - DNA, 17 bp, Homo sapiens
gccctggtgctgccaca

SEQ ID NO: 462078 - DNA, 23 bp, Homo sapiens
gccctgtgggagtccactttcct

SEQ ID NO: 462079 - DNA, 15 bp, Homo sapiens
gcccttcctctccac

SEQ ID NO: 462080 - DNA, 16 bp, Homo sapiens
gcccttcctctccact

SEQ ID NO: 462081 - DNA, 17 bp, Homo sapiens
gcccttcctctccactg

SEQ ID NO: 462082 - DNA, 23 bp, Homo sapiens
gccgccctgggctgtctgtcacc

SEQ ID NO: 462083 - DNA, 15 bp, Homo sapiens
gccgcctcctccaga

SEQ ID NO: 462084 - DNA, 16 bp, Homo sapiens
gccgcctcgggccgcc

SEQ ID NO: 462085 - DNA, 18 bp, Homo sapiens
ggcaggcacacagcagcc

SEQ ID NO: 462086 - DNA, 17 bp, Homo sapiens
ggcagggttctagaagg

SEQ ID NO: 462087 - DNA, 16 bp, Homo sapiens
ggcaggtcctgcccat

SEQ ID NO: 462088 - DNA, 11 bp, Homo sapiens
ggcagtggaga

SEQ ID NO: 462089 - DNA, 13 bp, Homo sapiens
ggcagtggagagg

SEQ ID NO: 462090 - DNA, 21 bp, Homo sapiens
ggcagtgggacagggcatggc

SEQ ID NO: 462091 - DNA, 16 bp, Homo sapiens
ggccagacgctgccgc

SEQ ID NO: 462092 - DNA, 17 bp, Homo sapiens
ggccagacgctgccgct

SEQ ID NO: 462093 - DNA, 20 bp, Homo sapiens
ggccagcaccctctcctggg

SEQ ID NO: 462094 - DNA, 23 bp, Homo sapiens
ggccagcaccctctcctgggggt

SEQ ID NO: 462095 - DNA, 20 bp, Homo sapiens
ggccagggacccccgaggcc

SEQ ID NO: 462096 - DNA, 14 bp, Homo sapiens
ggccatccctgggc

SEQ ID NO: 462097 - DNA, 19 bp, Homo sapiens
ggccatccctgggcccctc

SEQ ID NO: 462098 - DNA, 21 bp, Homo sapiens
ggccatccctgggcccctcca

SEQ ID NO: 462099 - DNA, 15 bp, Homo sapiens
ggcccacccctcttc

SEQ ID NO: 462100 - DNA, 23 bp, Homo sapiens
ggcccacccctcttcccccttcc

SEQ ID NO: 462101 - DNA, 15 bp, Homo sapiens
ggcccacgcagagcc

SEQ ID NO: 462102 - DNA, 18 bp, Homo sapiens
ggcccacgcagagccccg

SEQ ID NO: 462103 - DNA, 14 bp, Homo sapiens
ggcccatggcccca

SEQ ID NO: 462104 - DNA, 17 bp, Homo sapiens
ggcccatggccccagct

SEQ ID NO: 462105 - DNA, 13 bp, Homo sapiens
ggcccatggtgga

SEQ ID NO: 462106 - DNA, 19 bp, Homo sapiens
ggccccacccaccctctgg

SEQ ID NO: 462107 - DNA, 13 bp, Homo sapiens
ggccccagcctcc

SEQ ID NO: 462108 - DNA, 16 bp, Homo sapiens
ggccccagctggctgg

SEQ ID NO: 462109 - DNA, 19 bp, Homo sapiens
ggccccagctggctgggtc

SEQ ID NO: 462110 - DNA, 21 bp, Homo sapiens
ggccccgcgcgtgcccccagc

SEQ ID NO: 462111 - DNA, 22 bp, Homo sapiens
ggccccgcgcgtgcccccagcg

SEQ ID NO: 462112 - DNA, 21 bp, Homo sapiens
ggcccgagcgcgtgccttccc

SEQ ID NO: 462113 - DNA, 20 bp, Homo sapiens
ggcccggcccacgcagagcc

SEQ ID NO: 462114 - DNA, 17 bp, Homo sapiens
ggcccgtgcgcagccgc

SEQ ID NO: 462115 - DNA, 18 bp, Homo sapiens
ggcccgtgcgcagccgcg

SEQ ID NO: 462116 - DNA, 11 bp, Homo sapiens
ggccctccctg

SEQ ID NO: 462117 - DNA, 13 bp, Homo sapiens
ggccctggctccc

SEQ ID NO: 462118 - DNA, 22 bp, Homo sapiens
ggccctggctcccacaggccct

SEQ ID NO: 462119 - DNA, 13 bp, Homo sapiens
ggccctgggcctc

SEQ ID NO: 462120 - DNA, 19 bp, Homo sapiens
ggccctggggtctctgagc

SEQ ID NO: 462121 - DNA, 17 bp, Homo sapiens
ggccctgtgggagtcca

SEQ ID NO: 462122 - DNA, 23 bp, Homo sapiens
ggcccttcctctccactgccttc

SEQ ID NO: 462123 - DNA, 14 bp, Homo sapiens
ggccgcagggcgct

SEQ ID NO: 462124 - DNA, 16 bp, Homo sapiens
ggccgcagggcgctcc

SEQ ID NO: 462125 - DNA, 17 bp, Homo sapiens
ggccgcagggcgctccg

SEQ ID NO: 462126 - DNA, 15 bp, Homo sapiens
ggccgcctcctccag

SEQ ID NO: 462127 - DNA, 18 bp, Homo sapiens
ggccgcctcctccagact

SEQ ID NO: 462128 - DNA, 20 bp, Homo sapiens
ggccgcctcctccagactcg

SEQ ID NO: 462129 - DNA, 19 bp, Homo sapiens
ggccgggcaggtcctgccc

SEQ ID NO: 462130 - DNA, 19 bp, Homo sapiens
ggccgtccctgacttccca

SEQ ID NO: 462131 - DNA, 21 bp, Homo sapiens
ggccgtccctgacttcccagc

SEQ ID NO: 462132 - DNA, 23 bp, Homo sapiens
ggccgtccctgacttcccagctg

SEQ ID NO: 462133 - DNA, 12 bp, Homo sapiens
ggcctcagccct

SEQ ID NO: 462134 - DNA, 13 bp, Homo sapiens
ggcctccaggctg

SEQ ID NO: 462135 - DNA, 14 bp, Homo sapiens
ggcctccaggctgg

SEQ ID NO: 462136 - DNA, 15 bp, Homo sapiens
ggcctccaggctggg

SEQ ID NO: 462137 - DNA, 16 bp, Homo sapiens
ggcctccaggctgggg

SEQ ID NO: 462138 - DNA, 17 bp, Homo sapiens
ggcctccaggctggggc

SEQ ID NO: 462139 - DNA, 18 bp, Homo sapiens
ggcctccaggctggggcc

SEQ ID NO: 462140 - DNA, 17 bp, Homo sapiens
ggcctgagggaagccca

SEQ ID NO: 462141 - DNA, 20 bp, Homo sapiens
ggcctgagggaagcccaccc

SEQ ID NO: 462142 - DNA, 23 bp, Homo sapiens
ggcctgagggaagcccacccgcc

SEQ ID NO: 462143 - DNA, 12 bp, Homo sapiens
ggcctgcagccc

SEQ ID NO: 462144 - DNA, 17 bp, Homo sapiens
ggcctgcagcccagaac

SEQ ID NO: 462145 - DNA, 21 bp, Homo sapiens
ggcctgccccccttcccaccc

SEQ ID NO: 462146 - DNA, 17 bp, Homo sapiens
ggcctgtccacctgtgc

SEQ ID NO: 462147 - DNA, 19 bp, Homo sapiens
ggcctgtccacctgtgctg

SEQ ID NO: 462148 - DNA, 22 bp, Homo sapiens
ggcctgtccacctgtgctgctg

SEQ ID NO: 462149 - DNA, 23 bp, Homo sapiens
ggcctgtccacctgtgctgctgc

SEQ ID NO: 462150 - DNA, 16 bp, Homo sapiens
ggcgcccacctgccca

SEQ ID NO: 462151 - DNA, 20 bp, Homo sapiens
ggcgcctgcgctcctctgca

SEQ ID NO: 462152 - DNA, 23 bp, Homo sapiens
ggcgcctgcgctcctctgcagcc

SEQ ID NO: 462153 - DNA, 13 bp, Homo sapiens
ggcgcgcaccgcc

SEQ ID NO: 462154 - DNA, 13 bp, Homo sapiens
ggcgctcagaggc

SEQ ID NO: 462155 - DNA, 20 bp, Homo sapiens
ggcgctccggcagaggcagg

SEQ ID NO: 462156 - DNA, 20 bp, Homo sapiens
ggcggaggggcttggagcag

SEQ ID NO: 462157 - DNA, 13 bp, Homo sapiens
ggcggccagggac

SEQ ID NO: 462158 - DNA, 17 bp, Homo sapiens
ggcggccagggaccccc

SEQ ID NO: 462159 - DNA, 18 bp, Homo sapiens
ggcggccagggacccccg

SEQ ID NO: 462160 - DNA, 11 bp, Homo sapiens
ggcgggcagcc

SEQ ID NO: 462161 - DNA, 13 bp, Homo sapiens
ggcgggcagcccc

SEQ ID NO: 462162 - DNA, 19 bp, Homo sapiens
aaacagtgtggcttaaaca

SEQ ID NO: 462163 - DNA, 22 bp, Homo sapiens
aaacagtgtggcttaaacattt

SEQ ID NO: 462164 - DNA, 13 bp, Homo sapiens
aaacattaaacac

SEQ ID NO: 462165 - DNA, 18 bp, Homo sapiens
aaacattaaacactgtaa

SEQ ID NO: 462166 - DNA, 12 bp, Homo sapiens
aaaccacatggg

SEQ ID NO: 462167 - DNA, 20 bp, Homo sapiens
aaaccacctgtccccagtta

SEQ ID NO: 462168 - DNA, 17 bp, Homo sapiens
aaaccgacgacaaatct

SEQ ID NO: 462169 - DNA, 15 bp, Homo sapiens
aaacctgtgctttca

SEQ ID NO: 462170 - DNA, 16 bp, Homo sapiens
aaacctgtgctttcat

SEQ ID NO: 462171 - DNA, 16 bp, Homo sapiens
aaacgagatttgccaa

SEQ ID NO: 462172 - DNA, 15 bp, Homo sapiens
aaactcagttaaaat

SEQ ID NO: 462173 - DNA, 18 bp, Homo sapiens
aaactcttagagaataag

SEQ ID NO: 462174 - DNA, 12 bp, Homo sapiens
aaactcttcaag

SEQ ID NO: 462175 - DNA, 18 bp, Homo sapiens
aaactcttcaaggccaag

SEQ ID NO: 462176 - DNA, 15 bp, Homo sapiens
aaactgttttcatgt

SEQ ID NO: 462177 - DNA, 12 bp, Homo sapiens
aaacttcagcaa

SEQ ID NO: 462178 - DNA, 18 bp, Homo sapiens
aaacttctgaactttgga

SEQ ID NO: 462179 - DNA, 13 bp, Homo sapiens
aaacttgtcagaa

SEQ ID NO: 462180 - DNA, 12 bp, Homo sapiens
aaactttgtcac

SEQ ID NO: 462181 - DNA, 15 bp, Homo sapiens
aaagaaaggcagaga

SEQ ID NO: 462182 - DNA, 18 bp, Homo sapiens
aaagaacccccctcccca

SEQ ID NO: 462183 - DNA, 20 bp, Homo sapiens
aaagacaaatatttctttct

SEQ ID NO: 462184 - DNA, 24 bp, Homo sapiens
aaagagaaaatgctttctcatgca

SEQ ID NO: 462185 - DNA, 14 bp, Homo sapiens
aaagagaaacacta

SEQ ID NO: 462186 - DNA, 15 bp, Homo sapiens
aaagattccatgggt

SEQ ID NO: 462187 - DNA, 18 bp, Homo sapiens
aaagcagagatgtattat

SEQ ID NO: 462188 - DNA, 20 bp, Homo sapiens
aaagcaggaaagatcccaag

SEQ ID NO: 462189 - DNA, 15 bp, Homo sapiens
aaagctatatatgaa

SEQ ID NO: 462190 - DNA, 20 bp, Homo sapiens
aaaggaaacaagctttggct

SEQ ID NO: 462191 - DNA, 20 bp, Homo sapiens
aaaggatcatggtttttgct

SEQ ID NO: 462192 - DNA, 19 bp, Homo sapiens
aaagggcagcccctcccca

SEQ ID NO: 462193 - DNA, 18 bp, Homo sapiens
aaagtaataactgttaga

SEQ ID NO: 462194 - DNA, 15 bp, Homo sapiens
aaagtcaaactttca

SEQ ID NO: 462195 - DNA, 23 bp, Homo sapiens
aaagtcacagccgtttgaatata

SEQ ID NO: 462196 - DNA, 20 bp, Homo sapiens
aaagttctattatctgggtt

SEQ ID NO: 462197 - DNA, 21 bp, Homo sapiens
aaagttctattatctgggttt

SEQ ID NO: 462198 - DNA, 16 bp, Homo sapiens
aaataaactcttcaag

SEQ ID NO: 462199 - DNA, 20 bp, Homo sapiens
aaataaactcttcaaggcca

SEQ ID NO: 462200 - DNA, 13 bp, Homo sapiens
aaataaatctaaa

SEQ ID NO: 462201 - DNA, 15 bp, Homo sapiens
aaataacatctgaaa

SEQ ID NO: 462202 - DNA, 16 bp, Homo sapiens
aaataaccaaaaaatg

SEQ ID NO: 462203 - DNA, 20 bp, Homo sapiens
aaataagccccctcaactac

SEQ ID NO: 462204 - DNA, 16 bp, Homo sapiens
aaatactcagcaactg

SEQ ID NO: 462205 - DNA, 18 bp, Homo sapiens
aaatagttccattctatg

SEQ ID NO: 462206 - DNA, 13 bp, Homo sapiens
aaatagttctatt

SEQ ID NO: 462207 - DNA, 17 bp, Homo sapiens
aaatagttctatttcta

SEQ ID NO: 462208 - DNA, 17 bp, Homo sapiens
aaatagtttcaaatgag

SEQ ID NO: 462209 - DNA, 15 bp, Homo sapiens
aaatatctatttatc

SEQ ID NO: 462210 - DNA, 15 bp, Homo sapiens
aaatattctgtcatt

SEQ ID NO: 462211 - DNA, 13 bp, Homo sapiens
aaatatttctaag

SEQ ID NO: 462212 - DNA, 19 bp, Homo sapiens
aaatatttttttctagcta

SEQ ID NO: 462213 - DNA, 18 bp, Homo sapiens
aaatcagattagaccagt

SEQ ID NO: 462214 - DNA, 21 bp, Homo sapiens
aaatgagaaattgtgccaaag

SEQ ID NO: 462215 - DNA, 20 bp, Homo sapiens
aaatgagtttaaaaaaataa

SEQ ID NO: 462216 - DNA, 21 bp, Homo sapiens
aaatgagtttaaaaaaataac

SEQ ID NO: 462217 - DNA, 12 bp, Homo sapiens
aaatgatagata

SEQ ID NO: 462218 - DNA, 11 bp, Homo sapiens
aaatgattcca

SEQ ID NO: 462219 - DNA, 15 bp, Homo sapiens
aaatgattccaaata

SEQ ID NO: 462220 - DNA, 14 bp, Homo sapiens
aaatgcaatgtgaa

SEQ ID NO: 462221 - DNA, 16 bp, Homo sapiens
aaatgcatgatattgt

SEQ ID NO: 462222 - DNA, 20 bp, Homo sapiens
aaatgcatgatattgtatgt

SEQ ID NO: 462223 - DNA, 11 bp, Homo sapiens
aaatgctttct

SEQ ID NO: 462224 - DNA, 12 bp, Homo sapiens
aaatgctttctc

SEQ ID NO: 462225 - DNA, 13 bp, Homo sapiens
aaatgctttctca

SEQ ID NO: 462226 - DNA, 15 bp, Homo sapiens
aaatgctttctcatg

SEQ ID NO: 462227 - DNA, 14 bp, Homo sapiens
aaatggacttttgt

SEQ ID NO: 462228 - DNA, 13 bp, Homo sapiens
aaatgtctgtttc

SEQ ID NO: 462229 - DNA, 17 bp, Homo sapiens
aaatgtgagctataatg

SEQ ID NO: 462230 - DNA, 15 bp, Homo sapiens
aaattataatgcatc

SEQ ID NO: 462231 - DNA, 17 bp, Homo sapiens
aaattatatgatatgca

SEQ ID NO: 462232 - DNA, 24 bp, Homo sapiens
aaattattactttaaattatatga

SEQ ID NO: 462233 - DNA, 13 bp, Homo sapiens
aaattattctagt

SEQ ID NO: 462234 - DNA, 20 bp, Homo sapiens
aaattcaacacttattttct

SEQ ID NO: 462235 - DNA, 16 bp, Homo sapiens
aaattggctcctttcc

SEQ ID NO: 462236 - DNA, 19 bp, Homo sapiens
aaattggctcctttcccac

SEQ ID NO: 462237 - DNA, 14 bp, Homo sapiens
aaatttaatatact

SEQ ID NO: 462238 - DNA, 16 bp, Homo sapiens
aaatttaatatactgc

SEQ ID NO: 462239 - DNA, 15 bp, Homo sapiens
aaatttttactcagg

SEQ ID NO: 462240 - DNA, 14 bp, Homo sapiens
aacaagatttccct

SEQ ID NO: 462241 - DNA, 20 bp, Homo sapiens
aacaagatttccctaaaaat

SEQ ID NO: 462242 - DNA, 21 bp, Homo sapiens
aacaagccaaacattcttatt

SEQ ID NO: 462243 - DNA, 20 bp, Homo sapiens
aacaagccacgttgcagaaa

SEQ ID NO: 462244 - DNA, 18 bp, Homo sapiens
aacaaggaaggacatttc

SEQ ID NO: 462245 - DNA, 23 bp, Homo sapiens
aacaatgccttgttgtattcctg

SEQ ID NO: 462246 - DNA, 17 bp, Homo sapiens
aacacaattttcacttt

SEQ ID NO: 462247 - DNA, 14 bp, Homo sapiens
aacactaatggcca

SEQ ID NO: 462248 - DNA, 16 bp, Homo sapiens
aacactgcttaaggaa

SEQ ID NO: 462249 - DNA, 15 bp, Homo sapiens
aacacttattttctg

SEQ ID NO: 462250 - DNA, 15 bp, Homo sapiens
aacagacaccctcca

SEQ ID NO: 462251 - DNA, 13 bp, Homo sapiens
aacagaccagcat

SEQ ID NO: 462252 - DNA, 17 bp, Homo sapiens
aacagcaattttcataa

SEQ ID NO: 462253 - DNA, 15 bp, Homo sapiens
aacagcatgtctact

SEQ ID NO: 462254 - DNA, 15 bp, Homo sapiens
aacagccaaagaaac

SEQ ID NO: 462255 - DNA, 16 bp, Homo sapiens
aacagccaaagaaact

SEQ ID NO: 462256 - DNA, 18 bp, Homo sapiens
aacagtggcaagctacca

SEQ ID NO: 462257 - DNA, 12 bp, Homo sapiens
aacagtgtggct

SEQ ID NO: 462258 - DNA, 11 bp, Homo sapiens
aacatattctt

SEQ ID NO: 462259 - DNA, 21 bp, Homo sapiens
aacatattcttgctttcacaa

SEQ ID NO: 462260 - DNA, 18 bp, Homo sapiens
aatggtttttatttctcg

SEQ ID NO: 462261 - DNA, 19 bp, Homo sapiens
aatgtccccattctataaa

SEQ ID NO: 462262 - DNA, 11 bp, Homo sapiens
aatgtgccaaa

SEQ ID NO: 462263 - DNA, 22 bp, Homo sapiens
aatgtgcttttccatctaaaat

SEQ ID NO: 462264 - DNA, 20 bp, Homo sapiens
aatgtggaaaaaatatttta

SEQ ID NO: 462265 - DNA, 15 bp, Homo sapiens
aatgtggatgctctt

SEQ ID NO: 462266 - DNA, 15 bp, Homo sapiens
aatgttacagaatct

SEQ ID NO: 462267 - DNA, 16 bp, Homo sapiens
aatgttatatcatcaa

SEQ ID NO: 462268 - DNA, 21 bp, Homo sapiens
aatgttccgttcatctgagga

SEQ ID NO: 462269 - DNA, 21 bp, Homo sapiens
aatgttctgaataatttctta

SEQ ID NO: 462270 - DNA, 14 bp, Homo sapiens
aattaaattttaat

SEQ ID NO: 462271 - DNA, 14 bp, Homo sapiens
aattacaattgtca

SEQ ID NO: 462272 - DNA, 15 bp, Homo sapiens
aattatatgatatgc

SEQ ID NO: 462273 - DNA, 16 bp, Homo sapiens
aattatatgatatgca

SEQ ID NO: 462274 - DNA, 20 bp, Homo sapiens
aattatatgatatgcatgta

SEQ ID NO: 462275 - DNA, 14 bp, Homo sapiens
aattatgtttacct

SEQ ID NO: 462276 - DNA, 13 bp, Homo sapiens
aattattctagtc

SEQ ID NO: 462277 - DNA, 16 bp, Homo sapiens
aattcaacaaatgatg

SEQ ID NO: 462278 - DNA, 19 bp, Homo sapiens
aattcaacaaatgatgttg

SEQ ID NO: 462279 - DNA, 14 bp, Homo sapiens
aattcaactctgtg

SEQ ID NO: 462280 - DNA, 22 bp, Homo sapiens
aattcaactctgtgtcccagca

SEQ ID NO: 462281 - DNA, 15 bp, Homo sapiens
aattcataaaaataa

SEQ ID NO: 462282 - DNA, 16 bp, Homo sapiens
aattcataaaaataac

SEQ ID NO: 462283 - DNA, 15 bp, Homo sapiens
aattctagtctctga

SEQ ID NO: 462284 - DNA, 14 bp, Homo sapiens
aattcttgaataaa

SEQ ID NO: 462285 - DNA, 14 bp, Homo sapiens
aattcttgcactgt

SEQ ID NO: 462286 - DNA, 15 bp, Homo sapiens
aattcttttcccaga

SEQ ID NO: 462287 - DNA, 20 bp, Homo sapiens
aattgaaccgtcaatgtgaa

SEQ ID NO: 462288 - DNA, 21 bp, Homo sapiens
aattgaaccgtcaatgtgaaa

SEQ ID NO: 462289 - DNA, 14 bp, Homo sapiens
aattggaaaggact

SEQ ID NO: 462290 - DNA, 12 bp, Homo sapiens
aattggctcctt

SEQ ID NO: 462291 - DNA, 22 bp, Homo sapiens
aattggctcctttcccacagtc

SEQ ID NO: 462292 - DNA, 23 bp, Homo sapiens
aattggcttgtttaaggttcttg

SEQ ID NO: 462293 - DNA, 14 bp, Homo sapiens
aattgtttcttgac

SEQ ID NO: 462294 - DNA, 13 bp, Homo sapiens
aatttaactgcat

SEQ ID NO: 462295 - DNA, 17 bp, Homo sapiens
aatttaatatactgcat

SEQ ID NO: 462296 - DNA, 17 bp, Homo sapiens
aatttatttcatccagt

SEQ ID NO: 462297 - DNA, 13 bp, Homo sapiens
aatttcaaaatgc

SEQ ID NO: 462298 - DNA, 18 bp, Homo sapiens
aatttcaaaatgcatgtg

SEQ ID NO: 462299 - DNA, 22 bp, Homo sapiens
aatttcaaaatgcatgtgattg

SEQ ID NO: 462300 - DNA, 14 bp, Homo sapiens
aatttcataaattg

SEQ ID NO: 462301 - DNA, 13 bp, Homo sapiens
aatttctggtttg

SEQ ID NO: 462302 - DNA, 18 bp, Homo sapiens
aattttaaaaaataacat

SEQ ID NO: 462303 - DNA, 13 bp, Homo sapiens
aattttaatgtaa

SEQ ID NO: 462304 - DNA, 23 bp, Homo sapiens
aattttaatgtaaaattcatagc

SEQ ID NO: 462305 - DNA, 21 bp, Homo sapiens
aattttcataataaaaggcat

SEQ ID NO: 462306 - DNA, 17 bp, Homo sapiens
aatttttactcaggctt

SEQ ID NO: 462307 - DNA, 13 bp, Homo sapiens
acaaaatatttct

SEQ ID NO: 462308 - DNA, 19 bp, Homo sapiens
acaaacgtaatttgttata

SEQ ID NO: 462309 - DNA, 20 bp, Homo sapiens
acaaagctgtcactcacaaa

SEQ ID NO: 462310 - DNA, 22 bp, Homo sapiens
acaaatatagttgaacaagatt

SEQ ID NO: 462311 - DNA, 20 bp, Homo sapiens
acaaatatttcacttaaact

SEQ ID NO: 462312 - DNA, 14 bp, Homo sapiens
acaaatttttactc

SEQ ID NO: 462313 - DNA, 22 bp, Homo sapiens
acaaatttttactcaggctttc

SEQ ID NO: 462314 - DNA, 12 bp, Homo sapiens
acaacaggcatt

SEQ ID NO: 462315 - DNA, 13 bp, Homo sapiens
acaactctatttt

SEQ ID NO: 462316 - DNA, 17 bp, Homo sapiens
acaagccacgttgcaga

SEQ ID NO: 462317 - DNA, 19 bp, Homo sapiens
acaagccacgttgcagaaa

SEQ ID NO: 462318 - DNA, 23 bp, Homo sapiens
acaagtatgaataaagacaccta

SEQ ID NO: 462319 - DNA, 13 bp, Homo sapiens
acaataaacgaaa

SEQ ID NO: 462320 - DNA, 15 bp, Homo sapiens
acaataatgaataat

SEQ ID NO: 462321 - DNA, 18 bp, Homo sapiens
acaatttcaaaatgcatg

SEQ ID NO: 462322 - DNA, 14 bp, Homo sapiens
acacacacccttcc

SEQ ID NO: 462323 - DNA, 12 bp, Homo sapiens
acacacccttcc

SEQ ID NO: 462324 - DNA, 17 bp, Homo sapiens
acacagtattgacttct

SEQ ID NO: 462325 - DNA, 16 bp, Homo sapiens
acacagttggaagcag

SEQ ID NO: 462326 - DNA, 14 bp, Homo sapiens
acacagttttgtct

SEQ ID NO: 462327 - DNA, 20 bp, Homo sapiens
acacataaatctgtctgatt

SEQ ID NO: 462328 - DNA, 19 bp, Homo sapiens
acaccaccccttgcccaac

SEQ ID NO: 462329 - DNA, 16 bp, Homo sapiens
acaccagaagtgccat

SEQ ID NO: 462330 - DNA, 22 bp, Homo sapiens
acaccatctggagtcttcctgt

SEQ ID NO: 462331 - DNA, 21 bp, Homo sapiens
acacccaattttaaaaaataa

SEQ ID NO: 462332 - DNA, 18 bp, Homo sapiens
acaccccgtctgcccctt

SEQ ID NO: 462333 - DNA, 17 bp, Homo sapiens
acaccctccactctgag

SEQ ID NO: 462334 - DNA, 22 bp, Homo sapiens
acaccctccactctgaggtctc

SEQ ID NO: 462335 - DNA, 23 bp, Homo sapiens
acaccctccactctgaggtctca

SEQ ID NO: 462336 - DNA, 16 bp, Homo sapiens
acaccgggcctggaga

SEQ ID NO: 462337 - DNA, 15 bp, Homo sapiens
acacgccggggctgg

SEQ ID NO: 462338 - DNA, 22 bp, Homo sapiens
acacgccggggctggccctgcc

SEQ ID NO: 462339 - DNA, 13 bp, Homo sapiens
acactaatggcca

SEQ ID NO: 462340 - DNA, 16 bp, Homo sapiens
acactagtagctgttt

SEQ ID NO: 462341 - DNA, 15 bp, Homo sapiens
acactctgccttcct

SEQ ID NO: 462342 - DNA, 21 bp, Homo sapiens
acactctgccttcctgagtcc

SEQ ID NO: 462343 - DNA, 17 bp, Homo sapiens
acactgatgggtcctgc

SEQ ID NO: 462344 - DNA, 14 bp, Homo sapiens
acactgcttaagga

SEQ ID NO: 462345 - DNA, 18 bp, Homo sapiens
acactgtatctaaaaaat

SEQ ID NO: 462346 - DNA, 19 bp, Homo sapiens
acactgtatctaaaaaata

SEQ ID NO: 462347 - DNA, 20 bp, Homo sapiens
acactgtatctaaaaaataa

SEQ ID NO: 462348 - DNA, 21 bp, Homo sapiens
acagaaccaacgggtctgtgg

SEQ ID NO: 462349 - DNA, 20 bp, Homo sapiens
acagaaccagcactcccagg

SEQ ID NO: 462350 - DNA, 22 bp, Homo sapiens
acagaaccagcactcccagggc

SEQ ID NO: 462351 - DNA, 15 bp, Homo sapiens
acagaacctttgtca

SEQ ID NO: 462352 - DNA, 16 bp, Homo sapiens
acagaacctttgtcaa

SEQ ID NO: 462353 - DNA, 14 bp, Homo sapiens
acagacagaatata

SEQ ID NO: 462354 - DNA, 18 bp, Homo sapiens
acagacctccagattatt

SEQ ID NO: 462355 - DNA, 21 bp, Homo sapiens
acagacctccagattattttc

SEQ ID NO: 462356 - DNA, 16 bp, Homo sapiens
acagagaaggcagcag

SEQ ID NO: 462357 - DNA, 14 bp, Homo sapiens
acagagctggatgc

SEQ ID NO: 462358 - DNA, 22 bp, Homo sapiens
actccaaggtggcatagccatt

SEQ ID NO: 462359 - DNA, 15 bp, Homo sapiens
actccagacccctgg

SEQ ID NO: 462360 - DNA, 13 bp, Homo sapiens
actcccagggccc

SEQ ID NO: 462361 - DNA, 20 bp, Homo sapiens
actccctttgtggactttat

SEQ ID NO: 462362 - DNA, 17 bp, Homo sapiens
actccgcccagcctctc

SEQ ID NO: 462363 - DNA, 18 bp, Homo sapiens
actccgcccagcctctcc

SEQ ID NO: 462364 - DNA, 20 bp, Homo sapiens
actcctcccaactctggcct

SEQ ID NO: 462365 - DNA, 12 bp, Homo sapiens
actcctcccagg

SEQ ID NO: 462366 - DNA, 19 bp, Homo sapiens
actccttaaccacctagtc

SEQ ID NO: 462367 - DNA, 16 bp, Homo sapiens
actcgactctgctgct

SEQ ID NO: 462368 - DNA, 23 bp, Homo sapiens
actctaagaaatggctttccaca

SEQ ID NO: 462369 - DNA, 20 bp, Homo sapiens
actctacttagcatgtccct

SEQ ID NO: 462370 - DNA, 22 bp, Homo sapiens
actctattttttactacataat

SEQ ID NO: 462371 - DNA, 20 bp, Homo sapiens
actctctcctctctctccct

SEQ ID NO: 462372 - DNA, 21 bp, Homo sapiens
actctgaagtcccttcctgtc

SEQ ID NO: 462373 - DNA, 22 bp, Homo sapiens
actctgaagtcccttcctgtcc

SEQ ID NO: 462374 - DNA, 14 bp, Homo sapiens
actctgaggtctca

SEQ ID NO: 462375 - DNA, 17 bp, Homo sapiens
actctgcatagacaaag

SEQ ID NO: 462376 - DNA, 23 bp, Homo sapiens
actctgctgctcatgggaagaac

SEQ ID NO: 462377 - DNA, 23 bp, Homo sapiens
actctggccttggttcctccagc

SEQ ID NO: 462378 - DNA, 15 bp, Homo sapiens
actctgtcagccagc

SEQ ID NO: 462379 - DNA, 14 bp, Homo sapiens
actctgtgtaatct

SEQ ID NO: 462380 - DNA, 18 bp, Homo sapiens
actctgtgtaatctctga

SEQ ID NO: 462381 - DNA, 14 bp, Homo sapiens
actcttcaaggcca

SEQ ID NO: 462382 - DNA, 16 bp, Homo sapiens
actcttcagagaaatc

SEQ ID NO: 462383 - DNA, 21 bp, Homo sapiens
actcttgtctcctcctccagg

SEQ ID NO: 462384 - DNA, 19 bp, Homo sapiens
actgatatcacgggcccgc

SEQ ID NO: 462385 - DNA, 16 bp, Homo sapiens
actgcacagtgcatct

SEQ ID NO: 462386 - DNA, 23 bp, Homo sapiens
actgcacagtgcatctcagccca

SEQ ID NO: 462387 - DNA, 14 bp, Homo sapiens
actgcatgcaagct

SEQ ID NO: 462388 - DNA, 16 bp, Homo sapiens
actgcatgcaagctca

SEQ ID NO: 462389 - DNA, 17 bp, Homo sapiens
actgcatgcaagctcag

SEQ ID NO: 462390 - DNA, 20 bp, Homo sapiens
actgccattagactgaattt

SEQ ID NO: 462391 - DNA, 14 bp, Homo sapiens
actgcccaccctgg

SEQ ID NO: 462392 - DNA, 13 bp, Homo sapiens
actgctggctgcc

SEQ ID NO: 462393 - DNA, 13 bp, Homo sapiens
actgctgttttat

SEQ ID NO: 462394 - DNA, 12 bp, Homo sapiens
actgctttgtag

SEQ ID NO: 462395 - DNA, 16 bp, Homo sapiens
actggaaacaaggaag

SEQ ID NO: 462396 - DNA, 16 bp, Homo sapiens
actggcccacccctct

SEQ ID NO: 462397 - DNA, 23 bp, Homo sapiens
actggcccacccctcttccccct

SEQ ID NO: 462398 - DNA, 10 bp, Homo sapiens
actggcccca

SEQ ID NO: 462399 - DNA, 16 bp, Homo sapiens
actggccccaggcgga

SEQ ID NO: 462400 - DNA, 23 bp, Homo sapiens
actgggaaataagcaaaaaactg

SEQ ID NO: 462401 - DNA, 21 bp, Homo sapiens
actggtgcatttaaaatggac

SEQ ID NO: 462402 - DNA, 20 bp, Homo sapiens
actggtggcccgacagcctg

SEQ ID NO: 462403 - DNA, 20 bp, Homo sapiens
actggttatagttgatatgt

SEQ ID NO: 462404 - DNA, 15 bp, Homo sapiens
actgtaatcttaaaa

SEQ ID NO: 462405 - DNA, 17 bp, Homo sapiens
actgtaatcttaaaagt

SEQ ID NO: 462406 - DNA, 12 bp, Homo sapiens
actgtatctaaa

SEQ ID NO: 462407 - DNA, 18 bp, Homo sapiens
actgtatctaaaaaataa

SEQ ID NO: 462408 - DNA, 19 bp, Homo sapiens
actgtatctaaaaaataac

SEQ ID NO: 462409 - DNA, 22 bp, Homo sapiens
actgtcccacaaaatatttcta

SEQ ID NO: 462410 - DNA, 20 bp, Homo sapiens
actgtctcaagagggcactg

SEQ ID NO: 462411 - DNA, 18 bp, Homo sapiens
actgtcttcaaccctgcc

SEQ ID NO: 462412 - DNA, 22 bp, Homo sapiens
actgtttgtaatatacagtttt

SEQ ID NO: 462413 - DNA, 15 bp, Homo sapiens
actgttttcatgtgt

SEQ ID NO: 462414 - DNA, 13 bp, Homo sapiens
actgttttgtgcg

SEQ ID NO: 462415 - DNA, 13 bp, Homo sapiens
acttaaaagaaca

SEQ ID NO: 462416 - DNA, 17 bp, Homo sapiens
acttaaacctgtgcttt

SEQ ID NO: 462417 - DNA, 19 bp, Homo sapiens
acttaaacctgtgctttca

SEQ ID NO: 462418 - DNA, 15 bp, Homo sapiens
acttaaactttgtca

SEQ ID NO: 462419 - DNA, 19 bp, Homo sapiens
acttactgtcagagaatat

SEQ ID NO: 462420 - DNA, 17 bp, Homo sapiens
acttatgctgctgtgaa

SEQ ID NO: 462421 - DNA, 15 bp, Homo sapiens
acttattttctgaat

SEQ ID NO: 462422 - DNA, 22 bp, Homo sapiens
acttattttctgaattcataaa

SEQ ID NO: 462423 - DNA, 13 bp, Homo sapiens
acttcagactctc

SEQ ID NO: 462424 - DNA, 18 bp, Homo sapiens
acttcagactctctcctc

SEQ ID NO: 462425 - DNA, 19 bp, Homo sapiens
acttcagactctctcctct

SEQ ID NO: 462426 - DNA, 22 bp, Homo sapiens
acttcagcaaccctacagtata

SEQ ID NO: 462427 - DNA, 16 bp, Homo sapiens
acttcaggctcttctc

SEQ ID NO: 462428 - DNA, 18 bp, Homo sapiens
acttcaggctcttctcct

SEQ ID NO: 462429 - DNA, 12 bp, Homo sapiens
acttcccagctg

SEQ ID NO: 462430 - DNA, 17 bp, Homo sapiens
acttcctggattttctt

SEQ ID NO: 462431 - DNA, 17 bp, Homo sapiens
acttctatttatttatt

SEQ ID NO: 462432 - DNA, 21 bp, Homo sapiens
acttctcaaatgctactcagt

SEQ ID NO: 462433 - DNA, 12 bp, Homo sapiens
acttctgcagct

SEQ ID NO: 462434 - DNA, 19 bp, Homo sapiens
acttctttttggcattatc

SEQ ID NO: 462435 - DNA, 22 bp, Homo sapiens
acttgactataaaaactgcccc

SEQ ID NO: 462436 - DNA, 15 bp, Homo sapiens
acttgagcccactcc

SEQ ID NO: 462437 - DNA, 20 bp, Homo sapiens
acttgctagtgatacactgt

SEQ ID NO: 462438 - DNA, 22 bp, Homo sapiens
acttgctagtgatacactgtat

SEQ ID NO: 462439 - DNA, 15 bp, Homo sapiens
acttgctcaataaag

SEQ ID NO: 462440 - DNA, 19 bp, Homo sapiens
acttgctcaataaaggtca

SEQ ID NO: 462441 - DNA, 23 bp, Homo sapiens
acttggataggagcttccagatg

SEQ ID NO: 462442 - DNA, 15 bp, Homo sapiens
acttgtgttcaatct

SEQ ID NO: 462443 - DNA, 13 bp, Homo sapiens
actttaaattata

SEQ ID NO: 462444 - DNA, 18 bp, Homo sapiens
actttaaattatatgata

SEQ ID NO: 462445 - DNA, 17 bp, Homo sapiens
actttagtatttttact

SEQ ID NO: 462446 - DNA, 13 bp, Homo sapiens
actttatttaatt

SEQ ID NO: 462447 - DNA, 18 bp, Homo sapiens
actttatttaatttcata

SEQ ID NO: 462448 - DNA, 21 bp, Homo sapiens
actttatttaatttcataaat

SEQ ID NO: 462449 - DNA, 23 bp, Homo sapiens
actttatttaatttcataaattg

SEQ ID NO: 462450 - DNA, 15 bp, Homo sapiens
actttcctctctctc

SEQ ID NO: 462451 - DNA, 12 bp, Homo sapiens
actttgcctgcc

SEQ ID NO: 462452 - DNA, 18 bp, Homo sapiens
actttttctaagctgttt

SEQ ID NO: 462453 - DNA, 19 bp, Homo sapiens
actttttctaagctgtttc

SEQ ID NO: 462454 - DNA, 12 bp, Homo sapiens
acttttttataa

SEQ ID NO: 462455 - DNA, 14 bp, Homo sapiens
agcccctcctctcc

SEQ ID NO: 462456 - DNA, 16 bp, Homo sapiens
agcccctgctggacca

SEQ ID NO: 462457 - DNA, 21 bp, Homo sapiens
agcccggccaaggacactgat

SEQ ID NO: 462458 - DNA, 22 bp, Homo sapiens
agcccggccaaggacactgatg

SEQ ID NO: 462459 - DNA, 16 bp, Homo sapiens
agccctcccccttccc

SEQ ID NO: 462460 - DNA, 22 bp, Homo sapiens
agccctcccccttccccttctg

SEQ ID NO: 462461 - DNA, 18 bp, Homo sapiens
agccctctccacccagag

SEQ ID NO: 462462 - DNA, 20 bp, Homo sapiens
agccctctccacccagaggt

SEQ ID NO: 462463 - DNA, 15 bp, Homo sapiens
agccctctttctctc

SEQ ID NO: 462464 - DNA, 19 bp, Homo sapiens
agccctctttctctctgtg

SEQ ID NO: 462465 - DNA, 22 bp, Homo sapiens
agccctctttctctctgtgtgg

SEQ ID NO: 462466 - DNA, 16 bp, Homo sapiens
agccctgagactcccg

SEQ ID NO: 462467 - DNA, 20 bp, Homo sapiens
agccctgagcccagaaaaaa

SEQ ID NO: 462468 - DNA, 14 bp, Homo sapiens
agccctgccctcac

SEQ ID NO: 462469 - DNA, 16 bp, Homo sapiens
agccctgccctcactc

SEQ ID NO: 462470 - DNA, 17 bp, Homo sapiens
agccctgccctcactcc

SEQ ID NO: 462471 - DNA, 20 bp, Homo sapiens
agccctgccctcactccact

SEQ ID NO: 462472 - DNA, 23 bp, Homo sapiens
agccctgccctcactccactccc

SEQ ID NO: 462473 - DNA, 21 bp, Homo sapiens
agccctgctttgggctgccct

SEQ ID NO: 462474 - DNA, 22 bp, Homo sapiens
agccctgctttgggctgccctg

SEQ ID NO: 462475 - DNA, 16 bp, Homo sapiens
agccgcgctctgcccc

SEQ ID NO: 462476 - DNA, 15 bp, Homo sapiens
agccgtgccttcagc

SEQ ID NO: 462477 - DNA, 21 bp, Homo sapiens
agccgtggcttcccgctcagc

SEQ ID NO: 462478 - DNA, 11 bp, Homo sapiens
agcctcacctt

SEQ ID NO: 462479 - DNA, 13 bp, Homo sapiens
agcctcccccagg

SEQ ID NO: 462480 - DNA, 15 bp, Homo sapiens
agcctcccccaggct

SEQ ID NO: 462481 - DNA, 17 bp, Homo sapiens
agcctcccccaggctgc

SEQ ID NO: 462482 - DNA, 17 bp, Homo sapiens
agcctcctaggctccct

SEQ ID NO: 462483 - DNA, 13 bp, Homo sapiens
agcctgagccaca

SEQ ID NO: 462484 - DNA, 19 bp, Homo sapiens
agcctgagccacagtgggg

SEQ ID NO: 462485 - DNA, 12 bp, Homo sapiens
agcctgagctcc

SEQ ID NO: 462486 - DNA, 14 bp, Homo sapiens
agcctgagctccac

SEQ ID NO: 462487 - DNA, 16 bp, Homo sapiens
agcctgagctccaccc

SEQ ID NO: 462488 - DNA, 17 bp, Homo sapiens
agcctgagctccaccct

SEQ ID NO: 462489 - DNA, 14 bp, Homo sapiens
agcctgaggaagtt

SEQ ID NO: 462490 - DNA, 18 bp, Homo sapiens
agcctggcacagggcagt

SEQ ID NO: 462491 - DNA, 15 bp, Homo sapiens
agcctgggaaataag

SEQ ID NO: 462492 - DNA, 21 bp, Homo sapiens
agcctgggaaataagccccct

SEQ ID NO: 462493 - DNA, 18 bp, Homo sapiens
agcctggtgttgttcttc

SEQ ID NO: 462494 - DNA, 13 bp, Homo sapiens
agcctgtctctcc

SEQ ID NO: 462495 - DNA, 15 bp, Homo sapiens
agccttaagaaagct

SEQ ID NO: 462496 - DNA, 21 bp, Homo sapiens
agccttaagtcttactgtttt

SEQ ID NO: 462497 - DNA, 18 bp, Homo sapiens
agcctttatctatgggag

SEQ ID NO: 462498 - DNA, 18 bp, Homo sapiens
agcctttgcgctctgggt

SEQ ID NO: 462499 - DNA, 19 bp, Homo sapiens
agcctttggtgaataacct

SEQ ID NO: 462500 - DNA, 15 bp, Homo sapiens
agcgaggcagaatgg

SEQ ID NO: 462501 - DNA, 12 bp, Homo sapiens
agcgcctcccgc

SEQ ID NO: 462502 - DNA, 18 bp, Homo sapiens
agcgcctcccgccgcctc

SEQ ID NO: 462503 - DNA, 15 bp, Homo sapiens
agcgctcctctgcct

SEQ ID NO: 462504 - DNA, 17 bp, Homo sapiens
agcgctcctctgccttg

SEQ ID NO: 462505 - DNA, 17 bp, Homo sapiens
agcggcccggcccacgc

SEQ ID NO: 462506 - DNA, 23 bp, Homo sapiens
agcggcccggcccacgcagagcc

SEQ ID NO: 462507 - DNA, 21 bp, Homo sapiens
agcgggggctaactggcccca

SEQ ID NO: 462508 - DNA, 21 bp, Homo sapiens
agcgtgcagtagagagcaaag

SEQ ID NO: 462509 - DNA, 16 bp, Homo sapiens
agctaatcagcattct

SEQ ID NO: 462510 - DNA, 18 bp, Homo sapiens
agctaccaactaagttgt

SEQ ID NO: 462511 - DNA, 20 bp, Homo sapiens
agctaggttaataggaggac

SEQ ID NO: 462512 - DNA, 16 bp, Homo sapiens
agctataatgtttccc

SEQ ID NO: 462513 - DNA, 20 bp, Homo sapiens
agctatgagagatgtgtcca

SEQ ID NO: 462514 - DNA, 14 bp, Homo sapiens
agctcaatctctgc

SEQ ID NO: 462515 - DNA, 15 bp, Homo sapiens
agctcaatctctgca

SEQ ID NO: 462516 - DNA, 12 bp, Homo sapiens
agctcaggagaa

SEQ ID NO: 462517 - DNA, 19 bp, Homo sapiens
agctcaggagaaggcctgc

SEQ ID NO: 462518 - DNA, 22 bp, Homo sapiens
agctcagggtgctccctcctca

SEQ ID NO: 462519 - DNA, 14 bp, Homo sapiens
agctcagtacaggg

SEQ ID NO: 462520 - DNA, 15 bp, Homo sapiens
agctcagtacagggc

SEQ ID NO: 462521 - DNA, 21 bp, Homo sapiens
agctcatttcggggtcaggtg

SEQ ID NO: 462522 - DNA, 16 bp, Homo sapiens
agctccaccctcccct

SEQ ID NO: 462523 - DNA, 17 bp, Homo sapiens
agctccaccctcccctc

SEQ ID NO: 462524 - DNA, 13 bp, Homo sapiens
agctccactctga

SEQ ID NO: 462525 - DNA, 18 bp, Homo sapiens
agctctgcataagattat

SEQ ID NO: 462526 - DNA, 22 bp, Homo sapiens
agctctgcataagattatatac

SEQ ID NO: 462527 - DNA, 22 bp, Homo sapiens
agctgagtcggctgggcagggc

SEQ ID NO: 462528 - DNA, 15 bp, Homo sapiens
agctgctcctttggg

SEQ ID NO: 462529 - DNA, 22 bp, Homo sapiens
agctgctgtggtgttcccttgg

SEQ ID NO: 462530 - DNA, 14 bp, Homo sapiens
agctggcagcgcct

SEQ ID NO: 462531 - DNA, 20 bp, Homo sapiens
agctggcagcgcctcccgcc

SEQ ID NO: 462532 - DNA, 19 bp, Homo sapiens
agctggctgggtcgcccct

SEQ ID NO: 462533 - DNA, 21 bp, Homo sapiens
agctggctgggtcgcccctcc

SEQ ID NO: 462534 - DNA, 23 bp, Homo sapiens
agctggctgggtcgcccctcctc

SEQ ID NO: 462535 - DNA, 15 bp, Homo sapiens
agctgtagaaatgta

SEQ ID NO: 462536 - DNA, 23 bp, Homo sapiens
agctgtttcgcatccaccgccac

SEQ ID NO: 462537 - DNA, 11 bp, Homo sapiens
agcttccagat

SEQ ID NO: 462538 - DNA, 13 bp, Homo sapiens
agcttccagatgg

SEQ ID NO: 462539 - DNA, 22 bp, Homo sapiens
agcttcttatattaaagaagtt

SEQ ID NO: 462540 - DNA, 15 bp, Homo sapiens
agcttgaaaactgga

SEQ ID NO: 462541 - DNA, 22 bp, Homo sapiens
agcttgaatgtccccattctat

SEQ ID NO: 462542 - DNA, 17 bp, Homo sapiens
agcttgtttctatactg

SEQ ID NO: 462543 - DNA, 19 bp, Homo sapiens
agcttgtttctatactgtt

SEQ ID NO: 462544 - DNA, 23 bp, Homo sapiens
agctttctaagctttcttacaat

SEQ ID NO: 462545 - DNA, 12 bp, Homo sapiens
aggaaaagagaa

SEQ ID NO: 462546 - DNA, 16 bp, Homo sapiens
aggaaagatcccaagt

SEQ ID NO: 462547 - DNA, 17 bp, Homo sapiens
aggaaagatcccaagtc

SEQ ID NO: 462548 - DNA, 20 bp, Homo sapiens
aggaaagatcccaagtcaaa

SEQ ID NO: 462549 - DNA, 15 bp, Homo sapiens
aggaaagttctatta

SEQ ID NO: 462550 - DNA, 14 bp, Homo sapiens
aggaaataaatcta

SEQ ID NO: 462551 - DNA, 18 bp, Homo sapiens
aggaacttttaaactgca

SEQ ID NO: 462552 - DNA, 22 bp, Homo sapiens
atatgacaatttcaaaatgcat

SEQ ID NO: 462553 - DNA, 18 bp, Homo sapiens
atatgaggggactgcatg

SEQ ID NO: 462554 - DNA, 16 bp, Homo sapiens
atatgattctcctctc

SEQ ID NO: 462555 - DNA, 14 bp, Homo sapiens
atatgattgaaaag

SEQ ID NO: 462556 - DNA, 14 bp, Homo sapiens
atatgcatgtagca

SEQ ID NO: 462557 - DNA, 20 bp, Homo sapiens
atatgcatgtagcatataaa

SEQ ID NO: 462558 - DNA, 15 bp, Homo sapiens
atatgttagcaagag

SEQ ID NO: 462559 - DNA, 15 bp, Homo sapiens
atatgttatttttgg

SEQ ID NO: 462560 - DNA, 16 bp, Homo sapiens
atattaaaaatataca

SEQ ID NO: 462561 - DNA, 12 bp, Homo sapiens
atattaaagaag

SEQ ID NO: 462562 - DNA, 13 bp, Homo sapiens
atattaaagaagt

SEQ ID NO: 462563 - DNA, 10 bp, Homo sapiens
atattataag

SEQ ID NO: 462564 - DNA, 11 bp, Homo sapiens
atattataagt

SEQ ID NO: 462565 - DNA, 15 bp, Homo sapiens
atattataagttgac

SEQ ID NO: 462566 - DNA, 20 bp, Homo sapiens
atattataagttgaccttta

SEQ ID NO: 462567 - DNA, 10 bp, Homo sapiens
atattctgtc

SEQ ID NO: 462568 - DNA, 19 bp, Homo sapiens
atattcttgctttcacaaa

SEQ ID NO: 462569 - DNA, 22 bp, Homo sapiens
atattcttgctttcacaaatat

SEQ ID NO: 462570 - DNA, 16 bp, Homo sapiens
atattctttatatact

SEQ ID NO: 462571 - DNA, 21 bp, Homo sapiens
atattgagatcagcattcaaa

SEQ ID NO: 462572 - DNA, 20 bp, Homo sapiens
atattgctattgtttatagg

SEQ ID NO: 462573 - DNA, 21 bp, Homo sapiens
atattgctattgtttatagga

SEQ ID NO: 462574 - DNA, 14 bp, Homo sapiens
atattggaaacata

SEQ ID NO: 462575 - DNA, 12 bp, Homo sapiens
atattgtatgta

SEQ ID NO: 462576 - DNA, 14 bp, Homo sapiens
atattgtatgtacc

SEQ ID NO: 462577 - DNA, 17 bp, Homo sapiens
atattgtttttatatat

SEQ ID NO: 462578 - DNA, 19 bp, Homo sapiens
atattgtttttatatatta

SEQ ID NO: 462579 - DNA, 18 bp, Homo sapiens
atatttatttctagcaaa

SEQ ID NO: 462580 - DNA, 22 bp, Homo sapiens
atatttcacttaaactttgtca

SEQ ID NO: 462581 - DNA, 20 bp, Homo sapiens
atatttctaagcttatttct

SEQ ID NO: 462582 - DNA, 16 bp, Homo sapiens
atatttggattcacag

SEQ ID NO: 462583 - DNA, 20 bp, Homo sapiens
atattttcaacgcagccctg

SEQ ID NO: 462584 - DNA, 18 bp, Homo sapiens
atcaaagactccgagaag

SEQ ID NO: 462585 - DNA, 20 bp, Homo sapiens
atcaacagcatgtctactgc

SEQ ID NO: 462586 - DNA, 21 bp, Homo sapiens
atcaacagcatgtctactgct

SEQ ID NO: 462587 - DNA, 14 bp, Homo sapiens
atcaatacttttgt

SEQ ID NO: 462588 - DNA, 17 bp, Homo sapiens
atcaatacttttgtgta

SEQ ID NO: 462589 - DNA, 14 bp, Homo sapiens
atcacgggcccgct

SEQ ID NO: 462590 - DNA, 22 bp, Homo sapiens
atcactttgagcctgggaaata

SEQ ID NO: 462591 - DNA, 23 bp, Homo sapiens
atcagaattgaaccgtcaatgtg

SEQ ID NO: 462592 - DNA, 14 bp, Homo sapiens
atcagcattcaaaa

SEQ ID NO: 462593 - DNA, 18 bp, Homo sapiens
atcagcattcaaaatagt

SEQ ID NO: 462594 - DNA, 14 bp, Homo sapiens
atcagctctaaagc

SEQ ID NO: 462595 - DNA, 19 bp, Homo sapiens
atcagggcccaaataacag

SEQ ID NO: 462596 - DNA, 22 bp, Homo sapiens
atcatggtttttgctctacttt

SEQ ID NO: 462597 - DNA, 20 bp, Homo sapiens
atcattgagaaataaagcac

SEQ ID NO: 462598 - DNA, 22 bp, Homo sapiens
atccaaaatagtcatgtttctg

SEQ ID NO: 462599 - DNA, 16 bp, Homo sapiens
atccacaaattcctcc

SEQ ID NO: 462600 - DNA, 15 bp, Homo sapiens
atccacatgaaaata

SEQ ID NO: 462601 - DNA, 23 bp, Homo sapiens
atccaccccggctccccctgcca

SEQ ID NO: 462602 - DNA, 15 bp, Homo sapiens
atccaccgccacccc

SEQ ID NO: 462603 - DNA, 17 bp, Homo sapiens
atccaccgccaccccac

SEQ ID NO: 462604 - DNA, 15 bp, Homo sapiens
atccacctgcagtta

SEQ ID NO: 462605 - DNA, 16 bp, Homo sapiens
atccactaggtgccca

SEQ ID NO: 462606 - DNA, 15 bp, Homo sapiens
atccagtttgttctc

SEQ ID NO: 462607 - DNA, 14 bp, Homo sapiens
atccatatcagctc

SEQ ID NO: 462608 - DNA, 15 bp, Homo sapiens
atccattttctaaac

SEQ ID NO: 462609 - DNA, 11 bp, Homo sapiens
atcccaagtca

SEQ ID NO: 462610 - DNA, 15 bp, Homo sapiens
atcccaccaaccctc

SEQ ID NO: 462611 - DNA, 17 bp, Homo sapiens
atccctcggtcagcacc

SEQ ID NO: 462612 - DNA, 11 bp, Homo sapiens
atccctgggcc

SEQ ID NO: 462613 - DNA, 16 bp, Homo sapiens
atcccttggcccctct

SEQ ID NO: 462614 - DNA, 17 bp, Homo sapiens
atcccttggcccctctc

SEQ ID NO: 462615 - DNA, 22 bp, Homo sapiens
atccggaacagccaaagaaact

SEQ ID NO: 462616 - DNA, 20 bp, Homo sapiens
atccgtttgcaagaaccaga

SEQ ID NO: 462617 - DNA, 19 bp, Homo sapiens
atcctccaaccaggctcct

SEQ ID NO: 462618 - DNA, 12 bp, Homo sapiens
atcctgataaac

SEQ ID NO: 462619 - DNA, 20 bp, Homo sapiens
atcctgataaacattaaaca

SEQ ID NO: 462620 - DNA, 16 bp, Homo sapiens
atcctgcaccctctgc

SEQ ID NO: 462621 - DNA, 17 bp, Homo sapiens
atcctgcaccctctgct

SEQ ID NO: 462622 - DNA, 19 bp, Homo sapiens
atcctgctagctgtagaaa

SEQ ID NO: 462623 - DNA, 15 bp, Homo sapiens
atccttccatcctga

SEQ ID NO: 462624 - DNA, 15 bp, Homo sapiens
atcgagagtttctat

SEQ ID NO: 462625 - DNA, 17 bp, Homo sapiens
atcgtttcacatctgta

SEQ ID NO: 462626 - DNA, 19 bp, Homo sapiens
atcgtttcacatctgtata

SEQ ID NO: 462627 - DNA, 14 bp, Homo sapiens
atctaaaaaataac

SEQ ID NO: 462628 - DNA, 19 bp, Homo sapiens
atctagcaagaagattcta

SEQ ID NO: 462629 - DNA, 18 bp, Homo sapiens
atctatttatctgtctga

SEQ ID NO: 462630 - DNA, 19 bp, Homo sapiens
atctatttatctgtctgag

SEQ ID NO: 462631 - DNA, 17 bp, Homo sapiens
atctctaaaattctagt

SEQ ID NO: 462632 - DNA, 20 bp, Homo sapiens
atctctccacggtagcactt

SEQ ID NO: 462633 - DNA, 17 bp, Homo sapiens
atctctccccatatata

SEQ ID NO: 462634 - DNA, 20 bp, Homo sapiens
atctctccccatatataaat

SEQ ID NO: 462635 - DNA, 23 bp, Homo sapiens
atctctctggggccctgggcctc

SEQ ID NO: 462636 - DNA, 15 bp, Homo sapiens
atctctgattaaatt

SEQ ID NO: 462637 - DNA, 18 bp, Homo sapiens
atctctgattaaatttaa

SEQ ID NO: 462638 - DNA, 19 bp, Homo sapiens
atctctgattaaatttaat

SEQ ID NO: 462639 - DNA, 14 bp, Homo sapiens
atctcttcttcctt

SEQ ID NO: 462640 - DNA, 12 bp, Homo sapiens
atctgaaaagaa

SEQ ID NO: 462641 - DNA, 15 bp, Homo sapiens
atctgaaaagaaatg

SEQ ID NO: 462642 - DNA, 16 bp, Homo sapiens
atctgaggagtccaaa

SEQ ID NO: 462643 - DNA, 16 bp, Homo sapiens
atctgagtccagctcc

SEQ ID NO: 462644 - DNA, 17 bp, Homo sapiens
atctgagtccagctccc

SEQ ID NO: 462645 - DNA, 21 bp, Homo sapiens
atctgagtccagctcccccca

SEQ ID NO: 462646 - DNA, 18 bp, Homo sapiens
atctgattggacattttc

SEQ ID NO: 462647 - DNA, 18 bp, Homo sapiens
atctgcaaatagtttcaa

SEQ ID NO: 462648 - DNA, 17 bp, Homo sapiens
atctgctgcctctgaaa

SEQ ID NO: 462649 - DNA, 22 bp, Homo sapiens
atctgctgcctctgaaaatatt

SEQ ID NO: 462650 - DNA, 21 bp, Homo sapiens
attgaaaagaagaaagtctat

SEQ ID NO: 462651 - DNA, 22 bp, Homo sapiens
attgaaaagaagaaagtctatg

SEQ ID NO: 462652 - DNA, 17 bp, Homo sapiens
attgaaccgtcaatgtg

SEQ ID NO: 462653 - DNA, 19 bp, Homo sapiens
attgaaccgtcaatgtgaa

SEQ ID NO: 462654 - DNA, 21 bp, Homo sapiens
attgaaccgtcaatgtgaaat

SEQ ID NO: 462655 - DNA, 16 bp, Homo sapiens
attgaatgttatatca

SEQ ID NO: 462656 - DNA, 21 bp, Homo sapiens
attgacgacctacatctgaaa

SEQ ID NO: 462657 - DNA, 22 bp, Homo sapiens
attgagatcagcattcaaaata

SEQ ID NO: 462658 - DNA, 23 bp, Homo sapiens
attgagatcagcattcaaaatag

SEQ ID NO: 462659 - DNA, 13 bp, Homo sapiens
attgattaaaagc

SEQ ID NO: 462660 - DNA, 13 bp, Homo sapiens
attggaaaggact

SEQ ID NO: 462661 - DNA, 14 bp, Homo sapiens
attggaaaggactt

SEQ ID NO: 462662 - DNA, 23 bp, Homo sapiens
attggcagcttcaaaacagaacg

SEQ ID NO: 462663 - DNA, 23 bp, Homo sapiens
attggcatctctccccatatata

SEQ ID NO: 462664 - DNA, 15 bp, Homo sapiens
attggctcctttccc

SEQ ID NO: 462665 - DNA, 17 bp, Homo sapiens
attggctcctttcccac

SEQ ID NO: 462666 - DNA, 18 bp, Homo sapiens
attgggcaagtgattgaa

SEQ ID NO: 462667 - DNA, 13 bp, Homo sapiens
attgtatcttcat

SEQ ID NO: 462668 - DNA, 14 bp, Homo sapiens
attgtatgtacctg

SEQ ID NO: 462669 - DNA, 13 bp, Homo sapiens
attgtattcctca

SEQ ID NO: 462670 - DNA, 15 bp, Homo sapiens
attgtgccaaagata

SEQ ID NO: 462671 - DNA, 21 bp, Homo sapiens
attgtgccaaagatagcagaa

SEQ ID NO: 462672 - DNA, 22 bp, Homo sapiens
attgttcaaagaacccccctcc

SEQ ID NO: 462673 - DNA, 19 bp, Homo sapiens
attgtttttatatattata

SEQ ID NO: 462674 - DNA, 23 bp, Homo sapiens
attgtttttatatattataagtt

SEQ ID NO: 462675 - DNA, 19 bp, Homo sapiens
atttaaaatggacttttgt

SEQ ID NO: 462676 - DNA, 18 bp, Homo sapiens
atttaactactaagaata

SEQ ID NO: 462677 - DNA, 22 bp, Homo sapiens
atttaactactaagaataaata

SEQ ID NO: 462678 - DNA, 12 bp, Homo sapiens
atttaactgcat

SEQ ID NO: 462679 - DNA, 14 bp, Homo sapiens
atttaactgcatat

SEQ ID NO: 462680 - DNA, 16 bp, Homo sapiens
atttaatatactgcat

SEQ ID NO: 462681 - DNA, 18 bp, Homo sapiens
atttaatatactgcatat

SEQ ID NO: 462682 - DNA, 21 bp, Homo sapiens
atttaatatactgcatatcct

SEQ ID NO: 462683 - DNA, 12 bp, Homo sapiens
atttaatttcat

SEQ ID NO: 462684 - DNA, 14 bp, Homo sapiens
atttaatttcataa

SEQ ID NO: 462685 - DNA, 18 bp, Homo sapiens
atttaatttcataaattg

SEQ ID NO: 462686 - DNA, 16 bp, Homo sapiens
atttagtatctgtaat

SEQ ID NO: 462687 - DNA, 13 bp, Homo sapiens
atttattaaactt

SEQ ID NO: 462688 - DNA, 16 bp, Homo sapiens
atttattaaacttcag

SEQ ID NO: 462689 - DNA, 18 bp, Homo sapiens
atttattaaacttcagca

SEQ ID NO: 462690 - DNA, 12 bp, Homo sapiens
atttcaaaatgc

SEQ ID NO: 462691 - DNA, 13 bp, Homo sapiens
atttcaaaatgca

SEQ ID NO: 462692 - DNA, 14 bp, Homo sapiens
atttcaaaatgcat

SEQ ID NO: 462693 - DNA, 15 bp, Homo sapiens
atttcaaaatgcatg

SEQ ID NO: 462694 - DNA, 17 bp, Homo sapiens
atttcaaaatgcatgtg

SEQ ID NO: 462695 - DNA, 11 bp, Homo sapiens
atttcataaat

SEQ ID NO: 462696 - DNA, 19 bp, Homo sapiens
atttcatccagtttgttct

SEQ ID NO: 462697 - DNA, 16 bp, Homo sapiens
atttccgtgagagtca

SEQ ID NO: 462698 - DNA, 13 bp, Homo sapiens
atttctaactatt

SEQ ID NO: 462699 - DNA, 20 bp, Homo sapiens
atttctaagcttatttctaa

SEQ ID NO: 462700 - DNA, 17 bp, Homo sapiens
atttctatctgcaaata

SEQ ID NO: 462701 - DNA, 18 bp, Homo sapiens
atttctcgggtgcatttg

SEQ ID NO: 462702 - DNA, 17 bp, Homo sapiens
atttctttgattgtgaa

SEQ ID NO: 462703 - DNA, 22 bp, Homo sapiens
atttgccaaaaactaaaattca

SEQ ID NO: 462704 - DNA, 15 bp, Homo sapiens
attttaaaaaataac

SEQ ID NO: 462705 - DNA, 13 bp, Homo sapiens
attttaataaaga

SEQ ID NO: 462706 - DNA, 14 bp, Homo sapiens
attttaataaagat

SEQ ID NO: 462707 - DNA, 14 bp, Homo sapiens
attttagatttctt

SEQ ID NO: 462708 - DNA, 17 bp, Homo sapiens
attttagatttctttga

SEQ ID NO: 462709 - DNA, 14 bp, Homo sapiens
attttatctcttct

SEQ ID NO: 462710 - DNA, 16 bp, Homo sapiens
attttcatcaagtagc

SEQ ID NO: 462711 - DNA, 17 bp, Homo sapiens
attttctaaactgtttt

SEQ ID NO: 462712 - DNA, 23 bp, Homo sapiens
attttctcccttaggaatataca

SEQ ID NO: 462713 - DNA, 16 bp, Homo sapiens
attttctgaattcata

SEQ ID NO: 462714 - DNA, 18 bp, Homo sapiens
attttctgaattcataaa

SEQ ID NO: 462715 - DNA, 15 bp, Homo sapiens
attttctttctatgt

SEQ ID NO: 462716 - DNA, 16 bp, Homo sapiens
attttctttctatgta

SEQ ID NO: 462717 - DNA, 22 bp, Homo sapiens
attttctttctatgtagaactg

SEQ ID NO: 462718 - DNA, 13 bp, Homo sapiens
attttcttttata

SEQ ID NO: 462719 - DNA, 17 bp, Homo sapiens
attttcttttatatctg

SEQ ID NO: 462720 - DNA, 18 bp, Homo sapiens
attttcttttatatctgt

SEQ ID NO: 462721 - DNA, 20 bp, Homo sapiens
attttcttttatatctgtaa

SEQ ID NO: 462722 - DNA, 23 bp, Homo sapiens
attttgagacaccaataaaagtt

SEQ ID NO: 462723 - DNA, 19 bp, Homo sapiens
attttggaaaatgattagg

SEQ ID NO: 462724 - DNA, 22 bp, Homo sapiens
attttgggaaattcttgcactg

SEQ ID NO: 462725 - DNA, 23 bp, Homo sapiens
attttgggaaattcttgcactgt

SEQ ID NO: 462726 - DNA, 17 bp, Homo sapiens
attttgtctggctgtgg

SEQ ID NO: 462727 - DNA, 21 bp, Homo sapiens
attttttactacataattaaa

SEQ ID NO: 462728 - DNA, 13 bp, Homo sapiens
atttttttctagc

SEQ ID NO: 462729 - DNA, 21 bp, Homo sapiens
atttttttctagctataacaa

SEQ ID NO: 462730 - DNA, 12 bp, Homo sapiens
caaaaaagaaca

SEQ ID NO: 462731 - DNA, 13 bp, Homo sapiens
caaaaaagaacag

SEQ ID NO: 462732 - DNA, 17 bp, Homo sapiens
caaaaacaataaacgaa

SEQ ID NO: 462733 - DNA, 22 bp, Homo sapiens
caaaaataccatttatctacta

SEQ ID NO: 462734 - DNA, 12 bp, Homo sapiens
caaaacagaacg

SEQ ID NO: 462735 - DNA, 19 bp, Homo sapiens
caaaactaccacattctgt

SEQ ID NO: 462736 - DNA, 14 bp, Homo sapiens
caaaagataaaact

SEQ ID NO: 462737 - DNA, 23 bp, Homo sapiens
caaaaggctggatgtgctttcat

SEQ ID NO: 462738 - DNA, 14 bp, Homo sapiens
caaaatagttctat

SEQ ID NO: 462739 - DNA, 16 bp, Homo sapiens
caaaatagttctattt

SEQ ID NO: 462740 - DNA, 18 bp, Homo sapiens
caaaatagttctatttct

SEQ ID NO: 462741 - DNA, 22 bp, Homo sapiens
caaaatagttctatttctatct

SEQ ID NO: 462742 - DNA, 21 bp, Homo sapiens
caaaatatttctaagcttatt

SEQ ID NO: 462743 - DNA, 14 bp, Homo sapiens
caaacattcttatt

SEQ ID NO: 462744 - DNA, 18 bp, Homo sapiens
caaacatttctttttcct

SEQ ID NO: 462745 - DNA, 17 bp, Homo sapiens
caaagaacccccctccc

SEQ ID NO: 462746 - DNA, 16 bp, Homo sapiens
caaagactccgagaag

SEQ ID NO: 462747 - DNA, 17 bp, Homo sapiens
caaagaggccagtactt

SEQ ID NO: 462748 - DNA, 16 bp, Homo sapiens
cagcaaggggctctgc

SEQ ID NO: 462749 - DNA, 14 bp, Homo sapiens
cagcaccagcctga

SEQ ID NO: 462750 - DNA, 16 bp, Homo sapiens
cagcaccagcctgagc

SEQ ID NO: 462751 - DNA, 14 bp, Homo sapiens
cagcacctttgtaa

SEQ ID NO: 462752 - DNA, 16 bp, Homo sapiens
cagcactaaggccgtg

SEQ ID NO: 462753 - DNA, 16 bp, Homo sapiens
cagcactcccagggcc

SEQ ID NO: 462754 - DNA, 20 bp, Homo sapiens
cagcactcccagggcccgag

SEQ ID NO: 462755 - DNA, 17 bp, Homo sapiens
cagcagattccacagga

SEQ ID NO: 462756 - DNA, 12 bp, Homo sapiens
cagcagcccccc

SEQ ID NO: 462757 - DNA, 15 bp, Homo sapiens
cagcagccccccagc

SEQ ID NO: 462758 - DNA, 18 bp, Homo sapiens
cagcagccccccagcact

SEQ ID NO: 462759 - DNA, 18 bp, Homo sapiens
cagcagtaccatcccact

SEQ ID NO: 462760 - DNA, 22 bp, Homo sapiens
cagcagtacttgctcaataaag

SEQ ID NO: 462761 - DNA, 13 bp, Homo sapiens
cagcagtgctggg

SEQ ID NO: 462762 - DNA, 17 bp, Homo sapiens
cagcatagttctgcaat

SEQ ID NO: 462763 - DNA, 23 bp, Homo sapiens
cagcatagttctgcaataacagt

SEQ ID NO: 462764 - DNA, 12 bp, Homo sapiens
cagcatgtctac

SEQ ID NO: 462765 - DNA, 14 bp, Homo sapiens
cagcattcaaaata

SEQ ID NO: 462766 - DNA, 21 bp, Homo sapiens
cagcattcaaaatagttctat

SEQ ID NO: 462767 - DNA, 14 bp, Homo sapiens
cagcattctcactc

SEQ ID NO: 462768 - DNA, 15 bp, Homo sapiens
cagcattctcactcc

SEQ ID NO: 462769 - DNA, 14 bp, Homo sapiens
cagccaatttcaaa

SEQ ID NO: 462770 - DNA, 15 bp, Homo sapiens
cagccaatttcaaag

SEQ ID NO: 462771 - DNA, 23 bp, Homo sapiens
cagccagccgccctgggctgtct

SEQ ID NO: 462772 - DNA, 19 bp, Homo sapiens
cagcccacatagtgatggt

SEQ ID NO: 462773 - DNA, 19 bp, Homo sapiens
cagcccagaacgggcctcc

SEQ ID NO: 462774 - DNA, 15 bp, Homo sapiens
cagccccatccttcc

SEQ ID NO: 462775 - DNA, 17 bp, Homo sapiens
cagccccatccttcccg

SEQ ID NO: 462776 - DNA, 17 bp, Homo sapiens
cagccctccctgcccct

SEQ ID NO: 462777 - DNA, 22 bp, Homo sapiens
cagccctccctgcccctccctt

SEQ ID NO: 462778 - DNA, 12 bp, Homo sapiens
cagccctctcca

SEQ ID NO: 462779 - DNA, 18 bp, Homo sapiens
cagccctctccacccaga

SEQ ID NO: 462780 - DNA, 20 bp, Homo sapiens
cagccctctccacccagagg

SEQ ID NO: 462781 - DNA, 21 bp, Homo sapiens
cagccctctccacccagaggt

SEQ ID NO: 462782 - DNA, 22 bp, Homo sapiens
cagccctctccacccagaggtc

SEQ ID NO: 462783 - DNA, 23 bp, Homo sapiens
cagccctctccacccagaggtct

SEQ ID NO: 462784 - DNA, 19 bp, Homo sapiens
cagccctgctttgggctgc

SEQ ID NO: 462785 - DNA, 21 bp, Homo sapiens
cagccctgctttgggctgccc

SEQ ID NO: 462786 - DNA, 22 bp, Homo sapiens
cagccctgctttgggctgccct

SEQ ID NO: 462787 - DNA, 9 bp, Homo sapiens
cagccgtgc

SEQ ID NO: 462788 - DNA, 16 bp, Homo sapiens
cagccgtgccttcagc

SEQ ID NO: 462789 - DNA, 18 bp, Homo sapiens
cagccgtgccttcagctc

SEQ ID NO: 462790 - DNA, 12 bp, Homo sapiens
cagcctccaggc

SEQ ID NO: 462791 - DNA, 21 bp, Homo sapiens
cagcctcccccaggctgcgcc

SEQ ID NO: 462792 - DNA, 22 bp, Homo sapiens
cagcctcctaggctccctgagg

SEQ ID NO: 462793 - DNA, 20 bp, Homo sapiens
cagcctctccccgctctgga

SEQ ID NO: 462794 - DNA, 12 bp, Homo sapiens
cagcctgagcca

SEQ ID NO: 462795 - DNA, 16 bp, Homo sapiens
cagcctgagctccacc

SEQ ID NO: 462796 - DNA, 19 bp, Homo sapiens
cagcctgagctccaccctc

SEQ ID NO: 462797 - DNA, 20 bp, Homo sapiens
cagcctggcacagggcagtg

SEQ ID NO: 462798 - DNA, 20 bp, Homo sapiens
cagcctttgcgctctgggtt

SEQ ID NO: 462799 - DNA, 14 bp, Homo sapiens
cagcgcctcccgcc

SEQ ID NO: 462800 - DNA, 23 bp, Homo sapiens
cagcgcctcccgccgcctcgggc

SEQ ID NO: 462801 - DNA, 20 bp, Homo sapiens
cagcggcccggcccacgcag

SEQ ID NO: 462802 - DNA, 23 bp, Homo sapiens
cagcggcccggcccacgcagagc

SEQ ID NO: 462803 - DNA, 15 bp, Homo sapiens
cagcgtggggctaac

SEQ ID NO: 462804 - DNA, 15 bp, Homo sapiens
cagctacatgaagtt

SEQ ID NO: 462805 - DNA, 16 bp, Homo sapiens
cagctacatgaagttg

SEQ ID NO: 462806 - DNA, 19 bp, Homo sapiens
cagctctaaagcagagatg

SEQ ID NO: 462807 - DNA, 21 bp, Homo sapiens
cagctctaaagcagagatgta

SEQ ID NO: 462808 - DNA, 19 bp, Homo sapiens
cagctgatctaaggacccc

SEQ ID NO: 462809 - DNA, 17 bp, Homo sapiens
cagctggcagcgcctcc

SEQ ID NO: 462810 - DNA, 22 bp, Homo sapiens
cagctggctgggtcgcccctcc

SEQ ID NO: 462811 - DNA, 15 bp, Homo sapiens
cagctgtttcgcatc

SEQ ID NO: 462812 - DNA, 24 bp, Homo sapiens
cagctgtttcgcatccaccgccac

SEQ ID NO: 462813 - DNA, 15 bp, Homo sapiens
cagcttgtttctata

SEQ ID NO: 462814 - DNA, 15 bp, Homo sapiens
caggaatgggccaag

SEQ ID NO: 462815 - DNA, 14 bp, Homo sapiens
caggagaaggcctg

SEQ ID NO: 462816 - DNA, 17 bp, Homo sapiens
caggaggactgttctaa

SEQ ID NO: 462817 - DNA, 12 bp, Homo sapiens
caggatgggaag

SEQ ID NO: 462818 - DNA, 17 bp, Homo sapiens
caggatgggtgaaacca

SEQ ID NO: 462819 - DNA, 15 bp, Homo sapiens
caggcacacagcagc

SEQ ID NO: 462820 - DNA, 15 bp, Homo sapiens
caggccccagcctcc

SEQ ID NO: 462821 - DNA, 19 bp, Homo sapiens
caggccccagcctccaggc

SEQ ID NO: 462822 - DNA, 22 bp, Homo sapiens
caggccctccctgactccctgt

SEQ ID NO: 462823 - DNA, 17 bp, Homo sapiens
caggcccttcctctcca

SEQ ID NO: 462824 - DNA, 20 bp, Homo sapiens
caggcccttcctctccactg

SEQ ID NO: 462825 - DNA, 21 bp, Homo sapiens
caggcccttcctctccactgc

SEQ ID NO: 462826 - DNA, 15 bp, Homo sapiens
caggcggaggggctt

SEQ ID NO: 462827 - DNA, 22 bp, Homo sapiens
caggcggaggggcttggagcag

SEQ ID NO: 462828 - DNA, 18 bp, Homo sapiens
caggctcttctcctttca

SEQ ID NO: 462829 - DNA, 13 bp, Homo sapiens
caggctgcgcctg

SEQ ID NO: 462830 - DNA, 17 bp, Homo sapiens
caggctgcgcctgcccg

SEQ ID NO: 462831 - DNA, 19 bp, Homo sapiens
caggctgcgcctgcccgcc

SEQ ID NO: 462832 - DNA, 21 bp, Homo sapiens
caggctgcgcctgcccgcccg

SEQ ID NO: 462833 - DNA, 19 bp, Homo sapiens
caggctggggcctggccta

SEQ ID NO: 462834 - DNA, 14 bp, Homo sapiens
caggctttctattg

SEQ ID NO: 462835 - DNA, 15 bp, Homo sapiens
cagggacccccgagg

SEQ ID NO: 462836 - DNA, 16 bp, Homo sapiens
cagggacccccgaggc

SEQ ID NO: 462837 - DNA, 21 bp, Homo sapiens
cagggacccccgaggcccccc

SEQ ID NO: 462838 - DNA, 20 bp, Homo sapiens
cagggagctatgagagatgt

SEQ ID NO: 462839 - DNA, 12 bp, Homo sapiens
cagggagggaac

SEQ ID NO: 462840 - DNA, 15 bp, Homo sapiens
cagggatggcccagc

SEQ ID NO: 462841 - DNA, 22 bp, Homo sapiens
cagggatgggggatgggccagg

SEQ ID NO: 462842 - DNA, 15 bp, Homo sapiens
cagggcaggagctgc

SEQ ID NO: 462843 - DNA, 18 bp, Homo sapiens
cagggcccaaataacagt

SEQ ID NO: 462844 - DNA, 15 bp, Homo sapiens
cagggcccgagcgcg

SEQ ID NO: 462845 - DNA, 23 bp, Homo sapiens
ccaggccaactgccccgcgtctt

SEQ ID NO: 462846 - DNA, 16 bp, Homo sapiens
ccaggccccagcctcc

SEQ ID NO: 462847 - DNA, 18 bp, Homo sapiens
ccaggcgccccttccccc

SEQ ID NO: 462848 - DNA, 15 bp, Homo sapiens
ccaggcggaggggct

SEQ ID NO: 462849 - DNA, 19 bp, Homo sapiens
ccaggcggaggggcttgga

SEQ ID NO: 462850 - DNA, 13 bp, Homo sapiens
ccaggctgcgcct

SEQ ID NO: 462851 - DNA, 15 bp, Homo sapiens
ccaggctgcgcctgc

SEQ ID NO: 462852 - DNA, 15 bp, Homo sapiens
ccaggctggggcctg

SEQ ID NO: 462853 - DNA, 18 bp, Homo sapiens
ccaggctggggcctggcc

SEQ ID NO: 462854 - DNA, 14 bp, Homo sapiens
ccagggacccccga

SEQ ID NO: 462855 - DNA, 19 bp, Homo sapiens
ccagggacccccgaggccc

SEQ ID NO: 462856 - DNA, 21 bp, Homo sapiens
ccagggatgggggatgggcca

SEQ ID NO: 462857 - DNA, 20 bp, Homo sapiens
ccagggcccgagcgcgtgcc

SEQ ID NO: 462858 - DNA, 23 bp, Homo sapiens
ccagggcccgagcgcgtgccttc

SEQ ID NO: 462859 - DNA, 19 bp, Homo sapiens
ccagggggaagatgccaag

SEQ ID NO: 462860 - DNA, 15 bp, Homo sapiens
ccagggtgcaggcgc

SEQ ID NO: 462861 - DNA, 16 bp, Homo sapiens
ccagggtgcaggcgcg

SEQ ID NO: 462862 - DNA, 17 bp, Homo sapiens
ccagggtgcaggcgcgc

SEQ ID NO: 462863 - DNA, 14 bp, Homo sapiens
ccagggttccagac

SEQ ID NO: 462864 - DNA, 22 bp, Homo sapiens
ccagggttccagacagggtggg

SEQ ID NO: 462865 - DNA, 16 bp, Homo sapiens
ccaggtggccactcca

SEQ ID NO: 462866 - DNA, 21 bp, Homo sapiens
ccaggtggccactccagaccc

SEQ ID NO: 462867 - DNA, 23 bp, Homo sapiens
ccagtcttgagtgggccccctct

SEQ ID NO: 462868 - DNA, 17 bp, Homo sapiens
ccagttaatgtgccaaa

SEQ ID NO: 462869 - DNA, 12 bp, Homo sapiens
ccatatataaat

SEQ ID NO: 462870 - DNA, 21 bp, Homo sapiens
ccatatataaattattacttt

SEQ ID NO: 462871 - DNA, 19 bp, Homo sapiens
ccatatgacaatttcaaaa

SEQ ID NO: 462872 - DNA, 12 bp, Homo sapiens
ccatatgctctt

SEQ ID NO: 462873 - DNA, 15 bp, Homo sapiens
ccatcaaaaatattc

SEQ ID NO: 462874 - DNA, 13 bp, Homo sapiens
ccatcccactgat

SEQ ID NO: 462875 - DNA, 17 bp, Homo sapiens
ccatcccctcctagcac

SEQ ID NO: 462876 - DNA, 18 bp, Homo sapiens
ccatccctgggcccctcc

SEQ ID NO: 462877 - DNA, 20 bp, Homo sapiens
ccatccctgggcccctccac

SEQ ID NO: 462878 - DNA, 14 bp, Homo sapiens
ccatcctgaggacc

SEQ ID NO: 462879 - DNA, 15 bp, Homo sapiens
ccatccttccatcct

SEQ ID NO: 462880 - DNA, 19 bp, Homo sapiens
ccatccttccatcctgagg

SEQ ID NO: 462881 - DNA, 20 bp, Homo sapiens
ccatccttccatcctgagga

SEQ ID NO: 462882 - DNA, 21 bp, Homo sapiens
ccatccttccatcctgaggac

SEQ ID NO: 462883 - DNA, 14 bp, Homo sapiens
ccatccttgcactt

SEQ ID NO: 462884 - DNA, 12 bp, Homo sapiens
ccatgatctgta

SEQ ID NO: 462885 - DNA, 15 bp, Homo sapiens
ccatgatctgtattt

SEQ ID NO: 462886 - DNA, 21 bp, Homo sapiens
ccatgggaaatgtcaacaagt

SEQ ID NO: 462887 - DNA, 14 bp, Homo sapiens
ccatggtgcagtga

SEQ ID NO: 462888 - DNA, 17 bp, Homo sapiens
ccatgtgcctgcaccag

SEQ ID NO: 462889 - DNA, 16 bp, Homo sapiens
ccatgtgtcccctcac

SEQ ID NO: 462890 - DNA, 23 bp, Homo sapiens
ccattgcaaaaggttaagccata

SEQ ID NO: 462891 - DNA, 12 bp, Homo sapiens
ccattttctaaa

SEQ ID NO: 462892 - DNA, 16 bp, Homo sapiens
ccattttctaaactgt

SEQ ID NO: 462893 - DNA, 21 bp, Homo sapiens
cccaaggaagaacaaatatga

SEQ ID NO: 462894 - DNA, 21 bp, Homo sapiens
cccaattttaaaaaataacat

SEQ ID NO: 462895 - DNA, 18 bp, Homo sapiens
cccacaataatgaataat

SEQ ID NO: 462896 - DNA, 18 bp, Homo sapiens
cccacaccccgtctgccc

SEQ ID NO: 462897 - DNA, 22 bp, Homo sapiens
cccacaccccgtctgccccttg

SEQ ID NO: 462898 - DNA, 16 bp, Homo sapiens
cccacaggcccttcct

SEQ ID NO: 462899 - DNA, 15 bp, Homo sapiens
cccaccacacacacc

SEQ ID NO: 462900 - DNA, 19 bp, Homo sapiens
cccaccacacacacccttc

SEQ ID NO: 462901 - DNA, 15 bp, Homo sapiens
cccaccatccttcca

SEQ ID NO: 462902 - DNA, 16 bp, Homo sapiens
cccaccatccttccat

SEQ ID NO: 462903 - DNA, 15 bp, Homo sapiens
cccacccgccccaga

SEQ ID NO: 462904 - DNA, 23 bp, Homo sapiens
cccacccgccccagagactgccc

SEQ ID NO: 462905 - DNA, 12 bp, Homo sapiens
cccaccctctgg

SEQ ID NO: 462906 - DNA, 12 bp, Homo sapiens
cccaccctgggc

SEQ ID NO: 462907 - DNA, 13 bp, Homo sapiens
cccaccctgggcc

SEQ ID NO: 462908 - DNA, 18 bp, Homo sapiens
cccaccctgggcctcccg

SEQ ID NO: 462909 - DNA, 15 bp, Homo sapiens
cccacctcccggtgt

SEQ ID NO: 462910 - DNA, 13 bp, Homo sapiens
cccacctcctgca

SEQ ID NO: 462911 - DNA, 16 bp, Homo sapiens
cccacctgcccagtta

SEQ ID NO: 462912 - DNA, 23 bp, Homo sapiens
cccacgcagagccccggagcacc

SEQ ID NO: 462913 - DNA, 13 bp, Homo sapiens
cccacggccgtcc

SEQ ID NO: 462914 - DNA, 23 bp, Homo sapiens
cccactagccctctttctctctg

SEQ ID NO: 462915 - DNA, 17 bp, Homo sapiens
cccactgagagctgctc

SEQ ID NO: 462916 - DNA, 23 bp, Homo sapiens
cccactgagagctgctcctttgg

SEQ ID NO: 462917 - DNA, 16 bp, Homo sapiens
cccacttatgctgctg

SEQ ID NO: 462918 - DNA, 18 bp, Homo sapiens
cccacttatgctgctgtg

SEQ ID NO: 462919 - DNA, 22 bp, Homo sapiens
cccacttatgctgctgtgaatt

SEQ ID NO: 462920 - DNA, 12 bp, Homo sapiens
cccagaaaaaag

SEQ ID NO: 462921 - DNA, 16 bp, Homo sapiens
cccagaaaaaaggact

SEQ ID NO: 462922 - DNA, 14 bp, Homo sapiens
cccagaacgggcct

SEQ ID NO: 462923 - DNA, 19 bp, Homo sapiens
cccagaccctccttcccca

SEQ ID NO: 462924 - DNA, 21 bp, Homo sapiens
cccagaccctccttccccacc

SEQ ID NO: 462925 - DNA, 13 bp, Homo sapiens
cccagagactgcc

SEQ ID NO: 462926 - DNA, 14 bp, Homo sapiens
cccagagactgccc

SEQ ID NO: 462927 - DNA, 16 bp, Homo sapiens
cccagagactgcccac

SEQ ID NO: 462928 - DNA, 18 bp, Homo sapiens
cccagagactgcccaccc

SEQ ID NO: 462929 - DNA, 19 bp, Homo sapiens
cccagagactgcccaccct

SEQ ID NO: 462930 - DNA, 18 bp, Homo sapiens
cccagagagagctctgca

SEQ ID NO: 462931 - DNA, 17 bp, Homo sapiens
cccagccggggtggggt

SEQ ID NO: 462932 - DNA, 14 bp, Homo sapiens
cccagcctccaggc

SEQ ID NO: 462933 - DNA, 12 bp, Homo sapiens
cccagcctcccc

SEQ ID NO: 462934 - DNA, 15 bp, Homo sapiens
cccagcctcccccag

SEQ ID NO: 462935 - DNA, 16 bp, Homo sapiens
cccagcctcccccagg

SEQ ID NO: 462936 - DNA, 17 bp, Homo sapiens
cccagcctcccccaggc

SEQ ID NO: 462937 - DNA, 12 bp, Homo sapiens
cccagctggcag

SEQ ID NO: 462938 - DNA, 17 bp, Homo sapiens
cccagctggcagcgcct

SEQ ID NO: 462939 - DNA, 19 bp, Homo sapiens
cccagctggcagcgcctcc

SEQ ID NO: 462940 - DNA, 20 bp, Homo sapiens
cccagctggcagcgcctccc

SEQ ID NO: 462941 - DNA, 19 bp, Homo sapiens
cccagctggctgggtcgcc

SEQ ID NO: 462942 - DNA, 14 bp, Homo sapiens
cccaggccctccct

SEQ ID NO: 462943 - DNA, 23 bp, Homo sapiens
ccctggggtctctgagcagtggg

SEQ ID NO: 462944 - DNA, 16 bp, Homo sapiens
ccctgtgggagtccac

SEQ ID NO: 462945 - DNA, 19 bp, Homo sapiens
ccctgtgggggtggccatc

SEQ ID NO: 462946 - DNA, 22 bp, Homo sapiens
ccctgtgggggtggccatccct

SEQ ID NO: 462947 - DNA, 23 bp, Homo sapiens
ccctgtgggggtggccatccctg

SEQ ID NO: 462948 - DNA, 13 bp, Homo sapiens
cccttacctggct

SEQ ID NO: 462949 - DNA, 14 bp, Homo sapiens
cccttcccacccct

SEQ ID NO: 462950 - DNA, 13 bp, Homo sapiens
cccttccccactc

SEQ ID NO: 462951 - DNA, 14 bp, Homo sapiens
cccttccccactcc

SEQ ID NO: 462952 - DNA, 15 bp, Homo sapiens
cccttccccactccc

SEQ ID NO: 462953 - DNA, 17 bp, Homo sapiens
cccttcccctgcgccct

SEQ ID NO: 462954 - DNA, 22 bp, Homo sapiens
cccttcccctgcgccctccctc

SEQ ID NO: 462955 - DNA, 19 bp, Homo sapiens
cccttccccttctgtgtca

SEQ ID NO: 462956 - DNA, 15 bp, Homo sapiens
cccttcccgccttca

SEQ ID NO: 462957 - DNA, 22 bp, Homo sapiens
cccttcccgccttcaggttcct

SEQ ID NO: 462958 - DNA, 14 bp, Homo sapiens
cccttcctgtcctg

SEQ ID NO: 462959 - DNA, 22 bp, Homo sapiens
cccttcggtattgttcaaagaa

SEQ ID NO: 462960 - DNA, 12 bp, Homo sapiens
cccttctgtgtc

SEQ ID NO: 462961 - DNA, 14 bp, Homo sapiens
cccttggcccctct

SEQ ID NO: 462962 - DNA, 15 bp, Homo sapiens
ccctttccctgcatc

SEQ ID NO: 462963 - DNA, 17 bp, Homo sapiens
ccctttccctgcatccc

SEQ ID NO: 462964 - DNA, 14 bp, Homo sapiens
ccgacagcctggca

SEQ ID NO: 462965 - DNA, 22 bp, Homo sapiens
ccgacagcctggcacagggcag

SEQ ID NO: 462966 - DNA, 18 bp, Homo sapiens
ccgagcgcgtgccttccc

SEQ ID NO: 462967 - DNA, 21 bp, Homo sapiens
ccgaggcccccctctgccttt

SEQ ID NO: 462968 - DNA, 14 bp, Homo sapiens
ccgcagcaccagcc

SEQ ID NO: 462969 - DNA, 16 bp, Homo sapiens
ccgcagcaccagcctg

SEQ ID NO: 462970 - DNA, 13 bp, Homo sapiens
ccgcagccctctc

SEQ ID NO: 462971 - DNA, 19 bp, Homo sapiens
ccgcagggcgctccggcag

SEQ ID NO: 462972 - DNA, 20 bp, Homo sapiens
ccgcagggcgctccggcaga

SEQ ID NO: 462973 - DNA, 21 bp, Homo sapiens
ccgcagggcgctccggcagag

SEQ ID NO: 462974 - DNA, 12 bp, Homo sapiens
ccgccaccccac

SEQ ID NO: 462975 - DNA, 15 bp, Homo sapiens
ccgcccacccacacc

SEQ ID NO: 462976 - DNA, 18 bp, Homo sapiens
ccgcccacccacaccccg

SEQ ID NO: 462977 - DNA, 13 bp, Homo sapiens
ccgcccagcctct

SEQ ID NO: 462978 - DNA, 13 bp, Homo sapiens
ccgcccgcccacc

SEQ ID NO: 462979 - DNA, 18 bp, Homo sapiens
ccgcccgcccaccccgct

SEQ ID NO: 462980 - DNA, 14 bp, Homo sapiens
ccgcccgccctcct

SEQ ID NO: 462981 - DNA, 15 bp, Homo sapiens
ccgcccgccctcctc

SEQ ID NO: 462982 - DNA, 12 bp, Homo sapiens
ccgccctcctct

SEQ ID NO: 462983 - DNA, 15 bp, Homo sapiens
ccgccctcctctgcc

SEQ ID NO: 462984 - DNA, 24 bp, Homo sapiens
ccgccctgggctgtctgtcaccag

SEQ ID NO: 462985 - DNA, 15 bp, Homo sapiens
ccgcctcgggccgcc

SEQ ID NO: 462986 - DNA, 17 bp, Homo sapiens
ccgcctcgggccgcctc

SEQ ID NO: 462987 - DNA, 21 bp, Homo sapiens
ccgcctcgggccgcctcctcc

SEQ ID NO: 462988 - DNA, 19 bp, Homo sapiens
ccgccttcaggttcctcct

SEQ ID NO: 462989 - DNA, 20 bp, Homo sapiens
ccgccttcaggttcctccta

SEQ ID NO: 462990 - DNA, 23 bp, Homo sapiens
ccgccttcaggttcctcctaggc

SEQ ID NO: 462991 - DNA, 14 bp, Homo sapiens
ccgcgctctgcccc

SEQ ID NO: 462992 - DNA, 15 bp, Homo sapiens
ccgctcagccctccc

SEQ ID NO: 462993 - DNA, 22 bp, Homo sapiens
ccgctcagccctccctgcccct

SEQ ID NO: 462994 - DNA, 19 bp, Homo sapiens
ccgctctggatcctgcact

SEQ ID NO: 462995 - DNA, 13 bp, Homo sapiens
ccgctgcaccacg

SEQ ID NO: 462996 - DNA, 18 bp, Homo sapiens
ccgctgccgctgcaccac

SEQ ID NO: 462997 - DNA, 12 bp, Homo sapiens
ccgctgcctggc

SEQ ID NO: 462998 - DNA, 21 bp, Homo sapiens
ccgctgtcgccccaggccctc

SEQ ID NO: 462999 - DNA, 16 bp, Homo sapiens
ccggaacagccaaaga

SEQ ID NO: 463000 - DNA, 17 bp, Homo sapiens
ccggagcggctgaggac

SEQ ID NO: 463001 - DNA, 19 bp, Homo sapiens
ccggaggcgcccacctgcc

SEQ ID NO: 463002 - DNA, 21 bp, Homo sapiens
ccggaggcgcccacctgccca

SEQ ID NO: 463003 - DNA, 22 bp, Homo sapiens
ccggaggcgcccacctgcccag

SEQ ID NO: 463004 - DNA, 14 bp, Homo sapiens
ccggaggggcctgg

SEQ ID NO: 463005 - DNA, 15 bp, Homo sapiens
ccggaggggcctggc

SEQ ID NO: 463006 - DNA, 14 bp, Homo sapiens
ccggcagaggcagg

SEQ ID NO: 463007 - DNA, 19 bp, Homo sapiens
ccggcagaggcagggccct

SEQ ID NO: 463008 - DNA, 23 bp, Homo sapiens
ccggcagaggcagggccctgggg

SEQ ID NO: 463009 - DNA, 15 bp, Homo sapiens
ccggccaaggacact

SEQ ID NO: 463010 - DNA, 17 bp, Homo sapiens
ccggccaaggacactga

SEQ ID NO: 463011 - DNA, 18 bp, Homo sapiens
ccggccaaggacactgat

SEQ ID NO: 463012 - DNA, 17 bp, Homo sapiens
ccggcccacgcagagcc

SEQ ID NO: 463013 - DNA, 19 bp, Homo sapiens
ccggcccacgcagagcccc

SEQ ID NO: 463014 - DNA, 13 bp, Homo sapiens
ccggcctccaggc

SEQ ID NO: 463015 - DNA, 19 bp, Homo sapiens
ccggcctccaggctggggc

SEQ ID NO: 463016 - DNA, 16 bp, Homo sapiens
ccggctccccctgcca

SEQ ID NO: 463017 - DNA, 19 bp, Homo sapiens
ccggctccccctgccagca

SEQ ID NO: 463018 - DNA, 15 bp, Homo sapiens
ccggctggccggtcc

SEQ ID NO: 463019 - DNA, 16 bp, Homo sapiens
ccgggagcctccccct

SEQ ID NO: 463020 - DNA, 15 bp, Homo sapiens
ccgggcaggtcctgc

SEQ ID NO: 463021 - DNA, 19 bp, Homo sapiens
ccggggtggggtgcctgag

SEQ ID NO: 463022 - DNA, 19 bp, Homo sapiens
ccgggtgcgtgaccggccc

SEQ ID NO: 463023 - DNA, 21 bp, Homo sapiens
ccgggtgcgtgaccggcccgc

SEQ ID NO: 463024 - DNA, 13 bp, Homo sapiens
ccgggtgtggcct

SEQ ID NO: 463025 - DNA, 12 bp, Homo sapiens
ccgtccccaggg

SEQ ID NO: 463026 - DNA, 13 bp, Homo sapiens
ccgtccccagggt

SEQ ID NO: 463027 - DNA, 16 bp, Homo sapiens
ccgtccctttccctgc

SEQ ID NO: 463028 - DNA, 17 bp, Homo sapiens
ccgtccgcccgcccacc

SEQ ID NO: 463029 - DNA, 22 bp, Homo sapiens
ccgtgcaacggaagccaggcca

SEQ ID NO: 463030 - DNA, 15 bp, Homo sapiens
ccgtgccttcagctc

SEQ ID NO: 463031 - DNA, 16 bp, Homo sapiens
ccgtgccttcagctct

SEQ ID NO: 463032 - DNA, 23 bp, Homo sapiens
ccgtggcttcccgctcagccctc

SEQ ID NO: 463033 - DNA, 21 bp, Homo sapiens
ccgtggtgtgaggcccccgga

SEQ ID NO: 463034 - DNA, 22 bp, Homo sapiens
ccgtggtgtgaggcccccggag

SEQ ID NO: 463035 - DNA, 23 bp, Homo sapiens
ccgtggtgtgaggcccccggagg

SEQ ID NO: 463036 - DNA, 19 bp, Homo sapiens
ccgttagggaaatccaact

SEQ ID NO: 463037 - DNA, 15 bp, Homo sapiens
ccgttcatctgagga

SEQ ID NO: 463038 - DNA, 20 bp, Homo sapiens
ccgttcatctgaggagtcca

SEQ ID NO: 463039 - DNA, 15 bp, Homo sapiens
cctacagcctcactc

SEQ ID NO: 463040 - DNA, 13 bp, Homo sapiens
cctacagtatata

SEQ ID NO: 463041 - DNA, 15 bp, Homo sapiens
cgcctcccgccgcct

SEQ ID NO: 463042 - DNA, 14 bp, Homo sapiens
cgcctcctccagac

SEQ ID NO: 463043 - DNA, 12 bp, Homo sapiens
cgcctcctggcc

SEQ ID NO: 463044 - DNA, 22 bp, Homo sapiens
cgcctcctggccagacgctgcc

SEQ ID NO: 463045 - DNA, 21 bp, Homo sapiens
cgcctcgggccgcctcctcca

SEQ ID NO: 463046 - DNA, 22 bp, Homo sapiens
cgcctcgggccgcctcctccag

SEQ ID NO: 463047 - DNA, 23 bp, Homo sapiens
cgcctcgggccgcctcctccaga

SEQ ID NO: 463048 - DNA, 13 bp, Homo sapiens
cgcctgcccgccc

SEQ ID NO: 463049 - DNA, 17 bp, Homo sapiens
cgcctgcgctcctctgc

SEQ ID NO: 463050 - DNA, 18 bp, Homo sapiens
cgcctgcgctcctctgca

SEQ ID NO: 463051 - DNA, 22 bp, Homo sapiens
cgcctgcgctcctctgcagcct

SEQ ID NO: 463052 - DNA, 15 bp, Homo sapiens
cgccttcaggttcct

SEQ ID NO: 463053 - DNA, 22 bp, Homo sapiens
cgccttgagtgacatgcggctg

SEQ ID NO: 463054 - DNA, 13 bp, Homo sapiens
cgcgcgtgccccc

SEQ ID NO: 463055 - DNA, 13 bp, Homo sapiens
cgcgtgcccccag

SEQ ID NO: 463056 - DNA, 14 bp, Homo sapiens
cgcgtgcccccagc

SEQ ID NO: 463057 - DNA, 15 bp, Homo sapiens
cgcgtgcccccagcg

SEQ ID NO: 463058 - DNA, 17 bp, Homo sapiens
cgcgtgcccccagcgtg

SEQ ID NO: 463059 - DNA, 18 bp, Homo sapiens
cgcgtgcccccagcgtgg

SEQ ID NO: 463060 - DNA, 15 bp, Homo sapiens
cgctatccacagaac

SEQ ID NO: 463061 - DNA, 12 bp, Homo sapiens
cgctcagaggcc

SEQ ID NO: 463062 - DNA, 16 bp, Homo sapiens
cgctcagccctccctg

SEQ ID NO: 463063 - DNA, 21 bp, Homo sapiens
cgctcagccctccctgcccct

SEQ ID NO: 463064 - DNA, 22 bp, Homo sapiens
cgctcccgcgggaagccagccc

SEQ ID NO: 463065 - DNA, 22 bp, Homo sapiens
cgctccggcagaggcagggccc

SEQ ID NO: 463066 - DNA, 24 bp, Homo sapiens
cgctccggcagaggcagggccctg

SEQ ID NO: 463067 - DNA, 12 bp, Homo sapiens
cgctcctctgca

SEQ ID NO: 463068 - DNA, 13 bp, Homo sapiens
cgctcctctgcct

SEQ ID NO: 463069 - DNA, 16 bp, Homo sapiens
cgctcctctgccttgg

SEQ ID NO: 463070 - DNA, 13 bp, Homo sapiens
cgctcctgccctc

SEQ ID NO: 463071 - DNA, 12 bp, Homo sapiens
cgctctgcccct

SEQ ID NO: 463072 - DNA, 23 bp, Homo sapiens
cgctctgcccctccgtccccagg

SEQ ID NO: 463073 - DNA, 14 bp, Homo sapiens
cgctgcaccacggc

SEQ ID NO: 463074 - DNA, 16 bp, Homo sapiens
cgctgccgctgcacca

SEQ ID NO: 463075 - DNA, 18 bp, Homo sapiens
cgctgccgctgcaccacg

SEQ ID NO: 463076 - DNA, 15 bp, Homo sapiens
cgctgccgctgccgc

SEQ ID NO: 463077 - DNA, 19 bp, Homo sapiens
cgctgcctggcgggcagcc

SEQ ID NO: 463078 - DNA, 23 bp, Homo sapiens
cgctgtcgccccaggccctccct

SEQ ID NO: 463079 - DNA, 20 bp, Homo sapiens
cggaacagccaaagaaactc

SEQ ID NO: 463080 - DNA, 22 bp, Homo sapiens
cggaacagccaaagaaactcag

SEQ ID NO: 463081 - DNA, 14 bp, Homo sapiens
cggaagtggcctga

SEQ ID NO: 463082 - DNA, 15 bp, Homo sapiens
cggaccggagcggct

SEQ ID NO: 463083 - DNA, 14 bp, Homo sapiens
cggacgctggctcg

SEQ ID NO: 463084 - DNA, 13 bp, Homo sapiens
cggacgggacagc

SEQ ID NO: 463085 - DNA, 13 bp, Homo sapiens
cggagccccccac

SEQ ID NO: 463086 - DNA, 15 bp, Homo sapiens
cggagccccccactc

SEQ ID NO: 463087 - DNA, 13 bp, Homo sapiens
cggagcggctgag

SEQ ID NO: 463088 - DNA, 14 bp, Homo sapiens
cggaggcgcccacc

SEQ ID NO: 463089 - DNA, 16 bp, Homo sapiens
cggaggcgcccacctg

SEQ ID NO: 463090 - DNA, 21 bp, Homo sapiens
cggaggcgcccacctgcccag

SEQ ID NO: 463091 - DNA, 22 bp, Homo sapiens
cggaggcgcccacctgcccagt

SEQ ID NO: 463092 - DNA, 14 bp, Homo sapiens
cggaggctgggccc

SEQ ID NO: 463093 - DNA, 20 bp, Homo sapiens
cggaggctgggcccctggga

SEQ ID NO: 463094 - DNA, 18 bp, Homo sapiens
cggaggggcctggcagcc

SEQ ID NO: 463095 - DNA, 15 bp, Homo sapiens
cggaggggcttggag

SEQ ID NO: 463096 - DNA, 18 bp, Homo sapiens
cggaggggcttggagcag

SEQ ID NO: 463097 - DNA, 16 bp, Homo sapiens
cggcaccgcccaccca

SEQ ID NO: 463098 - DNA, 17 bp, Homo sapiens
cggcaccgcccacccac

SEQ ID NO: 463099 - DNA, 21 bp, Homo sapiens
cggcaccgcccacccacaccc

SEQ ID NO: 463100 - DNA, 16 bp, Homo sapiens
cggcagaggcagggcc

SEQ ID NO: 463101 - DNA, 12 bp, Homo sapiens
cggcagccccat

SEQ ID NO: 463102 - DNA, 15 bp, Homo sapiens
cggcagccccatcct

SEQ ID NO: 463103 - DNA, 19 bp, Homo sapiens
cggcagccccatccttccc

SEQ ID NO: 463104 - DNA, 17 bp, Homo sapiens
cggcccacgcagagccc

SEQ ID NO: 463105 - DNA, 17 bp, Homo sapiens
cggccccgcgcgtgccc

SEQ ID NO: 463106 - DNA, 19 bp, Homo sapiens
cggccccgcgcgtgccccc

SEQ ID NO: 463107 - DNA, 22 bp, Homo sapiens
cggccccgcgcgtgcccccagc

SEQ ID NO: 463108 - DNA, 15 bp, Homo sapiens
cggcccgccaccttg

SEQ ID NO: 463109 - DNA, 14 bp, Homo sapiens
cggcccggcccacg

SEQ ID NO: 463110 - DNA, 15 bp, Homo sapiens
cggcccgtgcgcagc

SEQ ID NO: 463111 - DNA, 17 bp, Homo sapiens
cggcccgtgcgcagccg

SEQ ID NO: 463112 - DNA, 12 bp, Homo sapiens
cggcctccaggc

SEQ ID NO: 463113 - DNA, 13 bp, Homo sapiens
cggcctccaggct

SEQ ID NO: 463114 - DNA, 14 bp, Homo sapiens
cggcctccaggctg

SEQ ID NO: 463115 - DNA, 16 bp, Homo sapiens
cggcctccaggctggg

SEQ ID NO: 463116 - DNA, 17 bp, Homo sapiens
cggcctccaggctgggg

SEQ ID NO: 463117 - DNA, 19 bp, Homo sapiens
cggcctccaggctggggcc

SEQ ID NO: 463118 - DNA, 13 bp, Homo sapiens
cggcctgcagccc

SEQ ID NO: 463119 - DNA, 18 bp, Homo sapiens
cggcctgcagcccagaac

SEQ ID NO: 463120 - DNA, 17 bp, Homo sapiens
cggcctttgttgctcag

SEQ ID NO: 463121 - DNA, 16 bp, Homo sapiens
cggcggcggccaggga

SEQ ID NO: 463122 - DNA, 17 bp, Homo sapiens
cggcggcggccagggac

SEQ ID NO: 463123 - DNA, 16 bp, Homo sapiens
cggctccccctgccag

SEQ ID NO: 463124 - DNA, 16 bp, Homo sapiens
cggctgggcagggccg

SEQ ID NO: 463125 - DNA, 13 bp, Homo sapiens
cgggaaggcctga

SEQ ID NO: 463126 - DNA, 23 bp, Homo sapiens
cgggactgtcttcaaccctgccc

SEQ ID NO: 463127 - DNA, 14 bp, Homo sapiens
cgggagagcgccac

SEQ ID NO: 463128 - DNA, 16 bp, Homo sapiens
cgggagagcgccaccc

SEQ ID NO: 463129 - DNA, 18 bp, Homo sapiens
cgggagagcgccacccgc

SEQ ID NO: 463130 - DNA, 12 bp, Homo sapiens
cgggagcctccc

SEQ ID NO: 463131 - DNA, 18 bp, Homo sapiens
cgggagcctccccctcag

SEQ ID NO: 463132 - DNA, 19 bp, Homo sapiens
cgggagcctccccctcaga

SEQ ID NO: 463133 - DNA, 17 bp, Homo sapiens
cgggcagcccctgctgg

SEQ ID NO: 463134 - DNA, 17 bp, Homo sapiens
cgggcaggtcctgccca

SEQ ID NO: 463135 - DNA, 17 bp, Homo sapiens
cgggcccgctcaacctc

SEQ ID NO: 463136 - DNA, 14 bp, Homo sapiens
cgggccgcctcctc

SEQ ID NO: 463137 - DNA, 16 bp, Homo sapiens
cgggcctggagaacta

SEQ ID NO: 463138 - DNA, 22 bp, Homo sapiens
cgggcgcctgcgctcctctgca

SEQ ID NO: 463139 - DNA, 23 bp, Homo sapiens
ctccaggctggggcctggcctat

SEQ ID NO: 463140 - DNA, 19 bp, Homo sapiens
ctccagtttgcccaccaca

SEQ ID NO: 463141 - DNA, 21 bp, Homo sapiens
ctccagtttgcccaccacaac

SEQ ID NO: 463142 - DNA, 18 bp, Homo sapiens
ctcccaaataaactcctt

SEQ ID NO: 463143 - DNA, 19 bp, Homo sapiens
ctcccaaataaactcctta

SEQ ID NO: 463144 - DNA, 20 bp, Homo sapiens
ctcccaaataaactccttaa

SEQ ID NO: 463145 - DNA, 23 bp, Homo sapiens
ctcccaaataaactccttaacca

SEQ ID NO: 463146 - DNA, 14 bp, Homo sapiens
ctcccacaggccct

SEQ ID NO: 463147 - DNA, 20 bp, Homo sapiens
ctcccacaggcccttcctct

SEQ ID NO: 463148 - DNA, 21 bp, Homo sapiens
ctcccacaggcccttcctctc

SEQ ID NO: 463149 - DNA, 17 bp, Homo sapiens
ctcccaggcgccccttc

SEQ ID NO: 463150 - DNA, 19 bp, Homo sapiens
ctcccaggcgccccttccc

SEQ ID NO: 463151 - DNA, 15 bp, Homo sapiens
ctccccacccaccac

SEQ ID NO: 463152 - DNA, 15 bp, Homo sapiens
ctccccatatataaa

SEQ ID NO: 463153 - DNA, 17 bp, Homo sapiens
ctccccatatataaatt

SEQ ID NO: 463154 - DNA, 15 bp, Homo sapiens
ctccccatggtgcag

SEQ ID NO: 463155 - DNA, 23 bp, Homo sapiens
ctccccatgtgcctgcaccagga

SEQ ID NO: 463156 - DNA, 21 bp, Homo sapiens
ctcccccacggccgtccctga

SEQ ID NO: 463157 - DNA, 18 bp, Homo sapiens
ctcccccaggctgcgcct

SEQ ID NO: 463158 - DNA, 12 bp, Homo sapiens
ctccccctgcca

SEQ ID NO: 463159 - DNA, 23 bp, Homo sapiens
ctcccccttccccttctgtgtca

SEQ ID NO: 463160 - DNA, 13 bp, Homo sapiens
ctccccgcagccc

SEQ ID NO: 463161 - DNA, 19 bp, Homo sapiens
ctccccgcagccctctcca

SEQ ID NO: 463162 - DNA, 21 bp, Homo sapiens
ctccccgcagccctctccacc

SEQ ID NO: 463163 - DNA, 22 bp, Homo sapiens
ctccccgcagccctctccaccc

SEQ ID NO: 463164 - DNA, 15 bp, Homo sapiens
ctccccgctctggat

SEQ ID NO: 463165 - DNA, 12 bp, Homo sapiens
ctcccctccaga

SEQ ID NO: 463166 - DNA, 14 bp, Homo sapiens
ctcccctccagacc

SEQ ID NO: 463167 - DNA, 18 bp, Homo sapiens
ctccccttaaaatgtcta

SEQ ID NO: 463168 - DNA, 13 bp, Homo sapiens
ctcccgccgcctc

SEQ ID NO: 463169 - DNA, 22 bp, Homo sapiens
ctcccgccgcctcgggccgcct

SEQ ID NO: 463170 - DNA, 14 bp, Homo sapiens
ctcccgcctttgac

SEQ ID NO: 463171 - DNA, 19 bp, Homo sapiens
ctccctaccctcttctcag

SEQ ID NO: 463172 - DNA, 14 bp, Homo sapiens
ctccctccacacct

SEQ ID NO: 463173 - DNA, 17 bp, Homo sapiens
ctccctccactcctccc

SEQ ID NO: 463174 - DNA, 15 bp, Homo sapiens
ctccctccctccaca

SEQ ID NO: 463175 - DNA, 22 bp, Homo sapiens
ctccctgaggtacctttccacc

SEQ ID NO: 463176 - DNA, 14 bp, Homo sapiens
ctccctgcccctcc

SEQ ID NO: 463177 - DNA, 21 bp, Homo sapiens
ctccctgtgggggtggccatc

SEQ ID NO: 463178 - DNA, 22 bp, Homo sapiens
ctccctgtgggggtggccatcc

SEQ ID NO: 463179 - DNA, 20 bp, Homo sapiens
ctcccttcaaccattcccca

SEQ ID NO: 463180 - DNA, 17 bp, Homo sapiens
ctcccttggatttttga

SEQ ID NO: 463181 - DNA, 15 bp, Homo sapiens
ctccggcagaggcag

SEQ ID NO: 463182 - DNA, 16 bp, Homo sapiens
ctccgggtgtggcctc

SEQ ID NO: 463183 - DNA, 15 bp, Homo sapiens
ctccgtccccagggt

SEQ ID NO: 463184 - DNA, 17 bp, Homo sapiens
ctcctaggcgctcagag

SEQ ID NO: 463185 - DNA, 22 bp, Homo sapiens
ctcctaggcgctcagaggccgc

SEQ ID NO: 463186 - DNA, 17 bp, Homo sapiens
ctcctaggctccctgag

SEQ ID NO: 463187 - DNA, 21 bp, Homo sapiens
ctcctccagactcgagagggc

SEQ ID NO: 463188 - DNA, 21 bp, Homo sapiens
ctcctccaggaggactgttct

SEQ ID NO: 463189 - DNA, 15 bp, Homo sapiens
ctcctcgtccggcct

SEQ ID NO: 463190 - DNA, 19 bp, Homo sapiens
ctcctcgtccggcctgcag

SEQ ID NO: 463191 - DNA, 23 bp, Homo sapiens
ctcctcgtccggcctgcagccca

SEQ ID NO: 463192 - DNA, 19 bp, Homo sapiens
ctcctctctctccctccac

SEQ ID NO: 463193 - DNA, 16 bp, Homo sapiens
ctcctctgcagcctga

SEQ ID NO: 463194 - DNA, 12 bp, Homo sapiens
ctcctctgctcc

SEQ ID NO: 463195 - DNA, 14 bp, Homo sapiens
ctcctgagcctgtc

SEQ ID NO: 463196 - DNA, 15 bp, Homo sapiens
ctcctgagcctgtct

SEQ ID NO: 463197 - DNA, 14 bp, Homo sapiens
ctcctgccctcgtc

SEQ ID NO: 463198 - DNA, 15 bp, Homo sapiens
ctcctgggggtggca

SEQ ID NO: 463199 - DNA, 16 bp, Homo sapiens
ctcctgggggtggcag

SEQ ID NO: 463200 - DNA, 17 bp, Homo sapiens
ctcctgggggtggcagg

SEQ ID NO: 463201 - DNA, 18 bp, Homo sapiens
ctcctgggggtggcaggc

SEQ ID NO: 463202 - DNA, 19 bp, Homo sapiens
ctcctgggggtggcaggca

SEQ ID NO: 463203 - DNA, 20 bp, Homo sapiens
ctcctgggggtggcaggcac

SEQ ID NO: 463204 - DNA, 21 bp, Homo sapiens
ctcctgggggtggcaggcaca

SEQ ID NO: 463205 - DNA, 20 bp, Homo sapiens
ctccttctcccctccagacc

SEQ ID NO: 463206 - DNA, 16 bp, Homo sapiens
ctccttgagttttcct

SEQ ID NO: 463207 - DNA, 13 bp, Homo sapiens
ctcctttcccaca

SEQ ID NO: 463208 - DNA, 14 bp, Homo sapiens
ctcctttcccacag

SEQ ID NO: 463209 - DNA, 15 bp, Homo sapiens
ctcctttcccacagt

SEQ ID NO: 463210 - DNA, 16 bp, Homo sapiens
ctcctttcccacagtc

SEQ ID NO: 463211 - DNA, 16 bp, Homo sapiens
ctcgactctgctgctc

SEQ ID NO: 463212 - DNA, 17 bp, Homo sapiens
ctcgagagggctgagcc

SEQ ID NO: 463213 - DNA, 22 bp, Homo sapiens
ctcgagagggctgagcccctcc

SEQ ID NO: 463214 - DNA, 17 bp, Homo sapiens
ctcgagcccagatggaa

SEQ ID NO: 463215 - DNA, 13 bp, Homo sapiens
ctcggacacagtt

SEQ ID NO: 463216 - DNA, 20 bp, Homo sapiens
ctcggccccacccaccctct

SEQ ID NO: 463217 - DNA, 19 bp, Homo sapiens
ctcgggccgcctcctccag

SEQ ID NO: 463218 - DNA, 16 bp, Homo sapiens
ctcgggcgcctgcgct

SEQ ID NO: 463219 - DNA, 22 bp, Homo sapiens
ctcgggcgcctgcgctcctctg

SEQ ID NO: 463220 - DNA, 14 bp, Homo sapiens
ctcgtccggcctgc

SEQ ID NO: 463221 - DNA, 15 bp, Homo sapiens
ctcgtccggcctgca

SEQ ID NO: 463222 - DNA, 22 bp, Homo sapiens
ctcgtccggcctgcagcccaga

SEQ ID NO: 463223 - DNA, 18 bp, Homo sapiens
ctcgtctccctggccacc

SEQ ID NO: 463224 - DNA, 21 bp, Homo sapiens
ctctaagaaatggctttccac

SEQ ID NO: 463225 - DNA, 22 bp, Homo sapiens
ctctaagaaatggctttccaca

SEQ ID NO: 463226 - DNA, 21 bp, Homo sapiens
ctctacagctaatcagcattc

SEQ ID NO: 463227 - DNA, 17 bp, Homo sapiens
ctctacttagcatgtcc

SEQ ID NO: 463228 - DNA, 19 bp, Homo sapiens
ctctacttagcatgtccct

SEQ ID NO: 463229 - DNA, 20 bp, Homo sapiens
ctctacttagcatgtcccta

SEQ ID NO: 463230 - DNA, 18 bp, Homo sapiens
ctctactttataatcaag

SEQ ID NO: 463231 - DNA, 14 bp, Homo sapiens
ctctattttttact

SEQ ID NO: 463232 - DNA, 17 bp, Homo sapiens
ctctcagatccctcggt

SEQ ID NO: 463233 - DNA, 18 bp, Homo sapiens
ctctcagatccctcggtc

SEQ ID NO: 463234 - DNA, 14 bp, Homo sapiens
ctctccacccagag

SEQ ID NO: 463235 - DNA, 15 bp, Homo sapiens
ctctccacccagagg

SEQ ID NO: 463236 - DNA, 13 bp, Homo sapiens
ctgtctgattcta

SEQ ID NO: 463237 - DNA, 17 bp, Homo sapiens
ctgtctgattctatgcc

SEQ ID NO: 463238 - DNA, 13 bp, Homo sapiens
ctgtctgtcacca

SEQ ID NO: 463239 - DNA, 20 bp, Homo sapiens
ctgtcttcaaccctgccctg

SEQ ID NO: 463240 - DNA, 23 bp, Homo sapiens
ctgtcttcaaccctgccctgcac

SEQ ID NO: 463241 - DNA, 21 bp, Homo sapiens
ctgtctttatgtaagaagaaa

SEQ ID NO: 463242 - DNA, 16 bp, Homo sapiens
ctgtgaagcctttatc

SEQ ID NO: 463243 - DNA, 18 bp, Homo sapiens
ctgtgaagcctttatcta

SEQ ID NO: 463244 - DNA, 21 bp, Homo sapiens
ctgtgaataaaaaccctgtat

SEQ ID NO: 463245 - DNA, 20 bp, Homo sapiens
ctgtgatcgtgtgttgccat

SEQ ID NO: 463246 - DNA, 22 bp, Homo sapiens
ctgtgccatggatgattctttt

SEQ ID NO: 463247 - DNA, 19 bp, Homo sapiens
ctgtgctccagcagtgctg

SEQ ID NO: 463248 - DNA, 21 bp, Homo sapiens
ctgtgctccagcagtgctggg

SEQ ID NO: 463249 - DNA, 22 bp, Homo sapiens
ctgtgctccagcagtgctgggc

SEQ ID NO: 463250 - DNA, 13 bp, Homo sapiens
ctgtgctgctgca

SEQ ID NO: 463251 - DNA, 21 bp, Homo sapiens
ctgtgctttcatgtttaagaa

SEQ ID NO: 463252 - DNA, 17 bp, Homo sapiens
ctgtggattctatattt

SEQ ID NO: 463253 - DNA, 19 bp, Homo sapiens
ctgtggcccctccttctcc

SEQ ID NO: 463254 - DNA, 21 bp, Homo sapiens
ctgtggcccctccttctcccc

SEQ ID NO: 463255 - DNA, 22 bp, Homo sapiens
ctgtggcccctccttctcccct

SEQ ID NO: 463256 - DNA, 12 bp, Homo sapiens
ctgtgggactgg

SEQ ID NO: 463257 - DNA, 19 bp, Homo sapiens
ctgtgggactggcccaccc

SEQ ID NO: 463258 - DNA, 20 bp, Homo sapiens
ctgtgggagtccactttcct

SEQ ID NO: 463259 - DNA, 22 bp, Homo sapiens
ctgtgggagtccactttcctct

SEQ ID NO: 463260 - DNA, 14 bp, Homo sapiens
ctgtgggcagcacc

SEQ ID NO: 463261 - DNA, 16 bp, Homo sapiens
ctgtgggggtggccat

SEQ ID NO: 463262 - DNA, 17 bp, Homo sapiens
ctgtgggggtggccatc

SEQ ID NO: 463263 - DNA, 18 bp, Homo sapiens
ctgtgtaatctctgatta

SEQ ID NO: 463264 - DNA, 17 bp, Homo sapiens
ctgttaacccagtgttc

SEQ ID NO: 463265 - DNA, 17 bp, Homo sapiens
ctgttagaattaggtaa

SEQ ID NO: 463266 - DNA, 10 bp, Homo sapiens
ctgttccaag

SEQ ID NO: 463267 - DNA, 14 bp, Homo sapiens
ctgttccaagtgtg

SEQ ID NO: 463268 - DNA, 17 bp, Homo sapiens
ctgttccaagtgtgtgt

SEQ ID NO: 463269 - DNA, 15 bp, Homo sapiens
ctgttctaactagta

SEQ ID NO: 463270 - DNA, 15 bp, Homo sapiens
ctgtttaccctccct

SEQ ID NO: 463271 - DNA, 19 bp, Homo sapiens
ctgttttatgtcatactct

SEQ ID NO: 463272 - DNA, 22 bp, Homo sapiens
ctgttttatgtcatactctgtg

SEQ ID NO: 463273 - DNA, 15 bp, Homo sapiens
ctgttttgaataaca

SEQ ID NO: 463274 - DNA, 14 bp, Homo sapiens
ctgtttttgtagtg

SEQ ID NO: 463275 - DNA, 16 bp, Homo sapiens
cttaaacctgtgcttt

SEQ ID NO: 463276 - DNA, 22 bp, Homo sapiens
cttaaacctgtgctttcatgtt

SEQ ID NO: 463277 - DNA, 13 bp, Homo sapiens
cttaaactttgtc

SEQ ID NO: 463278 - DNA, 20 bp, Homo sapiens
cttaaactttgtcacttctg

SEQ ID NO: 463279 - DNA, 21 bp, Homo sapiens
cttaaactttgtcacttctgc

SEQ ID NO: 463280 - DNA, 20 bp, Homo sapiens
cttaaatttctaaaaacagt

SEQ ID NO: 463281 - DNA, 16 bp, Homo sapiens
cttaacataaacttgt

SEQ ID NO: 463282 - DNA, 21 bp, Homo sapiens
cttaacataaacttgtactta

SEQ ID NO: 463283 - DNA, 17 bp, Homo sapiens
cttaactcatctgttat

SEQ ID NO: 463284 - DNA, 14 bp, Homo sapiens
cttaaggggggatg

SEQ ID NO: 463285 - DNA, 20 bp, Homo sapiens
cttaatgttctgaataattt

SEQ ID NO: 463286 - DNA, 16 bp, Homo sapiens
cttacactgaaatcca

SEQ ID NO: 463287 - DNA, 18 bp, Homo sapiens
cttacactgaaatccaaa

SEQ ID NO: 463288 - DNA, 21 bp, Homo sapiens
cttacagtattttctatgtaa

SEQ ID NO: 463289 - DNA, 16 bp, Homo sapiens
cttaccaataataaga

SEQ ID NO: 463290 - DNA, 18 bp, Homo sapiens
cttaccccgtccctttcc

SEQ ID NO: 463291 - DNA, 22 bp, Homo sapiens
cttactaaacattttgttattg

SEQ ID NO: 463292 - DNA, 19 bp, Homo sapiens
cttagaaaacatgggcttt

SEQ ID NO: 463293 - DNA, 15 bp, Homo sapiens
cttagaacctttctt

SEQ ID NO: 463294 - DNA, 22 bp, Homo sapiens
cttagatgacggggcctccttc

SEQ ID NO: 463295 - DNA, 14 bp, Homo sapiens
cttatgctgctgtg

SEQ ID NO: 463296 - DNA, 14 bp, Homo sapiens
cttattttagacaa

SEQ ID NO: 463297 - DNA, 20 bp, Homo sapiens
cttcaaccattccccatggg

SEQ ID NO: 463298 - DNA, 14 bp, Homo sapiens
cttcaaccctgccc

SEQ ID NO: 463299 - DNA, 19 bp, Homo sapiens
cttcaaccctgccctgcac

SEQ ID NO: 463300 - DNA, 22 bp, Homo sapiens
cttcaaccctgccctgcacctt

SEQ ID NO: 463301 - DNA, 19 bp, Homo sapiens
cttcacactgaactcagga

SEQ ID NO: 463302 - DNA, 14 bp, Homo sapiens
cttcaggctcttct

SEQ ID NO: 463303 - DNA, 17 bp, Homo sapiens
cttcaggctcttctcct

SEQ ID NO: 463304 - DNA, 20 bp, Homo sapiens
cttcaggttcctcctaggcg

SEQ ID NO: 463305 - DNA, 13 bp, Homo sapiens
cttcagttctcat

SEQ ID NO: 463306 - DNA, 14 bp, Homo sapiens
cttcagttctcatc

SEQ ID NO: 463307 - DNA, 18 bp, Homo sapiens
cttccaagttcattcata

SEQ ID NO: 463308 - DNA, 15 bp, Homo sapiens
cttccatcctgagga

SEQ ID NO: 463309 - DNA, 16 bp, Homo sapiens
cttccatcctgaggac

SEQ ID NO: 463310 - DNA, 17 bp, Homo sapiens
cttccatcctgaggacc

SEQ ID NO: 463311 - DNA, 13 bp, Homo sapiens
cttccatggtggt

SEQ ID NO: 463312 - DNA, 20 bp, Homo sapiens
cttccatggtggtttcagaa

SEQ ID NO: 463313 - DNA, 15 bp, Homo sapiens
cttcccagctggcag

SEQ ID NO: 463314 - DNA, 19 bp, Homo sapiens
cttcccagctggcagcgcc

SEQ ID NO: 463315 - DNA, 20 bp, Homo sapiens
cttcccagctggcagcgcct

SEQ ID NO: 463316 - DNA, 14 bp, Homo sapiens
cttccccaccccat

SEQ ID NO: 463317 - DNA, 23 bp, Homo sapiens
cttccccaccccataagccctga

SEQ ID NO: 463318 - DNA, 10 bp, Homo sapiens
cttccccact

SEQ ID NO: 463319 - DNA, 12 bp, Homo sapiens
cttccccactcc

SEQ ID NO: 463320 - DNA, 12 bp, Homo sapiens
cttccccctcca

SEQ ID NO: 463321 - DNA, 19 bp, Homo sapiens
cttccccgtgcggcccgtg

SEQ ID NO: 463322 - DNA, 21 bp, Homo sapiens
cttcccctgaggacctttctg

SEQ ID NO: 463323 - DNA, 22 bp, Homo sapiens
cttcccctgcgccctccctccc

SEQ ID NO: 463324 - DNA, 13 bp, Homo sapiens
cttccccttctgt

SEQ ID NO: 463325 - DNA, 16 bp, Homo sapiens
cttcccgcagcaccag

SEQ ID NO: 463326 - DNA, 18 bp, Homo sapiens
cttcccgcagcaccagcc

SEQ ID NO: 463327 - DNA, 20 bp, Homo sapiens
cttcccgccttcaggttcct

SEQ ID NO: 463328 - DNA, 16 bp, Homo sapiens
cttcccgctcagccct

SEQ ID NO: 463329 - DNA, 20 bp, Homo sapiens
cttccctgcttcacgattct

SEQ ID NO: 463330 - DNA, 18 bp, Homo sapiens
cttccgtgagacacaaga

SEQ ID NO: 463331 - DNA, 13 bp, Homo sapiens
cttcctctccact

SEQ ID NO: 463332 - DNA, 15 bp, Homo sapiens
cttcctctccactgc

SEQ ID NO: 463333 - DNA, 18 bp, Homo sapiens
gagcccagaaaaaaggac

SEQ ID NO: 463334 - DNA, 17 bp, Homo sapiens
gagccccccgtgttcac

SEQ ID NO: 463335 - DNA, 12 bp, Homo sapiens
gagccccggagc

SEQ ID NO: 463336 - DNA, 16 bp, Homo sapiens
gagccccggagcacca

SEQ ID NO: 463337 - DNA, 22 bp, Homo sapiens
gagcccctatcctgcaccctct

SEQ ID NO: 463338 - DNA, 16 bp, Homo sapiens
gagccctgagcccaga

SEQ ID NO: 463339 - DNA, 24 bp, Homo sapiens
gagccctgccctcactccactccc

SEQ ID NO: 463340 - DNA, 13 bp, Homo sapiens
gagcctgtctctc

SEQ ID NO: 463341 - DNA, 15 bp, Homo sapiens
gagcgcgtgccttcc

SEQ ID NO: 463342 - DNA, 15 bp, Homo sapiens
gagcgctcctctgcc

SEQ ID NO: 463343 - DNA, 13 bp, Homo sapiens
gagcggctgagga

SEQ ID NO: 463344 - DNA, 23 bp, Homo sapiens
gagcggctgaggacggggcagag

SEQ ID NO: 463345 - DNA, 21 bp, Homo sapiens
gagctaaattacaattgtcat

SEQ ID NO: 463346 - DNA, 17 bp, Homo sapiens
gagctcaggagaaggcc

SEQ ID NO: 463347 - DNA, 17 bp, Homo sapiens
gagctcagtacagggca

SEQ ID NO: 463348 - DNA, 13 bp, Homo sapiens
gagctccaccctc

SEQ ID NO: 463349 - DNA, 14 bp, Homo sapiens
gagctccaccctcc

SEQ ID NO: 463350 - DNA, 17 bp, Homo sapiens
gagctccaccctcccct

SEQ ID NO: 463351 - DNA, 21 bp, Homo sapiens
gagctgagtcggctgggcagg

SEQ ID NO: 463352 - DNA, 15 bp, Homo sapiens
gagctgctcctttgg

SEQ ID NO: 463353 - DNA, 18 bp, Homo sapiens
gagcttgattctaaaggg

SEQ ID NO: 463354 - DNA, 21 bp, Homo sapiens
gagcttgattctaaaggggac

SEQ ID NO: 463355 - DNA, 13 bp, Homo sapiens
gaggaatgtgctt

SEQ ID NO: 463356 - DNA, 19 bp, Homo sapiens
gaggaccgccccaaccctc

SEQ ID NO: 463357 - DNA, 22 bp, Homo sapiens
gaggacggggcagagctgagtc

SEQ ID NO: 463358 - DNA, 10 bp, Homo sapiens
gaggagcacc

SEQ ID NO: 463359 - DNA, 11 bp, Homo sapiens
gaggagcaccc

SEQ ID NO: 463360 - DNA, 14 bp, Homo sapiens
gaggagcaccccca

SEQ ID NO: 463361 - DNA, 15 bp, Homo sapiens
gaggagcacccccag

SEQ ID NO: 463362 - DNA, 17 bp, Homo sapiens
gaggagcacccccagcc

SEQ ID NO: 463363 - DNA, 23 bp, Homo sapiens
gaggagcacccccagcctccccc

SEQ ID NO: 463364 - DNA, 16 bp, Homo sapiens
gaggaggtgtggagtg

SEQ ID NO: 463365 - DNA, 11 bp, Homo sapiens
gaggagtccaa

SEQ ID NO: 463366 - DNA, 14 bp, Homo sapiens
gaggagtccaaaat

SEQ ID NO: 463367 - DNA, 22 bp, Homo sapiens
gaggcagaatggtgggctccag

SEQ ID NO: 463368 - DNA, 14 bp, Homo sapiens
gaggcagggccctg

SEQ ID NO: 463369 - DNA, 15 bp, Homo sapiens
gaggcagggccctgg

SEQ ID NO: 463370 - DNA, 17 bp, Homo sapiens
gaggccagtactttgcc

SEQ ID NO: 463371 - DNA, 12 bp, Homo sapiens
gaggcgcccacc

SEQ ID NO: 463372 - DNA, 13 bp, Homo sapiens
gaggcgcccacct

SEQ ID NO: 463373 - DNA, 14 bp, Homo sapiens
gaggcgcccacctg

SEQ ID NO: 463374 - DNA, 16 bp, Homo sapiens
gaggcgcccacctgcc

SEQ ID NO: 463375 - DNA, 19 bp, Homo sapiens
gaggcgcccacctgcccag

SEQ ID NO: 463376 - DNA, 21 bp, Homo sapiens
gaggcgttgtgaatgtgtccc

SEQ ID NO: 463377 - DNA, 15 bp, Homo sapiens
gaggctgggcccctg

SEQ ID NO: 463378 - DNA, 15 bp, Homo sapiens
gagggaagcccaccc

SEQ ID NO: 463379 - DNA, 23 bp, Homo sapiens
gagggaagcccacccgccccaga

SEQ ID NO: 463380 - DNA, 23 bp, Homo sapiens
gagggacagcagattccacagga

SEQ ID NO: 463381 - DNA, 21 bp, Homo sapiens
gagggatggagaggcggcctc

SEQ ID NO: 463382 - DNA, 16 bp, Homo sapiens
gagggcactggtggcc

SEQ ID NO: 463383 - DNA, 18 bp, Homo sapiens
gagggcactggtggcccg

SEQ ID NO: 463384 - DNA, 13 bp, Homo sapiens
gagggctgagccc

SEQ ID NO: 463385 - DNA, 18 bp, Homo sapiens
gagggctgagcccctcct

SEQ ID NO: 463386 - DNA, 14 bp, Homo sapiens
gaggggactgcatg

SEQ ID NO: 463387 - DNA, 19 bp, Homo sapiens
gaggggactgcatgcaagc

SEQ ID NO: 463388 - DNA, 21 bp, Homo sapiens
gaggggactgcatgcaagctc

SEQ ID NO: 463389 - DNA, 15 bp, Homo sapiens
gaggggagaaaggaa

SEQ ID NO: 463390 - DNA, 18 bp, Homo sapiens
gaggggcctggcagccgt

SEQ ID NO: 463391 - DNA, 20 bp, Homo sapiens
gaggggcctggcagccgtgc

SEQ ID NO: 463392 - DNA, 18 bp, Homo sapiens
gagggggccagagggact

SEQ ID NO: 463393 - DNA, 16 bp, Homo sapiens
gaggggtcagcagggg

SEQ ID NO: 463394 - DNA, 23 bp, Homo sapiens
gaggggtgagacagtgggggtgc

SEQ ID NO: 463395 - DNA, 14 bp, Homo sapiens
gaggtgtggagtgg

SEQ ID NO: 463396 - DNA, 19 bp, Homo sapiens
gaggtgtggagtggagggg

SEQ ID NO: 463397 - DNA, 18 bp, Homo sapiens
gagtccactttcctctct

SEQ ID NO: 463398 - DNA, 21 bp, Homo sapiens
gagtccagctccccccaagat

SEQ ID NO: 463399 - DNA, 14 bp, Homo sapiens
gagtccattgcaaa

SEQ ID NO: 463400 - DNA, 19 bp, Homo sapiens
gagtccattgcaaaaggtt

SEQ ID NO: 463401 - DNA, 15 bp, Homo sapiens
gagtcggctgggcag

SEQ ID NO: 463402 - DNA, 19 bp, Homo sapiens
gagtcggctgggcagggcc

SEQ ID NO: 463403 - DNA, 12 bp, Homo sapiens
gagtctcttctc

SEQ ID NO: 463404 - DNA, 17 bp, Homo sapiens
gagtctcttctccactg

SEQ ID NO: 463405 - DNA, 18 bp, Homo sapiens
gagtctcttctccactgg

SEQ ID NO: 463406 - DNA, 16 bp, Homo sapiens
gagtctgaaggagagg

SEQ ID NO: 463407 - DNA, 15 bp, Homo sapiens
gagtgaatacactgg

SEQ ID NO: 463408 - DNA, 18 bp, Homo sapiens
gagtgaatacactggaat

SEQ ID NO: 463409 - DNA, 20 bp, Homo sapiens
gagtgacatgcggctgccca

SEQ ID NO: 463410 - DNA, 22 bp, Homo sapiens
gagtgatatggcttgtagggtg

SEQ ID NO: 463411 - DNA, 13 bp, Homo sapiens
gagtggctcctcc

SEQ ID NO: 463412 - DNA, 14 bp, Homo sapiens
gagttcaaatactt

SEQ ID NO: 463413 - DNA, 15 bp, Homo sapiens
gagttcaaatacttt

SEQ ID NO: 463414 - DNA, 15 bp, Homo sapiens
gagttctcctggagc

SEQ ID NO: 463415 - DNA, 16 bp, Homo sapiens
gataaaatcttcaact

SEQ ID NO: 463416 - DNA, 13 bp, Homo sapiens
gataaacattaaa

SEQ ID NO: 463417 - DNA, 15 bp, Homo sapiens
gataaacattaaaca

SEQ ID NO: 463418 - DNA, 18 bp, Homo sapiens
gataagtgctcagtattg

SEQ ID NO: 463419 - DNA, 21 bp, Homo sapiens
gataagttccaaaaataccat

SEQ ID NO: 463420 - DNA, 22 bp, Homo sapiens
gatacactgtatctaaaaaata

SEQ ID NO: 463421 - DNA, 18 bp, Homo sapiens
gatactttgatattttca

SEQ ID NO: 463422 - DNA, 15 bp, Homo sapiens
gatatcacgggcccg

SEQ ID NO: 463423 - DNA, 21 bp, Homo sapiens
gatatctttgagggctgacaa

SEQ ID NO: 463424 - DNA, 23 bp, Homo sapiens
gatatgaaagagaaaatgctttc

SEQ ID NO: 463425 - DNA, 20 bp, Homo sapiens
gatatgcatgtagcatataa

SEQ ID NO: 463426 - DNA, 16 bp, Homo sapiens
gatattgtatgtacct

SEQ ID NO: 463427 - DNA, 20 bp, Homo sapiens
gatccctcggtcagcaccgt

SEQ ID NO: 463428 - DNA, 20 bp, Homo sapiens
gatcgtttcacatctgtata

SEQ ID NO: 463429 - DNA, 19 bp, Homo sapiens
gatctaaaaggaggacagg

SEQ ID NO: 463430 - DNA, 20 bp, Homo sapiens
gatctaaaaggaggacaggg

SEQ ID NO: 463431 - DNA, 19 bp, Homo sapiens
gcccacaataatgaataat

SEQ ID NO: 463432 - DNA, 15 bp, Homo sapiens
gcccacccacacccc

SEQ ID NO: 463433 - DNA, 15 bp, Homo sapiens
gcccaccccgctgcc

SEQ ID NO: 463434 - DNA, 21 bp, Homo sapiens
gcccaccccgctgcctggcgg

SEQ ID NO: 463435 - DNA, 23 bp, Homo sapiens
gcccacccctcttcccccttccc

SEQ ID NO: 463436 - DNA, 15 bp, Homo sapiens
gcccacccgccccag

SEQ ID NO: 463437 - DNA, 15 bp, Homo sapiens
gcccaccctgggcct

SEQ ID NO: 463438 - DNA, 17 bp, Homo sapiens
gcccaccctgggcctcc

SEQ ID NO: 463439 - DNA, 19 bp, Homo sapiens
gcccaccctgggcctcccg

SEQ ID NO: 463440 - DNA, 21 bp, Homo sapiens
gcccaccctgggcctcccgtc

SEQ ID NO: 463441 - DNA, 18 bp, Homo sapiens
gcccacgcagagccccgg

SEQ ID NO: 463442 - DNA, 15 bp, Homo sapiens
gcccacgctcctgcc

SEQ ID NO: 463443 - DNA, 19 bp, Homo sapiens
gcccagaacgggcctcccc

SEQ ID NO: 463444 - DNA, 12 bp, Homo sapiens
gcccagcctctc

SEQ ID NO: 463445 - DNA, 15 bp, Homo sapiens
gcccaggaggacctg

SEQ ID NO: 463446 - DNA, 14 bp, Homo sapiens
gcccagtcttgagt

SEQ ID NO: 463447 - DNA, 17 bp, Homo sapiens
gcccagtcttgagtggg

SEQ ID NO: 463448 - DNA, 13 bp, Homo sapiens
gcccagttagccc

SEQ ID NO: 463449 - DNA, 16 bp, Homo sapiens
gcccagttagcccggc

SEQ ID NO: 463450 - DNA, 14 bp, Homo sapiens
gcccatggccccag

SEQ ID NO: 463451 - DNA, 18 bp, Homo sapiens
gcccatggccccagctgg

SEQ ID NO: 463452 - DNA, 17 bp, Homo sapiens
gcccatgtgtcccctca

SEQ ID NO: 463453 - DNA, 22 bp, Homo sapiens
gcccatgtgtcccctcactctg

SEQ ID NO: 463454 - DNA, 17 bp, Homo sapiens
gccccaaccctcggagc

SEQ ID NO: 463455 - DNA, 18 bp, Homo sapiens
gccccacccaccctctgg

SEQ ID NO: 463456 - DNA, 12 bp, Homo sapiens
gccccagagact

SEQ ID NO: 463457 - DNA, 13 bp, Homo sapiens
gccccagagactg

SEQ ID NO: 463458 - DNA, 17 bp, Homo sapiens
gccccagagactgccca

SEQ ID NO: 463459 - DNA, 20 bp, Homo sapiens
gccccagagactgcccaccc

SEQ ID NO: 463460 - DNA, 14 bp, Homo sapiens
gccccagctggctg

SEQ ID NO: 463461 - DNA, 19 bp, Homo sapiens
gccccagctggctgggtcg

SEQ ID NO: 463462 - DNA, 14 bp, Homo sapiens
gccccaggccctcc

SEQ ID NO: 463463 - DNA, 15 bp, Homo sapiens
gccccaggccctccc

SEQ ID NO: 463464 - DNA, 16 bp, Homo sapiens
gccccaggcggagggg

SEQ ID NO: 463465 - DNA, 21 bp, Homo sapiens
gccccatccttcccgcagcac

SEQ ID NO: 463466 - DNA, 22 bp, Homo sapiens
gccccatccttcccgcagcacc

SEQ ID NO: 463467 - DNA, 23 bp, Homo sapiens
gccccatccttcccgcagcacca

SEQ ID NO: 463468 - DNA, 11 bp, Homo sapiens
gccccccactc

SEQ ID NO: 463469 - DNA, 12 bp, Homo sapiens
gccccccactca

SEQ ID NO: 463470 - DNA, 23 bp, Homo sapiens
gccccccagagagagctctgcac

SEQ ID NO: 463471 - DNA, 17 bp, Homo sapiens
gcccccggaggcgccca

SEQ ID NO: 463472 - DNA, 19 bp, Homo sapiens
gcccccggaggcgcccacc

SEQ ID NO: 463473 - DNA, 15 bp, Homo sapiens
gccccctcccccgca

SEQ ID NO: 463474 - DNA, 21 bp, Homo sapiens
gccccctcccccgcagacaga

SEQ ID NO: 463475 - DNA, 15 bp, Homo sapiens
gccccgcgcgtgccc

SEQ ID NO: 463476 - DNA, 21 bp, Homo sapiens
gccccgcgcgtgcccccagcg

SEQ ID NO: 463477 - DNA, 14 bp, Homo sapiens
gccccggagcacca

SEQ ID NO: 463478 - DNA, 18 bp, Homo sapiens
gcccctatcctgcaccct

SEQ ID NO: 463479 - DNA, 19 bp, Homo sapiens
gcccctatcctgcaccctc

SEQ ID NO: 463480 - DNA, 11 bp, Homo sapiens
gcccctcctcg

SEQ ID NO: 463481 - DNA, 17 bp, Homo sapiens
gcccctcctctcctcgt

SEQ ID NO: 463482 - DNA, 19 bp, Homo sapiens
gcccctcctctcctcgtcc

SEQ ID NO: 463483 - DNA, 13 bp, Homo sapiens
gcccctccttctc

SEQ ID NO: 463484 - DNA, 18 bp, Homo sapiens
gcccctccttctcccctc

SEQ ID NO: 463485 - DNA, 23 bp, Homo sapiens
gcccctccttctcccctccagac

SEQ ID NO: 463486 - DNA, 23 bp, Homo sapiens
gcccctctctgtttaccctccct

SEQ ID NO: 463487 - DNA, 17 bp, Homo sapiens
gcccctgctggaccaag

SEQ ID NO: 463488 - DNA, 20 bp, Homo sapiens
gcccctgtaaggtttcaatg

SEQ ID NO: 463489 - DNA, 17 bp, Homo sapiens
gccccttccccctccaa

SEQ ID NO: 463490 - DNA, 17 bp, Homo sapiens
gccccttgaccccacac

SEQ ID NO: 463491 - DNA, 21 bp, Homo sapiens
gcccgaatttctcactccctt

SEQ ID NO: 463492 - DNA, 12 bp, Homo sapiens
gcccgacagcct

SEQ ID NO: 463493 - DNA, 16 bp, Homo sapiens
gcccgacagcctggca

SEQ ID NO: 463494 - DNA, 20 bp, Homo sapiens
gcccgagcgcgtgccttccc

SEQ ID NO: 463495 - DNA, 12 bp, Homo sapiens
gcccgcccaccc

SEQ ID NO: 463496 - DNA, 13 bp, Homo sapiens
gcccgcccacccc

SEQ ID NO: 463497 - DNA, 14 bp, Homo sapiens
gcccgcccaccccg

SEQ ID NO: 463498 - DNA, 12 bp, Homo sapiens
gcccgcccccgc

SEQ ID NO: 463499 - DNA, 13 bp, Homo sapiens
gcccgccctcctc

SEQ ID NO: 463500 - DNA, 15 bp, Homo sapiens
gcccgccctcctctg

SEQ ID NO: 463501 - DNA, 17 bp, Homo sapiens
gcccgccggttggccgg

SEQ ID NO: 463502 - DNA, 17 bp, Homo sapiens
gcccgctcaacctctca

SEQ ID NO: 463503 - DNA, 18 bp, Homo sapiens
gcccgctcaacctctcag

SEQ ID NO: 463504 - DNA, 23 bp, Homo sapiens
gcccgctcaacctctcagatccc

SEQ ID NO: 463505 - DNA, 22 bp, Homo sapiens
gcccggcccacgcagagccccg

SEQ ID NO: 463506 - DNA, 18 bp, Homo sapiens
gcccgtgcaacggaagcc

SEQ ID NO: 463507 - DNA, 21 bp, Homo sapiens
gcccgtgcgcagccgcgctct

SEQ ID NO: 463508 - DNA, 24 bp, Homo sapiens
gcccgtgcgcagccgcgctctgcc

SEQ ID NO: 463509 - DNA, 19 bp, Homo sapiens
gccctcactccactcccct

SEQ ID NO: 463510 - DNA, 15 bp, Homo sapiens
gccctcccccacggc

SEQ ID NO: 463511 - DNA, 20 bp, Homo sapiens
gccctcccccttccccttct

SEQ ID NO: 463512 - DNA, 23 bp, Homo sapiens
gccctcccccttccccttctgtg

SEQ ID NO: 463513 - DNA, 12 bp, Homo sapiens
gccctccctccc

SEQ ID NO: 463514 - DNA, 14 bp, Homo sapiens
gccctccctccctc

SEQ ID NO: 463515 - DNA, 16 bp, Homo sapiens
gccctccctccctcca

SEQ ID NO: 463516 - DNA, 19 bp, Homo sapiens
gccctccctccctccacac

SEQ ID NO: 463517 - DNA, 20 bp, Homo sapiens
gccctccctccctccacacc

SEQ ID NO: 463518 - DNA, 20 bp, Homo sapiens
gccctccctgactccctgtg

SEQ ID NO: 463519 - DNA, 14 bp, Homo sapiens
gccctcctctgccc

SEQ ID NO: 463520 - DNA, 18 bp, Homo sapiens
gccctcctctgccccctc

SEQ ID NO: 463521 - DNA, 13 bp, Homo sapiens
gccctctccaccc

SEQ ID NO: 463522 - DNA, 15 bp, Homo sapiens
gccctctccacccag

SEQ ID NO: 463523 - DNA, 17 bp, Homo sapiens
gccctctccacccagag

SEQ ID NO: 463524 - DNA, 13 bp, Homo sapiens
gccctctttctct

SEQ ID NO: 463525 - DNA, 17 bp, Homo sapiens
gccctctttctctctgt

SEQ ID NO: 463526 - DNA, 22 bp, Homo sapiens
gccctctttctctctgtgtggc

SEQ ID NO: 463527 - DNA, 23 bp, Homo sapiens
gccctgagcccagaaaaaaggac

SEQ ID NO: 463528 - DNA, 22 bp, Homo sapiens
gccctgcaccttgggcacggga

SEQ ID NO: 463529 - DNA, 19 bp, Homo sapiens
gctgcctggcgggcagccc

SEQ ID NO: 463530 - DNA, 21 bp, Homo sapiens
gctgcctggcgggcagcccct

SEQ ID NO: 463531 - DNA, 13 bp, Homo sapiens
gctgcgcctgccc

SEQ ID NO: 463532 - DNA, 14 bp, Homo sapiens
gctgcgcctgcccg

SEQ ID NO: 463533 - DNA, 16 bp, Homo sapiens
gctgcgcctgcccgcc

SEQ ID NO: 463534 - DNA, 14 bp, Homo sapiens
gctgctcctttggg

SEQ ID NO: 463535 - DNA, 12 bp, Homo sapiens
gctgctgtgaat

SEQ ID NO: 463536 - DNA, 14 bp, Homo sapiens
gctggaggaatcag

SEQ ID NO: 463537 - DNA, 23 bp, Homo sapiens
gctggcagcgcctcccgccgcct

SEQ ID NO: 463538 - DNA, 21 bp, Homo sapiens
gctggccagcaccctctcctg

SEQ ID NO: 463539 - DNA, 12 bp, Homo sapiens
gctggccctgcc

SEQ ID NO: 463540 - DNA, 13 bp, Homo sapiens
gctggccctgccc

SEQ ID NO: 463541 - DNA, 15 bp, Homo sapiens
gctggccctgccctc

SEQ ID NO: 463542 - DNA, 15 bp, Homo sapiens
gctgggaagaatgta

SEQ ID NO: 463543 - DNA, 15 bp, Homo sapiens
gctgggcagggccgc

SEQ ID NO: 463544 - DNA, 16 bp, Homo sapiens
gctgggcagggccgca

SEQ ID NO: 463545 - DNA, 17 bp, Homo sapiens
gctgggcagggccgcag

SEQ ID NO: 463546 - DNA, 12 bp, Homo sapiens
gctgggcccagc

SEQ ID NO: 463547 - DNA, 13 bp, Homo sapiens
gctgggcccagcc

SEQ ID NO: 463548 - DNA, 12 bp, Homo sapiens
gctgggcccctg

SEQ ID NO: 463549 - DNA, 13 bp, Homo sapiens
gctgggcccctgg

SEQ ID NO: 463550 - DNA, 15 bp, Homo sapiens
gctgggcccctggga

SEQ ID NO: 463551 - DNA, 13 bp, Homo sapiens
gctggggcctggc

SEQ ID NO: 463552 - DNA, 16 bp, Homo sapiens
gctgggtcgcccctcc

SEQ ID NO: 463553 - DNA, 17 bp, Homo sapiens
gctgggtcgcccctcct

SEQ ID NO: 463554 - DNA, 17 bp, Homo sapiens
gctgggtttgggcagtg

SEQ ID NO: 463555 - DNA, 17 bp, Homo sapiens
gctgtaatgtaacagca

SEQ ID NO: 463556 - DNA, 21 bp, Homo sapiens
gctgtattttcttttatatct

SEQ ID NO: 463557 - DNA, 19 bp, Homo sapiens
gctgtcctccagggcgagc

SEQ ID NO: 463558 - DNA, 20 bp, Homo sapiens
gctgtcctccagggcgagca

SEQ ID NO: 463559 - DNA, 20 bp, Homo sapiens
gctgtcctctcgagcccaga

SEQ ID NO: 463560 - DNA, 21 bp, Homo sapiens
gctgtcgccccaggccctccc

SEQ ID NO: 463561 - DNA, 23 bp, Homo sapiens
gctgtcgccccaggccctccctg

SEQ ID NO: 463562 - DNA, 12 bp, Homo sapiens
gctgtctgtcac

SEQ ID NO: 463563 - DNA, 13 bp, Homo sapiens
gctgtctgtcacc

SEQ ID NO: 463564 - DNA, 16 bp, Homo sapiens
gctgtgctccagcagt

SEQ ID NO: 463565 - DNA, 23 bp, Homo sapiens
gctgtgctccagcagtgctgggc

SEQ ID NO: 463566 - DNA, 23 bp, Homo sapiens
gctgtggcccctccttctcccct

SEQ ID NO: 463567 - DNA, 15 bp, Homo sapiens
gctgtgggcagcacc

SEQ ID NO: 463568 - DNA, 18 bp, Homo sapiens
gctgtgggcagcaccctc

SEQ ID NO: 463569 - DNA, 21 bp, Homo sapiens
gctgtttcgcatccaccgcca

SEQ ID NO: 463570 - DNA, 21 bp, Homo sapiens
gctgttttatgtcatactctg

SEQ ID NO: 463571 - DNA, 17 bp, Homo sapiens
gctgttttgaataacat

SEQ ID NO: 463572 - DNA, 12 bp, Homo sapiens
gcttaaacattt

SEQ ID NO: 463573 - DNA, 14 bp, Homo sapiens
gcttaacataaact

SEQ ID NO: 463574 - DNA, 13 bp, Homo sapiens
gcttagaatgggg

SEQ ID NO: 463575 - DNA, 16 bp, Homo sapiens
gcttagaatggggctt

SEQ ID NO: 463576 - DNA, 17 bp, Homo sapiens
gcttagcgttctgtttc

SEQ ID NO: 463577 - DNA, 23 bp, Homo sapiens
gcttatcagaactcctttctaag

SEQ ID NO: 463578 - DNA, 15 bp, Homo sapiens
gcttcccgctcagcc

SEQ ID NO: 463579 - DNA, 16 bp, Homo sapiens
gcttcccgctcagccc

SEQ ID NO: 463580 - DNA, 13 bp, Homo sapiens
gcttctcctctgc

SEQ ID NO: 463581 - DNA, 21 bp, Homo sapiens
gcttgattctaaaggggacag

SEQ ID NO: 463582 - DNA, 21 bp, Homo sapiens
gcttggaacatttgggagact

SEQ ID NO: 463583 - DNA, 11 bp, Homo sapiens
gcttggagcag

SEQ ID NO: 463584 - DNA, 20 bp, Homo sapiens
gcttggagcagagacggcag

SEQ ID NO: 463585 - DNA, 14 bp, Homo sapiens
gcttggggtagaga

SEQ ID NO: 463586 - DNA, 18 bp, Homo sapiens
gcttgtagggtgaggcgt

SEQ ID NO: 463587 - DNA, 19 bp, Homo sapiens
gcttgtagggtgaggcgtg

SEQ ID NO: 463588 - DNA, 11 bp, Homo sapiens
gcttgttcttc

SEQ ID NO: 463589 - DNA, 22 bp, Homo sapiens
gcttgtttctatactgtttgta

SEQ ID NO: 463590 - DNA, 13 bp, Homo sapiens
gctttcacaaata

SEQ ID NO: 463591 - DNA, 14 bp, Homo sapiens
gctttcacaaatat

SEQ ID NO: 463592 - DNA, 11 bp, Homo sapiens
gctttctattg

SEQ ID NO: 463593 - DNA, 19 bp, Homo sapiens
gctttgggctgccctggtg

SEQ ID NO: 463594 - DNA, 23 bp, Homo sapiens
gcttttcactgctggctgcctta

SEQ ID NO: 463595 - DNA, 21 bp, Homo sapiens
ggaaaaccaagccgtggcttc

SEQ ID NO: 463596 - DNA, 18 bp, Homo sapiens
ggaaagggtgtggcttgg

SEQ ID NO: 463597 - DNA, 20 bp, Homo sapiens
ggaaagttctattatctggg

SEQ ID NO: 463598 - DNA, 13 bp, Homo sapiens
ggaaataaatcta

SEQ ID NO: 463599 - DNA, 17 bp, Homo sapiens
ggaaatgtcaacaagta

SEQ ID NO: 463600 - DNA, 15 bp, Homo sapiens
ggaacaaagacaacc

SEQ ID NO: 463601 - DNA, 20 bp, Homo sapiens
ggaacagccaaagaaactca

SEQ ID NO: 463602 - DNA, 22 bp, Homo sapiens
ggaacatccggaacagccaaag

SEQ ID NO: 463603 - DNA, 13 bp, Homo sapiens
ggaagatgccaag

SEQ ID NO: 463604 - DNA, 15 bp, Homo sapiens
ggaagcccacccgcc

SEQ ID NO: 463605 - DNA, 24 bp, Homo sapiens
ggaagcccacccgccccagagact

SEQ ID NO: 463606 - DNA, 16 bp, Homo sapiens
ggaaggcctgagggaa

SEQ ID NO: 463607 - DNA, 21 bp, Homo sapiens
ggaaggcctgagggaagccca

SEQ ID NO: 463608 - DNA, 18 bp, Homo sapiens
ggacaatgagtggaatac

SEQ ID NO: 463609 - DNA, 17 bp, Homo sapiens
ggacagcagattccaca

SEQ ID NO: 463610 - DNA, 17 bp, Homo sapiens
ggacagcggcccggccc

SEQ ID NO: 463611 - DNA, 22 bp, Homo sapiens
ggacagcggcccggcccacgca

SEQ ID NO: 463612 - DNA, 22 bp, Homo sapiens
ggaccaaggtgcggaccggagc

SEQ ID NO: 463613 - DNA, 17 bp, Homo sapiens
ggacccccgaggccccc

SEQ ID NO: 463614 - DNA, 20 bp, Homo sapiens
ggacccccggcctccaggct

SEQ ID NO: 463615 - DNA, 22 bp, Homo sapiens
ggacccccggcctccaggctgg

SEQ ID NO: 463616 - DNA, 12 bp, Homo sapiens
ggacgctggctc

SEQ ID NO: 463617 - DNA, 15 bp, Homo sapiens
ggacggggcagagct

SEQ ID NO: 463618 - DNA, 16 bp, Homo sapiens
ggacggggcagagctg

SEQ ID NO: 463619 - DNA, 18 bp, Homo sapiens
ggactggcccacccctct

SEQ ID NO: 463620 - DNA, 19 bp, Homo sapiens
ggactggtggcccctgcct

SEQ ID NO: 463621 - DNA, 11 bp, Homo sapiens
ggactttattt

SEQ ID NO: 463622 - DNA, 18 bp, Homo sapiens
ggactttatttaatttca

SEQ ID NO: 463623 - DNA, 22 bp, Homo sapiens
ggactttatttaatttcataaa

SEQ ID NO: 463624 - DNA, 23 bp, Homo sapiens
ggactttatttaatttcataaat

SEQ ID NO: 463625 - DNA, 22 bp, Homo sapiens
ggagaaaggaacttttaaactg

SEQ ID NO: 463626 - DNA, 21 bp, Homo sapiens
ggagaacctcgttgacatgca

SEQ ID NO: 463627 - DNA, 23 bp, Homo sapiens
gggaaggcctgagggaagcccac

SEQ ID NO: 463628 - DNA, 16 bp, Homo sapiens
gggaatccatatcagc

SEQ ID NO: 463629 - DNA, 13 bp, Homo sapiens
gggacagcggccc

SEQ ID NO: 463630 - DNA, 15 bp, Homo sapiens
gggacagcggcccgg

SEQ ID NO: 463631 - DNA, 19 bp, Homo sapiens
gggactggcccacccctct

SEQ ID NO: 463632 - DNA, 23 bp, Homo sapiens
gggactgtcttcaaccctgccct

SEQ ID NO: 463633 - DNA, 23 bp, Homo sapiens
gggagaacctcgttgacatgcac

SEQ ID NO: 463634 - DNA, 13 bp, Homo sapiens
gggagactgagct

SEQ ID NO: 463635 - DNA, 23 bp, Homo sapiens
gggagagcgccacccgcccgccc

SEQ ID NO: 463636 - DNA, 15 bp, Homo sapiens
gggagccatgctctt

SEQ ID NO: 463637 - DNA, 19 bp, Homo sapiens
gggaggagcacccccagcc

SEQ ID NO: 463638 - DNA, 16 bp, Homo sapiens
gggagggaacagacct

SEQ ID NO: 463639 - DNA, 15 bp, Homo sapiens
gggagggtgggcgtg

SEQ ID NO: 463640 - DNA, 20 bp, Homo sapiens
gggagtccactttcctctct

SEQ ID NO: 463641 - DNA, 20 bp, Homo sapiens
gggatctaaaaggaggacag

SEQ ID NO: 463642 - DNA, 23 bp, Homo sapiens
gggcaagagctcaggagaaggcc

SEQ ID NO: 463643 - DNA, 20 bp, Homo sapiens
gggcacgggagagcgccacc

SEQ ID NO: 463644 - DNA, 16 bp, Homo sapiens
gggcactggtggcccg

SEQ ID NO: 463645 - DNA, 16 bp, Homo sapiens
gggcagagctgagtcg

SEQ ID NO: 463646 - DNA, 11 bp, Homo sapiens
gggcagcccct

SEQ ID NO: 463647 - DNA, 12 bp, Homo sapiens
gggcagcccctg

SEQ ID NO: 463648 - DNA, 13 bp, Homo sapiens
gggcaggagctgc

SEQ ID NO: 463649 - DNA, 14 bp, Homo sapiens
gggcagggccgcag

SEQ ID NO: 463650 - DNA, 17 bp, Homo sapiens
gggcagggccgcagggc

SEQ ID NO: 463651 - DNA, 18 bp, Homo sapiens
gggcaggtcctgcccatg

SEQ ID NO: 463652 - DNA, 14 bp, Homo sapiens
gggcagtggagagg

SEQ ID NO: 463653 - DNA, 16 bp, Homo sapiens
gggcagtggagagggg

SEQ ID NO: 463654 - DNA, 20 bp, Homo sapiens
gggcatctgagtccagctcc

SEQ ID NO: 463655 - DNA, 20 bp, Homo sapiens
gggccaagccagggttccag

SEQ ID NO: 463656 - DNA, 19 bp, Homo sapiens
gggcccatggccccagctg

SEQ ID NO: 463657 - DNA, 13 bp, Homo sapiens
gggccccctctct

SEQ ID NO: 463658 - DNA, 17 bp, Homo sapiens
gggcccctccacgcctc

SEQ ID NO: 463659 - DNA, 13 bp, Homo sapiens
gggcccgagcgcg

SEQ ID NO: 463660 - DNA, 17 bp, Homo sapiens
gggcccgctcaacctct

SEQ ID NO: 463661 - DNA, 20 bp, Homo sapiens
gggcccgctcaacctctcag

SEQ ID NO: 463662 - DNA, 14 bp, Homo sapiens
gggccctgggcctc

SEQ ID NO: 463663 - DNA, 19 bp, Homo sapiens
gggccctggggtctctgag

SEQ ID NO: 463664 - DNA, 23 bp, Homo sapiens
gggccctggggtctctgagcagt

SEQ ID NO: 463665 - DNA, 14 bp, Homo sapiens
gggccgcagggcgc

SEQ ID NO: 463666 - DNA, 15 bp, Homo sapiens
gggccgcagggcgct

SEQ ID NO: 463667 - DNA, 23 bp, Homo sapiens
gggccgcagggcgctccggcaga

SEQ ID NO: 463668 - DNA, 14 bp, Homo sapiens
gggccgcctcctcc

SEQ ID NO: 463669 - DNA, 16 bp, Homo sapiens
gggccgcctcctccag

SEQ ID NO: 463670 - DNA, 13 bp, Homo sapiens
gggccgggcaggt

SEQ ID NO: 463671 - DNA, 10 bp, Homo sapiens
gggcctggca

SEQ ID NO: 463672 - DNA, 12 bp, Homo sapiens
gggcctggccta

SEQ ID NO: 463673 - DNA, 18 bp, Homo sapiens
gggcctggcctatttaag

SEQ ID NO: 463674 - DNA, 19 bp, Homo sapiens
gggcgcctgcgctcctctg

SEQ ID NO: 463675 - DNA, 18 bp, Homo sapiens
gggcgctccggcagaggc

SEQ ID NO: 463676 - DNA, 23 bp, Homo sapiens
gggcgctccggcagaggcagggc

SEQ ID NO: 463677 - DNA, 19 bp, Homo sapiens
gggctaactggccccaggc

SEQ ID NO: 463678 - DNA, 20 bp, Homo sapiens
gggctccagagtaggtgggt

SEQ ID NO: 463679 - DNA, 16 bp, Homo sapiens
gggctctgccctccct

SEQ ID NO: 463680 - DNA, 22 bp, Homo sapiens
gggctctgccctccctccttcc

SEQ ID NO: 463681 - DNA, 15 bp, Homo sapiens
gggctgagcccctcc

SEQ ID NO: 463682 - DNA, 21 bp, Homo sapiens
gggctgccctggtgctgccac

SEQ ID NO: 463683 - DNA, 13 bp, Homo sapiens
gggctggccctgc

SEQ ID NO: 463684 - DNA, 23 bp, Homo sapiens
gggcttatcagaactcctttcta

SEQ ID NO: 463685 - DNA, 19 bp, Homo sapiens
gggcttggggtagagagga

SEQ ID NO: 463686 - DNA, 20 bp, Homo sapiens
gggcttggggtagagaggac

SEQ ID NO: 463687 - DNA, 19 bp, Homo sapiens
ggggacagatcttgagcaa

SEQ ID NO: 463688 - DNA, 18 bp, Homo sapiens
ggggactgcatgcaagct

SEQ ID NO: 463689 - DNA, 15 bp, Homo sapiens
ggggaggagcacccc

SEQ ID NO: 463690 - DNA, 16 bp, Homo sapiens
ggggaggagcaccccc

SEQ ID NO: 463691 - DNA, 18 bp, Homo sapiens
ggggaggagcacccccag

SEQ ID NO: 463692 - DNA, 22 bp, Homo sapiens
ggggaggagcacccccagcctc

SEQ ID NO: 463693 - DNA, 14 bp, Homo sapiens
ggggatgggccagg

SEQ ID NO: 463694 - DNA, 13 bp, Homo sapiens
ggggattcaaatg

SEQ ID NO: 463695 - DNA, 18 bp, Homo sapiens
ggggattcaaatgcatga

SEQ ID NO: 463696 - DNA, 22 bp, Homo sapiens
ggggcaagagctcaggagaagg

SEQ ID NO: 463697 - DNA, 14 bp, Homo sapiens
ggggccagagggac

SEQ ID NO: 463698 - DNA, 14 bp, Homo sapiens
ggggccctgggcct

SEQ ID NO: 463699 - DNA, 23 bp, Homo sapiens
ggggctctgccctccctccttcc

SEQ ID NO: 463700 - DNA, 13 bp, Homo sapiens
ggggctggccctg

SEQ ID NO: 463701 - DNA, 17 bp, Homo sapiens
ggggctggccctgccct

SEQ ID NO: 463702 - DNA, 21 bp, Homo sapiens
ggggctggccctgccctcccc

SEQ ID NO: 463703 - DNA, 17 bp, Homo sapiens
ggggcttggaagggcgc

SEQ ID NO: 463704 - DNA, 13 bp, Homo sapiens
ggggcttggagca

SEQ ID NO: 463705 - DNA, 14 bp, Homo sapiens
ggggcttggagcag

SEQ ID NO: 463706 - DNA, 18 bp, Homo sapiens
ggggcttggagcagagac

SEQ ID NO: 463707 - DNA, 20 bp, Homo sapiens
ggggcttggggtagagagga

SEQ ID NO: 463708 - DNA, 23 bp, Homo sapiens
ggggcttggggtagagaggacag

SEQ ID NO: 463709 - DNA, 19 bp, Homo sapiens
gggggctaactggccccag

SEQ ID NO: 463710 - DNA, 20 bp, Homo sapiens
gggggcttggggtagagagg

SEQ ID NO: 463711 - DNA, 23 bp, Homo sapiens
gggggtgcctggtgcgctgtgct

SEQ ID NO: 463712 - DNA, 21 bp, Homo sapiens
ggggtaagttgaagggaaatc

SEQ ID NO: 463713 - DNA, 15 bp, Homo sapiens
ggggtagagaggaca

SEQ ID NO: 463714 - DNA, 20 bp, Homo sapiens
ggggtcgggggaggagcacc

SEQ ID NO: 463715 - DNA, 23 bp, Homo sapiens
ggggtgcctggtgcgctgtgctc

SEQ ID NO: 463716 - DNA, 12 bp, Homo sapiens
ggggtggggtgc

SEQ ID NO: 463717 - DNA, 15 bp, Homo sapiens
ggggtggggtgcctg

SEQ ID NO: 463718 - DNA, 19 bp, Homo sapiens
ggggttgcctcgagtcccc

SEQ ID NO: 463719 - DNA, 18 bp, Homo sapiens
ggggttgggttccagaca

SEQ ID NO: 463720 - DNA, 15 bp, Homo sapiens
gggtagagaggacag

SEQ ID NO: 463721 - DNA, 21 bp, Homo sapiens
gggtcgggggaggagcacccc

SEQ ID NO: 463722 - DNA, 13 bp, Homo sapiens
gggtctctgagca

SEQ ID NO: 463723 - DNA, 14 bp, Homo sapiens
gggtctctgagcag

SEQ ID NO: 463724 - DNA, 22 bp, Homo sapiens
gtcttgttttttttttccactt

SEQ ID NO: 463725 - DNA, 20 bp, Homo sapiens
gtctttagtgatgcaataaa

SEQ ID NO: 463726 - DNA, 23 bp, Homo sapiens
gtctttggagagctcagtacagg

SEQ ID NO: 463727 - DNA, 15 bp, Homo sapiens
gtgaagcccaggagg

SEQ ID NO: 463728 - DNA, 15 bp, Homo sapiens
gtgaagcctttatct

SEQ ID NO: 463729 - DNA, 15 bp, Homo sapiens
gtgaataaaaaccct

SEQ ID NO: 463730 - DNA, 16 bp, Homo sapiens
gtgaataacagactat

SEQ ID NO: 463731 - DNA, 19 bp, Homo sapiens
gtgaatgagtaaataaact

SEQ ID NO: 463732 - DNA, 20 bp, Homo sapiens
gtgaatgagtaaataaactc

SEQ ID NO: 463733 - DNA, 21 bp, Homo sapiens
gtgaatgagtaaataaactct

SEQ ID NO: 463734 - DNA, 16 bp, Homo sapiens
gtgacaggaaagccct

SEQ ID NO: 463735 - DNA, 17 bp, Homo sapiens
gtgacaggaaagccctc

SEQ ID NO: 463736 - DNA, 19 bp, Homo sapiens
gtgaccggcccgccacctt

SEQ ID NO: 463737 - DNA, 12 bp, Homo sapiens
gtgactgtccca

SEQ ID NO: 463738 - DNA, 12 bp, Homo sapiens
gtgatacactgt

SEQ ID NO: 463739 - DNA, 13 bp, Homo sapiens
gtgatgatagcac

SEQ ID NO: 463740 - DNA, 22 bp, Homo sapiens
gtgatggttcccctgttcactc

SEQ ID NO: 463741 - DNA, 15 bp, Homo sapiens
gtgcaatatgagggg

SEQ ID NO: 463742 - DNA, 23 bp, Homo sapiens
gtgcaatatgaggggactgcatg

SEQ ID NO: 463743 - DNA, 18 bp, Homo sapiens
gtgcaggcgcgcaccgcc

SEQ ID NO: 463744 - DNA, 20 bp, Homo sapiens
gtgcaggcgcgcaccgccca

SEQ ID NO: 463745 - DNA, 13 bp, Homo sapiens
gtgcatctcagcc

SEQ ID NO: 463746 - DNA, 14 bp, Homo sapiens
gtgcatctcagccc

SEQ ID NO: 463747 - DNA, 12 bp, Homo sapiens
gtgcatttaaaa

SEQ ID NO: 463748 - DNA, 14 bp, Homo sapiens
gtgccaaagatagc

SEQ ID NO: 463749 - DNA, 13 bp, Homo sapiens
gtgcctgagcccg

SEQ ID NO: 463750 - DNA, 14 bp, Homo sapiens
gtgcctgcaccagg

SEQ ID NO: 463751 - DNA, 15 bp, Homo sapiens
gtgcgcagccgcgct

SEQ ID NO: 463752 - DNA, 11 bp, Homo sapiens
gtgcggcccgt

SEQ ID NO: 463753 - DNA, 19 bp, Homo sapiens
gtgcggcccgtgcgcagcc

SEQ ID NO: 463754 - DNA, 13 bp, Homo sapiens
gtgcgtgtggccc

SEQ ID NO: 463755 - DNA, 22 bp, Homo sapiens
gtgctcagtattgacgacctac

SEQ ID NO: 463756 - DNA, 19 bp, Homo sapiens
gtgctccagcagtgctggg

SEQ ID NO: 463757 - DNA, 17 bp, Homo sapiens
gtgctccctcctcagtc

SEQ ID NO: 463758 - DNA, 13 bp, Homo sapiens
gtgctcggacaca

SEQ ID NO: 463759 - DNA, 17 bp, Homo sapiens
gtgctcggacacagttt

SEQ ID NO: 463760 - DNA, 17 bp, Homo sapiens
gtgctgctgcaccaacc

SEQ ID NO: 463761 - DNA, 14 bp, Homo sapiens
gtgctgggcccagc

SEQ ID NO: 463762 - DNA, 15 bp, Homo sapiens
gtgctgggcccagcc

SEQ ID NO: 463763 - DNA, 17 bp, Homo sapiens
gtgctgtgggcagcacc

SEQ ID NO: 463764 - DNA, 13 bp, Homo sapiens
gtgctttcatgtt

SEQ ID NO: 463765 - DNA, 19 bp, Homo sapiens
gtgctttcatgtttaagaa

SEQ ID NO: 463766 - DNA, 23 bp, Homo sapiens
gtgctttcatgtttaagaaatga

SEQ ID NO: 463767 - DNA, 17 bp, Homo sapiens
gtggactttatttaatt

SEQ ID NO: 463768 - DNA, 12 bp, Homo sapiens
gtggagtggagg

SEQ ID NO: 463769 - DNA, 12 bp, Homo sapiens
gtggatgctctt

SEQ ID NO: 463770 - DNA, 15 bp, Homo sapiens
gtggcaaaaaagaac

SEQ ID NO: 463771 - DNA, 20 bp, Homo sapiens
gtggcaggcacacagcagcc

SEQ ID NO: 463772 - DNA, 23 bp, Homo sapiens
gtggcaggcacacagcagccccc

SEQ ID NO: 463773 - DNA, 21 bp, Homo sapiens
gtggccatccctgggcccctc

SEQ ID NO: 463774 - DNA, 22 bp, Homo sapiens
gtggccatccctgggcccctcc

SEQ ID NO: 463775 - DNA, 14 bp, Homo sapiens
gtggcctcagccct

SEQ ID NO: 463776 - DNA, 15 bp, Homo sapiens
gtggcctcagccctc

SEQ ID NO: 463777 - DNA, 18 bp, Homo sapiens
gtggcctcagccctcaga

SEQ ID NO: 463778 - DNA, 14 bp, Homo sapiens
gtggcctgagaaga

SEQ ID NO: 463779 - DNA, 15 bp, Homo sapiens
gtggctcattctttt

SEQ ID NO: 463780 - DNA, 19 bp, Homo sapiens
gtggcttcccgctcagccc

SEQ ID NO: 463781 - DNA, 21 bp, Homo sapiens
gtggcttcccgctcagccctc

SEQ ID NO: 463782 - DNA, 18 bp, Homo sapiens
gtggcttggaacatttgg

SEQ ID NO: 463783 - DNA, 18 bp, Homo sapiens
gtgggactggcccacccc

SEQ ID NO: 463784 - DNA, 13 bp, Homo sapiens
gtgggatccagag

SEQ ID NO: 463785 - DNA, 14 bp, Homo sapiens
gtgggatccagaga

SEQ ID NO: 463786 - DNA, 17 bp, Homo sapiens
gtgggcagcaccctccc

SEQ ID NO: 463787 - DNA, 15 bp, Homo sapiens
gtggggagcgggggc

SEQ ID NO: 463788 - DNA, 17 bp, Homo sapiens
gtggggcccatggcccc

SEQ ID NO: 463789 - DNA, 20 bp, Homo sapiens
gtggggcccatggccccagc

SEQ ID NO: 463790 - DNA, 24 bp, Homo sapiens
gtggggcttagaatggggcttcca

SEQ ID NO: 463791 - DNA, 14 bp, Homo sapiens
gtggggtgcctgag

SEQ ID NO: 463792 - DNA, 17 bp, Homo sapiens
gtggtcttggagaggag

SEQ ID NO: 463793 - DNA, 15 bp, Homo sapiens
gtggtgatgcctaaa

SEQ ID NO: 463794 - DNA, 14 bp, Homo sapiens
gtggtgtgaggccc

SEQ ID NO: 463795 - DNA, 15 bp, Homo sapiens
gtggtgtgaggcccc

SEQ ID NO: 463796 - DNA, 23 bp, Homo sapiens
gtgtatttctattttgcagcagt

SEQ ID NO: 463797 - DNA, 10 bp, Homo sapiens
gtgtcacagt

SEQ ID NO: 463798 - DNA, 23 bp, Homo sapiens
gtgtcacagttcttggtgactgt

SEQ ID NO: 463799 - DNA, 19 bp, Homo sapiens
gtgtcccagcacctggcac

SEQ ID NO: 463800 - DNA, 13 bp, Homo sapiens
gtgtcccctcact

SEQ ID NO: 463801 - DNA, 14 bp, Homo sapiens
gtgtcccgttgtgt

SEQ ID NO: 463802 - DNA, 17 bp, Homo sapiens
gtgtgaggcccccggag

SEQ ID NO: 463803 - DNA, 13 bp, Homo sapiens
gtgtggagtggag

SEQ ID NO: 463804 - DNA, 17 bp, Homo sapiens
gtgtggagtggaggggt

SEQ ID NO: 463805 - DNA, 16 bp, Homo sapiens
gtgtggcaaacattta

SEQ ID NO: 463806 - DNA, 23 bp, Homo sapiens
gtgtggccctgtgggagtccact

SEQ ID NO: 463807 - DNA, 13 bp, Homo sapiens
gtgtggcctcagc

SEQ ID NO: 463808 - DNA, 17 bp, Homo sapiens
gtgtggcctcagccctc

SEQ ID NO: 463809 - DNA, 15 bp, Homo sapiens
gtgtggggagggtgg

SEQ ID NO: 463810 - DNA, 16 bp, Homo sapiens
gtgtggggagggtggg

SEQ ID NO: 463811 - DNA, 17 bp, Homo sapiens
gtgtggggagggtgggc

SEQ ID NO: 463812 - DNA, 17 bp, Homo sapiens
gtgtgggtttactctgt

SEQ ID NO: 463813 - DNA, 18 bp, Homo sapiens
gtgtgggtttactctgtg

SEQ ID NO: 463814 - DNA, 14 bp, Homo sapiens
gtgttataacacca

SEQ ID NO: 463815 - DNA, 13 bp, Homo sapiens
gtgttcccttggc

SEQ ID NO: 463816 - DNA, 22 bp, Homo sapiens
gtgttttcgagcaggactaaca

SEQ ID NO: 463817 - DNA, 19 bp, Homo sapiens
gtgttttgggtttttaaaa

SEQ ID NO: 463818 - DNA, 21 bp, Homo sapiens
gttaacccagtgttcagcata

SEQ ID NO: 463819 - DNA, 12 bp, Homo sapiens
gttaagccatat

SEQ ID NO: 463820 - DNA, 12 bp, Homo sapiens
gttaaggacttc

SEQ ID NO: 463821 - DNA, 19 bp, Homo sapiens
gttaaggacttctgcagct

SEQ ID NO: 463822 - DNA, 20 bp, Homo sapiens
tatctgctgcctctgaaaat

SEQ ID NO: 463823 - DNA, 21 bp, Homo sapiens
tatctgctgcctctgaaaata

SEQ ID NO: 463824 - DNA, 21 bp, Homo sapiens
tatctgggggactagaacaca

SEQ ID NO: 463825 - DNA, 19 bp, Homo sapiens
tatctgggttttagaaatt

SEQ ID NO: 463826 - DNA, 21 bp, Homo sapiens
tatctgtaaatttaactgcat

SEQ ID NO: 463827 - DNA, 21 bp, Homo sapiens
tatctgtcatctctctggggc

SEQ ID NO: 463828 - DNA, 13 bp, Homo sapiens
tatgaaagagaaa

SEQ ID NO: 463829 - DNA, 14 bp, Homo sapiens
tatgaaagagaaaa

SEQ ID NO: 463830 - DNA, 23 bp, Homo sapiens
tatgaaagagaaaatgctttctc

SEQ ID NO: 463831 - DNA, 22 bp, Homo sapiens
tatgaataattatgtttacctc

SEQ ID NO: 463832 - DNA, 20 bp, Homo sapiens
tatgacaatttcaaaatgca

SEQ ID NO: 463833 - DNA, 21 bp, Homo sapiens
tatgacaatttcaaaatgcat

SEQ ID NO: 463834 - DNA, 22 bp, Homo sapiens
tatgacaatttcaaaatgcatg

SEQ ID NO: 463835 - DNA, 16 bp, Homo sapiens
tatgaggggactgcat

SEQ ID NO: 463836 - DNA, 14 bp, Homo sapiens
tatgattctcctct

SEQ ID NO: 463837 - DNA, 17 bp, Homo sapiens
tatgattgaaaagaaga

SEQ ID NO: 463838 - DNA, 13 bp, Homo sapiens
tatgcatgtagca

SEQ ID NO: 463839 - DNA, 21 bp, Homo sapiens
tatgcatgtagcatataaatg

SEQ ID NO: 463840 - DNA, 22 bp, Homo sapiens
tatgctgagtatgttaagctct

SEQ ID NO: 463841 - DNA, 15 bp, Homo sapiens
tatgctgcaatacat

SEQ ID NO: 463842 - DNA, 11 bp, Homo sapiens
tatgctgctgt

SEQ ID NO: 463843 - DNA, 18 bp, Homo sapiens
tatgctgctgtgaatttt

SEQ ID NO: 463844 - DNA, 19 bp, Homo sapiens
tatgctggccagcaccctc

SEQ ID NO: 463845 - DNA, 22 bp, Homo sapiens
tatgctggccagcaccctctcc

SEQ ID NO: 463846 - DNA, 16 bp, Homo sapiens
tatggaaagggtgtgg

SEQ ID NO: 463847 - DNA, 23 bp, Homo sapiens
tatggcaagtttttggtaatgat

SEQ ID NO: 463848 - DNA, 18 bp, Homo sapiens
tatgggaggaacaaagac

SEQ ID NO: 463849 - DNA, 17 bp, Homo sapiens
tatggtatgctggccag

SEQ ID NO: 463850 - DNA, 15 bp, Homo sapiens
tatgtaagaagaaac

SEQ ID NO: 463851 - DNA, 16 bp, Homo sapiens
tatgtaagaagaaact

SEQ ID NO: 463852 - DNA, 14 bp, Homo sapiens
tatgtagaactgtt

SEQ ID NO: 463853 - DNA, 11 bp, Homo sapiens
tatgtctgtga

SEQ ID NO: 463854 - DNA, 18 bp, Homo sapiens
tatgttaagctctttatg

SEQ ID NO: 463855 - DNA, 19 bp, Homo sapiens
tatgttaagctctttatga

SEQ ID NO: 463856 - DNA, 15 bp, Homo sapiens
tatgtttacctcact

SEQ ID NO: 463857 - DNA, 15 bp, Homo sapiens
tattaaaatactgtt

SEQ ID NO: 463858 - DNA, 15 bp, Homo sapiens
tattaaacttcagca

SEQ ID NO: 463859 - DNA, 23 bp, Homo sapiens
tattataatataatatggaacct

SEQ ID NO: 463860 - DNA, 14 bp, Homo sapiens
tattatgcaaagta

SEQ ID NO: 463861 - DNA, 20 bp, Homo sapiens
tattcaactaatacatggtt

SEQ ID NO: 463862 - DNA, 18 bp, Homo sapiens
tattccatccatatactt

SEQ ID NO: 463863 - DNA, 13 bp, Homo sapiens
tattcctgccttt

SEQ ID NO: 463864 - DNA, 20 bp, Homo sapiens
tattctagtcaactgctgtt

SEQ ID NO: 463865 - DNA, 22 bp, Homo sapiens
tattctagtcaactgctgtttt

SEQ ID NO: 463866 - DNA, 12 bp, Homo sapiens
tattctattgca

SEQ ID NO: 463867 - DNA, 10 bp, Homo sapiens
tattctgtca

SEQ ID NO: 463868 - DNA, 16 bp, Homo sapiens
tattctgtggattcta

SEQ ID NO: 463869 - DNA, 20 bp, Homo sapiens
tattctgtggattctatatt

SEQ ID NO: 463870 - DNA, 21 bp, Homo sapiens
tattctgtggattctatattt

SEQ ID NO: 463871 - DNA, 18 bp, Homo sapiens
tattcttgctttcacaaa

SEQ ID NO: 463872 - DNA, 21 bp, Homo sapiens
tattgacgacctacatctgaa

SEQ ID NO: 463873 - DNA, 23 bp, Homo sapiens
tattgacgacctacatctgaaat

SEQ ID NO: 463874 - DNA, 15 bp, Homo sapiens
tattgtagcatttct

SEQ ID NO: 463875 - DNA, 16 bp, Homo sapiens
tattgtagcatttctt

SEQ ID NO: 463876 - DNA, 14 bp, Homo sapiens
tatttattaaactt

SEQ ID NO: 463877 - DNA, 23 bp, Homo sapiens
tatttatttctagcaaacagatg

SEQ ID NO: 463878 - DNA, 13 bp, Homo sapiens
tatttccaacaaa

SEQ ID NO: 463879 - DNA, 22 bp, Homo sapiens
tatttctaagcttatttctaac

SEQ ID NO: 463880 - DNA, 17 bp, Homo sapiens
tatttctatctgcaaat

SEQ ID NO: 463881 - DNA, 18 bp, Homo sapiens
tatttgaaaaaagaagag

SEQ ID NO: 463882 - DNA, 15 bp, Homo sapiens
tatttgatctggtgc

SEQ ID NO: 463883 - DNA, 21 bp, Homo sapiens
tatttgtagctagaatatcct

SEQ ID NO: 463884 - DNA, 14 bp, Homo sapiens
tattttaaactact

SEQ ID NO: 463885 - DNA, 21 bp, Homo sapiens
tattttaaactactgattgaa

SEQ ID NO: 463886 - DNA, 14 bp, Homo sapiens
tattttactttgtg

SEQ ID NO: 463887 - DNA, 19 bp, Homo sapiens
tattttactttgtgcaata

SEQ ID NO: 463888 - DNA, 19 bp, Homo sapiens
tattttctatatttggatt

SEQ ID NO: 463889 - DNA, 13 bp, Homo sapiens
tattttctgaatt

SEQ ID NO: 463890 - DNA, 14 bp, Homo sapiens
tattttctgaattc

SEQ ID NO: 463891 - DNA, 22 bp, Homo sapiens
tattttctgaattcataaaaat

SEQ ID NO: 463892 - DNA, 14 bp, Homo sapiens
tatttttttctagc

SEQ ID NO: 463893 - DNA, 14 bp, Homo sapiens
tcaaaatacttctt

SEQ ID NO: 463894 - DNA, 23 bp, Homo sapiens
tcaaaatagttctatttctatct

SEQ ID NO: 463895 - DNA, 12 bp, Homo sapiens
tcaaaatgcatg

SEQ ID NO: 463896 - DNA, 15 bp, Homo sapiens
tcaaacactgcttaa

SEQ ID NO: 463897 - DNA, 19 bp, Homo sapiens
tcaaacactgcttaaggaa

SEQ ID NO: 463898 - DNA, 17 bp, Homo sapiens
tcaaacaggaatttctg

SEQ ID NO: 463899 - DNA, 15 bp, Homo sapiens
tcaaacagtgtggct

SEQ ID NO: 463900 - DNA, 23 bp, Homo sapiens
tcaaacagtgtggcttaaacatt

SEQ ID NO: 463901 - DNA, 17 bp, Homo sapiens
tcaaagaacccccctcc

SEQ ID NO: 463902 - DNA, 18 bp, Homo sapiens
tcaaagaacccccctccc

SEQ ID NO: 463903 - DNA, 20 bp, Homo sapiens
tcaaagaacccccctcccca

SEQ ID NO: 463904 - DNA, 20 bp, Homo sapiens
tcaaatgagtttaaaaaaat

SEQ ID NO: 463905 - DNA, 20 bp, Homo sapiens
tcaaatgctactcagtatat

SEQ ID NO: 463906 - DNA, 17 bp, Homo sapiens
tcaacacttattttctg

SEQ ID NO: 463907 - DNA, 15 bp, Homo sapiens
tcaacagcatgtcta

SEQ ID NO: 463908 - DNA, 17 bp, Homo sapiens
tcaacagcatgtctact

SEQ ID NO: 463909 - DNA, 15 bp, Homo sapiens
tcaaccattccccat

SEQ ID NO: 463910 - DNA, 17 bp, Homo sapiens
tcaacctctcagatccc

SEQ ID NO: 463911 - DNA, 17 bp, Homo sapiens
tcaacctggtggcacca

SEQ ID NO: 463912 - DNA, 21 bp, Homo sapiens
tcaacctggtggcaccagatg

SEQ ID NO: 463913 - DNA, 21 bp, Homo sapiens
tcaactctgtgtcccagcacc

SEQ ID NO: 463914 - DNA, 21 bp, Homo sapiens
tcaactttagtatttttacta

SEQ ID NO: 463915 - DNA, 20 bp, Homo sapiens
tcaagagggcactggtggcc

SEQ ID NO: 463916 - DNA, 14 bp, Homo sapiens
tcaagccaggagac

SEQ ID NO: 463917 - DNA, 15 bp, Homo sapiens
tcaagccaggagacc

SEQ ID NO: 463918 - DNA, 21 bp, Homo sapiens
tcaagccaggagaccctgtct

SEQ ID NO: 463919 - DNA, 11 bp, Homo sapiens
tcattcttttc

SEQ ID NO: 463920 - DNA, 16 bp, Homo sapiens
tcattggttacaaatt

SEQ ID NO: 463921 - DNA, 17 bp, Homo sapiens
tcatttacaacttccag

SEQ ID NO: 463922 - DNA, 12 bp, Homo sapiens
tcatttgcatat

SEQ ID NO: 463923 - DNA, 21 bp, Homo sapiens
tccaaataggagtcttctgcc

SEQ ID NO: 463924 - DNA, 14 bp, Homo sapiens
tccaaattctctga

SEQ ID NO: 463925 - DNA, 13 bp, Homo sapiens
tccaacagacacc

SEQ ID NO: 463926 - DNA, 17 bp, Homo sapiens
tccaacagacaccctcc

SEQ ID NO: 463927 - DNA, 23 bp, Homo sapiens
tccaacagacaccctccactctg

SEQ ID NO: 463928 - DNA, 24 bp, Homo sapiens
tccaacagacaccctccactctga

SEQ ID NO: 463929 - DNA, 14 bp, Homo sapiens
tccaagtgtgtgtg

SEQ ID NO: 463930 - DNA, 21 bp, Homo sapiens
tccaagttatttgatctggtg

SEQ ID NO: 463931 - DNA, 22 bp, Homo sapiens
tccaagttatttgatctggtgc

SEQ ID NO: 463932 - DNA, 18 bp, Homo sapiens
tccaagttcattcatact

SEQ ID NO: 463933 - DNA, 14 bp, Homo sapiens
tccaataccctaga

SEQ ID NO: 463934 - DNA, 15 bp, Homo sapiens
tccaataccctagaa

SEQ ID NO: 463935 - DNA, 15 bp, Homo sapiens
tccacacctccaccc

SEQ ID NO: 463936 - DNA, 16 bp, Homo sapiens
tccacacctccacccg

SEQ ID NO: 463937 - DNA, 19 bp, Homo sapiens
tccacacctccacccgtcc

SEQ ID NO: 463938 - DNA, 20 bp, Homo sapiens
tccaccaagggtatctgctg

SEQ ID NO: 463939 - DNA, 14 bp, Homo sapiens
tccacccagaccct

SEQ ID NO: 463940 - DNA, 18 bp, Homo sapiens
tccaccccggctccccct

SEQ ID NO: 463941 - DNA, 14 bp, Homo sapiens
tccaccctcccctc

SEQ ID NO: 463942 - DNA, 17 bp, Homo sapiens
tccaccctcccctcttc

SEQ ID NO: 463943 - DNA, 14 bp, Homo sapiens
tccaccgccacccc

SEQ ID NO: 463944 - DNA, 18 bp, Homo sapiens
tccaccgccaccccactg

SEQ ID NO: 463945 - DNA, 19 bp, Homo sapiens
tccaccgccaccccactga

SEQ ID NO: 463946 - DNA, 16 bp, Homo sapiens
tccacctgtgctgctg

SEQ ID NO: 463947 - DNA, 14 bp, Homo sapiens
tccacgcctcctgg

SEQ ID NO: 463948 - DNA, 15 bp, Homo sapiens
tccacgcctcctggc

SEQ ID NO: 463949 - DNA, 19 bp, Homo sapiens
tccactcccctcatccact

SEQ ID NO: 463950 - DNA, 22 bp, Homo sapiens
tccactcctcccaactctggcc

SEQ ID NO: 463951 - DNA, 12 bp, Homo sapiens
tccactctgagg

SEQ ID NO: 463952 - DNA, 22 bp, Homo sapiens
tccactctgaggtctcaccttc

SEQ ID NO: 463953 - DNA, 21 bp, Homo sapiens
tccacttagaaattgcatttc

SEQ ID NO: 463954 - DNA, 16 bp, Homo sapiens
tccacttccagagggg

SEQ ID NO: 463955 - DNA, 17 bp, Homo sapiens
tccactttcctctctct

SEQ ID NO: 463956 - DNA, 23 bp, Homo sapiens
tccagacagagtggatctggagt

SEQ ID NO: 463957 - DNA, 16 bp, Homo sapiens
tccagacagggtgggg

SEQ ID NO: 463958 - DNA, 9 bp, Homo sapiens
tccagaccc

SEQ ID NO: 463959 - DNA, 14 bp, Homo sapiens
tccagacccctacc

SEQ ID NO: 463960 - DNA, 20 bp, Homo sapiens
tccagacccctaccctttcc

SEQ ID NO: 463961 - DNA, 17 bp, Homo sapiens
tccagacccctggcttt

SEQ ID NO: 463962 - DNA, 18 bp, Homo sapiens
tccagacccctggctttt

SEQ ID NO: 463963 - DNA, 23 bp, Homo sapiens
tccagacccctggcttttcactg

SEQ ID NO: 463964 - DNA, 10 bp, Homo sapiens
tccagagaga

SEQ ID NO: 463965 - DNA, 16 bp, Homo sapiens
tccagagagtggctcc

SEQ ID NO: 463966 - DNA, 15 bp, Homo sapiens
tccagagctcatttc

SEQ ID NO: 463967 - DNA, 21 bp, Homo sapiens
tccagagggggccagagggac

SEQ ID NO: 463968 - DNA, 16 bp, Homo sapiens
tccagattattttcta

SEQ ID NO: 463969 - DNA, 17 bp, Homo sapiens
tccagattattttctat

SEQ ID NO: 463970 - DNA, 22 bp, Homo sapiens
tccagcagtgctgggcccagcc

SEQ ID NO: 463971 - DNA, 18 bp, Homo sapiens
tccagctccccccaagat

SEQ ID NO: 463972 - DNA, 18 bp, Homo sapiens
tccagtttgttctccggg

SEQ ID NO: 463973 - DNA, 14 bp, Homo sapiens
tccatagacacagt

SEQ ID NO: 463974 - DNA, 16 bp, Homo sapiens
tccatagacacagtat

SEQ ID NO: 463975 - DNA, 19 bp, Homo sapiens
tccatatcagctctgcata

SEQ ID NO: 463976 - DNA, 20 bp, Homo sapiens
tccatatcagctctgcataa

SEQ ID NO: 463977 - DNA, 13 bp, Homo sapiens
tccatcctgagga

SEQ ID NO: 463978 - DNA, 21 bp, Homo sapiens
tccattctatgactcttgtct

SEQ ID NO: 463979 - DNA, 13 bp, Homo sapiens
tccattgtatctt

SEQ ID NO: 463980 - DNA, 17 bp, Homo sapiens
tccattttctaaactgt

SEQ ID NO: 463981 - DNA, 21 bp, Homo sapiens
tcccaacgtactcctcagacg

SEQ ID NO: 463982 - DNA, 19 bp, Homo sapiens
tcccacaaaatatttctaa

SEQ ID NO: 463983 - DNA, 17 bp, Homo sapiens
tcccacaggcccttcct

SEQ ID NO: 463984 - DNA, 21 bp, Homo sapiens
tcccacaggcccttcctctcc

SEQ ID NO: 463985 - DNA, 20 bp, Homo sapiens
tcccacccactagccctctt

SEQ ID NO: 463986 - DNA, 12 bp, Homo sapiens
tcccacccctat

SEQ ID NO: 463987 - DNA, 19 bp, Homo sapiens
tcccactgatatcacgggc

SEQ ID NO: 463988 - DNA, 11 bp, Homo sapiens
tcccagaagag

SEQ ID NO: 463989 - DNA, 22 bp, Homo sapiens
tcccagggcccgagcgcgtgcc

SEQ ID NO: 463990 - DNA, 23 bp, Homo sapiens
tcccagggcccgagcgcgtgcct

SEQ ID NO: 463991 - DNA, 17 bp, Homo sapiens
tcccatcgctggaaaac

SEQ ID NO: 463992 - DNA, 17 bp, Homo sapiens
tcccatgggggctccag

SEQ ID NO: 463993 - DNA, 13 bp, Homo sapiens
tccccaaggaaga

SEQ ID NO: 463994 - DNA, 16 bp, Homo sapiens
tccccacccaccaccg

SEQ ID NO: 463995 - DNA, 12 bp, Homo sapiens
tccccaccccat

SEQ ID NO: 463996 - DNA, 23 bp, Homo sapiens
tccccaccccataagccctgaga

SEQ ID NO: 463997 - DNA, 15 bp, Homo sapiens
tccccaccctcccct

SEQ ID NO: 463998 - DNA, 17 bp, Homo sapiens
tccccactcccgtgatg

SEQ ID NO: 463999 - DNA, 18 bp, Homo sapiens
tccccagttaatgtgcca

SEQ ID NO: 464000 - DNA, 20 bp, Homo sapiens
tccccagttaatgtgccaaa

SEQ ID NO: 464001 - DNA, 13 bp, Homo sapiens
tccccattctata

SEQ ID NO: 464002 - DNA, 17 bp, Homo sapiens
tccccattctataaatt

SEQ ID NO: 464003 - DNA, 16 bp, Homo sapiens
tcccccaggctgcgcc

SEQ ID NO: 464004 - DNA, 18 bp, Homo sapiens
tcccccaggctgcgcctg

SEQ ID NO: 464005 - DNA, 19 bp, Homo sapiens
tcccccgcagacagacaga

SEQ ID NO: 464006 - DNA, 20 bp, Homo sapiens
tccccgcagccctctccacc

SEQ ID NO: 464007 - DNA, 15 bp, Homo sapiens
tccccgcccgccctc

SEQ ID NO: 464008 - DNA, 21 bp, Homo sapiens
tccccgcccgccctcctctgc

SEQ ID NO: 464009 - DNA, 17 bp, Homo sapiens
tccccggacgctggctc

SEQ ID NO: 464010 - DNA, 14 bp, Homo sapiens
tcccctcactctgt

SEQ ID NO: 464011 - DNA, 17 bp, Homo sapiens
tcccctcactctgtcag

SEQ ID NO: 464012 - DNA, 21 bp, Homo sapiens
tcccctcactctgtcagccag

SEQ ID NO: 464013 - DNA, 21 bp, Homo sapiens
tcccctccagacccctaccct

SEQ ID NO: 464014 - DNA, 14 bp, Homo sapiens
tcccctctcctgag

SEQ ID NO: 464015 - DNA, 17 bp, Homo sapiens
tcccctctcctgagcct

SEQ ID NO: 464016 - DNA, 20 bp, Homo sapiens
tcccctgaggttaaggggat

SEQ ID NO: 464017 - DNA, 13 bp, Homo sapiens
tctctccctccac

SEQ ID NO: 464018 - DNA, 13 bp, Homo sapiens
tctctctccctcc

SEQ ID NO: 464019 - DNA, 15 bp, Homo sapiens
tctctctccctccac

SEQ ID NO: 464020 - DNA, 16 bp, Homo sapiens
tctctctccctccact

SEQ ID NO: 464021 - DNA, 10 bp, Homo sapiens
tctctctctc

SEQ ID NO: 464022 - DNA, 11 bp, Homo sapiens
tctctctctct

SEQ ID NO: 464023 - DNA, 15 bp, Homo sapiens
tctctctctctctgt

SEQ ID NO: 464024 - DNA, 13 bp, Homo sapiens
tctctctctgttc

SEQ ID NO: 464025 - DNA, 15 bp, Homo sapiens
tctctctctgttcca

SEQ ID NO: 464026 - DNA, 15 bp, Homo sapiens
tctctctggggccct

SEQ ID NO: 464027 - DNA, 21 bp, Homo sapiens
tctctctggggccctgggcct

SEQ ID NO: 464028 - DNA, 15 bp, Homo sapiens
tctctctgtgtggca

SEQ ID NO: 464029 - DNA, 16 bp, Homo sapiens
tctctctgtgtggcaa

SEQ ID NO: 464030 - DNA, 20 bp, Homo sapiens
tctctctgtgtggcaaacat

SEQ ID NO: 464031 - DNA, 16 bp, Homo sapiens
tctctctgttccaagt

SEQ ID NO: 464032 - DNA, 14 bp, Homo sapiens
tctctgatttgcaa

SEQ ID NO: 464033 - DNA, 22 bp, Homo sapiens
tctctgcaggatgggtgaaacc

SEQ ID NO: 464034 - DNA, 18 bp, Homo sapiens
tctctggggccctgggcc

SEQ ID NO: 464035 - DNA, 18 bp, Homo sapiens
tctctgtgtggcaaacat

SEQ ID NO: 464036 - DNA, 12 bp, Homo sapiens
tctctgttccaa

SEQ ID NO: 464037 - DNA, 20 bp, Homo sapiens
tctcttaccccgtccctttc

SEQ ID NO: 464038 - DNA, 11 bp, Homo sapiens
tctcttctcca

SEQ ID NO: 464039 - DNA, 17 bp, Homo sapiens
tctcttcttactgtatt

SEQ ID NO: 464040 - DNA, 20 bp, Homo sapiens
tctgaaaatatttttttcta

SEQ ID NO: 464041 - DNA, 14 bp, Homo sapiens
tctgaaatctacaa

SEQ ID NO: 464042 - DNA, 14 bp, Homo sapiens
tctgaaggagagga

SEQ ID NO: 464043 - DNA, 16 bp, Homo sapiens
tctgaaggagaggagt

SEQ ID NO: 464044 - DNA, 14 bp, Homo sapiens
tctgaaggcctcca

SEQ ID NO: 464045 - DNA, 16 bp, Homo sapiens
tctgaagtcactgcac

SEQ ID NO: 464046 - DNA, 19 bp, Homo sapiens
tctgaagtcccttcctgtc

SEQ ID NO: 464047 - DNA, 16 bp, Homo sapiens
tctgaataatttctta

SEQ ID NO: 464048 - DNA, 13 bp, Homo sapiens
tctgagcagtggg

SEQ ID NO: 464049 - DNA, 16 bp, Homo sapiens
tctgagccctgccctc

SEQ ID NO: 464050 - DNA, 16 bp, Homo sapiens
tctgagctgctaggaa

SEQ ID NO: 464051 - DNA, 19 bp, Homo sapiens
tctgaggagtccaaaatat

SEQ ID NO: 464052 - DNA, 15 bp, Homo sapiens
tctgagtccagctcc

SEQ ID NO: 464053 - DNA, 16 bp, Homo sapiens
tctgagtccagctccc

SEQ ID NO: 464054 - DNA, 17 bp, Homo sapiens
tctgagtccagctcccc

SEQ ID NO: 464055 - DNA, 14 bp, Homo sapiens
tctgatttgcaaat

SEQ ID NO: 464056 - DNA, 16 bp, Homo sapiens
tctgcagtattctgta

SEQ ID NO: 464057 - DNA, 19 bp, Homo sapiens
tctgccatgtttttgcaaa

SEQ ID NO: 464058 - DNA, 24 bp, Homo sapiens
tctgccccctcccccgcagacaga

SEQ ID NO: 464059 - DNA, 22 bp, Homo sapiens
tctgcccctccgtccccagggt

SEQ ID NO: 464060 - DNA, 19 bp, Homo sapiens
tctgccccttgaccccaca

SEQ ID NO: 464061 - DNA, 21 bp, Homo sapiens
tctgccccttgaccccacacg

SEQ ID NO: 464062 - DNA, 22 bp, Homo sapiens
tctgcctcttaacttaaaagaa

SEQ ID NO: 464063 - DNA, 12 bp, Homo sapiens
tctgccttggac

SEQ ID NO: 464064 - DNA, 13 bp, Homo sapiens
tctgcctttgagc

SEQ ID NO: 464065 - DNA, 16 bp, Homo sapiens
tctgctatgtctgtga

SEQ ID NO: 464066 - DNA, 20 bp, Homo sapiens
tctgctgcctctgaaaatat

SEQ ID NO: 464067 - DNA, 21 bp, Homo sapiens
tctgctgcctctgaaaatatt

SEQ ID NO: 464068 - DNA, 22 bp, Homo sapiens
tctgctttggggcttatcagaa

SEQ ID NO: 464069 - DNA, 12 bp, Homo sapiens
tctggagcccct

SEQ ID NO: 464070 - DNA, 20 bp, Homo sapiens
tctggagcccctatcctgca

SEQ ID NO: 464071 - DNA, 15 bp, Homo sapiens
tctggatcctgcact

SEQ ID NO: 464072 - DNA, 15 bp, Homo sapiens
tctggctgtggcccc

SEQ ID NO: 464073 - DNA, 15 bp, Homo sapiens
tctggcttctgcatt

SEQ ID NO: 464074 - DNA, 16 bp, Homo sapiens
tctggggccctgggcc

SEQ ID NO: 464075 - DNA, 14 bp, Homo sapiens
tctggggtggggct

SEQ ID NO: 464076 - DNA, 19 bp, Homo sapiens
tctggggtggggcttggaa

SEQ ID NO: 464077 - DNA, 19 bp, Homo sapiens
tctgtaaatttaactgcat

SEQ ID NO: 464078 - DNA, 17 bp, Homo sapiens
tctgtatatcagctcta

SEQ ID NO: 464079 - DNA, 18 bp, Homo sapiens
tctgtatatcagctctaa

SEQ ID NO: 464080 - DNA, 20 bp, Homo sapiens
tctgtatttaatggttttta

SEQ ID NO: 464081 - DNA, 21 bp, Homo sapiens
tctgtcagccagccgccctgg

SEQ ID NO: 464082 - DNA, 22 bp, Homo sapiens
tctgtcagccagccgccctggg

SEQ ID NO: 464083 - DNA, 21 bp, Homo sapiens
tctgtcatctctctggggccc

SEQ ID NO: 464084 - DNA, 19 bp, Homo sapiens
tctgtcattggttacaaat

SEQ ID NO: 464085 - DNA, 11 bp, Homo sapiens
tctgtctgagc

SEQ ID NO: 464086 - DNA, 14 bp, Homo sapiens
tctgtctgagccct

SEQ ID NO: 464087 - DNA, 19 bp, Homo sapiens
tctgtctgagccctgccct

SEQ ID NO: 464088 - DNA, 14 bp, Homo sapiens
tctgtctgattcta

SEQ ID NO: 464089 - DNA, 16 bp, Homo sapiens
tctgtctgattctatg

SEQ ID NO: 464090 - DNA, 17 bp, Homo sapiens
tctgtctgattctatgc

SEQ ID NO: 464091 - DNA, 23 bp, Homo sapiens
tctgtctttatgtaagaagaaac

SEQ ID NO: 464092 - DNA, 18 bp, Homo sapiens
tctgtgaagcctttatct

SEQ ID NO: 464093 - DNA, 23 bp, Homo sapiens
tctgtgatgtcagtagtgcctgt

SEQ ID NO: 464094 - DNA, 17 bp, Homo sapiens
tctgtgcaataaaacca

SEQ ID NO: 464095 - DNA, 15 bp, Homo sapiens
tctgtggattctata

SEQ ID NO: 464096 - DNA, 20 bp, Homo sapiens
tctgtggattctatatttca

SEQ ID NO: 464097 - DNA, 22 bp, Homo sapiens
tctgtggattctatatttcata

SEQ ID NO: 464098 - DNA, 16 bp, Homo sapiens
tctgtgggactggccc

SEQ ID NO: 464099 - DNA, 23 bp, Homo sapiens
tctgtgggactggcccacccctc

SEQ ID NO: 464100 - DNA, 12 bp, Homo sapiens
tctgtgtggcaa

SEQ ID NO: 464101 - DNA, 10 bp, Homo sapiens
tctgttccaa

SEQ ID NO: 464102 - DNA, 12 bp, Homo sapiens
tctgttccaagt

SEQ ID NO: 464103 - DNA, 15 bp, Homo sapiens
tctgttccaagtgtg

SEQ ID NO: 464104 - DNA, 21 bp, Homo sapiens
tctgttccaagtgtgtgtgca

SEQ ID NO: 464105 - DNA, 18 bp, Homo sapiens
tctgtttaccctccctgt

SEQ ID NO: 464106 - DNA, 23 bp, Homo sapiens
tctgtttaccctccctgtcccct

SEQ ID NO: 464107 - DNA, 17 bp, Homo sapiens
tcttaacttaaaagaac

SEQ ID NO: 464108 - DNA, 14 bp, Homo sapiens
tcttactaaacatt

SEQ ID NO: 464109 - DNA, 24 bp, Homo sapiens
tcttactaaacattttgttattgg

SEQ ID NO: 464110 - DNA, 22 bp, Homo sapiens
tcttagagaataagaataataa

SEQ ID NO: 464111 - DNA, 19 bp, Homo sapiens
tcttatattaaagaagttg

SEQ ID NO: 464112 - DNA, 23 bp, Homo sapiens
tcttatctagcaagaagattcta

SEQ ID NO: 464113 - DNA, 20 bp, Homo sapiens
tcttcaaccctgccctgcac

SEQ ID NO: 464114 - DNA, 13 bp, Homo sapiens
tcttcaaggccaa

SEQ ID NO: 464115 - DNA, 16 bp, Homo sapiens
tgcatttaaaatggac

SEQ ID NO: 464116 - DNA, 21 bp, Homo sapiens
tgcatttgagagaagccacgc

SEQ ID NO: 464117 - DNA, 23 bp, Homo sapiens
tgcatttgagagaagccacgctg

SEQ ID NO: 464118 - DNA, 19 bp, Homo sapiens
tgccaaaaactaaaattca

SEQ ID NO: 464119 - DNA, 14 bp, Homo sapiens
tgccaaagatagca

SEQ ID NO: 464120 - DNA, 21 bp, Homo sapiens
tgccaaagatagcagaagagt

SEQ ID NO: 464121 - DNA, 15 bp, Homo sapiens
tgccacacttcaggc

SEQ ID NO: 464122 - DNA, 22 bp, Homo sapiens
tgccacacttcaggctcttctc

SEQ ID NO: 464123 - DNA, 16 bp, Homo sapiens
tgccagacagagatca

SEQ ID NO: 464124 - DNA, 20 bp, Homo sapiens
tgccagacagagatcagaat

SEQ ID NO: 464125 - DNA, 14 bp, Homo sapiens
tgccatgatctgta

SEQ ID NO: 464126 - DNA, 18 bp, Homo sapiens
tgccattagactgaattt

SEQ ID NO: 464127 - DNA, 19 bp, Homo sapiens
tgccattagactgaattta

SEQ ID NO: 464128 - DNA, 21 bp, Homo sapiens
tgcccaagaatagatgctgac

SEQ ID NO: 464129 - DNA, 12 bp, Homo sapiens
tgcccaccctgg

SEQ ID NO: 464130 - DNA, 17 bp, Homo sapiens
tgcccaccctgggcctc

SEQ ID NO: 464131 - DNA, 15 bp, Homo sapiens
tgcccagtcttgagt

SEQ ID NO: 464132 - DNA, 19 bp, Homo sapiens
tgcccagtcttgagtgggc

SEQ ID NO: 464133 - DNA, 15 bp, Homo sapiens
tgcccagtctttgga

SEQ ID NO: 464134 - DNA, 23 bp, Homo sapiens
tgcccagttagcccggccaagga

SEQ ID NO: 464135 - DNA, 18 bp, Homo sapiens
tgcccatgtgtcccctca

SEQ ID NO: 464136 - DNA, 22 bp, Homo sapiens
tgcccatgtgtcccctcactct

SEQ ID NO: 464137 - DNA, 17 bp, Homo sapiens
tgccccctcccccgcag

SEQ ID NO: 464138 - DNA, 22 bp, Homo sapiens
tgccccctcccccgcagacaga

SEQ ID NO: 464139 - DNA, 16 bp, Homo sapiens
tgccccgcgtcttcag

SEQ ID NO: 464140 - DNA, 15 bp, Homo sapiens
tgcccctcccttcaa

SEQ ID NO: 464141 - DNA, 17 bp, Homo sapiens
tgccccttgaccccaca

SEQ ID NO: 464142 - DNA, 21 bp, Homo sapiens
tgccccttgaccccacacgcc

SEQ ID NO: 464143 - DNA, 19 bp, Homo sapiens
tgccctcactccactcccc

SEQ ID NO: 464144 - DNA, 20 bp, Homo sapiens
tgccctcactccactcccct

SEQ ID NO: 464145 - DNA, 20 bp, Homo sapiens
tgccctccctcggccccacc

SEQ ID NO: 464146 - DNA, 19 bp, Homo sapiens
tgccctcgtctccctggcc

SEQ ID NO: 464147 - DNA, 14 bp, Homo sapiens
tgccctgcaccttg

SEQ ID NO: 464148 - DNA, 14 bp, Homo sapiens
tgccctggtgctgc

SEQ ID NO: 464149 - DNA, 17 bp, Homo sapiens
tgccgctgcaccacggc

SEQ ID NO: 464150 - DNA, 18 bp, Homo sapiens
tgccgctgccgctgcacc

SEQ ID NO: 464151 - DNA, 19 bp, Homo sapiens
tgcctcgagtccccccacc

SEQ ID NO: 464152 - DNA, 12 bp, Homo sapiens
tgcctgagcccg

SEQ ID NO: 464153 - DNA, 14 bp, Homo sapiens
tgcctgagcccgaa

SEQ ID NO: 464154 - DNA, 14 bp, Homo sapiens
tgcctgcaccagga

SEQ ID NO: 464155 - DNA, 18 bp, Homo sapiens
tgcctgcaccaggagaca

SEQ ID NO: 464156 - DNA, 20 bp, Homo sapiens
tgcctgcaccaggagacaga

SEQ ID NO: 464157 - DNA, 19 bp, Homo sapiens
tgcctggtgcgctgtgctc

SEQ ID NO: 464158 - DNA, 23 bp, Homo sapiens
tgcctggtgcgctgtgctccagc

SEQ ID NO: 464159 - DNA, 15 bp, Homo sapiens
tgcctgtatttccaa

SEQ ID NO: 464160 - DNA, 16 bp, Homo sapiens
tgccttctgttttcca

SEQ ID NO: 464161 - DNA, 21 bp, Homo sapiens
tgcctttagcgtgtaaatgga

SEQ ID NO: 464162 - DNA, 18 bp, Homo sapiens
tgcctttgagcttctcct

SEQ ID NO: 464163 - DNA, 13 bp, Homo sapiens
tgcctttgatgtg

SEQ ID NO: 464164 - DNA, 11 bp, Homo sapiens
tgcgccctccc

SEQ ID NO: 464165 - DNA, 17 bp, Homo sapiens
tgcgccctccctccctc

SEQ ID NO: 464166 - DNA, 21 bp, Homo sapiens
tgcgccctccctccctccaca

SEQ ID NO: 464167 - DNA, 12 bp, Homo sapiens
tgcgcctgcccg

SEQ ID NO: 464168 - DNA, 13 bp, Homo sapiens
tgcgctcctctgc

SEQ ID NO: 464169 - DNA, 17 bp, Homo sapiens
tgcgctcctctgcagcc

SEQ ID NO: 464170 - DNA, 15 bp, Homo sapiens
tgcgctgtgctccag

SEQ ID NO: 464171 - DNA, 18 bp, Homo sapiens
tgcgctgtgctccagcag

SEQ ID NO: 464172 - DNA, 16 bp, Homo sapiens
tgcggaccggagcggc

SEQ ID NO: 464173 - DNA, 18 bp, Homo sapiens
tgcggaccggagcggctg

SEQ ID NO: 464174 - DNA, 20 bp, Homo sapiens
tgcggaccggagcggctgag

SEQ ID NO: 464175 - DNA, 20 bp, Homo sapiens
tgcggcaccgcccacccaca

SEQ ID NO: 464176 - DNA, 22 bp, Homo sapiens
tgcgtgaccggcccgccacctt

SEQ ID NO: 464177 - DNA, 20 bp, Homo sapiens
tgcgtgtggccctgtgggag

SEQ ID NO: 464178 - DNA, 13 bp, Homo sapiens
tgctaatgtaatc

SEQ ID NO: 464179 - DNA, 18 bp, Homo sapiens
tgctaatgtaatcattta

SEQ ID NO: 464180 - DNA, 12 bp, Homo sapiens
tgctactcagta

SEQ ID NO: 464181 - DNA, 14 bp, Homo sapiens
tgctagcacaatat

SEQ ID NO: 464182 - DNA, 13 bp, Homo sapiens
tgctagctgtaga

SEQ ID NO: 464183 - DNA, 15 bp, Homo sapiens
tgctcaataaaggtc

SEQ ID NO: 464184 - DNA, 16 bp, Homo sapiens
tgctcacgtctgtgag

SEQ ID NO: 464185 - DNA, 17 bp, Homo sapiens
tgctcacgtctgtgagt

SEQ ID NO: 464186 - DNA, 23 bp, Homo sapiens
tgctcacgtctgtgagtctgtcc

SEQ ID NO: 464187 - DNA, 20 bp, Homo sapiens
tgctcagcaaggggctctgc

SEQ ID NO: 464188 - DNA, 15 bp, Homo sapiens
tgctcatgggaagaa

SEQ ID NO: 464189 - DNA, 16 bp, Homo sapiens
tgctccaacagacacc

SEQ ID NO: 464190 - DNA, 20 bp, Homo sapiens
tgctccagcagtgctgggcc

SEQ ID NO: 464191 - DNA, 16 bp, Homo sapiens
tgctcggacacagttt

SEQ ID NO: 464192 - DNA, 19 bp, Homo sapiens
tgctcgggaaggcctgagg

SEQ ID NO: 464193 - DNA, 15 bp, Homo sapiens
tgctgaagtctcccc

SEQ ID NO: 464194 - DNA, 16 bp, Homo sapiens
tgctgaagtctccccg

SEQ ID NO: 464195 - DNA, 21 bp, Homo sapiens
tgctgactgtactcctcccag

SEQ ID NO: 464196 - DNA, 22 bp, Homo sapiens
tgctgactgtactcctcccagg

SEQ ID NO: 464197 - DNA, 14 bp, Homo sapiens
tgctgcaatacatt

SEQ ID NO: 464198 - DNA, 15 bp, Homo sapiens
tgctgccacacttca

SEQ ID NO: 464199 - DNA, 19 bp, Homo sapiens
tgctgccacacttcaggct

SEQ ID NO: 464200 - DNA, 24 bp, Homo sapiens
tgctgccccacaacacaccttgcc

SEQ ID NO: 464201 - DNA, 12 bp, Homo sapiens
tgctgctgtgaa

SEQ ID NO: 464202 - DNA, 14 bp, Homo sapiens
tgctgctgtgaatt

SEQ ID NO: 464203 - DNA, 15 bp, Homo sapiens
tgctggccagcaccc

SEQ ID NO: 464204 - DNA, 16 bp, Homo sapiens
tgctggccagcaccct

SEQ ID NO: 464205 - DNA, 13 bp, Homo sapiens
tgctggctgcctt

SEQ ID NO: 464206 - DNA, 13 bp, Homo sapiens
tgctgggcccagc

SEQ ID NO: 464207 - DNA, 23 bp, Homo sapiens
tgctgggcccagccggggtgggg

SEQ ID NO: 464208 - DNA, 13 bp, Homo sapiens
tgctgtgggcagc

SEQ ID NO: 464209 - DNA, 16 bp, Homo sapiens
tgctgtgggcagcacc

SEQ ID NO: 464210 - DNA, 18 bp, Homo sapiens
tgctgtgggcagcaccct

SEQ ID NO: 464211 - DNA, 15 bp, Homo sapiens
tgctgtttatatata

SEQ ID NO: 464212 - DNA, 17 bp, Homo sapiens
tgctgttttatgtcata

SEQ ID NO: 464213 - DNA, 14 bp, Homo sapiens
tgtcatactctgtg

SEQ ID NO: 464214 - DNA, 16 bp, Homo sapiens
tgtcattcaagcctgt

SEQ ID NO: 464215 - DNA, 23 bp, Homo sapiens
tgtcattcaagcctgtgaataaa

SEQ ID NO: 464216 - DNA, 17 bp, Homo sapiens
tgtcattggttacaaat

SEQ ID NO: 464217 - DNA, 19 bp, Homo sapiens
tgtccacctgtgctgctgc

SEQ ID NO: 464218 - DNA, 12 bp, Homo sapiens
tgtcccacaaaa

SEQ ID NO: 464219 - DNA, 18 bp, Homo sapiens
tgtcccagcacctggcac

SEQ ID NO: 464220 - DNA, 15 bp, Homo sapiens
tgtccccattctata

SEQ ID NO: 464221 - DNA, 23 bp, Homo sapiens
tgtcccctcactctgtcagccag

SEQ ID NO: 464222 - DNA, 22 bp, Homo sapiens
tgtccctaccgagtctcttctc

SEQ ID NO: 464223 - DNA, 22 bp, Homo sapiens
tgtcctattactgatgtgtgca

SEQ ID NO: 464224 - DNA, 18 bp, Homo sapiens
tgtcctcaggtgaataac

SEQ ID NO: 464225 - DNA, 14 bp, Homo sapiens
tgtcctccagggcg

SEQ ID NO: 464226 - DNA, 15 bp, Homo sapiens
tgtcctccagggcga

SEQ ID NO: 464227 - DNA, 18 bp, Homo sapiens
tgtcctgctcacgtctgt

SEQ ID NO: 464228 - DNA, 19 bp, Homo sapiens
tgtcgccccaggccctccc

SEQ ID NO: 464229 - DNA, 12 bp, Homo sapiens
tgtctactgctt

SEQ ID NO: 464230 - DNA, 15 bp, Homo sapiens
tgtctagtttgcata

SEQ ID NO: 464231 - DNA, 21 bp, Homo sapiens
tgtctagtttgcatacttcct

SEQ ID NO: 464232 - DNA, 19 bp, Homo sapiens
tgtctcaagagggcactgg

SEQ ID NO: 464233 - DNA, 21 bp, Homo sapiens
tgtctcaagagggcactggtg

SEQ ID NO: 464234 - DNA, 23 bp, Homo sapiens
tgtctctccctaccctcttctca

SEQ ID NO: 464235 - DNA, 13 bp, Homo sapiens
tgtctctgaggac

SEQ ID NO: 464236 - DNA, 17 bp, Homo sapiens
tgtctgaagtcactgca

SEQ ID NO: 464237 - DNA, 20 bp, Homo sapiens
tgtctgaagtcactgcacag

SEQ ID NO: 464238 - DNA, 13 bp, Homo sapiens
tgtctgagccctg

SEQ ID NO: 464239 - DNA, 20 bp, Homo sapiens
tgtctgagccctgccctcac

SEQ ID NO: 464240 - DNA, 12 bp, Homo sapiens
tgtctgattcta

SEQ ID NO: 464241 - DNA, 18 bp, Homo sapiens
tgtctggctgtggcccct

SEQ ID NO: 464242 - DNA, 19 bp, Homo sapiens
tgtctggctgtggcccctc

SEQ ID NO: 464243 - DNA, 20 bp, Homo sapiens
tgtctggctgtggcccctcc

SEQ ID NO: 464244 - DNA, 23 bp, Homo sapiens
tgtcttcaaccctgccctgcacc

SEQ ID NO: 464245 - DNA, 19 bp, Homo sapiens
tgtctttatgtaagaagaa

SEQ ID NO: 464246 - DNA, 20 bp, Homo sapiens
tgtctttatgtaagaagaaa

SEQ ID NO: 464247 - DNA, 23 bp, Homo sapiens
tgtctttatgtaagaagaaactg

SEQ ID NO: 464248 - DNA, 22 bp, Homo sapiens
tgtgaaacagggagctatgaga

SEQ ID NO: 464249 - DNA, 14 bp, Homo sapiens
tgtgacttctctct

SEQ ID NO: 464250 - DNA, 20 bp, Homo sapiens
tgtgagtctgtcctttccca

SEQ ID NO: 464251 - DNA, 21 bp, Homo sapiens
tgtgagtctgtcctttcccac

SEQ ID NO: 464252 - DNA, 13 bp, Homo sapiens
tgtgattgaatct

SEQ ID NO: 464253 - DNA, 19 bp, Homo sapiens
tgtgattggcagcttcaaa

SEQ ID NO: 464254 - DNA, 21 bp, Homo sapiens
tgtgccaaaatgtcaattttt

SEQ ID NO: 464255 - DNA, 20 bp, Homo sapiens
tgtgccaaagatagcagaag

SEQ ID NO: 464256 - DNA, 16 bp, Homo sapiens
tgtgcctgcaccagga

SEQ ID NO: 464257 - DNA, 19 bp, Homo sapiens
tgtgctccagcagtgctgg

SEQ ID NO: 464258 - DNA, 20 bp, Homo sapiens
tgtgctccagcagtgctggg

SEQ ID NO: 464259 - DNA, 14 bp, Homo sapiens
tgtgctcggacaca

SEQ ID NO: 464260 - DNA, 16 bp, Homo sapiens
tgtgctcggacacagt

SEQ ID NO: 464261 - DNA, 19 bp, Homo sapiens
tgtgctgtgggcagcaccc

SEQ ID NO: 464262 - DNA, 21 bp, Homo sapiens
tgtgctgtgggcagcaccctc

SEQ ID NO: 464263 - DNA, 22 bp, Homo sapiens
tgtgctgtgggcagcaccctcc

SEQ ID NO: 464264 - DNA, 19 bp, Homo sapiens
tgtgcttgttcttcctctt

SEQ ID NO: 464265 - DNA, 14 bp, Homo sapiens
tgtgctttcatgtt

SEQ ID NO: 464266 - DNA, 19 bp, Homo sapiens
tgtggagtggaggggtcag

SEQ ID NO: 464267 - DNA, 13 bp, Homo sapiens
tgtggatgctctt

SEQ ID NO: 464268 - DNA, 15 bp, Homo sapiens
tgtggcaaacattta

SEQ ID NO: 464269 - DNA, 22 bp, Homo sapiens
tgtggcccctccttctcccctc

SEQ ID NO: 464270 - DNA, 15 bp, Homo sapiens
tgtggccctgtggga

SEQ ID NO: 464271 - DNA, 16 bp, Homo sapiens
tgtggccctgtgggag

SEQ ID NO: 464272 - DNA, 15 bp, Homo sapiens
tgtggcctcagccct

SEQ ID NO: 464273 - DNA, 16 bp, Homo sapiens
tgtgggactggcccac

SEQ ID NO: 464274 - DNA, 20 bp, Homo sapiens
tgtgggagtccactttcctc

SEQ ID NO: 464275 - DNA, 13 bp, Homo sapiens
tgtgggcagcacc

SEQ ID NO: 464276 - DNA, 14 bp, Homo sapiens
tgtgggcagcaccc

SEQ ID NO: 464277 - DNA, 20 bp, Homo sapiens
tgtgggggtggccatccctg

SEQ ID NO: 464278 - DNA, 14 bp, Homo sapiens
tgtggggtaagttg

SEQ ID NO: 464279 - DNA, 16 bp, Homo sapiens
tgtgtaatctctgatt

SEQ ID NO: 464280 - DNA, 20 bp, Homo sapiens
tgtgtattctgtggattcta

SEQ ID NO: 464281 - DNA, 16 bp, Homo sapiens
tgtgtccatgtgaaat

SEQ ID NO: 464282 - DNA, 22 bp, Homo sapiens
tgtgtcccatgcataacacact

SEQ ID NO: 464283 - DNA, 14 bp, Homo sapiens
tgtgtcccctcact

SEQ ID NO: 464284 - DNA, 15 bp, Homo sapiens
tgtgtcccctcactc

SEQ ID NO: 464285 - DNA, 19 bp, Homo sapiens
tgtgtcccctcactctgtc

SEQ ID NO: 464286 - DNA, 16 bp, Homo sapiens
tgtgtctccagctgat

SEQ ID NO: 464287 - DNA, 13 bp, Homo sapiens
tgtgtgcaatgtt

SEQ ID NO: 464288 - DNA, 16 bp, Homo sapiens
tgtgtggcaaacattt

SEQ ID NO: 464289 - DNA, 18 bp, Homo sapiens
tgtgtgggtttactctgt

SEQ ID NO: 464290 - DNA, 14 bp, Homo sapiens
tgtgtgtgcaatgt

SEQ ID NO: 464291 - DNA, 19 bp, Homo sapiens
tgtgttgccattttgtctg

SEQ ID NO: 464292 - DNA, 19 bp, Homo sapiens
tgttaaacgtcacagcagt

SEQ ID NO: 464293 - DNA, 20 bp, Homo sapiens
tgttaaggacttctgcagct

SEQ ID NO: 464294 - DNA, 15 bp, Homo sapiens
tgttatatcagcaga

SEQ ID NO: 464295 - DNA, 14 bp, Homo sapiens
tgttatgtaaacat

SEQ ID NO: 464296 - DNA, 22 bp, Homo sapiens
tgttcaaagaacccccctcccc

SEQ ID NO: 464297 - DNA, 12 bp, Homo sapiens
tgttcacacaca

SEQ ID NO: 464298 - DNA, 13 bp, Homo sapiens
tgttcacacacac

SEQ ID NO: 464299 - DNA, 14 bp, Homo sapiens
tgttccaagtgtgt

SEQ ID NO: 464300 - DNA, 21 bp, Homo sapiens
tgttccaagtgtgtgtgcaat

SEQ ID NO: 464301 - DNA, 15 bp, Homo sapiens
tgttccgttcatctg

SEQ ID NO: 464302 - DNA, 19 bp, Homo sapiens
tgttccgttcatctgagga

SEQ ID NO: 464303 - DNA, 20 bp, Homo sapiens
tgttccgttcatctgaggag

SEQ ID NO: 464304 - DNA, 18 bp, Homo sapiens
tgttgcaaattattctag

SEQ ID NO: 464305 - DNA, 20 bp, Homo sapiens
tgttgcttagtcacttattt

SEQ ID NO: 464306 - DNA, 22 bp, Homo sapiens
tgtttataggaaataaatctaa

SEQ ID NO: 464307 - DNA, 21 bp, Homo sapiens
tgtttatattgtttttatata

SEQ ID NO: 464308 - DNA, 19 bp, Homo sapiens
tgtttcaatgacctgtatt

SEQ ID NO: 464309 - DNA, 14 bp, Homo sapiens
tgtttcgcatccac

SEQ ID NO: 464310 - DNA, 19 bp, Homo sapiens
ttctgtgcaataaaaccaa

SEQ ID NO: 464311 - DNA, 19 bp, Homo sapiens
ttctgtggattctatattt

SEQ ID NO: 464312 - DNA, 12 bp, Homo sapiens
ttctgtggctca

SEQ ID NO: 464313 - DNA, 15 bp, Homo sapiens
ttctgttttagagtt

SEQ ID NO: 464314 - DNA, 20 bp, Homo sapiens
ttcttcatccatagacacag

SEQ ID NO: 464315 - DNA, 12 bp, Homo sapiens
ttcttgaataaa

SEQ ID NO: 464316 - DNA, 17 bp, Homo sapiens
ttcttgctttcacaaat

SEQ ID NO: 464317 - DNA, 18 bp, Homo sapiens
ttcttggtgactgtccca

SEQ ID NO: 464318 - DNA, 20 bp, Homo sapiens
ttctttaacatacatctaag

SEQ ID NO: 464319 - DNA, 12 bp, Homo sapiens
ttctttctatgt

SEQ ID NO: 464320 - DNA, 15 bp, Homo sapiens
ttcttttatatctgt

SEQ ID NO: 464321 - DNA, 16 bp, Homo sapiens
ttcttttatatctgta

SEQ ID NO: 464322 - DNA, 23 bp, Homo sapiens
ttcttttcagcttgtttctatac

SEQ ID NO: 464323 - DNA, 23 bp, Homo sapiens
ttcttttgaatcaatctggcttc

SEQ ID NO: 464324 - DNA, 21 bp, Homo sapiens
ttcttttttcaatgtactgta

SEQ ID NO: 464325 - DNA, 17 bp, Homo sapiens
ttgaagggaaatcaatt

SEQ ID NO: 464326 - DNA, 19 bp, Homo sapiens
ttgaatcaatctggcttct

SEQ ID NO: 464327 - DNA, 23 bp, Homo sapiens
ttgaatctgattggacattttct

SEQ ID NO: 464328 - DNA, 20 bp, Homo sapiens
ttgaatgtccccattctata

SEQ ID NO: 464329 - DNA, 13 bp, Homo sapiens
ttgacctttattt

SEQ ID NO: 464330 - DNA, 21 bp, Homo sapiens
ttgacgacctacatctgaaat

SEQ ID NO: 464331 - DNA, 16 bp, Homo sapiens
ttgactataaaaactg

SEQ ID NO: 464332 - DNA, 15 bp, Homo sapiens
ttgagcaaggcaaga

SEQ ID NO: 464333 - DNA, 16 bp, Homo sapiens
ttgagcttctcctctg

SEQ ID NO: 464334 - DNA, 17 bp, Homo sapiens
ttgagtccattgcaaaa

SEQ ID NO: 464335 - DNA, 17 bp, Homo sapiens
ttgagtgggccccctct

SEQ ID NO: 464336 - DNA, 18 bp, Homo sapiens
ttgagtgggccccctctc

SEQ ID NO: 464337 - DNA, 13 bp, Homo sapiens
ttgatatgtaaca

SEQ ID NO: 464338 - DNA, 22 bp, Homo sapiens
ttgatattttcaacgcagccct

SEQ ID NO: 464339 - DNA, 20 bp, Homo sapiens
ttgatcgatgttaaacgtca

SEQ ID NO: 464340 - DNA, 12 bp, Homo sapiens
ttgatctggtgc

SEQ ID NO: 464341 - DNA, 20 bp, Homo sapiens
ttgatctggtgcgtgtggcc

SEQ ID NO: 464342 - DNA, 23 bp, Homo sapiens
ttgatggtagaaattttatctct

SEQ ID NO: 464343 - DNA, 13 bp, Homo sapiens
ttgattaaaagca

SEQ ID NO: 464344 - DNA, 14 bp, Homo sapiens
ttgcaaaaggttaa

SEQ ID NO: 464345 - DNA, 20 bp, Homo sapiens
ttgcaaatgcacatttgtca

SEQ ID NO: 464346 - DNA, 15 bp, Homo sapiens
ttgcaaattattcta

SEQ ID NO: 464347 - DNA, 19 bp, Homo sapiens
ttgcaaattattctagtca

SEQ ID NO: 464348 - DNA, 20 bp, Homo sapiens
ttgcaaattattctagtcaa

SEQ ID NO: 464349 - DNA, 15 bp, Homo sapiens
ttgcactgtatccaa

SEQ ID NO: 464350 - DNA, 15 bp, Homo sapiens
ttgcacttctgttat

SEQ ID NO: 464351 - DNA, 13 bp, Homo sapiens
ttgcagaaaaaga

SEQ ID NO: 464352 - DNA, 14 bp, Homo sapiens
ttgcagagtaaatc

SEQ ID NO: 464353 - DNA, 20 bp, Homo sapiens
ttgcaggaagagatgctcta

SEQ ID NO: 464354 - DNA, 13 bp, Homo sapiens
ttgcagtaaagtt

SEQ ID NO: 464355 - DNA, 14 bp, Homo sapiens
ttgccagacttaaa

SEQ ID NO: 464356 - DNA, 14 bp, Homo sapiens
ttgccatccttgca

SEQ ID NO: 464357 - DNA, 18 bp, Homo sapiens
ttgcctcgagtcccccca

SEQ ID NO: 464358 - DNA, 19 bp, Homo sapiens
ttgctcctgcatgcaacta

SEQ ID NO: 464359 - DNA, 16 bp, Homo sapiens
ttgctccttgaataag

SEQ ID NO: 464360 - DNA, 14 bp, Homo sapiens
ttgctgtcctccag

SEQ ID NO: 464361 - DNA, 20 bp, Homo sapiens
ttgctgtcctccagggcgag

SEQ ID NO: 464362 - DNA, 22 bp, Homo sapiens
ttgcttagtcacttatttcata

SEQ ID NO: 464363 - DNA, 23 bp, Homo sapiens
ttgctttaaagtacctgtagtga

SEQ ID NO: 464364 - DNA, 13 bp, Homo sapiens
ttgctttgtatgc

SEQ ID NO: 464365 - DNA, 23 bp, Homo sapiens
ttggaacagacctcactgctttg

SEQ ID NO: 464366 - DNA, 23 bp, Homo sapiens
ttggaagggcgctgagggcaggg

SEQ ID NO: 464367 - DNA, 19 bp, Homo sapiens
ttggagagctcagtacagg

SEQ ID NO: 464368 - DNA, 19 bp, Homo sapiens
ttggagaggaggtgtggag

SEQ ID NO: 464369 - DNA, 23 bp, Homo sapiens
ttggagcagagacggcagcccca

SEQ ID NO: 464370 - DNA, 19 bp, Homo sapiens
ttggataggagcttccaga

SEQ ID NO: 464371 - DNA, 12 bp, Homo sapiens
ttggattcacag

SEQ ID NO: 464372 - DNA, 20 bp, Homo sapiens
ttggattcacagcctttgcg

SEQ ID NO: 464373 - DNA, 16 bp, Homo sapiens
ttggcagcttcaaaac

SEQ ID NO: 464374 - DNA, 22 bp, Homo sapiens
ttggcatctctccccatatata

SEQ ID NO: 464375 - DNA, 21 bp, Homo sapiens
ttggcatggatttcctttgac

SEQ ID NO: 464376 - DNA, 13 bp, Homo sapiens
ttggcattatctc

SEQ ID NO: 464377 - DNA, 23 bp, Homo sapiens
ttggcctgtccacctgtgctgct

SEQ ID NO: 464378 - DNA, 17 bp, Homo sapiens
ttggctcctttcccaca

SEQ ID NO: 464379 - DNA, 19 bp, Homo sapiens
ttggctcctttcccacagt

SEQ ID NO: 464380 - DNA, 16 bp, Homo sapiens
ttggctctgttgctgt

SEQ ID NO: 464381 - DNA, 16 bp, Homo sapiens
ttgggaaattcttgca

SEQ ID NO: 464382 - DNA, 20 bp, Homo sapiens
ttgggaaattcttgcactgt

SEQ ID NO: 464383 - DNA, 15 bp, Homo sapiens
ttggggcttatcaga

SEQ ID NO: 464384 - DNA, 20 bp, Homo sapiens
ttggggcttatcagaactcc

SEQ ID NO: 464385 - DNA, 16 bp, Homo sapiens
ttgggggattcaaatg

SEQ ID NO: 464386 - DNA, 14 bp, Homo sapiens
ttgggttccagaca

SEQ ID NO: 464387 - DNA, 19 bp, Homo sapiens
ttggtaatgatgattcaat

SEQ ID NO: 464388 - DNA, 23 bp, Homo sapiens
ttggtaatgatgattcaatcatt

SEQ ID NO: 464389 - DNA, 12 bp, Homo sapiens
ttggtgaataac

SEQ ID NO: 464390 - DNA, 14 bp, Homo sapiens
ttggtgaataacct

SEQ ID NO: 464391 - DNA, 23 bp, Homo sapiens
ttggtggccgcaaccacttgcta

SEQ ID NO: 464392 - DNA, 15 bp, Homo sapiens
ttggttcctccagca

SEQ ID NO: 464393 - DNA, 20 bp, Homo sapiens
ttggttttaaaaaagcatta

SEQ ID NO: 464394 - DNA, 19 bp, Homo sapiens
ttgtaaataatgcttaaca

SEQ ID NO: 464395 - DNA, 14 bp, Homo sapiens
ttgtacttgaataa

SEQ ID NO: 464396 - DNA, 16 bp, Homo sapiens
ttgtagcatttcttga

SEQ ID NO: 464397 - DNA, 17 bp, Homo sapiens
ttgtattttaataaaga

SEQ ID NO: 464398 - DNA, 16 bp, Homo sapiens
ttgtcacttctgctgt

SEQ ID NO: 464399 - DNA, 18 bp, Homo sapiens
ttgtctgaagtcactgca

SEQ ID NO: 464400 - DNA, 20 bp, Homo sapiens
ttgtctgaagtcactgcaca

SEQ ID NO: 464401 - DNA, 20 bp, Homo sapiens
ttgtctggctgtggcccctc

SEQ ID NO: 464402 - DNA, 17 bp, Homo sapiens
ttgtgacaggaaagccc

SEQ ID NO: 464403 - DNA, 23 bp, Homo sapiens
ttgtgacaggaaagccctccccc

SEQ ID NO: 464404 - DNA, 15 bp, Homo sapiens
ttgtgctgtgggcag

SEQ ID NO: 464405 - DNA, 19 bp, Homo sapiens
ttgtgctgtgggcagcacc

SEQ ID NO: 464406 - DNA, 18 bp, Homo sapiens
ttgtggactttatttaat

SEQ ID NO: 464407 - DNA, 19 bp, Homo sapiens
ttttactcaggctttctat

SEQ ID NO: 464408 - DNA, 20 bp, Homo sapiens
ttttactcaggctttctatt

SEQ ID NO: 464409 - DNA, 22 bp, Homo sapiens
ttttactcaggctttctattgg

SEQ ID NO: 464410 - DNA, 17 bp, Homo sapiens
ttttagaaattctataa

SEQ ID NO: 464411 - DNA, 16 bp, Homo sapiens
ttttatatctgtaaat

SEQ ID NO: 464412 - DNA, 22 bp, Homo sapiens
ttttatgtcatactctgtgtaa

SEQ ID NO: 464413 - DNA, 14 bp, Homo sapiens
ttttattgaataac

SEQ ID NO: 464414 - DNA, 13 bp, Homo sapiens
ttttatttctcgg

SEQ ID NO: 464415 - DNA, 10 bp, Homo sapiens
ttttcaaaat

SEQ ID NO: 464416 - DNA, 18 bp, Homo sapiens
ttttcaaaatacttcttt

SEQ ID NO: 464417 - DNA, 20 bp, Homo sapiens
ttttcactgctggctgcctt

SEQ ID NO: 464418 - DNA, 16 bp, Homo sapiens
ttttccatctaaaata

SEQ ID NO: 464419 - DNA, 19 bp, Homo sapiens
ttttccccaattatcctcc

SEQ ID NO: 464420 - DNA, 12 bp, Homo sapiens
ttttctaaactg

SEQ ID NO: 464421 - DNA, 16 bp, Homo sapiens
ttttctgaattcataa

SEQ ID NO: 464422 - DNA, 13 bp, Homo sapiens
ttttctttctatg

SEQ ID NO: 464423 - DNA, 15 bp, Homo sapiens
ttttctttctatgta

SEQ ID NO: 464424 - DNA, 22 bp, Homo sapiens
ttttctttctatgtagaactgt

SEQ ID NO: 464425 - DNA, 23 bp, Homo sapiens
ttttgtaaccatatgattgaaaa

SEQ ID NO: 464426 - DNA, 15 bp, Homo sapiens
ttttgtttcttggtg

SEQ ID NO: 464427 - DNA, 16 bp, Homo sapiens
tttttaaatgattcca

SEQ ID NO: 464428 - DNA, 19 bp, Homo sapiens
tttttaacttatctccagc

SEQ ID NO: 464429 - DNA, 22 bp, Homo sapiens
tttttactcaggctttctattg

SEQ ID NO: 464430 - DNA, 12 bp, Homo sapiens
tttttcctacca

SEQ ID NO: 464431 - DNA, 15 bp, Homo sapiens
tttttggcattatct

SEQ ID NO: 464432 - DNA, 21 bp, Homo sapiens
tttttgtaaccatatgattga

SEQ ID NO: 464433 - DNA, 14 bp, Homo sapiens
ttttttctggtaag

SEQ ID NO: 464434 - DNA, 16 bp, Homo sapiens
ttttttgctatggaag

SEQ ID NO: 464435 - DNA, 19 bp, Homo sapiens
tttttttaaatgattccaa

SEQ ID NO: 464436 - DNA, 12 bp, Homo sapiens
tttttttctagc

SEQ ID NO: 464437 - DNA, 13 bp, Homo sapiens
tttttttctagct

SEQ ID NO: 464438 - DNA, 19 bp, Homo sapiens
cacgggagagcgccacccg

SEQ ID NO: 464439 - DNA, 21 bp, Homo sapiens
cacgggagagcgccacccgcc

SEQ ID NO: 464440 - DNA, 14 bp, Homo sapiens
cacgggcccgctca

SEQ ID NO: 464441 - DNA, 17 bp, Homo sapiens
cacggggtcgggggagg

SEQ ID NO: 464442 - DNA, 19 bp, Homo sapiens
cacggggtcgggggaggag

SEQ ID NO: 464443 - DNA, 23 bp, Homo sapiens
cacggggtcgggggaggagcacc

SEQ ID NO: 464444 - DNA, 16 bp, Homo sapiens
cactaagtaacctcta

SEQ ID NO: 464445 - DNA, 21 bp, Homo sapiens
cactagccctctttctctctg

SEQ ID NO: 464446 - DNA, 20 bp, Homo sapiens
cactaggtgcccagtcttga

SEQ ID NO: 464447 - DNA, 22 bp, Homo sapiens
cactcagtaggtctgaaggcct

SEQ ID NO: 464448 - DNA, 13 bp, Homo sapiens
cactccactcccc

SEQ ID NO: 464449 - DNA, 16 bp, Homo sapiens
cactccactcccctca

SEQ ID NO: 464450 - DNA, 16 bp, Homo sapiens
cactccagacccctgg

SEQ ID NO: 464451 - DNA, 12 bp, Homo sapiens
cactcccagggc

SEQ ID NO: 464452 - DNA, 12 bp, Homo sapiens
cactcccctcat

SEQ ID NO: 464453 - DNA, 14 bp, Homo sapiens
cactcctacctggt

SEQ ID NO: 464454 - DNA, 14 bp, Homo sapiens
cactcctcccaact

SEQ ID NO: 464455 - DNA, 20 bp, Homo sapiens
cactctgaggtctcaccttc

SEQ ID NO: 464456 - DNA, 14 bp, Homo sapiens
cactctgtcagcca

SEQ ID NO: 464457 - DNA, 22 bp, Homo sapiens
cactctgtcagccagccgccct

SEQ ID NO: 464458 - DNA, 19 bp, Homo sapiens
cactgatatcacgggcccg

SEQ ID NO: 464459 - DNA, 21 bp, Homo sapiens
cactgatgggtcctgctgctc

SEQ ID NO: 464460 - DNA, 18 bp, Homo sapiens
cactgcacagtgcatctc

SEQ ID NO: 464461 - DNA, 22 bp, Homo sapiens
cactgcacagtgcatctcagcc

SEQ ID NO: 464462 - DNA, 23 bp, Homo sapiens
cactgcacagtgcatctcagccc

SEQ ID NO: 464463 - DNA, 14 bp, Homo sapiens
cactgctggctgcc

SEQ ID NO: 464464 - DNA, 16 bp, Homo sapiens
cactgctggctgcctt

SEQ ID NO: 464465 - DNA, 18 bp, Homo sapiens
cactggagttcactttca

SEQ ID NO: 464466 - DNA, 21 bp, Homo sapiens
cactggtgcatttaaaatgga

SEQ ID NO: 464467 - DNA, 13 bp, Homo sapiens
cactggtggcccg

SEQ ID NO: 464468 - DNA, 21 bp, Homo sapiens
cactggtggcccgacagcctg

SEQ ID NO: 464469 - DNA, 17 bp, Homo sapiens
cactggtttgtttctca

SEQ ID NO: 464470 - DNA, 18 bp, Homo sapiens
cactggtttgtttctcaa

SEQ ID NO: 464471 - DNA, 19 bp, Homo sapiens
cactgtatctaaaaaataa

SEQ ID NO: 464472 - DNA, 21 bp, Homo sapiens
cacttaaactttgtcacttct

SEQ ID NO: 464473 - DNA, 19 bp, Homo sapiens
cacttagaaattgcatttc

SEQ ID NO: 464474 - DNA, 13 bp, Homo sapiens
cacttatgctgct

SEQ ID NO: 464475 - DNA, 20 bp, Homo sapiens
cacttatgctgctgtgaatt

SEQ ID NO: 464476 - DNA, 16 bp, Homo sapiens
cacttcaggctcttct

SEQ ID NO: 464477 - DNA, 20 bp, Homo sapiens
cacttcaggctcttctcctt

SEQ ID NO: 464478 - DNA, 23 bp, Homo sapiens
cacttcaggctcttctcctttca

SEQ ID NO: 464479 - DNA, 14 bp, Homo sapiens
cagaaaaaaggact

SEQ ID NO: 464480 - DNA, 17 bp, Homo sapiens
cagaaagggcagcccct

SEQ ID NO: 464481 - DNA, 19 bp, Homo sapiens
cagaaatgtggatgctctt

SEQ ID NO: 464482 - DNA, 14 bp, Homo sapiens
cagaacaaaagata

SEQ ID NO: 464483 - DNA, 15 bp, Homo sapiens
cagaaccagcactcc

SEQ ID NO: 464484 - DNA, 16 bp, Homo sapiens
cagaaccagcactccc

SEQ ID NO: 464485 - DNA, 19 bp, Homo sapiens
cagaaccagcactcccagg

SEQ ID NO: 464486 - DNA, 21 bp, Homo sapiens
cagaaccagcactcccagggc

SEQ ID NO: 464487 - DNA, 16 bp, Homo sapiens
cagaacgggcctcccc

SEQ ID NO: 464488 - DNA, 18 bp, Homo sapiens
cagaacgggcctccccgg

SEQ ID NO: 464489 - DNA, 14 bp, Homo sapiens
cagaacgggttctc

SEQ ID NO: 464490 - DNA, 16 bp, Homo sapiens
cagaactcagccttaa

SEQ ID NO: 464491 - DNA, 23 bp, Homo sapiens
cagaatctaactggtggacatgg

SEQ ID NO: 464492 - DNA, 21 bp, Homo sapiens
cagaattgaaccgtcaatgtg

SEQ ID NO: 464493 - DNA, 19 bp, Homo sapiens
cagaatttctttgtcattc

SEQ ID NO: 464494 - DNA, 22 bp, Homo sapiens
cagaatttctttgtcattcaag

SEQ ID NO: 464495 - DNA, 16 bp, Homo sapiens
cagacaccctccactc

SEQ ID NO: 464496 - DNA, 18 bp, Homo sapiens
cagacaccctccactctg

SEQ ID NO: 464497 - DNA, 19 bp, Homo sapiens
cagacaccctccactctga

SEQ ID NO: 464498 - DNA, 20 bp, Homo sapiens
cagacaccctccactctgag

SEQ ID NO: 464499 - DNA, 20 bp, Homo sapiens
cagacactccagtttgccca

SEQ ID NO: 464500 - DNA, 12 bp, Homo sapiens
cagacagagatc

SEQ ID NO: 464501 - DNA, 12 bp, Homo sapiens
cagacagagtgg

SEQ ID NO: 464502 - DNA, 17 bp, Homo sapiens
cagacagggtggggctt

SEQ ID NO: 464503 - DNA, 19 bp, Homo sapiens
cagacagggtggggcttag

SEQ ID NO: 464504 - DNA, 15 bp, Homo sapiens
cagacccctaccctt

SEQ ID NO: 464505 - DNA, 14 bp, Homo sapiens
cagacccctggctt

SEQ ID NO: 464506 - DNA, 20 bp, Homo sapiens
cagacctcactgctttgtag

SEQ ID NO: 464507 - DNA, 17 bp, Homo sapiens
cagacgctgccgctgcc

SEQ ID NO: 464508 - DNA, 20 bp, Homo sapiens
cagacggacgggacagcggc

SEQ ID NO: 464509 - DNA, 17 bp, Homo sapiens
cagacgggctgagagga

SEQ ID NO: 464510 - DNA, 19 bp, Homo sapiens
cagactcgagagggctgag

SEQ ID NO: 464511 - DNA, 22 bp, Homo sapiens
cagactcgagagggctgagccc

SEQ ID NO: 464512 - DNA, 22 bp, Homo sapiens
cagactctctcctctctctccc

SEQ ID NO: 464513 - DNA, 23 bp, Homo sapiens
cagactctctcctctctctccct

SEQ ID NO: 464514 - DNA, 14 bp, Homo sapiens
cagagacggcagcc

SEQ ID NO: 464515 - DNA, 22 bp, Homo sapiens
cagagacggcagccccatcctt

SEQ ID NO: 464516 - DNA, 10 bp, Homo sapiens
cagagactgc

SEQ ID NO: 464517 - DNA, 13 bp, Homo sapiens
cagagactgccca

SEQ ID NO: 464518 - DNA, 19 bp, Homo sapiens
cagagactgcccaccctgg

SEQ ID NO: 464519 - DNA, 21 bp, Homo sapiens
cagagactgcccaccctgggc

SEQ ID NO: 464520 - DNA, 14 bp, Homo sapiens
cagagagtggctcc

SEQ ID NO: 464521 - DNA, 16 bp, Homo sapiens
cagagatcagaattga

SEQ ID NO: 464522 - DNA, 14 bp, Homo sapiens
cagagccccggagc

SEQ ID NO: 464523 - DNA, 19 bp, Homo sapiens
cagagccccggagcaccac

SEQ ID NO: 464524 - DNA, 22 bp, Homo sapiens
cagagctcatttcggggtcagg

SEQ ID NO: 464525 - DNA, 19 bp, Homo sapiens
cagagctgagtcggctggg

SEQ ID NO: 464526 - DNA, 16 bp, Homo sapiens
cagagctggatgctga

SEQ ID NO: 464527 - DNA, 17 bp, Homo sapiens
cagaggagcaaggttta

SEQ ID NO: 464528 - DNA, 14 bp, Homo sapiens
cagaggcagggccc

SEQ ID NO: 464529 - DNA, 16 bp, Homo sapiens
cagaggcagggccctg

SEQ ID NO: 464530 - DNA, 16 bp, Homo sapiens
cagaggccgctctggg

SEQ ID NO: 464531 - DNA, 21 bp, Homo sapiens
cagagtaggtgggtcttggat

SEQ ID NO: 464532 - DNA, 19 bp, Homo sapiens
cagagtggatctggagtct

SEQ ID NO: 464533 - DNA, 19 bp, Homo sapiens
cagatccctcggtcagcac

SEQ ID NO: 464534 - DNA, 16 bp, Homo sapiens
cagatctggaatgtga

SEQ ID NO: 464535 - DNA, 19 bp, Homo sapiens
catggatttcctttgacct

SEQ ID NO: 464536 - DNA, 12 bp, Homo sapiens
catggccccagc

SEQ ID NO: 464537 - DNA, 13 bp, Homo sapiens
catggccccagct

SEQ ID NO: 464538 - DNA, 15 bp, Homo sapiens
catggccccagctgg

SEQ ID NO: 464539 - DNA, 20 bp, Homo sapiens
catggccccagctggctggg

SEQ ID NO: 464540 - DNA, 20 bp, Homo sapiens
catgggaaatgtcaacaagt

SEQ ID NO: 464541 - DNA, 18 bp, Homo sapiens
catggtttttgctctact

SEQ ID NO: 464542 - DNA, 10 bp, Homo sapiens
catgtagcat

SEQ ID NO: 464543 - DNA, 21 bp, Homo sapiens
catgtagcatataaatgttta

SEQ ID NO: 464544 - DNA, 22 bp, Homo sapiens
catgtccctaccgagtctcttc

SEQ ID NO: 464545 - DNA, 22 bp, Homo sapiens
catgtgattggcagcttcaaaa

SEQ ID NO: 464546 - DNA, 15 bp, Homo sapiens
catgtgcaaacgctg

SEQ ID NO: 464547 - DNA, 15 bp, Homo sapiens
catgtgcctgcacca

SEQ ID NO: 464548 - DNA, 20 bp, Homo sapiens
catgtgcctgcaccaggaga

SEQ ID NO: 464549 - DNA, 23 bp, Homo sapiens
catgtgcctgcaccaggagacag

SEQ ID NO: 464550 - DNA, 24 bp, Homo sapiens
catgtgtcccctcactctgtcagc

SEQ ID NO: 464551 - DNA, 24 bp, Homo sapiens
catgtgttgcaaattattctagtc

SEQ ID NO: 464552 - DNA, 18 bp, Homo sapiens
cattagcagtttgctttg

SEQ ID NO: 464553 - DNA, 22 bp, Homo sapiens
cattaggtagatgagaaaacag

SEQ ID NO: 464554 - DNA, 13 bp, Homo sapiens
cacccctcttccc

SEQ ID NO: 464555 - DNA, 14 bp, Homo sapiens
cacccctcttcccc

SEQ ID NO: 464556 - DNA, 18 bp, Homo sapiens
cacccctcttcccccttc

SEQ ID NO: 464557 - DNA, 11 bp, Homo sapiens
cacccgcccca

SEQ ID NO: 464558 - DNA, 12 bp, Homo sapiens
cacccgccccag

SEQ ID NO: 464559 - DNA, 16 bp, Homo sapiens
cacccgccccagagac

SEQ ID NO: 464560 - DNA, 22 bp, Homo sapiens
cacccgccccagagactgccca

SEQ ID NO: 464561 - DNA, 17 bp, Homo sapiens
cacccgcccgcccccgc

SEQ ID NO: 464562 - DNA, 18 bp, Homo sapiens
caccctccactctgaggt

SEQ ID NO: 464563 - DNA, 17 bp, Homo sapiens
caccctcccctctcctg

SEQ ID NO: 464564 - DNA, 18 bp, Homo sapiens
caccctcccctctcctga

SEQ ID NO: 464565 - DNA, 14 bp, Homo sapiens
caccctgggcctcc

SEQ ID NO: 464566 - DNA, 21 bp, Homo sapiens
cacccttccccactcccgtga

SEQ ID NO: 464567 - DNA, 12 bp, Homo sapiens
caccgccacccc

SEQ ID NO: 464568 - DNA, 14 bp, Homo sapiens
caccgccaccccac

SEQ ID NO: 464569 - DNA, 18 bp, Homo sapiens
caccgccaccccactgag

SEQ ID NO: 464570 - DNA, 19 bp, Homo sapiens
caccgggagcctccccctc

SEQ ID NO: 464571 - DNA, 13 bp, Homo sapiens
caccgggcctgga

SEQ ID NO: 464572 - DNA, 20 bp, Homo sapiens
caccgtggtgtgaggccccc

SEQ ID NO: 464573 - DNA, 12 bp, Homo sapiens
cacctccacccg

SEQ ID NO: 464574 - DNA, 12 bp, Homo sapiens
cacctcttcctt

SEQ ID NO: 464575 - DNA, 11 bp, Homo sapiens
cacctgcccag

SEQ ID NO: 464576 - DNA, 12 bp, Homo sapiens
cacctgcccagt

SEQ ID NO: 464577 - DNA, 18 bp, Homo sapiens
cacctgcccagttagccc

SEQ ID NO: 464578 - DNA, 22 bp, Homo sapiens
cacctgcccagttagcccggcc

SEQ ID NO: 464579 - DNA, 19 bp, Homo sapiens
cacctggcacaccagaagt

SEQ ID NO: 464580 - DNA, 14 bp, Homo sapiens
cacctgtgctgctg

SEQ ID NO: 464581 - DNA, 24 bp, Homo sapiens
caccttcccctgaggacctttctg

SEQ ID NO: 464582 - DNA, 15 bp, Homo sapiens
caccttcgcctttgc

SEQ ID NO: 464583 - DNA, 17 bp, Homo sapiens
caccttgtacagaacca

SEQ ID NO: 464584 - DNA, 18 bp, Homo sapiens
caccttgtacagaaccag

SEQ ID NO: 464585 - DNA, 21 bp, Homo sapiens
caccttgtacagaaccagcac

SEQ ID NO: 464586 - DNA, 14 bp, Homo sapiens
cacgcagagccccg

SEQ ID NO: 464587 - DNA, 20 bp, Homo sapiens
cacgcagagccccggagcac

SEQ ID NO: 464588 - DNA, 13 bp, Homo sapiens
cacgcctcctggc

SEQ ID NO: 464589 - DNA, 15 bp, Homo sapiens
cacgcctcctggcca

SEQ ID NO: 464590 - DNA, 17 bp, Homo sapiens
cacgcctcctggccaga

SEQ ID NO: 464591 - DNA, 15 bp, Homo sapiens
cacgctcctgccctc

SEQ ID NO: 464592 - DNA, 15 bp, Homo sapiens
cacgctgacagcctc

SEQ ID NO: 464593 - DNA, 14 bp, Homo sapiens
cacgctgtcctctc

SEQ ID NO: 464594 - DNA, 23 bp, Homo sapiens
cacggccgtccctgacttcccag

SEQ ID NO: 464595 - DNA, 17 bp, Homo sapiens
cacggcgtttttttaca

SEQ ID NO: 464596 - DNA, 18 bp, Homo sapiens
cacgggcccgctcaacct

SEQ ID NO: 464597 - DNA, 23 bp, Homo sapiens
cacgggcccgctcaacctctcag

SEQ ID NO: 464598 - DNA, 13 bp, Homo sapiens
cactagaatgaga

SEQ ID NO: 464599 - DNA, 16 bp, Homo sapiens
cactaggtgcccagtc

SEQ ID NO: 464600 - DNA, 16 bp, Homo sapiens
cactagtagctgtttt

SEQ ID NO: 464601 - DNA, 20 bp, Homo sapiens
cactatggtatgctggccag

SEQ ID NO: 464602 - DNA, 22 bp, Homo sapiens
cactatggtatgctggccagca

SEQ ID NO: 464603 - DNA, 14 bp, Homo sapiens
cactcagtaggtct

SEQ ID NO: 464604 - DNA, 23 bp, Homo sapiens
cactcagtaggtctgaaggcctc

SEQ ID NO: 464605 - DNA, 14 bp, Homo sapiens
cactcccagggccc

SEQ ID NO: 464606 - DNA, 19 bp, Homo sapiens
cactccctttgtggacttt

SEQ ID NO: 464607 - DNA, 20 bp, Homo sapiens
cactccctttgtggacttta

SEQ ID NO: 464608 - DNA, 14 bp, Homo sapiens
cactctacttagca

SEQ ID NO: 464609 - DNA, 17 bp, Homo sapiens
cactctcttcttactgt

SEQ ID NO: 464610 - DNA, 21 bp, Homo sapiens
cactctgaagtcccttcctgt

SEQ ID NO: 464611 - DNA, 15 bp, Homo sapiens
cactctgacagtatt

SEQ ID NO: 464612 - DNA, 21 bp, Homo sapiens
cactctgtcagccagccgccc

SEQ ID NO: 464613 - DNA, 23 bp, Homo sapiens
cactctgtcagccagccgccctg

SEQ ID NO: 464614 - DNA, 14 bp, Homo sapiens
cactgaactcagga

SEQ ID NO: 464615 - DNA, 15 bp, Homo sapiens
cactgagagctgctc

SEQ ID NO: 464616 - DNA, 16 bp, Homo sapiens
cactgagagctgctcc

SEQ ID NO: 464617 - DNA, 18 bp, Homo sapiens
cactgagagctgctcctt

SEQ ID NO: 464618 - DNA, 14 bp, Homo sapiens
cactgagtttgaac

SEQ ID NO: 464619 - DNA, 21 bp, Homo sapiens
cactgatatcacgggcccgct

SEQ ID NO: 464620 - DNA, 22 bp, Homo sapiens
cactgatatcacgggcccgctc

SEQ ID NO: 464621 - DNA, 16 bp, Homo sapiens
cactgatgggtcctgc

SEQ ID NO: 464622 - DNA, 17 bp, Homo sapiens
cactgatgggtcctgct

SEQ ID NO: 464623 - DNA, 19 bp, Homo sapiens
cactgcacagtgcatctca

SEQ ID NO: 464624 - DNA, 21 bp, Homo sapiens
cactgcacagtgcatctcagc

SEQ ID NO: 464625 - DNA, 13 bp, Homo sapiens
cactgctggctgc

SEQ ID NO: 464626 - DNA, 14 bp, Homo sapiens
cactggtgcattta

SEQ ID NO: 464627 - DNA, 19 bp, Homo sapiens
cactggtgcatttaaaatg

SEQ ID NO: 464628 - DNA, 21 bp, Homo sapiens
cactgtaatcttaaaagtgta

SEQ ID NO: 464629 - DNA, 17 bp, Homo sapiens
cacttaaactttgtcac

SEQ ID NO: 464630 - DNA, 20 bp, Homo sapiens
cacttagaaattgcatttcc

SEQ ID NO: 464631 - DNA, 14 bp, Homo sapiens
cacttatgctgctg

SEQ ID NO: 464632 - DNA, 14 bp, Homo sapiens
cacttcaggctctt

SEQ ID NO: 464633 - DNA, 17 bp, Homo sapiens
cacttctatttatttat

SEQ ID NO: 464634 - DNA, 12 bp, Homo sapiens
cacttctgttat

SEQ ID NO: 464635 - DNA, 17 bp, Homo sapiens
cactttgagcctgggaa

SEQ ID NO: 464636 - DNA, 21 bp, Homo sapiens
cactttttctgtctttatgta

SEQ ID NO: 464637 - DNA, 18 bp, Homo sapiens
cagaaaaaaggactgtat

SEQ ID NO: 464638 - DNA, 19 bp, Homo sapiens
cagaaagggcagcccctcc

SEQ ID NO: 464639 - DNA, 16 bp, Homo sapiens
cagaaccaacgggtct

SEQ ID NO: 464640 - DNA, 18 bp, Homo sapiens
cagaaccagcactcccag

SEQ ID NO: 464641 - DNA, 22 bp, Homo sapiens
cagaacccttggagccaatgga

SEQ ID NO: 464642 - DNA, 14 bp, Homo sapiens
cagaacctttgtca

SEQ ID NO: 464643 - DNA, 15 bp, Homo sapiens
cagaacctttgtcaa

SEQ ID NO: 464644 - DNA, 19 bp, Homo sapiens
cagaacctttgtcaacttc

SEQ ID NO: 464645 - DNA, 15 bp, Homo sapiens
cagaacgggcctccc

SEQ ID NO: 464646 - DNA, 17 bp, Homo sapiens
cagaactcctttctaag

SEQ ID NO: 464647 - DNA, 19 bp, Homo sapiens
cagaatggtgggctccaga

SEQ ID NO: 464648 - DNA, 20 bp, Homo sapiens
cagaatggtgggctccagag

SEQ ID NO: 464649 - DNA, 13 bp, Homo sapiens
cagacaccctcca

SEQ ID NO: 464650 - DNA, 22 bp, Homo sapiens
cagacaccctccactctgaggt

SEQ ID NO: 464651 - DNA, 16 bp, Homo sapiens
cagccccccagcacta

SEQ ID NO: 464652 - DNA, 13 bp, Homo sapiens
cagcccctgctgg

SEQ ID NO: 464653 - DNA, 15 bp, Homo sapiens
cagccctccctgccc

SEQ ID NO: 464654 - DNA, 16 bp, Homo sapiens
cagccctctccaccca

SEQ ID NO: 464655 - DNA, 19 bp, Homo sapiens
cagccctctccacccagag

SEQ ID NO: 464656 - DNA, 11 bp, Homo sapiens
cagccctgctt

SEQ ID NO: 464657 - DNA, 13 bp, Homo sapiens
cagccctgctttg

SEQ ID NO: 464658 - DNA, 13 bp, Homo sapiens
cagccgccctggg

SEQ ID NO: 464659 - DNA, 15 bp, Homo sapiens
cagccgccctgggct

SEQ ID NO: 464660 - DNA, 16 bp, Homo sapiens
cagccgcgctctgccc

SEQ ID NO: 464661 - DNA, 19 bp, Homo sapiens
cagccgcgctctgcccctc

SEQ ID NO: 464662 - DNA, 21 bp, Homo sapiens
cagccgcgctctgcccctccg

SEQ ID NO: 464663 - DNA, 20 bp, Homo sapiens
cagccgtgccttcagctcta

SEQ ID NO: 464664 - DNA, 17 bp, Homo sapiens
agtcccttcctgtcctg

SEQ ID NO: 464665 - DNA, 14 bp, Homo sapiens
agtcggctgggcag

SEQ ID NO: 464666 - DNA, 17 bp, Homo sapiens
agtcggctgggcagggc

SEQ ID NO: 464667 - DNA, 19 bp, Homo sapiens
agtcggctgggcagggccg

SEQ ID NO: 464668 - DNA, 18 bp, Homo sapiens
agtctccccgcagccctc

SEQ ID NO: 464669 - DNA, 19 bp, Homo sapiens
agtctctgatttgcaaatg

SEQ ID NO: 464670 - DNA, 16 bp, Homo sapiens
agtctgaaggagagga

SEQ ID NO: 464671 - DNA, 17 bp, Homo sapiens
agtctgaaggagaggag

SEQ ID NO: 464672 - DNA, 20 bp, Homo sapiens
agtctgaaggagaggagtgc

SEQ ID NO: 464673 - DNA, 18 bp, Homo sapiens
agtctgtacttcagttct

SEQ ID NO: 464674 - DNA, 15 bp, Homo sapiens
agtcttactgttttg

SEQ ID NO: 464675 - DNA, 19 bp, Homo sapiens
agtcttactgttttgtgcg

SEQ ID NO: 464676 - DNA, 14 bp, Homo sapiens
agtcttctgcctct

SEQ ID NO: 464677 - DNA, 14 bp, Homo sapiens
agtcttgagtgggc

SEQ ID NO: 464678 - DNA, 19 bp, Homo sapiens
agtctttgggggattcaaa

SEQ ID NO: 464679 - DNA, 20 bp, Homo sapiens
agtctttgggggattcaaat

SEQ ID NO: 464680 - DNA, 21 bp, Homo sapiens
agtctttgggggattcaaatg

SEQ ID NO: 464681 - DNA, 16 bp, Homo sapiens
agtgaagcccaggagg

SEQ ID NO: 464682 - DNA, 16 bp, Homo sapiens
agtgatacactgtatc

SEQ ID NO: 464683 - DNA, 21 bp, Homo sapiens
agtgatacactgtatctaaaa

SEQ ID NO: 464684 - DNA, 17 bp, Homo sapiens
agtgatgcaataaacaa

SEQ ID NO: 464685 - DNA, 15 bp, Homo sapiens
agtgctcagtattga

SEQ ID NO: 464686 - DNA, 15 bp, Homo sapiens
agtgctgggcccagc

SEQ ID NO: 464687 - DNA, 18 bp, Homo sapiens
agtggaggggtcagcagg

SEQ ID NO: 464688 - DNA, 21 bp, Homo sapiens
agtggatctggagtctgaagg

SEQ ID NO: 464689 - DNA, 16 bp, Homo sapiens
agtggcaaaaaagaac

SEQ ID NO: 464690 - DNA, 21 bp, Homo sapiens
agtggcctgagaagagtcgag

SEQ ID NO: 464691 - DNA, 14 bp, Homo sapiens
agtgggccccctct

SEQ ID NO: 464692 - DNA, 17 bp, Homo sapiens
agtgtaacccaagcatt

SEQ ID NO: 464693 - DNA, 15 bp, Homo sapiens
agtgtggcttaaaca

SEQ ID NO: 464694 - DNA, 18 bp, Homo sapiens
agtgtggcttaaacattt

SEQ ID NO: 464695 - DNA, 12 bp, Homo sapiens
agtgtgtacttc

SEQ ID NO: 464696 - DNA, 12 bp, Homo sapiens
agtgtgtgtgca

SEQ ID NO: 464697 - DNA, 18 bp, Homo sapiens
agtgtgtgtgcaatgttc

SEQ ID NO: 464698 - DNA, 23 bp, Homo sapiens
agtgttgaaattggaaaggactt

SEQ ID NO: 464699 - DNA, 15 bp, Homo sapiens
agttaagacaacagg

SEQ ID NO: 464700 - DNA, 16 bp, Homo sapiens
agttagcccggccaag

SEQ ID NO: 464701 - DNA, 23 bp, Homo sapiens
agttagcccggccaaggacactg

SEQ ID NO: 464702 - DNA, 15 bp, Homo sapiens
agttccattctatga

SEQ ID NO: 464703 - DNA, 13 bp, Homo sapiens
agttctatttcta

SEQ ID NO: 464704 - DNA, 12 bp, Homo sapiens
agttctcatctt

SEQ ID NO: 464705 - DNA, 15 bp, Homo sapiens
agttctcatcttgta

SEQ ID NO: 464706 - DNA, 17 bp, Homo sapiens
agttctccttgtacttg

SEQ ID NO: 464707 - DNA, 16 bp, Homo sapiens
agttctgcaataacag

SEQ ID NO: 464708 - DNA, 17 bp, Homo sapiens
agttctgcaataacagt

SEQ ID NO: 464709 - DNA, 22 bp, Homo sapiens
agttgaagggaaatcaatttaa

SEQ ID NO: 464710 - DNA, 13 bp, Homo sapiens
agttgcagtaaag

SEQ ID NO: 464711 - DNA, 16 bp, Homo sapiens
agttgtaagaaaagct

SEQ ID NO: 464712 - DNA, 18 bp, Homo sapiens
agttgtattttaataaag

SEQ ID NO: 464713 - DNA, 21 bp, Homo sapiens
agttgttggtttatactgtat

SEQ ID NO: 464714 - DNA, 15 bp, Homo sapiens
agtttaaaaaaataa

SEQ ID NO: 464715 - DNA, 20 bp, Homo sapiens
agtttaccaatcaacagcat

SEQ ID NO: 464716 - DNA, 13 bp, Homo sapiens
agtttataaaaga

SEQ ID NO: 464717 - DNA, 22 bp, Homo sapiens
agtttattgccctcaaaatctt

SEQ ID NO: 464718 - DNA, 15 bp, Homo sapiens
agtttccagctgctc

SEQ ID NO: 464719 - DNA, 16 bp, Homo sapiens
agtttctatggattca

SEQ ID NO: 464720 - DNA, 19 bp, Homo sapiens
agtttgcatacttcctgga

SEQ ID NO: 464721 - DNA, 23 bp, Homo sapiens
agtttgcatacttcctggatttt

SEQ ID NO: 464722 - DNA, 20 bp, Homo sapiens
agtttggaagtacataaagt

SEQ ID NO: 464723 - DNA, 15 bp, Homo sapiens
agtttgttctccggg

SEQ ID NO: 464724 - DNA, 21 bp, Homo sapiens
agtttgttctccgggtgtggc

SEQ ID NO: 464725 - DNA, 23 bp, Homo sapiens
agtttttggtaatgatgattcaa

SEQ ID NO: 464726 - DNA, 13 bp, Homo sapiens
ataaaaaagaaaa

SEQ ID NO: 464727 - DNA, 21 bp, Homo sapiens
ataaaaaagaaaacttgtgtt

SEQ ID NO: 464728 - DNA, 14 bp, Homo sapiens
ataaaactaggaat

SEQ ID NO: 464729 - DNA, 18 bp, Homo sapiens
ataaaactcagttaaaat

SEQ ID NO: 464730 - DNA, 12 bp, Homo sapiens
ataaaagagctt

SEQ ID NO: 464731 - DNA, 15 bp, Homo sapiens
ataaaagagctttat

SEQ ID NO: 464732 - DNA, 19 bp, Homo sapiens
ataaacaacttaatgttct

SEQ ID NO: 464733 - DNA, 13 bp, Homo sapiens
ataaacattaaac

SEQ ID NO: 464734 - DNA, 14 bp, Homo sapiens
ataaacattaaaca

SEQ ID NO: 464735 - DNA, 15 bp, Homo sapiens
ataaacattaaacac

SEQ ID NO: 464736 - DNA, 13 bp, Homo sapiens
ataaactccttaa

SEQ ID NO: 464737 - DNA, 15 bp, Homo sapiens
ataaacttgtactta

SEQ ID NO: 464738 - DNA, 12 bp, Homo sapiens
ataaagaagaaa

SEQ ID NO: 464739 - DNA, 22 bp, Homo sapiens
agctcaggagaaggcctgcccc

SEQ ID NO: 464740 - DNA, 13 bp, Homo sapiens
agctcagtacagg

SEQ ID NO: 464741 - DNA, 16 bp, Homo sapiens
agctcagtacagggca

SEQ ID NO: 464742 - DNA, 18 bp, Homo sapiens
agctcagtacagggcagg

SEQ ID NO: 464743 - DNA, 16 bp, Homo sapiens
agctccactctgaagt

SEQ ID NO: 464744 - DNA, 13 bp, Homo sapiens
agctctaaagcag

SEQ ID NO: 464745 - DNA, 18 bp, Homo sapiens
agctctaaagcagagatg

SEQ ID NO: 464746 - DNA, 17 bp, Homo sapiens
agctgagtcggctgggc

SEQ ID NO: 464747 - DNA, 19 bp, Homo sapiens
agctgagtcggctgggcag

SEQ ID NO: 464748 - DNA, 14 bp, Homo sapiens
agctgctctccttc

SEQ ID NO: 464749 - DNA, 15 bp, Homo sapiens
agctgctctccttca

SEQ ID NO: 464750 - DNA, 20 bp, Homo sapiens
agctggatgctgagagacct

SEQ ID NO: 464751 - DNA, 18 bp, Homo sapiens
agctggcaaactgtgaat

SEQ ID NO: 464752 - DNA, 16 bp, Homo sapiens
agctggcagcgcctcc

SEQ ID NO: 464753 - DNA, 19 bp, Homo sapiens
agctgtagaaatgtatcct

SEQ ID NO: 464754 - DNA, 20 bp, Homo sapiens
agctgtcactcacaaaaggc

SEQ ID NO: 464755 - DNA, 15 bp, Homo sapiens
agcttatttctaact

SEQ ID NO: 464756 - DNA, 14 bp, Homo sapiens
agcttcaaaacaga

SEQ ID NO: 464757 - DNA, 15 bp, Homo sapiens
agcttccagtagagc

SEQ ID NO: 464758 - DNA, 13 bp, Homo sapiens
agcttctcctctg

SEQ ID NO: 464759 - DNA, 19 bp, Homo sapiens
aggaaaaccaagccgtggc

SEQ ID NO: 464760 - DNA, 20 bp, Homo sapiens
aggaaaaccaagccgtggct

SEQ ID NO: 464761 - DNA, 21 bp, Homo sapiens
aggaaaaccaagccgtggctt

SEQ ID NO: 464762 - DNA, 22 bp, Homo sapiens
aggaaaaccaagccgtggcttc

SEQ ID NO: 464763 - DNA, 23 bp, Homo sapiens
aggaaaataacagagctggatgc

SEQ ID NO: 464764 - DNA, 17 bp, Homo sapiens
aggaaagccctccccct

SEQ ID NO: 464765 - DNA, 23 bp, Homo sapiens
aggaaagccctcccccttcccct

SEQ ID NO: 464766 - DNA, 19 bp, Homo sapiens
aggaaagttctattatctg

SEQ ID NO: 464767 - DNA, 22 bp, Homo sapiens
aggaaagttctattatctgggt

SEQ ID NO: 464768 - DNA, 11 bp, Homo sapiens
aggaatataca

SEQ ID NO: 464769 - DNA, 22 bp, Homo sapiens
aggaatatacatagtctttgtt

SEQ ID NO: 464770 - DNA, 20 bp, Homo sapiens
aggacactgatgggtcctgc

SEQ ID NO: 464771 - DNA, 23 bp, Homo sapiens
aggaccgccccaaccctcggagc

SEQ ID NO: 464772 - DNA, 16 bp, Homo sapiens
aggacggggcagagct

SEQ ID NO: 464773 - DNA, 17 bp, Homo sapiens
aggacggggcagagctg

SEQ ID NO: 464774 - DNA, 19 bp, Homo sapiens
aggactaacaactgggaaa

SEQ ID NO: 464775 - DNA, 18 bp, Homo sapiens
aggactgtatagtttaaa

SEQ ID NO: 464776 - DNA, 23 bp, Homo sapiens
aggactgtatagtttaaagggag

SEQ ID NO: 464777 - DNA, 14 bp, Homo sapiens
aggacttctgcagc

SEQ ID NO: 464778 - DNA, 15 bp, Homo sapiens
aggacttctgcagct

SEQ ID NO: 464779 - DNA, 14 bp, Homo sapiens
aggagaaggcctgc

SEQ ID NO: 464780 - DNA, 19 bp, Homo sapiens
aggagaaggcctgcccccc

SEQ ID NO: 464781 - DNA, 14 bp, Homo sapiens
aggagaccctgtct

SEQ ID NO: 464782 - DNA, 13 bp, Homo sapiens
aggagaggagtgc

SEQ ID NO: 464783 - DNA, 11 bp, Homo sapiens
aggagcacccc

SEQ ID NO: 464784 - DNA, 13 bp, Homo sapiens
aggagcaccccca

SEQ ID NO: 464785 - DNA, 17 bp, Homo sapiens
aggagcacccccagcct

SEQ ID NO: 464786 - DNA, 20 bp, Homo sapiens
aggagcacccccagcctccc

SEQ ID NO: 464787 - DNA, 21 bp, Homo sapiens
aggagcacccccagcctcccc

SEQ ID NO: 464788 - DNA, 22 bp, Homo sapiens
aggagcacccccagcctccccc

SEQ ID NO: 464789 - DNA, 13 bp, Homo sapiens
aggagcactagaa

SEQ ID NO: 464790 - DNA, 16 bp, Homo sapiens
aggaggacctgggggg

SEQ ID NO: 464791 - DNA, 22 bp, Homo sapiens
aggaggacctggggggggcaag

SEQ ID NO: 464792 - DNA, 23 bp, Homo sapiens
aggaggacctggggggggcaaga

SEQ ID NO: 464793 - DNA, 19 bp, Homo sapiens
aggaggtgtggagtggagg

SEQ ID NO: 464794 - DNA, 17 bp, Homo sapiens
aggagtgcgctagagca

SEQ ID NO: 464795 - DNA, 18 bp, Homo sapiens
aggattaatctctaaaat

SEQ ID NO: 464796 - DNA, 22 bp, Homo sapiens
aggattcttttttcaatgtact

SEQ ID NO: 464797 - DNA, 13 bp, Homo sapiens
aggcaagaagtgg

SEQ ID NO: 464798 - DNA, 15 bp, Homo sapiens
aggcacacagcagcc

SEQ ID NO: 464799 - DNA, 21 bp, Homo sapiens
aggcacacagcagccccccag

SEQ ID NO: 464800 - DNA, 15 bp, Homo sapiens
aggcagaatggtggg

SEQ ID NO: 464801 - DNA, 22 bp, Homo sapiens
aggcagagattgggggggcttg

SEQ ID NO: 464802 - DNA, 12 bp, Homo sapiens
aggcagggccct

SEQ ID NO: 464803 - DNA, 13 bp, Homo sapiens
aggcagggccctg

SEQ ID NO: 464804 - DNA, 14 bp, Homo sapiens
aggcagggccctgg

SEQ ID NO: 464805 - DNA, 13 bp, Homo sapiens
aggccagtacttt

SEQ ID NO: 464806 - DNA, 18 bp, Homo sapiens
aggccccagcctccaggc

SEQ ID NO: 464807 - DNA, 22 bp, Homo sapiens
aggcccccctctgcctttgagc

SEQ ID NO: 464808 - DNA, 13 bp, Homo sapiens
aggcccccggagg

SEQ ID NO: 464809 - DNA, 21 bp, Homo sapiens
aggcccccggaggcgcccacc

SEQ ID NO: 464810 - DNA, 21 bp, Homo sapiens
agacgtttttgtgctgtgggc

SEQ ID NO: 464811 - DNA, 17 bp, Homo sapiens
agactcccgcctttgac

SEQ ID NO: 464812 - DNA, 18 bp, Homo sapiens
agactcgagagggctgag

SEQ ID NO: 464813 - DNA, 20 bp, Homo sapiens
agactcgagagggctgagcc

SEQ ID NO: 464814 - DNA, 23 bp, Homo sapiens
agactcgagagggctgagcccct

SEQ ID NO: 464815 - DNA, 12 bp, Homo sapiens
agactgcccacc

SEQ ID NO: 464816 - DNA, 18 bp, Homo sapiens
agactgcccaccctgggc

SEQ ID NO: 464817 - DNA, 20 bp, Homo sapiens
agactgcccaccctgggcct

SEQ ID NO: 464818 - DNA, 20 bp, Homo sapiens
agactttaattcttctcttt

SEQ ID NO: 464819 - DNA, 19 bp, Homo sapiens
agagaaaatgctttctcat

SEQ ID NO: 464820 - DNA, 17 bp, Homo sapiens
agagaagccacgctgtc

SEQ ID NO: 464821 - DNA, 14 bp, Homo sapiens
agagacggcagccc

SEQ ID NO: 464822 - DNA, 16 bp, Homo sapiens
agagactgcccaccct

SEQ ID NO: 464823 - DNA, 19 bp, Homo sapiens
agagactgcccaccctggg

SEQ ID NO: 464824 - DNA, 22 bp, Homo sapiens
agagactgcccaccctgggcct

SEQ ID NO: 464825 - DNA, 20 bp, Homo sapiens
agagagcaaagatggcttcc

SEQ ID NO: 464826 - DNA, 18 bp, Homo sapiens
agagagtgaatacactgg

SEQ ID NO: 464827 - DNA, 20 bp, Homo sapiens
agagcaaagatggcttccgt

SEQ ID NO: 464828 - DNA, 14 bp, Homo sapiens
agagccacaataag

SEQ ID NO: 464829 - DNA, 12 bp, Homo sapiens
agagccctgagc

SEQ ID NO: 464830 - DNA, 16 bp, Homo sapiens
agagcctatggaaagg

SEQ ID NO: 464831 - DNA, 17 bp, Homo sapiens
agagcctatggaaaggg

SEQ ID NO: 464832 - DNA, 20 bp, Homo sapiens
agagcctatggaaagggtgt

SEQ ID NO: 464833 - DNA, 15 bp, Homo sapiens
agagcgccacccgcc

SEQ ID NO: 464834 - DNA, 16 bp, Homo sapiens
agagcgccacccgccc

SEQ ID NO: 464835 - DNA, 16 bp, Homo sapiens
agagctcaggagaagg

SEQ ID NO: 464836 - DNA, 18 bp, Homo sapiens
agagctcaggagaaggcc

SEQ ID NO: 464837 - DNA, 20 bp, Homo sapiens
agagctcagtacagggcagg

SEQ ID NO: 464838 - DNA, 18 bp, Homo sapiens
agagctgagtcggctggg

SEQ ID NO: 464839 - DNA, 14 bp, Homo sapiens
agagctgctccttt

SEQ ID NO: 464840 - DNA, 22 bp, Homo sapiens
agagcttcccctaacctgggtt

SEQ ID NO: 464841 - DNA, 18 bp, Homo sapiens
agaggaggtgtggagtgg

SEQ ID NO: 464842 - DNA, 20 bp, Homo sapiens
agaggaggtgtggagtggag

SEQ ID NO: 464843 - DNA, 11 bp, Homo sapiens
agaggcagggc

SEQ ID NO: 464844 - DNA, 12 bp, Homo sapiens
agaggcagggcc

SEQ ID NO: 464845 - DNA, 15 bp, Homo sapiens
agaggcagggccctg

SEQ ID NO: 464846 - DNA, 16 bp, Homo sapiens
agagggcactcccagg

SEQ ID NO: 464847 - DNA, 12 bp, Homo sapiens
agagggctgagc

SEQ ID NO: 464848 - DNA, 15 bp, Homo sapiens
agagggctgagcccc

SEQ ID NO: 464849 - DNA, 17 bp, Homo sapiens
agagggctgagcccctc

SEQ ID NO: 464850 - DNA, 14 bp, Homo sapiens
agaggggtgagaca

SEQ ID NO: 464851 - DNA, 21 bp, Homo sapiens
agaggggtgagacagtggggg

SEQ ID NO: 464852 - DNA, 12 bp, Homo sapiens
agaggtctccct

SEQ ID NO: 464853 - DNA, 14 bp, Homo sapiens
agaggtctccctat

SEQ ID NO: 464854 - DNA, 22 bp, Homo sapiens
agagtcgagtgatatggcttgt

SEQ ID NO: 464855 - DNA, 18 bp, Homo sapiens
agataaatccaactctga

SEQ ID NO: 464856 - DNA, 20 bp, Homo sapiens
agatccctcggtcagcaccg

SEQ ID NO: 464857 - DNA, 20 bp, Homo sapiens
agatcttgagcaaggcaaga

SEQ ID NO: 464858 - DNA, 23 bp, Homo sapiens
agatgacacataaatctgtctga

SEQ ID NO: 464859 - DNA, 20 bp, Homo sapiens
agatgactggaaacaaggaa

SEQ ID NO: 464860 - DNA, 22 bp, Homo sapiens
agatggcttccgtgagacacaa

SEQ ID NO: 464861 - DNA, 21 bp, Homo sapiens
agattaaaaccagagagaaag

SEQ ID NO: 464862 - DNA, 14 bp, Homo sapiens
agattattttctat

SEQ ID NO: 464863 - DNA, 21 bp, Homo sapiens
agattattttctatatttgga

SEQ ID NO: 464864 - DNA, 21 bp, Homo sapiens
agattccagagagtggctcct

SEQ ID NO: 464865 - DNA, 22 bp, Homo sapiens
agattccagagagtggctcctc

SEQ ID NO: 464866 - DNA, 12 bp, Homo sapiens
agattttgaatg

SEQ ID NO: 464867 - DNA, 21 bp, Homo sapiens
agcaaacagatgtttgttttc

SEQ ID NO: 464868 - DNA, 19 bp, Homo sapiens
agcaaactgaagcccacag

SEQ ID NO: 464869 - DNA, 18 bp, Homo sapiens
agcaaccctacagtatat

SEQ ID NO: 464870 - DNA, 21 bp, Homo sapiens
agcaaccctacagtatataag

SEQ ID NO: 464871 - DNA, 15 bp, Homo sapiens
agcaagaagattcta

SEQ ID NO: 464872 - DNA, 14 bp, Homo sapiens
agcaagtatattta

SEQ ID NO: 464873 - DNA, 14 bp, Homo sapiens
agcacccccagcct

SEQ ID NO: 464874 - DNA, 18 bp, Homo sapiens
aagactactggcctctgt

SEQ ID NO: 464875 - DNA, 19 bp, Homo sapiens
aagactgtcttaatttgca

SEQ ID NO: 464876 - DNA, 18 bp, Homo sapiens
aagagaaacactaatggc

SEQ ID NO: 464877 - DNA, 13 bp, Homo sapiens
aagagatgctcta

SEQ ID NO: 464878 - DNA, 17 bp, Homo sapiens
aagagctcaggagaagg

SEQ ID NO: 464879 - DNA, 18 bp, Homo sapiens
aagaggatatcccttcct

SEQ ID NO: 464880 - DNA, 15 bp, Homo sapiens
aagatagcagaagag

SEQ ID NO: 464881 - DNA, 15 bp, Homo sapiens
aagatagtttattat

SEQ ID NO: 464882 - DNA, 16 bp, Homo sapiens
aagatcccaagtcaaa

SEQ ID NO: 464883 - DNA, 11 bp, Homo sapiens
aagatgccaag

SEQ ID NO: 464884 - DNA, 12 bp, Homo sapiens
aagattccatgg

SEQ ID NO: 464885 - DNA, 22 bp, Homo sapiens
aagccacgctgtcctctcgagc

SEQ ID NO: 464886 - DNA, 19 bp, Homo sapiens
aagccacgttgcagaaaaa

SEQ ID NO: 464887 - DNA, 11 bp, Homo sapiens
aagccaggaga

SEQ ID NO: 464888 - DNA, 12 bp, Homo sapiens
aagccaggagac

SEQ ID NO: 464889 - DNA, 14 bp, Homo sapiens
aagccaggagaccc

SEQ ID NO: 464890 - DNA, 19 bp, Homo sapiens
aagccaggagaccctgtct

SEQ ID NO: 464891 - DNA, 18 bp, Homo sapiens
aagccagggttccagaca

SEQ ID NO: 464892 - DNA, 21 bp, Homo sapiens
aagccatatgacaatttcaaa

SEQ ID NO: 464893 - DNA, 23 bp, Homo sapiens
aagccatatgacaatttcaaaat

SEQ ID NO: 464894 - DNA, 10 bp, Homo sapiens
aagcccaccc

SEQ ID NO: 464895 - DNA, 12 bp, Homo sapiens
aagcccaggagg

SEQ ID NO: 464896 - DNA, 23 bp, Homo sapiens
aagcctgtgaataaaaaccctgt

SEQ ID NO: 464897 - DNA, 15 bp, Homo sapiens
aagctatatatgaat

SEQ ID NO: 464898 - DNA, 12 bp, Homo sapiens
aagcttccagta

SEQ ID NO: 464899 - DNA, 23 bp, Homo sapiens
aaggaaagttctattatctgggt

SEQ ID NO: 464900 - DNA, 13 bp, Homo sapiens
aaggacactgatg

SEQ ID NO: 464901 - DNA, 20 bp, Homo sapiens
aaggacactgatgggtcctg

SEQ ID NO: 464902 - DNA, 18 bp, Homo sapiens
aaggacccggaggggcct

SEQ ID NO: 464903 - DNA, 16 bp, Homo sapiens
aaggacttctgcagct

SEQ ID NO: 464904 - DNA, 17 bp, Homo sapiens
aaggattcttttttcaa

SEQ ID NO: 464905 - DNA, 20 bp, Homo sapiens
aaggattcttttttcaatgt

SEQ ID NO: 464906 - DNA, 13 bp, Homo sapiens
aaggcagcaggcg

SEQ ID NO: 464907 - DNA, 22 bp, Homo sapiens
aaggcctgagggaagcccaccc

SEQ ID NO: 464908 - DNA, 19 bp, Homo sapiens
aaggcctgccccccttccc

SEQ ID NO: 464909 - DNA, 19 bp, Homo sapiens
aaggctgcccctgtaaggt

SEQ ID NO: 464910 - DNA, 17 bp, Homo sapiens
aagggaaatcaatttaa

SEQ ID NO: 464911 - DNA, 16 bp, Homo sapiens
aagggagtaggctgta

SEQ ID NO: 464912 - DNA, 18 bp, Homo sapiens
aagggcagcccctcccca

SEQ ID NO: 464913 - DNA, 16 bp, Homo sapiens
aaggggatctaaaagg

SEQ ID NO: 464914 - DNA, 14 bp, Homo sapiens
aaggtggcatagcc

SEQ ID NO: 464915 - DNA, 14 bp, Homo sapiens
aaggttaagccata

SEQ ID NO: 464916 - DNA, 14 bp, Homo sapiens
aagtcactgcacag

SEQ ID NO: 464917 - DNA, 11 bp, Homo sapiens
aagtctatgct

SEQ ID NO: 464918 - DNA, 18 bp, Homo sapiens
aagtctccccgcagccct

SEQ ID NO: 464919 - DNA, 19 bp, Homo sapiens
aagttcattcatactcaaa

SEQ ID NO: 464920 - DNA, 22 bp, Homo sapiens
aagttcattcatactcaaagag

SEQ ID NO: 464921 - DNA, 14 bp, Homo sapiens
aagttctattatct

SEQ ID NO: 464922 - DNA, 18 bp, Homo sapiens
aagttctattatctgggt

SEQ ID NO: 464923 - DNA, 15 bp, Homo sapiens
aagttgaagggaaat

SEQ ID NO: 464924 - DNA, 13 bp, Homo sapiens
aagttgaccttta

SEQ ID NO: 464925 - DNA, 20 bp, Homo sapiens
aagttgacctttatttatta

SEQ ID NO: 464926 - DNA, 13 bp, Homo sapiens
acggggcagagct

SEQ ID NO: 464927 - DNA, 19 bp, Homo sapiens
acgtaatttgttatatcag

SEQ ID NO: 464928 - DNA, 23 bp, Homo sapiens
acgtaatttgttatatcagcaga

SEQ ID NO: 464929 - DNA, 21 bp, Homo sapiens
acgttgcagaaaaagagcttc

SEQ ID NO: 464930 - DNA, 17 bp, Homo sapiens
actaaaattcaacaaat

SEQ ID NO: 464931 - DNA, 20 bp, Homo sapiens
actaaaattcaacaaatgat

SEQ ID NO: 464932 - DNA, 20 bp, Homo sapiens
actaacaactgggaaataag

SEQ ID NO: 464933 - DNA, 21 bp, Homo sapiens
actaatgaatgcaaaaagata

SEQ ID NO: 464934 - DNA, 18 bp, Homo sapiens
actacagagtgttataac

SEQ ID NO: 464935 - DNA, 19 bp, Homo sapiens
actacaggtattttcatca

SEQ ID NO: 464936 - DNA, 16 bp, Homo sapiens
actagaatgagaaatc

SEQ ID NO: 464937 - DNA, 15 bp, Homo sapiens
actagccctctttct

SEQ ID NO: 464938 - DNA, 22 bp, Homo sapiens
actagccctctttctctctgtg

SEQ ID NO: 464939 - DNA, 23 bp, Homo sapiens
actagccctctttctctctgtgt

SEQ ID NO: 464940 - DNA, 19 bp, Homo sapiens
actaggtgcccagtcttga

SEQ ID NO: 464941 - DNA, 14 bp, Homo sapiens
actagtagctgttt

SEQ ID NO: 464942 - DNA, 21 bp, Homo sapiens
actatggtatgctggccagca

SEQ ID NO: 464943 - DNA, 13 bp, Homo sapiens
actatttcaccat

SEQ ID NO: 464944 - DNA, 18 bp, Homo sapiens
actatttgaaaaaagaag

SEQ ID NO: 464945 - DNA, 19 bp, Homo sapiens
actcaaagaggccagtact

SEQ ID NO: 464946 - DNA, 12 bp, Homo sapiens
actcaaggaatg

SEQ ID NO: 464947 - DNA, 22 bp, Homo sapiens
actcaatgtggaaaaaatattt

SEQ ID NO: 464948 - DNA, 15 bp, Homo sapiens
actcacaaaaggctg

SEQ ID NO: 464949 - DNA, 15 bp, Homo sapiens
actcaccaaaatata

SEQ ID NO: 464950 - DNA, 13 bp, Homo sapiens
actcagaagagtc

SEQ ID NO: 464951 - DNA, 19 bp, Homo sapiens
actcagtaggtctgaaggc

SEQ ID NO: 464952 - DNA, 22 bp, Homo sapiens
actcagttaaaatgtctgtttc

SEQ ID NO: 464953 - DNA, 20 bp, Homo sapiens
actcatctgttatcctgcta

SEQ ID NO: 464954 - DNA, 15 bp, Homo sapiens
actccactcccctca

SEQ ID NO: 464955 - DNA, 18 bp, Homo sapiens
actccagacccctggctt

SEQ ID NO: 464956 - DNA, 19 bp, Homo sapiens
actccagggttaaagaaag

SEQ ID NO: 464957 - DNA, 22 bp, Homo sapiens
actccagtttgcccaccacaac

SEQ ID NO: 464958 - DNA, 11 bp, Homo sapiens
actcccagggc

SEQ ID NO: 464959 - DNA, 16 bp, Homo sapiens
actcccagggcccgag

SEQ ID NO: 464960 - DNA, 17 bp, Homo sapiens
actcccagggcccgagc

SEQ ID NO: 464961 - DNA, 19 bp, Homo sapiens
actcccagggcccgagcgc

SEQ ID NO: 464962 - DNA, 23 bp, Homo sapiens
actccccgcccgccctcctctgc

SEQ ID NO: 464963 - DNA, 19 bp, Homo sapiens
actccctccctttctcttt

SEQ ID NO: 464964 - DNA, 14 bp, Homo sapiens
actcctacctggta

SEQ ID NO: 464965 - DNA, 21 bp, Homo sapiens
actcctcagacgggctgagag

SEQ ID NO: 464966 - DNA, 19 bp, Homo sapiens
actcctcccaactctggcc

SEQ ID NO: 464967 - DNA, 17 bp, Homo sapiens
actcgactctgctgctc

SEQ ID NO: 464968 - DNA, 21 bp, Homo sapiens
actctacttagcatgtcccta

SEQ ID NO: 464969 - DNA, 19 bp, Homo sapiens
actctctcctctctctccc

SEQ ID NO: 464970 - DNA, 20 bp, Homo sapiens
actctcttcttactgtattt

SEQ ID NO: 464971 - DNA, 18 bp, Homo sapiens
actctgaagtcccttcct

SEQ ID NO: 464972 - DNA, 23 bp, Homo sapiens
actctgaagtcccttcctgtcct

SEQ ID NO: 464973 - DNA, 13 bp, Homo sapiens
actctgagctgct

SEQ ID NO: 464974 - DNA, 21 bp, Homo sapiens
actctgagctgctaggaacct

SEQ ID NO: 464975 - DNA, 19 bp, Homo sapiens
actctgaggtctcaccttc

SEQ ID NO: 464976 - DNA, 22 bp, Homo sapiens
actctggccttggttcctccag

SEQ ID NO: 464977 - DNA, 17 bp, Homo sapiens
actctgtcagccagccg

SEQ ID NO: 464978 - DNA, 20 bp, Homo sapiens
actctgtgtaatctctgatt

SEQ ID NO: 464979 - DNA, 21 bp, Homo sapiens
actctgtgtaatctctgatta

SEQ ID NO: 464980 - DNA, 19 bp, Homo sapiens
actcttcttgattaaaagt

SEQ ID NO: 464981 - DNA, 20 bp, Homo sapiens
actcttcttgattaaaagtt

SEQ ID NO: 464982 - DNA, 20 bp, Homo sapiens
actcttgtctcctcctccag

SEQ ID NO: 464983 - DNA, 14 bp, Homo sapiens
atccaactggaagg

SEQ ID NO: 464984 - DNA, 17 bp, Homo sapiens
atccaactggaaggctt

SEQ ID NO: 464985 - DNA, 16 bp, Homo sapiens
atccatacaaaactat

SEQ ID NO: 464986 - DNA, 21 bp, Homo sapiens
atccattttctaaactgtttt

SEQ ID NO: 464987 - DNA, 18 bp, Homo sapiens
atcccaagtcaaacagtg

SEQ ID NO: 464988 - DNA, 20 bp, Homo sapiens
atcccaagtcaaacagtgtg

SEQ ID NO: 464989 - DNA, 22 bp, Homo sapiens
atcccagtttaatattccaata

SEQ ID NO: 464990 - DNA, 22 bp, Homo sapiens
atccccaccctcccctctcctg

SEQ ID NO: 464991 - DNA, 15 bp, Homo sapiens
atcccctcctagcac

SEQ ID NO: 464992 - DNA, 21 bp, Homo sapiens
atccctcggtcagcaccgtgg

SEQ ID NO: 464993 - DNA, 14 bp, Homo sapiens
atcccttggcccct

SEQ ID NO: 464994 - DNA, 24 bp, Homo sapiens
atcctctgcttgtcattctgctaa

SEQ ID NO: 464995 - DNA, 20 bp, Homo sapiens
atcctgaggaccgccccaac

SEQ ID NO: 464996 - DNA, 19 bp, Homo sapiens
atcctgataaacattaaac

SEQ ID NO: 464997 - DNA, 14 bp, Homo sapiens
atcctgcaccctct

SEQ ID NO: 464998 - DNA, 15 bp, Homo sapiens
atcctgcaccctctg

SEQ ID NO: 464999 - DNA, 11 bp, Homo sapiens
atcctgcactc

SEQ ID NO: 465000 - DNA, 16 bp, Homo sapiens
atcctggtgtctagtt

SEQ ID NO: 465001 - DNA, 16 bp, Homo sapiens
atccttccatcctgag

SEQ ID NO: 465002 - DNA, 22 bp, Homo sapiens
atccttcccaacgtactcctca

SEQ ID NO: 465003 - DNA, 14 bp, Homo sapiens
atccttcccgcagc

SEQ ID NO: 465004 - DNA, 17 bp, Homo sapiens
atccttcccgcagcacc

SEQ ID NO: 465005 - DNA, 19 bp, Homo sapiens
atccttcccgcagcaccag

SEQ ID NO: 465006 - DNA, 21 bp, Homo sapiens
atccttcccgcagcaccagcc

SEQ ID NO: 465007 - DNA, 17 bp, Homo sapiens
atcgatgttaaacgtca

SEQ ID NO: 465008 - DNA, 20 bp, Homo sapiens
atcgatgttaaacgtcacag

SEQ ID NO: 465009 - DNA, 23 bp, Homo sapiens
atctaaaatactcaccaaaatat

SEQ ID NO: 465010 - DNA, 22 bp, Homo sapiens
atctagcaagaagattctaaaa

SEQ ID NO: 465011 - DNA, 17 bp, Homo sapiens
atctcaaacactgctta

SEQ ID NO: 465012 - DNA, 16 bp, Homo sapiens
atctcacaaataagta

SEQ ID NO: 465013 - DNA, 11 bp, Homo sapiens
atctcagccca

SEQ ID NO: 465014 - DNA, 18 bp, Homo sapiens
atctccagccaatttcaa

SEQ ID NO: 465015 - DNA, 21 bp, Homo sapiens
atctccagccaatttcaaaga

SEQ ID NO: 465016 - DNA, 15 bp, Homo sapiens
atctctaaaattcta

SEQ ID NO: 465017 - DNA, 19 bp, Homo sapiens
atctctaaaattctagtct

SEQ ID NO: 465018 - DNA, 13 bp, Homo sapiens
atctctctggggc

SEQ ID NO: 465019 - DNA, 20 bp, Homo sapiens
atctctgattaaatttaata

SEQ ID NO: 465020 - DNA, 12 bp, Homo sapiens
atctgaaatcta

SEQ ID NO: 465021 - DNA, 14 bp, Homo sapiens
atctgaaatctaca

SEQ ID NO: 465022 - DNA, 18 bp, Homo sapiens
atctgaaatctacaacat

SEQ ID NO: 465023 - DNA, 19 bp, Homo sapiens
atctgattggacattttct

SEQ ID NO: 465024 - DNA, 13 bp, Homo sapiens
atctgcaaatagt

SEQ ID NO: 465025 - DNA, 15 bp, Homo sapiens
atctgcaaatagttt

SEQ ID NO: 465026 - DNA, 22 bp, Homo sapiens
atctggagtctgaaggagagga

SEQ ID NO: 465027 - DNA, 14 bp, Homo sapiens
atctggcttctgca

SEQ ID NO: 465028 - DNA, 16 bp, Homo sapiens
atctgggttttagaaa

SEQ ID NO: 465029 - DNA, 17 bp, Homo sapiens
atctggtgcgtgtggcc

SEQ ID NO: 465030 - DNA, 18 bp, Homo sapiens
atctggtgcgtgtggccc

SEQ ID NO: 465031 - DNA, 21 bp, Homo sapiens
atctgtctgagccctgccctc

SEQ ID NO: 465032 - DNA, 12 bp, Homo sapiens
atctgtctgatt

SEQ ID NO: 465033 - DNA, 19 bp, Homo sapiens
atctgtgaatcctttgtac

SEQ ID NO: 465034 - DNA, 19 bp, Homo sapiens
atcttcaactaatttttga

SEQ ID NO: 465035 - DNA, 23 bp, Homo sapiens
atcttcccccttcccgccttcag

SEQ ID NO: 465036 - DNA, 14 bp, Homo sapiens
atcttgagcaaggc

SEQ ID NO: 465037 - DNA, 21 bp, Homo sapiens
atctttgtgacaggaaagccc

SEQ ID NO: 465038 - DNA, 17 bp, Homo sapiens
atgaataaagacaccta

SEQ ID NO: 465039 - DNA, 16 bp, Homo sapiens
atgaataattatgttt

SEQ ID NO: 465040 - DNA, 21 bp, Homo sapiens
atgaataattatgtttacctc

SEQ ID NO: 465041 - DNA, 15 bp, Homo sapiens
atgacaatttcaaaa

SEQ ID NO: 465042 - DNA, 16 bp, Homo sapiens
atgacaatttcaaaat

SEQ ID NO: 465043 - DNA, 20 bp, Homo sapiens
atgacaatttcaaaatgcat

SEQ ID NO: 465044 - DNA, 16 bp, Homo sapiens
atgacacataaatctg

SEQ ID NO: 465045 - DNA, 14 bp, Homo sapiens
atgacctaaatcca

SEQ ID NO: 465046 - DNA, 12 bp, Homo sapiens
atgagaaatcat

SEQ ID NO: 465047 - DNA, 14 bp, Homo sapiens
atgagaaatcatgt

SEQ ID NO: 465048 - DNA, 15 bp, Homo sapiens
atgagaaatcatgtt

SEQ ID NO: 465049 - DNA, 18 bp, Homo sapiens
atgagaaattgtgccaaa

SEQ ID NO: 465050 - DNA, 16 bp, Homo sapiens
atgagcagttagaaat

SEQ ID NO: 465051 - DNA, 17 bp, Homo sapiens
atgaggctattaaaaga

SEQ ID NO: 465052 - DNA, 15 bp, Homo sapiens
atgaggggactgcat

SEQ ID NO: 465053 - DNA, 15 bp, Homo sapiens
atgagtaaataaact

SEQ ID NO: 465054 - DNA, 18 bp, Homo sapiens
atgagtaaataaactctt

SEQ ID NO: 465055 - DNA, 16 bp, Homo sapiens
atgagttcaaatactt

SEQ ID NO: 465056 - DNA, 19 bp, Homo sapiens
atgagttcaaatacttttg

SEQ ID NO: 465057 - DNA, 20 bp, Homo sapiens
atgagtttaaaaaaataaca

SEQ ID NO: 465058 - DNA, 19 bp, Homo sapiens
atgatagcgtgcagtagag

SEQ ID NO: 465059 - DNA, 14 bp, Homo sapiens
atgatatgcatgta

SEQ ID NO: 465060 - DNA, 16 bp, Homo sapiens
atgattcaatgtgaat

SEQ ID NO: 465061 - DNA, 17 bp, Homo sapiens
atgattctcctctccca

SEQ ID NO: 465062 - DNA, 14 bp, Homo sapiens
atgattgaaaagaa

SEQ ID NO: 465063 - DNA, 23 bp, Homo sapiens
agactgcccaccctgggcctccc

SEQ ID NO: 465064 - DNA, 14 bp, Homo sapiens
agactgtctcaaga

SEQ ID NO: 465065 - DNA, 17 bp, Homo sapiens
agagaaaatgctttctc

SEQ ID NO: 465066 - DNA, 14 bp, Homo sapiens
agagaagcacccca

SEQ ID NO: 465067 - DNA, 15 bp, Homo sapiens
agagaagccacgctg

SEQ ID NO: 465068 - DNA, 14 bp, Homo sapiens
agagaaggcagcag

SEQ ID NO: 465069 - DNA, 13 bp, Homo sapiens
agagacggcagcc

SEQ ID NO: 465070 - DNA, 16 bp, Homo sapiens
agagacggcagcccca

SEQ ID NO: 465071 - DNA, 20 bp, Homo sapiens
agagacggcagccccatcct

SEQ ID NO: 465072 - DNA, 12 bp, Homo sapiens
agagactgccca

SEQ ID NO: 465073 - DNA, 15 bp, Homo sapiens
agagactgcccaccc

SEQ ID NO: 465074 - DNA, 12 bp, Homo sapiens
agagaggacagt

SEQ ID NO: 465075 - DNA, 20 bp, Homo sapiens
agagagtgaatacactggaa

SEQ ID NO: 465076 - DNA, 14 bp, Homo sapiens
agagcattctgggg

SEQ ID NO: 465077 - DNA, 16 bp, Homo sapiens
agagccccggagcacc

SEQ ID NO: 465078 - DNA, 21 bp, Homo sapiens
agagcctatggaaagggtgtg

SEQ ID NO: 465079 - DNA, 19 bp, Homo sapiens
agagcctttggtgaataac

SEQ ID NO: 465080 - DNA, 18 bp, Homo sapiens
agagcgctcctctgcctt

SEQ ID NO: 465081 - DNA, 17 bp, Homo sapiens
agagctcaggagaaggc

SEQ ID NO: 465082 - DNA, 20 bp, Homo sapiens
agagctcaggagaaggcctg

SEQ ID NO: 465083 - DNA, 20 bp, Homo sapiens
agagctctctattctggaag

SEQ ID NO: 465084 - DNA, 14 bp, Homo sapiens
agagctctgcacgt

SEQ ID NO: 465085 - DNA, 20 bp, Homo sapiens
agagctggcaaactgtgaat

SEQ ID NO: 465086 - DNA, 13 bp, Homo sapiens
agaggaggtgtgg

SEQ ID NO: 465087 - DNA, 14 bp, Homo sapiens
agaggaggtgtgga

SEQ ID NO: 465088 - DNA, 17 bp, Homo sapiens
agaggaggtgtggagtg

SEQ ID NO: 465089 - DNA, 22 bp, Homo sapiens
agaggaggtgtggagtggaggg

SEQ ID NO: 465090 - DNA, 16 bp, Homo sapiens
agaggagtgcgctaga

SEQ ID NO: 465091 - DNA, 13 bp, Homo sapiens
agaggcagggccc

SEQ ID NO: 465092 - DNA, 16 bp, Homo sapiens
agaggcagggccctgg

SEQ ID NO: 465093 - DNA, 16 bp, Homo sapiens
agaggcggcctcgtgc

SEQ ID NO: 465094 - DNA, 18 bp, Homo sapiens
agagggctgagcccctcc

SEQ ID NO: 465095 - DNA, 19 bp, Homo sapiens
agagggctgagcccctcct

SEQ ID NO: 465096 - DNA, 17 bp, Homo sapiens
agagtgaatacactgga

SEQ ID NO: 465097 - DNA, 12 bp, Homo sapiens
agagtggctcct

SEQ ID NO: 465098 - DNA, 13 bp, Homo sapiens
agagtggctcctc

SEQ ID NO: 465099 - DNA, 21 bp, Homo sapiens
agagttctccttgtacttgaa

SEQ ID NO: 465100 - DNA, 15 bp, Homo sapiens
agagttgcagtaaag

SEQ ID NO: 465101 - DNA, 18 bp, Homo sapiens
agataagtgctcagtatt

SEQ ID NO: 465102 - DNA, 19 bp, Homo sapiens
agatatcgagagtttctat

SEQ ID NO: 465103 - DNA, 20 bp, Homo sapiens
agatcagcattcaaaatagt

SEQ ID NO: 465104 - DNA, 24 bp, Homo sapiens
agatcagcattcaaaatagttcta

SEQ ID NO: 465105 - DNA, 19 bp, Homo sapiens
agatcattctccttgtaaa

SEQ ID NO: 465106 - DNA, 20 bp, Homo sapiens
agatcccaagtcaaacagtg

SEQ ID NO: 465107 - DNA, 16 bp, Homo sapiens
agatctggaatgtgaa

SEQ ID NO: 465108 - DNA, 21 bp, Homo sapiens
agatgacacataaatctgtct

SEQ ID NO: 465109 - DNA, 14 bp, Homo sapiens
agatgcaacctcac

SEQ ID NO: 465110 - DNA, 23 bp, Homo sapiens
agatgctgactgtactcctccca

SEQ ID NO: 465111 - DNA, 17 bp, Homo sapiens
agatgggtattaaactt

SEQ ID NO: 465112 - DNA, 21 bp, Homo sapiens
agatgttaattacttttgaaa

SEQ ID NO: 465113 - DNA, 14 bp, Homo sapiens
agatgtttgttttc

SEQ ID NO: 465114 - DNA, 18 bp, Homo sapiens
agatgtttgttttcaaaa

SEQ ID NO: 465115 - DNA, 23 bp, Homo sapiens
agatgtttgttttcaaaatactt

SEQ ID NO: 465116 - DNA, 19 bp, Homo sapiens
agattatatacaaagctgt

SEQ ID NO: 465117 - DNA, 19 bp, Homo sapiens
agattccagagagtggctc

SEQ ID NO: 465118 - DNA, 15 bp, Homo sapiens
agattctaaaacatt

SEQ ID NO: 465119 - DNA, 19 bp, Homo sapiens
agcaaccctacagtatata

SEQ ID NO: 465120 - DNA, 15 bp, Homo sapiens
agcaactgttagctg

SEQ ID NO: 465121 - DNA, 19 bp, Homo sapiens
agcaactgttagctgggaa

SEQ ID NO: 465122 - DNA, 18 bp, Homo sapiens
agcaagaagattctaaaa

SEQ ID NO: 465123 - DNA, 18 bp, Homo sapiens
agcaaggcaagaagtggg

SEQ ID NO: 465124 - DNA, 20 bp, Homo sapiens
agcaaggcaagaagtgggat

SEQ ID NO: 465125 - DNA, 21 bp, Homo sapiens
agcaaggtttaaatttgttat

SEQ ID NO: 465126 - DNA, 18 bp, Homo sapiens
agcaatatgttagcaaga

SEQ ID NO: 465127 - DNA, 17 bp, Homo sapiens
agcaattttcataataa

SEQ ID NO: 465128 - DNA, 17 bp, Homo sapiens
agcaccagcctgagcca

SEQ ID NO: 465129 - DNA, 13 bp, Homo sapiens
agcaccctccccc

SEQ ID NO: 465130 - DNA, 16 bp, Homo sapiens
agcaccctctcctggg

SEQ ID NO: 465131 - DNA, 20 bp, Homo sapiens
agcaccgtggtgtgaggccc

SEQ ID NO: 465132 - DNA, 12 bp, Homo sapiens
agcactcccagg

SEQ ID NO: 465133 - DNA, 14 bp, Homo sapiens
agcactcccagggc

SEQ ID NO: 465134 - DNA, 19 bp, Homo sapiens
agcactcccagggcccgag

SEQ ID NO: 465135 - DNA, 22 bp, Homo sapiens
agcagacactccagtttgccca

SEQ ID NO: 465136 - DNA, 16 bp, Homo sapiens
agcagagacggcagcc

SEQ ID NO: 465137 - DNA, 21 bp, Homo sapiens
agcagagacggcagccccatc

SEQ ID NO: 465138 - DNA, 16 bp, Homo sapiens
agcagagatgtattat

SEQ ID NO: 465139 - DNA, 17 bp, Homo sapiens
agcaggaaagatcccaa

SEQ ID NO: 465140 - DNA, 16 bp, Homo sapiens
agcagtaccatcccac

SEQ ID NO: 465141 - DNA, 11 bp, Homo sapiens
agcagtgctgg

SEQ ID NO: 465142 - DNA, 15 bp, Homo sapiens
agcagtgctgggccc

SEQ ID NO: 465143 - DNA, 17 bp, Homo sapiens
agcagtgctgggcccag

SEQ ID NO: 465144 - DNA, 15 bp, Homo sapiens
agcatagttctgcaa

SEQ ID NO: 465145 - DNA, 21 bp, Homo sapiens
agcatagttctgcaataacag

SEQ ID NO: 465146 - DNA, 22 bp, Homo sapiens
agcatagttctgcaataacagt

SEQ ID NO: 465147 - DNA, 17 bp, Homo sapiens
agcatgtctactgcttg

SEQ ID NO: 465148 - DNA, 18 bp, Homo sapiens
agcattctcactcctacc

SEQ ID NO: 465149 - DNA, 13 bp, Homo sapiens
agcattctggggt

SEQ ID NO: 465150 - DNA, 21 bp, Homo sapiens
agccaacttaaacctgtgctt

SEQ ID NO: 465151 - DNA, 23 bp, Homo sapiens
agccaacttaaacctgtgctttc

SEQ ID NO: 465152 - DNA, 16 bp, Homo sapiens
ataggaaataaatcta

SEQ ID NO: 465153 - DNA, 16 bp, Homo sapiens
ataggagcttccagat

SEQ ID NO: 465154 - DNA, 13 bp, Homo sapiens
ataggaggacaga

SEQ ID NO: 465155 - DNA, 13 bp, Homo sapiens
ataggagttctcc

SEQ ID NO: 465156 - DNA, 18 bp, Homo sapiens
ataggagttctcctggag

SEQ ID NO: 465157 - DNA, 17 bp, Homo sapiens
atagggtttggaagaaa

SEQ ID NO: 465158 - DNA, 23 bp, Homo sapiens
atagtaaataatgattcaatgtg

SEQ ID NO: 465159 - DNA, 23 bp, Homo sapiens
atagtcatgtttctgcagtattc

SEQ ID NO: 465160 - DNA, 14 bp, Homo sapiens
atagtctgtacttc

SEQ ID NO: 465161 - DNA, 20 bp, Homo sapiens
atagtgtgctcggacacagt

SEQ ID NO: 465162 - DNA, 21 bp, Homo sapiens
atagttaattgtggctttatg

SEQ ID NO: 465163 - DNA, 19 bp, Homo sapiens
atagttccattctatgact

SEQ ID NO: 465164 - DNA, 15 bp, Homo sapiens
atagttctatttcta

SEQ ID NO: 465165 - DNA, 22 bp, Homo sapiens
atagtttattatagtctgtact

SEQ ID NO: 465166 - DNA, 17 bp, Homo sapiens
atagttttataaaactc

SEQ ID NO: 465167 - DNA, 14 bp, Homo sapiens
atataaatgtttat

SEQ ID NO: 465168 - DNA, 17 bp, Homo sapiens
atataaattattacttt

SEQ ID NO: 465169 - DNA, 12 bp, Homo sapiens
atataagctttt

SEQ ID NO: 465170 - DNA, 20 bp, Homo sapiens
atataatttgccagacagag

SEQ ID NO: 465171 - DNA, 23 bp, Homo sapiens
atataatttgccagacagagatc

SEQ ID NO: 465172 - DNA, 16 bp, Homo sapiens
atatacagacctccag

SEQ ID NO: 465173 - DNA, 18 bp, Homo sapiens
atatacagacctccagat

SEQ ID NO: 465174 - DNA, 17 bp, Homo sapiens
atatagttgaacaagat

SEQ ID NO: 465175 - DNA, 15 bp, Homo sapiens
atatataaatatcta

SEQ ID NO: 465176 - DNA, 13 bp, Homo sapiens
atatatatgtata

SEQ ID NO: 465177 - DNA, 15 bp, Homo sapiens
atatatttattattt

SEQ ID NO: 465178 - DNA, 22 bp, Homo sapiens
atatatttattattttcatata

SEQ ID NO: 465179 - DNA, 20 bp, Homo sapiens
atatcagctctgcataagat

SEQ ID NO: 465180 - DNA, 23 bp, Homo sapiens
atatctatttatctgtctgagcc

SEQ ID NO: 465181 - DNA, 23 bp, Homo sapiens
atatctgtaaatttaactgcata

SEQ ID NO: 465182 - DNA, 13 bp, Homo sapiens
atatctttcagtt

SEQ ID NO: 465183 - DNA, 17 bp, Homo sapiens
atatgaaagagaaaatg

SEQ ID NO: 465184 - DNA, 19 bp, Homo sapiens
atatgaatgcttgtaatag

SEQ ID NO: 465185 - DNA, 21 bp, Homo sapiens
atatgaggggactgcatgcaa

SEQ ID NO: 465186 - DNA, 12 bp, Homo sapiens
atatgatatgca

SEQ ID NO: 465187 - DNA, 17 bp, Homo sapiens
atatgattctcctctcc

SEQ ID NO: 465188 - DNA, 13 bp, Homo sapiens
atatggaaccttc

SEQ ID NO: 465189 - DNA, 15 bp, Homo sapiens
atatgtttaaaagta

SEQ ID NO: 465190 - DNA, 17 bp, Homo sapiens
atattctgtcattggtt

SEQ ID NO: 465191 - DNA, 14 bp, Homo sapiens
atatttatttctag

SEQ ID NO: 465192 - DNA, 19 bp, Homo sapiens
atatttcacttaaactttg

SEQ ID NO: 465193 - DNA, 18 bp, Homo sapiens
atatttctaagcttattt

SEQ ID NO: 465194 - DNA, 21 bp, Homo sapiens
atatttctaagcttatttcta

SEQ ID NO: 465195 - DNA, 18 bp, Homo sapiens
atatttgtagctagaata

SEQ ID NO: 465196 - DNA, 14 bp, Homo sapiens
atatttttttctag

SEQ ID NO: 465197 - DNA, 22 bp, Homo sapiens
atcaaataatcacaaaatcaca

SEQ ID NO: 465198 - DNA, 15 bp, Homo sapiens
atcaatctggcttct

SEQ ID NO: 465199 - DNA, 19 bp, Homo sapiens
atcaatctggcttctgcat

SEQ ID NO: 465200 - DNA, 20 bp, Homo sapiens
atcacagatgggtattaaac

SEQ ID NO: 465201 - DNA, 22 bp, Homo sapiens
atcacagatgggtattaaactt

SEQ ID NO: 465202 - DNA, 15 bp, Homo sapiens
atcacgggcccgctc

SEQ ID NO: 465203 - DNA, 16 bp, Homo sapiens
atcacgggcccgctca

SEQ ID NO: 465204 - DNA, 20 bp, Homo sapiens
atcacgggcccgctcaacct

SEQ ID NO: 465205 - DNA, 14 bp, Homo sapiens
atcagaaagttggc

SEQ ID NO: 465206 - DNA, 16 bp, Homo sapiens
atcagaactcctttct

SEQ ID NO: 465207 - DNA, 16 bp, Homo sapiens
atcagattagaccagt

SEQ ID NO: 465208 - DNA, 17 bp, Homo sapiens
atcagcagacactccag

SEQ ID NO: 465209 - DNA, 20 bp, Homo sapiens
atcagggcccaaataacagt

SEQ ID NO: 465210 - DNA, 23 bp, Homo sapiens
atcatacttgctccttgaataag

SEQ ID NO: 465211 - DNA, 21 bp, Homo sapiens
atcatttatcttatctagcaa

SEQ ID NO: 465212 - DNA, 14 bp, Homo sapiens
atcattttgggaaa

SEQ ID NO: 465213 - DNA, 22 bp, Homo sapiens
atcattttgggaaattcttgca

SEQ ID NO: 465214 - DNA, 17 bp, Homo sapiens
atccaaaatagtcatgt

SEQ ID NO: 465215 - DNA, 18 bp, Homo sapiens
atccaaaatagtcatgtt

SEQ ID NO: 465216 - DNA, 13 bp, Homo sapiens
atccaactccagg

SEQ ID NO: 465217 - DNA, 16 bp, Homo sapiens
atccacatgaaaataa

SEQ ID NO: 465218 - DNA, 22 bp, Homo sapiens
atccaccgccaccccactgaga

SEQ ID NO: 465219 - DNA, 23 bp, Homo sapiens
atccactaggtgcccagtcttga

SEQ ID NO: 465220 - DNA, 20 bp, Homo sapiens
atccagtttgttctccgggt

SEQ ID NO: 465221 - DNA, 15 bp, Homo sapiens
atccatagacacagt

SEQ ID NO: 465222 - DNA, 15 bp, Homo sapiens
atccatatcagctct

SEQ ID NO: 465223 - DNA, 14 bp, Homo sapiens
atccattttctaaa

SEQ ID NO: 465224 - DNA, 21 bp, Homo sapiens
atcccactgatatcacgggcc

SEQ ID NO: 465225 - DNA, 23 bp, Homo sapiens
atcccagtttaatattccaatac

SEQ ID NO: 465226 - DNA, 18 bp, Homo sapiens
atccctcggtcagcaccg

SEQ ID NO: 465227 - DNA, 13 bp, Homo sapiens
atccctgggcccc

SEQ ID NO: 465228 - DNA, 13 bp, Homo sapiens
atcccttggcccc

SEQ ID NO: 465229 - DNA, 15 bp, Homo sapiens
atcccttggcccctc

SEQ ID NO: 465230 - DNA, 18 bp, Homo sapiens
atcccttggcccctctct

SEQ ID NO: 465231 - DNA, 19 bp, Homo sapiens
atcccttggcccctctctg

SEQ ID NO: 465232 - DNA, 14 bp, Homo sapiens
atcctatactggtt

SEQ ID NO: 465233 - DNA, 18 bp, Homo sapiens
atcctgattattgaatgt

SEQ ID NO: 465234 - DNA, 18 bp, Homo sapiens
atcctgctagctgtagaa

SEQ ID NO: 465235 - DNA, 15 bp, Homo sapiens
atccttcccgcagca

SEQ ID NO: 465236 - DNA, 18 bp, Homo sapiens
atccttcccgcagcacca

SEQ ID NO: 465237 - DNA, 18 bp, Homo sapiens
atccttttatctcacaaa

SEQ ID NO: 465238 - DNA, 20 bp, Homo sapiens
atccttttttattgaataac

SEQ ID NO: 465239 - DNA, 18 bp, Homo sapiens
atcgatccccagcctggt

SEQ ID NO: 465240 - DNA, 21 bp, Homo sapiens
atcgatgttaaacgtcacagc

SEQ ID NO: 465241 - DNA, 21 bp, Homo sapiens
atcggaggctgggcccctggg

SEQ ID NO: 465242 - DNA, 22 bp, Homo sapiens
atcggaggctgggcccctggga

SEQ ID NO: 465243 - DNA, 16 bp, Homo sapiens
atcgtttcacatctgt

SEQ ID NO: 465244 - DNA, 15 bp, Homo sapiens
agccaggccaactgc

SEQ ID NO: 465245 - DNA, 15 bp, Homo sapiens
agccagggttccaga

SEQ ID NO: 465246 - DNA, 19 bp, Homo sapiens
agccagggttccagacagg

SEQ ID NO: 465247 - DNA, 16 bp, Homo sapiens
agcccacccgccccag

SEQ ID NO: 465248 - DNA, 19 bp, Homo sapiens
agcccacccgccccagaga

SEQ ID NO: 465249 - DNA, 21 bp, Homo sapiens
agcccagaacgggcctccccg

SEQ ID NO: 465250 - DNA, 13 bp, Homo sapiens
agccccccactca

SEQ ID NO: 465251 - DNA, 23 bp, Homo sapiens
agcccctatcctgcaccctctgc

SEQ ID NO: 465252 - DNA, 22 bp, Homo sapiens
agcccctccccatggtgcagtg

SEQ ID NO: 465253 - DNA, 17 bp, Homo sapiens
agcccctcctctcctcg

SEQ ID NO: 465254 - DNA, 12 bp, Homo sapiens
agcccctgctgg

SEQ ID NO: 465255 - DNA, 19 bp, Homo sapiens
agcccggccaaggacactg

SEQ ID NO: 465256 - DNA, 20 bp, Homo sapiens
agcccggccaaggacactga

SEQ ID NO: 465257 - DNA, 20 bp, Homo sapiens
agccctcccccttccccttc

SEQ ID NO: 465258 - DNA, 12 bp, Homo sapiens
agccctccctgc

SEQ ID NO: 465259 - DNA, 19 bp, Homo sapiens
agccctctccacccagagg

SEQ ID NO: 465260 - DNA, 16 bp, Homo sapiens
agccctctttctctct

SEQ ID NO: 465261 - DNA, 24 bp, Homo sapiens
agccctctttctctctgtgtggca

SEQ ID NO: 465262 - DNA, 20 bp, Homo sapiens
agccctgctttgggctgccc

SEQ ID NO: 465263 - DNA, 23 bp, Homo sapiens
agccctgctttgggctgccctgg

SEQ ID NO: 465264 - DNA, 13 bp, Homo sapiens
agccgccctgggc

SEQ ID NO: 465265 - DNA, 22 bp, Homo sapiens
agccgccctgggctgtctgtca

SEQ ID NO: 465266 - DNA, 24 bp, Homo sapiens
agccgccctgggctgtctgtcacc

SEQ ID NO: 465267 - DNA, 17 bp, Homo sapiens
agccgcgctctgcccct

SEQ ID NO: 465268 - DNA, 18 bp, Homo sapiens
agccgcgctctgcccctc

SEQ ID NO: 465269 - DNA, 19 bp, Homo sapiens
agccgcgctctgcccctcc

SEQ ID NO: 465270 - DNA, 20 bp, Homo sapiens
agccggggtggggtgcctga

SEQ ID NO: 465271 - DNA, 23 bp, Homo sapiens
agccggggtggggtgcctgagcc

SEQ ID NO: 465272 - DNA, 23 bp, Homo sapiens
agccgtggcttcccgctcagccc

SEQ ID NO: 465273 - DNA, 20 bp, Homo sapiens
agcctccaggcccccaactc

SEQ ID NO: 465274 - DNA, 21 bp, Homo sapiens
agcctccaggcccccaactcc

SEQ ID NO: 465275 - DNA, 11 bp, Homo sapiens
agcctccccca

SEQ ID NO: 465276 - DNA, 21 bp, Homo sapiens
agcctcccccaggctgcgcct

SEQ ID NO: 465277 - DNA, 15 bp, Homo sapiens
agcctccccctcaga

SEQ ID NO: 465278 - DNA, 18 bp, Homo sapiens
agcctcctaggctccctg

SEQ ID NO: 465279 - DNA, 22 bp, Homo sapiens
agcctcctaggctccctgaggt

SEQ ID NO: 465280 - DNA, 13 bp, Homo sapiens
agcctgagctcca

SEQ ID NO: 465281 - DNA, 20 bp, Homo sapiens
agcctggcacagggcagtgg

SEQ ID NO: 465282 - DNA, 22 bp, Homo sapiens
agcctgtgaataaaaaccctgt

SEQ ID NO: 465283 - DNA, 21 bp, Homo sapiens
agcctgttgaaggactacagg

SEQ ID NO: 465284 - DNA, 17 bp, Homo sapiens
agcctttgcgctctggg

SEQ ID NO: 465285 - DNA, 17 bp, Homo sapiens
agcgcctcccgccgcct

SEQ ID NO: 465286 - DNA, 15 bp, Homo sapiens
agcgctatccacaga

SEQ ID NO: 465287 - DNA, 14 bp, Homo sapiens
agcggcccggccca

SEQ ID NO: 465288 - DNA, 19 bp, Homo sapiens
agcgggggctaactggccc

SEQ ID NO: 465289 - DNA, 22 bp, Homo sapiens
agcgggggctaactggccccag

SEQ ID NO: 465290 - DNA, 18 bp, Homo sapiens
agctaaattacaattgtc

SEQ ID NO: 465291 - DNA, 21 bp, Homo sapiens
agctaatcagcattctcactc

SEQ ID NO: 465292 - DNA, 22 bp, Homo sapiens
agctaccaactaagttgtattt

SEQ ID NO: 465293 - DNA, 19 bp, Homo sapiens
agctataacaactctattt

SEQ ID NO: 465294 - DNA, 23 bp, Homo sapiens
agctatatatatatatatatgta

SEQ ID NO: 465295 - DNA, 16 bp, Homo sapiens
agctatatatgaataa

SEQ ID NO: 465296 - DNA, 21 bp, Homo sapiens
agctcaggagaaggcctgccc

SEQ ID NO: 465297 - DNA, 23 bp, Homo sapiens
agctcagggtgctccctcctcag

SEQ ID NO: 465298 - DNA, 17 bp, Homo sapiens
agctcagtacagggcag

SEQ ID NO: 465299 - DNA, 14 bp, Homo sapiens
agctccaccctccc

SEQ ID NO: 465300 - DNA, 15 bp, Homo sapiens
agctccaccctcccc

SEQ ID NO: 465301 - DNA, 19 bp, Homo sapiens
agctccactctgaagtccc

SEQ ID NO: 465302 - DNA, 14 bp, Homo sapiens
agctctgcataaga

SEQ ID NO: 465303 - DNA, 19 bp, Homo sapiens
agctctgcataagattata

SEQ ID NO: 465304 - DNA, 18 bp, Homo sapiens
agctgagtcggctgggca

SEQ ID NO: 465305 - DNA, 23 bp, Homo sapiens
agctgctaggaacctcatttgtc

SEQ ID NO: 465306 - DNA, 14 bp, Homo sapiens
agctgctctattgt

SEQ ID NO: 465307 - DNA, 23 bp, Homo sapiens
agctgctctccttcactctgaca

SEQ ID NO: 465308 - DNA, 12 bp, Homo sapiens
agctggcagcgc

SEQ ID NO: 465309 - DNA, 13 bp, Homo sapiens
agctggcagcgcc

SEQ ID NO: 465310 - DNA, 15 bp, Homo sapiens
agctggcagcgcctc

SEQ ID NO: 465311 - DNA, 17 bp, Homo sapiens
agctggcagcgcctccc

SEQ ID NO: 465312 - DNA, 13 bp, Homo sapiens
agctggctgggtc

SEQ ID NO: 465313 - DNA, 22 bp, Homo sapiens
agctggctgggtcgcccctcct

SEQ ID NO: 465314 - DNA, 16 bp, Homo sapiens
agctgtagaaatgtat

SEQ ID NO: 465315 - DNA, 16 bp, Homo sapiens
agcttatttctaacta

SEQ ID NO: 465316 - DNA, 12 bp, Homo sapiens
agcttcaaaaca

SEQ ID NO: 465317 - DNA, 13 bp, Homo sapiens
agcttcaaaacag

SEQ ID NO: 465318 - DNA, 16 bp, Homo sapiens
agcttcaaaacagaac

SEQ ID NO: 465319 - DNA, 14 bp, Homo sapiens
agcttctcctctgc

SEQ ID NO: 465320 - DNA, 15 bp, Homo sapiens
agcttctcctctgct

SEQ ID NO: 465321 - DNA, 18 bp, Homo sapiens
agcttctcctctgctcca

SEQ ID NO: 465322 - DNA, 11 bp, Homo sapiens
agcttgaatgt

SEQ ID NO: 465323 - DNA, 12 bp, Homo sapiens
agcttgaatgtc

SEQ ID NO: 465324 - DNA, 13 bp, Homo sapiens
agcttgaatgtcc

SEQ ID NO: 465325 - DNA, 16 bp, Homo sapiens
agcttggagggatgga

SEQ ID NO: 465326 - DNA, 13 bp, Homo sapiens
agcttgtttctat

SEQ ID NO: 465327 - DNA, 15 bp, Homo sapiens
aggaaaagagaaaca

SEQ ID NO: 465328 - DNA, 13 bp, Homo sapiens
aggaaacaagctt

SEQ ID NO: 465329 - DNA, 14 bp, Homo sapiens
aggaaagccctccc

SEQ ID NO: 465330 - DNA, 15 bp, Homo sapiens
aggaaatactcagca

SEQ ID NO: 465331 - DNA, 16 bp, Homo sapiens
aggaagagatgctcta

SEQ ID NO: 465332 - DNA, 14 bp, Homo sapiens
aggaaggacatttc

SEQ ID NO: 465333 - DNA, 13 bp, Homo sapiens
aggaagtggaatg

SEQ ID NO: 465334 - DNA, 20 bp, Homo sapiens
aggaatgggccaagccaggg

SEQ ID NO: 465335 - DNA, 20 bp, Homo sapiens
atctagcaagaagattctaa

SEQ ID NO: 465336 - DNA, 21 bp, Homo sapiens
atctatgggagattaaaacca

SEQ ID NO: 465337 - DNA, 23 bp, Homo sapiens
atctattcccatcgctggaaaac

SEQ ID NO: 465338 - DNA, 19 bp, Homo sapiens
atctccagccaatttcaaa

SEQ ID NO: 465339 - DNA, 18 bp, Homo sapiens
atctctaaaattctagtc

SEQ ID NO: 465340 - DNA, 21 bp, Homo sapiens
atctctaaaattctagtctct

SEQ ID NO: 465341 - DNA, 16 bp, Homo sapiens
atctctctggggccct

SEQ ID NO: 465342 - DNA, 20 bp, Homo sapiens
atctctctggggccctgggc

SEQ ID NO: 465343 - DNA, 21 bp, Homo sapiens
atctctgattaaatttaatat

SEQ ID NO: 465344 - DNA, 13 bp, Homo sapiens
atctcttcttcct

SEQ ID NO: 465345 - DNA, 14 bp, Homo sapiens
atctctttctctct

SEQ ID NO: 465346 - DNA, 14 bp, Homo sapiens
atctgaaaagaaat

SEQ ID NO: 465347 - DNA, 15 bp, Homo sapiens
atctgaaatctacaa

SEQ ID NO: 465348 - DNA, 14 bp, Homo sapiens
atctgaggagtcca

SEQ ID NO: 465349 - DNA, 23 bp, Homo sapiens
atctgcaaatagtttcaaatgag

SEQ ID NO: 465350 - DNA, 15 bp, Homo sapiens
atctgctgcctctga

SEQ ID NO: 465351 - DNA, 18 bp, Homo sapiens
atctgctgcctctgaaaa

SEQ ID NO: 465352 - DNA, 20 bp, Homo sapiens
atctgctgcctctgaaaata

SEQ ID NO: 465353 - DNA, 18 bp, Homo sapiens
atctggagtcttcctgta

SEQ ID NO: 465354 - DNA, 15 bp, Homo sapiens
atctggcttctgcat

SEQ ID NO: 465355 - DNA, 22 bp, Homo sapiens
atctggtgcgtgtggccctgtg

SEQ ID NO: 465356 - DNA, 16 bp, Homo sapiens
atctgtaaatttaact

SEQ ID NO: 465357 - DNA, 17 bp, Homo sapiens
atctgtaaatttaactg

SEQ ID NO: 465358 - DNA, 23 bp, Homo sapiens
atctgtaaatttaactgcatata

SEQ ID NO: 465359 - DNA, 16 bp, Homo sapiens
atctgtcatctctctg

SEQ ID NO: 465360 - DNA, 17 bp, Homo sapiens
atctgtcatctctctgg

SEQ ID NO: 465361 - DNA, 19 bp, Homo sapiens
atctgtcatctctctgggg

SEQ ID NO: 465362 - DNA, 13 bp, Homo sapiens
atctgtctgagcc

SEQ ID NO: 465363 - DNA, 15 bp, Homo sapiens
atctgtctgagccct

SEQ ID NO: 465364 - DNA, 19 bp, Homo sapiens
atctgtctgagccctgccc

SEQ ID NO: 465365 - DNA, 13 bp, Homo sapiens
atctgtctgattc

SEQ ID NO: 465366 - DNA, 15 bp, Homo sapiens
atctgtctgattcta

SEQ ID NO: 465367 - DNA, 23 bp, Homo sapiens
atcttaagattccattttggaaa

SEQ ID NO: 465368 - DNA, 13 bp, Homo sapiens
atcttatgttgat

SEQ ID NO: 465369 - DNA, 17 bp, Homo sapiens
atcttccatatgctctt

SEQ ID NO: 465370 - DNA, 14 bp, Homo sapiens
atcttcccccttcc

SEQ ID NO: 465371 - DNA, 14 bp, Homo sapiens
atctttcagttatt

SEQ ID NO: 465372 - DNA, 21 bp, Homo sapiens
atctttcagttattaaatgat

SEQ ID NO: 465373 - DNA, 22 bp, Homo sapiens
atgaaagagaaaatgctttctc

SEQ ID NO: 465374 - DNA, 22 bp, Homo sapiens
atgacacataaatctgtctgat

SEQ ID NO: 465375 - DNA, 23 bp, Homo sapiens
atgacctaaatccattttctaaa

SEQ ID NO: 465376 - DNA, 21 bp, Homo sapiens
atgactggaaacaaggaagga

SEQ ID NO: 465377 - DNA, 17 bp, Homo sapiens
atgactgtttttgtagt

SEQ ID NO: 465378 - DNA, 18 bp, Homo sapiens
atgactgtttttgtagtg

SEQ ID NO: 465379 - DNA, 14 bp, Homo sapiens
atgagtaaataaac

SEQ ID NO: 465380 - DNA, 18 bp, Homo sapiens
atgagttcaaatactttt

SEQ ID NO: 465381 - DNA, 19 bp, Homo sapiens
atgagtttaaaaaaataac

SEQ ID NO: 465382 - DNA, 15 bp, Homo sapiens
atgatactgaattgt

SEQ ID NO: 465383 - DNA, 11 bp, Homo sapiens
atgatatgcat

SEQ ID NO: 465384 - DNA, 12 bp, Homo sapiens
atgatatgcatg

SEQ ID NO: 465385 - DNA, 13 bp, Homo sapiens
atgatatgcatgt

SEQ ID NO: 465386 - DNA, 18 bp, Homo sapiens
atgatatgcatgtagcat

SEQ ID NO: 465387 - DNA, 19 bp, Homo sapiens
atgatatgcatgtagcata

SEQ ID NO: 465388 - DNA, 22 bp, Homo sapiens
atgatctgtatttaatggtttt

SEQ ID NO: 465389 - DNA, 22 bp, Homo sapiens
atgattaggcccgccaaacttc

SEQ ID NO: 465390 - DNA, 22 bp, Homo sapiens
atgattcaatgtgaattttaaa

SEQ ID NO: 465391 - DNA, 12 bp, Homo sapiens
atgattccaaat

SEQ ID NO: 465392 - DNA, 13 bp, Homo sapiens
atgattccaaata

SEQ ID NO: 465393 - DNA, 15 bp, Homo sapiens
atgattctcctctcc

SEQ ID NO: 465394 - DNA, 16 bp, Homo sapiens
atgattctcctctccc

SEQ ID NO: 465395 - DNA, 20 bp, Homo sapiens
atgattgaaaagaagaaagt

SEQ ID NO: 465396 - DNA, 22 bp, Homo sapiens
atgcaaagtaccaactgagcca

SEQ ID NO: 465397 - DNA, 15 bp, Homo sapiens
atgcaagctcagggt

SEQ ID NO: 465398 - DNA, 14 bp, Homo sapiens
atgcataacacact

SEQ ID NO: 465399 - DNA, 17 bp, Homo sapiens
atgcatagacaagtgtt

SEQ ID NO: 465400 - DNA, 18 bp, Homo sapiens
atgcatgatattgtatgt

SEQ ID NO: 465401 - DNA, 21 bp, Homo sapiens
atgcatgatattgtatgtacc

SEQ ID NO: 465402 - DNA, 15 bp, Homo sapiens
atgcatgtagcatat

SEQ ID NO: 465403 - DNA, 23 bp, Homo sapiens
atgcatgtagcatataaatgttt

SEQ ID NO: 465404 - DNA, 24 bp, Homo sapiens
atgcatgtgattggcagcttcaaa

SEQ ID NO: 465405 - DNA, 21 bp, Homo sapiens
atgccagggcgcactttccac

SEQ ID NO: 465406 - DNA, 12 bp, Homo sapiens
atgcctgcctga

SEQ ID NO: 465407 - DNA, 20 bp, Homo sapiens
atgcctgtatttccaacaaa

SEQ ID NO: 465408 - DNA, 19 bp, Homo sapiens
atgccttctgttttccaaa

SEQ ID NO: 465409 - DNA, 23 bp, Homo sapiens
atgctaatgtaatcatttatctt

SEQ ID NO: 465410 - DNA, 22 bp, Homo sapiens
atgctagcacaatattcctatg

SEQ ID NO: 465411 - DNA, 19 bp, Homo sapiens
atgctgctggaggaatcag

SEQ ID NO: 465412 - DNA, 12 bp, Homo sapiens
atgctgctgtga

SEQ ID NO: 465413 - DNA, 14 bp, Homo sapiens
atgctgctgtgaat

SEQ ID NO: 465414 - DNA, 16 bp, Homo sapiens
atgctgctgtgaattt

SEQ ID NO: 465415 - DNA, 12 bp, Homo sapiens
atgctggccagc

SEQ ID NO: 465416 - DNA, 18 bp, Homo sapiens
atgctggccagcaccctc

SEQ ID NO: 465417 - DNA, 10 bp, Homo sapiens
atgctttctc

SEQ ID NO: 465418 - DNA, 16 bp, Homo sapiens
atgctttctcatgcat

SEQ ID NO: 465419 - DNA, 20 bp, Homo sapiens
atgctttctcatgcatagac

SEQ ID NO: 465420 - DNA, 16 bp, Homo sapiens
atggaaagggtgtggc

SEQ ID NO: 465421 - DNA, 20 bp, Homo sapiens
atggaaagggtgtggcttgg

SEQ ID NO: 465422 - DNA, 13 bp, Homo sapiens
atggaaccttccc

SEQ ID NO: 465423 - DNA, 19 bp, Homo sapiens
atggaattatgtataacaa

SEQ ID NO: 465424 - DNA, 20 bp, Homo sapiens
atggagaggcggcctcgtgc

SEQ ID NO: 465425 - DNA, 20 bp, Homo sapiens
atggatgattcttttcccat

SEQ ID NO: 465426 - DNA, 21 bp, Homo sapiens
attctagtcaactgctgtttt

SEQ ID NO: 465427 - DNA, 16 bp, Homo sapiens
attctagtctctgatt

SEQ ID NO: 465428 - DNA, 17 bp, Homo sapiens
attctataaattcaaca

SEQ ID NO: 465429 - DNA, 14 bp, Homo sapiens
attctatatttcat

SEQ ID NO: 465430 - DNA, 15 bp, Homo sapiens
attctatatttcata

SEQ ID NO: 465431 - DNA, 20 bp, Homo sapiens
attctatgcctgtatttcca

SEQ ID NO: 465432 - DNA, 21 bp, Homo sapiens
attctatgcctgtatttccaa

SEQ ID NO: 465433 - DNA, 21 bp, Homo sapiens
aggaatgggccaagccagggt

SEQ ID NO: 465434 - DNA, 20 bp, Homo sapiens
aggacacgaaggctgcccct

SEQ ID NO: 465435 - DNA, 21 bp, Homo sapiens
aggacactgatgggtcctgct

SEQ ID NO: 465436 - DNA, 23 bp, Homo sapiens
aggacagaaccaacgggtctgtg

SEQ ID NO: 465437 - DNA, 17 bp, Homo sapiens
aggacagggagggaaca

SEQ ID NO: 465438 - DNA, 14 bp, Homo sapiens
aggacagtttagga

SEQ ID NO: 465439 - DNA, 18 bp, Homo sapiens
aggacccggaggggcctg

SEQ ID NO: 465440 - DNA, 14 bp, Homo sapiens
aggaccgccccaac

SEQ ID NO: 465441 - DNA, 14 bp, Homo sapiens
aggacggggcagag

SEQ ID NO: 465442 - DNA, 15 bp, Homo sapiens
aggactaacaactgg

SEQ ID NO: 465443 - DNA, 22 bp, Homo sapiens
aggagaaggcctgccccccttc

SEQ ID NO: 465444 - DNA, 17 bp, Homo sapiens
aggagaccctgtctttg

SEQ ID NO: 465445 - DNA, 18 bp, Homo sapiens
aggagcacccccagcctc

SEQ ID NO: 465446 - DNA, 19 bp, Homo sapiens
aggagcacccccagcctcc

SEQ ID NO: 465447 - DNA, 23 bp, Homo sapiens
aggagcacccccagcctccccca

SEQ ID NO: 465448 - DNA, 20 bp, Homo sapiens
aggagcactagaatgagaaa

SEQ ID NO: 465449 - DNA, 16 bp, Homo sapiens
aggagcttccagatgg

SEQ ID NO: 465450 - DNA, 16 bp, Homo sapiens
aggaggtgtggagtgg

SEQ ID NO: 465451 - DNA, 17 bp, Homo sapiens
aggaggtgtggagtgga

SEQ ID NO: 465452 - DNA, 18 bp, Homo sapiens
aggaggtgtggagtggag

SEQ ID NO: 465453 - DNA, 20 bp, Homo sapiens
aggaggtgtggagtggaggg

SEQ ID NO: 465454 - DNA, 21 bp, Homo sapiens
aggaggtgtggagtggagggg

SEQ ID NO: 465455 - DNA, 16 bp, Homo sapiens
aggagtgcccgccttg

SEQ ID NO: 465456 - DNA, 16 bp, Homo sapiens
aggagttctcctggag

SEQ ID NO: 465457 - DNA, 17 bp, Homo sapiens
aggagttctcctggagc

SEQ ID NO: 465458 - DNA, 15 bp, Homo sapiens
aggatgggaagaaaa

SEQ ID NO: 465459 - DNA, 21 bp, Homo sapiens
aggatgggtgaaaccacatgg

SEQ ID NO: 465460 - DNA, 11 bp, Homo sapiens
aggattctttt

SEQ ID NO: 465461 - DNA, 17 bp, Homo sapiens
aggattcttttttcaat

SEQ ID NO: 465462 - DNA, 19 bp, Homo sapiens
aggattcttttttcaatgt

SEQ ID NO: 465463 - DNA, 23 bp, Homo sapiens
aggattcttttttcaatgtactg

SEQ ID NO: 465464 - DNA, 15 bp, Homo sapiens
aggattgaaagggag

SEQ ID NO: 465465 - DNA, 20 bp, Homo sapiens
aggcaacttttcatttttgc

SEQ ID NO: 465466 - DNA, 15 bp, Homo sapiens
aggcaagaagtggga

SEQ ID NO: 465467 - DNA, 17 bp, Homo sapiens
aggcaagaagtgggatt

SEQ ID NO: 465468 - DNA, 17 bp, Homo sapiens
aggcacacagcagcccc

SEQ ID NO: 465469 - DNA, 14 bp, Homo sapiens
aggcagaatggtgg

SEQ ID NO: 465470 - DNA, 23 bp, Homo sapiens
aggcagagattgggggggcttgg

SEQ ID NO: 465471 - DNA, 19 bp, Homo sapiens
aggccagtactttgccatc

SEQ ID NO: 465472 - DNA, 14 bp, Homo sapiens
aggccccagcctcc

SEQ ID NO: 465473 - DNA, 16 bp, Homo sapiens
aggcccccctctgcct

SEQ ID NO: 465474 - DNA, 14 bp, Homo sapiens
aggcccctgccccc

SEQ ID NO: 465475 - DNA, 18 bp, Homo sapiens
aggcccttcctctccact

SEQ ID NO: 465476 - DNA, 19 bp, Homo sapiens
aggcccttcctctccactg

SEQ ID NO: 465477 - DNA, 14 bp, Homo sapiens
aggccgtgtctctg

SEQ ID NO: 465478 - DNA, 16 bp, Homo sapiens
aggccgtgtctctgag

SEQ ID NO: 465479 - DNA, 15 bp, Homo sapiens
aggcctgagggaagc

SEQ ID NO: 465480 - DNA, 19 bp, Homo sapiens
aggcctgagggaagcccac

SEQ ID NO: 465481 - DNA, 20 bp, Homo sapiens
aggcctgagggaagcccacc

SEQ ID NO: 465482 - DNA, 23 bp, Homo sapiens
aggcctgagggaagcccacccgc

SEQ ID NO: 465483 - DNA, 19 bp, Homo sapiens
aggcctgccccccttccca

SEQ ID NO: 465484 - DNA, 23 bp, Homo sapiens
aggcctgccccccttcccacccc

SEQ ID NO: 465485 - DNA, 12 bp, Homo sapiens
aggcgcccacct

SEQ ID NO: 465486 - DNA, 14 bp, Homo sapiens
aggcgccccttccc

SEQ ID NO: 465487 - DNA, 13 bp, Homo sapiens
aggcgctcagagg

SEQ ID NO: 465488 - DNA, 15 bp, Homo sapiens
aggcgctcagaggcc

SEQ ID NO: 465489 - DNA, 20 bp, Homo sapiens
aggcgctcagaggccgctct

SEQ ID NO: 465490 - DNA, 21 bp, Homo sapiens
aggcggcctttgttgctcagc

SEQ ID NO: 465491 - DNA, 18 bp, Homo sapiens
aggcgtgggatccagaga

SEQ ID NO: 465492 - DNA, 17 bp, Homo sapiens
aggctccctgaggtacc

SEQ ID NO: 465493 - DNA, 13 bp, Homo sapiens
aggctcttctcct

SEQ ID NO: 465494 - DNA, 14 bp, Homo sapiens
aggctcttctcctt

SEQ ID NO: 465495 - DNA, 15 bp, Homo sapiens
aggctgcgcctgccc

SEQ ID NO: 465496 - DNA, 16 bp, Homo sapiens
aggctgcgcctgcccg

SEQ ID NO: 465497 - DNA, 18 bp, Homo sapiens
aggctgcgcctgcccgcc

SEQ ID NO: 465498 - DNA, 14 bp, Homo sapiens
aggctgggcccctg

SEQ ID NO: 465499 - DNA, 15 bp, Homo sapiens
aggctgggcccctgg

SEQ ID NO: 465500 - DNA, 16 bp, Homo sapiens
aggctggggcctggcc

SEQ ID NO: 465501 - DNA, 18 bp, Homo sapiens
aggctgtattttctttta

SEQ ID NO: 465502 - DNA, 20 bp, Homo sapiens
aggctgtattttcttttata

SEQ ID NO: 465503 - DNA, 22 bp, Homo sapiens
aggctgtattttcttttatatc

SEQ ID NO: 465504 - DNA, 22 bp, Homo sapiens
aggctttattcttccaagttca

SEQ ID NO: 465505 - DNA, 21 bp, Homo sapiens
agggaaatcaatttaaaggaa

SEQ ID NO: 465506 - DNA, 16 bp, Homo sapiens
agggaaatccaactcc

SEQ ID NO: 465507 - DNA, 19 bp, Homo sapiens
agggaaatccaactccagg

SEQ ID NO: 465508 - DNA, 17 bp, Homo sapiens
agggaagcccacccgcc

SEQ ID NO: 465509 - DNA, 20 bp, Homo sapiens
agggaagcccacccgcccca

SEQ ID NO: 465510 - DNA, 20 bp, Homo sapiens
agggaatccatatcagctct

SEQ ID NO: 465511 - DNA, 18 bp, Homo sapiens
agggacccccgaggcccc

SEQ ID NO: 465512 - DNA, 22 bp, Homo sapiens
agggagggaacagacctcggct

SEQ ID NO: 465513 - DNA, 22 bp, Homo sapiens
agggagtaggctgtattttctt

SEQ ID NO: 465514 - DNA, 17 bp, Homo sapiens
agggatggagaggcggc

SEQ ID NO: 465515 - DNA, 18 bp, Homo sapiens
agggatggagaggcggcc

SEQ ID NO: 465516 - DNA, 14 bp, Homo sapiens
agggcactggtggc

SEQ ID NO: 465517 - DNA, 15 bp, Homo sapiens
agggcaggagctgct

SEQ ID NO: 465518 - DNA, 19 bp, Homo sapiens
agggcagggttctagaagg

SEQ ID NO: 465519 - DNA, 20 bp, Homo sapiens
agggcagggttctagaaggg

SEQ ID NO: 465520 - DNA, 14 bp, Homo sapiens
agggccgcagggcg

SEQ ID NO: 465521 - DNA, 15 bp, Homo sapiens
agggcgctccggcag

SEQ ID NO: 465522 - DNA, 17 bp, Homo sapiens
agggcgctccggcagag

SEQ ID NO: 465523 - DNA, 18 bp, Homo sapiens
agggctgagcccctcctc

SEQ ID NO: 465524 - DNA, 20 bp, Homo sapiens
agggctgagcccctcctctc

SEQ ID NO: 465525 - DNA, 15 bp, Homo sapiens
aggggacagatcttg

SEQ ID NO: 465526 - DNA, 19 bp, Homo sapiens
aggggactgcatgcaagct

SEQ ID NO: 465527 - DNA, 21 bp, Homo sapiens
aggggatctaaaaggaggaca

SEQ ID NO: 465528 - DNA, 24 bp, Homo sapiens
aggggatctaaaaggaggacaggg

SEQ ID NO: 465529 - DNA, 18 bp, Homo sapiens
aggggcctggcagccgtg

SEQ ID NO: 465530 - DNA, 23 bp, Homo sapiens
aggggcctggcagccgtgccttc

SEQ ID NO: 465531 - DNA, 20 bp, Homo sapiens
aggggcttggagcagagacg

SEQ ID NO: 465532 - DNA, 17 bp, Homo sapiens
agggggaagatgccaag

SEQ ID NO: 465533 - DNA, 15 bp, Homo sapiens
agggggccagaggga

SEQ ID NO: 465534 - DNA, 18 bp, Homo sapiens
agggggccagagggactt

SEQ ID NO: 465535 - DNA, 12 bp, Homo sapiens
aggggggttggg

SEQ ID NO: 465536 - DNA, 19 bp, Homo sapiens
aggggggttgggttccaga

SEQ ID NO: 465537 - DNA, 21 bp, Homo sapiens
aggggggttgggttccagaca

SEQ ID NO: 465538 - DNA, 13 bp, Homo sapiens
aggggtcagcagg

SEQ ID NO: 465539 - DNA, 23 bp, Homo sapiens
aggggtgggggagaatggctctg

SEQ ID NO: 465540 - DNA, 23 bp, Homo sapiens
agggtatctgctgcctctgaaaa

SEQ ID NO: 465541 - DNA, 14 bp, Homo sapiens
agggtgaggcgtgg

SEQ ID NO: 465542 - DNA, 15 bp, Homo sapiens
agggtgaggcgtggg

SEQ ID NO: 465543 - DNA, 12 bp, Homo sapiens
agggtgggcgtg

SEQ ID NO: 465544 - DNA, 15 bp, Homo sapiens
agggtgtggcttgga

SEQ ID NO: 465545 - DNA, 15 bp, Homo sapiens
agggttaaagaaagg

SEQ ID NO: 465546 - DNA, 19 bp, Homo sapiens
agggttaaagaaaggcaga

SEQ ID NO: 465547 - DNA, 13 bp, Homo sapiens
agggttccagaca

SEQ ID NO: 465548 - DNA, 14 bp, Homo sapiens
agggttccagacag

SEQ ID NO: 465549 - DNA, 19 bp, Homo sapiens
agggttctaacctttctaa

SEQ ID NO: 465550 - DNA, 13 bp, Homo sapiens
agggttctagaag

SEQ ID NO: 465551 - DNA, 18 bp, Homo sapiens
agggtttacccagtggga

SEQ ID NO: 465552 - DNA, 14 bp, Homo sapiens
aggtaatggatatg

SEQ ID NO: 465553 - DNA, 13 bp, Homo sapiens
aggtcctgcccat

SEQ ID NO: 465554 - DNA, 22 bp, Homo sapiens
aggtctcaccttcgcctttgct

SEQ ID NO: 465555 - DNA, 21 bp, Homo sapiens
aggtgcccagtcttgagtggg

SEQ ID NO: 465556 - DNA, 18 bp, Homo sapiens
aggtgcggaccggagcgg

SEQ ID NO: 465557 - DNA, 13 bp, Homo sapiens
aggtgggtcttgg

SEQ ID NO: 465558 - DNA, 22 bp, Homo sapiens
aggtggtcttggagaggaggtg

SEQ ID NO: 465559 - DNA, 17 bp, Homo sapiens
aggtgtggagtggaggg

SEQ ID NO: 465560 - DNA, 14 bp, Homo sapiens
aggttaagccatat

SEQ ID NO: 465561 - DNA, 13 bp, Homo sapiens
aggttaaggggat

SEQ ID NO: 465562 - DNA, 12 bp, Homo sapiens
aggttcctccta

SEQ ID NO: 465563 - DNA, 21 bp, Homo sapiens
aggttcctcctaggcgctcag

SEQ ID NO: 465564 - DNA, 20 bp, Homo sapiens
aggttgtctgaagtcactgc

SEQ ID NO: 465565 - DNA, 12 bp, Homo sapiens
agtaaataaact

SEQ ID NO: 465566 - DNA, 22 bp, Homo sapiens
agtaaataaactcttcaaggcc

SEQ ID NO: 465567 - DNA, 19 bp, Homo sapiens
agtaacactagtagctgtt

SEQ ID NO: 465568 - DNA, 20 bp, Homo sapiens
agtaagctgctctattgtag

SEQ ID NO: 465569 - DNA, 19 bp, Homo sapiens
agtacagggcaggagctgc

SEQ ID NO: 465570 - DNA, 20 bp, Homo sapiens
agtacataaagtaataactg

SEQ ID NO: 465571 - DNA, 15 bp, Homo sapiens
agtaccatcccactg

SEQ ID NO: 465572 - DNA, 17 bp, Homo sapiens
agtacctgtagtgagaa

SEQ ID NO: 465573 - DNA, 22 bp, Homo sapiens
agtactcactaaaagttctcaa

SEQ ID NO: 465574 - DNA, 16 bp, Homo sapiens
agtacttgctcaataa

SEQ ID NO: 465575 - DNA, 19 bp, Homo sapiens
agtactttgccatccttgc

SEQ ID NO: 465576 - DNA, 19 bp, Homo sapiens
agtagtgcctgtgatcgtg

SEQ ID NO: 465577 - DNA, 14 bp, Homo sapiens
agtatataagcttt

SEQ ID NO: 465578 - DNA, 19 bp, Homo sapiens
agtatatagccttaagtct

SEQ ID NO: 465579 - DNA, 17 bp, Homo sapiens
agtatatttatttctag

SEQ ID NO: 465580 - DNA, 16 bp, Homo sapiens
agtatgttaagctctt

SEQ ID NO: 465581 - DNA, 19 bp, Homo sapiens
agtatgttaagctctttat

SEQ ID NO: 465582 - DNA, 12 bp, Homo sapiens
agtattctgtag

SEQ ID NO: 465583 - DNA, 22 bp, Homo sapiens
agtattctgtagccaacttaaa

SEQ ID NO: 465584 - DNA, 22 bp, Homo sapiens
agtattgacgacctacatctga

SEQ ID NO: 465585 - DNA, 16 bp, Homo sapiens
agtcaaacagtgtggc

SEQ ID NO: 465586 - DNA, 17 bp, Homo sapiens
agtcaaacagtgtggct

SEQ ID NO: 465587 - DNA, 16 bp, Homo sapiens
agtcacttatttcata

SEQ ID NO: 465588 - DNA, 16 bp, Homo sapiens
agtcatctcaaacact

SEQ ID NO: 465589 - DNA, 14 bp, Homo sapiens
agtccactttcctc

SEQ ID NO: 465590 - DNA, 15 bp, Homo sapiens
agtccactttcctct

SEQ ID NO: 465591 - DNA, 21 bp, Homo sapiens
agtcccttccagtcatgtgtg

SEQ ID NO: 465592 - DNA, 20 bp, Homo sapiens
agtcccttcctgtcctgctc

SEQ ID NO: 465593 - DNA, 19 bp, Homo sapiens
agtcctcaccttctgtttt

SEQ ID NO: 465594 - DNA, 16 bp, Homo sapiens
agtcctcctttgcttg

SEQ ID NO: 465595 - DNA, 13 bp, Homo sapiens
agtcggctgggca

SEQ ID NO: 465596 - DNA, 15 bp, Homo sapiens
agtcggctgggcagg

SEQ ID NO: 465597 - DNA, 18 bp, Homo sapiens
agtcggctgggcagggcc

SEQ ID NO: 465598 - DNA, 20 bp, Homo sapiens
agtcggctgggcagggccgc

SEQ ID NO: 465599 - DNA, 23 bp, Homo sapiens
agtctctgatttgcaaatgcaca

SEQ ID NO: 465600 - DNA, 13 bp, Homo sapiens
agtctcttctcca

SEQ ID NO: 465601 - DNA, 19 bp, Homo sapiens
agtctcttctccactggat

SEQ ID NO: 465602 - DNA, 21 bp, Homo sapiens
agtctcttctccactggatgg

SEQ ID NO: 465603 - DNA, 22 bp, Homo sapiens
agtctgtacttcagttctcatc

SEQ ID NO: 465604 - DNA, 15 bp, Homo sapiens
agtcttcctgtagtg

SEQ ID NO: 465605 - DNA, 20 bp, Homo sapiens
agtgaagcccaggaggacct

SEQ ID NO: 465606 - DNA, 17 bp, Homo sapiens
agtgaatgagtaaataa

SEQ ID NO: 465607 - DNA, 15 bp, Homo sapiens
agtgatatggcttgt

SEQ ID NO: 465608 - DNA, 15 bp, Homo sapiens
agtgcatctcagccc

SEQ ID NO: 465609 - DNA, 16 bp, Homo sapiens
agtgcatctcagccca

SEQ ID NO: 465610 - DNA, 13 bp, Homo sapiens
agtgcctgtgatc

SEQ ID NO: 465611 - DNA, 12 bp, Homo sapiens
agtgctgggccc

SEQ ID NO: 465612 - DNA, 16 bp, Homo sapiens
agtgctgggcccagcc

SEQ ID NO: 465613 - DNA, 17 bp, Homo sapiens
agtgctgggcccagccg

SEQ ID NO: 465614 - DNA, 22 bp, Homo sapiens
agtggaagatttcttgactatt

SEQ ID NO: 465615 - DNA, 11 bp, Homo sapiens
agtggaatcat

SEQ ID NO: 465616 - DNA, 17 bp, Homo sapiens
agtggaggggtcagcag

SEQ ID NO: 465617 - DNA, 23 bp, Homo sapiens
agtggaggggtcagcaggggggt

SEQ ID NO: 465618 - DNA, 17 bp, Homo sapiens
agtggcctgagaagagt

SEQ ID NO: 465619 - DNA, 17 bp, Homo sapiens
agtggctcctcccggtg

SEQ ID NO: 465620 - DNA, 21 bp, Homo sapiens
agtggctcctcccggtgccca

SEQ ID NO: 465621 - DNA, 19 bp, Homo sapiens
agtgggacagggcatggcc

SEQ ID NO: 465622 - DNA, 18 bp, Homo sapiens
agtgggattcaggaatgg

SEQ ID NO: 465623 - DNA, 19 bp, Homo sapiens
agtggggcccatggcccca

SEQ ID NO: 465624 - DNA, 20 bp, Homo sapiens
agtggggcccatggccccag

SEQ ID NO: 465625 - DNA, 23 bp, Homo sapiens
agtggttcgggggaaatagttcc

SEQ ID NO: 465626 - DNA, 12 bp, Homo sapiens
agtgtacatttg

SEQ ID NO: 465627 - DNA, 21 bp, Homo sapiens
agtgtacatttgatttgatat

SEQ ID NO: 465628 - DNA, 17 bp, Homo sapiens
agtgtgctcggacacag

SEQ ID NO: 465629 - DNA, 18 bp, Homo sapiens
agtgtgctcggacacagt

SEQ ID NO: 465630 - DNA, 17 bp, Homo sapiens
agtgtggcttaaacatt

SEQ ID NO: 465631 - DNA, 13 bp, Homo sapiens
agtgtgtgtgcaa

SEQ ID NO: 465632 - DNA, 15 bp, Homo sapiens
agtgttgaaattgga

SEQ ID NO: 465633 - DNA, 22 bp, Homo sapiens
agtgtttattaaaatactgttt

SEQ ID NO: 465634 - DNA, 23 bp, Homo sapiens
agttaacagtctcattacagatt

SEQ ID NO: 465635 - DNA, 13 bp, Homo sapiens
agttaatgtgcca

SEQ ID NO: 465636 - DNA, 15 bp, Homo sapiens
agttaatgtgccaaa

SEQ ID NO: 465637 - DNA, 16 bp, Homo sapiens
agttaatgtgccaaaa

SEQ ID NO: 465638 - DNA, 19 bp, Homo sapiens
agttagcccggccaaggac

SEQ ID NO: 465639 - DNA, 20 bp, Homo sapiens
agttcaacctggtggcacca

SEQ ID NO: 465640 - DNA, 21 bp, Homo sapiens
agttcaacctggtggcaccag

SEQ ID NO: 465641 - DNA, 14 bp, Homo sapiens
agttcactttcaat

SEQ ID NO: 465642 - DNA, 23 bp, Homo sapiens
agttcattcatactcaaagaggc

SEQ ID NO: 465643 - DNA, 14 bp, Homo sapiens
agttccataccaag

SEQ ID NO: 465644 - DNA, 16 bp, Homo sapiens
agttccattctatgac

SEQ ID NO: 465645 - DNA, 18 bp, Homo sapiens
agttctattatctgggtt

SEQ ID NO: 465646 - DNA, 19 bp, Homo sapiens
agttctattatctgggttt

SEQ ID NO: 465647 - DNA, 16 bp, Homo sapiens
agttctatttctatct

SEQ ID NO: 465648 - DNA, 23 bp, Homo sapiens
agttctatttctatctgcaaata

SEQ ID NO: 465649 - DNA, 15 bp, Homo sapiens
agttctcctggagca

SEQ ID NO: 465650 - DNA, 22 bp, Homo sapiens
agttcttggcctatgataagtt

SEQ ID NO: 465651 - DNA, 17 bp, Homo sapiens
agttgaagggaaatcaa

SEQ ID NO: 465652 - DNA, 17 bp, Homo sapiens
agttgacctttatttat

SEQ ID NO: 465653 - DNA, 16 bp, Homo sapiens
agttgatatgtaacag

SEQ ID NO: 465654 - DNA, 22 bp, Homo sapiens
agttgctttaaagtacctgtag

SEQ ID NO: 465655 - DNA, 13 bp, Homo sapiens
agttgtcttacac

SEQ ID NO: 465656 - DNA, 22 bp, Homo sapiens
agttgttggtttatactgtata

SEQ ID NO: 465657 - DNA, 14 bp, Homo sapiens
agtttaaaaaaata

SEQ ID NO: 465658 - DNA, 16 bp, Homo sapiens
agtttaaaaaaataac

SEQ ID NO: 465659 - DNA, 17 bp, Homo sapiens
agtttaaaaaaataaca

SEQ ID NO: 465660 - DNA, 14 bp, Homo sapiens
agtttaccaatcaa

SEQ ID NO: 465661 - DNA, 16 bp, Homo sapiens
agtttaccaatcaaca

SEQ ID NO: 465662 - DNA, 17 bp, Homo sapiens
agtttattatagtctgt

SEQ ID NO: 465663 - DNA, 13 bp, Homo sapiens
agtttcaaatgag

SEQ ID NO: 465664 - DNA, 19 bp, Homo sapiens
agtttcacatatttgtagc

SEQ ID NO: 465665 - DNA, 17 bp, Homo sapiens
agtttgcaatcttatgt

SEQ ID NO: 465666 - DNA, 21 bp, Homo sapiens
agtttgcaatcttatgttgat

SEQ ID NO: 465667 - DNA, 13 bp, Homo sapiens
ataaaaaccctgt

SEQ ID NO: 465668 - DNA, 12 bp, Homo sapiens
ataaaaactgcc

SEQ ID NO: 465669 - DNA, 19 bp, Homo sapiens
ataaaagtgatattcctat

SEQ ID NO: 465670 - DNA, 18 bp, Homo sapiens
ataaaagttttttaataa

SEQ ID NO: 465671 - DNA, 14 bp, Homo sapiens
ataaaatcttcaac

SEQ ID NO: 465672 - DNA, 12 bp, Homo sapiens
ataaacattaaa

SEQ ID NO: 465673 - DNA, 17 bp, Homo sapiens
ataaacattaaacactg

SEQ ID NO: 465674 - DNA, 14 bp, Homo sapiens
ataaacgaaacaca

SEQ ID NO: 465675 - DNA, 12 bp, Homo sapiens
ataaactcttca

SEQ ID NO: 465676 - DNA, 13 bp, Homo sapiens
ataaacttgtact

SEQ ID NO: 465677 - DNA, 18 bp, Homo sapiens
ataaagaagaaaataacc

SEQ ID NO: 465678 - DNA, 23 bp, Homo sapiens
ataaaggtcatattggaaacata

SEQ ID NO: 465679 - DNA, 15 bp, Homo sapiens
ataaataaagaagaa

SEQ ID NO: 465680 - DNA, 15 bp, Homo sapiens
ataaatagtaaataa

SEQ ID NO: 465681 - DNA, 12 bp, Homo sapiens
ataaatctaaat

SEQ ID NO: 465682 - DNA, 19 bp, Homo sapiens
ataaatctgtctgattcta

SEQ ID NO: 465683 - DNA, 20 bp, Homo sapiens
ataaatctgtctgattctat

SEQ ID NO: 465684 - DNA, 14 bp, Homo sapiens
ataaatgtttatat

SEQ ID NO: 465685 - DNA, 18 bp, Homo sapiens
ataaattattactttaaa

SEQ ID NO: 465686 - DNA, 20 bp, Homo sapiens
ataaattattactttaaatt

SEQ ID NO: 465687 - DNA, 22 bp, Homo sapiens
ataaattcaacacttattttct

SEQ ID NO: 465688 - DNA, 19 bp, Homo sapiens
ataaattggctcctttccc

SEQ ID NO: 465689 - DNA, 18 bp, Homo sapiens
ataactggatattcttta

SEQ ID NO: 465690 - DNA, 15 bp, Homo sapiens
ataagagacaaagtt

SEQ ID NO: 465691 - DNA, 22 bp, Homo sapiens
ataagagacaaagtttggaagt

SEQ ID NO: 465692 - DNA, 18 bp, Homo sapiens
ataagagttacttccctt

SEQ ID NO: 465693 - DNA, 15 bp, Homo sapiens
ataagtaatatcttt

SEQ ID NO: 465694 - DNA, 19 bp, Homo sapiens
ataagtaatatctttcagt

SEQ ID NO: 465695 - DNA, 15 bp, Homo sapiens
ataagtgctcagtat

SEQ ID NO: 465696 - DNA, 13 bp, Homo sapiens
ataatcaagacaa

SEQ ID NO: 465697 - DNA, 12 bp, Homo sapiens
ataatgaataat

SEQ ID NO: 465698 - DNA, 17 bp, Homo sapiens
ataatgcttaacataaa

SEQ ID NO: 465699 - DNA, 16 bp, Homo sapiens
ataatggaattatgta

SEQ ID NO: 465700 - DNA, 22 bp, Homo sapiens
ataatgtttccctcaagaacaa

SEQ ID NO: 465701 - DNA, 14 bp, Homo sapiens
atacaaagctgtca

SEQ ID NO: 465702 - DNA, 15 bp, Homo sapiens
atacaataaaagagc

SEQ ID NO: 465703 - DNA, 16 bp, Homo sapiens
atacaataaaagagct

SEQ ID NO: 465704 - DNA, 17 bp, Homo sapiens
atacaataaaagagctt

SEQ ID NO: 465705 - DNA, 14 bp, Homo sapiens
atacaccgggcctg

SEQ ID NO: 465706 - DNA, 13 bp, Homo sapiens
atacactggaatt

SEQ ID NO: 465707 - DNA, 19 bp, Homo sapiens
atacagtaagctgctctat

SEQ ID NO: 465708 - DNA, 16 bp, Homo sapiens
atacatggtttaaagt

SEQ ID NO: 465709 - DNA, 16 bp, Homo sapiens
atacattaaaataact

SEQ ID NO: 465710 - DNA, 19 bp, Homo sapiens
ataccctagaagaaaaccc

SEQ ID NO: 465711 - DNA, 21 bp, Homo sapiens
ataccctaggtctccacccct

SEQ ID NO: 465712 - DNA, 23 bp, Homo sapiens
ataccctaggtctccacccctca

SEQ ID NO: 465713 - DNA, 21 bp, Homo sapiens
atactctgtgtaatctctgat

SEQ ID NO: 465714 - DNA, 22 bp, Homo sapiens
atactgcatatcctggtgtcta

SEQ ID NO: 465715 - DNA, 16 bp, Homo sapiens
atactggaaataacct

SEQ ID NO: 465716 - DNA, 15 bp, Homo sapiens
atacttcacactgaa

SEQ ID NO: 465717 - DNA, 12 bp, Homo sapiens
atacttcctgga

SEQ ID NO: 465718 - DNA, 20 bp, Homo sapiens
atacttgctccttgaataag

SEQ ID NO: 465719 - DNA, 13 bp, Homo sapiens
atacttttgtgta

SEQ ID NO: 465720 - DNA, 18 bp, Homo sapiens
atacttttgtgtattctg

SEQ ID NO: 465721 - DNA, 21 bp, Homo sapiens
atagaactgtcccacaaaata

SEQ ID NO: 465722 - DNA, 22 bp, Homo sapiens
atagaactgtcccacaaaatat

SEQ ID NO: 465723 - DNA, 14 bp, Homo sapiens
atagataacagaga

SEQ ID NO: 465724 - DNA, 19 bp, Homo sapiens
atagcactggtttgtttct

SEQ ID NO: 465725 - DNA, 15 bp, Homo sapiens
ataggaaataaatct

SEQ ID NO: 465726 - DNA, 22 bp, Homo sapiens
cctgtgggggtggccatccctg

SEQ ID NO: 465727 - DNA, 16 bp, Homo sapiens
ccttaagaaagctata

SEQ ID NO: 465728 - DNA, 16 bp, Homo sapiens
ccttcaggttcctcct

SEQ ID NO: 465729 - DNA, 14 bp, Homo sapiens
ccttccatcctgag

SEQ ID NO: 465730 - DNA, 17 bp, Homo sapiens
ccttccatcctgaggac

SEQ ID NO: 465731 - DNA, 23 bp, Homo sapiens
ccttcccaacgtactcctcagac

SEQ ID NO: 465732 - DNA, 14 bp, Homo sapiens
ccttcccaccccta

SEQ ID NO: 465733 - DNA, 14 bp, Homo sapiens
ccttccccacccca

SEQ ID NO: 465734 - DNA, 15 bp, Homo sapiens
ccttccccaccccat

SEQ ID NO: 465735 - DNA, 15 bp, Homo sapiens
ccttccccactcccg

SEQ ID NO: 465736 - DNA, 21 bp, Homo sapiens
ccttcccgcagcaccagcctg

SEQ ID NO: 465737 - DNA, 15 bp, Homo sapiens
ccttcccgccttcag

SEQ ID NO: 465738 - DNA, 17 bp, Homo sapiens
ccttcctctccactgcc

SEQ ID NO: 465739 - DNA, 20 bp, Homo sapiens
ccttcctctccactgccttc

SEQ ID NO: 465740 - DNA, 21 bp, Homo sapiens
ccttcctgagtcccttccagt

SEQ ID NO: 465741 - DNA, 16 bp, Homo sapiens
ccttcctgtcctgctc

SEQ ID NO: 465742 - DNA, 17 bp, Homo sapiens
ccttcctgtcctgctca

SEQ ID NO: 465743 - DNA, 18 bp, Homo sapiens
ccttcctgtcctgctcac

SEQ ID NO: 465744 - DNA, 14 bp, Homo sapiens
ccttccttcttgct

SEQ ID NO: 465745 - DNA, 20 bp, Homo sapiens
ccttcgatacaccgggcctg

SEQ ID NO: 465746 - DNA, 20 bp, Homo sapiens
ccttctcccctccagacccc

SEQ ID NO: 465747 - DNA, 21 bp, Homo sapiens
ccttctcccctccagacccct

SEQ ID NO: 465748 - DNA, 22 bp, Homo sapiens
ccttctcccctccagaccccta

SEQ ID NO: 465749 - DNA, 14 bp, Homo sapiens
ccttgaccccacac

SEQ ID NO: 465750 - DNA, 17 bp, Homo sapiens
ccttgaccccacacgcc

SEQ ID NO: 465751 - DNA, 19 bp, Homo sapiens
ccttgagtgacatgcggct

SEQ ID NO: 465752 - DNA, 18 bp, Homo sapiens
ccttgctttctcttctaa

SEQ ID NO: 465753 - DNA, 16 bp, Homo sapiens
ccttggacaccatccc

SEQ ID NO: 465754 - DNA, 18 bp, Homo sapiens
ccttggatgtagtctgag

SEQ ID NO: 465755 - DNA, 14 bp, Homo sapiens
ccttggcccctctc

SEQ ID NO: 465756 - DNA, 17 bp, Homo sapiens
ccttggcccctctctgt

SEQ ID NO: 465757 - DNA, 18 bp, Homo sapiens
ccttggcccctctctgtt

SEQ ID NO: 465758 - DNA, 18 bp, Homo sapiens
ccttgggcacgggagagc

SEQ ID NO: 465759 - DNA, 14 bp, Homo sapiens
ccttggttcctcca

SEQ ID NO: 465760 - DNA, 18 bp, Homo sapiens
ccttggttcctccagcaa

SEQ ID NO: 465761 - DNA, 11 bp, Homo sapiens
ccttgtacttg

SEQ ID NO: 465762 - DNA, 19 bp, Homo sapiens
cctttatttattaaacttc

SEQ ID NO: 465763 - DNA, 22 bp, Homo sapiens
cctttatttattaaacttcagc

SEQ ID NO: 465764 - DNA, 17 bp, Homo sapiens
cctttccctgcatccct

SEQ ID NO: 465765 - DNA, 14 bp, Homo sapiens
cctttccgctgtcg

SEQ ID NO: 465766 - DNA, 21 bp, Homo sapiens
cctttcttttgaatcaatctg

SEQ ID NO: 465767 - DNA, 16 bp, Homo sapiens
cctttgcgctctgggt

SEQ ID NO: 465768 - DNA, 17 bp, Homo sapiens
cctttgtcaacttcagt

SEQ ID NO: 465769 - DNA, 14 bp, Homo sapiens
cctttgtggacttt

SEQ ID NO: 465770 - DNA, 16 bp, Homo sapiens
cgaaacacagaactca

SEQ ID NO: 465771 - DNA, 10 bp, Homo sapiens
cgactctgct

SEQ ID NO: 465772 - DNA, 13 bp, Homo sapiens
cgactctgctgct

SEQ ID NO: 465773 - DNA, 13 bp, Homo sapiens
cgagaagctctcg

SEQ ID NO: 465774 - DNA, 21 bp, Homo sapiens
cgagagggctgagcccctcct

SEQ ID NO: 465775 - DNA, 22 bp, Homo sapiens
cgagagggctgagcccctcctc

SEQ ID NO: 465776 - DNA, 17 bp, Homo sapiens
cgaggcagaatggtggg

SEQ ID NO: 465777 - DNA, 15 bp, Homo sapiens
cgaggcccccctctg

SEQ ID NO: 465778 - DNA, 17 bp, Homo sapiens
cgaggcccccctctgcc

SEQ ID NO: 465779 - DNA, 17 bp, Homo sapiens
cgagtccccccacccct

SEQ ID NO: 465780 - DNA, 21 bp, Homo sapiens
cgagtctcttctccactggat

SEQ ID NO: 465781 - DNA, 15 bp, Homo sapiens
cgatcttcccccttc

SEQ ID NO: 465782 - DNA, 13 bp, Homo sapiens
cgcaccgcccaac

SEQ ID NO: 465783 - DNA, 17 bp, Homo sapiens
cgcagagccccggagca

SEQ ID NO: 465784 - DNA, 16 bp, Homo sapiens
cgcagcaccagcctga

SEQ ID NO: 465785 - DNA, 17 bp, Homo sapiens
cgcagcaccagcctgag

SEQ ID NO: 465786 - DNA, 19 bp, Homo sapiens
cgcagcaccagcctgagcc

SEQ ID NO: 465787 - DNA, 21 bp, Homo sapiens
cgcagcaccagcctgagccac

SEQ ID NO: 465788 - DNA, 22 bp, Homo sapiens
cgcagcaccagcctgagccaca

SEQ ID NO: 465789 - DNA, 22 bp, Homo sapiens
cgcagccctctccacccagagg

SEQ ID NO: 465790 - DNA, 13 bp, Homo sapiens
cgcagccctgctt

SEQ ID NO: 465791 - DNA, 23 bp, Homo sapiens
ccaggattaatctctaaaattct

SEQ ID NO: 465792 - DNA, 13 bp, Homo sapiens
ccaggccccagcc

SEQ ID NO: 465793 - DNA, 20 bp, Homo sapiens
ccaggccccagcctccaggc

SEQ ID NO: 465794 - DNA, 15 bp, Homo sapiens
ccaggcccccaactc

SEQ ID NO: 465795 - DNA, 14 bp, Homo sapiens
ccaggccctccctg

SEQ ID NO: 465796 - DNA, 19 bp, Homo sapiens
ccaggcgccccttccccct

SEQ ID NO: 465797 - DNA, 20 bp, Homo sapiens
ccaggcggaggggcttggag

SEQ ID NO: 465798 - DNA, 12 bp, Homo sapiens
ccaggctgcgcc

SEQ ID NO: 465799 - DNA, 12 bp, Homo sapiens
ccaggctggggc

SEQ ID NO: 465800 - DNA, 13 bp, Homo sapiens
ccaggctggggcc

SEQ ID NO: 465801 - DNA, 13 bp, Homo sapiens
ccagggacccccg

SEQ ID NO: 465802 - DNA, 22 bp, Homo sapiens
ccagggttaaagaaaggcagag

SEQ ID NO: 465803 - DNA, 17 bp, Homo sapiens
ccagggttccagacagg

SEQ ID NO: 465804 - DNA, 21 bp, Homo sapiens
ccagtcttgagtgggccccct

SEQ ID NO: 465805 - DNA, 19 bp, Homo sapiens
ccagtctttggagagctca

SEQ ID NO: 465806 - DNA, 23 bp, Homo sapiens
ccagttagcccggccaaggacac

SEQ ID NO: 465807 - DNA, 14 bp, Homo sapiens
ccagtttgggaact

SEQ ID NO: 465808 - DNA, 13 bp, Homo sapiens
ccataagccctga

SEQ ID NO: 465809 - DNA, 13 bp, Homo sapiens
ccatatataaatt

SEQ ID NO: 465810 - DNA, 16 bp, Homo sapiens
ccatatataaattatt

SEQ ID NO: 465811 - DNA, 19 bp, Homo sapiens
ccatatataaattattact

SEQ ID NO: 465812 - DNA, 23 bp, Homo sapiens
ccatatataaattattactttaa

SEQ ID NO: 465813 - DNA, 14 bp, Homo sapiens
ccatatcagctctg

SEQ ID NO: 465814 - DNA, 20 bp, Homo sapiens
ccatatgacaatttcaaaat

SEQ ID NO: 465815 - DNA, 13 bp, Homo sapiens
ccatcaccagaaa

SEQ ID NO: 465816 - DNA, 14 bp, Homo sapiens
ccatccctgggccc

SEQ ID NO: 465817 - DNA, 12 bp, Homo sapiens
ccatccttcccg

SEQ ID NO: 465818 - DNA, 15 bp, Homo sapiens
ccatccttcccgcag

SEQ ID NO: 465819 - DNA, 16 bp, Homo sapiens
ccatccttcccgcagc

SEQ ID NO: 465820 - DNA, 14 bp, Homo sapiens
ccatctaaaatact

SEQ ID NO: 465821 - DNA, 17 bp, Homo sapiens
ccatcttaaatttctaa

SEQ ID NO: 465822 - DNA, 19 bp, Homo sapiens
ccatgatctgtatttaatg

SEQ ID NO: 465823 - DNA, 15 bp, Homo sapiens
ccatggccccagctg

SEQ ID NO: 465824 - DNA, 16 bp, Homo sapiens
ccatggccccagctgg

SEQ ID NO: 465825 - DNA, 18 bp, Homo sapiens
ccatggccccagctggct

SEQ ID NO: 465826 - DNA, 13 bp, Homo sapiens
ccatggtgcagtg

SEQ ID NO: 465827 - DNA, 17 bp, Homo sapiens
ccatggtggtttcagaa

SEQ ID NO: 465828 - DNA, 20 bp, Homo sapiens
ccatggtggtttcagaaagg

SEQ ID NO: 465829 - DNA, 17 bp, Homo sapiens
ccatgtgtcccctcact

SEQ ID NO: 465830 - DNA, 16 bp, Homo sapiens
ccattctataaattca

SEQ ID NO: 465831 - DNA, 22 bp, Homo sapiens
ccattttctaaactgttttcat

SEQ ID NO: 465832 - DNA, 18 bp, Homo sapiens
ccattttgtctggctgtg

SEQ ID NO: 465833 - DNA, 11 bp, Homo sapiens
cccaaaagatt

SEQ ID NO: 465834 - DNA, 12 bp, Homo sapiens
cccaaacccttc

SEQ ID NO: 465835 - DNA, 23 bp, Homo sapiens
ccccatgtgcctgcaccaggaga

SEQ ID NO: 465836 - DNA, 20 bp, Homo sapiens
cccccaacaccaccccttgc

SEQ ID NO: 465837 - DNA, 12 bp, Homo sapiens
cccccacggccg

SEQ ID NO: 465838 - DNA, 19 bp, Homo sapiens
cccccacggccgtccctga

SEQ ID NO: 465839 - DNA, 18 bp, Homo sapiens
cccccagcctcccccagg

SEQ ID NO: 465840 - DNA, 21 bp, Homo sapiens
cccccagcctcccccaggctg

SEQ ID NO: 465841 - DNA, 19 bp, Homo sapiens
cccccaggctgcgcctgcc

SEQ ID NO: 465842 - DNA, 13 bp, Homo sapiens
ccccccagcacta

SEQ ID NO: 465843 - DNA, 13 bp, Homo sapiens
cccccctccccaa

SEQ ID NO: 465844 - DNA, 12 bp, Homo sapiens
cccccctctgcc

SEQ ID NO: 465845 - DNA, 12 bp, Homo sapiens
cccccgaggccc

SEQ ID NO: 465846 - DNA, 23 bp, Homo sapiens
cccccggaggcgcccacctgccc

SEQ ID NO: 465847 - DNA, 21 bp, Homo sapiens
cccccggcctccaggctgggg

SEQ ID NO: 465848 - DNA, 12 bp, Homo sapiens
ccccctccccaa

SEQ ID NO: 465849 - DNA, 12 bp, Homo sapiens
ccccctctgcct

SEQ ID NO: 465850 - DNA, 18 bp, Homo sapiens
ccccctctgcctttgagc

SEQ ID NO: 465851 - DNA, 19 bp, Homo sapiens
cccccttcccctgcgccct

SEQ ID NO: 465852 - DNA, 16 bp, Homo sapiens
cccccttccccttctg

SEQ ID NO: 465853 - DNA, 20 bp, Homo sapiens
ccccgaggcccccctctgcc

SEQ ID NO: 465854 - DNA, 15 bp, Homo sapiens
ccccgccctcgctcc

SEQ ID NO: 465855 - DNA, 16 bp, Homo sapiens
ccccgcgcgtgccccc

SEQ ID NO: 465856 - DNA, 22 bp, Homo sapiens
ccccgcgcgtgcccccagcgtg

SEQ ID NO: 465857 - DNA, 23 bp, Homo sapiens
ccccgctcacgctgacagcctcc

SEQ ID NO: 465858 - DNA, 12 bp, Homo sapiens
ccccgctctgga

SEQ ID NO: 465859 - DNA, 15 bp, Homo sapiens
ccccgctgcctggcg

SEQ ID NO: 465860 - DNA, 16 bp, Homo sapiens
ccccggacgctggctc

SEQ ID NO: 465861 - DNA, 21 bp, Homo sapiens
ccccggaggcgcccacctgcc

SEQ ID NO: 465862 - DNA, 13 bp, Homo sapiens
ccccgtctgcccc

SEQ ID NO: 465863 - DNA, 21 bp, Homo sapiens
cccctcactctgtcagccagc

SEQ ID NO: 465864 - DNA, 22 bp, Homo sapiens
cccctcactctgtcagccagcc

SEQ ID NO: 465865 - DNA, 21 bp, Homo sapiens
cccctcagatgatctctccac

SEQ ID NO: 465866 - DNA, 12 bp, Homo sapiens
cccctccagacc

SEQ ID NO: 465867 - DNA, 15 bp, Homo sapiens
cccctccccacccac

SEQ ID NO: 465868 - DNA, 11 bp, Homo sapiens
cccctcccccg

SEQ ID NO: 465869 - DNA, 14 bp, Homo sapiens
cccctcccccgcag

SEQ ID NO: 465870 - DNA, 15 bp, Homo sapiens
cccctcccccgcaga

SEQ ID NO: 465871 - DNA, 10 bp, Homo sapiens
cccctcctcg

SEQ ID NO: 465872 - DNA, 22 bp, Homo sapiens
cccctctcctgagcctgtctct

SEQ ID NO: 465873 - DNA, 20 bp, Homo sapiens
cccctctcttaccccgtccc

SEQ ID NO: 465874 - DNA, 23 bp, Homo sapiens
cccctctgcctttgagcttctcc

SEQ ID NO: 465875 - DNA, 14 bp, Homo sapiens
cccctgcgccctcc

SEQ ID NO: 465876 - DNA, 13 bp, Homo sapiens
ccccttcccaccc

SEQ ID NO: 465877 - DNA, 16 bp, Homo sapiens
ccccttccccttctgt

SEQ ID NO: 465878 - DNA, 14 bp, Homo sapiens
ccccttctgtgtca

SEQ ID NO: 465879 - DNA, 15 bp, Homo sapiens
ccccttgaccccaca

SEQ ID NO: 465880 - DNA, 16 bp, Homo sapiens
ccccttgaccccacac

SEQ ID NO: 465881 - DNA, 17 bp, Homo sapiens
ccccttgaccccacacg

SEQ ID NO: 465882 - DNA, 21 bp, Homo sapiens
cccgaggcccccctctgcctt

SEQ ID NO: 465883 - DNA, 13 bp, Homo sapiens
cccgcagcaccag

SEQ ID NO: 465884 - DNA, 17 bp, Homo sapiens
cccgcagcaccagcctg

SEQ ID NO: 465885 - DNA, 21 bp, Homo sapiens
cccgcagccctctccacccag

SEQ ID NO: 465886 - DNA, 22 bp, Homo sapiens
cccgcagccctctccacccaga

SEQ ID NO: 465887 - DNA, 19 bp, Homo sapiens
cccgcccaccccgctgcct

SEQ ID NO: 465888 - DNA, 13 bp, Homo sapiens
cccgccccagaga

SEQ ID NO: 465889 - DNA, 16 bp, Homo sapiens
cccgccccagagactg

SEQ ID NO: 465890 - DNA, 23 bp, Homo sapiens
cagggatgggggatgggccaggg

SEQ ID NO: 465891 - DNA, 13 bp, Homo sapiens
cagggcaggagct

SEQ ID NO: 465892 - DNA, 17 bp, Homo sapiens
cagggcccaaataacag

SEQ ID NO: 465893 - DNA, 12 bp, Homo sapiens
cagggcccgagc

SEQ ID NO: 465894 - DNA, 22 bp, Homo sapiens
cagggccctggggtctctgagc

SEQ ID NO: 465895 - DNA, 24 bp, Homo sapiens
cagggccctggggtctctgagcag

SEQ ID NO: 465896 - DNA, 17 bp, Homo sapiens
cagggccgcagggcgct

SEQ ID NO: 465897 - DNA, 20 bp, Homo sapiens
cagggccgcagggcgctccg

SEQ ID NO: 465898 - DNA, 18 bp, Homo sapiens
cagggcgctccggcagag

SEQ ID NO: 465899 - DNA, 23 bp, Homo sapiens
cagggcgctccggcagaggcagg

SEQ ID NO: 465900 - DNA, 11 bp, Homo sapiens
cagggtgcagg

SEQ ID NO: 465901 - DNA, 23 bp, Homo sapiens
cagggttccagacagggtggggc

SEQ ID NO: 465902 - DNA, 19 bp, Homo sapiens
cagggttctagaaggggcg

SEQ ID NO: 465903 - DNA, 12 bp, Homo sapiens
caggtcctgccc

SEQ ID NO: 465904 - DNA, 22 bp, Homo sapiens
caggtcctgcccatgtgtcccc

SEQ ID NO: 465905 - DNA, 12 bp, Homo sapiens
caggttcctcct

SEQ ID NO: 465906 - DNA, 15 bp, Homo sapiens
caggttcctcctagg

SEQ ID NO: 465907 - DNA, 21 bp, Homo sapiens
caggttcctcctaggcgctca

SEQ ID NO: 465908 - DNA, 14 bp, Homo sapiens
cagtacagggcagg

SEQ ID NO: 465909 - DNA, 16 bp, Homo sapiens
cagtaccatcccactg

SEQ ID NO: 465910 - DNA, 17 bp, Homo sapiens
cagtaccatcccactga

SEQ ID NO: 465911 - DNA, 18 bp, Homo sapiens
cagtacttgctcaataaa

SEQ ID NO: 465912 - DNA, 14 bp, Homo sapiens
cagtatataagctt

SEQ ID NO: 465913 - DNA, 19 bp, Homo sapiens
cagtattaacatcaaagac

SEQ ID NO: 465914 - DNA, 17 bp, Homo sapiens
cagtattctgtagccaa

SEQ ID NO: 465915 - DNA, 18 bp, Homo sapiens
cagtattctgtagccaac

SEQ ID NO: 465916 - DNA, 22 bp, Homo sapiens
cagtattgacgacctacatctg

SEQ ID NO: 465917 - DNA, 17 bp, Homo sapiens
cagtccctacttaggaa

SEQ ID NO: 465918 - DNA, 22 bp, Homo sapiens
cagtcttgagtgggccccctct

SEQ ID NO: 465919 - DNA, 23 bp, Homo sapiens
cagtcttgagtgggccccctctc

SEQ ID NO: 465920 - DNA, 16 bp, Homo sapiens
cagtgcatctcagccc

SEQ ID NO: 465921 - DNA, 13 bp, Homo sapiens
cagtgctgggccc

SEQ ID NO: 465922 - DNA, 15 bp, Homo sapiens
cagtgctgggcccag

SEQ ID NO: 465923 - DNA, 23 bp, Homo sapiens
cagtgctgggcccagccggggtg

SEQ ID NO: 465924 - DNA, 14 bp, Homo sapiens
cagtggaagtgatt

SEQ ID NO: 465925 - DNA, 17 bp, Homo sapiens
cagtggagaggggactt

SEQ ID NO: 465926 - DNA, 14 bp, Homo sapiens
cagtggggcccatg

SEQ ID NO: 465927 - DNA, 21 bp, Homo sapiens
cagtggggcccatggccccag

SEQ ID NO: 465928 - DNA, 14 bp, Homo sapiens
cagtggtgatgcct

SEQ ID NO: 465929 - DNA, 18 bp, Homo sapiens
cagtggttcgggggaaat

SEQ ID NO: 465930 - DNA, 20 bp, Homo sapiens
cagtggttcgggggaaatag

SEQ ID NO: 465931 - DNA, 16 bp, Homo sapiens
cagtgtggcttaaaca

SEQ ID NO: 465932 - DNA, 17 bp, Homo sapiens
cagtgtggcttaaacat

SEQ ID NO: 465933 - DNA, 19 bp, Homo sapiens
cagttaagacaacaggcat

SEQ ID NO: 465934 - DNA, 16 bp, Homo sapiens
cagttaatgtgccaaa

SEQ ID NO: 465935 - DNA, 13 bp, Homo sapiens
cagttaattcttg

SEQ ID NO: 465936 - DNA, 23 bp, Homo sapiens
cagttacagcaggccagaaacat

SEQ ID NO: 465937 - DNA, 23 bp, Homo sapiens
cagttaccccgatccgtttgcaa

SEQ ID NO: 465938 - DNA, 17 bp, Homo sapiens
cagttagcccggccaag

SEQ ID NO: 465939 - DNA, 22 bp, Homo sapiens
cagttcaacctggtggcaccag

SEQ ID NO: 465940 - DNA, 16 bp, Homo sapiens
cagttcttggtgactg

SEQ ID NO: 465941 - DNA, 11 bp, Homo sapiens
cagttgattaa

SEQ ID NO: 465942 - DNA, 14 bp, Homo sapiens
cagttggtgatttt

SEQ ID NO: 465943 - DNA, 17 bp, Homo sapiens
cagttggtgattttaga

SEQ ID NO: 465944 - DNA, 17 bp, Homo sapiens
cagtttaatattccaat

SEQ ID NO: 465945 - DNA, 17 bp, Homo sapiens
cagtttaggacccaagg

SEQ ID NO: 465946 - DNA, 22 bp, Homo sapiens
cagtttaggacccaaggtggtc

SEQ ID NO: 465947 - DNA, 17 bp, Homo sapiens
ccactgagagctgctcc

SEQ ID NO: 465948 - DNA, 19 bp, Homo sapiens
ccactgagagctgctcctt

SEQ ID NO: 465949 - DNA, 24 bp, Homo sapiens
ccactgatatcacgggcccgctca

SEQ ID NO: 465950 - DNA, 21 bp, Homo sapiens
ccactgccttcgatacaccgg

SEQ ID NO: 465951 - DNA, 18 bp, Homo sapiens
ccacttatgctgctgtga

SEQ ID NO: 465952 - DNA, 12 bp, Homo sapiens
ccactttcctct

SEQ ID NO: 465953 - DNA, 13 bp, Homo sapiens
ccactttcctctc

SEQ ID NO: 465954 - DNA, 15 bp, Homo sapiens
ccagaacgggcctcc

SEQ ID NO: 465955 - DNA, 15 bp, Homo sapiens
ccagacagagtggat

SEQ ID NO: 465956 - DNA, 14 bp, Homo sapiens
ccagacagggtggg

SEQ ID NO: 465957 - DNA, 12 bp, Homo sapiens
ccagacccctac

SEQ ID NO: 465958 - DNA, 20 bp, Homo sapiens
ccagacccctaccctttccc

SEQ ID NO: 465959 - DNA, 17 bp, Homo sapiens
ccagactcgagagggct

SEQ ID NO: 465960 - DNA, 18 bp, Homo sapiens
ccagactcgagagggctg

SEQ ID NO: 465961 - DNA, 16 bp, Homo sapiens
ccagagactgcccacc

SEQ ID NO: 465962 - DNA, 19 bp, Homo sapiens
ccagagcctatggaaaggg

SEQ ID NO: 465963 - DNA, 19 bp, Homo sapiens
ccagagggggccagaggga

SEQ ID NO: 465964 - DNA, 20 bp, Homo sapiens
ccagagggggccagagggac

SEQ ID NO: 465965 - DNA, 17 bp, Homo sapiens
ccagattattttctata

SEQ ID NO: 465966 - DNA, 23 bp, Homo sapiens
ccagattattttctatatttgga

SEQ ID NO: 465967 - DNA, 15 bp, Homo sapiens
ccagcacatctctga

SEQ ID NO: 465968 - DNA, 16 bp, Homo sapiens
ccagcaccctctcctg

SEQ ID NO: 465969 - DNA, 15 bp, Homo sapiens
ccagcacctttgtaa

SEQ ID NO: 465970 - DNA, 22 bp, Homo sapiens
ccagcactaaggccgtgtctct

SEQ ID NO: 465971 - DNA, 14 bp, Homo sapiens
ccagcactcccagg

SEQ ID NO: 465972 - DNA, 17 bp, Homo sapiens
ccagcactcccagggcc

SEQ ID NO: 465973 - DNA, 18 bp, Homo sapiens
ccagcactcccagggccc

SEQ ID NO: 465974 - DNA, 21 bp, Homo sapiens
ccagcactcccagggcccgag

SEQ ID NO: 465975 - DNA, 13 bp, Homo sapiens
ccagcagtgctgg

SEQ ID NO: 465976 - DNA, 16 bp, Homo sapiens
ccagcagtgctgggcc

SEQ ID NO: 465977 - DNA, 14 bp, Homo sapiens
ccagccgccctggg

SEQ ID NO: 465978 - DNA, 15 bp, Homo sapiens
ccagccgccctgggc

SEQ ID NO: 465979 - DNA, 23 bp, Homo sapiens
ccagccggggtggggtgcctgag

SEQ ID NO: 465980 - DNA, 17 bp, Homo sapiens
ccagcctcccccaggct

SEQ ID NO: 465981 - DNA, 17 bp, Homo sapiens
ccagcctctccccgctc

SEQ ID NO: 465982 - DNA, 12 bp, Homo sapiens
ccagcctgagcc

SEQ ID NO: 465983 - DNA, 15 bp, Homo sapiens
ccagcctgagccaca

SEQ ID NO: 465984 - DNA, 17 bp, Homo sapiens
ccagcctgagccacagt

SEQ ID NO: 465985 - DNA, 18 bp, Homo sapiens
ccagcctgagccacagtg

SEQ ID NO: 465986 - DNA, 23 bp, Homo sapiens
ccagcgtggggctaacgggcgcc

SEQ ID NO: 465987 - DNA, 16 bp, Homo sapiens
ccagctggcagcgcct

SEQ ID NO: 465988 - DNA, 19 bp, Homo sapiens
ccagctggcagcgcctccc

SEQ ID NO: 465989 - DNA, 14 bp, Homo sapiens
ccagctggctgggt

SEQ ID NO: 465990 - DNA, 16 bp, Homo sapiens
ccagctggctgggtcg

SEQ ID NO: 465991 - DNA, 16 bp, Homo sapiens
ccaggagaccctgtct

SEQ ID NO: 465992 - DNA, 19 bp, Homo sapiens
cagcaccctctcctggggg

SEQ ID NO: 465993 - DNA, 21 bp, Homo sapiens
cagcaccgtggtgtgaggccc

SEQ ID NO: 465994 - DNA, 21 bp, Homo sapiens
cagcactaaggccgtgtctct

SEQ ID NO: 465995 - DNA, 22 bp, Homo sapiens
cagcactaaggccgtgtctctg

SEQ ID NO: 465996 - DNA, 13 bp, Homo sapiens
cagcactcccagg

SEQ ID NO: 465997 - DNA, 15 bp, Homo sapiens
cagcactcccagggc

SEQ ID NO: 465998 - DNA, 13 bp, Homo sapiens
cagcagcccccca

SEQ ID NO: 465999 - DNA, 14 bp, Homo sapiens
cagcagccccccag

SEQ ID NO: 466000 - DNA, 22 bp, Homo sapiens
cagcaggggggttgggttccag

SEQ ID NO: 466001 - DNA, 22 bp, Homo sapiens
cagcagtaccatcccactgata

SEQ ID NO: 466002 - DNA, 21 bp, Homo sapiens
cagcagtacttgctcaataaa

SEQ ID NO: 466003 - DNA, 11 bp, Homo sapiens
cagcagtgctg

SEQ ID NO: 466004 - DNA, 14 bp, Homo sapiens
cagcagtgctgggc

SEQ ID NO: 466005 - DNA, 15 bp, Homo sapiens
cagcagtgctgggcc

SEQ ID NO: 466006 - DNA, 16 bp, Homo sapiens
cagcagtgctgggccc

SEQ ID NO: 466007 - DNA, 17 bp, Homo sapiens
cagcagtgctgggccca

SEQ ID NO: 466008 - DNA, 16 bp, Homo sapiens
cagcatagttctgcaa

SEQ ID NO: 466009 - DNA, 15 bp, Homo sapiens
cagcatgtctactgc

SEQ ID NO: 466010 - DNA, 22 bp, Homo sapiens
cagcattcaaaatagttctatt

SEQ ID NO: 466011 - DNA, 13 bp, Homo sapiens
cagccaaagaaac

SEQ ID NO: 466012 - DNA, 15 bp, Homo sapiens
cagccaaagaaactc

SEQ ID NO: 466013 - DNA, 16 bp, Homo sapiens
cagccaaagaaactca

SEQ ID NO: 466014 - DNA, 22 bp, Homo sapiens
cagccaaagaaactcagaagag

SEQ ID NO: 466015 - DNA, 14 bp, Homo sapiens
cagccagccgccct

SEQ ID NO: 466016 - DNA, 18 bp, Homo sapiens
cagccagccgccctgggc

SEQ ID NO: 466017 - DNA, 19 bp, Homo sapiens
cagccagccgccctgggct

SEQ ID NO: 466018 - DNA, 20 bp, Homo sapiens
cagcccagaacgggcctccc

SEQ ID NO: 466019 - DNA, 14 bp, Homo sapiens
cagcccctgctgga

SEQ ID NO: 466020 - DNA, 17 bp, Homo sapiens
cagcccctgctggacca

SEQ ID NO: 466021 - DNA, 13 bp, Homo sapiens
cagccctccctgc

SEQ ID NO: 466022 - DNA, 18 bp, Homo sapiens
cagccctccctgcccctc

SEQ ID NO: 466023 - DNA, 13 bp, Homo sapiens
cagccctctccac

SEQ ID NO: 466024 - DNA, 15 bp, Homo sapiens
cagccctctccaccc

SEQ ID NO: 466025 - DNA, 23 bp, Homo sapiens
cagccctgctttgggctgccctg

SEQ ID NO: 466026 - DNA, 16 bp, Homo sapiens
cagccgccctgggctg

SEQ ID NO: 466027 - DNA, 14 bp, Homo sapiens
cagccgcgctctgc

SEQ ID NO: 466028 - DNA, 15 bp, Homo sapiens
cagccgcgctctgcc

SEQ ID NO: 466029 - DNA, 17 bp, Homo sapiens
cagccgcgctctgcccc

SEQ ID NO: 466030 - DNA, 22 bp, Homo sapiens
cagccgcgctctgcccctccgt

SEQ ID NO: 466031 - DNA, 14 bp, Homo sapiens
cagccggggtgggg

SEQ ID NO: 466032 - DNA, 15 bp, Homo sapiens
cagccggggtggggt

SEQ ID NO: 466033 - DNA, 23 bp, Homo sapiens
cagccggggtggggtgcctgagc

SEQ ID NO: 466034 - DNA, 11 bp, Homo sapiens
cagcctccccc

SEQ ID NO: 466035 - DNA, 17 bp, Homo sapiens
cagcctcccccaggctg

SEQ ID NO: 466036 - DNA, 16 bp, Homo sapiens
cagcctcctaggctcc

SEQ ID NO: 466037 - DNA, 17 bp, Homo sapiens
cagcctcctaggctccc

SEQ ID NO: 466038 - DNA, 19 bp, Homo sapiens
cagcctcctaggctccctg

SEQ ID NO: 466039 - DNA, 21 bp, Homo sapiens
cagcctcctaggctccctgag

SEQ ID NO: 466040 - DNA, 15 bp, Homo sapiens
cagcctgagctccac

SEQ ID NO: 466041 - DNA, 20 bp, Homo sapiens
cagcctgagctccaccctcc

SEQ ID NO: 466042 - DNA, 21 bp, Homo sapiens
cagcctgagctccaccctccc

SEQ ID NO: 466043 - DNA, 10 bp, Homo sapiens
cagcctggca

SEQ ID NO: 466044 - DNA, 13 bp, Homo sapiens
cagccttaagaaa

SEQ ID NO: 466045 - DNA, 16 bp, Homo sapiens
cagcctttgcgctctg

SEQ ID NO: 466046 - DNA, 13 bp, Homo sapiens
cagcgcctcccgc

SEQ ID NO: 466047 - DNA, 15 bp, Homo sapiens
cagcgcctcccgccg

SEQ ID NO: 466048 - DNA, 21 bp, Homo sapiens
cagcgcctcccgccgcctcgg

SEQ ID NO: 466049 - DNA, 22 bp, Homo sapiens
cagcgcctcccgccgcctcggg

SEQ ID NO: 466050 - DNA, 15 bp, Homo sapiens
cagcggcccggccca

SEQ ID NO: 466051 - DNA, 19 bp, Homo sapiens
cagcggcccggcccacgca

SEQ ID NO: 466052 - DNA, 22 bp, Homo sapiens
cagcggcccggcccacgcagag

SEQ ID NO: 466053 - DNA, 19 bp, Homo sapiens
cagctaatcagcattctca

SEQ ID NO: 466054 - DNA, 14 bp, Homo sapiens
cagctatctgtcat

SEQ ID NO: 466055 - DNA, 23 bp, Homo sapiens
cagctccactctgaagtcccttc

SEQ ID NO: 466056 - DNA, 12 bp, Homo sapiens
cagctctaaagc

SEQ ID NO: 466057 - DNA, 14 bp, Homo sapiens
cagctggcagcgcc

SEQ ID NO: 466058 - DNA, 15 bp, Homo sapiens
cagctggcagcgcct

SEQ ID NO: 466059 - DNA, 13 bp, Homo sapiens
cagcttcaaaaca

SEQ ID NO: 466060 - DNA, 23 bp, Homo sapiens
cagcttgaatgtccccattctat

SEQ ID NO: 466061 - DNA, 12 bp, Homo sapiens
caggaaaataac

SEQ ID NO: 466062 - DNA, 14 bp, Homo sapiens
caggaaaataacag

SEQ ID NO: 466063 - DNA, 14 bp, Homo sapiens
caggaaagatccca

SEQ ID NO: 466064 - DNA, 14 bp, Homo sapiens
caggaaagccctcc

SEQ ID NO: 466065 - DNA, 23 bp, Homo sapiens
caggaaagccctcccccttcccc

SEQ ID NO: 466066 - DNA, 21 bp, Homo sapiens
caggacacgaaggctgcccct

SEQ ID NO: 466067 - DNA, 23 bp, Homo sapiens
caggacacgaaggctgcccctgt

SEQ ID NO: 466068 - DNA, 15 bp, Homo sapiens
caggagaccctgtct

SEQ ID NO: 466069 - DNA, 23 bp, Homo sapiens
caggattaatctctaaaattcta

SEQ ID NO: 466070 - DNA, 17 bp, Homo sapiens
caggcacacagcagccc

SEQ ID NO: 466071 - DNA, 21 bp, Homo sapiens
caggcacacagcagcccccca

SEQ ID NO: 466072 - DNA, 16 bp, Homo sapiens
caggccctccctgact

SEQ ID NO: 466073 - DNA, 20 bp, Homo sapiens
caggccctccctgactccct

SEQ ID NO: 466074 - DNA, 23 bp, Homo sapiens
caggcccttcctctccactgcct

SEQ ID NO: 466075 - DNA, 17 bp, Homo sapiens
caggcgcgcaccgccca

SEQ ID NO: 466076 - DNA, 17 bp, Homo sapiens
caggcggaggggcttgg

SEQ ID NO: 466077 - DNA, 22 bp, Homo sapiens
caggctcttctcctttcacaac

SEQ ID NO: 466078 - DNA, 16 bp, Homo sapiens
caggctgcgcctgccc

SEQ ID NO: 466079 - DNA, 20 bp, Homo sapiens
caggctgcgcctgcccgccc

SEQ ID NO: 466080 - DNA, 23 bp, Homo sapiens
caggctgcgcctgcccgcccgcc

SEQ ID NO: 466081 - DNA, 12 bp, Homo sapiens
caggctggggcc

SEQ ID NO: 466082 - DNA, 15 bp, Homo sapiens
caggctggggcctgg

SEQ ID NO: 466083 - DNA, 11 bp, Homo sapiens
caggctttcta

SEQ ID NO: 466084 - DNA, 12 bp, Homo sapiens
cagggacccccg

SEQ ID NO: 466085 - DNA, 18 bp, Homo sapiens
cagggacccccgaggccc

SEQ ID NO: 466086 - DNA, 22 bp, Homo sapiens
cagggacccccgaggcccccct

SEQ ID NO: 466087 - DNA, 23 bp, Homo sapiens
cagggacccccgaggcccccctc

SEQ ID NO: 466088 - DNA, 19 bp, Homo sapiens
cagggagggaacagacctc

SEQ ID NO: 466089 - DNA, 17 bp, Homo sapiens
cagggatgggggatggg

SEQ ID NO: 466090 - DNA, 16 bp, Homo sapiens
ggctcttctcctttca

SEQ ID NO: 466091 - DNA, 23 bp, Homo sapiens
ggctcttctcctttcacaacctt

SEQ ID NO: 466092 - DNA, 18 bp, Homo sapiens
ggctgagcccctcctctc

SEQ ID NO: 466093 - DNA, 19 bp, Homo sapiens
ggctgagcccctcctctcc

SEQ ID NO: 466094 - DNA, 13 bp, Homo sapiens
ggctgccctggtg

SEQ ID NO: 466095 - DNA, 14 bp, Homo sapiens
ggctgccctggtgc

SEQ ID NO: 466096 - DNA, 22 bp, Homo sapiens
ggctgccctggtgctgccacac

SEQ ID NO: 466097 - DNA, 16 bp, Homo sapiens
ggctggatgtgctttc

SEQ ID NO: 466098 - DNA, 12 bp, Homo sapiens
ggctggccctgc

SEQ ID NO: 466099 - DNA, 13 bp, Homo sapiens
ggctggccctgcc

SEQ ID NO: 466100 - DNA, 18 bp, Homo sapiens
ggctggccctgccctccc

SEQ ID NO: 466101 - DNA, 22 bp, Homo sapiens
ggctggccctgccctcccccac

SEQ ID NO: 466102 - DNA, 13 bp, Homo sapiens
ggctgggcagggc

SEQ ID NO: 466103 - DNA, 13 bp, Homo sapiens
ggctgggcccctg

SEQ ID NO: 466104 - DNA, 15 bp, Homo sapiens
ggctgggcccctggg

SEQ ID NO: 466105 - DNA, 17 bp, Homo sapiens
ggctggggcctggccta

SEQ ID NO: 466106 - DNA, 17 bp, Homo sapiens
ggctgggtcgcccctcc

SEQ ID NO: 466107 - DNA, 16 bp, Homo sapiens
ggctgtattttctttt

SEQ ID NO: 466108 - DNA, 14 bp, Homo sapiens
ggctgtctgtcacc

SEQ ID NO: 466109 - DNA, 14 bp, Homo sapiens
ggctgtggcccctc

SEQ ID NO: 466110 - DNA, 15 bp, Homo sapiens
ggctgtggcccctcc

SEQ ID NO: 466111 - DNA, 16 bp, Homo sapiens
ggctgtggcccctcct

SEQ ID NO: 466112 - DNA, 17 bp, Homo sapiens
ggctgtggcccctcctt

SEQ ID NO: 466113 - DNA, 21 bp, Homo sapiens
ggctgtggcccctccttctcc

SEQ ID NO: 466114 - DNA, 14 bp, Homo sapiens
ggcttaaacatttt

SEQ ID NO: 466115 - DNA, 15 bp, Homo sapiens
ggcttccatggtggt

SEQ ID NO: 466116 - DNA, 14 bp, Homo sapiens
ggcttcccgctcag

SEQ ID NO: 466117 - DNA, 19 bp, Homo sapiens
ggcttcccgctcagccctc

SEQ ID NO: 466118 - DNA, 21 bp, Homo sapiens
ggcttcccgctcagccctccc

SEQ ID NO: 466119 - DNA, 22 bp, Homo sapiens
ggcttcccgctcagccctccct

SEQ ID NO: 466120 - DNA, 16 bp, Homo sapiens
ggcttggaagggcgct

SEQ ID NO: 466121 - DNA, 15 bp, Homo sapiens
ggcttggggtagaga

SEQ ID NO: 466122 - DNA, 18 bp, Homo sapiens
ggcttggggtagagagga

SEQ ID NO: 466123 - DNA, 20 bp, Homo sapiens
ggcttggggtagagaggaca

SEQ ID NO: 466124 - DNA, 16 bp, Homo sapiens
ggcttgtagggtgagg

SEQ ID NO: 466125 - DNA, 15 bp, Homo sapiens
ggcttttcactgctg

SEQ ID NO: 466126 - DNA, 22 bp, Homo sapiens
ggcttttcactgctggctgcct

SEQ ID NO: 466127 - DNA, 14 bp, Homo sapiens
gggaaattcttgca

SEQ ID NO: 466128 - DNA, 22 bp, Homo sapiens
gggaagcccacccgccccagag

SEQ ID NO: 466129 - DNA, 18 bp, Homo sapiens
gggacagcggcccggccc

SEQ ID NO: 466130 - DNA, 23 bp, Homo sapiens
gggacccccggcctccaggctgg

SEQ ID NO: 466131 - DNA, 16 bp, Homo sapiens
gggactgcatgcaagc

SEQ ID NO: 466132 - DNA, 15 bp, Homo sapiens
gggactggcccaccc

SEQ ID NO: 466133 - DNA, 22 bp, Homo sapiens
gggactggcccacccctcttcc

SEQ ID NO: 466134 - DNA, 22 bp, Homo sapiens
gggactgtcttcaaccctgccc

SEQ ID NO: 466135 - DNA, 20 bp, Homo sapiens
gggagaacctcgttgacatg

SEQ ID NO: 466136 - DNA, 23 bp, Homo sapiens
gggagattaaaaccagagagaaa

SEQ ID NO: 466137 - DNA, 23 bp, Homo sapiens
gggagtccactttcctctctctc

SEQ ID NO: 466138 - DNA, 13 bp, Homo sapiens
gggatccagagag

SEQ ID NO: 466139 - DNA, 17 bp, Homo sapiens
gggatctaaaaggagga

SEQ ID NO: 466140 - DNA, 13 bp, Homo sapiens
gggcacgggagag

SEQ ID NO: 466141 - DNA, 17 bp, Homo sapiens
gggcacgggagagcgcc

SEQ ID NO: 466142 - DNA, 23 bp, Homo sapiens
gggcacgggagagcgccacccgc

SEQ ID NO: 466143 - DNA, 13 bp, Homo sapiens
gggcactggtggc

SEQ ID NO: 466144 - DNA, 20 bp, Homo sapiens
gggcagagctgagtcggctg

SEQ ID NO: 466145 - DNA, 17 bp, Homo sapiens
gggcagcaccctccccc

SEQ ID NO: 466146 - DNA, 14 bp, Homo sapiens
gggcagcccctccc

SEQ ID NO: 466147 - DNA, 18 bp, Homo sapiens
ggatgggaagaaaaagga

SEQ ID NO: 466148 - DNA, 19 bp, Homo sapiens
ggatgggggatgggccagg

SEQ ID NO: 466149 - DNA, 18 bp, Homo sapiens
ggatgtcttgagatgtat

SEQ ID NO: 466150 - DNA, 13 bp, Homo sapiens
ggattatctacta

SEQ ID NO: 466151 - DNA, 11 bp, Homo sapiens
ggattcaaatg

SEQ ID NO: 466152 - DNA, 13 bp, Homo sapiens
ggattcacttcta

SEQ ID NO: 466153 - DNA, 15 bp, Homo sapiens
ggattcatgtccaga

SEQ ID NO: 466154 - DNA, 19 bp, Homo sapiens
ggattcttttttcaatgta

SEQ ID NO: 466155 - DNA, 15 bp, Homo sapiens
ggcaaaaaagaacag

SEQ ID NO: 466156 - DNA, 20 bp, Homo sapiens
ggcaacaaaggatggctctg

SEQ ID NO: 466157 - DNA, 20 bp, Homo sapiens
ggcaagagctcaggagaagg

SEQ ID NO: 466158 - DNA, 14 bp, Homo sapiens
ggcacacagcagcc

SEQ ID NO: 466159 - DNA, 16 bp, Homo sapiens
ggcacagggcagtggg

SEQ ID NO: 466160 - DNA, 15 bp, Homo sapiens
ggcacgggagagcgc

SEQ ID NO: 466161 - DNA, 16 bp, Homo sapiens
ggcacgggagagcgcc

SEQ ID NO: 466162 - DNA, 19 bp, Homo sapiens
ggcacgggagagcgccacc

SEQ ID NO: 466163 - DNA, 22 bp, Homo sapiens
ggcacgggagagcgccacccgc

SEQ ID NO: 466164 - DNA, 21 bp, Homo sapiens
ggcagagattgggggggcttg

SEQ ID NO: 466165 - DNA, 13 bp, Homo sapiens
ggcagcaccctcc

SEQ ID NO: 466166 - DNA, 14 bp, Homo sapiens
ggcagcaccctccc

SEQ ID NO: 466167 - DNA, 16 bp, Homo sapiens
ggcagcaccctccccc

SEQ ID NO: 466168 - DNA, 19 bp, Homo sapiens
ggcagcaccctcccccgca

SEQ ID NO: 466169 - DNA, 21 bp, Homo sapiens
ggcagccccatccttcccgca

SEQ ID NO: 466170 - DNA, 22 bp, Homo sapiens
ggcagccccatccttcccgcag

SEQ ID NO: 466171 - DNA, 23 bp, Homo sapiens
ggcagccccatccttcccgcagc

SEQ ID NO: 466172 - DNA, 11 bp, Homo sapiens
ggcagcccctc

SEQ ID NO: 466173 - DNA, 12 bp, Homo sapiens
ggcagcccctcc

SEQ ID NO: 466174 - DNA, 14 bp, Homo sapiens
ggcagcccctgctg

SEQ ID NO: 466175 - DNA, 19 bp, Homo sapiens
ggcagcccctgctggacca

SEQ ID NO: 466176 - DNA, 14 bp, Homo sapiens
ggcaggagctgctg

SEQ ID NO: 466177 - DNA, 20 bp, Homo sapiens
ggcaggcacacagcagcccc

SEQ ID NO: 466178 - DNA, 22 bp, Homo sapiens
ggcaggcacacagcagcccccc

SEQ ID NO: 466179 - DNA, 23 bp, Homo sapiens
ggcagggccctggggtctctgag

SEQ ID NO: 466180 - DNA, 16 bp, Homo sapiens
ggcagggccgcagggc

SEQ ID NO: 466181 - DNA, 17 bp, Homo sapiens
ggcagggccgcagggcg

SEQ ID NO: 466182 - DNA, 15 bp, Homo sapiens
ggcaggtcctgccca

SEQ ID NO: 466183 - DNA, 19 bp, Homo sapiens
ggcaggtcctgcccatgtg

SEQ ID NO: 466184 - DNA, 14 bp, Homo sapiens
ggcagtggagaggg

SEQ ID NO: 466185 - DNA, 18 bp, Homo sapiens
ggcatggccaggtggcca

SEQ ID NO: 466186 - DNA, 19 bp, Homo sapiens
ggccacccttggcctgtcc

SEQ ID NO: 466187 - DNA, 14 bp, Homo sapiens
ggccagacgctgcc

SEQ ID NO: 466188 - DNA, 13 bp, Homo sapiens
ggccagcaccctc

SEQ ID NO: 466189 - DNA, 17 bp, Homo sapiens
ggccagcaccctctcct

SEQ ID NO: 466190 - DNA, 19 bp, Homo sapiens
ggccagcaccctctcctgg

SEQ ID NO: 466191 - DNA, 19 bp, Homo sapiens
ggccaggtggccactccag

SEQ ID NO: 466192 - DNA, 14 bp, Homo sapiens
ggccagtactttgc

SEQ ID NO: 466193 - DNA, 13 bp, Homo sapiens
ggccatccctggg

SEQ ID NO: 466194 - DNA, 14 bp, Homo sapiens
ggcccaaataacag

SEQ ID NO: 466195 - DNA, 21 bp, Homo sapiens
ggcccaaataacagtggcaag

SEQ ID NO: 466196 - DNA, 12 bp, Homo sapiens
ggcccacccctc

SEQ ID NO: 466197 - DNA, 16 bp, Homo sapiens
ggcccacgcagagccc

SEQ ID NO: 466198 - DNA, 20 bp, Homo sapiens
ggcccacgcagagccccgga

SEQ ID NO: 466199 - DNA, 22 bp, Homo sapiens
ggcccacgcagagccccggagc

SEQ ID NO: 466200 - DNA, 19 bp, Homo sapiens
ggcccagccggggtggggt

SEQ ID NO: 466201 - DNA, 13 bp, Homo sapiens
ggcccatggcccc

SEQ ID NO: 466202 - DNA, 15 bp, Homo sapiens
ggcccatggccccag

SEQ ID NO: 466203 - DNA, 18 bp, Homo sapiens
ggcccatggccccagctg

SEQ ID NO: 466204 - DNA, 19 bp, Homo sapiens
ggcccatggccccagctgg

SEQ ID NO: 466205 - DNA, 20 bp, Homo sapiens
ggcccatggccccagctggc

SEQ ID NO: 466206 - DNA, 21 bp, Homo sapiens
ggccccacccaccctctggtc

SEQ ID NO: 466207 - DNA, 17 bp, Homo sapiens
ggccccagcctccaggc

SEQ ID NO: 466208 - DNA, 18 bp, Homo sapiens
ggccccagctggctgggt

SEQ ID NO: 466209 - DNA, 20 bp, Homo sapiens
ggcccccggaggcgcccacc

SEQ ID NO: 466210 - DNA, 18 bp, Homo sapiens
ggccccgcgcgtgccccc

SEQ ID NO: 466211 - DNA, 19 bp, Homo sapiens
ggccccgcgcgtgccccca

SEQ ID NO: 466212 - DNA, 20 bp, Homo sapiens
ggccccgcgcgtgcccccag

SEQ ID NO: 466213 - DNA, 18 bp, Homo sapiens
ggcccctccacgcctcct

SEQ ID NO: 466214 - DNA, 23 bp, Homo sapiens
ggcccctccacgcctcctggcca

SEQ ID NO: 466215 - DNA, 11 bp, Homo sapiens
ggcccctcctt

SEQ ID NO: 466216 - DNA, 15 bp, Homo sapiens
ggcccctccttctcc

SEQ ID NO: 466217 - DNA, 23 bp, Homo sapiens
ggcccctccttctcccctccaga

SEQ ID NO: 466218 - DNA, 14 bp, Homo sapiens
ggcccctgccttgg

SEQ ID NO: 466219 - DNA, 13 bp, Homo sapiens
ggcccctgggatg

SEQ ID NO: 466220 - DNA, 22 bp, Homo sapiens
ggcccctgggatgggaccaggg

SEQ ID NO: 466221 - DNA, 16 bp, Homo sapiens
ggcccgacagcctggc

SEQ ID NO: 466222 - DNA, 17 bp, Homo sapiens
ggcccgacagcctggca

SEQ ID NO: 466223 - DNA, 15 bp, Homo sapiens
ggcccgagcgcgtgc

SEQ ID NO: 466224 - DNA, 20 bp, Homo sapiens
ggcccgctcaacctctcaga

SEQ ID NO: 466225 - DNA, 13 bp, Homo sapiens
ggcccggcccacg

SEQ ID NO: 466226 - DNA, 14 bp, Homo sapiens
ggcccggcccacgc

SEQ ID NO: 466227 - DNA, 15 bp, Homo sapiens
ggcccggcccacgca

SEQ ID NO: 466228 - DNA, 17 bp, Homo sapiens
ggcccggcccacgcaga

SEQ ID NO: 466229 - DNA, 21 bp, Homo sapiens
ggcccggcccacgcagagccc

SEQ ID NO: 466230 - DNA, 20 bp, Homo sapiens
ggcccgtgcgcagccgcgct

SEQ ID NO: 466231 - DNA, 19 bp, Homo sapiens
ggccctccctgactccctg

SEQ ID NO: 466232 - DNA, 21 bp, Homo sapiens
ggccctccctgactccctgtg

SEQ ID NO: 466233 - DNA, 22 bp, Homo sapiens
ggccctccctgactccctgtgg

SEQ ID NO: 466234 - DNA, 15 bp, Homo sapiens
ggccctgccctcccc

SEQ ID NO: 466235 - DNA, 19 bp, Homo sapiens
ggccctgccctcccccacg

SEQ ID NO: 466236 - DNA, 17 bp, Homo sapiens
ggccctggggtctctga

SEQ ID NO: 466237 - DNA, 20 bp, Homo sapiens
ggccctggggtctctgagca

SEQ ID NO: 466238 - DNA, 12 bp, Homo sapiens
ggccctgtggga

SEQ ID NO: 466239 - DNA, 13 bp, Homo sapiens
ggcccttcctctc

SEQ ID NO: 466240 - DNA, 17 bp, Homo sapiens
ggcccttcctctccact

SEQ ID NO: 466241 - DNA, 19 bp, Homo sapiens
ggcccttcctctccactgc

SEQ ID NO: 466242 - DNA, 22 bp, Homo sapiens
ggcccttcctctccactgcctt

SEQ ID NO: 466243 - DNA, 12 bp, Homo sapiens
ggccgcagggcg

SEQ ID NO: 466244 - DNA, 13 bp, Homo sapiens
ggccgcctcctcc

SEQ ID NO: 466245 - DNA, 19 bp, Homo sapiens
gggctgagcccctcctctc

SEQ ID NO: 466246 - DNA, 14 bp, Homo sapiens
gggctgccctggtg

SEQ ID NO: 466247 - DNA, 15 bp, Homo sapiens
gggctgccctggtgc

SEQ ID NO: 466248 - DNA, 14 bp, Homo sapiens
gggctgtctgtcac

SEQ ID NO: 466249 - DNA, 15 bp, Homo sapiens
gggcttagaatgggg

SEQ ID NO: 466250 - DNA, 14 bp, Homo sapiens
gggcttggagcaga

SEQ ID NO: 466251 - DNA, 13 bp, Homo sapiens
gggcttggggtag

SEQ ID NO: 466252 - DNA, 21 bp, Homo sapiens
gggcttggggtagagaggaca

SEQ ID NO: 466253 - DNA, 14 bp, Homo sapiens
ggggagaatggctc

SEQ ID NO: 466254 - DNA, 16 bp, Homo sapiens
ggggagaatggctctg

SEQ ID NO: 466255 - DNA, 13 bp, Homo sapiens
ggggaggagcacc

SEQ ID NO: 466256 - DNA, 22 bp, Homo sapiens
ggggatctaaaaggaggacagg

SEQ ID NO: 466257 - DNA, 14 bp, Homo sapiens
ggggcagagctgag

SEQ ID NO: 466258 - DNA, 17 bp, Homo sapiens
ggggcccatggccccag

SEQ ID NO: 466259 - DNA, 18 bp, Homo sapiens
ggggccctgggcctcagt

SEQ ID NO: 466260 - DNA, 17 bp, Homo sapiens
ggggccgggcaggtcct

SEQ ID NO: 466261 - DNA, 15 bp, Homo sapiens
ggggctaactggccc

SEQ ID NO: 466262 - DNA, 16 bp, Homo sapiens
ggggctaactggcccc

SEQ ID NO: 466263 - DNA, 11 bp, Homo sapiens
ggggctggccc

SEQ ID NO: 466264 - DNA, 15 bp, Homo sapiens
ggggctggccctgcc

SEQ ID NO: 466265 - DNA, 19 bp, Homo sapiens
ggggctggccctgccctcc

SEQ ID NO: 466266 - DNA, 20 bp, Homo sapiens
ggggctggccctgccctccc

SEQ ID NO: 466267 - DNA, 23 bp, Homo sapiens
ggggctggccctgccctccccca

SEQ ID NO: 466268 - DNA, 18 bp, Homo sapiens
ggggcttccatggtggtt

SEQ ID NO: 466269 - DNA, 16 bp, Homo sapiens
ggggcttggagcagag

SEQ ID NO: 466270 - DNA, 24 bp, Homo sapiens
ggggcttggagcagagacggcagc

SEQ ID NO: 466271 - DNA, 15 bp, Homo sapiens
gggggaggagcaccc

SEQ ID NO: 466272 - DNA, 17 bp, Homo sapiens
gggggattcaaatgcat

SEQ ID NO: 466273 - DNA, 18 bp, Homo sapiens
gggggattcaaatgcatg

SEQ ID NO: 466274 - DNA, 21 bp, Homo sapiens
gggggcaagagctcaggagaa

SEQ ID NO: 466275 - DNA, 12 bp, Homo sapiens
gggggccgggca

SEQ ID NO: 466276 - DNA, 12 bp, Homo sapiens
gggggctccaga

SEQ ID NO: 466277 - DNA, 12 bp, Homo sapiens
gggggtggcagg

SEQ ID NO: 466278 - DNA, 15 bp, Homo sapiens
gggggttgggttcca

SEQ ID NO: 466279 - DNA, 21 bp, Homo sapiens
ggggtcgggggaggagcaccc

SEQ ID NO: 466280 - DNA, 15 bp, Homo sapiens
ggggtctctgagcag

SEQ ID NO: 466281 - DNA, 21 bp, Homo sapiens
ggggtgagacagtgggggtgc

SEQ ID NO: 466282 - DNA, 22 bp, Homo sapiens
ggggtgcctggtgcgctgtgct

SEQ ID NO: 466283 - DNA, 15 bp, Homo sapiens
ggggtggggcttgga

SEQ ID NO: 466284 - DNA, 16 bp, Homo sapiens
gggtcgggggaggagc

SEQ ID NO: 466285 - DNA, 22 bp, Homo sapiens
gggtctctgagcagtggggagc

SEQ ID NO: 466286 - DNA, 15 bp, Homo sapiens
gggtgcaggcgcgca

SEQ ID NO: 466287 - DNA, 22 bp, Homo sapiens
gggtgcaggcgcgcaccgccca

SEQ ID NO: 466288 - DNA, 12 bp, Homo sapiens
gggtgcctgagc

SEQ ID NO: 466289 - DNA, 15 bp, Homo sapiens
gggtgcctgagcccg

SEQ ID NO: 466290 - DNA, 13 bp, Homo sapiens
gggtgcctggtgc

SEQ ID NO: 466291 - DNA, 18 bp, Homo sapiens
gggtgcgtgaccggcccg

SEQ ID NO: 466292 - DNA, 20 bp, Homo sapiens
gggtgcgtgaccggcccgcc

SEQ ID NO: 466293 - DNA, 13 bp, Homo sapiens
gggtgtggcctca

SEQ ID NO: 466294 - DNA, 16 bp, Homo sapiens
gggttgggttccagac

SEQ ID NO: 466295 - DNA, 13 bp, Homo sapiens
gggttgttgcaga

SEQ ID NO: 466296 - DNA, 14 bp, Homo sapiens
gggtttgggcagtg

SEQ ID NO: 466297 - DNA, 16 bp, Homo sapiens
ggtacctttccaccca

SEQ ID NO: 466298 - DNA, 12 bp, Homo sapiens
ggtagagaggac

SEQ ID NO: 466299 - DNA, 18 bp, Homo sapiens
ggtagatgagaaaacagg

SEQ ID NO: 466300 - DNA, 21 bp, Homo sapiens
ggtatctgctgcctctgaaaa

SEQ ID NO: 466301 - DNA, 15 bp, Homo sapiens
ggtatgctggccagc

SEQ ID NO: 466302 - DNA, 20 bp, Homo sapiens
ggtatgctggccagcaccct

SEQ ID NO: 466303 - DNA, 15 bp, Homo sapiens
ggtccaccccgtccc

SEQ ID NO: 466304 - DNA, 18 bp, Homo sapiens
ggtccaccccgtcccggc

SEQ ID NO: 466305 - DNA, 20 bp, Homo sapiens
ggtccccggacgctggctcg

SEQ ID NO: 466306 - DNA, 17 bp, Homo sapiens
gctgggcccctgggatg

SEQ ID NO: 466307 - DNA, 12 bp, Homo sapiens
gctggggcctgg

SEQ ID NO: 466308 - DNA, 12 bp, Homo sapiens
gctgggtcgccc

SEQ ID NO: 466309 - DNA, 14 bp, Homo sapiens
gctgggtcgcccct

SEQ ID NO: 466310 - DNA, 21 bp, Homo sapiens
gctgggtttgggcagtggaga

SEQ ID NO: 466311 - DNA, 15 bp, Homo sapiens
gctggtaactgttaa

SEQ ID NO: 466312 - DNA, 14 bp, Homo sapiens
gctgtaatgtaaca

SEQ ID NO: 466313 - DNA, 14 bp, Homo sapiens
gctgtacagatatc

SEQ ID NO: 466314 - DNA, 16 bp, Homo sapiens
gctgtcctccagggcg

SEQ ID NO: 466315 - DNA, 19 bp, Homo sapiens
gctgtcctctcgagcccag

SEQ ID NO: 466316 - DNA, 14 bp, Homo sapiens
gctgtcgccccagg

SEQ ID NO: 466317 - DNA, 18 bp, Homo sapiens
gctgtcgccccaggccct

SEQ ID NO: 466318 - DNA, 14 bp, Homo sapiens
gctgtgaatttttt

SEQ ID NO: 466319 - DNA, 14 bp, Homo sapiens
gctgtggcccctcc

SEQ ID NO: 466320 - DNA, 18 bp, Homo sapiens
gctgtggcccctccttct

SEQ ID NO: 466321 - DNA, 22 bp, Homo sapiens
gcttaacataaacttgtactta

SEQ ID NO: 466322 - DNA, 14 bp, Homo sapiens
gcttaagcctgtgt

SEQ ID NO: 466323 - DNA, 15 bp, Homo sapiens
gcttagaggagctct

SEQ ID NO: 466324 - DNA, 10 bp, Homo sapiens
gcttccagat

SEQ ID NO: 466325 - DNA, 21 bp, Homo sapiens
gcttccatggtggtttcagaa

SEQ ID NO: 466326 - DNA, 17 bp, Homo sapiens
gcttcccgctcagccct

SEQ ID NO: 466327 - DNA, 17 bp, Homo sapiens
gcttccgtgagacacaa

SEQ ID NO: 466328 - DNA, 22 bp, Homo sapiens
gcttgaatgtccccattctata

SEQ ID NO: 466329 - DNA, 21 bp, Homo sapiens
gcttggagcagagacggcagc

SEQ ID NO: 466330 - DNA, 20 bp, Homo sapiens
gcttgtttaaggttcttgct

SEQ ID NO: 466331 - DNA, 21 bp, Homo sapiens
gctttctattggcatggattt

SEQ ID NO: 466332 - DNA, 13 bp, Homo sapiens
gctttctcatgca

SEQ ID NO: 466333 - DNA, 15 bp, Homo sapiens
gctttgggctgccct

SEQ ID NO: 466334 - DNA, 15 bp, Homo sapiens
gctttgtgtgattga

SEQ ID NO: 466335 - DNA, 21 bp, Homo sapiens
gctttgtttaacccaaaagat

SEQ ID NO: 466336 - DNA, 12 bp, Homo sapiens
gcttttcactgc

SEQ ID NO: 466337 - DNA, 18 bp, Homo sapiens
gcttttttctcaataaaa

SEQ ID NO: 466338 - DNA, 16 bp, Homo sapiens
ggaaaaaaatgcgtat

SEQ ID NO: 466339 - DNA, 22 bp, Homo sapiens
ggaaaaccaagccgtggcttcc

SEQ ID NO: 466340 - DNA, 19 bp, Homo sapiens
ggaaaataacagagctgga

SEQ ID NO: 466341 - DNA, 16 bp, Homo sapiens
ggaaagccctccccct

SEQ ID NO: 466342 - DNA, 13 bp, Homo sapiens
ggaaatcaattta

SEQ ID NO: 466343 - DNA, 22 bp, Homo sapiens
ggaaatcaatttaaaggaaagt

SEQ ID NO: 466344 - DNA, 21 bp, Homo sapiens
ggaaattcttgcactgtatcc

SEQ ID NO: 466345 - DNA, 19 bp, Homo sapiens
ggaacagccaaagaaactc

SEQ ID NO: 466346 - DNA, 12 bp, Homo sapiens
ggaaccttccct

SEQ ID NO: 466347 - DNA, 23 bp, Homo sapiens
ggaagaacaaatatgattctcct

SEQ ID NO: 466348 - DNA, 15 bp, Homo sapiens
ggaagagatgctcta

SEQ ID NO: 466349 - DNA, 12 bp, Homo sapiens
ggaagcccaccc

SEQ ID NO: 466350 - DNA, 22 bp, Homo sapiens
ggaagcccacccgccccagaga

SEQ ID NO: 466351 - DNA, 19 bp, Homo sapiens
ggaaggcctgagggaagcc

SEQ ID NO: 466352 - DNA, 22 bp, Homo sapiens
ggaaggcctgagggaagcccac

SEQ ID NO: 466353 - DNA, 13 bp, Homo sapiens
ggaaggctttatt

SEQ ID NO: 466354 - DNA, 16 bp, Homo sapiens
ggaagtacataaagta

SEQ ID NO: 466355 - DNA, 17 bp, Homo sapiens
ggaagtggcctgagaag

SEQ ID NO: 466356 - DNA, 22 bp, Homo sapiens
ggacactgatgggtcctgctgc

SEQ ID NO: 466357 - DNA, 23 bp, Homo sapiens
ggacactgatgggtcctgctgct

SEQ ID NO: 466358 - DNA, 24 bp, Homo sapiens
ggacactgatgggtcctgctgctc

SEQ ID NO: 466359 - DNA, 20 bp, Homo sapiens
ggacagaaccaacgggtctg

SEQ ID NO: 466360 - DNA, 20 bp, Homo sapiens
ggacagaggagcaaggttta

SEQ ID NO: 466361 - DNA, 15 bp, Homo sapiens
ggacagcggcccggc

SEQ ID NO: 466362 - DNA, 18 bp, Homo sapiens
ggacagcggcccggccca

SEQ ID NO: 466363 - DNA, 21 bp, Homo sapiens
ggacagggagggaacagacct

SEQ ID NO: 466364 - DNA, 15 bp, Homo sapiens
ggacagggcatggcc

SEQ ID NO: 466365 - DNA, 22 bp, Homo sapiens
ggacagggcatggccaggtggc

SEQ ID NO: 466366 - DNA, 21 bp, Homo sapiens
ggacccccggcctccaggctg

SEQ ID NO: 466367 - DNA, 14 bp, Homo sapiens
ggaccggagcggct

SEQ ID NO: 466368 - DNA, 23 bp, Homo sapiens
ggacgatagcttggagggatgga

SEQ ID NO: 466369 - DNA, 15 bp, Homo sapiens
ggactgcatgcaagc

SEQ ID NO: 466370 - DNA, 20 bp, Homo sapiens
ggactgtcttcaaccctgcc

SEQ ID NO: 466371 - DNA, 16 bp, Homo sapiens
ggactttatttaattt

SEQ ID NO: 466372 - DNA, 20 bp, Homo sapiens
ggactttatttaatttcata

SEQ ID NO: 466373 - DNA, 21 bp, Homo sapiens
ggactttatttaatttcataa

SEQ ID NO: 466374 - DNA, 18 bp, Homo sapiens
ggacttttgttcatggga

SEQ ID NO: 466375 - DNA, 17 bp, Homo sapiens
ggagagcgccacccgcc

SEQ ID NO: 466376 - DNA, 22 bp, Homo sapiens
ggagagctcagtacagggcagg

SEQ ID NO: 466377 - DNA, 17 bp, Homo sapiens
ggagaggcggcctcgtg

SEQ ID NO: 466378 - DNA, 21 bp, Homo sapiens
ggagaggcggcctcgtgccat

SEQ ID NO: 466379 - DNA, 16 bp, Homo sapiens
ggagcacccccagcct

SEQ ID NO: 466380 - DNA, 18 bp, Homo sapiens
ggagcacccccagcctcc

SEQ ID NO: 466381 - DNA, 20 bp, Homo sapiens
ggagcacccccagcctcccc

SEQ ID NO: 466382 - DNA, 18 bp, Homo sapiens
ggagcactagaatgagaa

SEQ ID NO: 466383 - DNA, 20 bp, Homo sapiens
ggagcactagaatgagaaat

SEQ ID NO: 466384 - DNA, 16 bp, Homo sapiens
ggagccaatggagact

SEQ ID NO: 466385 - DNA, 14 bp, Homo sapiens
ggagccatgctctt

SEQ ID NO: 466386 - DNA, 16 bp, Homo sapiens
ggagcctccccctcag

SEQ ID NO: 466387 - DNA, 20 bp, Homo sapiens
ggagcgggggctaactggcc

SEQ ID NO: 466388 - DNA, 14 bp, Homo sapiens
ggagcttccagatg

SEQ ID NO: 466389 - DNA, 13 bp, Homo sapiens
ggaggacagggag

SEQ ID NO: 466390 - DNA, 15 bp, Homo sapiens
ggaggcctggtctgg

SEQ ID NO: 466391 - DNA, 12 bp, Homo sapiens
ggaggcgcccac

SEQ ID NO: 466392 - DNA, 13 bp, Homo sapiens
ggaggcgcccacc

SEQ ID NO: 466393 - DNA, 21 bp, Homo sapiens
ggaggggcctggcagccgtgc

SEQ ID NO: 466394 - DNA, 17 bp, Homo sapiens
ggaggtgtggagtggag

SEQ ID NO: 466395 - DNA, 22 bp, Homo sapiens
ggagtccactttcctctctctc

SEQ ID NO: 466396 - DNA, 17 bp, Homo sapiens
ggagtctgaaggagagg

SEQ ID NO: 466397 - DNA, 21 bp, Homo sapiens
ggagtggaggggtcagcaggg

SEQ ID NO: 466398 - DNA, 13 bp, Homo sapiens
ggatccagagaga

SEQ ID NO: 466399 - DNA, 15 bp, Homo sapiens
ggatgattcttttcc

SEQ ID NO: 466400 - DNA, 21 bp, Homo sapiens
ggatgctgagagacctcaggg

SEQ ID NO: 466401 - DNA, 18 bp, Homo sapiens
ggatggagaggcggcctc

SEQ ID NO: 466402 - DNA, 15 bp, Homo sapiens
ggatggcccagctga

SEQ ID NO: 466403 - DNA, 17 bp, Homo sapiens
ctgtaaatttaactgca

SEQ ID NO: 466404 - DNA, 17 bp, Homo sapiens
ctgtaaggtttcaatgc

SEQ ID NO: 466405 - DNA, 15 bp, Homo sapiens
ctgtactcctcccag

SEQ ID NO: 466406 - DNA, 19 bp, Homo sapiens
ctgtactcctcccaggcgc

SEQ ID NO: 466407 - DNA, 19 bp, Homo sapiens
ctgtagccaacttaaacct

SEQ ID NO: 466408 - DNA, 17 bp, Homo sapiens
ctgtagtgagaaactga

SEQ ID NO: 466409 - DNA, 18 bp, Homo sapiens
ctgtagtgagaaactgat

SEQ ID NO: 466410 - DNA, 18 bp, Homo sapiens
ctgtatctaaaaaataac

SEQ ID NO: 466411 - DNA, 23 bp, Homo sapiens
ctgtatggcacttattatgaggc

SEQ ID NO: 466412 - DNA, 20 bp, Homo sapiens
ctgtatttaatggtttttat

SEQ ID NO: 466413 - DNA, 20 bp, Homo sapiens
ctgtattttcttttatatct

SEQ ID NO: 466414 - DNA, 18 bp, Homo sapiens
ctgtcactcacaaaaggc

SEQ ID NO: 466415 - DNA, 19 bp, Homo sapiens
ctgtcactcacaaaaggct

SEQ ID NO: 466416 - DNA, 18 bp, Homo sapiens
ctgtcagagaatatgacc

SEQ ID NO: 466417 - DNA, 22 bp, Homo sapiens
ctgtcagccagccgccctgggc

SEQ ID NO: 466418 - DNA, 13 bp, Homo sapiens
ctgtcatctctct

SEQ ID NO: 466419 - DNA, 14 bp, Homo sapiens
ctgtcatctctctg

SEQ ID NO: 466420 - DNA, 17 bp, Homo sapiens
ctgtcatctctctgggg

SEQ ID NO: 466421 - DNA, 15 bp, Homo sapiens
ctgtcccaccgggag

SEQ ID NO: 466422 - DNA, 18 bp, Homo sapiens
ctgtcctctcgagcccag

SEQ ID NO: 466423 - DNA, 13 bp, Homo sapiens
ctgtcctgctcac

SEQ ID NO: 466424 - DNA, 13 bp, Homo sapiens
ctgtcctttccca

SEQ ID NO: 466425 - DNA, 13 bp, Homo sapiens
ctgtcgccccagg

SEQ ID NO: 466426 - DNA, 18 bp, Homo sapiens
ctgtcgccccaggccctc

SEQ ID NO: 466427 - DNA, 20 bp, Homo sapiens
ctgtcgccccaggccctccc

SEQ ID NO: 466428 - DNA, 22 bp, Homo sapiens
ctgtcgccccaggccctccctg

SEQ ID NO: 466429 - DNA, 20 bp, Homo sapiens
ctgtctcaagagggcactgg

SEQ ID NO: 466430 - DNA, 18 bp, Homo sapiens
ctgtctgagccctgccct

SEQ ID NO: 466431 - DNA, 19 bp, Homo sapiens
ctgtctgagccctgccctc

SEQ ID NO: 466432 - DNA, 21 bp, Homo sapiens
ctgtctgagccctgccctcac

SEQ ID NO: 466433 - DNA, 24 bp, Homo sapiens
ctgtctgagccctgccctcactcc

SEQ ID NO: 466434 - DNA, 15 bp, Homo sapiens
ctgtctgattctatg

SEQ ID NO: 466435 - DNA, 16 bp, Homo sapiens
ctgtctgtcaccagct

SEQ ID NO: 466436 - DNA, 19 bp, Homo sapiens
ctgtctgtcaccagctatc

SEQ ID NO: 466437 - DNA, 22 bp, Homo sapiens
ctgtctgtcaccagctatctgt

SEQ ID NO: 466438 - DNA, 15 bp, Homo sapiens
ctgtcttcaaccctg

SEQ ID NO: 466439 - DNA, 16 bp, Homo sapiens
ctgtcttcaaccctgc

SEQ ID NO: 466440 - DNA, 16 bp, Homo sapiens
ctgtctttgctgttta

SEQ ID NO: 466441 - DNA, 15 bp, Homo sapiens
ctgtgagtctgtcct

SEQ ID NO: 466442 - DNA, 18 bp, Homo sapiens
ctgtgagtctgtcctttc

SEQ ID NO: 466443 - DNA, 19 bp, Homo sapiens
ctgtgatcgtgtgttgcca

SEQ ID NO: 466444 - DNA, 23 bp, Homo sapiens
ctgtgctccagcagtgctgggcc

SEQ ID NO: 466445 - DNA, 12 bp, Homo sapiens
ctgtggattcta

SEQ ID NO: 466446 - DNA, 15 bp, Homo sapiens
ctgtggattctatat

SEQ ID NO: 466447 - DNA, 16 bp, Homo sapiens
ctgtggattctatatt

SEQ ID NO: 466448 - DNA, 18 bp, Homo sapiens
ctgtggcccctccttctc

SEQ ID NO: 466449 - DNA, 23 bp, Homo sapiens
ctgtgggactggcccacccctct

SEQ ID NO: 466450 - DNA, 14 bp, Homo sapiens
ctgtgggagtccac

SEQ ID NO: 466451 - DNA, 13 bp, Homo sapiens
ctgtgggcagcac

SEQ ID NO: 466452 - DNA, 15 bp, Homo sapiens
ctgtgggcagcaccc

SEQ ID NO: 466453 - DNA, 17 bp, Homo sapiens
ctgtgtaatctctgatt

SEQ ID NO: 466454 - DNA, 16 bp, Homo sapiens
ctgtgtataaaaaaga

SEQ ID NO: 466455 - DNA, 21 bp, Homo sapiens
ctgtgtggcaaacatttaaaa

SEQ ID NO: 466456 - DNA, 16 bp, Homo sapiens
ctgtgtggggagggtg

SEQ ID NO: 466457 - DNA, 15 bp, Homo sapiens
ctgttcactctactt

SEQ ID NO: 466458 - DNA, 13 bp, Homo sapiens
ctgttcatttcca

SEQ ID NO: 466459 - DNA, 19 bp, Homo sapiens
ctgttccaagtgtgtgtgc

SEQ ID NO: 466460 - DNA, 14 bp, Homo sapiens
ctgtttaccctccc

SEQ ID NO: 466461 - DNA, 16 bp, Homo sapiens
ctgtttaccctccctg

SEQ ID NO: 466462 - DNA, 20 bp, Homo sapiens
ctgtttcgcatccaccgcca

SEQ ID NO: 466463 - DNA, 23 bp, Homo sapiens
ctgtttcgcatccaccgccaccc

SEQ ID NO: 466464 - DNA, 14 bp, Homo sapiens
ctgttttccaaagg

SEQ ID NO: 466465 - DNA, 13 bp, Homo sapiens
cttaaaagaacat

SEQ ID NO: 466466 - DNA, 12 bp, Homo sapiens
cttaaacatttt

SEQ ID NO: 466467 - DNA, 15 bp, Homo sapiens
cttaaacctgtgctt

SEQ ID NO: 466468 - DNA, 19 bp, Homo sapiens
cttaaacctgtgctttcat

SEQ ID NO: 466469 - DNA, 20 bp, Homo sapiens
cttaacataaacttgtactt

SEQ ID NO: 466470 - DNA, 22 bp, Homo sapiens
cttaacataaacttgtacttac

SEQ ID NO: 466471 - DNA, 18 bp, Homo sapiens
cttaacttaaaagaacat

SEQ ID NO: 466472 - DNA, 18 bp, Homo sapiens
cttaagattccattttgg

SEQ ID NO: 466473 - DNA, 21 bp, Homo sapiens
cttaagattccattttggaaa

SEQ ID NO: 466474 - DNA, 16 bp, Homo sapiens
cttaagcctgtgtata

SEQ ID NO: 466475 - DNA, 20 bp, Homo sapiens
cttaagcctgtgtataaaaa

SEQ ID NO: 466476 - DNA, 20 bp, Homo sapiens
cttacattagcagtttgctt

SEQ ID NO: 466477 - DNA, 21 bp, Homo sapiens
cttacattagcagtttgcttt

SEQ ID NO: 466478 - DNA, 21 bp, Homo sapiens
cttactaaacattttgttatt

SEQ ID NO: 466479 - DNA, 17 bp, Homo sapiens
cttagaaattgcatttc

SEQ ID NO: 466480 - DNA, 17 bp, Homo sapiens
cttagaatactgtattg

SEQ ID NO: 466481 - DNA, 12 bp, Homo sapiens
cttagaatgggg

SEQ ID NO: 466482 - DNA, 15 bp, Homo sapiens
cttagcgttctgttt

SEQ ID NO: 466483 - DNA, 17 bp, Homo sapiens
cttagtgtcccttacct

SEQ ID NO: 466484 - DNA, 22 bp, Homo sapiens
cttatctagcaagaagattcta

SEQ ID NO: 466485 - DNA, 15 bp, Homo sapiens
cttatgctgctgtga

SEQ ID NO: 466486 - DNA, 11 bp, Homo sapiens
cttattttctg

SEQ ID NO: 466487 - DNA, 13 bp, Homo sapiens
cttattttctgaa

SEQ ID NO: 466488 - DNA, 19 bp, Homo sapiens
cttattttctgaattcata

SEQ ID NO: 466489 - DNA, 22 bp, Homo sapiens
cttattttctgaattcataaaa

SEQ ID NO: 466490 - DNA, 15 bp, Homo sapiens
cttcaaaacagaacg

SEQ ID NO: 466491 - DNA, 15 bp, Homo sapiens
cttcaaccctgccct

SEQ ID NO: 466492 - DNA, 17 bp, Homo sapiens
cttcaaccctgccctgc

SEQ ID NO: 466493 - DNA, 19 bp, Homo sapiens
gccccagagactgcccacc

SEQ ID NO: 466494 - DNA, 15 bp, Homo sapiens
gccccagctggctgg

SEQ ID NO: 466495 - DNA, 16 bp, Homo sapiens
gccccaggccctccct

SEQ ID NO: 466496 - DNA, 15 bp, Homo sapiens
gccccatccttcccg

SEQ ID NO: 466497 - DNA, 24 bp, Homo sapiens
gccccatccttcccgcagcaccag

SEQ ID NO: 466498 - DNA, 13 bp, Homo sapiens
gccccccactcag

SEQ ID NO: 466499 - DNA, 13 bp, Homo sapiens
gcccccctctgcc

SEQ ID NO: 466500 - DNA, 16 bp, Homo sapiens
gcccccctctgccttt

SEQ ID NO: 466501 - DNA, 20 bp, Homo sapiens
gcccccctctgcctttgagc

SEQ ID NO: 466502 - DNA, 13 bp, Homo sapiens
gccccccttccca

SEQ ID NO: 466503 - DNA, 18 bp, Homo sapiens
gccccccttcccacccct

SEQ ID NO: 466504 - DNA, 16 bp, Homo sapiens
gcccccgccctcgctc

SEQ ID NO: 466505 - DNA, 18 bp, Homo sapiens
gcccccgccctcgctccg

SEQ ID NO: 466506 - DNA, 19 bp, Homo sapiens
gcccccgccctcgctccgg

SEQ ID NO: 466507 - DNA, 20 bp, Homo sapiens
gcccccgccctcgctccggg

SEQ ID NO: 466508 - DNA, 22 bp, Homo sapiens
gcccccggaggcgcccacctgc

SEQ ID NO: 466509 - DNA, 23 bp, Homo sapiens
gcccccggaggcgcccacctgcc

SEQ ID NO: 466510 - DNA, 17 bp, Homo sapiens
gccccctcccccgcaga

SEQ ID NO: 466511 - DNA, 20 bp, Homo sapiens
gccccctcccccgcagacag

SEQ ID NO: 466512 - DNA, 14 bp, Homo sapiens
gccccgcgcgtgcc

SEQ ID NO: 466513 - DNA, 15 bp, Homo sapiens
gccccgcgtcttcag

SEQ ID NO: 466514 - DNA, 16 bp, Homo sapiens
gcccctatcctgcacc

SEQ ID NO: 466515 - DNA, 17 bp, Homo sapiens
gcccctatcctgcaccc

SEQ ID NO: 466516 - DNA, 17 bp, Homo sapiens
gcccctccacgcctcct

SEQ ID NO: 466517 - DNA, 13 bp, Homo sapiens
gcccctccccatg

SEQ ID NO: 466518 - DNA, 17 bp, Homo sapiens
gcccctccccatggtgc

SEQ ID NO: 466519 - DNA, 14 bp, Homo sapiens
gcccctcccttcaa

SEQ ID NO: 466520 - DNA, 15 bp, Homo sapiens
gcccctcccttcaac

SEQ ID NO: 466521 - DNA, 13 bp, Homo sapiens
gcccctccgtccc

SEQ ID NO: 466522 - DNA, 19 bp, Homo sapiens
gcccctccgtccccagggt

SEQ ID NO: 466523 - DNA, 14 bp, Homo sapiens
gcccctccttctcc

SEQ ID NO: 466524 - DNA, 16 bp, Homo sapiens
gcccctccttctcccc

SEQ ID NO: 466525 - DNA, 21 bp, Homo sapiens
gcccctccttctcccctccag

SEQ ID NO: 466526 - DNA, 22 bp, Homo sapiens
gcccctgggatgggaccaggga

SEQ ID NO: 466527 - DNA, 22 bp, Homo sapiens
gcccctgtaaggtttcaatgca

SEQ ID NO: 466528 - DNA, 18 bp, Homo sapiens
gcccgaatttctcactcc

SEQ ID NO: 466529 - DNA, 15 bp, Homo sapiens
gcccgacagcctggc

SEQ ID NO: 466530 - DNA, 17 bp, Homo sapiens
gcccgacagcctggcac

SEQ ID NO: 466531 - DNA, 15 bp, Homo sapiens
gcccgagcgcgtgcc

SEQ ID NO: 466532 - DNA, 21 bp, Homo sapiens
gcccgagcgcgtgccttcccc

SEQ ID NO: 466533 - DNA, 23 bp, Homo sapiens
gcccgccaccttgtacagaacca

SEQ ID NO: 466534 - DNA, 19 bp, Homo sapiens
gcccgcccaccccgctgcc

SEQ ID NO: 466535 - DNA, 21 bp, Homo sapiens
gcccgcccaccccgctgcctg

SEQ ID NO: 466536 - DNA, 16 bp, Homo sapiens
gcccgcccccgccctc

SEQ ID NO: 466537 - DNA, 17 bp, Homo sapiens
gcccgcccccgccctcg

SEQ ID NO: 466538 - DNA, 18 bp, Homo sapiens
gcccgccctcctctgccc

SEQ ID NO: 466539 - DNA, 19 bp, Homo sapiens
gcccgccctcctctgcccc

SEQ ID NO: 466540 - DNA, 22 bp, Homo sapiens
gcccgccctcctctgccccctc

SEQ ID NO: 466541 - DNA, 18 bp, Homo sapiens
gcccgccggttggccggc

SEQ ID NO: 466542 - DNA, 16 bp, Homo sapiens
gcccggcccacgcaga

SEQ ID NO: 466543 - DNA, 18 bp, Homo sapiens
gcccggcccacgcagagc

SEQ ID NO: 466544 - DNA, 14 bp, Homo sapiens
gcccgtgcgcagcc

SEQ ID NO: 466545 - DNA, 15 bp, Homo sapiens
gcccgtgcgcagccg

SEQ ID NO: 466546 - DNA, 18 bp, Homo sapiens
gccctcactccactcccc

SEQ ID NO: 466547 - DNA, 11 bp, Homo sapiens
gccctccctcc

SEQ ID NO: 466548 - DNA, 17 bp, Homo sapiens
gccctccctccctccac

SEQ ID NO: 466549 - DNA, 23 bp, Homo sapiens
gccctccctgactccctgtgggg

SEQ ID NO: 466550 - DNA, 15 bp, Homo sapiens
gccctcctctgcccc

SEQ ID NO: 466551 - DNA, 20 bp, Homo sapiens
gccctcctctgccccctccc

SEQ ID NO: 466552 - DNA, 20 bp, Homo sapiens
gctgcaatacattaaaataa

SEQ ID NO: 466553 - DNA, 15 bp, Homo sapiens
gctgccacacttcag

SEQ ID NO: 466554 - DNA, 18 bp, Homo sapiens
gctgccacacttcaggct

SEQ ID NO: 466555 - DNA, 12 bp, Homo sapiens
gctgccctggtg

SEQ ID NO: 466556 - DNA, 19 bp, Homo sapiens
gctgccctggtgctgccac

SEQ ID NO: 466557 - DNA, 22 bp, Homo sapiens
gctgccctggtgctgccacact

SEQ ID NO: 466558 - DNA, 16 bp, Homo sapiens
gctgccgctgcaccac

SEQ ID NO: 466559 - DNA, 18 bp, Homo sapiens
gctgcctctgaaaatatt

SEQ ID NO: 466560 - DNA, 12 bp, Homo sapiens
gctgcctggagg

SEQ ID NO: 466561 - DNA, 13 bp, Homo sapiens
gctgcctggaggg

SEQ ID NO: 466562 - DNA, 12 bp, Homo sapiens
gctgcctggcgg

SEQ ID NO: 466563 - DNA, 20 bp, Homo sapiens
gctgcctggcgggcagcccc

SEQ ID NO: 466564 - DNA, 22 bp, Homo sapiens
gctgcctggcgggcagcccctg

SEQ ID NO: 466565 - DNA, 15 bp, Homo sapiens
gctgccttagaacct

SEQ ID NO: 466566 - DNA, 12 bp, Homo sapiens
gctgcgcctgcc

SEQ ID NO: 466567 - DNA, 22 bp, Homo sapiens
gctgcgcctgcccgcccgccgg

SEQ ID NO: 466568 - DNA, 16 bp, Homo sapiens
gctgctcgggaaggcc

SEQ ID NO: 466569 - DNA, 18 bp, Homo sapiens
gctgctcgggaaggcctg

SEQ ID NO: 466570 - DNA, 19 bp, Homo sapiens
gctgctcgggaaggcctga

SEQ ID NO: 466571 - DNA, 20 bp, Homo sapiens
gctgctcgggaaggcctgag

SEQ ID NO: 466572 - DNA, 15 bp, Homo sapiens
gctgctgcaccaacc

SEQ ID NO: 466573 - DNA, 13 bp, Homo sapiens
gctgctgtgaatt

SEQ ID NO: 466574 - DNA, 15 bp, Homo sapiens
gctggaccaaggtgc

SEQ ID NO: 466575 - DNA, 20 bp, Homo sapiens
gctggatgctgagagacctc

SEQ ID NO: 466576 - DNA, 15 bp, Homo sapiens
gctggatgtgctttc

SEQ ID NO: 466577 - DNA, 16 bp, Homo sapiens
gctggatgtgctttca

SEQ ID NO: 466578 - DNA, 14 bp, Homo sapiens
gctggcagcgcctc

SEQ ID NO: 466579 - DNA, 16 bp, Homo sapiens
gctggcagcgcctccc

SEQ ID NO: 466580 - DNA, 18 bp, Homo sapiens
gctggcagcgcctcccgc

SEQ ID NO: 466581 - DNA, 14 bp, Homo sapiens
gctggccagcaccc

SEQ ID NO: 466582 - DNA, 16 bp, Homo sapiens
gctggccagcaccctc

SEQ ID NO: 466583 - DNA, 17 bp, Homo sapiens
gctggccagcaccctct

SEQ ID NO: 466584 - DNA, 19 bp, Homo sapiens
gctggccagcaccctctcc

SEQ ID NO: 466585 - DNA, 23 bp, Homo sapiens
gctggccagcaccctctcctggg

SEQ ID NO: 466586 - DNA, 17 bp, Homo sapiens
gctggccctgccctccc

SEQ ID NO: 466587 - DNA, 19 bp, Homo sapiens
gctggccctgccctccccc

SEQ ID NO: 466588 - DNA, 18 bp, Homo sapiens
gctggccggtccaccccg

SEQ ID NO: 466589 - DNA, 20 bp, Homo sapiens
gctggccggtccaccccgtc

SEQ ID NO: 466590 - DNA, 22 bp, Homo sapiens
gctggccggtccaccccgtccc

SEQ ID NO: 466591 - DNA, 13 bp, Homo sapiens
gctgggcagggcc

SEQ ID NO: 466592 - DNA, 16 bp, Homo sapiens
gctgggcccagccggg

SEQ ID NO: 466593 - DNA, 14 bp, Homo sapiens
gctgggcccctggg

SEQ ID NO: 466594 - DNA, 17 bp, Homo sapiens
gaataatggaattatgt

SEQ ID NO: 466595 - DNA, 13 bp, Homo sapiens
gaatactgtattg

SEQ ID NO: 466596 - DNA, 14 bp, Homo sapiens
gaatatacatagtc

SEQ ID NO: 466597 - DNA, 16 bp, Homo sapiens
gaatatacttagaaaa

SEQ ID NO: 466598 - DNA, 20 bp, Homo sapiens
gaatcaatctggcttctgca

SEQ ID NO: 466599 - DNA, 23 bp, Homo sapiens
gaatcaatctggcttctgcatta

SEQ ID NO: 466600 - DNA, 13 bp, Homo sapiens
gaatccacctgca

SEQ ID NO: 466601 - DNA, 16 bp, Homo sapiens
gaatccacctgcagtt

SEQ ID NO: 466602 - DNA, 11 bp, Homo sapiens
gaatcttgatt

SEQ ID NO: 466603 - DNA, 12 bp, Homo sapiens
gaatgagaaatc

SEQ ID NO: 466604 - DNA, 16 bp, Homo sapiens
gaatgagaaatcatgt

SEQ ID NO: 466605 - DNA, 19 bp, Homo sapiens
gaatgagcagttagaaata

SEQ ID NO: 466606 - DNA, 18 bp, Homo sapiens
gaatgagtaaataaactc

SEQ ID NO: 466607 - DNA, 18 bp, Homo sapiens
gaatgcatccaaatagga

SEQ ID NO: 466608 - DNA, 19 bp, Homo sapiens
gaatgggccaagccagggt

SEQ ID NO: 466609 - DNA, 20 bp, Homo sapiens
gaatgggccaagccagggtt

SEQ ID NO: 466610 - DNA, 23 bp, Homo sapiens
gaatgggccaagccagggttcca

SEQ ID NO: 466611 - DNA, 17 bp, Homo sapiens
gaatggtgggctccaga

SEQ ID NO: 466612 - DNA, 19 bp, Homo sapiens
gaatggtgggctccagagt

SEQ ID NO: 466613 - DNA, 17 bp, Homo sapiens
gaatgtccccattctat

SEQ ID NO: 466614 - DNA, 19 bp, Homo sapiens
gaatgtccccattctataa

SEQ ID NO: 466615 - DNA, 21 bp, Homo sapiens
gaatgtccccattctataaat

SEQ ID NO: 466616 - DNA, 17 bp, Homo sapiens
gaatgtgcttttccatc

SEQ ID NO: 466617 - DNA, 16 bp, Homo sapiens
gaattatgtataacaa

SEQ ID NO: 466618 - DNA, 15 bp, Homo sapiens
gaattcataaaaata

SEQ ID NO: 466619 - DNA, 14 bp, Homo sapiens
gacaaaggccttaa

SEQ ID NO: 466620 - DNA, 17 bp, Homo sapiens
gacaatttcaaaatgca

SEQ ID NO: 466621 - DNA, 16 bp, Homo sapiens
gacaccatcccctcct

SEQ ID NO: 466622 - DNA, 15 bp, Homo sapiens
gacaccctccactct

SEQ ID NO: 466623 - DNA, 17 bp, Homo sapiens
gacacctactgagtggc

SEQ ID NO: 466624 - DNA, 18 bp, Homo sapiens
gacactgatgggtcctgc

SEQ ID NO: 466625 - DNA, 21 bp, Homo sapiens
gacactgatgggtcctgctgc

SEQ ID NO: 466626 - DNA, 22 bp, Homo sapiens
gacactgatgggtcctgctgct

SEQ ID NO: 466627 - DNA, 23 bp, Homo sapiens
gacactgatgggtcctgctgctc

SEQ ID NO: 466628 - DNA, 12 bp, Homo sapiens
gacagacagacg

SEQ ID NO: 466629 - DNA, 19 bp, Homo sapiens
gacagacggacgggacagc

SEQ ID NO: 466630 - DNA, 17 bp, Homo sapiens
gacagagaaggcagcag

SEQ ID NO: 466631 - DNA, 18 bp, Homo sapiens
gacagagtggatctggag

SEQ ID NO: 466632 - DNA, 22 bp, Homo sapiens
gacagcggcccggcccacgcag

SEQ ID NO: 466633 - DNA, 17 bp, Homo sapiens
gacaggaaagccctccc

SEQ ID NO: 466634 - DNA, 19 bp, Homo sapiens
gacaggaaagccctccccc

SEQ ID NO: 466635 - DNA, 14 bp, Homo sapiens
gacagggcatggcc

SEQ ID NO: 466636 - DNA, 22 bp, Homo sapiens
gacagggcatggccaggtggcc

SEQ ID NO: 466637 - DNA, 20 bp, Homo sapiens
gaccatttagtcctcacctt

SEQ ID NO: 466638 - DNA, 19 bp, Homo sapiens
gaccccacacgccggggct

SEQ ID NO: 466639 - DNA, 18 bp, Homo sapiens
gaccccacttatgctgct

SEQ ID NO: 466640 - DNA, 20 bp, Homo sapiens
gaccccacttatgctgctgt

SEQ ID NO: 466641 - DNA, 22 bp, Homo sapiens
gacccccgaggcccccctctgc

SEQ ID NO: 466642 - DNA, 20 bp, Homo sapiens
gacccccggcctccaggctg

SEQ ID NO: 466643 - DNA, 21 bp, Homo sapiens
gacccccggcctccaggctgg

SEQ ID NO: 466644 - DNA, 13 bp, Homo sapiens
gacccctggcttt

SEQ ID NO: 466645 - DNA, 21 bp, Homo sapiens
gacccctggcttttcactgct

SEQ ID NO: 466646 - DNA, 17 bp, Homo sapiens
gacccggaggggcctgg

SEQ ID NO: 466647 - DNA, 19 bp, Homo sapiens
gacccggaggggcctggca

SEQ ID NO: 466648 - DNA, 20 bp, Homo sapiens
gacccggaggggcctggcag

SEQ ID NO: 466649 - DNA, 15 bp, Homo sapiens
gaccctccttcccca

SEQ ID NO: 466650 - DNA, 19 bp, Homo sapiens
gaccctccttccccacccc

SEQ ID NO: 466651 - DNA, 20 bp, Homo sapiens
gaccctccttccccacccca

SEQ ID NO: 466652 - DNA, 11 bp, Homo sapiens
gaccggcccgc

SEQ ID NO: 466653 - DNA, 15 bp, Homo sapiens
gaccggcccgccacc

SEQ ID NO: 466654 - DNA, 16 bp, Homo sapiens
gaccggcccgccacct

SEQ ID NO: 466655 - DNA, 18 bp, Homo sapiens
gacctaaatccattttct

SEQ ID NO: 466656 - DNA, 20 bp, Homo sapiens
gacctaaatccattttctaa

SEQ ID NO: 466657 - DNA, 22 bp, Homo sapiens
gacctacatctgaaatctacaa

SEQ ID NO: 466658 - DNA, 23 bp, Homo sapiens
gacctccagattattttctatat

SEQ ID NO: 466659 - DNA, 22 bp, Homo sapiens
gacctgaagagcgctcctctgc

SEQ ID NO: 466660 - DNA, 23 bp, Homo sapiens
gacctgaagagcgctcctctgcc

SEQ ID NO: 466661 - DNA, 20 bp, Homo sapiens
gacctgacgatcttccccct

SEQ ID NO: 466662 - DNA, 16 bp, Homo sapiens
gaccttgaaaagcagt

SEQ ID NO: 466663 - DNA, 14 bp, Homo sapiens
gacgctggtaactg

SEQ ID NO: 466664 - DNA, 19 bp, Homo sapiens
gacgcttaacctttccgct

SEQ ID NO: 466665 - DNA, 15 bp, Homo sapiens
gacggacgggacagc

SEQ ID NO: 466666 - DNA, 13 bp, Homo sapiens
gacggcagcccca

SEQ ID NO: 466667 - DNA, 18 bp, Homo sapiens
gacggcagccccatcctt

SEQ ID NO: 466668 - DNA, 17 bp, Homo sapiens
gatgtattatgcaaagt

SEQ ID NO: 466669 - DNA, 22 bp, Homo sapiens
gattaaatttaatatactgcat

SEQ ID NO: 466670 - DNA, 20 bp, Homo sapiens
gattaatctctaaaattcta

SEQ ID NO: 466671 - DNA, 13 bp, Homo sapiens
gattattgaatgt

SEQ ID NO: 466672 - DNA, 20 bp, Homo sapiens
gattattgaatgttatatca

SEQ ID NO: 466673 - DNA, 22 bp, Homo sapiens
gattcaagactcaatgtggaaa

SEQ ID NO: 466674 - DNA, 20 bp, Homo sapiens
gattccagagagtggctcct

SEQ ID NO: 466675 - DNA, 15 bp, Homo sapiens
gattctaaaggggac

SEQ ID NO: 466676 - DNA, 19 bp, Homo sapiens
gattctaaaggggacagat

SEQ ID NO: 466677 - DNA, 18 bp, Homo sapiens
gattctatgcctgtattt

SEQ ID NO: 466678 - DNA, 13 bp, Homo sapiens
gattctcctctcc

SEQ ID NO: 466679 - DNA, 19 bp, Homo sapiens
gattcttttttcaatgtac

SEQ ID NO: 466680 - DNA, 12 bp, Homo sapiens
gattgaaaagaa

SEQ ID NO: 466681 - DNA, 22 bp, Homo sapiens
gattgaaaagaagaaagtctat

SEQ ID NO: 466682 - DNA, 16 bp, Homo sapiens
gattgggggggcttgg

SEQ ID NO: 466683 - DNA, 17 bp, Homo sapiens
gattgggggggcttggg

SEQ ID NO: 466684 - DNA, 14 bp, Homo sapiens
gattggtaccagag

SEQ ID NO: 466685 - DNA, 14 bp, Homo sapiens
gatttaaactctta

SEQ ID NO: 466686 - DNA, 14 bp, Homo sapiens
gatttattatgaac

SEQ ID NO: 466687 - DNA, 14 bp, Homo sapiens
gatttcctaagctg

SEQ ID NO: 466688 - DNA, 18 bp, Homo sapiens
gatttgagtccattgcaa

SEQ ID NO: 466689 - DNA, 21 bp, Homo sapiens
gatttgcaaatgcacatttgt

SEQ ID NO: 466690 - DNA, 22 bp, Homo sapiens
gattttagatttctttgattgt

SEQ ID NO: 466691 - DNA, 19 bp, Homo sapiens
gcaaaatgttacagaatct

SEQ ID NO: 466692 - DNA, 15 bp, Homo sapiens
gcaaacatttaaaaa

SEQ ID NO: 466693 - DNA, 17 bp, Homo sapiens
gcagggccctggggtct

SEQ ID NO: 466694 - DNA, 13 bp, Homo sapiens
gcagggccgcagg

SEQ ID NO: 466695 - DNA, 17 bp, Homo sapiens
gcagggccgcagggcgc

SEQ ID NO: 466696 - DNA, 19 bp, Homo sapiens
gcagggcgctccggcagag

SEQ ID NO: 466697 - DNA, 13 bp, Homo sapiens
gcaggggggttgg

SEQ ID NO: 466698 - DNA, 13 bp, Homo sapiens
gcagggttctaga

SEQ ID NO: 466699 - DNA, 17 bp, Homo sapiens
gcagggttctagaaggg

SEQ ID NO: 466700 - DNA, 14 bp, Homo sapiens
gcaggtcctgccca

SEQ ID NO: 466701 - DNA, 18 bp, Homo sapiens
gcagtaccatcccactga

SEQ ID NO: 466702 - DNA, 20 bp, Homo sapiens
gcagtaccatcccactgata

SEQ ID NO: 466703 - DNA, 14 bp, Homo sapiens
gcagtacttgctca

SEQ ID NO: 466704 - DNA, 13 bp, Homo sapiens
gcagtgctgggcc

SEQ ID NO: 466705 - DNA, 15 bp, Homo sapiens
gcagtgctgggccca

SEQ ID NO: 466706 - DNA, 15 bp, Homo sapiens
gcagtggagagggga

SEQ ID NO: 466707 - DNA, 17 bp, Homo sapiens
gcagtggagaggggact

SEQ ID NO: 466708 - DNA, 21 bp, Homo sapiens
gcagtggagaggggacttgga

SEQ ID NO: 466709 - DNA, 16 bp, Homo sapiens
gcataagattatatac

SEQ ID NO: 466710 - DNA, 20 bp, Homo sapiens
gcataagattatatacaaag

SEQ ID NO: 466711 - DNA, 13 bp, Homo sapiens
gcatacaataaaa

SEQ ID NO: 466712 - DNA, 16 bp, Homo sapiens
gcatacaataaaagag

SEQ ID NO: 466713 - DNA, 18 bp, Homo sapiens
gcatacaataaaagagct

SEQ ID NO: 466714 - DNA, 19 bp, Homo sapiens
gcatacaataaaagagctt

SEQ ID NO: 466715 - DNA, 20 bp, Homo sapiens
gcatacaataaaagagcttt

SEQ ID NO: 466716 - DNA, 14 bp, Homo sapiens
gcatagacaagtgt

SEQ ID NO: 466717 - DNA, 16 bp, Homo sapiens
gcatagggtttggaag

SEQ ID NO: 466718 - DNA, 20 bp, Homo sapiens
gcatagttctgcaataacag

SEQ ID NO: 466719 - DNA, 11 bp, Homo sapiens
gcatataaatg

SEQ ID NO: 466720 - DNA, 14 bp, Homo sapiens
gcatataaatgttt

SEQ ID NO: 466721 - DNA, 21 bp, Homo sapiens
gcatattagcatcatgtcttt

SEQ ID NO: 466722 - DNA, 13 bp, Homo sapiens
ctgcctctgaaaa

SEQ ID NO: 466723 - DNA, 17 bp, Homo sapiens
ctgcctctgaaaatatt

SEQ ID NO: 466724 - DNA, 15 bp, Homo sapiens
ctgcctggcgggcag

SEQ ID NO: 466725 - DNA, 20 bp, Homo sapiens
ctgcctggcgggcagcccct

SEQ ID NO: 466726 - DNA, 21 bp, Homo sapiens
ctgcctggcgggcagcccctg

SEQ ID NO: 466727 - DNA, 23 bp, Homo sapiens
ctgcctggcgggcagcccctgct

SEQ ID NO: 466728 - DNA, 19 bp, Homo sapiens
ctgcctttgagcttctcct

SEQ ID NO: 466729 - DNA, 23 bp, Homo sapiens
ctgcctttgagcttctcctctgc

SEQ ID NO: 466730 - DNA, 12 bp, Homo sapiens
ctgcgccctccc

SEQ ID NO: 466731 - DNA, 13 bp, Homo sapiens
ctgcgccctccct

SEQ ID NO: 466732 - DNA, 14 bp, Homo sapiens
ctgcgccctccctc

SEQ ID NO: 466733 - DNA, 15 bp, Homo sapiens
ctgcgccctccctcc

SEQ ID NO: 466734 - DNA, 21 bp, Homo sapiens
ctgcgccctccctccctccac

SEQ ID NO: 466735 - DNA, 13 bp, Homo sapiens
ctgcgcctgcccg

SEQ ID NO: 466736 - DNA, 19 bp, Homo sapiens
ctgcgctcctctgcagcct

SEQ ID NO: 466737 - DNA, 20 bp, Homo sapiens
ctgcgctcctctgcagcctg

SEQ ID NO: 466738 - DNA, 21 bp, Homo sapiens
ctgcgctcctctgcagcctga

SEQ ID NO: 466739 - DNA, 18 bp, Homo sapiens
ctgctatgtctgtgatgt

SEQ ID NO: 466740 - DNA, 17 bp, Homo sapiens
ctgctccaacagacacc

SEQ ID NO: 466741 - DNA, 18 bp, Homo sapiens
ctgctccaacagacaccc

SEQ ID NO: 466742 - DNA, 20 bp, Homo sapiens
ctgctccaacagacaccctc

SEQ ID NO: 466743 - DNA, 21 bp, Homo sapiens
ctgctccaacagacaccctcc

SEQ ID NO: 466744 - DNA, 13 bp, Homo sapiens
ctgctcctttggg

SEQ ID NO: 466745 - DNA, 13 bp, Homo sapiens
ctgctcgggaagg

SEQ ID NO: 466746 - DNA, 17 bp, Homo sapiens
ctgctcgggaaggcctg

SEQ ID NO: 466747 - DNA, 15 bp, Homo sapiens
ctgctctattgtagc

SEQ ID NO: 466748 - DNA, 19 bp, Homo sapiens
ctgctgctcgggaaggcct

SEQ ID NO: 466749 - DNA, 23 bp, Homo sapiens
ctgctgctcgggaaggcctgagg

SEQ ID NO: 466750 - DNA, 13 bp, Homo sapiens
ctgctggctgcct

SEQ ID NO: 466751 - DNA, 14 bp, Homo sapiens
ctgctgtgaatttt

SEQ ID NO: 466752 - DNA, 22 bp, Homo sapiens
ctgctgtggtgttcccttggca

SEQ ID NO: 466753 - DNA, 14 bp, Homo sapiens
ctgctgttttatgt

SEQ ID NO: 466754 - DNA, 16 bp, Homo sapiens
ctgctgttttatgtca

SEQ ID NO: 466755 - DNA, 24 bp, Homo sapiens
ctgctgttttatgtcatactctgt

SEQ ID NO: 466756 - DNA, 16 bp, Homo sapiens
ctgcttagtgtccctt

SEQ ID NO: 466757 - DNA, 19 bp, Homo sapiens
ctgcttggatccatacaaa

SEQ ID NO: 466758 - DNA, 21 bp, Homo sapiens
ctggactggtggcccctgcct

SEQ ID NO: 466759 - DNA, 15 bp, Homo sapiens
ctggcacagggcagt

SEQ ID NO: 466760 - DNA, 19 bp, Homo sapiens
ctggcagccgtgccttcag

SEQ ID NO: 466761 - DNA, 20 bp, Homo sapiens
ctggcagccgtgccttcagc

SEQ ID NO: 466762 - DNA, 14 bp, Homo sapiens
ctggcagcgcctcc

SEQ ID NO: 466763 - DNA, 15 bp, Homo sapiens
ctggcagcgcctccc

SEQ ID NO: 466764 - DNA, 16 bp, Homo sapiens
ctggccagacgctgcc

SEQ ID NO: 466765 - DNA, 14 bp, Homo sapiens
ctggccagcaccct

SEQ ID NO: 466766 - DNA, 20 bp, Homo sapiens
ctggccagcaccctctcctg

SEQ ID NO: 466767 - DNA, 16 bp, Homo sapiens
ctggcccacccctctt

SEQ ID NO: 466768 - DNA, 12 bp, Homo sapiens
ctggccccaggc

SEQ ID NO: 466769 - DNA, 13 bp, Homo sapiens
ctggccctgccct

SEQ ID NO: 466770 - DNA, 15 bp, Homo sapiens
ctggcctatttaagc

SEQ ID NO: 466771 - DNA, 16 bp, Homo sapiens
ctggcctatttaagcc

SEQ ID NO: 466772 - DNA, 17 bp, Homo sapiens
ctggcctatttaagccc

SEQ ID NO: 466773 - DNA, 14 bp, Homo sapiens
ctggcgggcagccc

SEQ ID NO: 466774 - DNA, 15 bp, Homo sapiens
ctggcgggcagcccc

SEQ ID NO: 466775 - DNA, 20 bp, Homo sapiens
ctggctacgacttgggacgg

SEQ ID NO: 466776 - DNA, 22 bp, Homo sapiens
ctggctcccacaggcccttcct

SEQ ID NO: 466777 - DNA, 14 bp, Homo sapiens
ctggctgccttaga

SEQ ID NO: 466778 - DNA, 18 bp, Homo sapiens
ctggctgggtcgcccctc

SEQ ID NO: 466779 - DNA, 20 bp, Homo sapiens
ctggctgggtcgcccctcct

SEQ ID NO: 466780 - DNA, 15 bp, Homo sapiens
ctggctgtggcccct

SEQ ID NO: 466781 - DNA, 17 bp, Homo sapiens
ctggctgtggcccctcc

SEQ ID NO: 466782 - DNA, 22 bp, Homo sapiens
ctggctgtggcccctccttctc

SEQ ID NO: 466783 - DNA, 19 bp, Homo sapiens
ctggcttagcgttctgttt

SEQ ID NO: 466784 - DNA, 16 bp, Homo sapiens
ctggcttttcactgct

SEQ ID NO: 466785 - DNA, 20 bp, Homo sapiens
ctggcttttcactgctggct

SEQ ID NO: 466786 - DNA, 19 bp, Homo sapiens
ctgggatgggaccagggat

SEQ ID NO: 466787 - DNA, 22 bp, Homo sapiens
ctgggcagggccgcagggcgct

SEQ ID NO: 466788 - DNA, 12 bp, Homo sapiens
ctgggcccagcc

SEQ ID NO: 466789 - DNA, 14 bp, Homo sapiens
ctgggcccctccac

SEQ ID NO: 466790 - DNA, 15 bp, Homo sapiens
ctgggcccctccacg

SEQ ID NO: 466791 - DNA, 16 bp, Homo sapiens
ctgggcccctccacgc

SEQ ID NO: 466792 - DNA, 20 bp, Homo sapiens
ctgggcccctccacgcctcc

SEQ ID NO: 466793 - DNA, 21 bp, Homo sapiens
ctgggcccctccacgcctcct

SEQ ID NO: 466794 - DNA, 12 bp, Homo sapiens
ctgggcccctgg

SEQ ID NO: 466795 - DNA, 20 bp, Homo sapiens
ctgggcctcagttcaacctg

SEQ ID NO: 466796 - DNA, 12 bp, Homo sapiens
ctgggcctcccg

SEQ ID NO: 466797 - DNA, 22 bp, Homo sapiens
ctgggcctcccgtccgtccgcc

SEQ ID NO: 466798 - DNA, 13 bp, Homo sapiens
ctggggccctggg

SEQ ID NO: 466799 - DNA, 16 bp, Homo sapiens
ctggggccctgggcct

SEQ ID NO: 466800 - DNA, 23 bp, Homo sapiens
ctggggcctggcctatttaagcc

SEQ ID NO: 466801 - DNA, 14 bp, Homo sapiens
ctgggggtggcagg

SEQ ID NO: 466802 - DNA, 16 bp, Homo sapiens
ctggggtctctgagca

SEQ ID NO: 466803 - DNA, 17 bp, Homo sapiens
ctggggtctctgagcag

SEQ ID NO: 466804 - DNA, 18 bp, Homo sapiens
ctggggtctctgagcagt

SEQ ID NO: 466805 - DNA, 23 bp, Homo sapiens
ctggggtctctgagcagtgggga

SEQ ID NO: 466806 - DNA, 22 bp, Homo sapiens
ctgggtttgggcagtggagagg

SEQ ID NO: 466807 - DNA, 23 bp, Homo sapiens
ctgggtttgggcagtggagaggg

SEQ ID NO: 466808 - DNA, 15 bp, Homo sapiens
ctgggttttagaaat

SEQ ID NO: 466809 - DNA, 18 bp, Homo sapiens
ctggtcagtgaagcccag

SEQ ID NO: 466810 - DNA, 16 bp, Homo sapiens
ctggtctggagcccct

SEQ ID NO: 466811 - DNA, 18 bp, Homo sapiens
ctggtctggagcccctat

SEQ ID NO: 466812 - DNA, 14 bp, Homo sapiens
ctggtgcatttaaa

SEQ ID NO: 466813 - DNA, 22 bp, Homo sapiens
ctggtgcatttaaaatggactt

SEQ ID NO: 466814 - DNA, 21 bp, Homo sapiens
ctggtgcgctgtgctccagca

SEQ ID NO: 466815 - DNA, 15 bp, Homo sapiens
ctggtgcgtgtggcc

SEQ ID NO: 466816 - DNA, 16 bp, Homo sapiens
ctggtgcgtgtggccc

SEQ ID NO: 466817 - DNA, 12 bp, Homo sapiens
ctggtgctgcca

SEQ ID NO: 466818 - DNA, 18 bp, Homo sapiens
ctggtgtctagtttgcat

SEQ ID NO: 466819 - DNA, 17 bp, Homo sapiens
ctggttatagttgatat

SEQ ID NO: 466820 - DNA, 23 bp, Homo sapiens
ggttccagacagggtggggctta

SEQ ID NO: 466821 - DNA, 13 bp, Homo sapiens
ggttctagaaggg

SEQ ID NO: 466822 - DNA, 14 bp, Homo sapiens
ggttggaggcctgg

SEQ ID NO: 466823 - DNA, 14 bp, Homo sapiens
ggttgggttccaga

SEQ ID NO: 466824 - DNA, 15 bp, Homo sapiens
ggtttcagaaagggc

SEQ ID NO: 466825 - DNA, 14 bp, Homo sapiens
ggtttgggcagtgg

SEQ ID NO: 466826 - DNA, 17 bp, Homo sapiens
ggttttgttaggggtgg

SEQ ID NO: 466827 - DNA, 21 bp, Homo sapiens
ggtttttatttctcgggtgca

SEQ ID NO: 466828 - DNA, 16 bp, Homo sapiens
gtaaaattcatagcat

SEQ ID NO: 466829 - DNA, 18 bp, Homo sapiens
gtaaacatcataaatagt

SEQ ID NO: 466830 - DNA, 23 bp, Homo sapiens
gtaaacatcataaatagtaaata

SEQ ID NO: 466831 - DNA, 22 bp, Homo sapiens
gtaaataaactcttcaaggcca

SEQ ID NO: 466832 - DNA, 23 bp, Homo sapiens
gtaaataaactcttcaaggccaa

SEQ ID NO: 466833 - DNA, 20 bp, Homo sapiens
gtaaataatgattcaatgtg

SEQ ID NO: 466834 - DNA, 12 bp, Homo sapiens
gtaaatttaact

SEQ ID NO: 466835 - DNA, 17 bp, Homo sapiens
gtaaccaggccccagcc

SEQ ID NO: 466836 - DNA, 20 bp, Homo sapiens
gtaaccaggccccagcctcc

SEQ ID NO: 466837 - DNA, 14 bp, Homo sapiens
gtaactattcttca

SEQ ID NO: 466838 - DNA, 20 bp, Homo sapiens
gtaactgttaacccagtgtt

SEQ ID NO: 466839 - DNA, 13 bp, Homo sapiens
gtaagaagaaact

SEQ ID NO: 466840 - DNA, 15 bp, Homo sapiens
gtaaggtttcaatgc

SEQ ID NO: 466841 - DNA, 16 bp, Homo sapiens
gtaaggtttcaatgca

SEQ ID NO: 466842 - DNA, 19 bp, Homo sapiens
gtaagttgaagggaaatca

SEQ ID NO: 466843 - DNA, 22 bp, Homo sapiens
gtaagttgaagggaaatcaatt

SEQ ID NO: 466844 - DNA, 18 bp, Homo sapiens
gtaataactgttagaatt

SEQ ID NO: 466845 - DNA, 16 bp, Homo sapiens
gtaatagcctcacctt

SEQ ID NO: 466846 - DNA, 20 bp, Homo sapiens
gtaatcacactctcttctta

SEQ ID NO: 466847 - DNA, 20 bp, Homo sapiens
gtaatcatttatcttatcta

SEQ ID NO: 466848 - DNA, 24 bp, Homo sapiens
gtaatcatttatcttatctagcaa

SEQ ID NO: 466849 - DNA, 17 bp, Homo sapiens
gtaatggatatgaaaga

SEQ ID NO: 466850 - DNA, 22 bp, Homo sapiens
gtaatttgttatatcagcagac

SEQ ID NO: 466851 - DNA, 20 bp, Homo sapiens
gtaattttatgagctgtgag

SEQ ID NO: 466852 - DNA, 21 bp, Homo sapiens
gtaccagagcctatggaaagg

SEQ ID NO: 466853 - DNA, 22 bp, Homo sapiens
gtaccagagcctatggaaaggg

SEQ ID NO: 466854 - DNA, 14 bp, Homo sapiens
gtacctttccaccc

SEQ ID NO: 466855 - DNA, 15 bp, Homo sapiens
gtacctttccaccca

SEQ ID NO: 466856 - DNA, 21 bp, Homo sapiens
gtacctttccacccagaccct

SEQ ID NO: 466857 - DNA, 19 bp, Homo sapiens
gtacttacactgaaatcca

SEQ ID NO: 466858 - DNA, 21 bp, Homo sapiens
gtacttcttcatccatagaca

SEQ ID NO: 466859 - DNA, 19 bp, Homo sapiens
gtacttgctcaataaaggt

SEQ ID NO: 466860 - DNA, 20 bp, Homo sapiens
gtagaaattttatctcttct

SEQ ID NO: 466861 - DNA, 22 bp, Homo sapiens
gtagaaattttatctcttcttc

SEQ ID NO: 466862 - DNA, 11 bp, Homo sapiens
gtagagaggac

SEQ ID NO: 466863 - DNA, 16 bp, Homo sapiens
gtagcatataaatgtt

SEQ ID NO: 466864 - DNA, 21 bp, Homo sapiens
gtagctagaatatcctatact

SEQ ID NO: 466865 - DNA, 13 bp, Homo sapiens
gtaggctgtattt

SEQ ID NO: 466866 - DNA, 21 bp, Homo sapiens
gtagggaagaaaactatcctg

SEQ ID NO: 466867 - DNA, 20 bp, Homo sapiens
gtataacaagccaaacattc

SEQ ID NO: 466868 - DNA, 13 bp, Homo sapiens
gtatataagcttt

SEQ ID NO: 466869 - DNA, 14 bp, Homo sapiens
gtatatcagctcta

SEQ ID NO: 466870 - DNA, 20 bp, Homo sapiens
gtatatcagctctaaagcag

SEQ ID NO: 466871 - DNA, 17 bp, Homo sapiens
gtatctaaaaaataact

SEQ ID NO: 466872 - DNA, 21 bp, Homo sapiens
gtatctgctgcctctgaaaat

SEQ ID NO: 466873 - DNA, 18 bp, Homo sapiens
gtatgaataaagacacct

SEQ ID NO: 466874 - DNA, 19 bp, Homo sapiens
gtatgctggccagcaccct

SEQ ID NO: 466875 - DNA, 20 bp, Homo sapiens
gtatgctggccagcaccctc

SEQ ID NO: 466876 - DNA, 21 bp, Homo sapiens
gtatgtccagaacaaaagata

SEQ ID NO: 466877 - DNA, 23 bp, Homo sapiens
gtattgacgacctacatctgaaa

SEQ ID NO: 466878 - DNA, 23 bp, Homo sapiens
gtattgacttctttttggcatta

SEQ ID NO: 466879 - DNA, 23 bp, Homo sapiens
gtattttaataaagattccatgg

SEQ ID NO: 466880 - DNA, 22 bp, Homo sapiens
gtattttcttttatatctgtaa

SEQ ID NO: 466881 - DNA, 21 bp, Homo sapiens
gtcaacaagtatgaataaaga

SEQ ID NO: 466882 - DNA, 18 bp, Homo sapiens
gtcaatgtgaaataaaga

SEQ ID NO: 466883 - DNA, 16 bp, Homo sapiens
gttgggttccagacag

SEQ ID NO: 466884 - DNA, 20 bp, Homo sapiens
gttgttcgatcgtttcacat

SEQ ID NO: 466885 - DNA, 14 bp, Homo sapiens
gtttaaaaaaataa

SEQ ID NO: 466886 - DNA, 14 bp, Homo sapiens
gtttaccctccctg

SEQ ID NO: 466887 - DNA, 17 bp, Homo sapiens
gtttaccctccctgtcc

SEQ ID NO: 466888 - DNA, 13 bp, Homo sapiens
gtttacctcactg

SEQ ID NO: 466889 - DNA, 17 bp, Homo sapiens
gtttacctcactggtgc

SEQ ID NO: 466890 - DNA, 18 bp, Homo sapiens
gtttacctcactggtgca

SEQ ID NO: 466891 - DNA, 13 bp, Homo sapiens
gtttactctgtgc

SEQ ID NO: 466892 - DNA, 21 bp, Homo sapiens
gtttattatagtctgtacttc

SEQ ID NO: 466893 - DNA, 21 bp, Homo sapiens
gtttcagaaagggcagcccct

SEQ ID NO: 466894 - DNA, 23 bp, Homo sapiens
gtttcagaaagggcagcccctcc

SEQ ID NO: 466895 - DNA, 20 bp, Homo sapiens
gtttctatactgtttgtaat

SEQ ID NO: 466896 - DNA, 21 bp, Homo sapiens
gtttctatactgtttgtaata

SEQ ID NO: 466897 - DNA, 22 bp, Homo sapiens
gtttctatactgtttgtaatat

SEQ ID NO: 466898 - DNA, 15 bp, Homo sapiens
gtttctatggattca

SEQ ID NO: 466899 - DNA, 15 bp, Homo sapiens
gtttctgcagtattc

SEQ ID NO: 466900 - DNA, 13 bp, Homo sapiens
gtttgcaagaacc

SEQ ID NO: 466901 - DNA, 17 bp, Homo sapiens
gtttggcaacctttgtg

SEQ ID NO: 466902 - DNA, 15 bp, Homo sapiens
gtttgtaatatacag

SEQ ID NO: 466903 - DNA, 16 bp, Homo sapiens
gttttaaaaaagcatt

SEQ ID NO: 466904 - DNA, 22 bp, Homo sapiens
gttttagaaattctataagaga

SEQ ID NO: 466905 - DNA, 17 bp, Homo sapiens
gttttatgtcatactct

SEQ ID NO: 466906 - DNA, 14 bp, Homo sapiens
gttttcaaaatact

SEQ ID NO: 466907 - DNA, 22 bp, Homo sapiens
gtttttaaaaaaaatattctgt

SEQ ID NO: 466908 - DNA, 17 bp, Homo sapiens
gtttttgctctacttta

SEQ ID NO: 466909 - DNA, 17 bp, Homo sapiens
gtttttgtgctgtgggc

SEQ ID NO: 466910 - DNA, 17 bp, Homo sapiens
taaaaaaaatattctgt

SEQ ID NO: 466911 - DNA, 15 bp, Homo sapiens
taaaaaaataacatc

SEQ ID NO: 466912 - DNA, 13 bp, Homo sapiens
taaaaaagcatta

SEQ ID NO: 466913 - DNA, 13 bp, Homo sapiens
taaaaaataacat

SEQ ID NO: 466914 - DNA, 14 bp, Homo sapiens
taaaaaataacata

SEQ ID NO: 466915 - DNA, 22 bp, Homo sapiens
taaaaaataacatattcttgct

SEQ ID NO: 466916 - DNA, 14 bp, Homo sapiens
taaaaaataactgt

SEQ ID NO: 466917 - DNA, 15 bp, Homo sapiens
taaaaaataactgtg
